United States Patent 7,630,836 (POLYNUCLEOTIDES) - sequence listing, part 5

SEQ ID NO: 1 - DNA, 9025608 bp, Streptomyces avermitilis (residues 7,220,489-9,025,608 of 9,025,608)
  misc_feature (4187715): a, t, c, g, other or unknown
tcggcgaagccgcgcacaccggccagcacccagggcgtggtgacgatcccgaccccgaggggcaccaggagaagggaaacgacggccagtacgtagaggacgagggcgccggggagcccgaccacggccagcacgagggccctcgtcccgtcgcgtacgacgccccgcgccctcgtcgccatgccgctgccgccgctgctgatctccatgtccccagtctcaccgagcggccgcccagggtcactgggccgggcacccgggcggggggtggggtcaggtgcacccctggcgtcccccgccgccgacgctcacaccccgagcaccttcgcctccacctcggggtcgaggcccacggggggccggtcgggccgcccgggggcgacgccgccgatgtcctggagccaggcccaggtgtcggccaccgtttcggcgaccggccggcagcgcagcccgtcccgcagcgcccgggacacatcggcactgtgcagagcggcgtgcccctcgctcttcggcggcgcccacaccggcaactgcgtccacggctcgatccccgcatcgaggatcacctcggggtcggtccacctgagctcggccgcaccgcccgtcacccgcacgcacgcgtcgagcagttcgcccgtcgtcgtgtgcccctgcgggctgatgaggttgtacgccccgttcagtccgcgctccgccgcccccagagtccactcggcgaggtcgcgcacatcgacgtactggagcggaagctcccgcggcccgggcgcgaggaccggcccgccgcgggccgtccgggtgagccaccacggcagccggccgatgttctcgtacggcccgaggatcagcccggaccgcacgagcagtgaacgctccgcgccgaacgcgtcgagcgtggccagctccccgccccgcttgtcgcgcgcgtagtcggtctgctccgcgtccgcggacgcgtccgccacgaggggtgcctcttccgtgtatccggcggccggcggccacgcgtacacggagcagctcgacacatacacataacgccgggccgcgccggccagcagtcgcgcggtgtcccgcacggcccgcggcgcagccgaccaggtgtcgacgacgacgtcccactcctgtgcgccccccgccacggcctcggcgagcgcggcgagcccgtccggtgcggtgcggtcaccgatcaacgaccgcacaccgggcgggggttggtgccgtccccggtggaagacggtcacctcccagccccgcccgagagccgcctcgaccatggcgcgtcccacgaactcggtaccacccagcatcagaagtctcatgccgaccactctgcccgcgggaccggcggggcggaacggaaatctgctgacagaagatccgccgcgtggtgcgggagcggctcagcgacccgtcggcggcgtgtacttgtagccgacccgccgcaccgtctggatcgtctgccggtgatcggccccgagcttgcgccgcagccgggcgatgtggacgtccacggtccgcccgtcgcccacatgcccgtatccccacaccgtggtgaccagctggtcgcgggtgtgcacccggtgcggatgcgcgacgagatgcgcgagcagctcgaactccaggtaggtgaggtcgagcggctgtccgtcgacctcggcggtgcgctgcacggtgtcgacgcggatcagcgggccgtcgccggcggtgaggtcgctcgcctcgggctggtccggcacggcgaccggcagcacggtctgctggtcggccgggacgagcaccagatagccgatcatcggcggctggcccggcagcgtgggcagggtgtgctggggcgcgggcagccaggtggcgcccggcggcaggaagtcggcgacgtccaccacctcgtcccggtcgacggcacgcagtcggtgccgtgccgagcccggggacggtgcgggggaggggacggtcgcgacggacgagaaggaacgggtgttcgccatgagaggtcagctctttcgcgcgaggagttcgtcgggaaggccgacgaccgcgagttcgtggtcggggtcgtcgaggacgtacgtcgtgcgcgctggccgaaggccggaggtgtacggctttaaagggccggcgcgttcatcgcgcgacaacacacccggtcgaagtcgtggtgctgacgggaaggccagaagggctcgaggtcgtggcgacctgtcgcggtgtacttctggaagctggccatactcccattgaagcagacaccgggcccgggcaggagactcctctcactgcttggacgcttccttggtgtgaagttgacgttgcgcacctcaaccgaccagccgtctttgccaggtcagcggcgtgagggagatcgccttgtccggggaggcgtcccactgtgcggacagccccgccgcggtgagcgcggccacgacctcgtgtcccacggccaccgtggtctgctcggctccgtcgaacccgccgtagtagagcgtgagtccgtacccgtcggcggcgtgctccgtgacctgctggtggaagaagacgaagccccgggcgtcctcgcgctccgcgcctatctccgccatgccgcagccccggcagcacgcgaagttctcccgggccgtgatcccgctcgcctccagcgccgcgaaggcgagggcgagccgctcggggtcggtgacgccctcccaggtctcctgctcggccagccgctccagccacagccggtccaccaaccgccgggcctgggccttcgacaccggccggtcgcccccgtcgacgaggtactcctcggcgatctcggccagcaccttccggtcgtcgtagccgcagcgcagccgggtccgcacgcggtcctcgaccttgccccgcacgtcgtccgcaagctcgggcacctcttcctgcggcccgaggtcgaccggctcccaggtgacgcccgcgtcccaggccgcctcctgccgcgcccagccggtcaggaggtccgccacccgatccgggtccgtgaggtccgtaccgaagaacgcgtcctcggtgagccggtgctccagccggtagtcgccgccctcctcgtgccacacctgggcgaacacatccgggatgtccggtatccgctgcaccaccagccagcggtcgccggccgtgccgatccgccccaccagctcccgcagccgctccgccgaaatgcgcgcgtgccgctgccagttctccgtctcgaccttgatggcgagggcgccgtcgatctccatgtccccaccatggcacgcgccactgacaacgcgagggggcgcccaccgcgacggtggacgccccctcccggagccggtgtgcggatcagacctggccggccttctccagggcggagcagcaggtgtcgacgagcagacgcgtcacgacgtacgggtcgacgttggcgttcggacggcggtcctcgatgtagcccttgccgtccttctcgacctgccacgggatacggaccgaggcgccacggttcgagacgccgtacgagtactcgttccacggggcggtctcgtgcaggcccgtcaggcggtcgtcgatgcccgcgccgtagttcttgacgtggtcgagcggcttggagccctcgcccagcgactcgcacgcggtgatgatcgcgtcgtagccctcgcgcatcgccttcgtggagaagttggtgtgcgcgcccgcgccgttccagtcgcccttcaccggcttcgggtccagcgtcgcggagacgccgaagtcctcggcggtgcggtagagcagccagcgggccacccacagctggtcggagacctcgagcggcgccagcgggccgacctggaactcccactggccgggcatgacctcggcgttgatgccggagatgcccagacccgccttgaggcagttctccaggtgcgcctcgacgacgtcacggccgaagatctcgtccgagccgacaccgcagtagtagccgccctgcgcggccgggaagccgccctcggggaagcccagcgggcgcgagcccttgaagaaggtgtactcctgctcgatgccgaagatcggctcctgggcgccgaacttctcctcgacctcggccagcgtggcacgcgtgttggactcgtgcggcgtcatgtcgatgttcaggacctcgcacatgacgaggacgtcgtcgccgccgcggatcgggtccgggtaggtggcgaccggcttgagtacgcggtcggaggcgtgcccctcggcctggttcgtggaggacccgtcgaagccccagatcggcagctcggcacccttggcatcgtccgccaggatcttcgtcttcgaacggagcttggccgtcggctcggtgccgtcgatccagatgtactcagccttgaaggtcacgggccacatccttcggggtgtgtctgtaggcgcactgcgggtgctgcggcgctgcggctggggcgccgcgggagatgccggaagcctgtcaacaggcgatttcccgaccattgcccgaatgtgaaccccgtgttacctggggcctctgtgctgcggctcacccgctgagagggcccgcggcggtgttcgcacccgctatcgcgtcccggtggcccggaccgtgttccgtccgctcccgggggagacgactcgtatgcgatgggtttgcgcgaggcggacgtcacccggcgccgaacgccgcggtccacacccccgtgcgggagccggccgcggtgcgggggattacgtgccccccggagtccggcgcgctccgcgcactcggcacgaaggtcccgctgctcccggccggaagcagcaggacttccctcgagttctcggcttccctcaagctctcggcttcgctcgagcaaggggaccccccgtcacccaccgggtggtcgcccgcgccgccgggccggtgccgcgtacggcaccggcccggctcgatcaccggccgacggacttcctcagccgatgactccgatggcgtccggggtcaccccaccttctcgatgacagcccggcggatcaggaacttgccaggctcccggacctgctcgaaggccgcgttgttgagcagggcgcagctgccggagaccgaagtgacctccacggtcgtggacttgttgttgtccaggttcgtgaccttcagcttcgtgccggccgggaactggttgctggacgcggccggagcgccgccctcgccggagagcgtgacggtcgagcccttgcagacctgctccccggaggccgcgttgccgccggcgttctccgcgggcgcggtggccgaggcgttgtccgcgggcgcggtggcggcctgcgagggctgcgtggcttgggagtcctgagccgaccccccggccgcagccgatccgtcggccgcctgagccgactctccgacctcgcagccggacgcttcctgctggcgcttgatctcggcgatgacggcctcgcggttggcgatccgcgcctccgactgcgcgtccggtttggcgcgctgcccgtcgatgaacttctggttgttgccgatcgcggtggccagaccctggcagaccgtcgagttcgaggcgttctgcaccgacgccgcgttcgacgtggcggccagggcgaaggccccgcctccggccaccgcagcggcgctgagcagaagcgcgagcttcttcttggtgctgagagttctcctgcgcgacatccgcgcctcctgagcggtaggggagcgtacgccgctatgtacgagatgccgaacgaggttactcagtggtttacaggagtcagcgacgtaacgtacgtcacagggatggtgcggagggccttccgctaccgggacaaggcatcccgtaccgcctcctccgtgcgtgccacgagcgcggtgccgtcgtccgcggtgatgatcggccgctgaatgagcttggggtgctcggcgagcgcccgcacccactggtccctcgaaccggcgtcccgggcccactccttcacgccgagctccttggcgacggcttcctcggtccgcgtgatgtcccagggctcgagtccgagccgctggagcacgccgcggatctcgtcctcgctcggcacgtcctccaggtagcgccgcacggtgtactcggcgtcctccgcgtcgagcaggctgagggcgctgcggcacttcgaacaggcgggattgatccagatctccatgcccacacggtaaccgccgtacccccttgcgcctgcgccacaacccaccccaaagcccgtgtggccagcggcttttgtcagtgccgagcggtagaatagaagcagtgttcgagggtgccgccggaggttccggacggtcccctgaccgcgacaggaggatgcctgtgcccgctgccgcactgaagccgaagccgacccagtccacatccaggaggccggtcccgctggacctcccgtaccagcccgtggaaaagcgcccgctgccgccggggcgcccccgcgagtggtacatgacccacaaccgccgcctcaaggcgatgcgcctcgccatcgccctgctcgactccggggtgtacgtcccgaaccaggcgcgcaacgagacgatccgcagcacggcggagaccatcggcgtccacccgccgtcggacacgacgtgccacatggtccgcgcgctgatcaggtacagccgctgaggtcccgcgccgagcgctgagatcccgcgccgggcaccgcgtcttcgacggggtgcccggcgcgggcgtcgtgggagaagggggccgcgccggccccgtcgcccgcccgcctcacgacaactcccgctccagcggggtccggaagcgcggcgtgccccgcgtccgccccagccacgctcccacccgtgccgccttcgcctcgatcgccgccaggacacggtgtgcgcactctcgtggctccggcccgcgccgaagctagccgtaccgccgcaacagcccgcccacataagcctccagccgcgcgcccagtacctcgcgcgtcaggtcggtgcggcccagctcgtgccagggggccgcgagcttctcggcgtcgggggagtacgccagcgtgtccagcagccgccagtacaagtggtccgccccgtccgccagtcgccggccgccgtgggcctcgtaccgctcccggaaccccagcccgtacgcctccccgtgcagcagcgcgagcgccgtcgaacagtgggcgacgtccaggtcggcgggcccccacgaggtctcgacccagtcgacgaccccgctgatccgcagcgtgtcgcccgcaccgtcgaacagcacgttcccggggtggaagtcccggtgcaggaagcacccttcgtacgcgggcggttcgcgcctgagcaccgccacggcccggtcccacagggcgcccccgggggtgcggacccgctcgggcgacgtccacgcctggtaggggcgtggccgttcgtccggtacgacggtgtggatccggacgagttgccgcgcgagcaggtcgaggcgccggtccagatcctcctcgtcgacccgtaccgcgccgggcagcagggacatcagcagcgaagggtggtcgcagtgttcgccggtcgcgtcgacggcgacggcctcgggcacgggggtgccgtcctgcgcggcgagcagggcgaggacggacgcctcgcgggagagcagtccgggcgcgtggcgccggaagaagggccgcacgaaggtgcgcagcaccaggccggtgccgtcgtcgagagtgagacggcgtatctgcgaactccagccgccccgcagccgcgccgagtcccgtacgcgcctgcccgccgggagctgcttcgccacccaggcccgggtcgccgtccatcccccctcgccccgcccggtgagcacggcgtccacgaacctccgccggtcgtcctcgtggtcgcggaaccacaggcccagcgtgtgctccgcgtcgggcagttcgaccaggctgaactgggcgttcgtggcgagcgcggccgtcaccgccgcggtcacggcgggcgggatcacggtgtcggtaccgggcaccgcgagcacggcccggcccccgtacgcccgcaggacgtcgagcgcgggagactcccgccagctgtccgccgcacggatgatctcgctgaaccgtccgtcgcccgcaccgaacggaaccggccatgccgcggccgcgtacacggcgggtgcgcacaggcccagggccgccacccgctccccgtagtgcgcggcgagatccgccaccgtctgcccgctcatgctgaacccgacgaggaccagcggaccgtccccgggaacccgcgcgtcgatcaccgcgaccgcctgcgcgaagcgtctgcgcaggctcgactcggccagcgcgccggtgctttggccgtgcccggagaagtcgaacgcgaggccccggcagccgcgcgcgacgaattccgcgagcagggggagcaggcgccccgcgcacccgtcgcccgcgccgtgcagcagcacgacggtgggcgattcccggccaccctctacgcccccggcgtcgtccccgtcgtcgtcaccgccgtacatgccgctgagtcgttcgccgtcgtgttcgtacgcgaaggagaggagctcgctcatgcccccattcattcacgaccctgccgtcgcccggtcgttcaggaggaggacgtaccgccgaaaagcaggtgcgtgctctacggctccgtccctacgctgggcacgcgtaccggagctgcccagcacctctttccgccggacaggcatcaccaggcggactcggggctactctctacgcaccgacggccggacgcctcccccagcgccccgtcgagacaacgagcaccacccacacccacgcccacggaggcccgtcatgggcaccatcgtcattgccgggactgtcgtcctggtcctcctaggattcggtaaccacgcctggtggctcgccgcggccgtcctgctcttcctgtacctgcagtacgggcggggctcgtcctcggcgtcacccacgtccggcgccggaggctcctcgtcggggtccgcccgccccgacaccagctaccgcgcgtaccgcgaacgccgtgaccagcaggccaagtgggagcgccgctaccgccgcgagcgtcccctcgaggcccgccgtcaggaacgtaagaactagtactggtccggtcacaggccgggcgcgccccagatcgggaaccagcgggtcaggtcctgctcgatccgcagatcgtcggcgagcgcggccttgacctggagttccagcgcgttgtcgcgccgccggccggcaccggccagcggcgcgaagggatagaacgtgccgcgcttgtagaggtagacgagcccgagccgccgcagcccgccgtcccggcccgttgccgcggaccggaatccggcgacggagcagagcagctgcggcccgaagccgctgccctccagcgcgctgttgaccgcgtgcagatcgctcaccagcgccggcaggtcgtcgggcgtccgccgggagacgagccaggagtagccgtactcgtcccggctgagctcgacgggtggtccgcccccgagctcccggccctgctcgggcaggggggagttccgtcgctcggagtccgcgtcgagcagggcccgcacctcctggtgcgcctcggcgaaggccgcgccctcgacggtcgagaagcacaccgcgcccgtacccgtgggggtgaacccggccgcggcctccagggtcacggccgccgacggcagcccgaacagccggtcgaggtcgggcgccaccggcttggtacggccgagcaggatgtccaggaaccccatcggtgctcagcgcgccttcccgggcgtcgccgcctcgcccaactcggcggagatacggccgagttgttcgagccgctgctccaggctcggatgtgtggagaagaggcgctcgaggcccggcgtggtgccgagggcgggcgtgaagtagaaggcgttgaaggcctgcgccgaccgcaggtccttcgtcgggatgcgggcgatgtcaccggtgaccttggtcagcgcggacgccagtgccgagggacgcccggtcagcagggcggcggcccggtcggcggccagctcgcggtagcgggacagggcccggatgagcaagaagctgagcgcgtacacggccgcggacaccgccagcaccgccatgaagatcacaacggtgttctggtccttccgtccccgtacgccgaagaactgcgagtagaacgcgaaccgcacgatcagaccggcgatgaccccgaggaaggacgcgacggtgatcacggcgacgtccttgtgcgccacgtgcgacagctcgtgagcgaggacgccctccagctcgtcgggctccagtcgtcgcagtagcccggtggtcacgcacagcaccgcgtgatcggcgttccgcccggtcgcgaacgcgttcggcatctccaggtcggagacggcgacgagcgggttgggcatgtcggccaccgcggacagccggtcgacgaccccgtgcagctgggggtactcctcgcgctccacgatccgcccgcgcatcgcgtacagcgcgatccggtcggagaaccagtactgcgcccccaggaacgccgccgcgatcaccacgaccagcacccaggacttcagcaggacgatcagcgcggcgacgaacgccaggtacagcagtccgaggagaaagagtgtgactgtcatccgcgcggtcagtcgccgatcgctctggaaccggctctgcatctgcatcaccccgcactaaggcacccgtcccgctgtccagtgtgcacctgcggatgcccatgaagcggttccgatcagccctaggaggtgcaaaggccaccggtgagatcggcaccccatttcgtccaagatgctgagtggtcgaagggcggctagcctttaatggcggttggcccttcataaggcgaatagaccttatgaacggaccagcccgaaatgaacagagccgcaatccgggggtacaccggctgtcggcgagatccccatccaccgggggccgacagcccaatgtcatggacgcgtcggcggcttacgtgtcctcgcactcaggcgacaccgcgccggactttccgctgcggcccggccatctgccatccgtctcgtgcctcggaaagaccgcacgggagggtggaaggaggattcacccatgaaggcacaacgcgcgaggcgtctcttcgcggtatctgccgtcggcgttctgatggccgggggcgccgcgatcggcgcagcaggtacggcctcggcagccgctccggcccaagcccccacccaagtcaccacccatggctgttccaactggggtggccgtggcttcgtgagcaactgtggcttcggcttcaacaacggcttcaacaacggcttcggcttcaacaacggcttcggcaacggcttcggtggtggagtcgtggtcattctggtgtcctgacggagcacggcagagggccgccacctgaagtgttcccaggtggcggccctcagcgttgcgcctgcttttcagacgtcggatttcagacgtcggatttcagacgtcgaatttttagacgtcgaagtagagctcgaactcgtgcgggtgcgggcgcagctggagcggggcgatctcgttcgtgcgcttgtagtcgatccacgtctcgatcaggtcgggcgtgaagacgttgccctggagcaggtactcgtggtcggcctcgagggcgctgagcacggccgggagcgaggtcgggacctgcgcgacgctcgcgtgctcctcgggggccagctcgtagaggtccttgtcgatcggctcggccggctcgaccttgttcttgatgccgtcgaggcccgcgagcagcagcgccgagaaggcgaggtacgggttgccggaggagtccggggcgcggaactcgacgcgcttggccttcgggttcgagccggtgatcgggatacgcatcgcggccgagcggttgcgctgcgagtagaccatgttgaccggggcctcgaagcccgggaccagacggtggtacgagttcaccgtcgggttggtgaaggccagcagcgacggggcgtgcttgaggatgccgccgatgtagtagcgggcggtgtccgagaggcccgcgtaaccggcctcgtcgtagaacagcgggtcgccattggcccacagcgactggtggacgtgcatgcccgagccgttgtcaccgaagatcggcttcggcatgaaggtcgcggtcttgccgttgcgccaggcgacgttcttcacgatgtacttgaagagctggaggtcgtcggccgcggcgagcagcgtgttgaacttgtagttgatctcggcctggccggcggtgcccacctcgtggtgctggcgctcgacctggaggccggagttggccagctccagggagatctcggcacgcaggtcggcgaagtggtcgaccggcggggtcgggaagtaaccgcccttgtagcggaccttgtagccgcggttgtcctcgatcgcaccggtgttccaggcgccggcctcggagtcgatgtggtagaaggactcgttctccgcggtcttgaagcgcacgctgtcgaagacgtagaactcggcctcggggccgaagtacgcggtgtcggcgatgccggtcgacgcgaggtaggcctcggccttcttcgccacgttgcgcgggtcacgggagtactgctcgcccgtgatcgggtcgtggatgaagaagttgatgttgaccgtcttgtcgcggcggaaggggtcgacgcgcgcggtggacaggtcggcgcggagcgccatgtcggactcgtggatggcctggaagccgcggatcgaggagccgtcgaaggccagctcctcggccgggtcgaaggcctccgccggaatcgtgaagtgctgcatcacgcccggcaggtcgcagaaccggacgtcgacgaacttgacgtcctcgtccgcgatgtacttcttggcctcgtcggcgttctggaacatccagctcctcctactcccgaccatgtccgaccggggtggtagttcgttcgtgcggccagtgcggtggcacacgctggacccgaccatagggacgggggatttctcaagcatgacccatttgtttcgccgaagttaaccggctcgggttcaacagcagcctacgcacaccccgccatccctggcgcatatgagggcgcagtaccgtggacgggtggacaacaggcaagtaatcggatcgtggctctccggcccccgcgaggccgcggaacaagccggggccgacttcggctaccggggcgaacagctcggtctgccggaggaggggccgggttcgatcgcccgcccgggccgccgcttcggcgccctcgccgtcgactggggcctgtgcctcttgatcgcatacggcctgctcacccacggctacaaccagacgaccggcaactgggcgctgctcgtcttcctcgggctcggcttcctgacggtcggcacggtgggcttcaccccgggcaagcgcctgttcggtctgcgggtggtcgccgagggcacgggccgcgtgaacccgctccgcgccgtcgtgcgcacggtcctgctgtgcctcgcgatcccggccctgatctgggaccgcgacggccggggcctgcacgaccggctggcccgcacggtcgaggtcagaatctgaccgttccggtacgacgacggccgttccggtatgacgacggccgttccgcgtatggcgacggctgttccgcgtacgacgacgcccgctccacgtacgacgaaggatctccgtagcacgaatgatctccgtacgacgaagggggcgcccggatttctccgggcgcccccttcgtcgtacgagctcatgtgcgagggaggtcagcgggccttcggcccaccgcgcggcatgcgcatccccttcggcatcggacccttcggcaacggcatgttgctcatcaggtcgcccagcgcgcgcagccggtcgttggtcgcggtgacctgcgggccggtcaggacgcgcgggaacttcagcagggtcgtacggagcttcttcagctccacctggccctcgccggtgcccacgagcacatcgtgcaccgggacgtccgccacgatccgcgccatcttcttcttctcggcggccagcaggctcttcacccggttcgggttgccctcggccaccaggacgacgcccgccttgccgaccgcccggtgcaccacgtcctggctgcggttcatcgccaccgccggagtcgtcgtccacccccggccgatgttgtcgagcacggccgcggccgcgccgggctggccctccatctgcccgaaggcggcgcgctcggccctgcgtccgaagacgatcgccgacgcgaggaaggcgagcaggaggccgagaatgccgagatagtacgggtggccgatcaagaagccgatcgcgaggaagacaccgaaggtgatgattccgacagccgcgagtacaagaccgatctttgagtcggccttgcgggtcatcttgtaagtgagagcgatctgcttgagtcgccccgggttcgcagcgtccgctgcgggttccttcctcgccatgccacgaagtctacgtggcccggcaagcgccgacgacggcagcaccggcgaagcggcggctacggacgcgtcgacaccgcttccagcacgcgctgcgcctcgacccggtccttggcacggcggcggtcctcctggaccgacgtccaggcattgcgacgggcggtgcgctggccgccgctcatgagcagcgactcgacggcacggagtgcatcggtgaacgacggaatggcggtggcgcgtacgggcgcggcctgcatgatggaggtcccccctcgggatggcggcgctggctggggctctacgtggcgtaagagcagggtcactgattggtgttaccagggcgtgaccgaccggtcaaacacccatgaagccttgatgcgcggcccatggacgccgacgcggtcccggcaccgtccccatctgcggggacggccgggaccgcgtcgaatgcgccattaccggaggtagatgcttgtgcgcagattcacacgctcttgtggcaccgagtgccacagcggggtgtgcccggcgtctcagaccgcctgcgaggcgacctgcgcaccgccctgcggagcggctgactgacgcagctccatggccatctggtacaggcggccggcccggtacgaggagcggaccagcgggcccgacatgacaccggagaagccgatctcctcggcctcctccttgagttccacgaactcgtgcggcttgacccagcgctccacggggtggtggcgcacggaggggcgcaggtactgcgtgatcgtgatgagctcgcagcccgcgtcgtgcagctgccggagcgcctcgctgacctcttcgcgggtctcacccatgccgaggatgaggttcgacttcgtgaccagaccgtagtcccgggcctccgtgatgaccttcagggagcgctcgtagcggaagccggggcggatgcgcttgaagatccgcgggaccgtctcgacgttgtgcgcgaagacctcggggcgcgcggagaagacctcggccagctggtcgggctcggcgttgaagtcgggggcgagcagctcgaccttggtgcggccggcctcgcggcccgccgtctgcgcgtggatctggcggaccgtctccgcgtacagccaggcgccgccgtcctcgaggtcgtcgcgggcgacgcccgtgatcgtggcgtagttcaggtccatcgtgacgacggactcaccgacgcggcgcggctcgtcgcggtcgagggcctcgggcttgccggtgtcgatctggcagaagtcgcagcgccgggtgcactggtcgccgccgatgaggaaggtggcctcgcggtcttcccagcactcgtagatgttgggacagcccgcctcctggcagaccgtgtgcagcccctcgctcttcacgaggttctgcatcttcgtgtattcgggacccattttcgcccgggtcttgatccactcgggcttgcgctcgatgggggtctgggcgttccggacctccaggcgcagcatcttgcgtccgtcgggtgcgactgcggacacatcggctccctgtagcttcgattcttcggcgtacaccagggtacgcccgtgcggttcctggtccccggggtgggcaaccttggggaacgcgggtgcattcccccggggtcaggccgaggcccgttccacctcgcgcggcttcaggtccgcgttctccagtacgtcccgcaggtgcttctccgcgaccggcaggacctcgccgatggtgacctcgcggcccagctcgtacgcgagggacgtcacgcccgcgtcgcggatcccgcacgggatgatcttgtcgaaggaggacgtgtccggattcacgttcagggcgaaaccgtgcatggtgacgcccttggcgacgcggatgcccatggcgcagatcttgcggtcctcgcggcgctggccggcgttggagggggcgtactcggggccgttgaggcgggggtcgaactcgtcgtcggccaggcgggggtcgaagtcgagggagaggccgccgaggctggggcgctgctccaccgggtcgccgaggacccagacgcccgcccggccctccacgcggctggtggccacgccgaactccgcgcagacgcggatcatgacctcttcgaggcggcggaggtgggcgacgacgtcgaccgggcgcggcagtttctggatcggatacccgacgagctggcccgggccgtgccaggtgatcttgccgccgcggtccacgtcgacgacgggggtgccgtcgaggggccgctcgttgtccgccgtacgccggcccgccgtgtagaccggcgggtgctccaggagcagacaggtgtcggggacctcgtccaggaaacgggcggcatgcacacggcgctgctcgtcccaggccgcctggtactcgacggcctcggcaccgaatcccatgtggacgaaccgcaactcactcacggcaagcgcctccctagaagccctcagaacccttgtaaggcacgtaacgcgcccacgccactgtacgtccggccgatgtccgtcagcccgacggtcaatcctcacacgatcggatgaatggacgccgaagcgtgcgatcacgtgcttaccctccgctacattcgcgccgtcaccccaggccataagggctgttcgcaggcgatccgggcacgcggcaaggtcgctgcgcggatcgaaaggcaggagaccgcaccgcagatgacggaacgacccgcgcagcgcacccccaaccgacagctcgccgcgctcatcgcagaagcggggttctccaacgcaggtctcgcccgtcgcgtggaccagctcggcctcgaacacggcctggacctcagatacgacaagacctcggtgacgaggtggctgcgcgggcagcagccccggggcaccacccccgcactcatcgccgaggtgttcacccgccgcctcggccgccggctcaccgcccaggacctgggcctcgacgcgtgcgcccccgtctacgcgggcctggagttcgccgcgacgcccgaagaggccatcgacatcgtcggcgggctgtggcgcaaggactccggcagccacgccgagctgcgcaagatcgcgttcaccccggccgggctcgtcgtgcccagccgggactggctgatcggccgcgccgacgaccgggtcggccgcggcgatccgcccgccgcccgggtgcccgcgcagggccggcccgcggtgccccgccagcgcagccagaccgagcgcggccccggccagaaggtcaccggcggcgacatcgccgcgctgcgctcggtgggcgagctgttccgggcgctcgaccacgcgtacggcggcggccacgcccgccaggccctggtccgctatctggagcacgaggccgagccgatgctgcgcggcacgtacggcgagcagaccgggcgccgcctgttcgccgccgcctccgacctcacccggctcgccggctggacctcgtacgacatcggcgcgcacgggctcgcccagcggtacttcgtccaggcgttgcggctgtcccaggcggccggggaccgggcgtacggctcgtacgtcctggtcaccatgagccgccaggccgtctacctcgggcacggccgggaggccgtccagctcgcacgggtggcccagcagggggtcggggcgtcggcgccgcccgtggtgcaggcgctgctgcactccgtggaggcgcgcgggcacggggtgctgggggaggtacgggcctgcacggcgtccctggtgcgtgccgagcggtcgctggaggcggcccgccccggcgacgaagtcccttactgggcacggttcttcgacgaggcgcagctcgccgacgagttcgcgcactgccaccgggacctccagcagttccgggccgcggcacagcacgcggagcgctcgctgcaactgcgtgcgccggggtacgcccgcagccggctcttctgccgcgtcgtgctcgccacggcccggctcgggctcggagagctggaccaggcctgcctgctgggcgcggaggcggccgggcaggcggcggagatgcggtcggtacgggccatcgagtacgtccgcgacttcgagcgccgcctggagccgtaccgggacgcggcgcccgtacgcgggtaccgggaccgggtgacggcgttgcagtagccggtcgggggcgtctccgtggccggccagggagttgcggtggccggccagggagttgcggtggccgggcggggcgttgcggtggccggctggggcggacggggggcgcccggtgggggacgggcgcccccgtccgctcaggccgccgtctcgagcggctcctccagtgaggtctggcctgcccccacatccgtgagcagggcgtgggcggcgcggcggccggagcggagcgcgccctggaccgtgctggtgtcgcggtggtcgccgcagatgtacaggcccgcgagcaggcgtacggggcggcgcggatcgtgcggcgggggcatcgccgggaccgcctcggagtcgtggtggatcgcgaggagctcccagcgggcggtcgacgtccggtagagccgggccagttgggcccggaccgccgcctccagccggtccggcggcgggggcgtaccgaggaccgtcgaggagacgagcgcgcggccggccggggccctgctcgggtcgacccggctgatgaccgcggtgtgcgccaccgggccgccgcgctcggcgtcgaggacgagggccgggtcgccgagcggcggctcgtcggtcgtgtggtgcaggaccgtcaccgggtggaagccggggacgcgcaggcccgggagcagccgggcggcggcccgggcgccggtggccagcagaacggcccgacagcggagttcgccgtggtccttcgtcgtgacggaggtggtggagaccgccgtgacgcgcacacccgtgtggacggtgcccggcgggagcgtggccgcgagcagctccggaagaacgtcggcgccgccctccgggacacacagccggcccgtcacgaaggcacgcagggccaggtcggcgcagcggctggaggtctccagggccgggtcgcacaggagtgcggcgagcagggggcgcagaaagccgtcgatcgtgcggggcggaaggccgagggccgacagggcccgggcggccgggagttcggggcgggacagcagccggtcgggcggggtggcggcgagccgggcgagtgcgccggccagccgggactggccgacgggactgcccagcaggcccgggcgggaggcaccttgggtgcggggggcgcgcggtgtgcgctgctgtcggggggcgcttgcgagggcgcgcgcagcggtgagtgcgccccttgcgctccggggtgtgccgggctccccgacgcggtggaggtggccgtcgctgtggaccagcacgccgggggagaactcccgcaggggcagggcgtccaggccgggggtgctgcggagttccggatacgcggtggagagcaactggcccatgcggtccagccggaagccgtccaccttctccgtcgacatgcggccgccgacgttcggcgcggcctccaggacggcggtggtgaggcctgccctggtcagatggtgggcggcggcgagtcccgccgccccggctcccacgatgacgacgtccgcgggttgtacatccgcggtgtacgcacttgcttggtgcaccgactcaagcacgtggcccctcctcgaggtcgcgcggctgctgggaacgtcatgcccccaacaggcttctggaatacccgagttcggcatgagggtaggtgggcgccgccgggtcgggggagtggcgcgggagcctcgcacggaggcacggggtgtcacggcgtgcgcctgcggccggccgcccgtcgagggcgtgtcgtggtgggacgcggtccgcttccgcgacgccctgtccgaacgggcgggaccgacccccgcgtatcgcccgcacaccgatgccgaagacaccgagagtgccgaccgggacgtcatggaccggatcgacgacgtggggttcggtgtcgcggtcccggccggcccagggcctgcccgccggacgggccctgggttccgtcagcgcagcgccgagcggagggtctcctcgatgccagggaacgcgaaggcgaagcccgattccagcagacgggccggcagcacccgctggctgcccaggatgtcgcccgccatgtcgccgagcgccgcgcggagcaccggcgccggggccgtgaagagcgtcgggcggtgcaggacccggcccatcgccgccgtgatctccgcgttggtcagcggcgtcggcgccgtcaggttcaccggccccgacaaggacgccgtatcgatgacatggcggatcgccgcgacctcgtcgtgcagggagatgtagctccagtactgacggccgtcgcccatacggccgccgagacccgccttgaagagcggaaacagcctgccccacgcaccgcccccggcggccaccaccaggccggtccgggtgaacaccgtacggacgccggcctcctgggccggctcggccgcctcctcccactccacgcacagggcgggcaggaagccgtcaccgggcggcgccgtctcgtccaccgcccggtcgcccgtgtcgccgtagaagccgatcgcactgccgctgacgaagaccgccggcggctcgtcgagcgaggcgatcgcctcggccagcgtcgcggtgcccagcacccggctggagcggatcgtctgcttgtacgcgtccgtccaccgccgcgaggcgacgcccgccccggccagattgaccaccgcggcacaccccacgagcccggccgagtcgatccgctgttccccgggatcccagcggacctcgttcttcccgcgcggcgcccgccgtacgagccgtacgacctcgtggccgtccgccgtgagcgagcgcgccagagccgaaccgatcagcccggacgcaccggcgatcgcgacgcgggaaccgggaggaagcggcgcatcggagttcatgggtccatcctgccgggtgagcggggaaatcgccgggacggccaccgttcggccgccgtacagtgatcctcatgccggatccgcacatacgcttcgcgacccacgacgacgaggacgggctcgcccggctggaccgagtcacctggtccacgctgcacgccgtccagccccgcccgcaaccgccgtacgaccccttctacagcgaccggttcggcccccgcgaccacctcgtggccgagctgggcggacgcctggccggctacatccggctggggtacccgacccccctcgccgccaactcccacgtccggcagatccaggggctcgtcgtcgccgaggaggcacgcggggcgggcgtcggccgggcactcctgcgggccgtccaggagcacgccgcgcggcagggcgcacgccgcatctcgctgcgcgtgctcgggcacaacacccccgccaggaagctctacgagtcggaggggttcgaggtggaggggatcctgccggaggagttcctgctggacgggcagtacgtggacgacgtcctcatggggcgtgctctgcgacccgcggtcccgcgctcatgaggtgaccaggtcgcccgtgcccaccggatccgtcgcggccgccgcgcgccgcgcgtcgtcgctcacctcgtccgccgtcagcacataccccgtctcgttgtccgaggtggagcgcgcgaacacgacgccgtacacccggccgtccgtggtcagcagcggtccgcccgagttgccggggcggaccgtggagcggatcgagtagatctcgcgggtgacggtgtccgagttgtagatgttctggccggtcgcgttgatccggcccgcgaccgtggccgcctggaggtcgaggccgccgtcctgcggataaccggccacgaccgccgagccgccccgcgccgcgctgtcgtcgaagcgcagcaccggcgccttcagctccgggacgtacagcaccgccacgtccttgttcgggtcgaagagcaccacgcgggcctcgtacgcccgcccgaccccgcccacgcggacggtcggctcgtcgatgcccgccaccacatgggcgttcgtcatcacgtgctgccccgcgtacacgaagccgctgccctcgcggccctggctgcccgcgatgccctcgaccttcacggtggacagcttcgcggcgttcgtcgcggccggcgtgacgctgtccccggagggcttggcgacacccgtcgtcggctcgttctcgaacgggttgaagacctgcgggaagccggcctgcgtgagcgccgacgtcgcgcgcgagaaccaggtgggggtggtgtccggcatcgtgttctgcaccgcgcccagcagcgccgaattgcggatcgacgtcgtgatcatgctcgtcgaggaggcgcccaggacgctcgccgccacccaggcgaccagcagcacggcgaccgtgttcgcggcggccccgcccactccgtcggccacccgcagcggcccgcggtccagctcgcggcgcagccgcagcgcgagcctgcccgccagctcgtgcccgaccacggcgggcgcgaggaccgtcagcacggccgtcagcgtcgccgccgacgtgcccggtgtcaccagcttcatcacccacggcaggatccatacgccgacgacggcgccgcccacgaaaccggccagcgagacacacccggcgaccagcccgcgccggtagccggacgccgcgtaggccaggatcaccagcaacagcaggaagtcgagcaggtccacggggccgcctttctcttgggccccttagtacgcgcagggcgggcccagtgatcaggcacgcacacgcggagcccgccgaaccggtcacgcatgcgtggacctgtaaaaacgtcccggaccagggcaatggttccgccgggtggcacagcgcacatcgcggcgggccgggaccggcgccagggtgagggcatgcgtgtgttgcgaggtgcgcggcgggtcctgggccgggtacgcgttccggtacgaattccacaggtgccaggaccgggtggcgcgcgccgttcgccgtggctgcggcgcacggccctcgtcgcgctggcctgtgggcccggtctcgccgccgtcctggcgctggtgctgtgcgcggcaggtgtcgaccgcacggtggccgcgcacccggcgcccgtcgtcggccgccccgcgccggcgcacaccaccgcccggccgcccatcgtgccccgctcccgctggatcgacgaccgcacgcacaagcagccgccgccgcgctacgacgacaaggtcgtcgcggtcttcgtgcaccacaccgactcgcccaacacctacgactgcgccgacgcaccccgcatcatccgctccctgtacgcgggccagatcggcccccggcagtgggacgacctcggctacaacttcgtcgtcgaccgctgcggcacgatctacgagggccgcgcgggcggcgtcgaccgggccgtcaccggcgcccacgcccagggcttcaaccaccgcaccgcggggatcgcggcgctcggcaccttcaccgagggcacgccggtaccgcgggcggtgaccgacgccatcgccgcgctcgccgcctggaaactcggcctcgcggacgtcgacccgcgctcccgcgtccgcctcgtctccaccagcggccagagccggtacgccgccggcaccatcgccacactgcctgtcctgtccggccacaacgacggcttcccgacgacctgccccggcgcggccctcaccgcccacctcccggcactccggcaggcggccgcgcggctccagggccggacctagctcacaggtacgccacaggcggcgcgaagcgttctcagatcccggcctcctacggtcttcgcagaagccgaccggaggtggggatcatgagcagcagccgtacacgcaccacggagcaggcgggcggatggaccaaggccgcgcgcagcccgtggacggtggtctgcgcggtggcgacggtcgtcctcggcccgggcgcggtcaccgcgtccgccctcgaccaggccaacgccgcgcccttgcaccacgccgtccgggccgaccatgcccaggcgtacatccccgcggacctcagccggcgccgagcggcctgacccgcggggcgttccgccgggccggagcgcggggtcagcccttgaagcgctcccacagccggggatagcgctcggcgagctccgactcgttctccaggttcatcggggttccggcgggctcgggcgccgccggcggaatgcccaggtcgggagcgacgacgccggtgagctgctcgtacgcctcgtccgccgcgtaccccagctcctcgccgtcgccgtccagctcctcgtcgaactcgtccaggagctcggcgagggagtccgggtcgtgcacggcgccctcgaacacctcccggccctgaccgatcagccagcagcggaagaagtcgaaggcgtcgtcgctggctccgtcgagcagtacccaggcggcgccccagaggtcccaccggtaggcgcggttgtagcgggactcgaagtggcgggcgaagtcgagcaccgagtccgggtccatccggacgagccgttccacgagcaggtcggcgtggtcctcggggtcgccgtcggcggcctcgcgggtcgtgtccaccagctcccagaactccgtctcgtccatcacggctcaagcatcggtcctggaggggagggacgcacgcggagtgccgcagatcgccgggcgtgaccatgccgatggcggacgtgcccccctcgcgggcggcgccgctaccggtacagctccgcctgccgggccgcgtcccccgcgaaccgttcccgcaaggtcaccggagacagcacctccgcctcggcgcccagggcggtcaactggctgtgggccacctcctccgactccacggggagcgtgacggtcacccagccccgctcgtcgggctcgccgcacgtctgccgggccaggcgcacggacgccggatcaagggcggacggcagtctccgcagccccagggccgacagccgcaccaccacctccgcccgcaggagggaccgcgcgaaccgctcggcctgttcctcccagaagccgggcaggtcgaagtcctcgtcccgcccgaaacgctccccgtcggcggcgaccgccgtgaaccggtcgatccggtacacccggaaggaccccggctccggcacgcgtgcgcataggtaccagacccccgccttcagcacgagcccgtacggctccagctcccgctccacaccggtgtccccgtgccggtagcgcgcggtgatccggcggtcgtcccacaccgcctgggccaccgcgggcagcagctcgggcgtatcgggctccttgaaccagccgggcgcgtccacatggaaccgctgcgccgccgtccgcgaggcgtcccgcagggacggaagaagcgcggcggacaccttcagccgggccgcggaggccgcgtcctcgaggcccatctcccgcagcgcccccggcacccccgagaggaacagcgcctcggcctcgctccgggccagccccgtcagccgcgtccggtacccgccgaccagccggtagcccccggcccgcccccggtccgcgtacaccggcaccccggcctcggacagcgcctgcgcgtcccgcgtgaccgtccgctcggacacctccagctcccgcgccagctcggcgccggtcatggtgggccgggactggagcaacagcaccattttgatcagccgggcagcgcgcatacgttcatgatgccgggccccaccgacagcgaaggggtacggcggtcgccgtaccccttcaccgaacgaacgtcaggaactgaaggccctacaggccgtagcgctcccgcgcctccttcaccgccgtggccttgacctcgccgcgcctggcgagctgggccagggccgcgacgacgatcgactccgcgtccacgccgaagtgacggcgggccgcgtcacgggtgtcggagaggccgaagccgtccgcaccgagcgacgagtagtcctgctcgacccactgcgcgatctggtccgggacctgacgcatgtagtcggagaccgcgagcaccgggccctcggcgccgtgcagcgcctggcggacgaacggcacccgctcctcgccgcgcagcagcgccgcgtcggcctcgagcgcgtcgcgccgcagctcggtccaggaggtcgcggaccacacgtcggcggccacaccccactcctcggcgagcagccgctgcgcctgaagcacccagtggatcgccgtgccggagcccagcagctggatgcgcggggcgttggcggcgggggacaggtccgccgactcggccgtgttgaagcggtacaggcccttgacgatgccctcgtcgatgccgaggccggccggcttcgcgggctgcggcaccggctcgttgtagacggtgaggtagtagaagacgttcgggtcctcgcccggggccgcctcgccgtacatacggcgcagaccgtccttgacgatgaccgcgatctcgtacgcgaacgccgggtcgtacgtcagcgccgccgggttggtcgcggcgatgaccggcgagtggccgtccgcgtgctggaggccctcacccgtcagcgtcgtacggccggccgtcgcgccgaccaggaagccgcggcccagctggtcgccgagctgccacatctggtcggccgtgcgctgccagccgaacatcgagtagaagatgtagaaggggatcatcgcttcgccgtgcgtggagtacgcggtggacgcggcgatgaagtccgccatggagccggcctcggtgatcccctcgttgaggatctggccgtccttggcctccttgtagtacatcagctggtcgcggtcgaccggctcgtacgtctggcccttcggcgaatagatgccgagggacgggaagagcgactccataccgaaggtacgggcctcgtccggcacgatcggcacccagcgccggccggtctgcttgtcgcggaccaggtccttgaccagccggacgaacgccatcgtcgtcgccacgttctgcgagccggagcccttgtcgaaggacgcgaacgtcttgtcggcgggggccggcagcggggccagcgggtgcgtacggcgggccggggccgggccgccgagggccgcgcggcgctcctgaaggtagcggacctcgggggagtcggcgcccgggtggccgtagggcaccacgccgtcgacgaactggctgtcggagatgggcagttccagcaggtcacgcatctgcttgaactcgtccgtcgacagcttcttcatctggtggttggcgttcttcgacgcgaagccctcgccgagggtgtggcccttgaccgtctgggccaggatcaccgtcggcgcgcccttgtgggacacggccgccctgtaggccgcgtagaccttgcgcgactcgtgaccaccgcgggagaggtggaaacactcgaggatcttgtcgtcgccgatcagcttcgccatctcgacgagggccgggtcggcgccgaagaagtcctggcggatgtaggcggcgtcgcgggtctggtacgtctgcacctgcgcgtccggtacctcgcgcaggcggcgtacgagggcgcccgtggtgtcgagctggaacagctcgtcccaggccgagccccacagcgtcttgacgacgttccagccggcaccgcggaactgggcctccagctcctgcacgatcttgaagttggcgcggaccgggccgtcgaggcgctggaggttgcagttgatgacgaaggtcaggttgtccaggccctcgcgggaggccagggcgagtgccgcggtcgactcgggctcgtccatctcgccgtcgccgaggaacgcccacacgtgggactgcgagacgtccttgatgccgcggctggtcaggtagcggttgaagcgcgcctggtagatcgcggagagcgggccgaggcccatcgacaccgtcgggaactcccacagccaggggagacggcgcgggtgcgggtacgacggcagaccgttgccgccggactcctggcggaagtggtcgaggtggtgctcggtcagccggccgtcgaggaaggcgcgggcgtagatgcccggggaggcgtggccctggatgtagagctggtcaccggaaccgtccgcctccttgcccctgaagaagtggttgaagccggtctcgtacagccaggcggcggaggcgaaggtggcgatgtggccgcccacgccgtatttgctgccccgggtgaccatcgcggccgcgttccagcggttccacgcggtgatccggtgctccatctcctcgtcgccgtccacgacgggctcggcggaggtggggatggtgttgacgtagtccgtctcgagcagcttcggcagcgcgatgccgttgccctcggcgcgctccagtgtgcggcgcatcaagtacgcggcacggtgcggcccggccgcctgggtgacggcgtccagggaggcctgccactcggcggtctcctcggggtcgcggtccgggagctggtcgagctcgctcggctggattgcggtggggtcggtcattgcgccgccttccggatgcggagggtgggtgccctcgtcggtaaggggttggggtgcccttggtctttggcaggacagggcggcgggctctggtgaaagcccgtcggtgactttaaccccctgatcgatgatcgatcaaagggttgaggggcaaaacctcttgattacgagaaagtaggcacggggtgcctccggggcgggcaccgggtgccttggaatcgaagggtttccgcaggtgagcgcatacgcgctcagagtgccacggcggcggggcggcggggtgtccggctccgagtcgcgggccgtgaggtcacgcggggtcacgtggggtcacggggggttgcgcggggtcacgctcgcggagcgcacccgagcacatgcgccttcacgagttccgcgatcagcgggtcccggcgccggaaggcgtcgacgagggcctcgtgctcctccgcgtacgactgctgcaccgtccccagccagcggatggacagggccgtgaagacctcgatgcccaggccctcccaggtgtggagcaggacggagttccccgccgcccgcaccagttcccggtggaaggccacggtgtgccgcacctgggcggtcccgtcggcgtgccggtccgcctcgtacagcgccgcgacgtgcggttcgagggccgagcagtcctcggccagccgcccggccgccagctccgccgcgatggcctccagaccggctcgtacggggtagctctcctcgaggtccgcggcggtcaggttgcgcacccgtacgcccttgttgggcgccgactcgatcagccgcagcgactccagctcgcgcagcgcctcccgtacgggggtctggctgacctccagctccgtcgcgatccgccgctcgacgatccgctcgcccggcttccagcgcccgctgacgatcccctccacgatgtgctcgcggatctgttcgcgcagcgagtggacgacgggcgcggtcatgaaggctccttcggacggggactcggcggccccctagggcgtttgacgtttagacaataaggccggacccggccgcgggaagggcgcgcgggggcgctttcatgcaggtgagacgagacttacacgctcccggcaggtgtccctcggtacggacccggtgcggacccatgacaacgcccctgcccggaaagctccggacaggggcgtcgctaccagccgtacaggcgatacgggttacaggccgagctcgacctcgaactcgcccgcctccaggatcgccttgaccgcggtcaggtaacgggccgcgtcggcgccgtccaccagacggtggtcgtaggagagcgtcaggtacgtcatgtcgcggacgccgatgaccgtaccctcctccgtctcgatgacggccgggcgcttgaccgtggcaccgatgccgaggatcgcgacctggttcggcggcacgatgatcgtgtcgaagagcgcgccgcgcgagccggtgttggagatggtgaaggtcgcgccggacagctcgtccggggtgatcttgttcgcccggaccttgcccgccaggtcggcggtggccttggcgataccggcgatgttgaggtcgcccgcgtgcttgatgaccggggtcatcaggcccttctcggagtccaccgcgataccgatgttctcggtgtcgaagtaggtgatcgtgccctcgtccacgttgatccgggcgttgacggccgggtgggccttcagcgcctgggccgccgccttcacgaagaacggcatcggggagagcttgacgccctcgcgggccgcgaaggagtccttcgcctgcgcgcggagcttcatcaggcgggtgatgtccacctcgacgaccgaggagagctgggcctgctcgtgcagggccttcaccatgttgtcgccgatgaccttgcggatgcggggcatcttgacggtctggccgcggaggggggagacctccagggccggggccttcttcgcggcggccggagcggcggcgggcgccggagcggcggccttcgcggcctcggcggcggcggtgacgtcctgcttgcggatgcggccgccgacgccggtgcccttgacggtggccaggtcgacgccgttctcggcggcgagcttgcgcaccagcggggtcacgtaggcgccgtcgtcaccggaggtcgcggcgggcgccgcggccggggtgacgggggccggcgccggggcggccggggcctgcggagcggccggggccggagcggcctgagccggggcggcgggcgccgcgggggcggcctgagccggggccggggcggccggagccggagccggagcggccggagccggggcagccggggcgggagccggggcggccggggcggcggcgggcgcgggcgcggcctgcgccggggcggccgccggagcggcaccgggcgcaccgatgacggcgagcttcgcgccgacctcggccgtctcgtcctcgccgaccacgatctcgagcagcacggccggaggcgggcgccgggatctcggtgtcgaccttgtccgtggagacctcgagcagcggctcgtcctccgagacctcctcgccgacctccttcagccagcgggtgacggtgccctcggtgaccgacttcgcccagcgcgggcaggacgacgtcggtgccctcggcgctgccggcgccggcggcggcctcggcggtcggggccggcgcgggggcggcctgctcggtggacggggtggcctgcggcgccggctcgggagccggcggggcgacctgctcggcggcctgctcggcggccggggccggggcggcggcgggcgcgcccgtgccgtcgtcgatgacggccagctcggcgccgacctcgaccgtctcgtcctcggcgaccttgatggacgcgagcacgccggcggcgggggaggggatctcggtgtcgaccttgtcggtcgacacctcgagcagcggctcgtcggcctcgacgcgttcaccctcggccttcagccagcgggtgacagtgccctcggtgacgctctcgccgagcgccggaagggttacggaaaccggcatggtttctgttgctccttacaaatggtgcggaagtctgtggtcgtcgtcgcgcccaactgtgacgcggtgactgggtacagccggtggctgaaggtcagccggcgactgatcagtcgtgcgagtgcagcggcttgcccgcgagggccaggtgggcctcgcccatcgcttcgttctgcgtcgggtgggcgtggatgagctgggcgacctcggccggcagcgcctcccagttgtagatcagctgggcttcgccgacctgctcgcccatacggtcaccgaccatgtggacgccgaccacggcaccgtccttcacctggacgagcttgatctcgcccgcggtgttgaggatcttgctcttgccgttgcccgccaggttgtacttcagagcgacgaccttgtccgcgccgtagatctccttggccttggcctcggtgatgcccacggaggcgacctcggggtggcagtacgtcacccgcggcacgccgtcgtagtcgatcgggacggtcttcagaccggccagacgctccgccaccaggatgccctcggcgaagccgacgtgcgcgagctggagcgtcgggaccaggtcaccgacggcggagatggtcgggacgttcgtccgcatgtactcgtcgaccaggacgtagccgcggtccatggcgacgccctgctcctcgtagccgaggccctgcgagaccgggccgcggccgacggcgacgagcaggacctcggcctcgaactccttgccgtcggcgagggtgaccttgacaccgttctgggtgtactcggccttcgagaagaaggtgcccaggttgaacttgatgccgcgcttgcggaacgcgcgctcaagaagcttggaggagttctcgtcctcgaccgggacgaggtgcttgaggccctcgatcaccgtcacgtcggctccgaaggacttccacgcggaggcgaactcgacgccgatgacgccgccgccgagcacgatcgcggactccgggacgcggtccaggaccagcgcgtggtcggaggagatgatgcggttgccgtcgatcgccaggcccggcagcgacttcggcacggagccggtcgccaggagcacgtggcggccctggacgcgctggccgttcacgtcgacggaggtcggggaggacagacggccctcaccctcgatgtacgtcaccttgcgggaggcgatcagcccctgcagacccttgtacaggcccgagatgaccccgtccttgtacttgtggacggccggtacgtcgatgccctcgaaggtggccttgacgccgaactgctcgctctcgcgggcctggtcggcgatctcgcccgcgtgcagcagcgccttggtggggatgcacccacggtgcaggcaggtaccgccgaccttgtccttctcgatcagggcgacgtccaggcccagctgcgctccgcgcagggccgcggcgtaaccaccgctaccaccgccgaggatcactaggtcgaaaacggtgctggcgtcgttcgccacgtcacgtcctccatgcatgtgcgccacgccggtcgtcagtgaccggtcggcggctggtgtccggccgctcttcttcggccctgtggtgggggccctgtcctgccgagaacccatcttcgcacttgtcgggggcgggcgagacgccgggccggtgtgtgagacgtcccactcgtccgccgcgagagacgatccgtcggacagaacgaccccgggtggcggtcacccggggtcgttgcccgacccgccggacagccccagggactgtccggcggttcaggcgccgttgcctgtcacggcactagcccaggtcgcccgcggccgtcagctccgcgaggcggaccagcgtgcggaccgccgtgcccgtgccgcccttcggggtgtagccgaagggggccgcctcgttgaaggccgggcccgcgatgtcgaggtgcgcccaggtgatgccctcgcccacgaactcgcgcaggaacaggccggcgaccaggccgccgcccatccgctcgcccatgttggcgatgtcggccgtgggggagtccatgcccttgcgcaggtgctcgggcagcggcatcggccaggagtcctcgccgacctcctcggcggcctcgacgaccgcggtgcggaaggcgtcgtcgttcgccatgacgccgaagaggcggttgccgagcgccagcatcatcgcgccggtcagggtcgccacgtcgacgatcgcgtccggcttctcctcggacgcggcccacagcgcgtcggcgaggaccagccggccctcggcgtccgtgttgagcacctcgacggtcttgccgctgtacatgcgcagcacgtcgccggggcgggtcgcggtacccgacggcatgttctcggccagcgcgagccagccggtgacgttgacctccaggcccaggcgggcggcggccacgaccgcggcgaagaccgccgccgcgccgctcatgtcgcacttcatcgtctcgttgtggccggccggcttgagcgagatgccgcccgagtcgtacgtgatgcccttgccgacgaaggcgaggtgcttcttcgccttggacgaggtgtacgacagcttcaccagccggggaccggcggccgagccggcgccgacgccgaggatgccgccgtagccgcccttcgtcagggccttctcgtcgagcacctgcaccttgatgccgtgctccttggccgcggcctgcgcgacggcggcgaacgactccgggttcaggtcgttcggcggggtgttgatcaggtcgcgggcacggttgagctcctccgtgacggcgacggcgcgctcgacggccgccttgaacgccttgtcgcggggcttgccgccgagcaggacgacctcggcgagcggggccttgccgttcttggcgttcctgccgttctccttgtaggcgtcgaaggagtacgcgccgaggagcgcgccctcgccgatcgtgccggcgtcggcggcgtccgcgaccggcagcgcgaaggcggccttcttggcaccggcgagcgcgcgggccgcggcaccggcggcgcggcgcagtgcttcggcgtcgaacgccgtgcccttgtcctggccgtcctcgggcgcggcgcccagaccgaccgccaccacgacgggcgccttgaagccggacggtgcaggcagcttggtcacctcgccctcggcccccgaggcgccgagggtctccaggacggcggcgagcttgccgtcgtaccccttgtccacggcctcggcgcccggtgcgacgacgagtcccttgtcgcccttcgggctcttcgccacaccgaccacgatcgcgtcggcgcgcaggccggacgctgcggcggtgctgagagtgagagcagtcacggtggtgaaatctcgcttccattgagtttcagtggccgaacggatggggtcgaccggcccgacgacagaccctagggcccgccgtccgaacggcgtctgccgggccctgagcggagtacgggggcggcccggaccgggcccgaggtatgccgaggacgagcctacgcgcgggtgcgggtttcgctcattcccacgggtgttcacttcgctgtggcggccgtggccactcccgccggccactgcgggtgacccgagccgtggtcaaggacaacccctccactgtgcgggacagttggcccggggcatcgcggaatggctgattcagggcgggtggcggcggcatcgggaagcaaccgccgctcggcgccaccgtgttcgggacgccgcccgcgggagagcgctcaggcgagtgacaggacgacgagggccgtcgtcgccgcggtttccgcgaggccgccgaagacgtctccggtcactccgccgaagcggcgcgtgcagtgccgcaggagcagctccgccgcggcgacggcgaggaggaccgccagcgccgtacggacgacgtcgtacgtcccgaacagggcgcccgccccggccgccgccgcgatgacggcgcccgcggtgagcagcgcgcccgttacgggcaccgtgcccgcgaccgccgcgcccaggccctccggacgcgccggtggtacgccggtgcgcgcggccagggtgagtacgagccgggccgcgcccgccgagaccacggccgcgaacgcgccccgggcccacgaggtctcgtacgcctgggcgagcgcggccacctgggcgagcagcacgaacaccagagtgatcacgccgaacgggccgatgtccgactgcttcatgatccgcagcgcgtcctcggcgggcttgccgctgccgaggccgtccgcggtgtcggcgagcccgtcgaggtggagcccgcgggtgaggacggcgggcacggcggcggtggccacggcggcgagcaacgggctcgcgcccagcaggagcagcagcgtgccgagcgccgcggcgagcagcccgaccaccagtccggcgaccggcgcgcacaacatcccgccgcgcgcggcggcacggtcccagcgggtcacccggaccggcaggacggtcagggtgccgaaggcgaaacggagaccgtcgagaagcgggggcttgggcaccggcgcaggctacccggcggccccgggggtgagcgcggcggccgagggcgaaggccgaggataaagtgcgcttatggggcattggttgcaccgcaacatcatcgagccgggcaagttgccgctgcttctcgcgctggcctcgttcgtgctgacgttcgtgatcacccgggtcatcacccggctgatccgggccggcaagggcccgttcggcaacgtcaaggcagggggcctgcacatccaccatgtcgtgcccggtgtcgtcctgatcgtcatcggcggcttcggggccgtggccagcgaacggcacggcttcggctcggccgccttcgccgtggtgttcggcatcggagccggtctggtgctcgacgagttcgcgctgctcctgcacctcgacgacgtctactggaccgaggagggccgtaagagcgtggaggtcgtggtggtcaccgcggccctggtcggcctggccctggcgggcttcctgccgttcggggtcaacgacctcagccaggaggagctgcgcgaccgcggcggcgtcatcctgagcgtcggcctgaacttcgtcttcgcgctgctcgccctgagcaagggcaagggccgtaccgcgatcttcggggtgatcgtcccgctcgtcgccctggtcggcgcgatccgcctggcccgccccggctcaccgtgggccaggcgcttctaccgcaaacggccgcgcgcccgcgccagatccagcctgcgcgcctaccgccacgaccgccgctgggcgggcccgcgccgcaagttccaggactggatcggcggcaaacccgactccgagaacctgcctatcccgcccgcgtcctgaccgctcgccggtgacgcagcgccgagatcccgcacagcacgagcaccgcggcgatggcggcgaggtgctccttgcccgcgaggttccccttcagcgcgacctcgatcaccatcgacgcgatcaccacccccgccgtggtgtaggcgcgataccgccagcacacgaacacggcgagcccgaccacggccgccgacggaccggtgtcgacgacctgcgcgtccgtcgcgggcagcccgaacaggctctccgggtcgagggtgaggcacacgcgcgcgtagagcgtgccggccagggtggcgacgtacgcgacgacgagtgtgcgccaccagcccaggcagatctcggcgatcccgaacacgacgaggatctgcgcgagcgcaccccacaccggcagatccagcgccggtacgaagagggagagcggggtgcgcagcagggccggccacagcggttcctcggcccgtacggccccgatgttctgcacgaacccgaagccccaggactggttctgcacgaactggagcagggccgtcagacacaccgccccgatggtcagcgggatcgccctcccgcgccgttcggcgagcgccgtgcgcacggtgacggcgagcgccccccactcggcgcgggccagccgggcgagggctctcatccggccgtcctcgcccgtcccccgtcgacgtacatccgtccccccgtccgttgtggtcatctgtgcgactccaggtgcctgcggtgcagccacttcggcagccccggcgcctccagaaacccctcggcacgcgcggcggcgacaccgatgcgcagcaggtccgcgctcttttcgaagagcaggaaccggggctcccagatgggccggtacttcgcgttggcgcggtacagcgactcgatctgccaccagcgcgagaagaagctgagcagggaccgccacagccgcagcaccggtccggcgccgaggcgtgcaccacgttcgaagacggaacgaaacatggcgaagttgagcgaaacctgagtgatcttgatctcccgggcgcggcgcaggagttcgatcaccatgaactccatgagtccgttctcgcaggcgcggtcgcgtcgcatgaggtcgagcgagagcccccgcggtccccagggcacgaaggagagcagggcccgcaactcgccttcggcatccctgcattcgagcatcacgcactgcccgtcgtcgggatcgccgagccgccccagcgccatgctgaacccgcgctcggtggccccgtcccgccagtcgtcggcacgcttcaggaagtacgccatctcgtcggcggggatgtcctcgtggcgccggatgcgcaccttgtacccggcgcgtgcgatccggttgtacgcctgccggacggtgcgcatggcccgcccctccagggtgaactcggcggtctccacgagggcttcgtcgccgagttcgagcgcgtcgagcccgtgccgggcgtagatggtgcccgcctcctcgctcgcgcccatcaccgccgggatccatccgtgtgcgcgggcctcgtcgagccagggggcgatggcgccgggccaggcctccgggtcaccgatcggatcgcccgaggccagtgagacgccgccgacgacgcggtaggcgaccgcggccttgccggtgggcgaccacaccacgctcttctcccggcgcagcgcgaagtagcccagtgagtcgcggtcgccgttcttgtcgagcagggcgcgcagccgcttctcgtcgtcctcggagagcgggtcgacggcgcggcgggagcggaaggcggcgtagaagacggccagcacgagcagcgtactgagcacgttgatgacgacgttgacccagttgggagtggtgatccccgggaagtgggagccgtcggcggcgaccgagaccagccgctgggtgccgtagttccagcgctccaggaaggtcgaacggtacgcgtccggcgcctggttggtggtggtcaccaggagcgcggcgagcagcgaggaagcgagcagtccgccgaccgcgacggccgcggcgagcttggggttcgaccggtcgcccttggcgtagaactcccggcggccgaggacgagggagccgacgaaggcggcggtgaggacgatcgagatccagttctgggcgtactgccggatctccgggaaggacatcgcgaaggcgaacagcagcaggaacaggccgctgagcacgaggttcaggatccaggcggcccgcttgcggcgccgcatggtgatggcgaggaacatcgtgaacacgcccgacgcgaagccggccgtcagcaggtagggcgtgaagtagttctcctggttgtgccgccgtacgtcctggccgagggagacccagacggcgctgaggaagttgatgaacgtgacagcccgcagataccagacgacgaacgccgcggcccgctgcgaggtcccggtggaccgcccctccccaccgcccgaccgggccggagtccgttcctgttccgcggtaattcgggcatctcccatgaagggcgatgatatggggcgccggggtgcatgcggaggagcggagcgacgcacgatacggcggctcgtcccgggggcgggtgggccggtcggtaggcggcctgttcggccgaaaatcgctgttccggacggcggcaaacgactgttcccgccctggctctccgctcccgcgtggagggaaccgcttggttcggcgtggcccgccgtggtccgccgtggtccgccgcgccggtcggacgtactacggcgcggcccggggtgccgggccgcgccgtctccgtccgctcgcctgctccgctcgcctgctccgctcgcgggcccctctcgactgctcctcttgtcctactccgcttgtcctactccgcgagggcttccgggttctccggctccggcgacgactcttccgcggcctccggcccttccccggcctcaagctcctcgggcttctccggcagctccgccgccagtgccgccgcggcctgtaccagcggcagcgccagcagcgcgcccgcgccctcgcccaccgtcaccccgtggttcagcagcggctccagcgccatccggtccagcgccttcgcctgcgccggctccccgctgttctgcccggccagccaccagtccggcgcccggaaggcgatccgctgcccgaccagcgcacacgcggccgacaccacgccgtccagaatcaccggcgtcttgcgcgccgcgctctgcaacaggaacccggtcatcgccgccagatccgccccgcccaccgccgccagcaactgaagctgatccccgagcacgggccgggcccgccgcaaggcgtcccgtaccgccgcgcacttccgcatccacgcgaggtcgtcgatggccagccccccgcgcccggtcaccacggacgcgtccgtgccgcacagcgcggcgatcagcacggccgccgcggtcgtcccgccgacactcacatcaccgagtacgacgagatccgtccccgcgtccgcctcctcgtccgcgaccgcgacccccgcccggaacgccgcctcggcctcctccagggtcagcgcgtcctcgacgtcgatgcgcccgctgccgcgccgcacccggtgccgtacgacactctccggcagggcgtccggctcgcagtccaacgccatgtcgaccacccgcaccggcacgttcagccgccgcgccaggatcgacgccgggctcgcgccctccagcaccgcccgcaccaactggtcggcgctgcccgcgggccgcgccgacacgccgagcgaggcgaccccgtggtcgcccgcgaagagcaccacgcgagggcgctcgaccggccgcaccggcaccgccgactgcgccgcggccagccactcacccaggtcgtcgaggcggcccagggacccgggcggcacgatctgtcgctctcggcgcgcctcggcgtcgcggcgcaccccgccgtccgggcgctcgatcaggtcggagaagtcgtcgagattcagcgagctcattcgccgaacagtaccgggagcgatcgaacacggctgcgctccatcgacgccacgacagcaccacgtcgttgcacccgtgatcgagatcccatacgttccgctttagtgcgtattgtcgtacgccccgatgtgcacctgtcgccccacaggagctgccatgcctcccaccccgcaggcgatcgcggcgcgccgcgccgcgtacctcggcgaactcgcccagggcaccgaccggttccacgaaccgcgccgcgagaactgcccgtggtgcggctcgaagcggctgcgcacccgcctcaggacccccgacctgaggcagcacaagccgggctcgttcgtcgtcgacgagtgccgggactgcgcgcacaccttccagaacccccggctcacgaccgagggactggcgttctaccaccgcgacttccccgaggaccccgaaggccgcgacttccccgaagaccccgaaggccgtgagggccccgagggccacgagagacctgggggcttcgccgagcgcatcgtcgccgcccgcggcagcctcccccgggctctcggcttcgcccgcgcagggcgccacctccgccgtcaccgcaccgccgcccacgccatgctgtccatccccgaaccggagagctggctcgacgtcggcaccgggcacggccacttcccggagagcgcccgcgagatccacccgtacacggccttcgacgggctcgaccccaccccgcgcgtcgaaagggcccgggcggccggccgggtcgaggaggcccaccgcggccacctcaccgacccggagatcatccaacggctgcgcgcccgctacgacgtcgtcagcatgttccatcacctggagcacacgccggacccgcgcgaggaactgcgcgccgcgctcgcggtcctgcgccccggcggccatctgctgatcgaaggaccggacccggcctgcgcgttcggcaggctgctcggcaagtggtggatgccgtacggccagccccgccgtctccatctgatgcccctgagcaacctgctcgccgaactggaggcacggggctgcgtgatcgtccgcaccgaccgccgcgaaccgcacaccccgtacgacatcaccggcgcggtctccctggccctggcccgcctcctgccggccgcggacgcaccctggcgggcgaccccgccgagcgaactccggcgcaggctgcgcacggccctgctgcgcgtcaccacccccctggtggtctcggccgcggccttggaccacgcactggccccgctcctcagccgcacccgcttctcgaacacgtaccggatcatcgcgcgccgggaggagtaggggtgcctggcggatcagcctccggacggtccacgacaccacggcccggtccggccccggctcagccgccccgcagcaccatcgcctgccccgccaccaccagcagcaggtgctcgcactccgcggcgaacgcggcgttcaggcgcccgagttcatcccggtaccggcgcccggaagccgtggccgggacgatcccggagccgacctcgttggagacggccacgaccgttcggccggtctcgcggaccgcggccgtgagctcctccacccgcccgcgcagcgcccgctcgccgccgcccgcccactcgtcgtcgtcccaggcgttgacggagtccatcgcgtccgtcagccacaacgacagacagtcgatgagcagcggcggcccgtcctccttcagcaggggcacgaggtcacaggtctccaccgtccgccaggagcccggacgccgctcccggtgcacactcacccgctccgcccactcggtgtccccgccccgggagccgcccgtcgccacgtacagcacgtccgggaaggactcgagccgccgctccgcctccaccgacttgccggaccgggccccgcccagcaccagcgtgcgccggggcacatccggtacgtcctcgtacacgcccaccgtcagcgtcgtcccgtccggcaccgcccgcgcccccgccgccgcgagccgccgccgcaactcgacgcccggcggcacgtcgtggtcgaggtgcacggcgatcacatccgtcgtcggcccgagggctccgaccgcgcgcagccgggcgagggcgtccggccgaccgaccacatcggcggccaccatgtcgtacggctgaaccgtctcgtcgagcccggccggcgccccgcccggcggcagatacagcagccgctgcccgtcgggccccgtcaccgcgtaccccgtgcccggcgcgtccatcggcatcgcccgcacccggtgcccggtcagcagcgccaactcccgcccgtcgggcacccgcgcgggctgcggcagtcccgccggcacctcgacggcgggaccgttgtgcggatgcgagaggagcacctgccgtaccccgcccagcgagcgcccggcgcgcgcggccgcgaatgccgcgccgggcgtcaggtcgagcagcaccgtgccgtccacgagcagcgcggtcgccgcccgcgctgcttcgccgagcgcggtcgcacaggccgcgcagggacagtcggggcgggggagtcccgcgggagcaccggtgccgagcagagtcagttccacggacccgattttcgcgtgccgccgcaggtcctgcgcgtccgaggccccataagaggtcccgcaggtcctcgcaagcgggcccgcaggtccccatgagagggcaggcaggttccccatgagagggcctggagggggcgcggggccgggcccgcaggttcacgcaggccggggagtgtctgcccgcccaccgggggaacacttaggcttcgggcgggggccgatcaagatccggcttcggctccgcagtgtgctcacaccttggaggcgtacatggcggcatggacgtggcggttcgagaaggccgacggggcggaggtccagcccgcggtcgcgccggaggagttcaccacgcagggggacgccgagtcatggatcggtgagtactggaaggacctcaaggagggcggcgcggaccaggtccggctgttcgaggacaccaccgagatctacggtccgatgagcctgcacgccgaggacgcgtaggccgtacggggccgcgagacctcaccgccccggcgacggggaccgcgagaccccatccttcgggctgccggtggcacacgcctcggcagcccgccggtcctacggggctcctccgccccgcactccgcacagatgcagcaaggccgccacctgccgatagggatccgtccgcccggcccgctcctcggcggccagcagcgtctccacgtccgccggaagttccgccccgtccgcggccgtgtccgtgaagacccgtaccccgtaccaggcgtgcagcggcgccccgatcccggccagcgtcgatgtcagcgcgtccagccggtcggcccgtacgtcgagccccagccggttcgtgtacgccgtcgtgtcgaacgaggtcagcgccgacgcccagtcgcccgccagtcccggccgcatcgccagcgcatccgcgttccgtaccagcagggacagcagcccgccgggcgcgagcatccgcgcgagccccgccagcagagcgtccgggtcctcgacgtacatcagcacgccatggcacagcaccacgtcgaagctgcccggcaggaagtgcacgcccgtgtcccggccgtcgctctgcacgagccgcatccggctccggatgccctccggctcggcggcgagcgtctcgcgggccacggcgatcatcgtcgcgtcctgctcgaccccggtcacctggtgcccggcccgcgccagccgcagcgcctgcgtgccctggcccatgccgacatcgaggacccgcagccgctgccccaccgggaaccgcccggctatctgctcgtcgagctgccgggccaccagctcctgtcgtacgacatcacgcagcccgcccagcttgctcagccaggcatccgccgcgcccccggagaaagacgtcgcgctcagggccgctctccgcgcttgacctgcggcttcggcagccggaggcgacgcatctggagagagcgcatcagtgcgtaggggatggcgcccttcttgggcacatcggggaagcgcgcgtccagctgcttcttcagacggaacgcgctgatgatcgagtcgatcacgatcagcacgatcacgacgagccacagcagcagcgcgatgttctggagctgcgccaccttcagcacgctcagcacgaggatcagcacggccagcgggaggaagaactccgcgacgcagaagcgcgagtcgatgaagtcccgggcgaacttgcgcaccggacccttgtcgcggaccgggagatagcgctcgtcgccgctggccagcgcctggcgctgcctctccagctggacgcggcgctcgtcgcgctgccgcttggcggcctccttgcgcgtcgtctgcgtgttggccacgctgcgacgctgggtctgggcctcactgcgcttgggcgtggggcgccccttgggggcctgcgggtgacggggctgcttggagtcggtcaccggcgccttgtcggcgggggccttctcttccttggcacggctacggaacacaaaacccaagggtacggggtgtcggggcatggaccccagtcgaggtgggaacgatccggcaacaccaggcgtctgtaggggacagggatcaggacaggagtcgggacaggcaggggcaaaccgtgggtgacacctacgggtggcgcctactccctgggccggagcgggggcctacgcagtcgtccttggggatgagcgcatcagtccccgaacagtgcggtaatggatgcaggccccgtactgtgggttctgttgtagtcgctggagctggagtccgtcagaagggggcgcgcgaagcccatgagcggtgtcatgaagcgtatggggatgatcttccgcgcgaaggcgaacaaggcccttgaccgggccgaggacccgcgcgaaaccctcgattactcgtatcagaagcagctggagctgctccagaaggtgcgccggggcgtcgccgacgtggcgacctcgcgcaagcgcctggagctccagctcaaccagctccagtcccagtcctcgaagctggaggaccaggggcgcaaggcgctcgcgctgggccgcgaggacctggcccgcgaggccctctcccgccgggccgcgctccagcagcaggtgacggacctggagacccagcaccagacgttgcagggcgaggaggagaagctcacccttgcggcgcagcggctccaggccaaggtggacgccttccgtacgaagaaggagaccatcaaggcgacgtacacggcggcgcaggcacagacccgcatcggcgaggcgttctccggcatctccgaggagatgggcgacgtcggcatggcgatccagcgtgccgaggacaagaccgcgcagctccaggcgcgggccggcgcgatcgacgaactgctcgcctccggtgccctcgacgaccagtccgggctggccaaggacgacatccagagcgagctggaccggctctccggtggtacggatgtagagctggaactccagcgcatgaaggcggagctggcgggcggttcgtcctcctcgcagcaggcgatcgagggcggcacgggccagtccccgtcacagcagcagccgcaggacactccgcgcttcgacaagcagtgacgtcccacgcctgaggagggcgacatgatcgtacggatcatgggggaggggcaggtgaggctggacgacagccacctcaccgaactgaacaagctggacgacgagctgctcgcggagatggagagcggcgacgaggaaggcttccaccggacgctggggtcgctgctgggggcggtgcgccgactgggcgacccgcttccggacgcctcgctcgagccgtcggagctgatccttccgtctccggacgcgaccttggacgaggtccgggagatgctgagcgacgacggtctgattccgggctgacgcgggtggtgccctgctggagccggggctgacgcgggtggtgccctgctggagccggggctgatgcgggcggtgccccgcctgagctgggttgcgcgacccacccacctacccaccctccccacgccggccgcggttcccgggcaacccaccggtcagccgcgattccggcgccccaccaggcaggcgcgacgtcggcatccgttccgccccctgcaagggccccgtacctttgcggggtgagcaccctcgagcgcacccggtgcagactgcgcgcccacccgttcgcgctggacgccgtcctcgccgccggcgtcctcgcctgcatgctgagcgcctccttcgtggacccccacggtgggaacggcgccacctggggcgcccgcgccccgggcgccctcagcctcaccctcatgggactcgccgccgcggccctcgtcttccggcgccgcgccccgatggccgtcctcgccgccacgggcgccgtctccctcgtggagctggtcaccggcgacccccgcgcgcccgtcgccatgtccgccgtcgtcgccctctacaccgtggcctccaccaaggaccggcccacgacctggcgggtcggcgtgctcaccatgaccgtgctgacggcgtccgcgatgctcgcggggcctctgccctggtacgcccaggaaaacctcggcgtcttcgcctggacgggcatggccgccgccgccggcgacgccgtacgcagccggcgggccttcgtgcacgccatccgggaacgcgccgagcgagccgaacgtacgagggaggaggaggcgcggcggcgcgtcgccgaggagcggctgcgcatcgcccgcgatctgcacgacgtcgtcgcccaccacatcgccctcgtcaacgtgcaggccggggtcgcggcccatgtgatggacaagcggcccgaccaggcgaaggaggcgctcgcgcacgtacgggaggccagtcgctccgccctcaacgaactgagggccacggtcgggttgctgcggcagagcggggaccccgaggcgccgaccgagccggcccccggcctgcaccgcctcgacgaactcgccgacaccttccgcaacgccggcctccccgtcgaggtcgcccgcgccgaccacggcaccaccctgcccgccgccgtcgacctggccgcgtaccgcgtcatccaggaggccctcaccaacgtgcaaaaacacgcgggcgccggggcgaaggccgaggtcagcgtcgtacgggtggggccgaatgtggagatcaccgttctcgacaacggggcgggcacggaccaggggcccgagaacggcggtgggcacgggctgctcggcatgcgggaacgcgtcaccgcgatcgggggcacctgcaccgccggccgccgatacggaggcggcttccgggttcatgcgatcctgccggtcaagaaccgtacgaccgccccggaggagaccgtatgaccatccgcgtcctgctcgccgacgaccaggcgctgctgcgcagcgcgttccgggtgctggtcgactccgagcccgacatggaggtcgtgggggaggcgtcggacggcgcggaggcggcgcggctggcgggggagacacaggccgacgtcgtcctcatggacatccggatgccggggaccgacgggctggccgcgacacggctgatcagcgcggatcccgggctgacgcatgtccgcgtcgtcatgctgacgaccttcgaggtcgacgagtacgtggtccagtcgctgcgcgcgggcgcgtccgggttcctggggaagggggccgagcccgaggagctgctgaacgcgatccgggtcgcggccgggggagaggcgctgctgtccccggccgccaccaagggactcatcgcgaagttcctcgcccagggggacggcctcgacgacgagcgcgatccggcgcgggccgagcgcctcgacgcgctgacgggccgggagcgcgaggtcctcgtccaggtcgccggcgggcactccaacgacgagatcgccgagcggctcgaagtcagcccgctgaccgtgaagacgcacgtcaaccgggccatggccaagctcggcgcgcgggaccgggcccagctcgtggtgatcgcgtacgagtccgggctggtccgtccaagggtggactgacctccaccgggccgtactgcgcccgcagtatgcgccggataaggaaatggacccacgggctacggatcgggcaccggggatggctcattgtgtaagggcggatgctcgtatgtgcccgctcctgccgcgcccgccacggaagagagaccctgatccatgtcctggctgtccaggttcagcctcgcgcaacgggccctgatcgggctgatgtcgatcgtcgcgctcgccttcggagccatcgcgatccctcagctcaagcagcagctgttgcccaccatcgaactgcccatggtgtccgtgctggcgccctaccagggcgcgtccccggacgtggtcgagaagcaggtcgtcgagcccatcgaggacaacctcgaggccgtcgacggcatcacgggcgtcacttccacggcgagcgagggcaacgccgtgatccgggcgtccttcgactacggcaacgacaccaagcagctcgtcgccgacgtccagcaggccgtcaaccgcgcccgcgtccagctccccgacgctgtcgacccgcaggtcatcgccggttcgaccgacgacatcccgaccgtcgtcctggccgtcacctccgacaaggaccagcaggcactggccgatcagctcgaccggaccgtcgtccccgctctgaagagcatcggcggcgtcggccaggtcaccgtggacggcgtccgcgacctccaggtcaccgtcacgcccgacgacaagaaggccgcgaaggcgcgcgtcacctccgccgcgatcggccaggcactgcaggcgggcggcgcgaccgtcccggcgggttccttcgacgaggacggccacaaccgcaccgtccaggtcggcggcggcctcacctcgctggggcagatccgggacctgatggtcatgggcggggccggcaagaagcccgtacgcctcggtgacatcgccaccgtcgagcaggagcccgccaaggcggactccctcacgcgcaccgacggcaggcccagcctcgccgtcaacgtgaccatggaccacgacggcagcgccgtagccatctcggaagcggtcaaggacaagctgccgggcatgcgcaaggacctgggctcgggggcgacgatcaccgtcgtcagcgaccagggccccgcggtctcgaagtccatcgacggtctgacgaccgagggcgcgctcggcctgctcttcgcggtcctcgtcatcctggtcttcctggcgtcggtccgctcgaccctcgtcacggcggtgtccatcccgctgtcggtggtcctcgcgctgatcgtcctgtggacccgcgacctgtccctcaacatgctcacgctcggcgcgctgaccatcgcgatcggccgggtcgtcgacgactcgatcgtggtcctggagaacatcaggcgtcatctcgggtacggcgaggagcgccaggaggcgatcctcagggcggtccgtgaggtgtccggtgcggtcacctcgtccacgctgaccacggtcgcggtgttcctgcccatcggtctggtcggcggcatggtgggcgagctgttcggctcgttctcgctgaccgtgacggccgcgctcctcgcgtcgctgctggtctcgctgacggtcgtacccgttctgtcgtactggttcctgcgcgccccgaagggcacgcccgacgacgcggaggaagcccgccggacggccgaggagaaggaggcgaggagcaggctccaacgtgtctacgtccctgtcctgcgcttcgccacgcgccgccgcctcaccagtgtgctgatcgcggccgcgatcctgatcggcacgttcggcatggcgccgctgctgaagacgaacttcttcgaccagggcgagcaggaagtcctcaccgtcaagcaggagttgaagccgggcaccagcctggcggcgaccgacgcccaggccaagaaggtcgagaagatgctcgacggggtcaagggcgtcaaggactaccaggtcaccgtcggctcgtccggcttcctggcggccttcggcggcggcacggacaccaaccaggcgtcgtactcggtcatgctggacgactcggcgtcgtacgaggacgtgcagaacagcgtcgaggaggggctcgccaagctctccgggatcggtacgacgacggtgtcggccggtgacggattcggcagccaggacctgagcgtggtcgtgaaggcggccgacgcggacgtcctgcggaaggcctcggaccaggtccgtgccgaggtcgcgaagctggacgacgtcacggacgtgtcgagcgacatggcgcagagcgtgccgcgcctctcggtgcgggccaacgacaaggccgccgcggcgggcttcgacgacaccaccctcggcgcggccgtgacccaggcggtacggggcaccacgagcggcaaggcgctcctcgacgacaccgagcgcgacatcgtgatcaggtcggccaagccggccgagacgtcggcccagctgaggaacctgcgcctgggtgcggtgaagctgggtgacatcgcgacggtgaagctggtggacagcccggtttcgatgacccggatcgacggacggcgcgccgccaccatcacggcacggccgaccggcgacaacacgggcgccgtcagcacgaagctccagtcgaagatcgacgcgctgaagctgccgaccggtgcgacggcggagatcggcggtgtctcgcaggaccaggacgacgcgttcaagaacctgggcctggcgatgctggcggcgatcgcgatcgtgttcatgctgctggtcgccaccttccgctcgctggtccagccgctcatcctgctggtctccatccccttcgcggcgacgggcgcgatcggtctcctggtggccacgggcactccgatgggtgtcccggcgatgatcggcatgctgatgctgatcggcatcgtggtgacgaacgcgatcgtgctgatcgacctgatcaaccagtaccgcaagcagggttacggcacggtcgacgccgtgatcgagggcggccgtcaccgcctccgcccgatcctgatgacggccctggcgacgatcttcgccctgctcccgatggcgctcggcgtcacgggcgagggcggcttcatcgcccagccgttggcggtggtcgtcatcggcggtctgatcacgtccacgctgctgacgctgctgctggtcccgacgctctacacggtgatcgaggtccgtaaggagcgccgggcgaagaagaaggcggcgaagcgggcggcgaagtcggggaacccgtcctcgccgacggggacgccgacggagacagaggcggagacggacgcggacgccgggcagccggaacccgcgcaggcctgacgtcttcacacgccccgggccctggtccgcactcacggtgcgggccagggcccgggggtttttcgttcgtgggcggacgggcgcggacgagccgggccgcgcaacggccgagcccccgcgccccggagggttacggcagcgccagcatccgctccagcgccagcttcgcgaactgttccgtctcccggtccacctcgatgcggttgaccaggttgccctcggcgagggactccagggtccacaccagatgcggcaggtcgatgcggttcatcgtcgagcagaagcagaccgtcttgtcgaggaagacgatttccttgccctcgggagcgaaacggttcgccaggcggcgtacgaggttcagctccgtaccgatggcccacttggagcccgcgggcgccgcttccagcgccttgatgatgtactcggtcgaaccgacgtagtccgccgcgtccacgacctcgtgcttgcactcggggtgcacgaggacgttcacgccggggatccgctcgcgtacgtcgttcaccgagtccagcgagaagcggccgtgcacggagcagtggccccgccacaggatcatcttcgcggaccgcagctcctcggccgtcagcccgccgttcggcttgtgcgggttgtagagcacgcagtcgtcgagcgacatccccatgtcccgcacggccgtgttgcggcccaggtgctggtcgggaaggaagaggaccttcgagccctgctcgaaggcccactccagcgcccgctgcgcgttcgacgaggtgcagatggtgccgccgtgccggcccgtgaacgccttgatgtccgcggacgagttcatgtacgagacgggtacgacctgctcggctatgccggcctcggtcagcacgtcccagcactcggcgacctgctcggcggtggccatgtcggccatggagcacccggcggccaggtccggcagcacgaccttctggtcgtcgcccgtcaggatgtccgcggactccgccatgaagtgcacaccgcagaacacgatgtactcggcttcggggcgcgccgccgcgtcccgggccagcttgaaggagtcgccggtgacgtccgcgaactggatgacctcgtcgcgctggtagtggtggccgagcacgaagaccttgtccccgagcttctccttggccgcgcgggcgcgctcgaccaggtccgggtcggacggcgagggcagatcgccgggacactcgacgccgcgctcactcctcgggtcggcctcacggccgagcagcagcagggcgaggggcgtcggctgtacgtcgagctcctggggctgggcggtggtcacgacacgcaccctttctgttctgcggctcgcttggatcatggaggcgatccagcgggacatgccttttcgtcgaattgacgctatctatcataaccggttcacgtcactttgacgaaggtcatagtgtcgatgtgacgtgaatcccgctggctcgaacggcggccgacctggacgtgccggaggggttgtccacagggcgctgtccgtgcttcggcgcatgtgcgagcatgaagacagacaagggaaagacacacgctcggcccggaatgaatccgcggccccgccggttgcaaccgtcggcaagcagtctccgtacaacccgggagagaagcagatgtccgtatcggacgagaccaccaccgtgagcgacggcatcatcctgtccgacgccgccgcggccaaggtcaaggccctgctcgaccaggaaggccgcgaggatctggcactgcgcgtcgccgttcagcccggcggctgctccggcctgcgctaccagctcttcttcgacgagcgttccctcgacggcgacgtcgtgaaggacttcgacggtgtcaaggtcgtcaccgaccgcatgagtgctccgtacctgggcggcgcctcgatcgacttcgtggacaccatcgagaagcagggcttcacgatcgacaacccgaacgcgacgggctcctgcgcctgcggcgactccttcagctgagcacgcggcacccaccggtacgcgtacgcaggcggcgtaccggcagacgtgctaagtcggcagtccccctccgacgggaacgccgccttcgagcatccacggccttttgcgcggccttcgcgcaggcacgggcgggccttcgcgcaggcacggtggccgccaccggtgcggccaccactggggcagccgcaccgggcggaccggggctactgcggctgagccgactgggccgacttcggcagccggtgctccgccgccgtctccttcgggatctgcgtgccgtccgagcccaccaccttgcggtcaccgagcggcgcgtccaggtggagcgtccggtggtactccttggcgatcatgatgcagaccttgtcctgccagggcgtctcggtcacggtgaccttcacctcgtcggagctctcgctcgccgacgccgcgtagtccccgcacaccccgcccgtgaagctcacggtcaggtccttcccgtcggccgtgtagccgtccaccttgacgtcacgcttggtcggcgccgaggtcgacccgtcgctgggccgcggggcaggcgagccgctcggcgcctgcgaaggctccgtgggctgcgaagcccccggcgcggccacgtaccgcgggtcgaccgccggatgcgtcacggtgaaggtgtcgtcggcccccttcggacgtacgtcgaacagccaggacggcaccagcgccggctgcccgtccaccacctgcgaggccagcccgaacacggcgccctcgacggccaccggctccggcgtgggcgtcgcggtcgacgcctcgcacggcgtctcgtccttgtccttgagcggtacggggctggcgcagccgccgatgcccttgcggccgtcccccgtcgccgaaccgttcatcaggtccagcgtcttctgcgcactgatgacggggtacgtgtcgctcttcaccggcgccttcaggttgccgctgccgccgaccacctggccgtccgcgccgacctggatgcccgtcgtccagccgtgcgtgggcagcccgccgaccttcggctcggcgttcaccacccgtacccggtccatgacctggccggcgttcagcttcgcgtcgtcctggcccaccgccttcaggacgggagcggcggccttcctggcggcggcctcgctcaccggatcggcggccgaccgtccggaggattcgctcgggcacgccttggtgctcgtgcagaggttgtcggtccccggcgtgtaccggctgaacgtccagatccccggtgcccgcttggtcacccgcagcgtcggccccgacccgtccttcaccgccccgaccgtccaggcgtccccggtcagcctcggggtgccgtccaccgccagggcctgcgcgagacgcgccacctcgtccttcgtcacctcgcccgtcgcccggtacacgggcgcggagtccgggccgtcggggagcttgccgtcggcccggtaggacgcgccgtaggggtttggctcacccaccgcgatgcccggcctgccgccctcgctgtagccgtcgagggcgagcggcgggggagtgccgtcgccgccggggccggtggaacggccgccggagccgccggtcgcggtcgcggtgaagtacgccccgccgcccccgacgagcagcaccgcggccgccaccgaggccacgaccaccggagaccgccgccgacgcggtgcgccttcgtcggcacccgcgacgccctcaccggactcggtgatgtcggcgacttcggcgacttcggcgtcttcagtgacttcaacggcttcgctgatctcggcagcttcggcagcttcggcagcttcggcagcttcggcggcttcggcggcttcggcagctttggtgtcgtcactggcctcggcggtgtcactggctttggtgtcgtcactggcttcggcagcctcagtgacgtcggcagcttcagtgacgtcggcagcctcaccggctgtggtggcgtcggccgcttcggacgcgtcgccggcttccccgtcgggccgcccggtgttcaccgcgtcgctcgcgctgctcgcgtcgtcgtcgggtcgctcggtgctcaccgcatcgctcctttggctccactgctgtcccggacgaccctgccccgtcggagagggggctcaggagggtcgtacgccgtatcccctttacgggggacggcgatgggacgcaatgggggagcgcgcggttccctcgtcggcgcgctctgtctcagcggatcgaaatctgtgcggatcagtccccgtagtccgacatcgcgtccaggagccgcgcggaggcgggcggcacggtcacgccgtgaatgagggacggggagaccgggcggggggtgatccggtcgggtgccgcccagtgcggggccatccgggcgccgtcgccgcgcagcgacgccagatcgccctccaggtcgagcgggacggagccgtggaccttcaggttcgtcatagcggaaccgtagacacggtcgggtccacgaagaaagatctactatcgggtagttttgcccgcttcagtgggcccccgtcgaccgggtagcgtgaactgtcaatcccttcccccgcaggagcgtgtcctcgccgtgcgtatcgcagtcaccggctccatcgccaccgaccacctcatgaccttccccggccgtttcgccgaccagctcgtcgcggaccagctgcacacggtctccctctccttcctggtcgacaatctcgacgtacgccggggtggcgtcggcgcgaacatcgccttcggcatggggcagctcggtacgtcgccgatcctggtcggcgcggcgggctcggacttccaggagtaccgcgcctggctggaccggcacggcgtcgacacggcctccgtgcgcatctccgaggtgctgcacaccgcccgcttcgtgtgcaccacggacgccgaccacaaccagatcggctccttctacacgggcgcgatgagcgaggcccggctgatcgagctcaagtcggtcgccgaccgcgtgggcgggctcgacctggtcctgatcggcgcggacgacccggaggcgatgctgcgccacacggaggagtgccggtcccgctcgatccccttcgcggccgacttctcgcagcagatcgcccgtatgaacggcgacgagatccggatactgctggacggggcgacctacctcttctccaacgagtacgagaaggggctcatcgagtccaagaccggctggagcgacgaggagatcctgtcgaaggtcggccaccgcgtgaccaccctcggcgcgcagggcgtgcgcatcgagcgggccggccaggacccgatcgaggtgggctgccccgaggaggagcgcaaggcggacccgaccggcgtcggcgacgcgttccgcgcgggtttcctgtccgccctcgcctggggcgtctccctcgagcgcgccgcccaggtgggctgcatgctcgccacgctggtcatcgagacggtcggcacccaggagtaccagctgcgccgcgcccacttcatggaccgcttcaccaaggcgtacggcgacgacgcggccgtagaggtccgccggcacctcgcctgaccaggccctgtccggccgatcaggccggacaggacctaggacaaccggcggaccacataggccgagccgtggtccgccggctcctccccgacgtactcctgcccgcgcatctcgcaccacgcgggaatgtccaggcgggccgcctcgtcgtccgacaggacgcggaccgtgccgccgacgggcacgtccccgatgaccttggccagctcgatgaccgggatcgggcaccgcttgcccagggagtccacgacgagggactccgcccgtacggccgtcgcgggcgccgacaccggcgcgcccagcttgtcgcggaccgccgacaccgtgccgggaagcacctccaggaagcggtcgacatcctccgccggcgtgccgagcggcagcgacacccgcacattgccctcgctcagcacccccatcgccctcagcacatggctcggcgtcagggtgctgctcgtacaggacgagccggacgagacggagaaaccggcccggtccagctcgtgcagcagggtctccccgtcgacatagagacacgagaaggtgacgatgccgggcagccggcggaccgggtcgccgaccacctccacgtccccgaccagctcgggcacccgtacccggatccggtccgtcagctcccgcagccgtaccgcctcttccgccgcctcggcgcgcaccgcccgcagcgacgccgcggcggccacgatcgccgggaggttctcgaaccccgccgcccgccccgactcccgctcgtccgtgggcccttggggcgcgaatcgcacacctttacgcaccacgagaagcccgacgcccgacgggccgccccacttgtgggcgctcgccgtcagcagcgaccagtcacccgccacccggccccagcccagcgactgcgccgcgtccaccagcagcggcacccccgccgcccggcacacgtcggccaccgcggccaccggctgctccgtgcccacctcgtggttcgccgactggagacaggccagcgcggtgtccgggcgcagagcttcggcgtacgaggccggcgcgaccgtgcccgtacggtccaccgcgacccgggtcaccgtcccgccctccgtctcgaacacctccgccgaatggagtaccgaagagtgttcgaccgctgacacgatcaggtggcgtccgacacgccgccggcccgccagcgcgcccgctaccccggagtgcaccgcacgcgtgccggacgagttgaagaccagctcgtccggccggcagcccaccgcctcggcggccgcctcgcgggccgcgtcgagcagcagccgggcccgtcgcccctcgcggtagaggcgtgcggggtcggcccacccctcgtcgagcgaggcctgaagggcctgccgggcgacggggtggaggggagcggcggacgcggcgtcgaagtaggacacgccgccacgctaactcctgcgaacactcctgcgaaccgcgcgctcggcggggacgtggacggggacgtgggcggcggcgagggcggggatgtggggcgcaggcgtcgtacgagacgtcggaggggccgtcagatgaggcccggagtcgggcattccaccccttcggggtgtccggcggcgcgttgggcaccctccccgcgcgaccccaaatagcgtccagtagggtttggtccgcataaacatccaaacccctgcccgacgcagggcggcgaccgaccagcgaggccgcagccgaacagcgcgggcgagactctcgggaaggcgctacgtgagtcccaacggctccgaccgctcgccgcggcgcccgatgcggcggaagctgctgcaggcactgactgcgggcctggtcctggcgaccgctaccggttgcacatacaaggacttcccccgccttggcatgcccaccccagtcacggaagaggctccgcggatcctctccctgtggcagggctcctgggctgccgcgctcgccaccggcgtgctggtctggggcttgatcctgtgggcgaccatcttccaccggcgcagccgcaccaaggtcgaagttcccccgcagaccaggtacaacatgcccatcgaggcgctgtacacggtggtcccgctcatcatcgtctcggtgctcttctacttcacggcccgcgacgagtcgaagctcctcgacctctccaagaagcccgacgtcacggtcaacgtggtcggcttccagtggagctggggcttcaactacatcgagaacgtcgacggctcgaccggcaacgcgaagaccgacaagaacctggcggccattccggaccggttcaaggaagccttcccggcgaacgccggcggtgtctacgacgtcggcacgcccggcacgcggaacccgcagaccaacaacccgggtccgaccctctggctgcccaagggcaagacggtccgcttcgtcctcacttcgcgtgacgtcatccactccttctgggtggtgccgttcctcatgaagcaggacgtcatcccgggccacaccaactccttccaggtgacccccaacagggagggcaccttcctgggcaagtgcgccgagctctgcggcgtcgaccactcccggatgctgttcaacgtgaaggtcgtctcccccgagcgctaccagcagcatctcaaggacctcgcgaagaaggggcagaccggttacgttcccgccggcatcgcgcagacgagccacgagaagaaccgggagacgaacaacctgtgagcatcctcaacgaaccccagggtgccgccgcagctgaggactcttacgagaacgagctgccggtacggcgcaagcagcccggcaatgtcgtggtcaagtggctcaccaccaccgaccacaagacgatcggcacgctgtatctggtgacgtccttcgcgttcttctgcatcggcggcgtcatggcgctgctcatgcgcgcggaactcgcccggcccggtatgcagatcatgtcgagcgagcagttcaaccaggcgttcacgatgcacggcacgatcatgctgctgatgttcgcgacgccgctgttcgccggtttcgcgaactggatcatgccgctgcagatcggcgcgcccgacgtggcgttcccgcggctgaacatgttcgcctactggctctacctgttcggctcgctcatcgcggtcggcggcttcctcaccccgcagggcgcggccgacttcggctggttcgcctacagcccgctgtcggacgcggtccgctcgccgggcatcggcgccgacatgtggatcatgggtctggccttctccggcttcggcaccatcctcggctcggtcaacttcatcaccacgatcatctgcatgcgtgcccccggcatgaccatgttccgcatgccgatcttcgtgtggaacgtgctgctgaccggtgtgctcgtcctgctggccttcccggtcctggccgccgcgctgttcgccctggaggcggaccgcaagttcggtgcccatgtgttcgacgcggcaaacggcggagcactgctctggcaacacctcttctggttcttcggccatccagaggtgtacatcatcgccctgccgttcttcgggatcatttccgaagtgatcccggtgttcagtcgcaagccgatgttcggctacatgggtctcatcggcgccaccatcgcgatcgccggcctttccgtgacggtgtgggcgcaccacatgtacgtcacgggtggcgtactgctcccgttcttctccttcatgacgttcctcatcgccgtaccaacaggcgtgaagttcttcaactggatcggaacgatgtggaaggggtccctgagtttcgagaccccgatgctctgggcgaccggcttcctgatcaccttcaccttcggtggtctgaccggtgtcatcctggcctcgccgccgatggacttccacgtctcggactcgtacttcgtggtggcgcacttccactacgtggtgttcggcaccgtcgtgttcgcgatgttctccggcttccactactggtggccgaagttcaccggcaagatgctcgacgagcgcctcggcaagatcacgttctggacgctgttcgtcggcttccacggcacgttcctcatccagcactggctgggtgcggagggcatgccgcgtcgttacgcggactacctcgcggccgacggcttcaccgccctgaacacgatctcgacgatctgctcgttcctgctcggcctgtcgatcctgccgttcctctacaacgtgtggaagacggccaagtacggcaagccggtcggcgtcgacgacccgtggggctacggccgctccctggagtgggccacgtcctgcccgccgccgcggcacaacttcctcaccctgccgcggatccgctccgaatccccggctttcgacctgcaccacccggagatcgccgcgctcgaccagctcgagaacgccggtcacggtgagaaggccgccgtcgctggtggcaaggaggccggcaagtgaagatccagggcaagatgttcatctggctggccgtcttcatcctcgccatggcgatcatctatggcgtgtggtcgaaggagccggcgggcaccaccgcgctcttcctggccttcggcctgagcatcatgatcggctactacctggccttcacggcccggcgggtcgacgcgggtgcccaggacaacaaggaggccgacgtcgcggacgacgccggcgaggtgggcttcttcagcccgcacagctggcagccgctcgccctcggcatcggtggcgcgctggccttcatgggcgtcgtcttcggctggtggctgctctacttctcggccccgatcatcctgatcggcctgtggggctgggtcttcgagtactaccgcggcgagagccgcacccagtaggaaccgccccagcagtacccgcccctcgcgggcgtggtcagtagcacgcgctgagcgcacgggagcccggacactccgtcaggagagtccgggctctttcttttctcgcgtccgccgtccctcgctcggctcactcgccgcgccgtgaccgacggaggttcttagcgtgaagccatgaaccactcaccgcgaaaccgcacggtcgtcagctgcaccctgctggtgatcgccctgggcgcggcgggcctcaccgcctgcacctccgacggtcacccgctctcggcgaagccgtacgacgcggcgggtcagatcgccttcaacgcccctgtcggcgacagcaagaaggccgaccccgacaagcccctggagatcaccgcctcgggctcggacggccgcatcacggacgtcacggccaccgacgcgagcggccgctacgtggcgggcgaactcgccgccgacggcagccgctggcacagcacctcaccactggccgccggcagccggtacacggtgcgggtgagcacggaggacgaggacggcgcacccggccgcaaggacatcaccttcaccaccagcgtcccgaagaccaagaaggagctgggggtggcgttcggccccgaggcgggcacgtacggcgtcggccagcccgtcaccgccacactcagtgcccccgtcaaggacaaggccgcccgtacggtcatcgagcgcgccctcaaggtcgactcgaagcccgtggtggagggcgcctggcactgggtggacgacaagacgctgcactaccgccccaaggagtactggcccacccacgccaccatcacggcgcacagcaacctgaagggcgtcaaggtcgccgagcggctctggggcggcgacgtgaagcccctgaagctcaccaccggcgacagcctgatcgccgtcacggacgccgccgcacactcgatgacggtcttccgcaacggcaaggagatcaaccagatccccgtcaccaccggcaaggccggcttcgagacccgcaacggcgtcaaggtcgtgctgggcaaggagtacttcgtacggatgcgcggtaccaccgtcggcatcgccgagggctcgtcggactcgtacgacctgccggtgtactacgcgacccgggtgacctggagcggcgagtacgtccacgcggcgccctggtcggtcggctcccaggggtccgccaacgtcagccacggctgcaccgggatgagcaccagcaacgcggagtggttcttcgacaccgtgcgggagggcgacatcgtcaaggtcgtcaactcgaacggcgacaacatggacccgttcgggaacggctacggagactggaacctcgactggaagaactggcgcacgggcagcgccctgatggccggcaccccggacgggccgagcccggcggaccgggccaagctgcggcccgagacggtgtgaagacccggggggtggcaccgcgccccgaacgaggcgcggtacggccccccgagctctcagccgatcagagccttctgacgcaacagagaggccagcgcggccgcgaactccaccggatccaccggcagcgtcaccgcggcgtccgcacggctccacgtggccagccaggcgtcctggggtcgcccgatcagcagcagcacgggcgggcagttgaagacctcgtccttgatctgccggcagagacccatcccgcccatcggcacggcctcgccgtccagcacgcagacgtcgatgccgcccttgtccagctccgcgatcacggcggccggcgtcgcgcactccaggaactccaccacgggcacgtccggcgccggacggcgtccggtggcgagccggacctgttcgcgggtgttggagtcgtcgctgtagaccagcaccgtggcggtcggctgcattcttcctccgagacatcagcgtcgtacggacttggaccgatgcgcggatgctactcccttgaacacctcgtcaacaccggttcggacagggcttcgatgggccatatgggcagcacatggggctcggacaccccgaacggcacccccgggagtgagggcgagataagcgaccgacataatgtcggtcgtggcgacagcaacgacagtagaaaccgggcacgcgcacccgtcggtcaaccggccgaacctcaccagcgtcggaaccatcatctggctgagttccgagctgatgttcttcgcggccctcttcgcgatgtacttcaccctgcgatcggtgaccgggccggagcactggaaggagatggcgagccatctcaacttcccgttctccgcgacgaacaccacgatcctggtgctttcctccctgacctgccagctcggcgtgttcgccgccgagcgcggggacgtgaagaagctccggatgtggttcatcgtcaccttcatcatgggtgcgatcttcatcggcggtcaggtcttcgaatacaccgagctggtcaagaaggacgggctctcgctctcctccgacccgtacggctcggtgttctacctgaccaccggcttccacggcctgcacgtgacgggcggtctcatcgccttcctgctggtcctcggccgcacctacgcggcccggagattcactcacgagcaggcaaccgccgccatcgtcgtgtcctactactggcacttcgtcgatgtcgtctggatcggcctcttcgccacgatctacatgatcaagtaatcgggccagaagtccgaacatccagaagcatcgacgcagaagatcctgacaccggggtaatccgtgaaaaagctctccgcacgacgacgccatccgctggcggcggtcgtcgtcctactcctcgcgctggcggccaccggggggctgtacgccgcgttcgctcccgcgagcaaggcgcaggccgatgacaccgcccagtccctcgccatcgacgagggcaagaagctctacgccgtaggctgcgccagctgccacggcgccggcggtcaggggaccaccgacggtccgcaactggtgggcgtgggtgccgcggccgtcgacttccaggtcggcacgggccggatgccggcccagcagcccggcgctcaggtgccgaagaagaaggtcatctacacgcaggccgagatcgaccagctcgcggcgttcatcgcctcgctcggtgccggtccctcgatcccgacgaagaaccaggtcagccccgagggcgcggacatcgccaagggcggcgagctcttccgtaccaactgcgcgcagtgccacaacttcaccggtaagggcggcgcgctgacgcacggcaagttcgcgccgagcctcgagggcgtcgacccgaagcacatctacgaggccatgcagaccggcccgcagaacatgccgtccttccccgacacgaccctgtcggagaagaacaagaaggacatcatcgcgtacctcgacgcggtcaacggtgacgaaaccgtcgagcccggcggcctcagcctgggcggcctcgggccggtcagcgagggcctgttcggctgggtcttcggcctcggcacgctgatcgccgtcgccgtctgggtcgccgctcggaccgcaaaggccaagaagtcatgagtagccaagagattccagaagagaaccgtcccgctgagcgggccaccgacgaagatgcgcacggtcacggtgcggtagccgtcgcggacgagcagaacccgttcgccaacccgggtctgccgccccacgagcaccgcgtccaggacatcgacgagcgggccgcccagcggtccgagcgtgtcgtcgccttcctgttcacggtgtcgatgctggccaccgtcgccttcatcgcctcgtacgtggcgatcccgaaggaagaggcgatctatgtcttcccgatcgggcacatcagcgcgctgaacttcgcgctgggcctgtcgctcggcgtcgcgctcttcacgatcggcgcgggcgcggtccactgggcccgcaccctgatgtccgacgtggagatcgccgacgagcggcacccgatcgaggcgccgccggaggtcaaggccaaggttctggccgacttcaaggagggcgccaaggagtccgtgctcggccgccgcaagctgatccgcaacacgatgttcggcgcgctggccctgttcccgctctccggcgtcatgctgctgcgcgacctcggtccgctgcccgagaccaagctgcggcacacgatgtggcgcaagggtctccagctcgtcaacatgaacacgaacgagccgctgcgtcccgcggacgtcgcggtcggttcgctgaccttcgccaagcccgagggcctggaggagcacgacgaggacttccagaaggagatcgcgaaggcggccctgatgatcgtccggcttcagccggacaacatcaaggacaagaaggaactcgagtggtcccacgagggcatcgtggcctactcgaagatctgcacccacgtcggctgcccgatctccctgtacgagcagcagacgcaccacgtgctgtgcccgtgccaccagtccaccttcgacctctccgacggtgcccgagtgatcttcggcccggccggtcacgccctgccgcagctgcgcatcggtgtgaacgacgagggctacctcgaggcgctcggcgacttcgaagagcccgtcggtcctgcattctgggagcgcggatgagcgccacgtcaaacacaccgtcccccgactcgcgtgcgcgcgggaaggcgcccgccggtgagcgggtcgccgactgggccgacggccgcctggggatctactccctggccaagtccaacatgcgcaagatcttccccgaccactggtcgttcatgttgggtgaggtctgcctctacagcttcatcatcatcatcctcacgggtgtgtatctgacgctgttcttccacccgtcgatgaacgaggtgacgtacaacggcagctatgtcccgctccaggggcagctgatgtcggaggcgttcaactcgaccatgcacatctccttcgatgtgcgcggtggtctgctgatccggcagatccaccactgggcggcgctgatcttcctcgccggcatgttcgtgcacatgatgcgcgtcttcttcacgggtgcgttccgcaagccgcgtgaggtcaactggctgttcggcttcctgctgttcgtcctcggcatgttcaccggcttcaccggttactcgctcccggacgacctgctctccggcaccggtgtccgcttcatggagggcgcggtcctgtccgtgccgatcgtgggcacgtacctgtcgttcttcctcttcggcggcgagttcccgggcggcgacttcgtggcccgcttctactcggtccacgtcctgctgctgccgggcatcatgctcggcctggtggtcggccacctgatcctggtcttctaccacaagcacacgcagttcgcgggccccggaaagacgaacaacaacgtcgtcggcatgccgctgctgccggtctacatggccaaggccggaggcttcttcttcctggtcttcggtgtcatcgcggccatcgcggcgatcgcctccatcaacccgatctggtccatgggcccctaccgtccggacatggtgtccacgggcgcccagcccgactggtacatgggcttctccgagggcctgatccgtgtcatgccgggctgggagatcaacctctggggtcacacgctcgtcctgggcgtgttcatcccgctggtgatcttcccgctggtcctggccgcgatcgcggtctacccgttcatcgagtcctgggtcaccggcgacaagcgcgagcaccacatcctggaccgcccgcgcaacgtcccgacccggaccgggttcggcgcggcctggatcagctggtacttcgtcctgctcatcggtggcggcaacgacctctgggcgacgcacttccacctgtcgatcaactcgatcacctggttcgtccggatcggcttcttcgtcgtgccggtcctcgtgttcgtcatcaccaagcggatctgcctcggcctccagcgccgggaccgggacaaggtgctgcacggccgtgagtcgggcatcatcaagcgcctgccgcacggtgagttcatcgagatccacgagccgctcagccaggacgcgctgcacacgctcaccgcgcacgagcagtacgagccggccgcgatcggcccggtggtcgacgagaacggtgtcgagcgcaagcccaaggtgacggagaagctgcgcgccaagctcagcggcgcgtactacggggacgacaaccagatccccaagcccaccgtcgaggagtacaaggagatcacgagcggccacggccaccactgatcacctgactgatctgtactgatcgccacggcaggagccccgtccattgcatggacggggctctttgccgtctctccacctggatagggtggactcaccccctggggcttaagggggctgagttccaccgtcgtacggctacgaacccaggagcgaccatgagcgctgtgaaccccgctggaggcgacatcgcggcgggccgttcctggcccgaggtgctgaacggcctgctcgacggccgcgaccagagcgcggacgacacggcctgggcgatggaccggatcatgcgcggcgaggccacggacgcgcagatcgccgggttcctggtggcgctgcgcgccaagggcgagacggtcgaggagatctccgggctggtccgggcgatgtacgagcacgcgaatctgatcgaggtgcccggagcgaccgtcgacatcgtcggcaccggcggtgacggcgcgaagaccgtcaacatctccacgatgtcgtcgatcgtcgtggccggcacgggtgccaaggtcgtcaagcacggcaaccgggccgcgtcctccgcgtccggttcctcggacgtcctggagaagctcggcatcaatcttcagctgacccccaagcgggtcgccgaggtggccgaggaagccgggatcaccatctgcttcgcggtgaagttccatccggcgctgcggcatgtggcggcggcgcgggggcagttggggatccggacgacgttcaacgtcctcggcccgctgacgaatccggcccgggtgaaggcacaggccgtcggagtcgccgacccccgcatggcccccatcgtggccggtgtcttcgccgagcgcggcaactcctcgctggtcttccgcggcgacgacggcctcgacgagctgaccaccacgtcgacctcccgggtctgggtcgtccgcgagggcaaggtcaccgaggagtccttcgacccccgcgacgtcggcctcgacctggtcccggtggaggcgctgcggggcgcggacgcggcgtacaacgcggatgtcgcccggcgcctgctgaacggcgagacggggccggtacgggacgcggtgctgctgaactcggcggcggccctggtggccctgtccccgggcgccgggaccctcgcggagcagctgcgcgcgggtatggcgcaggcggcggaggcgatcgactcgggagccgcgaagagggcgctggagcggtgggtggcggccagcaacgcctgagccgtggcgaggtgacgcggggcgcggtccggattctggactgcgccttgcgcgtcgaagatcgtatggcaagatgctgtatcaggtcatgagcgacagtcatgaggccccggccgactgtccggcaaccctccgtccgtggcggggtgccccgggtgaagaccaggtcgtaggcagcgaggtctacggcaagcgcggacccctcgtaatcaccaggggtcctggtcgttcgagggagccttccgtgagcaagcgaatgcgatagggcgccgagccccgcctccgcaatccccttttcacctttcctgtgccgttgacgtgcgcgtttcgcgctgtccggcacggtgattccgcctgctcttcacgggagtacacccatgtccgtctccaccgctgccgccgaccagaccgtttgctgtgacatttcgggacacctgcccgttctgggccgcgaggtcaccgtcccgctcgtcaccggtggcgaggtcacctacgccgccctcgactacgccgccagcgcccccgccctccagcgcgtctgggacgacgtcgccgcgtacgccccctactacggctccgtccaccggggtgccgggtatctctcccagctgtccaccgacctgttcgagaacgcccgcaggaccgtcgccgagttcctcgactgccgggacggcgaccaggtcgtcttcacccggtccaccaccgactcgctcaatctcctcgccgccgcccttccggccgactgccaggtcttcgtcttcgagaccgagcaccacgcctcgctgctgccgtggcgcgacgcccgggtgacgtacctgaacgccccgcgcaccccccagcaggccgtcgagaccctcgagcgcgccctcgccggccgtgacccgcacggtccggccctggtgtgcgtcaccggtgcctccaacgtcaccggcgagctgtggccggtacgtgaactggccgccgccgcccatgcgcacggcgcccgcatcgtcctcgacgccgcccagctcgcgccccaccaccccgtctccgtacgggagttggacgtcgactgggtcgccttctccgggcacaagctgtacgcgccgttcgggtccggtgtgctcgccggacgcgccgactggctgcgtgcggccgagccgtacctcgccggcggcggcgccagccgcaaggtcacgcggcgtacggacggcggggtggacgtggagtggcacgagagcgccgcccggcacgaggccggctcgccgaacgtcatcggcgcctactccatcgcctccgcctgcaaggcgctcaccgaggccggctacgacaacctcgtcgcccgggagcagcagctgatcggcaccgtccgcgcgggtctcgccgaggtgcccgaggtcagggtcctctccctcttcggcgacgacgccccccgcgtcggcgtcatctccttcgtcgtcgagggctggaacagctcccacttcgccgccgcgctctccgccgagtacggcatcggcgtccgcgacggcctcttctgcgcccacccgctggtgcgcaccctgctcggcagcgacccgcaggtccagggcgagtgcggcgcccccgaggcggcgcccggcgagaagtccctcaacgcgatccgcgtcagcttcggcgccggcacccccgacgagcacgtggagcgcttcgtgcgcgcggtcaaggagctcgtgcgggaaggtgcccggtggcagtaccggaccgaggacgggcgctgcgtgccggcggtctgaccgggctccgggtcaggaggcggggttcacgagtcgagaccgatcgcgaacgccgcctccaggtcgtgctgggagtacgtacggaacgccacgtgcgtgtccgtggcctcgacgcccgggatcttgctgatgctgccggggatgacgtccgccaggtcgtcgtgggccttgacgcggaccatggcgatcaggtcgtacgtgccggtgacggagaagacctcgctgacggagtcgagggcggcgatcgactccgcgatctcggggatccggtccacgctggtcttgatgagcacgatcgcggtgatcacggctggttttctccctcgggggccgctgctggggttttcactctagtcgtccgtccgtagcgcacccacgcgtagaggaagccgagcgagaagcccaccaggtgggccaggtaggcgacgctcgggccggtggcgacgcggctcgcggccagccactggagggcggcccagaagggcaggacgacccaggccggaaggcgcagcggcaggaagaagaggaacgggaagagactggtcacccgggccccggggaacaggtagaggaacgcgccgaggaccgcggagatcgatccggacgcgccgaccagcgtctgcgtcgagccggcgttggccgccgcgtacccgagcagggcgagatagccgcagcccagatagaacagggcgaactcgaggtgtcccaggcgttcctcggccatcgccccgaagacgtagaggaagagcatgttgcccagcagatggatccagctgccgtgcacgaagagcgccgtggccggggtgagtgccgcgcgcggggctccgctgaagagctccgcgggcaccacgccccagcgggcgaagtaggtctgctgcgcggcgagcagcccctccccggtgccgtgggcgggattgagtcccgccgcggggccgatcgcgaagatcaggcagcagaggccgatcagtccgtacgtcaccggcgccgactgtgcccggaccgcgctgccgaccgtcgtactccacctgctgatcacggaacagagcatggcgtaacgggaccgaaccgcgcagagtgcctcgccgccgtggacaggcgggcatcgagtacccgccaggccgtagggtgagatcctgtgtctgattcccggagactggaaggaacagcagccacgatgacggttcccctgccgactgccgagacccggtggcgctgcactttgtgcggcaacctcacgcgtttcgacgtgacccgctcgtcgaaggtcgtcgagtacgtacacctcgacctcgcgggcgagccgagcgtcgaggagcgcgacgtggtcagtgagaccatcgagtcggtgcgctgccgctggtgcaacgcggtggaccaggtggaactcgtggacaggccgggcgccggctcctgacgggagcgggccccgcacaggcattggggtgacggatggtggagaccacaggcggggggccgggcgacggcaccgccgaggtgctcgaccgtccgctgcccgacggcgtgcgccgcagggtcgtgcagatcgtctccgacgggttcggcgggctgaccgtcgccgagttgcccgcgcagctcaggcagtacgcccgcttcgccccgaaccggcgcgccaagttcgccggcaacgcgatggcggccgctctggagaccgacccgatcttccggcagcgcatcgccgagaagctgagagaggctcagccggagctggccggcgccctcgactccggctcgccgcccccggccgcggacccgctggacgtggcggccgcggcctatgtcctgcgccccatgggctgggtgaagctggtgaccgccgccggcgaggaggcccagcgtgccgacgccgagcgcgcggacgacgagacccgggccgagctggagcggctgcgcgaggagctggccgaggcccgcggccggacgaaggcggagaccgagcggctgcgcgccgagctggaatcgaccaagaaggaagccgaatcgctgcaccgcaagctgcgcggcgccttcagtgacgtcaagcgcggcgaggcggcgctgcgcaaggtgcagagcgagatcgaggccgtccgcgccgaggggcaggcccaggtgtccgccgccgagagcgagacccggcggctcaaggcgcggctcggtgagaccgaggcggccctggaggccagccgcaaggccgcgcgcgaggggcgcagcgtcgaggacatgcgcgtacggctgttgctcgacacggtgctcgacgcggcgcaggggctgcggcgtgaactcgccctgccgcccgtgtccgtacggcccgcggagaccgtggacgcggtcgaaccgggacgaatgaccccgaaggacatcgccgcccgtgcgctgtccgaaaacgaccccgcgatcatcgaccagctgctcgcgctgccgcaggcgcatctggtcgtcgacggctacaacgtcaccaagaccggttatccgcagatgccgttggagaagcagcgcctcagactgctcgggcagctctcgcagctcgccgcgcagaccggcgccgaggtgacgtgcgtcttcgacggggccgaactggccgctcccgtgctgctcgcgccgccgcgcggagtgcgggtgctgttctccaaagcgggcgtcacagccgacgagctgatccgtcagctggtgcgtgcggagccgcccggccggcccgtcatcgtcgtctccaccgaccgcgaggtggcggacggcatcgccaaggcgggcgcccgcccggtggcgtccgtggtgctcctcaagcgcttctcgcgcggctgaacgcggctcaaacctgcccctcgcaaacggctgcggacatctgtcacgttcaccccatgagttacgtacgcaccaaccgcaacatccgtccgtgatgcccgaattggcggaaccttcacgcaacgtagcgtcaagcgcgcattacagcatgtgagttgagtgtaaagaatgcgctcggtgaccgagatttttcacgtgaggatttgaacgatcacaggaaggtcactagggtcgcctcgaacccccgctcggttgatcactcattgggagtgacggcggaggggcaccgcccaccggcgtgtcggtaggcggctggaggaagaaggagctcgccttcgtggcgtcccaccgtcgacccaagcagccgagccgcacccgtgtgaccgtgctcaccaccgccgcagcggcagcagttgtcctcagcgcgaacgccgccaacgccgcgccgagtgagaagccgagcaaggacgaggtcaagtccaaggtcgacaagctctacgaagaggcggagaaggccaccgagaagctcaacggggccaaggagaagcaggacaagctcgagaagcagatcggcaccctccaggacaacgtggcccgcggtcaggaagagctcaacaacctgcgcgacggcctcggttcgctggccagtgcccagtaccgcaccggcggcatcgacccctccgtccagctcttcctctcctcgaacccggacgacttcctggacaaggcgtccacgatggaccagctgagcagtcagcaggtcgacgcgctcaagaagatccaggagaagcagcgctcgctggcccagcagcgcaaggaagcctccgagaagctcgcggaccttgccgacacccgcacggagctcagcaagaagaagaaggaagtccagggcaagctcgccgaggcgcagaaggttctcaacaccctgaccgccaaggagaaggcggccctcgccgccgagcagagccgcgccagccgcgccagcgagcgcagcgccctcgacgacagcggttccgccaagcccgcctccgggcgcgccgcgtccgcgtacgccgccgcgcagtcgaagatcggctcgccctacgtctacggcgcctccggcccctcctccttcgactgctcgggtctgacctcctgggcctacgcgcaggccggcgtctccatcccccgcacctcgcaggcgcaggccaacgccggtacccgcatctactcgcagagcgacctccaggtcggcgacctggtcatcttctacggcgaccagcaccacgtcggtttctacgcgggcaacggccaggtgctgcacgccccgcgtaccggcaccgtcgtgcgctacgaggcgatcggcaacatgccgttccagttcggcgtccgcatctgacacccttcgggacccgctgagggccccctccccgcgccgcccaatcgggcgaattgcggtgactcccgctgaccccacgccccgccgatgacctgcgtcagaggcggggcgtcggcgttgtgcgccggtcggggcctttggccggagtgtgatcgcacggctactgtctgccgcgtttcccccaactccgggggtccgtcagcggaagggagtgcggctacacgtggggtcccatcgccgccttgcaccgtccggcttcaaccggggcgccggtgccgcggtctgcgcactgtccaccgcggcagcggcactcggcgccgtaccggccgacgccgccccgcacgacgacacccgggcccgggtggaccgcctgtacgaggaggccgaacgggccaccgaggcgtacaacaaggccgacgagcgcgccgacgtcctgcgcgagcaggtgtcgcaggcgcaggacgagatcgcccggcagcaggagcgcatcaacaccatgcgggacgcgctcggttcgctcgccggcgcccagtaccgctccggcggcctggacccctcgctcgccctgctcttctccgacaacccggacgactatcttgaccgggccgccgcgctccatcgcgtcagcgcccgtcaggcgacccggttgaaggacttccagcacgccatgcgtgacgtcgcccaggagcgcgcggaggccgcgggccggctggccgagctggagaagagccgcaaggccgtcgcccggcacaagcggaccgtcgagcagaagctggcggcggcgcgccggctgctcaacgcgctgccggacgcccagcgcgccgccttcgaacgggcgtcgcgggccggtcgctccggcatgcccgacctcaccggtgtcctcgcgccgggcggtcgcgcgggggccgccgtcgccgcggcccgctccgcgctcggccgcccgtatgtgtggggcgccaacgggcccggcggcttcgactgttcgggactgatgcagtgggcgtacgcgcaggccggcgtcggtctgccgcgcacctcgcaggagcagcggtacgccggccggcaggtgccgctctcccaggcgcagcccggcgatctggtcgtgtaccggtcggatgccggccatgtcgggatgtacgtcggcaacggccaggtgatccacgcgccgtacccgggggcgccggtgcgctacgacccggtcggaatgatgccggtctcgtccgtcacgaggccctgaaccgccgcgtacgatcggaaacgtggctggtcgagggcgtacgtcaggggtgctggcgagctgtctgctgctgcttgccgccctggtcggctgcggtggccggcccgcgcgggacgcctcggcggccgaggtgcagcgggtgctcgaccggcgggccgcggcggtgctgcaccgggaccggtccgcgttcctcgcgaccgagtcgcccgtcgccccggccgccggccaactcgccacgggcgccgaggagttcggcaacctccgcggtgtcccgctggcttcctggtcgtaccgcgtcaccgccttccaccgctccggcgagcgggccacggccaccgccgaactccactaccgcctcaagggatacgaccgtgcgcccgtcacggccggccgcatgctgcgcctgacccgcggcgacggcgggtggtacgtggtgtccgacgagcccgcgaagaagtccagcgagcagctgtgggagcagggggccgtgcggatcgtccgcggtgagcacagcctcgtcctcggtgtcgggcagccggactcggtgctgcggggttacgcgaacctggcggaccgtgccgtgcccgccgcctcccaggcgtggggcgccgactgggcggggcgggtggtggtgctcgtaccgaagtcgctggacgggatggcggggctgctcggcgcgccggcgtccgggtaccgggggatcgcggcggtcaccaccggggaggcgggcggtgcggcgaaggccccggcggaccggatcgtcgtcaaccccgacgcgtacggcgtgctcggcgacttcggcaggcaggtcgtcctcacccacgaggccacccatgtcgccacccgcgcccacaccacggcggccacgcccctgtggctctccgagggctacgcggactgggtcggctaccgcggctcggggcgcacggcggcgcagatcgccccggagctggaccgggccgtgcgggaggggcagctgccggccgctctgccggccgacgcggacttcggcttcagcggggacgcggggaagctggcgaaggcgtacgagggcggctggatggcctgccggatgatcgcggaccactggggagaggtccggctcgacgacttctaccgggccgtgggggaccaccggaagcgggcgggagcggtcgagggcgccctgaaggacgtactcggcacgacgccgcggaagttcaccgcgcagtggcgggcctatctgaaggctcagctcggctgatcccgtccgatggcccggcccggccgatccggcgacgacagctccagtaccgggtcggctccttcttgtcgtcgtcgtaccttgccgtcgtcgtacgagaatgatacctctaatcgggctacctcgaatcgagataccgccctgagggagctcacgtcgaggcagctctcatcgagggggtcccatgaacgcccaccgcgcccaactgatctcgctcgcccgccccgtctacttctcgctgctggcctccgtggccgccgggatcatcaacaccgtctgggtctcccggctcggcggcccggccgtggccgccgtggccgtcgccaccaacaccgagaacgtgctgctcggagtcgccctggtcttcgcctccggtacgaccgtcctggtcgcgcacgccaggggagcgcaggaccccggcgcggtgcgggcggccgtgcgcgggggatgggcgctgtgcgcggtggtcacgccggtggtcgccggctgcggatatctgctgcgcgagccgctcgcccggctggtgctgggcggcgagggcccggccctgcccctcgccgtcggctacttcgcgatctccctgccgggcatcaccgtcttctacgcgcagaacctcgtcgacggcatcctcaagggcgccggcgacacccgcaccccgatgcgcctcgccctgcttgccaacgggctgatcctggccctcgacccgttgctcatccaccggtacggcgtccggggcgccgccgtctccacggtgctgtgccgctgcgccgcgctcggcgtgggtctgctcgccctgcgccgcaacgcgctgctccgcggggccgcggccgtccggcccgccgaggccaccggcgccgccctgcgccggaccctgagcaccggcctgcccatgtccgccgacttcaccgtgcgccagggcggggcgctggtgctcgtcgcgatcgtggcccggctcggggtgaccgccgtggccgcgtactcgatcgcgtacaaggtgatgtacgtcgccaccatggccttctacgcggtgcgccaggccgcctcgatccacacggcgcacacgcgaggcgcggaccgacgggcgtcctcccgctcggccggagccgggagcgggggagagcggcgggccatcgggcggcaggccgtcgtcgtctcggggacggtgggactgctcgcctcggccctgctctgcgtgctcgccccctgggtcatgcgcgccttcggcgccgggcccgaggtcgcgcaccagggcgtgctctttctgcgctgcgtcgggccctatctgctgctgatggcctgcttcatcgcgctcggcggggtcttcgaggggagcgggggcgctcctgtgctgctgcgggtgacgctgctcggcacggcggtccagcttccgctcgcgtacgccctgtcagggctcgggctgcccgggatctgtctggccctggcgctggccatggtggtgcagtgcgccgcgctcctgcccggcgtgcgccgtcaggaggacgccagggactccctggtgcgggtggcctgaccgggcaccgtggggaccggcggcaggaccgtgccgcgccacagttccagggcggccgtcagcgcggcggccatcaggaggccgttgcgcgcgaacagcagtgtgatgcccatccagtcgctgccgaccacgtgcgagaaccagacggggaactccagcacggtcacgaagcacgcggcgaggaccagcccgccgggcacggtcatgcggctgccccggaagcacagacagaccgcggcgagcccgaccagccacaccatgtactgcgggctgatcacccggctcgtggcggtgaacatcagcaccgccgtgaacgccgcgtccgcgagcgtgtgcgccaggaaccgcttggcgcgcagccgccacagcagcagccagccgaaggcgaccgcggtcaggaacagggccgcggtgctcaccgcgccgacatacgggcccaggaactccaccgagccgtagttgagcagcacctggccgttccagccgaagtgccgggcgacatggaagaccagggagcccagcgactccacctcggtgccccgctcgcgctggaaggtcaggaaggcgaaggcgccgggcatggccagggcgaagagggaggcgaccgcgacgacggtcaccgtcgccgaggcccagacccggcgtctggcggcgcccaccagcagcagtaccggccacaccttcagcagcgccccgaagccgatcagcgcccccgtcacgcgcggatgccgggcccccgcgagcagtgcggcgaccgcgaccgcggtgaccatcacgtcgtagcgggcgtacacggtcgggccgagcagggcgacgcccaccacccacacccaggcgccgcgcagcgtcctgcccgggcgcaggcccgtgtactggagcagacagaagaccgccaggtcggcgaggaaggccaggacgaagaacgccgacgcgtagtcgaggaagggcagcagggcgggggagaggatggcgagcgcggcggcgggcgggtactgccaggtgacgtcgtcgagcgggaaggtgccggtgcgcagggtctcgtaccagccctggtagatcaccgagacgtcgccggtgacgtccgggcccgggaagacgaacaccttgaagacgaacagcagcagcgccagcctggtcaggccccaggaggccaggagccaggccgggaaccttctcgtgcccgcgatgtccacctttgcgcccctgtccgtgtccttctcgtgcttctcgaagctacccgctgcctctcgtgcgggcggccatgatctcccggagggctgtgcgagagccgtgaagcacggccggggggagctgtgagtaccacgcgtggacgggttcggtactgtcgacctgcgatgcacaagaccttgatcgtgaccaacgacttcccgccccggcccggcgggatccaggcgttcctgcacaacatggcgctgcgcctggaccccgagcggctggtcgtctacgcctccacgtggaagcgcggccgcgagggcgtcgaggcgacggctgccttcgacgccgagcagcccttcaccgtcgtacgcgaccgcaccacgatgctgctgccgacgccgggcgccacccggcgggccgtcgggctgctgcgggagcacggctgtacgtcggtgtggttcggtgcggcggctccgctcggtctgatggcgcccgcgttgcgcagggcgggcgccgagcggctggtggccaccacgcacgggcacgaggccggctgggctcagctgcccgcctcgcgtcagctgctgcgcaggatcggcgagtccacggacacgatcacctatctcggcgagtacacgcgctcgcggatcgccgccgcgctgacgccggaagcggccggcaggatggtccagctgccgcccggcgtcgacgagaagaccttccaccccggctcgggcggcgccgaggtccgcgcccggctcgggctcaccgaccgtccggtggtcgtctgtgtctcgcggctcgttccccgcaagggtcaggacacgctgatcctcgccatgccgcacatcctcgccaaggagccggaggccgtcctgctgatcgtcggcggcgggccgtacgagaaggagctgcgcaggctcgcggacgagaccggggtcgccggctcggtccgcttcaccggggccgtgccctggtcggagctgcccgcccactacggggcgggggacgtgttcgcgatgccgtgccgtacgcgccggggcgggctcgatgtcgaagggctcgggatcgtctatctggaggcgtccgcgaccgggctgcccgtggtcgcgggcgactccggcggggcgcccgacgcggtgctcgacggcgagaccggctgggtggtgcgcggcggctccccggaagcggccgccgaccgcgtcgtcacgctcctcggcgaccccgagctgcgccgccgcatgggcgagcggggccgcgagtgggtcgaggagaagtggcgctgggacctgctggcggagaagctcaagaccctgctctgagacgagcacaggattcccctccgcgcggcgcacaccgctgcccgggacgcgggcccctgcggtcggcgcggtgcacatcgccgctcggggcgcgcccaggcccctgcctcggggtgagcgtatgactctgcgtcggcgcggtgcgcatcgccgctcggggcgcgcccaggccccggcttcggggcgcgcccagcccccgcctcgacgcggccccaaatcggtgccccaaagcgtgccgtgaccctaggcggaacggaataatccgcccatgctgcgcgcatgacagaaaaactgacgcatcgtcacctgactcgccgtcaaatccttggtatggccgccctccagacggcggccaccctgggcttcacccggatcggcctccagtcggcgcgggccgccgagcccgacgcggtcgagaccgcacccgccatcgtggtcggttccggctacggcgccgccgtggccgcgctccgcctcggccaggccggcctccgcacgctcgtcatcgagatgggcggactctggaacacacccggctccgacggcaaggtcttctgttccaccagcgccccggaccggagatccatgtggttccggacgcgcaccgaggcgccgctcgccgagttcctgtggctggacgtcgtcaacaaggacatcagcccgtacccgggcgtcctggaccgggtgcacttcgccaacatgtccgtgtacgtcggccggggcgtcggcggcggctccctggtcaacggcggcatggccgtcaccccgctccagtcgtacttcgccgagcagttcccgaccgtggacgccgccgagatgtacagcacgtacttcccgcgcgcccgcaccatgctcggcgtcaacacggtcgaccccgcctggttcgagtccaccgagtggtaccggttcacccggacctcgcggaaggcggccacgaacaccggcctgaagaccaccttcgtaccgaacgtctacgacttcggctacatgcagcgcgaggcggccggcaccgccaccaagtccgccctcgccggcgaggtcatctacggcaacaactacggcaagcgcagcctcgacaagacgtacctcgcctcggcgctgggcaccggcaacgtcaccatccacacactggagagggtccgcgagatacgaagggcgagcgacgggacgtacctgctgaccgccgaccggatcgacaccaccggcgcggtcgtcgagaccaagcagtacagctgcacctacctgttcctcggcggcggcagcctcggcacctccgaactcctcgtccgggcccgggagacgggcgccctgcccgccctcgacgcgagcgtgggcaccggctggggcaccaacggcaatgtgatgaccggccgggcgaaccacatctgggacaccgtcggggccaaccagtccaccatgcccgtcatgggcatcgacgactgggcgaacacctcgaaccccgtcttcgccgagatcgccccgctgcccatggggctggagcactggatcagcctctatctggcgatcaccaagaacccggagcgggcgtccttcacgtacgacgcggcgagcgactccgcgaagctcggctggagcgccgcccagagcgccgtgtccgtgagcatggccaagaagctcttcgaccggatcaactcggccaacgcgacgatctaccggtacgacctcttcggcaacaacaagaccttcgccgacgacttcacgtaccacccgctgggcggctgcgtactcgggaagtcgacggacaactacggccgggtgaaggggtattcgaagctgtacgtcaccgacggctcgctcgtccccgggtcgatcggcgtcaacccgttcgtgacgatcaccgcgctcgcggaacgcaccatggcgcgggtcctcgccgaggacaccgcgccatgaaccgcccgaccggggccgcctacttctggtagatcgcctcgatctcgtccgcgtagtccttcgccaccacatgacgcttgagcttcagggacggcgtgaggtggcccgactcctcggtgaactgggaggacagaatgcggaacttccgcaccgattccgccttcgacaccgcggcgttgccgtcgtcgacagcgctctggaccgccgcgaggagatccggatcctgccgcagcgacgccgcggtggagccggccggcttgccgtgctcggcggcccaacggcccaggaactcgtcgtcgatggtgacgagcgcgcccacgaacgggcgtccgtcgccgaccaccatgcactccgcgaccagcgcgtgcgcgcggatacggtcctcgatcacggccggggcgacgttcttgccgcccgcggtgacgatgatctccttcttgcggccggtgatccgcagatacccgtcctcgtcgagggtgccgatgtcaccggtgtggaaccagccgtcggcaagcgcctcggcggtcgcgccctcgttgttccagtactccttgaacaggtgctcgccgtgcagcagcacctcgccgtcgtccgcgatccggatcacggagcccggcagcggctggccgaccgtgccgatcttcgtgcggtcccaggggttgaaggcggtggccgcgcaggactcggtcaggccgtagccctcgaggaccgtgaagccgatgccgcggaagaagtggcccaggcgctcgcccagcggggcgccgccggagatggcgtactcgcccttgccgccgagaacggcccgcagcttgctgtagacgagcttgtcgaacgtcttgtatttgatcttcagcccgagggacgggccggacggggtgtccagggcgcggctgtacgcgatcgccgtgtccgccgccttgtcgaagatcttgcccttgccgtccgcctgcgccttggcgcgcgccgagttgtagaccttctcgaagacgcgcggcacaccgaggatcagcgtcggccggaacgcggccagttcgtcggtcaggttcttgatgtccgggacgcagcccagcttgatcggcgccatcatcggcgcgacctgcacgagccgtccgaagacatgcgcgagcggcaggaagagcaggacggaacactcgcccgtgcggaagagcgggcgcagccgctccacgatgttgccgcactccgcgaagaaggcgcggtgggtgaggacgcagcccttgggacggccggtcgtgccgctcgtgtagacgatggtcgccgggtcgtcggccttggcgagcgagctgcgctcctcgacggtggcgtcgctgacgtccctgccgaggcgccccagctcctccacgccgccggtgtcgatctgccagacgtgcttgagggcgggcagccggtcgcgcaccgactccaccgaggccgcgtgcgtgtccagctcgacgacgcaggcggtcgcgcccgagtcgccgaggatccactgcacctgctcgggggagctggtctcgtacaccggcacggtgatcgcgcccgcgctccagatcgcgaagtcgagcagcgtccactcgtagcgggtacgggacatcaggccgacccggtcgcccggctggacgcccgaggcgatgagccccttcgccgcggcgcgcacctcggcgaggaaggcggtggcggtgacgtcctgccagctgccgccgaccttgcgggcgatgacggcgacgtcaggatgctgcgcggcgtttctgcggacgatgtcggtcagattgccgtccgcagggacctcgtacaaagccggaaggctgaactcgcgcaagactgctgctcctcatagggcgccggcgccacgactctgtgtgatgcgacggtgcggtccaaggctcgggcaggtgctcgggacatcattgttgaattcctgagcacgactggactgcccggacgttacccgccggtatggcttcttcgacagggggtcccggccagatgttctgtgcgtcacacatggtggcgttcctgcgatcacggtagtgcacgcggttactgactagccagtaatcgcaggtccggcccgctctattcacctttgccgcacacgcttacgcttgatcgccatggcactctcaccaggcggcaaccgcaggaagcgcatccatgtggtcagcgatgtgcatggcaacgcgcgtgacctggcccgggccggcgacggcgcggacgccctgatctgcctcggtgacctcgtgctcttcctcgactacgccgaccactcgcgcggcatcttcccggacctgttcggtgtggcgaacgcggaccgcatcgtcgagctgcgcaccgcccgccgcttcgaggaggcgcgggcgttcggcgccgagctgtggtccggcatcggcagcgaccgggcggccgccatcgagaaggcggtacgcaagcagtacgcggagatgttcgccgcgttcccgacgccgacgtacgcgacctatggaaacgtcgacatgccgacactgtggcgtgagtacgccggacccggcacgaccgtgctggacggcgagcgggtggagatcggcggctggaccttcggcttcgtcggcggcggactgcgcacgcccatgcggacgccctacgagatcagcgacgaggagtacgcggcgaagatcgaggcggtcggcgaggtggacgtgctgtgcagccacatcccgccggaggtgccggagctggtctacgacacggtggcgcggcgcttcgagcgcggcagccgggcgctgctggacgccatccgccgcacccgcccgcgctactccctcttcggccacgtccaccagccgctggtgcgccggatgcggatcggggcgacggagtgcgtgaacgtggggcacttcgcggggtccggcaagccgtgggcgctggagtggtgagcggcttcgagcgctccgggtgccgatacgtcaggtggggtgacagcgccggtggctgtgcgcggtagccttcacgctgcacacacgtgcgcaccaccctccctcaccggaccgcacctggaggagccacggcgatggcggaacacaccagctcgagcatcatgatcgaggcggcaccggccgacgtcatggaagtgatcgccgacttcgcccgctacccggactggacgggcgaggtgaaggaggcggaggtcctcgggaccgacggccagggccgcgccgagcaggtccggctcgtcatggacgcgggcgcgatcaaggacgaccaggtcctggcgtacacctggacgggcgaccacgaggtgtcctggagcctggtcaagtcccagatgctccgctccctggacggctcctacctcctgaagccggcgggctcggacgcgaccgaggtgacgtaccagctcacggtcgacgtcaagatccccatgctcggcatgatcaagcgcaaggcggagaaggtcatcatcgaccgcgcgctggccggcctgaagaagagggtggagtcggaggagaagtaggggtcggccgcggcgggggccgggggcgcggccccacggacaccgggaacgggctccgccatcgggaccagccaggtccgccggccaggcacgggtagcgttcacccttatgcgcaccctcctgatcacaggccccggcggctccggccgtaccaccgtcgccgcggccacggcgctgagggcgagccgtacgggcacccggaccctcgtgctcagcgccgaccgcacggacaccctgggtgccgccctcggcgtaccgacgggcggggcccccgtcgaagccgcaccgggcctgaccgcctggcgccccgacgccgccgaccgcttccgcgcggacctcaccgccttccaggaccgcgccgccaccgccctcgacttcctcggcgccgcccgcctggacgccgaggaactcacccccctccccggcgccgaggaactcgccctgctgcgcgccctgcgcgacgccgcgctctccgaggcgtacgacctcctcgtcgtcgacctccccccggccccgcaggcgctcgccctcctcgccctccccgaggagctgcgccgctatctgcgccgcctcctcccgcccgaacgccaggcggcccgcgccctgcgccccgtgctcggccggctcgccggcgtcccgatgcccgcggactggctgtacgagacggccgcccgctgggacgtggagctcgccgcggtcgaggcggtcgtcgaggaccgcgccacgaccgtacgactggtcgccgagcccggaccggccggcgccgacgccgtccgcgccgccgccaccggcttcgccctgcgcgccgtgcgcatcgacaccctgatcgcgaaccggctcctgcccgaggaggccgacgacgcctggtcggccggcctcgccgcccagcagcgcaagttcctcgaggagtggcggggggagtaccggctccacgaactcccgcacctcggacacgacccgcgcggcgcggacgacctggccgcactcgccgtacccggcgtcaacgacgcgcctgggccggtcgagtggtccgtcgccgaccgcctcgccgacgacggggtgctcgtctggcacatcccgctgcccggcgccatacgcgacgaactcgacctcctccggcgcggcgacgaactcgtcgtcaccgcgggacagttccgccggatcgtcccgctcccgtcggccctgcgccgctgcaccgtggccggcgccgccctgcgcgagggcgagctgcggatccgcttcgcgcccgacccggacctgtggccccgcgaaaggtgacggcgagctcccggcggagtcgcggtccgtggccccggatccggtgaaccgcgtaccccgttcgggtaacgtcggaggtacgaaccgtaggcaggagtccgccatgagcgaagagcgccccacgtccgacgccgctcaggaggacgcggccgacgagacgcgggttccccccggccgagcggagtcgagcgctcgcgggagcgcagccgacggcgacgcctgggccaaggcctgcgccgaggatctcgccgccgagaaggcccgccgccgcgcccagtacggcgcacagcccggctcggccgccgaggaactgcgcaagctcgtcgacgccgtcgccgagaagctgtccgggctccagtcgccgctgatcgacgcggccacctccgggacggcccagcagatggtcagccaggtggtgcgacaggccaaggccgtcgtcgagcccgtcatcgagcgcaatccggacgtcttcgaccatctggccgcggccggctccgagctgctcgccgcctaccgctccgccgtggaggcccaggagaagcgctggacggcccgggaccacgacccccgccaccggggcggggaccaggggccgggggaacacatcgacttggactgacagccccctcgggtacggttggcagtagcggggctcgaccgaaactgagggattcatgggactcaccatcggcgtcgacatcggcggcacgaagatcgcggccggcgtggtcgacgaggaaggcaacatcctctcgaccttcaaggtgccgacccccaccacgccgcaggccatcgtggacgcgatcgccgctgccgtggagggtgcccgcgcggggcacgagatcgtcggagtgggcatcggtgccgcgggctacgtcaaccgtcagcgctccacggtctacttcgcgccgaacatccactggcggcaggagccgttgaaggacgaggtcgaggcgcgcgtgggcctgccggtcgtcgtggagaacgacgcgaacgcggcggcctggggcgagtacaagttcggcgcgggcaagggccaccgcaacgtcatctgcatcacgctgggcacgggcctcggcggcggcatcatcatcggcaacaagctgcgccgcggccacttcggcgtggccgccgagttcggccacatccggatggtcccggacggcctgctgtgcggctgcggctcgcagggctgctgggagcagtacgcgtcggggcgcgccctcgtgcggtacgcgaagcagcgcgccaacgcgaccccggagaacgcggaggtcctgctggcgctcggcaacggcaccccggacggcatcgagggcaagcacatctcggtggccgcccgccagggcgacccggtcgcggtcgactcctaccgcgagctggcccgctgggcgggcgcgggcctcgccgacctggcctccctcttcgacccgtccgccttcatcgtcggcggcggcctgtccgacgagggcgagctggtcctcgacccgatccgcaagtcgtacaagcgctggctggtcggcggcaactggcggccggtggccgacgtcatcgcggcccagctcggcaacaaggcgggcctggtcggcgccgccgacctggcccgggagcccgacccgatcatgtaacgcgcatacgtgtgtgacgacggcgcccgccgcaccccgcgaggggtacggcgggcgccgcggtttccgccgcggccccagccgtcggcgtatcttgatcgccatgccgaccagccctgccgccagtccgctgcccccctcgcgcaccgaaccggacggttccgccgtcatccgggtgctcagctacaacatccgctcgatgcgcgacgacaccgccgcgctcgcccgggtgatcagcgcctgcgaacccgatctggtgctcgtccaggaggcgccgcggttcttccgctggcgcaagaagctggcgccgctggcgtcggcctgcggccaggtggtcctctccggcggtgccacggccgcgggccccgcgctgctgtgctcgctgcgggccacggtcgagcgcaccgaggacgtcctgctcccgctcacccccggtctgcaccggcgcggcttcgccaccgccgtcgtccgcttcggccgggcccgcctcggtgtgctgagctgtcacctctcgctccagaagaacgaacggtacgaacagggcggcatgctccttgaccacctggcccgcctcggtaccccgcacgcgatcgcgggcggcgacctcaacgaacgccccgacggccgcaccttcaagcgcctcgcctccgagctccgggactgctgggcgacggccccctggggcgccgagtacacctccacgcccgccgacccccaccagcgcatcgacgcgatcctcgccaccccgggcatcgaggtcctggcgtgcggggtgccgctcggccaccccggggtcacggaggcggacctgagggcggccacggaccacctgccggtcctggccgccctcagagtgcccgcgtcctagccggcctggggacgctgcttggccttgtcggtcacggcccagctgtcgaggtacgagaactggtcgtaggtcctgccgtgcgaggtgcgggtgtcacggaagcccaggaattcgtaggtgtccgggtcgaagatgaaggagttgccggccccggtctcggcgttggagcggtgcgagaaccgatcgtcgaaggtgatcgcgacacccctccgtccggcggcgtccttctggttcggcaccgccttcacccccggcaccatggccagggcctcataggccgcgggccgcaggtcctccggcatcaccggcacgagcatgagcagcccgacgagggagaagtggatctgcgaccattcctgatccccgatttcgtcgatcgagtgcggggtcctgccaccgaagttgagtttcaggatgagcttcgccggatcggtcggcaggctcttgagcgtgtcccagtcctgcggcggccacatggacaccgactccacgtggtcgcccggccgcttcttgtacggcaccgaccaccagcccttgccgatctccatgatccatgagggcttggtgtcgtccacggaccgccaggtctcgtcgacgtaggtcttcttcgctccggtctcccgctcggtctccttgatgatctccttggtgtagatgaactggtcgtcgcgcggagcgaccgccgtctcgtgctcgcgcgagaacgccgccgccccgtacagcacggtccgcgcgctcacgttccgcagcgccggggagctgctggagggcggtgtcgcggtgcgccgtgcacctccgtcgtcgtcgcgtaccgccaccaggaccgtggcggcgaccgccgcggccacggtggcggtcagggcgatgcgcacgacgggacggcggcgtcgtacgaccggagccgggtcgttcatcgctgcgaacagacggacgcgcacccggtgccgggtctcgtcgtcgagcgggggtgcccccgcgtcccagtcgcgcagctggtcgagttcgggcgagtcatgcatgggcgtctgcctcccggaaagccgtcggatcggtgccacccagtgcttcgcgcagtctgccgcgggcccggtgcagccgtgatctgacggtgccgacgggcacgcccagggcctgggccgcctcctcgtagtcgaggccgccccaggccaccagcagcacgacgtcacggtgccgggcggagagcccggacagcgcggccgccagttcccggcgcacccctgtggcgccggccctggcgaccgcgcggtccgcgaccggctcctcgtgctcgaccggctgcgggacccgggcgagcgccttgaagcggcgcgcctcggctcttcggtgccgggccacgaggttggtcgcgatcccgaacagccacgggcgggcgtcggcccggccgaggtcgtacgtgtgacgttgcctgaaggccgtggtgaacgtctccgccgtcagatcctccgccgcctcgggaccgagccgccgggccgcgtaacggtgcacggcgccggcgtatcggtcgaagagggcggcgaacagctcgggctcgtcccgggaccgttcgatcacgcgggcgtcactctcctcgcgatgctcctcgcgggcgacgacgtccggtccgacggtcatcggggctcctttcgttcgtgtgaacgcctcgaaggcttgggttctgtcaggtggttcacctctctttcgccggtcgccgcgatcgagttccatccgggccggggcatgggcaggttccgggccggggcgtgcgagagttccgggccgggagcctgcgagagtgccgggagcctgcgagagttccgggccggggggcgggcgagaagcccgggccgcgggcatgcgaaaggcccgcccggattgctccggacgggcctcggccggtcgggctcagaccaccgcgccccgccccggatcctcgtcgtcctcgtcacccgtgcgcatgcgcatcaccagcgtggcgaagccgccgaggaagccgccgatgccgaccgtggtgagccaccaggtcatgtcccagcccagaaggaccgccagcaggagcaggatcggcccgcccaccaccccgagccaggcgaacttcgccgtcgcgtcggccgcgggcagcggcggcggctccggcggtacgaaatggccctcgtcgtcctcgtcgaagtcgtcctcggacgcgtccggcgccgcgtagtcgcgcgggccgccgccgatgcccggcgcgaaggcgaccgaactgcccagcggcttaccggccgagggcttgtcggcggacccggacccggagccggcgtccgaggcggagtccgatcccgggtccgcatccgattctgatcccgggtccgcacccgaaccggctcccgcgtcgccgtcgttggtctccggatcgaggagtgccaggtcctctatcgacttgaacggcttcgcgccgggcgggtccggcggctcctcgccgtacccggcgacgatcgccgcccacgcggcctcctcgtcgatcggcacgcccttctcctccggctcgcggtcggagtcgtgctcagccaccggtggccgtcccttcctgctggtccacgtgtcccaccccggacttcttgccgacggcgggtgcgagcctgccgaggaaggcgtagctctcctcgaagatccggtccgcgtcgtggtccaacgtcgccacgtggtagctctgttccagcaggctctccgtcacgtccgtggacgacacccggctgaggatgcgcgccgagtcggccggcggcaccacatggtcctgcgggctgtgcagcagcagcatcggctgggtgacctggggcagctcgccgtcgaccagcgcgtagaggttccgcatggagtgggccgcgtgcagcgggacgcgggagtagccgatctcgacgccgccctccttcgcgatgtcgctgatgatccccttcacggaagggacgaggtgccgcagcaccggaagggcgtacgcggccgggccgtgcaccttgttcgccgggttgacgagcacgaggccgctgatctcgtccccgtgcttcgcggccagccgcatcgccagcgcggcgcccatggacagaccgaagacgaacacctgtgtgcagcggtcgcgcagggcgcgcagctcgcggtccagctccgcgtaccagtcctgccagccggtgagctgcatgtcctcccagcgcgtgccgtgcccgggcagcaggggcagcgacacggtcagaccgcgctcggcgagatactccgcccaggggcgcagcgactgcggggaaccggtgaagccgtggcagaggaggacgccgacctccccgccctcgtggcggtacggctcggctccaggaaggaccggcaccttcggtctcctgttcatgaggtgggtgttcatgaggggggtgatcacgaaaagcacgacgagcgtgccccgaggcttcgaggcgtacttcaccgtacgcgaccgcactgacaccgaccagggtcgtcggctcctttgagggtgccccgggatagggtctgatcgacagacacaggaggcattcggttgatctacggcgccatgaagttttccatcggggggccactgaagcttgccttcaggccctgggtggaaggcctcgagaacattcccgccgagggacccgccatcctggcgagcaatcacctgtcgttctcggactcgttcttcctgcccgcggtcctcgaccgcaaggtgaccttcatcgcgaaggccgagtacttcacgactcccggcatcaaggggcgtatgacggccgccttcttcaagggcgtcggtcagctgccggtggaccgctccggcgcgcgcggcgcgggcgaggcggccatcaagagcggcatcgaagtcatcgagcggggtgagctgttcggtatctacccggagggcacgcgctcgcccgacggccggctgtaccgcggcaagcccggcggtctcgcgcgcgtggcactcgccaccggcgcgcccgtcatcccggtcgccatgatcgacaccgagaagatccagccgcccgggaaggtgatgcccaagctgatgcgcccgggcatccgcatcggcaagccgctggacttcggccgctacagcggcatggagcacgaccgcttcgtgctgcgcgcggtgaccgacgaggtcatctacgagatcatgaagctctccggccaggagtacgtcgacatgtacgccacggccgcgaagcggcagatcgcggacgcggcgaaggccgagaagcaggcccagaaggacgccgaaaagcaggcgcagaaggaactcgaggcccggcaggccctggagaaggaacggtccggctcctagacgcgtccgtcaggggtgggggtgggggacatggccaagcgggtcagagtcatgagtatgtcggtcgagcagccgctgtggcgtgcgctgaccggataccgcgtgctcacgatgttgtacgccgtcgggctcttcgcgaccgcgtacggcacgttcgaccgtccgtgggtcgccgtcgcctactacgccgtgctgtgcggctggaccctggcgaccctccccaaggtcgcgaacgcggcgagctgcaccaagcggttcctggccgccgacctcaccatcgcgctcgtcggcatcctcctcacgccgctcgccgacgcgcacgagcggatcgtcgcgggcgggccgacgctgccgtcgatatggaccgcggggtccgtcctggcgttcgcggtcaagggcggctggcgctgggcggccttcgcctcgacggcggtcgccgtcgccaacgtcttcgagcgccaggcccccgcccgggacaccgtgcacaacgtgatcctcgtgtgggtcgcctccatcgcgatcggctacgtcgtcgaagtcgcccgcgcctccgagcgcaccctcgcgcgcgccctggagatcgaggccgcgacccgcgagcgggagcggctcgcccgagacatccacgacagtgttcttcaggtcctcgcgatggtgcagcgccgcggtgccgtgctcggcggcgaggccgcggagctgggccggatggccggcgagcaggaggtggccctgcgcaccctggtcgccggcggtttactgccggcgtcgcgggtgtcggaggacgagtcccagggcgcggtcgtccgcgcggtggaggagcccgacgaggagggcccgctcgatctgcgcgcgctcctcgtgccgtacgccaccgcgaaggtcaccttctcggagcccggcgccccggtgcggctggcccacgccgccgcgaaggagctggcagcggcggtcggcgccgccctggacaacgtccgcaagcacgcgggggacagcgcccgcgcctggatcctggtcgaggacgagccggacgcggtgatcgtgacggtgcgcgacgacggcccgggcatcccggcggggcggctcgcccaggccgagggtgaggggcggctcggcgtggcccagtcgatccgtggcaggctgcgcgacatcggcggcacggccgagctgatctcggtcccgggccagggcaccgaggtcgaactgaaggtaccgaaggacccggggcacccgaaggctgcacgggggaaggcggagcgaggatgagcgagcagcagggcccgatcaaggtcatggtggtcgacgaccacccgatgtggcgcgacgcggtcgcccgcgacctggccgagtccggcttcgacgtggtcgccacggcgggcgacggcgagcaggcggtgcgccgggcgagggccgccgcgcccgacgtcctcgtcctggacctgaacctgcccgccaagccgggcgtccaggtctgcaaggagctggtcggcgccaacccggcgctgcgcgtcctcgtcctgtccgccagcggtgagcacgccgacgtcctggaggcggtgaagtccggcgccacgggatatctgctcaagtcggcgtccacggaggagctgaccgacgccgtgcgccgcacggccgtcggcgaccccgtcttcacgcccggactcgcgggcctggtcctcggcgagtaccgccgcctggcctccgagcccgccccggccaccggcgccggcgagcccagggccccgcagctcaccgaccgcgagaccgaggtgctgcggctggtcgccaagggcctgagctacaagcagatcgccgaacgcctggtcatctcgcaccgcaccgtccagaaccatgtgcagaacaccctgggcaagctccagctgcacaacagggtggagctcgtgcggtacgcgatagagcggggcctggacgaggcgtaaaccgcccgatactcaccttcgggtgatatccgctgatcaactacccgacaattcaccggaattgaccttccgcaccatgccgaagtgacctggatcactattagcgtgaccttcaccaggcaaccgcggcgaagggatatttccatgcgggtcggagtactgaccggaggcggcgactgccccgggctcaacgccgtcatccggggcgtcgtccgtaagggcgtgcaggagtacggctacgacttcgtcggcttccgggacggctggcggggaccactcgaaggcgacgccgtacggctcgacatccccgcggtgcgcggcatcctgccccgcggcggcacgatcctcggctcctcgcgcaccaaccccctcaagctcgacgacggcatccgccggatcaaggagaacctcgccaagcaggaggtcgacgcgctcatcgcgatcggcggcgaggacacgctcggcgtcgccgcacgcctcaccgacgagtacggcgtgcccgtcgtcggcgtcccgaagaccatcgacaacgacctgtcggccaccgactacacgttcggcttcgacacggccgtcggcatcgcgaccgaggccatcgaccgcctccacaccaccgccgagtcccacatgcgcgtcctcgtctgcgaggtgatgggccggcacgcgggctggatcgccatccactcgggcctggccggcggcgccaacgtcatcctcatccccgagcagcgcttcgacgtcgaccaggtgtgcgcctatgtgacctcgcggttcaaggcctcgtacgcgccgatcgtggtcgtcgccgagggcgcgatgcccaaggacggccagatggtcctcaaggacgagtccctcgactccttcggccacgtgcgcctctccggggtcggcgagtggctggccaaggagatcgagaagcgcaccggcaaggaggcccgcaccacggtcctcgggcatgtgcagcgcggcggcacgccgagcgcgttcgaccgctggctcgccacccgcttcggcctgcacgccatcgaggccgtccgcgacggcgacttcggcaagatggtcgccctgcgcggcacggacatcgtccgtgtcccgatcgcggaggccacggcgaagctgaagacggtcgatccgaagctgtacgaggaggtcggggtcttcttcggctgaccgaggccggccggtgtcacggtggtgaccctcctttgtccggcggtcaccaccgtgcggtccggcgagaagcccttgcccgaccacgcccgactacaccgcgggccgccgctcgaagaacgtgtcggcaccgcggagctgatccagcaggtcccgtacgaccgcggtgccgttgaccgacagcaccgactccgggtggaactggatgcccgcgaagccgggtccgcgcatcgcgtgcacctcccccgtgccgctgcggctgacctccacgtcatgggccgccagctccagcgccgtctcgtcgtcgcagtgcgccacgaagctgttgtagaagccgacggtctcggtacgcccgaacaggtcgatcccggtctgcgcaccctgatacgggacctccttgcgcacgatctccaggcccagctcggccgcgatcagctcatggccgaggcagacgccgagcaccccgtggcggtgaccgcggagcacctcggcggtgagcgcgcgcaggaaccgcatcttggggtcggccgggtcgttcggatcgccgggtcctggccccagaaccagcggcccctcgtgcgcgagcaccgcctttcgcagccccggctcgtcgtagcgccgcacggtcacctccagcccgctcgagcgcagcacatgcgccagcatcgccgtgaaggtgtcctcggcgtccacgacgagcgcgtgcccggtgagcgcgtccgtccgctcctgcatccgcagccagaacggcgcgagcgaggcccgccgtccgtcgagcgccgcccgcacccgcggatcgtcggccagcctcggccgtacgccctcctgccgcggccgggccggacggaccccgagggccgccagcaccccggccgccttcgcgtgcgtctcggcgacctcgcccgccggatccgacccccgtacgagcgtggcgcccaccggcacccgcagccggccgtccgcgtcgatgtcggcggtccggatgaggatgggggagtcgagggtctgcgccccgcccgcgtcccggccgatcagcgccagcgcgcccgcgtagtacccgcgcccgacaccgtcccgcccgaggggctcgtaccgctcgatgacccggcaggcgttctgtaccggcgacccggtgacggtggccgcgaacatggtctcgcgcaggacgtcccgcacatccagcgacgaacggccccgcaactcgtactcggtgtgcgccagatgggccatctccttcagccggggcccgacgaccaccccgcccatgtcgccgaccgtgcacatcatcttgagctcctcgtcgacgaccatcgagagctcctcgatctccttgccgtccgcgaggaagtccaggaggtcctcgggcgtcggcccctcggcgggatagcggtacgtcccgctgatcgggttcatcacgaccgtcccgccggacatccgcacatgcacctcggggctcgccccgaccagcgtgcgcccacccgtctcccgcccttccggggaagaccctgcgggccccttccccgttccggtgtgcacgacgaaggtccagtacgcgccctgctcgccgaccagcagccgccggaacagcgcgagcacgtcggcccttccgaatcccgggatctcgccctcgtacgtacgccggatcacgaagttcgcgccctcgccgcgtccgatctcctcgcgcagcacccgcccgacgatctccgcgtactcgtcgtcggcgacgtcgaagccgccgtcctcgacccgcacgtcatgcgtgggcaactgggacagcgcctgctccagcgggatttcgtggctctcctcgggcgtcagcaccagcagcggggtgccgtcgtcgcggacgtcgaagccgcgctcgcggatctggcggaagggaatgagcgcgaggccctcgtcggggaggtcggcgagacgctcgtaggtggcgacggggccgagcagcacctccaccgtcgcgctgtcctcggtggagcgccccggcgtgcggcggcgcagcagggcgaacgggcggtcctcgtgcaggagtcgggtcagatccatcgttcctcttccctcgtgatcattcgtgatcattcggaaccttgtggagaggaacggcccgggtccggaaacacgaaaggccgcccctcgggcggccttcgcgaagtcttgcgtacgcgcagtcagtgggccgccggatgagcggtccaccaccagttctggatcgagtgcgcgaacatgccaggcaccttacccgattcggccgcccgccggtcgtccggtgcggccgtccgatccggtcgtccggtccggcatccgtcgcggacagctccgagcggcacccccacacggcctacacaggcggtttcgcgccggcctcccgggtggaaggagggcacatcatcgggctatcggaggttcggaccgacgtgtacacgacctggactccacgacgacggcgcgccgcacggccgctcacggcgctggtcgccgccacggcgctcggcgcgggcacgctgggcgccgcccaggccgccccgcggtcttccgacgacaccatccgcgtgacctaccggggctacgagttcgccgtccccgccggctgggacgtcatcgacctcgacaaggacccgggggcctgcgtccgcttcgaccagcacgccgtctatctcggcaccccgggcgaccggcaggactgcccggcgcgggcgaaggggcgcaccgaggcactgctggtgcagccggccgaggcggccacggccgaggtgaccgagaaccgcacggcgggcacctaccgggccgtcgcggaccagatcgcggtgaccgccgcgtacggacaggaccgtgagcagatccaggagatcctccggggtgccggcctgcccgtcgcctccgcacgggccgagtcgggcgccgaggtgccggccgcgccggccgtccccgacgacgccacaaccttcaagggcaagggcttcgacgcctgcaccgccccgagccaggcctccatggacgcctggaagggcacgtccgggtacggcgccatcggcgtctacgtcggcggcgtcaaccgtgcctgcgcccagccgaagctcaccgccaaatgggtgcagacccagtacgcgaacggctggcggttcttcccgctgtacgtcggccggcagccctcggccgacggcggcagctgcctgggcggctgcgcctcgatcaccgacccggagccgcagggcaaggacgccgcggacgacgcggtgcggcaggcggccgctgtcgggttcggccccgggtcggtgatctacaacgacctggagcactacgcgggcgggaccgccgtgaccacccgggtgctcacctacctcgaatcctggaccacgcgcctgcacgagctgggctaccgctccggcgcgtacggcagtgtctcgtcgctcatcaccgacctggtgaagcacgccgacgacaggacgctgcccgacgtgatccacttcgcccactggaacgacgaggcgaccaccaccgacccggtcctccccgccgatctgtgggccgatcaccagcgcatccaccagtacgcgggcaaccgcaccgagacccacggcggcgtgaagatcagcatcgaccgcaacaagctcgacgtgggctccgggaccgggaaacggtcgtcgatcgagcgcggtccgtctcaattgatgagcaggtgaaggggtgcccgacacgaccccgtaatgttgggggggtgaccgtgaacgctaagtccagcgcgagcgctggcaacacctggcgagacctgcccgcggcgcagcagcccgagtaccccgatgccgaggctctgcgcgatgtgatcgcggacctcgagtcgtatccgccgctcgtcttcgcgggcgagtgcgaccagctgcgcgcccggttggcgtccgtcgccaagggagaggcgttcctcctccagggcggcgactgcgccgaggccttcgacggcgtgtccgccgaccacatccgcaacaagctcaagaccctgctccagatgggcgccgtgctcacgtacgccgcctcggtgccggtcgtgaaggtcggccgcatcgccggccagtactcgaagccccgctccaaggggaccgagacccgcgacggcgtgaccctgccgacgtaccgcggtgactcggtcaacggcttcgacttcaacgagaaggcccgcatcccggaccccgagcgcctgaagcggatgtacaacgcctccgcctcgacgctcaacctggtgcgcgccttcaccaccggcggctacgccgacctgcgccaggtgcacgcctggaaccaggacttcgtgaagtcgtcgccgtccggccagcgctacgagcagctggcgcgcgagatcgacaacgcgctgaacttcatgcgggcctgcggcaccgacccggaggagttcaagaccgtcgagttctacgcctcccacgaggcgctgctcctcgactacgagtcggcgctgacccgcgtggactcgcgcacgggcaagctgtacgacgtctcgggccacatggtgtggatcggtgagcgcacccggcagctggacggcgcgcacatcgagttcgcctcgaagatccgcaacccgatcggcatcaagctgggtccgacgacgacggccgaggacgcgctccagtacatcgagcgcctcgacccggaccgcgagccgggccggctcaccttcatcgtgcgcatgggcgcggacaaggtccgcgacaagctgcccgagctggtcgagaaggtcaccgcctccggtgcgaccgtggcctgggtgaccgacccgatgcacggcaacaccttcgaggcggcctcgggtcacaagacccgccgcttcgacgacgtgctcgacgaggtcaagggcttcttcgaggtccacaagggcctgggcacccacccgggcggcatccacgtcgagctcaccggtgacgatgtcaccgagtgcgtgggcggcggcgacgagatcttcgtcgacgatctgcaccagcgctacgagacggcctgcgacccgcggctgaaccgcagccagtcgctcgacctggcgttcctggtcgccgagatgtaccgggaccagtagccgcccatcagtagccgccgaccagcggattcgcctgtcacgggcgtgtggagtggggcgcggatcacatacgatccgcgccccctcgcacttttccgcgtcccacagggcaggtaaggttaggttagcctcaccgatcaagtcgggacggcacgacccagagatcccgccgggaggtgaaccgcgtgtacgtctgcagctgtttcggagtgaccgaagcgcaggtgaagaagcacgcggacggcggtgcctgcaccccccggcagatagcctcggcctgcaaggcgggcacggactgcggcggctgtgtgcgtcgtatccaggagatcctgggacggggtgcgtgtccgcgccgcgagccggcggaccgggcgcagccgctgttcgcccgggccgagaaggcggacgagcgggtcgaggtactggacgaggccgcctagctctccggttgcctgcggcgcctcggtccggccggggccgcctagctctccggctgctcgatcacctgggcgatgtagagcgcttcgccgagcttttccaccagctccagctgggtgtccaggtagtcgatgtggtgctcctcgtcctcgaggatcgactcgaagatgttcgcggacgtgatgtcccccttggcgcgcatcacctcgaccccgcgcctgagccggtcgatcgcctcgacctcgatctgccggtccgcctggaacatctcggtgaccgtctgtccgacccggacgtggaacagtcgctggtagttcggcaggccgtccaggaagaggatgcgatcggtgagcacttccgcgtgcttcatctcgtcgaacgactcgcgccgcgtgtactgggcgagcttcgtccagccgaagttctcctgcatcttcgcgtgcaggaagtactggttgatcgcggtcagctcggcggtcagctgctcgttgaggaattcgatgacctcggggtcgccctgcatcgcagaggctccttccaggcgggtgactgggcagattgcgccgcatccttgcaccggcaccgtaaggcgtccagtaagtacacgcttagtaggagttgcccgaatcggaacggggctggtcatgtgtaccggtcgaggtctgtcaggatggagtcatgggtcagccggtggagcgagaatctggagaagccgcacagtcggagcttccgccgggccagcgactgcagcgcggctggccggtcacgcactacgggcccgtacccaagttccgtcccgagcgctgggaattcagggtcttcggagccaccgccgacggcgagaagcactgctggacccacgaggagttcacggctctgccgtatgcctcggtcgtgtccgatctgcactgcgtgaccaagttcagcatgctcggtgccgaatggggtggcataccggctcgtacgatcctggagatcgccccgcccgccccgaccgtcacccacgtcatggtctgggccgaatacgggttcagttccaacctgcggctggcggacttcgcctccgaccgcacgatcttcgccacccacaaggacggcgagctgctgacggcggagcacggcttcccgcttcgtctcgtcgtaccgcatctgtacgcctggaaggggcccaagtgggtccggggcgtggagtacatgacggccgaccggcgcggtttctgggaggagcgcggctaccacaacgtgggtgacccgtggcgggagcagcgctactcctaccaggaagagcccggggaaggccccgagctctgaccccgggtcccggccccctgcgggcgggtcagtggtggtactggtgcaccaccgcgtggcccttgccgcggccgatcatccatcggttgacgggcacggtgatcacgaacgcggcgaccagcgagagggccagtgagccccagaacagcacgtcgtcgaggtgggcgtccatcgcggccggccagagcgcgatcacgccgttgtcgatcagctccatcacggcgatggacagggtgtccgcggcgagcgcgacccgcaaggcggtccggaagccgacaccggccttcagcactccgcgcaacgtgagcgagtagccgaagaagaaggcgagcacgatcgccaggatcgtcgtcggcacgttgccccagccgagcgcggtgccgaccaccatgccgagcacctcgccgatggcgcagccggtgaggcagtggagcgtggcctgggcggccatggcccagccgaccttcccggggctgtgggcgggcgggtgcgcctcgtggccgacgggctcggcgtgtccgtggtgtccggcgtgtgcgtcgtgccgcatgaaagcccccgacgtcgagtgagtggtggtgcctgtaccgatgggcaacgtcataccccccaggggtattcccatgcgtctggctcctgtgttcctcgaccgcgcctgtgttcctcggcggtgtcagccgtcgcggagcttcttgagctgctccacgtccgccgcgtggccctcctttccgccgggcgtctcgatgatcagagggacgccctcggtggccgggtgggtcatcagagcgcggaacgggtcctcgcctatgtggccggagccgatgttctcgtggcggtccttgtgcgcgccgacgacgtccttggagtcgttggcgtggatcagcttgagacgcccctcgccgaccgtgtcgaccagcagatcgagcgtctggtgcatcccgctcggcccggtgaggtcatggcccgccgcgaagatgtgacacgtgtccaggcacacgcccagcttcgggtgggcgtccagcgcctcgaagtacggcccgaagtcccaggtccgggagcacagggaggcgccctgacccgcggtcgactccaggagcagatacgggtcgtcgtcgtgggtcagctcgtcgagcaggggcagcagatgctcccgcacctgggcgagggcgacggaccgctcccgtccgccggtggcgctcccggtgtgcaccaccacgcccagggcgccgatctcgcgccccctgcgcagcgagtgccgcagcgactccacggacttctccacggtcgcctcggtgtgcgagccgaagttgatcagatacggggcatggacgtacgcggggatcgactcggcggcacaggccgcgcggaactcctcgtcctgccgcggattgccggcgggcgtcgcccagccgcgcgggttggcgacgaagacctgcacggcctcggccgcgaggtcgcgggcgtaggccagaccgacggagtggaggccaccggccaccgggacgtggccgccgacggggttgcgggagagaccgggggtggcgtcgggcaggtcgggggtggcgccggacgtgccgagggcgccgcgggactgctgattgttcaccccatcagggtgtcacgcggtcccgggcgcccggtcggcggctcttgccggctccgcgctagcggatcttgatcgtgatcgtcgaccccttgggcgccttctcgccgccctccaccgactggtccttgacctcgtccccgaagaacccgagcagaccccggtccttgtcgacctcgaagccggcgtcctccagcgtctgctgggcgtcggcgacgctgtcgccgacgacgtccgggacctcgaccatctccggtcccttggagatcgtgagcgtcaccgtgtcgccctcggcgaccttgtcgtcgtccgcgcccggcgactgctccacgacctggcccttctcgaactccgccgacgtgacccgctgcgaggagatccgcaccttgaggccggcgtcctccaggtccgcggtggcgtcgtccacggactcgcccgtgacctcgggcacctccaccggactgcccttgctgacggtgaacgcgatggccgaacccccgcgccgctcggtgcccgcggccgggtccgtgctgatcacggagcccttggggacgtcgtcgctgacggcgcgcgagaccatgcccggagccaggccgtccgccttgagctccgccctggccttgctcagcgggaggcccgcgagatcgggcaccttcacggtcctcgggccgtcggaaatggtcagcgtcacggagtcgttgtcccggatccgggcgcccggcttcgggtcgctcctgatgaccgtgccgcgcttcaccgtgtcgctgtagtcgtgtctgacctgcttgacgtcgagcccggccttctccagctgcgccgtggcctcgacctgcgtcttcgcgagcaccggcgggaccttggtgaactggccggagttgatgtaccagacgcccgctcccaggccgagcaccagcagcacggccgcgacgatcacgagcggcccgcgccgggggcgcccggagcgccgccgcggagaaacgggcggggactcgaaccggctcgtccggttgatctgctcgtcctcgttgacgggcagcggccgcggcaccgtcagcgaacgcggaatcacactcgtacggtcctcggcgccgccgtgctgcgtggctatggcctgcggcggtacggcgtcgagctgctcggtgctgagcgccgcccgtgcctccaggacctgggcgagcagcgccaccgcgtcgggcgggcgcagcccggggttgcgggcggccgccgaggagaccagctcgtccagcgtcgcggggagccccggcacggcggccgacggcggcggcacgtcctcgtgcagatgctggtagaggatctgggccggggagtccccggcgtgcggcttgccgcccgtgagcatctcgtagaggacgacaccgcacgcgtacacgtcgacgcgggtgtccgccgtgccgtgctctatctgctccggcgcgagatacgacacggtgccgagcacggagcccgtggtgttcgtgacggtgtccacagcccgtacgagcccgaagtcggccaccttgacccggccgtcgtcccctatcaggacgttctccggcttcatgtcgcggtgcacgaacccggcgcggtgcgcggcgccgagcgcggcgagcaccggctccaggatgtcgagcgcggcccgcggctgcagcgccccccggtcgcgcagcacatcgcgcagggtgcagccggccacgtactccatggcgagatagacgtacgacccgtccgcgccctggtcgaagacctgcaccacattggggtgcgcgagccgcgccaccgacttggcctcgcggatgaaacgctcgacgaacgagccgtcggcggccagtgtcggatgcatcaccttgagggcgagcacacggtccaggcgggtgtccacggcccggtagaccgtggccatcccaccgaccgcgatccgagcgtcgacgcggtagcggccgtcgagcacctgcccgaggagggggtcctgaagggtcgtatccacgcaggtgagtctacgagccgccactgtcacacccacccggtccgcttgatccggggacggaatgcagcagagctgtgactgttgcgcgactagaacgcggggcgctcgggatccaggtgtgcgcgcccctccggcggggacgacgcctcggcgaaatggcggcgtgggatgcgtcccgcgcggtacgcgagccggcccgcgtccaccgcgtgccgcatgccctcggccatcagcaccggttcctgcgcccgcgtcacggccgaggcgagcatcacacccgcgcagcccagctccatcgccagcgccacgtccgacgccgtacccgcccccgcgtccaggatcaccggcacgcgcgcgtgctccacgatcagctggaagttgtgcgggttgcggatgccgagcccggagccgatgggcgagccgagcggcatgaccgccgcgcagccgacgtcctccagcttgcgcgcgaggacggggtcgtcgttggtgtacggcagcacggtgaagccgtcgtcgaccagggtctcggcggcgtcgagcagctcgatcggatcgggcagcagggtgcgctcgtcggcgatgacctccagcttgatcaggtcggtgccgagcgcctcgcgggccaggcgcgcggtcagcacggcctcgcccgcggtgaaacagccggccgtgttgggcagcacccggatgccgagccggtcgagcacggacagcacggagccgtggacgcccgcgtcgacgcgccgcatcgcgaccgtcgtcaactccgtgccggacgccacgagcgcccgctccaggatgtcgaggctgggcgccccgcccgtccccatgatcagccgggacgagaacggcgtatcgccgaggacgaagggatcgtcagccatggttcagcctccttgcacggcggtgaggacttcgacgcggtccccctcggagagggccgtggaggaccactgcgcgcgcgggacgacggtttcgttgagggcggcggccacgccggagggagccgcggtgagtgtcttcacgagggtgtcgagcgcggtgcccggcgcgatccgccggcgctcgccgttgaccgagatgttcatgcggactgctccgtgagtacggcggtgctgaaacgcctgggggtgaaggggcgggcctcgtcgggaagctcgccggtggtcaggacatgcgccatggcgtctccggtgacgggggtgagcaggacgccgttgcggaagtggccggtggccagcagcagcccgtccagctcggtggggccgagcagcggcgcgttgtccggcgagccggggcgcagtcccgcgcgggtctcggtgagcggcagttcggtgatccccggcaccagctcgtgcgcgtcgcgcagcagctcgtacaccccgcccgcggtcaccgtggtgtcccagcccagctcctcactggtcgcgccgacgaccagctcgccactctcgcgcggcaccagatagatctggctgccgcggacgacggcgcgcacggtacggctcaggaacggtgcgtaccgcttcggcacggtcagccgcagcacctgtcccttcaccgggcggacgggcggcagtacgtcgtcggggacgcccgcgagctgcccgctgaggctgcccccggcgagcacgatctggcccgcggccagctcggcgccgtccctggtcacgaccccggcggcccggccccgcaccaggaacaggcgctcggcccacacccggtggaagaccaccccggcgcgctcgcaggccaccaccagcgccttggcgagccggcgcggatcgatctggtgatcgccgtcgactctgagccccccgcgtacgccgggcgcgagcatcggctcgagacggcggcactcgcggccgttcagccactccgactcgagccccgaccggcgttgcagggcatgcagttcgcgcagctgggcacggtcgtcggcgtcgagcgcgacggcgagcgtgccgcaccggcggtagccgagatcgtgcccggtcgcctcggtgagctcggcggcgaagtccggatagcggcgcgcggaggcaaggttgagccccagcagggtctgctcgccgtagtgcagctcggtgaccgcagcgagcatcccggcggccacctgggcggccccgccaccggggtcggggtccaccacagccgtggcgaacccgcgctgcgcggcgcgccaggcggtcaccagaccgatgattccgccccccacgacgaggacgtcggaggtatgtgtaggcgacatgggcgtccagcccctcccttcgccggcatgacccggatcaggttcgtacggtcggaggccgtcccagcctccctctcagcccggtgcgtccgggctcccgcgagtgctttacgttggccagcctagcccgtgccgtttgcctcagtaagggagcctcctgccatggcccgttcgctcgacggactcgtcctcgccccggtcacggaccaggcgccgggtcaggtgggtacccgtacccggttcacgtaccacgagaaggacggcgagatctgggccgagtacgcgggcggcgatgtcgtacgcggccacctcgtgggcaggcgtgaaggggaccgcctggacttccggtacgtgcagctgaagcacgacgggaccacatcgtccgggcactgcgtctccacggtgatcgagctggcggacggccgtgtgcgtcttcaggagacctgggagtgggagtcgcagccgggcaacgggacgagtgttgtggagcaggtcactgagcacgccccctgactgacaaactgtcagttgtctatggtgatcaggtgagcgagcagacgcaggaacgaggccgtacggcagcgcggcgtgtcgtcgtcgtgggcgcgggcatggccggggtgcagaccgcggtcgccctgcgggagcagggcttcacgggcggagtgacgctgatcggcgcggaaccccatcagccgtacgaccggccgccgctgtccaaggccgtgctgctcggcaaggccgagggctccgccttcgacgtcgacttcgaggcgctcggcatcgagctccagctcggccgcgaggcgctcggcctgcgcccggaggaccacgaactcgacacggactcgggccccgtcccgtacgacgtcctggtcgccgccaccggtgcggaaccgatccagctgccgggcgccgagggcgtcccgggcgtgcatctgctgcgcaccctggacgacgccgagcggctgcgtcccgtcctcgcccagcagcacgacatcgtggtcgtcggggccggctggatcggcgccgagttcgccacggccgcgcgcgaggcaggctgcgcggtcacggtcgtcgaggccgcggaccggccgctcgcgggggcgctgcccgccgaggtggccgcgccgatgacggcctggtacggcgacagcggggcgcggcttctcacccacgcgcgcgtggagcgcatcgagccgggcgcggtggtgctcgacaacggctcgcgggtgcccgcgggcgccgtcgtcgtcggcatcggcgcccgtcccgccacggcctggctcgtcggctccgggatcgcgctcggcgcccaccaggaggtcctcgccgacaaccacctgcgcacctccctgccggatgtgtacgcggtcggcgactgcgcctccttcccgtcgggacgctacgaggcgcgcctgctcgtccatcactgggacaacgccttgcagggcccgcggacggtggccgcgaacatcatcggggaggccccggcggcgtacgacccggtcccgtacttctggtcggagcagttcggccggttcgtccagtacgtgggccaccacgcgaccgccgacgcgacggtgtggcgcggggacccggagggggccgcctggacggtgtgctggctgcgtgaggggcgcctggtcgcccttctggcggtgggccgtccgagggacctggcccagggccggaagctgatcgagtcgggcgcccccatgaacccggagctgctggcggacgcgtcgcgcccgctgaaggcggcggtcgtgtagcactccccgggcactctcgggcactccccggttccgccgcgggcgaggggggcggagcacctcgatgggggcagtatgtccatttcacccccacctgggcgagactcgggtaccgactgtcagtccgggatggcagtcttggttgcgtgaccgagattgacgcaaagattgatgctctcgtccccgcctggctcaccctccccgacatcgccgaacagttcggcgtcgaggtgacgcgtgtccggcagctggtcaaggagggccaggtgatcgccgtacgccgtggtgagaaccgcgcgctgcacgtccccgccgctttcatcgacggggacaaggtcgtcaagggcctgaccggcaccctgacgctcctgcgggacgacggcttctccgacgaagagatgatcgagtggctcttcacgcccgacgagagcctgcccggtacccccgcgcaggctctgagcgagaatcgtgggacggaggtgaagcgccgcgcccaggcgctcgccgtctgacctgaacagagccgtccggtgtacggaccgtggccggccatgccccgccgcggtccgtacaccgccgagagacggtccgtacgttcaccgaccgacggtccgtacgccaccgacaggcggtccgtaggccaccggccgacggcccgtgagccaccgacaacgggggaactccaccatgcccgacaccgcccgcgaccggctcgccgacgcccgcgtctatctgtgcacggacgcccgcaggcgccagggtgacctcgccgagttcctcgacgcggccctggccggcggcgtcgacatcgtgcagctgcgcgacaagggcatggaggcggccgaggagctggagcacctccaggtcttcgcggacgcctgtcgccgccacggcaagctcctcgcggtcaacgaccgggcggacgtcgcgcacgccgtcgactccgacgtgctccacctggggcagggcgacctccccgtcccggcggcccgggcgatcctcggcgccgacgtcctcatcggccgctccacgcatgccgaggccgaggccgaggccgccgccgtccaggagggcgtggactacttctgtacgggtccctgctggcccacccccaccaagcccggccggcacgccccgggcctcgacctggtccgccacacggccgccctgggcaccgaccgcccctggttcgccatcggcggcatcgacctcggcaatctcgacgaggttctcgaagcgggcgcccgccgtgtcgtcgtcgtgcgcgcgatcaccgaggcggacgacccgaaggcggcggcggaggagttcgcgaagcggctccgtcacgcctagtcgtcggcgcggtcatccgcgcagccacccctcaggtgtccgaggggtggacaacaagtcgacaattcgggcaaatgcccgtcatccggttgggggaccgccgggccctggctaacctgcgggtatggccctcggaaccgcatccaccaggactgatcgcgcacgcactgtgcgtgacatgctcgcgtccggcaagaccacgtactcgttcgagttctcggcgccgaagacccccaagggcgagcggaacctgtggagcgcgctcaggagggtcgaggcggtcgcccccgacttcgtctccgtgacctacggggccggcggttccacccgcgcgggcacggtcaaggagaccgagcagatcgtcgccgacacgacgctcaccccggtcgcgcacctgaccgcggtcaaccactccatcgcggagctgcgcaacatcatcggccagtacgcggacgccgggatccgcaacatgctcgccgtgcgcggcgacccgcccggcgacccgatgggcgagtgggtgccgcacccgagggggctgacgtacgcggccgaactggtgcgtctcatcaaggagtcgggcgacttctgcgtgggagtcgcggccttccccgaaatgcatccgcgctccgccgactgggaagccgacgtcgagcgcttcgtcgacaagtgccgggccggcgccgactacgcgatcacccagatgttcttccaccccgagtcgtatctgcggctgcgtgaccgcgtcgccgcggccggctgcgagaccccggtgatccccgagatcatgccggtgacgagtgtgaagatgctggaacggctgccacagctcagcaacgccgcgatcccgtccgttctgcaagagcggatcctcacagccaaagacgatccggcggctgtacgctccattggcatcgagttcgccacggagttctgcgcgaggttgctggccgagggagtccccggacttcacttcattacgctgaacaactccaccgcgacgctggagatctacgaaaatctgggactgcaccacccacagcaggcctagaccggtcgcatcgtcgtacgacacactgcgtagcgaccacagggataggggcgtacatgggctggacggtcctctacatcgcgttcggcatcgtcgcgctgtggctgctgggcgaggtgctgctgcagtacaaggcgcggctgcgctggcggctgctcgccttcggcggcttcctcggcgtggtgctcggtgtgctgatcccctccgtcatcgtcatcggcctgggcgctgccgcgttcgcggtcggacagacgtacgtcacgctttccttccgccgcggcttcgcggccggctgggccgtcggcaaccgcccgcgcgagagcggcggcagcaagcgccgccggggcgaggcagcgcgtcaggagccgacgctggaggtcaccgacctacagccgacggctgccggaacgtaccgccgggaggaggcgtacgacccggaccacgacgatgtgttcacccgcccgcagcccgccgaggccgcggccgagagcaccgccgtgtacgagccccagcccctgcccgacgacaccggttcgtacggcgtctacagcgacgccgcgtacgcggccgcgacggacccgtcctacgcggccgcggcccagacgccggaccagaacttcgcgtacgacggctacgcgggctacgaccagcagcagtacggctacgacaacggccagcagcagtacgccgcctactccgacccgtacatcggcacgcagacctacggcggcggctcctacgacgcctcgtacggcggccagcagcagtacggtcagcaggcgtacggccaggattcctacgccaccggcacctatggcggcgagactccgccgggtggcgtctgggtgccgcagcagcgcaccaccgacgacgcgtacggcggcgaactcccgcccgagcagccgtatccgtaccaggggaacggtggcggggacggcaacgcgcacgggtacgacgagcagtaccggttctgagccggtcccggctcagagcgggcgggagcacgtgtgccgagggcccggcggtgactgccgccgggccctcgcgcgtggtccgacgccttacggggagccggtcactgtgagccccggaagtccggtccctccacgatcagtccggccaccagcgcgcccgacatgcccgcgtgggggaggccgccgccggggtgggaccagccgcccacggtgaacagcccgggcatacgtgtggtgttcgccgggtgcagcagacggccgtccgccgcggcgagggccggcgccgggatcgcgccgccgggcgcaccggtggcctgcgcgatgtcgtccggcgtacgggtctcgtgccagaggaggcggtcgcgcaggtcgggtatcgcgcgctcggcgacccccaggatccggtccacgtcggactcggtcacgcgcagacccgagggcgccgggagggtcagggtgaccgcctcgtgcccaccgtcgggaaccagcccggggtcgtcggggcgcagcacggtcagcgtgggcgtcgccgggagtcccgcgggctcgccgaagagccggtccaactcgccctgccggtcggtggtgtggacgaccgtccggtgcgcggtgccctcggggcgtgtgccgcgcagcgccagcagcaccgtcagccggctcggcaccccgcgccgcggtccgacatcgccgtcaccccgcaccgccctcccggcggtgaggcggtccaggacgccgggtgcgacgcccgccaccacatggtccgcctccgcgaccgtcccgtcggccagctccagccctgccgcccggccgtccttctcgacgatcccggtgacctccgcgccgaagacgaactcgaccttccgggccaggcagcgctcgtggaccgcgcgggccaactcccgtatcccgccgcggacgtaccaggtgccgaaggcgtgctccatgtacggcagcaccgccgcgctcgccggggtgacccgggggtccaggccgtaggccagcgcgtggctctccaggagcgaggcgagcctggggtcgcgcagctcccaggcgccgatgtccgcgagggtgcccgcccgccgggtgcgcagcagccgcttgtgcggcaccgccggataggggtcgcgctcggccagcacctcccagttcggccacaggggctcttccaggagcggtcggcgcgtccggtcccaggcctcgcgggcccggaccaggaagtcgccccagcgtccgccggcgcccgctccgagggcctcgtcgagcgcggtgacgactcccgcgcgtgaggcgttcggcagcgaggccgcggtgccgtccgcgaagacatgccgcgacgacggatccacctggaccagctcgacgcacgcctccagcggctccttgccggtcttgacgaacaggtcgcggtggaccgcgggcagcggcagcagccccgggcccgtgtcgaagcggaagccgtcgcgtgcgaagcggcccaccgctccgccgtacgtcgccgcgcgctcgtacaccgccacccggtggcccgcgacggccagccgggcggcagccgccatcgcgcccatcccggcgccgatcaccgcaatccgtgccatgccagggactttatcggccgccaccgacaatcccgtccggggaggtcagccgggcggtcccagccgccgcgccagccgtctctcctcccgtcgctgggccctgcgccttaggaaccgtctgatccgcgagacgaggaagaacagcgtcagcagcccgaggagcagcagcactccggcgatgacggcggccgcctccggatggaacatcgcgaacgtgacgatcccgccgaccccgagatcctcggccacgctcatgatcacgttgctgaacggctcgggcgaggcgttgatcgccatgcgggtcccggccttgacggcatggctcgccagcgcggtcgacccgccgatcgcgcccgccgccacatcggagagcgagccgctctgcccggcgagcagcgcgcccacccaggccccggcggccggccggatcacggtgtgcgccgcgtcccatgccgagtccacgtacgggatcttgtcggcgaccgcctcgcacaggaacagaaccccggcggtgatcaggacctcagggcgctgaagggactcggggacgtcgtcgctcagaccggtcgcaccgaagacgccgaggagcagcaccaccgcgtaggcgttgatgccgctggcccagccgctggtgaagaccagggggagtacggacacggacgcgatcgtaaccagtcggcaacagcacggcctgggcatgagtgcgtacgactgagtacccgtacccagggagtgagatgagtacgcgcgcggatgagctccgacctgcgtgaacgagagagtggagacacggaaaggggcgcggctccggtaccgccgacacggggcggcggaacggatcccgcgcccttggccgctccttccgccgacctgtcggcgggagcgagacacagggggacccgggagagaccacctgggggacacagcgggggaagtacgggggagcacggggaaaagtacgggggaagtacgggggagcacggcgaagcgccggttcgaggtggcccgcgggggacgcggccacatcgaaccggcgctttcgtgtgggccggcggccccaggtcagcggctgccgctgacgcggccctggagcagccgggacagtgccgcgtggacatcgtccaaggagcgttccggctggaaggactgccagtccagggcggccaccaggaccatgccgaccagggcggccgccgtcagctggatgtcgatctcgtcgctgagctcgccgcccgccacgccctcgcgcagcacgtcctcgacgaccgcgacggcctcctgcctgaccaccatcagggtggactgccatgcccggttggtacgccacagctcggccacgtacagctgggtgaaggccgggtagcggtcgatgaagacgagtccggcccggatcatcgcgtcgagggcgtcgaccttgctgccgccctcacgcgcggtcttctccgccgcctcgcggagggaggcggtgaggagtcccacgccgtgccgcagcaactcctcgaagaggacggacttgcttgcgaagttgtagtagaccgtgcccttcgcgactccggcgcgctcggcgatctcgtccaccgtggtggcggagaacccctgctccgcgatgagggtgacggccgcctcgtagagcttctgccgggtcgcctcgcgacggccgccgcccgccgtggcggtgccgccgtgcttggtcttgctgctgtccatggcgttgattgtcacaggaacagtcgctcgcacggtcacaggctcagctccgggtgcagccggtcgagggtccacacctgcttgcggcgcgcggacagggcggtgagcgcgagggcgcccgcggtgaaggccaccagcacggcgcacgcctgccagacgggacccagaccgccaccggagatgagcctgcgcagggcctcgacgacgtaactcatcggcaggaaggggtggagcgcgttgaagaagcccggactggtctgcacggggtaggtgccgcccgcggacgtcagctggagcatcaggagggcgaggacgaggatccggcccgccgctccgaagcgcgcgttcagccactgcacgatcgccgcgaagcacgccgtcaccaggaacaggaagcccaccgtcccggccgcccgcgccatctccaggccgatcgcccagtgcagcaccgacatgagggccgcggtctgcagcacgcccacggcggccaccggcagccagcccgcgagggcgatccgccaggccgaggagcccgccgcgagcgcgcgccggttgagcggctggatcagcatgtacgccaccatcgcgcccacccacagggagagcgggatgaagtacggggcgaagccggtgccgtagttgggcgcgttgtgcaggtccctggaggcgagctgcacggggtcggccatgacctgggtgcgtgcgtcgcggtcctgcttgtcgtagtcggggatctggtcggcgccgtcgtgcaggccgccggcgagcttcccggagccgtcgacgagcttgtacatgcccccggtgaggtcggtcgcgcccgtctgcagcttgccgacgcccgtgtcgaggtccgccgcaccggtcttggccgtgccgagcccggtgtgcagtgttccggcgcccttggcgaccttggcggcccccttgttgagggcgtcgaccttggtgacggcgtcgtcgaggtcctcggagagatgcggtgccgccttggcgagggccctggcctggcgctgaagggtcaccaggtccttttcgagggcggtcatgtcgccgtggtagtcctgcaccaccgtgttcacgtccgcggtgagccgcgccgcgtccgccgcggcgtccttcgccttcttgaggtcgtcgcacgccgggtcgggcacgagctggttctcgcagcgcctttcgtagacgccgttcagcgtctcggacgctttacgggtaccgctctctgccagcggggcggtggtgacgaaggcgtcgaggtgcttgcggatgacgcccgcggaatcggccaccgtggtcgcggtgtcggcgatcgtccggccgttgttcttcaagaagggccgcacctggtccgccgcgccgccgaccttgtcggccagcgcctgcgtgccgcccgcgacctggcgtgcaccgtcctggaggtcacccgcgcccgtgtcgagcttcttgaggccgctcgacagcttcccgctgcccgccttggcgtccttcaggccgtcggcgaggtccttggagcccttcttggccttgccgatccccccggtgagcttgtcggcgcccttcgccgccttctcggtctccccgtggatgtccgagaaggagatgaagatcttgtcgaggaacgagcgggacgccttcgtggacgcggccgtgcgcacctcgctgaacaccgtccgcgagatctgcccgacgatgtagttgttcgcgtcgttcgtgcgcacctggagagcgcccgtctcgggggagtccccggagctggaggcgatccgcttgctgaagtcggacggcatggtcagcgacaggtagtacgtcccgtcctccacgcccttcctggcctccgcggcgctcacctcgtgccactggaaggtctcgctctcgcgcagtcccttggtgatgtcgtcgcccgcggtgaccttcttgccggcggcggtcgccccctggtcgtcgttcacgagcgccacggggatgcggtcgagccggccgtacggatcccagaacgaccacaagtagagagcgccgtacagcaggggcagcagcatgagcgcggccagcgcggcgcggggcagcttgcccctgccgaagcgcctgagctcaagcgcggccagcttcggggagcgcatccgccgtctccttgtcgttcgtctcgagcgtctcgggtgtcttggaggccgcgtgggtctcgtgggtctcgtgggcgtcgggggtcccgtgggtgggctcggcggcctgccgggtggacaccacgacggcacccgccggggcttcgctgcacaccgccacgaccgtggtcccggactcggtgagcgaggtcagcagggtccagacctcggcccgttcggcgtccgagagcttgaggtcggtgtcgtcgacggccagcaggcgcgggcggccgatcagggcgagagcgatggacagccgcagggcctgaaggcgttccaagtcgcgtacggcggtccgggagcccttgggcagcgcctcccggtcgagtccggcggcggccagcgcggtgtcgatccgcagcttcgcctccgtcgtgcgctccgcacgcggccgcagcagcccgcgcagcgaaccgccgtagcgtcgctccagcaacgcccgttcgccgaggtgctccccgacggtcagggccggatcgaggtcggtgacgccggggacatgggccggcgcgctgatcaggcgtacggccgacatctgcttcggcagtcggagggagccgaccgtggcgtgcccctcggtgggcttcatgcgtccggtgagcgccagcagcaggcaggtccggccggacccggagggcccctcgacggcgatcagcgaaccgggcgcggcgtcgaagccgacgccgcggaaggcccagccgcgcggccccttcagcccgaagttctcggcgccgacggcgatcccgacgggtgcccttggcccgtcgaggccgccttgtgtgtccgcctgtgtgtccgcctgtgtgtccgttcgtgcgtccgcgtctgcgtccgcctgcgtgtcccgctgggtgtctgccggcctgttctcccgcatgtccccctccacgcccccttccacgtcccccgtcacgtccccggccacgtaccctccatgccccctttgatccgccatcgctgccctgcggcggcggtctggtcgggggccccatttttgaactgactggtcagtgcaaaaactaccccgaacccttgagcgatgcaaaagcccaggtcagatcggattgtcagtggcatacctcacgatgggcacatacggccacagtgccgtcacgcagacgacaggaggttcgtcatggccagctccaacgcagccgccgcccgtcggcgccgcgcccccggccctgcaccctcactgaccggccaggcgggcgatgtgcaccccgtgctgcgccgggccacggccccgcccgccgccctcgacctgcttgcccaggcccgcgccggtctcgaagaggcgaccggcctcgacatggccaacgagcggtatgccacggcgcatctggcagccctgcgcaccgctgccgccgtactcgcggcgcgggcgcgaccggagccgaacgcgcgacgccgcgccaggatccggagcgcctgggaagtgctccccgagatagcgccggaactcagcgagtggagcgcgctgttcgcctcgggggcgggccgccgcgcccgcgccgaggccggcatccagggcgcggcgagcaaccgcgacgccgacgacctgatacgcgacgtggcgatgttcctccgcctcgtcgagcggatgctcgtcctccagccggtcctgccccagccacgccaggacgacgaccggggtgaccgggaggtgccggacgcggggtgaacccggacgcggggtgaacccgggccgggccggtggcgtaccggcccggcggcgtaccggcccggttcgggacggggtgacgcacggcgcgcggcccgccgtgcggggtaaccgaacggcgcacgaatgacgcgcggtccgccgggtggttcgctgcgtggacgggggcgctgggcacccggccggaggcaatagggtggaggcgcctgaagccttccgcctggtaccgaggtcggaaggcaccccgaatcgctccgccgtacagaaggcggtgccgcgccgaggagtcaactgccgtgtcggacccgatgcgcccccgcgcttctctccgtaccgccgtggtctgggaggtcctcaaggacgccctcgaccgccgcgtcaaggccacggggcgggacgcgctcgacgtcctcgacaccggaggcggcagcggcaacttcgcggtgcccgcggcccgcctcggccaccgcgtcaccgtcgtcgaccccagccccaacgcgctgttcgcgctggagcgccgggctgccgaggccggcgtcgccgaccgcgtgaagggcgttcagggcgacgcccacggcctcttcgacgtggtcgagcgcggcggctacgacgcggtgctctgccacggcgtcctggagtacgtggacgatcccgcggagggcgtccgcaacgcggtggccgcgctgcgtcccgagggtgtcctcagcctgctggccgccggactcggcggagccgtgctcgcacgcgccctcgccgggcacttcaaggaggccaaacaggcgctggaggacccgaacggccgctggggcgagggtgaccccgtgccgcaccgcttcaccgtcgagcaactgaccgctctcgtcgagggcgcgggcctgcgggtcggggccgtgcacggcgtccgggtcttcgcggacctggtccccggcgtcctcgtggacaccgagccgggagccctggacgcactgctcaagctggaggaggcggcggccgagttccccgcgttccactccgtggccacacagctccacgtactgggtgagacgcaggcggcggccgacgcctgagccgcctccctgacgcgtcgctgatcagggccttggcggcagatggagtacgccacaggccccccgatcgggcggtgcgcgccgtatgatcgggggagaccgtccggcatgacgggtcggccgctggggaatgcaagcttcagcgagtcggaacccgtcatggcggtttcggttggccaattggcgtagaggggcgggtttcaagggggcgattccctgcctatcctgaaggggacccccagtcgccccggcgactgcacgatgaggaggactccgtgccgctctcggagcacgagcagcgaatgctcgagcagatggagcgagcgctgtacgccgaagatcccaagttcgcgacagcgcttgagggaagcgggctgcgtacgtacacccggcgacgggtttaccaggcggtcgcgggcttcctggtgggtatcgcgctcctcatggccggaatggtcgcacagcagatctggatcagtgtggtggggttcctcgtcatgctgggctgtgcggtgctcgccgtcaccggttggcgcaaggcccccaagccgggtgagcagtcggccgccggtgcgcccggggcccgccgacagccgcgccggcgccgctccatgatggaccgcatcgaacagcgctggcagcgccgtcgcgacgagcaaggccactaggccctccgggcggcagtcgaagacatgcgtaaggggtgaccacccacagcaggtggtcaccccttacgcacgccctgagccgacctccaacggccccccgcacggtccctgccgcagccgcagccgcagccgcagccgcagccgcagccatagccggggcaccgcagcagccacatccccgcagcctcaccagtcctccgcagtttccgcgggcccggggtgccggcggagccccacagccagcccaacagccaacgccgccccccgccccggccacccacgcgaacgccccgcccgccgggcgaacccgggcggacggggcgtctgacatgagccggttcaaacggccgtgccaatcggcagtgccagtcagccgttcagccagccgttcaaccgttctggctcgacggccgtctcggcagggtcggccgacgggccgccaggttcgtcctcagcgccgtccagcggtcggacaccgcccaggccatccggacagctgaacgcggcgccagcagagcacgcaggcgtgtcgggcggctcaccgtggagttcagggcactcccgacgaggcgggcgtcctccgccagccccgccgtcgggcgggggcgcggcgcgtacagaacctgttccaccgccgccgccagccggtgcaccgctgccgcggccgcgggatccagatgaccgagacgggcgatccgggccgcggccttgcgcggtgtctgggactcgtccggcgcgatcccgtggtcccacgccgtatcggtcacctcctgccaggccgccagggcgtgggccgccgcactctcctccgtacggccgtgcgtaccgagccgtacggcccgcacccgcatccgccacagcatcggcaggaacggcagcaccagcaccacgagccccaccagggtccacagcaggatcccgtaccacggcggaccggcgtcgcccgagcccgccacggcctgcgccgactggctcgggcacgcctccagcttccgctcctgggccgagcagctcgcactcgccgacggcgcggccgacggtgcggcggacgccgaccgcgtcggcttcggcacatcgggactgtcaccggacggggtgtccgactgcgtgtacgtcggcgtcgtcccccggttcggggtcggctcgaagcgggtccagcccacgccctcgaagtacagctcgggccaggcgtgcgcgtcccgcagccccaccgacatcgagccgtccgcctgcggcgagcccggagtgaagcccaccgcgacccgggccggtatccccagcgtccgcgccatcgcggccatcgcgaaggagaagtggacgcagaagccctgcttctgcttcaggaaccgggcgatcgccgcggagccgctgcccgcctgcacctgggtgtcgtacgtgaacccgccgttcacggcgaagtagtcctggagcttgaccgcctgctcgtagtggttcgccgagccgtccgtgacctcgcgtgccgtcctggccaccacggccggcagcgagtcgggcaccttggtgaactcgcgcttcagcgccgccggcggctcgggtgacagggcgagctgttccgcggtcggctgcacgatcaggctcttgaccgtgtactgcgcaccccgggtgttctggccgtggtcgccgacgagcgtgcgcccgatcggctcgtaccgccacttgcccttgatctgcacaccggtcgcggggtacggcatcggcagccagtcctgcgcgtaccagtccgccgccgagacacgggtctcgatctcggtccgccgtatgtcggtgccgagcccgatcggcgtctggaaggtgtccggcaccccgacgatgtgccgctgggccggcttccaggacgtgccgtcgaagtcgtccagggagacgatccgcagatacatgtcccgggtgttctcggtgttggtgcggtacgacatgacctggcggtcctgatccacgttcagactgtcgcgcagcgacaccagcgggttcaccgcggagatcgtgccgccgtcgccggtcccggcgcccacgccggtcctggcaccgtccagcagcccgccgtcgagcgcgggcaggccgagcggcacgatcagggcgacgcccagcgcgaccgcgccgatgcgccggccggtgcgcacgggtgccacggcgccgccggagtcggtgcccggcgcccgggccgcgccgccgaagacgcgcccccactgggagaggcggtcgcggccctcggccagcagcagcatcagatagcccgcggccgcgaccacgaaccacagccagtcggccgcgccgtcggacagccccgcggccaccgagtacagggcgagcagcggcagtccggccggggccgcggtgcggaacgtcaccgccagcgcgtcgaccgcgagcccgatcaccaggacgccgccgaccatcatcagccggatcccgggagacagcggcgcgggtatcgcgtaacgcccgacatcgtccgtgcccgactggagcaactccccgaagcgttggaagacgtccggcccggggatgaagccggcgagggcctgttcccgggcgaacgtcagggtcagcagcagcagggtgaccagcacctggcaggcgatggtcagcggccgggccagtgggacccgccgggtcagcgccccgaccccggtctgcaccgccaccaggaacgccgcctggaagagccaggtcggcggatcgaccagcggcagcagcgcgcacgatgccatcagcgtcgccgccgcggcacacagcgccaggcgggcgcgcccgctcatgaccgtccctccgtaccgcttccggcgccgatgcccatgcgctgtcggtccgcctggcgccacaggtcggcgagtccggctccccgtggcaccttcagcgccgtccagcccgcctcgcgcagcatccgcagccgctcctcgctcttgtccaaggggcccggcacatcggccgcctcgcgcacccagctctcactgtccagcaggaacgccaccgccccaccgctgcgcgggcgcatcttggcgaccaccgtggcctgttcctcgtcgaggtcgccgaagaaggcgaccagcaggccctcgttgcccccgcgcagcacgtcgtaggcgtgggacaggcccgtgccgtccgagtggtcgatcaccgcgagggtgtccatcatcagtccggccgcgtcggccgactcctggctcgcgcccgcgaacccgtcggccccctcggcgggcaccgaactgccggtgtccgtcagcagccgcaccgagaagccccgttcgagcatgtgcaccagcgtggacgccgcacccgagaccgcccattcgaacgccgagtccgggcccgcgccctggaaggcgaggcccctggtgtcgaggaacaccgtgcagcgggaccgctgcggctgctcctcacggcggaccatcagctcgccgtagcgcgcggtcagccgccagtggacccggcgcagatcgtcaccgtgccggtacccgcgcgggatcacgtcgtcctcgcccgccagcgccagtgcgcgctgccgcccgtcgccgtaccccttcgcctcgccgctcagccgtacaggcggcagcggctccacgcgcgggatgaccgtcagggtgtcgtacgtcgagaaggagcgggtcagctcgcacatgccgaacgggtcggtgagccgcagctggagcgggcccagcgggtagcggccgcgcagatcggagcgcacgcggtaggacacctcgcggcgcccgcccgcctccacccggtccaggacgaaccgggggcgcggcccgagcacgtacggcacccggtcctggagcatcagcagtccggtgggcagccgcgagacgttgtccatccgcagatggacccgggcctcggaaccggcgggcacgcgccccggggacagccggcggctgcccgcgacccggtagcgcgtgcggtacagcacggtcgcgcacaccagcggcagcacggccagcagcagaccgacccggagcagatcgctctgccccaggacgtaggcgcagatggcggcagcgatgccggcggccaggaaggagcgcccgcgcgtggtgagaccggcgagggccgtgcgcagcccgcccttgtcctcctcgggggtgggggccggcgccccttgcgtcatcacagcctccggggtggctgctggccgaaggcgccacggcccgtggtgaagcccgcctgctgctggggcgtcgccggcacggcggtgcgctgaaggatctcctggacgacctgttccgccgtacgacggttcagctgggcctgagcggtgggcagcaggcggtgggccaggacggccacggcgagcgcctgtacgtcgtccggcagggcgtactcccggccgctgagcgcggcggacgccttcgccgcgcgcagcaggtgcagcgtggcccgcggcgaggcgccgagtctcaggtcggggtgggtgcgcgtggccgcgaccaggtccaccgcgtacctgcggaccgactcggcgacatggaccgagcgcaccgcgtcgaccagcttcacgatctcgtgcgcgtgcgccaccggctggaggtcgtccagcgggttcaccccgccgtggatgtcgagcatctccagctcggcctcggcgctcggatagccgatggagacccgggccatgaagcggtcgcgctgggcctccggaagcgggtaggtgccctccatctcgaccgggttctgcgtggccaccaccatgaacgggctcggcagctcataggtgtgcccgtcgatcgtgacctggcgttcctccatcgactccaggagcgcggactgcgtcttgggcgaggcgcggttgatctcgtcgccgatcacgatctgcgcgaagatcgcgcccggcttgaactcgaattcccggcgctgctggtcccagatggacacacccgtgatgtccgagggcagcaggtcgggcgtgaactggatacgccgcaccgagcagtcgatggaccgcgccagtgccttggcgagcatggtcttgccgacgcccgggacatcctcgatcagaagatgtccctcggcgagcagcacggtcagcgaaagccgtacgacctctggcttgccttcgatcactccttccaccgaactgcggacgcgctccacagtggcggtcagatctgtaaggctcgctcgatcgtcataggtcgtcacccggccctcctcggcccgttctttctccgggccgacgctctgcgatgcggaccggcccaccccgaaacacggacaccacgcgcatagttccgcgtgacgtcacacccgcattcttgttgccgttaccggttcgtgtcactcgcctgtggataactggccgcgatatgccggacttacgacctattgcaatgccgggaccggggctttttccgtgacgagagtgccctgtggggcgccggcaggacggctaggcggggtcgatctcgcgcagccggcccgttttcacgtcgaagacgaagccgcgcacgtcgtcggtgtgcagcaggaacggggaggtccgtacgcgctgcatggactgccgaacgtcctgttcgacgtcccggaaggcctcgaccgcccaggccggacgctgtccgacctccatctccagctcgtgccggaagtcctcggtgagggactccagaccgcagccggtgtggtggatgaggaccacgctgcgggtgccgagcgcccgctggctgatggtgagggagcggatcacgtcgtcggtgaccacaccgcccgcgttgcggatggtgtggcagtcgcccagttccaggccgagcgcggcatgcaggtcgagccgggcgtccatgcaggcgaccacggcgacgtgcaggacggggcgcgcgtccatgccggggtcggagaacgcggcggcgtaccgctggttcgcgtcgatcaggcggtcggtcacggtgccgtcggtggatatggcgtcttcgggttcagtgggaacggatgcggaagtcgtcatacctatgacggtactggtcacctgcggtcggggcgcgctgtgagtggggacaaagaacgccatcgtgacgtgttgtgaggtaacccacacgaggggttgctcagtgcccgtatgggtgattgccatggatttgcggcttcgccggggcgggggtacgcgacgcgcaggccggttgattgaccggaagacagggtggactaaagtgacgcgaagtgggaggcgaggcgctctccctgcggattgttcaccccaggagacctcggccatgtgccggaatctccccgcgtgcgcggcgcgtacgtacggctcggcctcctcccgctccggtccgctgacgcttccggcgccggcaggcctccccgtcaccgggggcacctcccagcgtcagccgggggagggcggggacccggcggtgcgtgcgccccgcgccggacctgagagggccccttgagccagagtcgacacgtcccggtcatgctccagcggtgcctggacatgctggccccggccctcaccgagccaggagccgtcgtcgtcgactgcacccttggtctcggcggccacagcgaggcgctgctgacgcagttccccgaagcccggctcgtcgccctggaccgggacaaggaggcgctgcgcctgtccggtgagcggctcgcccccttcggtgaccgcgccaccctggtgcacgcggtctacgacgagctgcccgacgtactcgaccggctgggcgtgccccgcgtccagggcgtcctgttcgatctcggcgtctcctccatgcaactcgacgaggccgaccgcggcttcgcctacgcccaggacgcccccctcgacatgcgcatggaccagacgaccggcatcagcgccgccgaggtcctcaacacctacccgccgggcgagatcgtccggatcctgcgggcgtacggcgaggagaagcaggccaagcggatcgtctcggccatcgtgcgcgagcgcgagaaggagccgttcagcaacagcgcgcggctggtggaactgatccgtgactcgctcccgcaggccgccaagcgcaccggcggcaaccccgccaagcgcaccttccaggccctgcgcatcgaggtcaacggtgagctgtccgtcctggagagggcgattcccgcggccgtgaaggcgctcgccgtcggcggcaggatcgccgtcctgtcgtaccactcgctcgaagaccgcctggtgaagcaggtgttcgcggccggtgccgccaccaccgcgccgcccggtctgccggtggtccccgagcgctaccagccccggctcaagctcctcacgcgtggtgccgaacttcccaccgaggaagagatcgccgagaaccggcgggccgccccggcgcggctgcgcggcgcgcagcgcatccgcgaggacgccgagtgagtcgtacgacatgagacgaaggggagggcgcgtgagcgggaaacctcaactgaagggccgggccgcgcggctcgcgcggctcttcccggccggcgcgggacaggccgcccgcgcccccttcgtcctgctggtcgtcctgctgctcggcggcggactcatcggcctcctggtactgaactccgcgctcagtgagggctcgttcaagctcgacgacctccagaaggagacgaagagcctcaccgacgaggagcaggcgctccagcgggacgtggacgcctactccgcccccgacgccctccagcgccgcgcccgcgaactcggcatggtccccggcggcgacccggccttcctcgatcccgacggcaccgtcaagggcgtcccccgagccgccgggcagtcctcgctgcggacctcggcggtgcgcccgcccgaggtcctctccccgtacccggcgccgccgcccgcgcagtcgcaccccctcggcgcacccgccacgaccacccagcccgcactcccctcctcgactaccggcaggtgacggaagtgtccgacagggaaccgccgcgccgccgcgtgcccggacccgccaggcccgtacgccccggcaaccagcgccgacccggcccgggcgcccgccccgcgcgccgccccgccccgtcccgcggccccgccccgcgcacgatccggctcggcagcccccggccccggctgcgcatggtcagcctggcgctcaccctggtgatgatcgccttcgtcgtacggctgctccaggtgcaggccgtcgacgcgagcacgtatgccgccaaggccgacaagaaccggtacgtcggccatgtcctgaccgccgagcgcggcggcatcaccgaccgcgggggagtggcgctcgcgatcagcgtggacgccaacgacatcacggccgaccccacgatgttcacccgcaagcagctcaagatcgacgacggtcccgagcaggccgccgcgctcctcgcgccgatcctcggccaggaccaggcgacgctcaccgagaagctcaggaccagcaacacgcagtacgtcctgctcgcccgccgtcagaccccccaggtctggaagcagatcaaggacctgaagaccgccctcaccaaaaaggccgagagcgacgggagcaccgtgaacgtcctcgcgggcgtcttccaggaccccagcagcaagcgcgtctatccgaacggcgacctcgccgccgggatactgggctgggtcaacgccgagggcaagggcggaggcgggatcgagcagcagctgaacaaggagctcaccggcaaggacggcaagatccgctacgcccagtccggcggccgtctggtgcccaccgcgggctccaccgagacccccgccgtggccggctccgacgtcgagctgaccatcgaccgcgacatccagtgggccgcgcagaacgccatcaccgagcaggtggagaagtccggggcggaccgcggctacgtgatggtgcaggacaccaggaccggcgagatcctggccatggccaactcgcccggcttcgaccccaacgacctgtccaaggccagctcggcggccctcggcaacgcggccctccaggacgcgtacgagcccggctccaccgccaaggtcatgtccatggccgccgtgctggaggagaacgtcgccacacccgagacacatgtcgtcgtgcccaaccggctgcaccgcggcgaccggctcttccaggacgacatcgaccacccgacctggaacctgacgctcaacggcgtgctcgccaagtccagcaacatcggcaccatcctggcggcgggacagctcggcaagacgcagaagcaggccaacgaggtcctgtactcgtacatgcgcaagttcggcatcggcctccccaccgggctcggcttcccgggcgagacctccggcatcctcgcgccggccgccaagtggtcgacctcgcagcagtacacgattcctttcggccagggcgtgtcgatcaacgcgatgcaggcggcctccgtctactcgacgatcgccaacggcggcgtacgcgtcgagccgacactggtgcgcggcaccaaggggcccgacggacgcttcactccggcgccccggcccaagaagaccagggtcgtgagcgagaagacggcgaagaccctcgcccagatgctggagtccgtcgtggacgacgaggagggcaccggcgccaaggcccgtatcccgggctaccgggtggcgggcaagaccggtacggccaaccgcgtggatccggccaccggcaagtaccacggctacacctcgtcgttcgccggattcgcacccgccgacaacccccggatcaccgtctactgcgccatccagaacgccacccagggcagctacttcggcggccagatctgcggtcccatctacaaacaggtcatggaattcgccctcaagaccctccaggtcccgcccaccggggccggggccgcccatctgcccgtcaccttcacaccgtgagcggcacggaaacagaccaggaaccagctcgtgacaacgatcacccccgggcccgggaaccagggctcgccacgcccctcacttcgctccgccgggggtgcgcccggtacgctcaccgccgtgccacacgctgatcagtcccaaaccacccaaaaaggcgctcctgtgacatatccagggccgccccgaccggctcatgtctccgccacacccctcgcggaactggccggtcagatgggtgccgccacgccggagcgcgacgccgaggtcacggggatcacccacgactcgcgcgccgtccgccccggcgacctgtacgccgccctgcccggcgcccgcctgcacggcgccgacttcgtgacccaggcggccggcctgggcgccgtggccgtgctcaccgacccgacgggcgccgatcgtgccgccgccaccggtctgcccgtgctggtcgtcgacgacccgcgtggccggatgggcgagctggcggccacgatctacggccacccggggcgcgacctgctccagatcggcatcaccggcacctccggcaagaccacgaccgcctacctcatcgagggcggtctgaggacggtccgcagcaccgggctgatcggcaccgtcgagatgcgcatcggcgacgagcgcatcaagtccgagcgcaccacccccgaagccaccgacctccaggccctgttcgcggtcatgcgtgagcgcggggtcgacgcggtcgccatggaggtctccagccacgcgctggtcctcggccgggtcgacggctgcgtcttcgacatcgccgtcttcaacaacctcagcccggaacacatggagttccactccgacatggaggactacttccgggccaaggcgcagctgttcaccccgcaacgcagcaaactcggtgtggtcaacttcgacgacgagtacggccgcaggctggtcgaggaagccggcgtcccgatcgtcaccttctccgccgagggccatcccgacgccgactggcgcgcccaggacgtcgaagtcggccccatggactcgacgttcaccgtgatcggccccaaggaggagcggatcacggccaggtcgccgctcgccgggcccttcaacgtggcgaacaccctcgccgcgatcgtcgccctcgccgcggccgggctcgacccgcaggccgccgccgacggcatcgccgcggtgccgggcgtgccgggccgcctggagcgcgtggacgtgggccagccgtacctcgcggtcgtcgactacgcccacaagaccgacgccgtcgaatcggtgctgcgcgccctgcgcaaggtcaccgagggcaaactgcacatcgtgctcggctgcggcggcgaccgggacagaacgaagcggatgccgatgggcgccgccgcggcccggctcgccgacaccgccgtactgacatcggacaacccccgctcggaggaccccctcgcgatcctcgccacgatgctggcgggcgccgccgaggtgccctcgcacgagcgcggcgaggtccaggtcttcgagaaccgggcggccgccatcgcggccgtcgtcgcccgcgcacggccgggcgacaccgtgctggtcgcgggcaaggggcatgagcagggccaggacatcgccggtgtggtgcgtcccttcgacgaccgcctggtgctacgcgaagctatccagcagacccagggatgaacttgtgatcgccctctctctcgccgagatcgcagcagtcgtcggcgggcagacgtacgacataccggatccggcggtacaggtcaccggaccggtcgtccgggactcccgtgaggtggagtccggcagcctcttcgtcgccttcgccggtgagcgcgtggacggccacgacttcgcggcagcggtcgtggaagcgggcgccgtcgccgttctggcgtcccgccccgtcggggtgcccgcgatcgtcgtggacgacgtccagacggcgctcggggccctcgcgcgccatgtcgtggagcgcctcggcgcgaccctcgtggcgctcaccggctccgcgggcaagaccagcaccaaggacctgatcgcccaggtgctgagaagcaaggcgccgacggtcttcacgcccggctcgctcaacaacgagatcgggctgccgctcaccgccctcagcgccaccgaggagacgaagttcctcgtgctggagatgggcgcccgcggcatcggtcacatccgctacctcgcggatctcacgcctccgaaggtcggtctcgtcctcaacgtcggcaccgcccacatcggcgagttcggcggccgcgagcagatcgcgcaggccaagggcgagctcgtcgagggtcttccgccggcggaggacggcggcgccgcgatcctgaacgccgacgatccgctcgtccgcgccatggcgtcccgcacgaaggcgcgcgtgatcctcttcggagagtccgacgaagcggacgtacgcgccgagaacgtccgtctcacggccggcggacagccctcgttcagccttcacacaccctccgggtgcagcgatgtgaccatgcgcctgtacggtgagcaccacgtgtcgaacgcgctcgccgcggccgccgtcgcccatgagctgggcatgtccgcagacgagatcgcccgtgcgctctccgaggcgggctccctctcccgttggcggatggaggtcaccgagcgcccggacggcgtgacggtcgtcaacgacgcctacaacgcgaaccccgagtccatgcgagccgccctgcgcgcgctcgcggcaatgggcaaggggcggcggacctgggcggtgctcggcaagatggccgagctcggggacgaggcgctcgccgagcacgacgcggtcggacggctcgccgtccggctcaatgtcggcaagctcgtcgcggtcgggggcagggaagcgtcctggctgcaactgggcgcatataacgagggttcgtggggtgaggagtcggtgcacgtgtccgacgcacaggcggctgtcgacctgttgcgcagcgagctgcgcccgggggacgtcgttctcgtgaaggcgtcccggtcggtcgggctggagagcgttgcacaggcgctgctcgagaccggtgccgagggtgaggttgtcgcccgatgatgaagcagatcctgttctcaggagtcattggtctcttcctgaccctggtcggcactccgctgctgatcaagctgctcgcccgcaagggctacgggcagtacatccgtgacgacggcccgcgcgagcatcacagcaagcgcggtacgccgaccatgggtggtatcgccttcatcctggcgacgatcatcgcgtacttcatgtccaaggtgatcacgggctacacgccgaccttctcgggtctgctggtgctcggcctgatggccggcatgggcctggtcggcttcctggacgactacatcaagatcgtcaagcggcgctcgctcggtctgcgggccaaggcgaagatggccggtcagctgatcgtcggtatcgccttcgcggtcctcgcgctgcagttcgcggacaaccacggcaacaccccggcctccaccaggctctccttcgtggaggacttcggctggaccatcggcccggtgctgttcgtgatctgggccctgttcatgattctcgccatgtcgaacggcgtgaacctgacggacggtctggacggtctcgccaccggcgccgcgaccatggtcttcggcgcgtacacgttcatcggcgtctggcagttccaggagtcctgcgccaacgcgcagaccctcaccaacccggccgcctgctacgaggtacgcgacccactcgacctcgcggtcgtcgcctccgccctcatgggcgcctgcttcggcttcctgtggtggaacacgtcgcccgccaagatcttcatgggtgacaccggatccctcgcgctcggcggcgcgctcgccggtctcgcgatctgctcccgcaccgaactgctggtcgcgctcctcggcggcctcttcgtcctgatcaccatgtcggtcgtcatccaggtcggctccttccggctcaccggcaagcgggtcttccgaatggcgccactccagcaccacttcgaactcaaggggtggtccgaagtccttgtggtggtccgcttctggatcatccagggcatgtgcgtgatcgtcggtctcggcctcttctacgcaggatgggcagccaagaagtgaccaactggcagggcaagaacgtcaccgtcgccgggctcggcgtctccggtatcccggcggcccgcgtgctgcacggcctcggcgcggtcgtcacggtcgtcaacgacggcgacgacgagcgctcccgggcccaggccgcggatctggaggcgctcggcatcaccgtgcgcctcggtgacggcgcgaccctgcccgagggcaccgagctcatcgtcaccacacccggctggcagccggacaagccgctgttcgccgcggccgccgaggcgggcgtcccggtctggggcgacgtcgaactcgcctggcggctgcgcggccccggatccgcgccctggctcgccgtcacgggcaccaacggcaagaccacgaccgtgcagatgctcgcctcgatcctgacggccgcgggcctgcgcacggccgcggtcggcaacatcggcgtctcgctcctcgacgcggtcctcggcgaggagacgtacgacgtcctcgcggtcgaactctccagctaccagctgcactgggcgccctccctgcgcgcccactccgccaccgtcctgaacatcgcgcccgaccacctcgactggcacggctccatggaggcgtacaccgccgacaagggccgtatctacgagggcaatcgggtcgcctgcgtctacaacgtggccgacaaggccaccgaggacctggtgcgcgcggcggacgtcgaggagggctgccgggccgtcggcttcacgctgggcacgcccggaccgtcccaactcggcgtcgtggagggcattctggtcgaccgcgccttcgtcgaggaccggcagaagaacgcccaggagctggccgaggtggcggacgtgcatccgcccgcgccgcacaacatcgccaacgcccttgcggcagcggccctggcgcgcgccttcggggtgcccgcctcggcggtacgggacggactgcgggccttccgcccggacgcccaccgcatcgcgcacgtcgccgacgtggacggggtcacctacatcgacgactccaaggccaccaacacgcacgccgcggaagcctctttggcggcgtacgggtccatcgtctggatcgccggcgggctcgccaagggcgcctccttcgacgagctggtggccaagtcggcacagcggctccggggtgtggtgctcatcggtgcggatcgtgcgctgatccgtgaagcccttgcgcgacacgccccggaggtacccgtcgtcgacctcgaccggaccgacactggggcgatgcccgcggctgtccaggaggcgcggcggctcgccgtcgccggcgacacggtactgctggccccggcctgtgcctcgatggacatgttcgccaactacaacaagcgcggtgacgcgttcgcggaggcggttcgcggactcggagcctgatccggccgcctcgccgggcgaccttgggagggacgcgtgacaccgctcaggcccggagacgccgatgcccactagccgtaccggccggccccccgtccagcgtgccaccaggcggcccgccgcgtcccgctcccggcgcgagaaccccgtacagagcctctaccaccgcgccaggcgcgcctgggaccggccgctgaccgcctactacctgatcctcggcagcagcctcctgatcaccgtgctcggtctggtgatggtctactcggcctcgcagatcaccgcgttgcagatgtcgctgcccggttcgtacttcttccgcaagcagttcctggcggcctcgatcggcaccgtactgctgctgaccgcctcgcggatgccggtgaggctgcaccgggcgctggcgtacccgctgctggccggcgccgtcttcctgatgatcctggtgcaggtgccggggataggcgtggcggtcaacggcaaccagaactggatctccgtcggcggcccgttccagcttcagccgagcgagttcggcaagctcgccctcgtgctgtggggcgccgatctgctcgcccgcaagcaggacaagcggctgctgacccagtggaagcacatgctggtgccgctcgtcccggcggccttcatgctgctcgggctgatcatgctcggcggcgacatgggcacggccatcatcctgaccgcgatcctcttcgggctgctgtggctggcgggggcgccgaccaggctgttcggcggtgtgctggccatcgccacgaccatcgggatcatcctcatcaagaccagcccgaaccgcatggcccgcctcgcctgcatcggcgccaccgatcccgggccgggcgaccactgctggcaggccgtgcacggcatctacgcgctcgcctcgggcggaatcttcggttccgggctcggcgccagtgtggagaaatggggccaactccccgaagcgcacaccgacttcatcttcgccatcaccggggaggaactcggtctggcggggacgctgtcggtgctcgccctcttcgcggctctaggctatgcgggtatccgcgtggccggacgcacggaggaccccttcgtgaggtacgccgcgggaggtgtgaccacctggatcacggctcaggccatgatcaacgtaggtgcggtgctcggtctgctgccgatcgccggtgtcccgctcccgctgttctcctacgggggttccgccctgctgccgaccatgttcgccatcgggttgctgatcgccttcgcgcgcgacgagcccgctgcgcgggccgcgcttgcgatgcggcaacctcgctttggtagaaagcgggctggaggtcctgcggggcctcggagatggaaaacgatgagacggcgtgcctcggcggcgcgttcgtccggagagcggtgaatttcggtgcatgtcgtactcgccggtggggggaccgccggccacatcgagcccgcgctcgccctcgcggacgccctgcgcaggcaggacccgaccgtggggatcacggccctgggaacggagcgcggcctcgagacccgtctcgtacccgagcgcggttacgacctcgcgctgatccccgccgtcccgctgccacgcaagcccacgcccgagctgatcaccgtccccgggcggctgcgcggcacgatcaaggcggccgagcagatcctggagcgcaccaaggcggacgccgtggtcggcttcggcggctatgtcgccctgcccggctacctggccgccaagcggctcggtgtgccgatcgtcatccacgaggccaacgcccgccccggcctggccaacaagatcggctcgcggtacgcggcccaggtcgccgtgtccaccccggacagcaagctgcgcggcgcccgctacatcggcatcccgctgcgccgctccatcgccaccctcgaccgggccgccgtacgccccgaggcgcgcgccgcgttcggactcgacccgaacctgccgacgctgctggtctccggcggctcgcagggcgcccgccggctcaacgaggtggtccagcaggtcgcgccgtacctccagcaggccggcatccagatcctgcacgcggtcggcccgaagaacgaaatgccgcaggtccaccagatgccggggatgcccccgtacatcccggtaccgtacgtggaccggatggacctcgcctacgccgctgccgacatgatgctctgccgcgcgggcgcgatgaccgtcgccgaactctccgccgtcggactcccggccgcctacgtcccgctgcccatcggcaacggcgaacagcggctgaacgcccagccggtggtcaaggccggcggcggcctcctcgtcgacgacgcggaactgacacccgagtgggtccagggcaacgtcctgcccgtcctcgccgacccgcaccggctgtacgagatgtcccgcgccgccagcgagttcggccgtcgggacgccgacgacctgctcgtcggcatggtgtacgaggcaatcgccgcacgccaccgctagggtctgtcccgcgggtcggcccgacgcgaggcggcggcgtccgaccggcggagccgagcggggtccggtgggtcaactgcgaggcggcggaggctgtgacgtcagccgccgccgcggcgaccgccaaagccgcggcagatgtactggcggaccacgcggcccccggcgggagccgcctgacgggccccaggaaggcatgagggaaggcagggagcgtggccggaccgacgaccgccgagcgcggcgaacggcagaagctggagtccggcccgccccggctgccccgcctgcggccccggccccgtacgttcatcatccttttgtgtgcggtggtgttggcgggcgccggatccgtgtgggtcctctacggttccccgtggctgcgcgtggagcgtgtgtccgtctccgggacacgggtcctgacggagggtcaggtgcgcgaagcggccgatgtgtcgctcggatcgcccctgatttccgtcggtatcgacgagattgaggcgcgattgcgccagaaattgccccgaattgactcggttgatgtcgtccgttcctggcctcatggaatcgggctgaaagtgaccgagcgcactccggtcctgattgtcgaaaactccggaaacgggggaaagtacgtcgaagtggacgccaagggagtgcgattcgcgacggtttcggacgctccgaagggcgtgcccgtgctggaattggccgtctcccggtcggcggcggccctgcggcgcttccccgaggcccggctggtgcgggaggcggtccgggtcgccggggacctcccggccgccgtcgcccgcgacaccggcaccgtcaaggtccgctcgtacgactccatctcgctggagttgagcggcggtcgcaccgtgatgtgggggagcggcgagaagggcagcgcgaaagccaggacgctcaccgctctcctgaaagcctctcccggggcgcggcacttcgacgtgagcgtgcccactgcccctgcgtcatcagggagttgacgcacatctgcgcaggccagcaccctggttgggcactgctacggctgatcacatagggtgaaaagaaaaacgggaggttcggcgtgttcgttgaacgtgcgccacttgtcgacttagtgtcctgttcggaagagtccagggaacagacacactggtaaccctaaacttcagcgttagggttcgggtcggcgttcggaccgtcccattcggcatcagtcgtcggatcgcgtcatccgcgaggcggcgacacgtaactcgaggcgagaggccttcgacgtggcagcaccgcagaactacctcgcagtcatcaaagtcatcggtgtcggcggcggtggtgtcaatgccatcaaccggatgatcgaggtcggtctcaagggcgtcgagttcatcgccatcaacacggacgcgcaagctctgttgatgagcgacgccgacgtcaaactcgacgtcggtcgcgaactcacccgcggactcggcgccggagccaacccggctgtcggccgcaaggcagccgaggaccaccgcgaggagatcgaggaggtcctcaagggggccgacatggtcttcgtgacggccggggaaggcggcggcaccggcaccggcggcgcgcccgtcgtggccaacatcgcccgctcgctcggcgccctcaccatcggcgtggtcacgcgcccgttcactttcgagggacggcgccgcgccaaccaggcggaggacggcatcgccgaactccgcgaagaggtcgacaccctcatcgtcatcccgaacgaccggctgctgtccatctcggaccgccaggtctcggtcctcgacgccttcaagtcggcggaccaggtcctgctctccggtgttcagggcatcaccgacctcatcaccacgcccggtctgatcaacctcgacttcgccgacgtgaagtccgtgatgtccgaggccggttcggcgctcatgggcatcggctcggcccgcggcgacgaccgcgcggtggcggcggccgagatggcgatctcctcgccactcctggaagcctccatcgacggcgcccgtggcgtcctgctctccatctccggcggctccgacctcggcctgttcgagatcaacgaggcggcccagctggtgagcgaggccgcgcaccccgaggccaacatcatcttcggcgcggtcatcgacgacgccctcggcgacgaggtgcgcgtcaccgtcatcgccgccgggttcgacggcggccagccgccttcgaagcgggacaccgtcctcggctcgtcctccgccaagcgcgacgagcccacgccggcccggcccgccgagagccgcccgtccttcggctcgctcggcagcgtcacgccgaaggaggccccggagcccgcgccggagccggtgaacgaactcccggtctcgccgccggtcccgccgtcccggacctactcggacagcgcggccgaagagctggacgtgccggacttcctgaagtgataggacagcgcgacaccgtgagcggcgcgcacttcgccttcaccgaccggtggggcggggtgagcgccgttccgtacgaggagctcaacctcggcggagcggtcggcgacgactccgacgccgtacgtaccaatcgtgaactggccgccaagtccatggggctcgacccggcccgggtggtctggatgaaccaggtgcacgggccggacgtggccgtggtcgacgagccgtggggggcgcggcccgtggccgaggtcgacgcgatcgtcacccggcgccgcggactcgccctcgccgtactcaccgccgactgcacgccggttctgctcgccgaccccgtcgccggggtcgcggccgccgcccacgccgggcggcccggcatgatcgccggagtcgtgccggccgccgtcgaggcgatggtggagctgggtgccgacccgtcccggatcgtcgcccgtaccggccccgccgtctgcggccgctgctacgaagtgccggacgcgatgcgcgccgaggtcgcggccgtcgaacccgcggcgtacgccgagaccagttggggcacgcccgcggtggatgtgagcgccggcgtgcacgcgcagctcgaacggctcggggtgtgcgaccgggagcagtcgccggtgtgcaccctcgaatccggtgaccacttctcgtaccgccgcgaccgcaccaccggtcggctcgcgggctatgtctggctggactgatggtgcatgacggaccgtaaggatcaactcgccgcaaacctggcgaaagtggaggaccgcatcgcggccgcgtgtgcggccgccgggcgtgggcgggaggaggtgaccctcatcgtggtcaccaagacctaccctgcgatcgatgtgcggatcctgtcggaactcggtgtgcgcgatgtcgccgagaacaaggaccaggacgcggcgcccaaggccgccgagtgctcggatctgccgctcaagtggcactttgtcggtcagttgcagaccaataaggtgcgctctgtggtgggttatgccgatgtcgtgcaatccgtcgatcgtcccaagcttgtcacggctctgtcgaaggaagccgtgcgcgccgggcgcgaagtgggctgcctgatccaggtcgcgctggatgctcaggagtacggacggggagagcgcggcggtgtgggacccggcggactcgaagagttgggcgacctcgtcgccgaggctccgggcctgaggctggacgggctgatgaccgtcgcgccgctcaccggggagtacgcgggtcgccaacgggcggcgttcgaccggttgatggatttgtcgactgacctgcgccgagcccatccggctgcgaacatggtttccgcagggatgagtgcggacctcgaggaggccgtggcggccggggcgacacatgtgcgcgtcggcactgcggtactcggcgtccgccccaggctcgggtaacgtcgccaagaagtcggaccacagcagaaaatatggtcattaccgccgataggcgggcgcaacgacctcgtggatcgcgggcacttggcacatcgtcagtggatccaccacagagcggaggactcagagcatggccggcgcgatgcgcaagatggcggtctacctcggcctcgtggaggacgatgggtatgacggcaggggattcgatcccgacgacgacttcgagccagagctcgacccggagcccgagcgggaccgcaggcggcatgaaccgccacaccagtcacaccaggcacttcaccctcaacgggacgaatcggtacgagtggtacagccgccgatgcagcgggatcctgtgccgcattccgcttcgctccccgcggaatccgtacggcctgcacgaatcgcccccgtggcatccatcacacaagaacgtcaaagcctggagaagaacgcaccggtgatcatgcccaaggtcgtgtcggaacgggagccttaccggatcaccacgctccatccgcggacctacaacgaggcccgtaccatcggggaacacttccgcgaaggcaccccggtgatcatgaatctgaccgagatggatgacactgatgcgaagcgacttgtcgactttgcggccggtttggtgtttggtcttcacggcagcatcgagcgggtgacgcagaaggtgttcctgttgtcgcctgctaacgtcgatgtcacggcggaggacaaggcccgcatcgcagagggcgggttcttcaaccagagctgagacgcaccaccggaatgaagcacgggaacaggggagagggaaacacggatcatgagcgtggtcttcgatgtcatctacatcgcgctgatgtgtttcctcatcgtgctgatcttccggttggtcatggactacgtcttccagttcgcccgctcatggcaacccggcaaggcgatggtggtcgttctggaggccacctacactgtcactgatccaccgctcaagcttctgcggcggttcattccgccgctgcgtctcgggggcgtggcgctagacctgtccttcttcgtactgatgatcatcgtctacatcctgatctccgtcgtgagccggctgtgaacgatacggtcttgccgaatgccgacgactacgttgaggtgaagagatgccgttgacccccgaggacgtgcggaacaagcagttcacgaccgtccgcctccgagaaggctatgacgaggacgaggtcgatgccttcctcgacgaggtcgaagccgaactgacccgcctgctccgcgagaacgaggacctgcgcgccaagctggccgcggccacgcgtgccgctgcgcagaaccagcagcagggcatgcgcaagccacccgagcagcaacaggaccagcagcagggcatgcgaggtcccggttctccggtgcccgccgggatatcgggcccgccgcagcagcagcagatgggtggccccatgggcggcccgccgcagctgccgagcggcgccccgcagctgcctgccggtcccggtggcggccagggtggcccgcagggccccggcccgatgggtcagggtcagatgggtcagggcccgatgggccagggtcagatgggccagggaccgatgggccagggccagatgggccagggccagatgggtcagggtccgatgggccagggccccggccagatgcagggccagatgcagcagatgggcggtcccatgggcggtcccatgggtggccccatgggcggtcatggcccgcagatgtcgcagcccggtcagggccccggcggcgacagcgccgcgcgtgtgctctcgctggcccagcagaccgccgaccaggcgatcgccgaggctcgttccgaggccaacaagatcgtcggcgaggcccgtagccgcgccgagggtctggagcgcgacgcccgtgccaaggcggacgctctcgagcgggacgcgcaggagaagcaccgcgtagcgatgggctccctggagtccgctcgcgccacgctggagcgcaaggtcgaggacctgcgcggcttcgagcgcgagtaccgcacgcggctgaagtcctacctggagtcgcagctgcgtcagctggaaacccaggccgacgactcgctggctccgccgcggactccggcgaccgcgtccctgccgtcgtcctcgccgtccatggctccggcgggcgcgagcgccccgtcgtacggcggcaaccagacgatgggtggccctccggctccggccgcgccttcctatggcggccagcagcagatgtccccggccatgacccagccgatggccccggtccggccgcagggcccgtcgcccatgcagcaggcgccttcgccgatgcgcggtttcctcatcgacgaggacgacaactgacggcctcccgtacgccttaggcgtcgtcggcgttcagggcggggccccggattcttccggggccccgcccttttgcgtgcttctgcgtccggggcctgcgcggcgcttgtgcagtgtgtgttcgggcatggggacagctgtccgtgcgtacgcaacgccgaaggcccgggcccgccaagatctttggcgggcccgggccttcgtgtgtgccgctgtgccttgctgtggtgcgttgccgttacgccttgcgcaggcggaacgtcagcgacagggactcgtcggtgaacggctccccgtatgtgtcgtccgcctcaccctgggcgaagtccgtggcgaggacctcgtcggcgatgagctcggagtgctcggacagcgccgcgatcacctccgggtccgtcgaggtccagcggagcgcgatccggtccgccacgtcgaggccgctgttcttgcgggcctcctggatcagacggatcgcgtcacgggcgaggcccgcctgccgcagttcctccgtgatctccaggtcgagggcgaccgtcgcaccggagtcggacgcgaccgaccagccctcgcgcggagtctcggtgatgatcacctcgtccggggcgagcgtcaccgtctcgccgtcgacctcgaccgacgccgtgccctcgcgcagggccagcgacagcgcggccgcgtcggcgcccgcgacagccttcgcgacggcctggacgcccttgccgaaccgcttgccgagcgcgcggaagttcgccttggcggtggtgtcgaccagcgagccgccgacctcgctcagtgcggccagggatgtgacgttcagctcttccgtgatctgcgcgtgcagctcacggtcgagcgtttcgaagccggccaccgcgaccagcgcacgcgacagcggctgccgggtcttgacgcccgactccgcgcgcgtggcacggccgagctcgacgagccgccggacgagcaccatctgcttcgacagctccgggtcgatggcggacaggtccgcctccggccacgacgccaggtgtacggactcgggggcgcccggcgtcaccgggaacaccaggtcctgccagacccgctcggtgatgaacggggtcagcggggccatcaggcgcgtgaccgtctcgacgacctcgtgcagggtgcgcagcgccgccttgtcgccctgccagaagcggcgacgggagcggcgtacgtaccagttggacaggtcgtcgacgaacgcggacaggagcttgccggcgcgctgggtgtcgtacgactccagggcctgcgtcacctggtcggtgagcgcgtggagttcggacaggagccagcggtcgaggaccgggcggtccgccggggccgggtcggcctcgctgggcgcccagcccgacgtgcgcgcgtacagggcctggaaggcgaccgtgttccagtacgtgaggagcgtcttgcggacgacctcctggatggtgccgtggcccacgcggcgcgccgcccacggggagccgcccgccgccatgaaccagcgcaccgcgtccgctccgtgctggtccatcagcgggatcggctgaaggatgttgcccaggtgcttggacatcttgcggccgtcctcggcgaggatgtggccgaggcacaccacgttctcgtacgaggacttgtcgaagacgagcgtgccgaccgccatcagcgtgtagaaccagcctcgcgtctggtcgatggcctcgctgatgaactgcgcggggtagcggctctcgaagagctccttgttcttgtacgggtagccccactgcgcgaacggcatcgaacccgagtcgtaccaggcgtcgatgacctccgggacgcgggtcgccgtccgcccgcagccgtcctgggggcaggcgaaggtgaccgcgtcgatgaacgggcggtgcgggtccaggttcgactggtcggtgcctgtcagctcggagagctccgcgcgggagccgacgcaggtgaggtggccctcctcgcaggtccacagcgggagcggggtgccccagaagcggctgcgggacagcgcccagtcgacgttgttgttcagccagtcaccgaagcggccgtgcttgacggactccgggaaccagttggtcttctcgttctcctggaggaggcggtccttgacggccgtggtgcggatgtaccaggacggctgcgcgtagtagaggagcgcggtgtggcagcgccagcagtgcgggtagctgtgctcgtacgggatgtgcttgaagagcagaccgcggttctggaggtcctcggtgagcttttcgtccgccttcttgaagaagacaccgcccacgaggggaacgtcctcctcgaaggtcccgttcgtgcggacggggttcaccaccggcaggccgtactcacggcagaccttgaggtcgtcctcaccgaaggcgggggactggtggaccagacccgtaccgtcctcggtggtgacgtactcggcgttcaccacgtagtgggcgggtgccgggaactcgaccagttcgaacggacgttgatacgtccagcgctccatctcggcgccggtgaaggtctcgccggtggtctcccagccctcaccgagggccttctcgacgagcggctcggcgacgacgagcttctcctcgccgttcgtcgcgaccacgtaggtgacgtcggggtgcgcggcgacggcggtgttggagaccagcgtccacggggtcgtcgtccacaccaggagcgcggcccggccggccagcggaccggaggtgagtgggaaacggacgtagacggaggggtcgacgatcgtctcgtagccctgtgccagctcgtggtccgacaggccggtctcgtcctgcgggcaccacggggcgacgcggtagtcctggaccagcagccccttgttgaagatctccttgagcgaccaccacacggactcgatgtactcggggtccatcgtgcggtacgggtcgttcaggtcggtccagtagcccatgcgggacgtgagctcttcgaaggcgtcggtgtggcgggtcacggactcgcggcacttggcgttgaactcggcgatgccgtacgcctcgatgtcctgcttgccgctgaagccgagctccttctccaccgccagctccaccgggaggccgtggcagtcccagccggccttgcgggccacgtggtagccgcgcatggtgcggaagcgggggaagacgtccttgaagacgcgggcctcgatgtggtgggcgcccggcatgccgttggccgtgggcgggccctcatagaacacccattcggggcggccctcggactgctcgaggctcttggcgaagatcttctgctcgcgccagaagtcgagcacggcgtgctcgagggcgggcaggtcgacctgggcgggcacctggcggtactgcggcggtttcatcggcgagcttcctccggcggactttctgccttccgtccggagggacgagagccgagtctttccgtacgccgtgtgcggcgcgctcccgcggtaccaccctccttggctccccggcgccctgtgtgcaccgatgagccccctcattggggtcgcgatgccgggtctactggcttcggctgctgggcctcggcgttcttccggcggctccggggtgatcttcgcgtcgcgctcgcccccgggcttccaccgtccccgggtcgctcctggccgcgtccgccgctactcgtccccatccacgcttctcgctccgcccagtgtacggcgccgcgcggacagcggccgaccggttttccggggcccgcgcggaaggcggcaggggggccggtacgggccgcggactgacccgaatggcgaggcggcggcgtccggatcctgggacgcccggcccggcggattacccggcggagagctgggcacaacgctggaaggcttgccgcgcggcacccgtggggcgggcaaatcatgggcgtgccccgttgccgcgggccagaagtcgatttatcgtcccagcacgattcgcgatcaagatcacaatatgtgaaggggccgcggccatggtggcgaagaagaccgccgtacagcagtcggcgtcgggcagatccacgggttcagcggccaaggacgtcgatggcgagaagagtgcccatgcagtggttgcgaacggcgcgcccaagccggtgaggacggttcgtatggacgccggaggatcgggaacggagggcacggcggaggccgcgggtgcttcctcggctgcgggtgctgcgggtgctgcgggtgcttcgggggcgaggaagaccgggggaacgaagtccgccgcgaagaagaccacggtcgccgcgtcggccggggccgccacaaaagccgcggcgaagaagatcacggcgaagagaaccgcggtgaagaagaccacggtgaagaagagcacggcgaagaagtccacggtgaaggaaaccggcgtgcggaagaccgtcgcccagaaggaggcggcggcctcgaaggtggctccttcgaagaggccggacgaggaggaaggccccgagaggccggcggcgaagaatgcggccgggacgaaggcggccgggaagaagacagcggagaaggccgccgtcgcgaggaagaccgttgccaggaagagtgccgcagcgaagggcggtaccacggaggccacctccccgaagagcacctccacgaagagcacctccacgaagagtgcggccaagaagagcactgccaagaacgcgggcgcggccgcggccgcgaagcagacgggagccacgacagtggttgcgaagaagactcctggcacggccacggcggcgcagaaccccaccgcggtccccaaggcgcggatcgccgcggtggagcccggcgagctggccgtgcgccccggcgaggacccgtggacccccgaggaggtcgcggaggcacgcgccgaacttcagggcgaggcgatccggctgagcaccgagatctcctcgtcggaggcggcgctcgtcggtctgatgcgggactccggggacggtgcgggcgacgaccaggcggacaccggcaccaagaacatcacgcgcgagcacgagatggctctcgccgccaacgcgcgcgagatgctcgaacagaccgagcgggcgctggagcggctcgatgccggtacgtacggcctctgcgagaactgcggcaaccccatcggcaaggcgcgtatgcaggccttcccgcgggccacgctgtgcgtcgagtgcaagcagaagcaggaacgccgttactgaatccctcctgggcacgtggtcgggtaggggcgtgtcgtactctcgtccccagtcaggcacctaggttgagggactcacgtggcagaggcggagcgcatcatcggtacgccggatatcccagaggcggcgggagccgaaccggagcaggccgacggtgagagtggcggtgccggtgccggcaccgagcggcccaagggcaggcgccggatcgccgtcctgttcgccgtcgccgcgctcgcgtacgccttcgacctcgtcagcaagctgatcgtggtcgcgaagctggagcaccacgcgccgatcgagatcatcggggactggctgaggttcgaggcgatccgcaacgcgggtgcggccttcggcttcggcgaggccttcaccgtcatcttcacggtgatcgcggcggccgtgatcgtggtgatcgcccgcctcgcgcgcaagctctacagcctgccctgggcgatcgcgctcgggctgctgctcggcggtgcgctgggcaacctcaccgaccggatcttccgctcgcccggtgtcttcgagggcgcggtcgtcgacttcatcgcgcccaagcacttcgcggtgttcaacctggcggactcggcgatcgtctgcggcggcatcctgatcgtgctgctgtccttccgcgggctcgacccggacgggacggtccacaaggactgacggtcgtgaggcactgacggtcgtgaggcacggatgttcgagctctggtcaagtggtgtcggacctgtccggcatactcgacgggtgagcacgattcccgagatccgtaccctgcccgtgccggacggcctggagggcgagcgcgtcgacgccgccatttcccgcatgttcggcttttcccgcacgaaggcggccgagctggccgcggcaggcaaggtgctggtcgacggcacggtggtcggcaaatccgagcgcgtgcacggcggcgcctggctcgaggtggagatgccgcaggcccccgcgcccgtgcagatcgtcgccgagccggtcgagggcatggagatcgtgcacgacgacgacgacgtgctcgtgatcgtcaagccggtcggcgtggccgcgcacccgtcgcccggctggtcgggcacgaccgtcatcggcggcctcgccgccgccgggtaccggatctccacctcgggcgccgccgagcgccagggcatcgtgcaccgcctcgacgtgggcacgtcgggcctgatggtggtcgccaagtcggagtacgcgtacacgtcgctgaagcgccagttcaaggagcgcacggtcgacaagcgctaccacgcgctggtgcagggccaccccgacccgaccagcggcacgatcgacgcgcccatcgggcgtcatccgaaccacgactacaagtgggcggtcacggccgagggcaagccctccgtcacgcactacgacctgatcgaggcgttccgcgcggcctccctgctcgacatcaagctggagaccgggcgcacccaccagatccgcgtccacatgtcggcgcaccgccacccgtgcgtgggcgacctgacgtacggcgccgacccgacgctcggcaagcgactcggcctcacccgccagtggctgcacgcggtgcgcctcggcttcgagcaccccggagacggcgagtgggtcgagttcgcctgcgactatcccgccgacctccagcaggctctggacaaggtgcgggaggaaagctacgcatgagcgcggcgtacgaggtgcgggtcgcggagggtactgccgaccgtgaggcgtgcttcgcggtccgcaaggaggtcttcgtcgtcgagcagcgcgtcccgcaggacatcgagtacgacgcgtacgacgccggagccgtgcatgtgctggcggtccgggacgacggggtgccgctcggcaccgggcggctgctgcacggggaggcggccgccgccaagaccgacggcgacctcaccgtgggctccctcgggcggctcgccgtgacgcaggacgcgcgcggcctgggtgtcggcgcggcgctggtccgcgccatcgaggacgcggcacgcgcgcgtggcctcgcggcggtcgacctgcacgcccagacccacgccctcggtttctacgagcggctggggtacgtggtgtacggaccggagttcctcgaggcggggataccgcatcgggcgatgcggcgcacgctgtaaggaaaccgcccgtggcacgctggacgtctggcctttcttgatcgcctagaccgccggagtgctgaccgtggatcagttggccctgttgttcgtgcttctcctcggggccgtggtgagtgtcccggtgggagaccggttcgggctgcccgcgccggtgctgatgacgctgctcgggatcggcctcgccgtggcggacttcgtgccgaacgtggacatcccgcccgatctgatccttcccgcgctgctgccgccgctgctctacgccgcggtgcggcggacgtcgtggagacagttcaccgccaacaagcgcccgatcttcctgctggctgtggcgctggtgttcgtcaccacggcggtcgtggcgctcgtcgccggcgcgatcgtgccggggctgccgatcgcggccgccgtggcgctcggtgcgctggtcgcgccgcccgacccggtcgcggcgaccgccgtcgcggggcagctggggctgccgcggcgactggtgtcgatcctggagggcgaggggctcttcaacgacgtcacggcgatcgttctctaccacgtcgcgatcgccgccgccgtcagcggaacgttctccctgccgaacgccgtgctcgacctggtgctgtccgccgtggtcgcggtcgccgtcgggctcgcgctcggctgggccgcgaacaggctgatggacctgctcgacgacgtcacgctgcagatcggtctgacgctgctggtgccgtacgcgtcgtacgtcctggccgaggaactgcacgggtccggggtgctcgcggtgctcaccaccgcgctgttcctcgcggagtacgccaccgacgcggacgacgtgatgacacggctcgccgggcacacgttctggaacgtggtggacaccctcgtcaccggtgtcgcgttcgggctgatcgggctcgaactgcacaacgccctcaggacggcgtccgggcggtggggcgagatgctgggctgggcggcggcgatcgtggccgtggtggtgctcgtacggctggcgtatctgctgccggcgacctggctgaccaaacggctgcacgcgaaacgggactacgacgaggagatcccgacctcgtggcgcgagaccgtcgtgatgtggtgggccgggatgcggggggtggcgtccgcggccctggcgctggccattccgctgaagatggacgacgggtcgccgtttccggaccgggacgagatcgtcttcatcgcgttcggagtgatcatggggacactggtgttgcaggggctgacgctgccgtggctggtgaagaggctgggggtgcgggccgacacggggagcgagaaggcgttcgagaaggcgttggccattcgggcggcgaaggcggcgaagcggcggctgcgggagatcgaggacgtggaggagttgccggaggagctgtccgagcagttgttgcggcgggcgttcgacatcggggcgcggatcagtcctgatctgggggacgaggagcggcgggaggcgcacgagcagcgggtccggcggatgaagagggtgcggcggattcagggggagatgatgagtgcggcgcggcatgaggtgctggccgcgcggagcgagccgggggcggatccggagattgtggaccgggtgttgcggcatctggatgtgcggagtttgcgttgaagtgtgttctcccacccgcgcaccgcccgcttccagccggttgacaggtgcgggtctcccgtggggggtgcggcggcgactgcgggtcgtggggggagtgggcggtggtgttcgttgtgggatgtggctcgggggcggggcgtcgttgtggcgtgtgtgtggcgggggtgtaactccgagggcggttttcgggggtgctttgtacgattcggtgatgactcgcaacgtggtgatcagcggtggtggtacggggatcgggctcgcggcggcccgggcttttgccggggacggggaccaggtgctgctgctcgggcggcgggcggacgtgttggagaaggcggaggtgccgggcgcgctcacctacgcggccgacctgagtgatccgcacggcgtgcgcggggtcgcggagttcgtcgcggccgagttcggcaccgtcgatgtgctcgtccacagtgccggaggggccgggaatctggagcccaggacggagaccgacgacccgctcgaagccgtcgcccacaactggaccgtgaacttccggctcaacgtgctgaccgccgcgctgctcacggaggcgttgcgggagcggctcgcctcgccgggcgggcggctgctgttcctcagctccatcgccgcctaccgggggtccgggagcggggcgtacgcggcggccaaggccgcgctgcatccgtacgccttcgatctggcgcgggagttggggccgcggggcgtcaccgtgaacgtggtggcgcccgggtatgtcgaggacaccgggttcttcggcggggagatcgagcaggcgcggcgtgagcggctcgtcgccgagacctcgaccggccgcgcgggtacgcccggcgacatcgccgcgacactgcactggctggcgtcaccgggcgccgcgcacatcaccgcacaggtgatccaggtcaacggaggagcggaacgcgggcattgagcgcaccggactgcccgcggcccgtccctccgtggacctccgtccctccgttgtcctttgactgccgactgccgactgccgactgccgactgctgactgctgacctcgggccgctgcccgcggtcagccccggcccgttctcggcggctcgaaggcccggtgggccacgccgtcccgggacgcggtcctgcccggcggcacgaccgcgtccgccgtgttgacgcgcggcagcgcgtaggggtgctgctccgtcagccaacggaccatctgttcacggaccgtgacgcgcaccgtccagatgtcgtccgcgtccttcgcggtcaccagggcgcgcacctgaatggtggtgggtgtcgtgtccgtgaccgccaggccgtagtcgcggccgtcccaggccgggcactcgcgcacgatgtcctggagcttcttgcgcatctcctcgacgggcgtggagtggtcgacgtggaagaagacggtgccggtcatctgggcgctgccccgcgaccagttctcgaagggctgggcggtgaagtacgagaccggcatcgtgatccggcgctcgtcccacgtccgtacggtcaggaatgtcagcgtgatctcgtcgaccgtgccccactcgccgtccaccacgaccgtgtcaccgagccgcaccatgtcgccgaacgcgatctgcagtccggcgaagagattggcgagcgtggactgggcggcgacaccggcgacgatgcccaggatgccggccgaggccagcagcgaggcgccggccgcccgcatcgccgggaaggtgagcagcatcgcggcgacggccaccacgcccacgatggcggagaccacccgctggatcagcgacacctgggtgcgcacgcggcggacccgggcgggatcgcggtgggcggccgcgtagcgccagtacgaggtctcgacgatcgccgcagcgatgcggaccaccagccaggccgtcgagccgatgaggacgagcgtcagagcccggcctatgccgatccggtggtcctccagcagcttcgcctggtcgtacgaccctctgaacagggccgagcacagcacgagctggaacggcacgccgccgcggcgcagcaggccccacaggggagtctcatggtgtcggccgtcggcccgtcgcaacagctggtcgacggcccagccgacgaccagcgtgagtacgagcgagccgccgacgacgatcagcggtcgcagtacgttctccatgcctgcgaacgtaaccggcctggcggcctcatgaacctgtttactctgcccggtccggggtatcgccgcaggccgggtcgtccgtccggggtgccggtccgggctggcaccatggcctcatgaacatcatgctctttcactcgacctacgggttgcggcccgcggtgcgcgccgcggcggaccggttgcgcgccgcgggacacgaggtgtggacgcccgacctcctcgaggggcgcaccttcgagaccgtggaggagggcatggctttctgcgacgggatcggcaaggacgagctgctcaagcgcgcggtcctggccgccgcgccctactcggagcgtggcctggtgtacgcgggcttctcgctgggcgcctccatcgcccagaccctggcgctcggcgacgagaaggcccgcgggctgctgctcctgcacggcacgtcggacatcgccgagagcgcgtcggtggacgagctgccggtccagctgcatgtcgccgagcccgacgcgttcgagacggacgactggctgggcgcctggtacctgcagctgcggagagccggggccgacgtggaggtctatcggtacgcgggtgccgggcacctctacaccgaccccgacctgcccgactacgacgcggaggcggccgaggccacctggaaggtggcgctcggcttcctcgacagcctctagacggacgtcatagatgtagcggatgtcacagacgtagcggacgtcgcgaatgtagcggacgtcacagacgtagcggacgtcgcgcatgtagcggacgtcacaccggatcgtacgtccgctccaccttctgcgtgccgctgcgcgtgcggtacgagcgggcccaggacgaggtcgcgttcgggtccgtgcggtcggagagcacgtagtagtccatctgcgcgcggtcggcggtgatgtccaggacgccgtagccgtgccggtcggtgtcgacccagtggacgtgccggttggcggcgcggatgagcggcgcggccacggccgagacggtgccctcggggaccttgacgatgtcgtcgaggttgtcggaggtgaccgacgtgaccacgaactcggtgccggccgacgcggacagcgggtacgtaccggcgtcgaacggcacgtcgttggcccacgccatgtggatgtcgccggtcaggaagaccgtgttgcggatcgcgttgttccgcaggtgggcgaggagttcacggcggtcgtccgtgtagccgtcccactggtcggtgttgagggcgatgccctcctgcggcagcccgagcagcttggcgagcggcttgaagaggtcggcggagagctcaccgatggcgaacggcgagatcatcaccgagttgccgaccagccgccaggtggtgtcggacgccttgagccccgccttcagccagtcgagctggacccggcccgtgagcgtacgctccgggtcgtcgaccgtgccgctgcccgtggacgcctgctgcgagcggaaggaccgcaggtcgagcagcgagaggtcggcgagcttgccgaagcgcagccgccggtaggtggtcccctcgatcgccgggcggaccggcatccactcgaagtaggcctgtttcgcggcggcctgacgtgccgtccaggtgccctcggcgccctcggtgtggttccccgcgccgcccgaccacgcgttgtcggcgaactcgtggtcgtcccagatcgcgacgaccggcgccttgtgatgcagggcctggaggtccgggtccgtcttgtaacggccgtgccgggtgcggtagtcggcgagggtgaggatctcgttggcgggggcgtgcgggcgtacgaccttgccgcgggccgcgtactcgccggacttgtactcgtagatgtagtcgcccagatgcagccaggcgtccaggtcgccgcgcgcggccaggtggcggtacggggagaagtagccggcctcccagttggcgcacgagaccacgccgaagcgcagaccggccacgcccgcgtcggcggccggggcggtgcgggtgcgggcgacgggcgagtcggtgccgccggccgagaagcggaagaagtagtccgtggccggctggaggccgcggatgtccgccttgacggtgtggtcggaggcggcggtcgcggtggtggagcccttggcgacgatcgcggtgaacgtcttgtccttggccaccgtccagctcacctcggtgtcggggccgagcccggagccgggtatcgcctcggcggtgggcgtcacccgggtccacagcaggatgccgtcggggagcgggtcgccggaggccacgccgtgcaggaaggcgggggtctcggtggccgcgcgggcgggcagtgcggcggcgagcggcccggccaggacggcggtggcggccgcggccttgacgaccgtacggcggcgcggcgagaacgtatgggcggtgtcggatgatctgtgtcgactggtcacgagcgatcaggttactgatcagtatgagcgaagagcgggtgaactcgtaaaagttcgcccgctcttcgttcgtcagccgcccaaaaaggcgccgtggctcaggccttgagcgccttgtcgatcgccgtcgtgtactcggccaccgacatcggcgcgttctggccgtcggagccggtgagcttcttgccgtccatcttcagggtcggtgtgccggtcacgccgctcttgtcgaacttctgcgacatgaccagcgcccacttgtcgtaggtgccgcccgtcacggccttctggaacgccttgttgttcttcagggcgtccaccgtgttcgcgaccttgatcaggtagtcgtcgctcttgaacttgtcgtcggtctcgtccgggtgccacttcgtcgagtacagggcggtcttgtactcgaggaacgcctcggggctcacgttcagcgcggcgcccagagcgctgagcgcgttcttggagccctcgccctggtcgctgttgtcgatgaacgtggcaccgatgtactggaccttgtacgtgccgtccgcgatggccttgtccacggtcgagccgacggtctgctcgaactgggcgcagaccgggcagcgcgagtcctcgtacagctccagcgtcttcttggcgtcggccttgccgaagacgaccgtggtgccgttcgtgcccgtggtgttggccggcttgacgagcttgtcgttcttggcggcctcccagtaaccgggcttgttgttctggacgacgaagtagccgatgccgccggcgacggccaggacggcgacgagggagccggcgaccatgccctgccgcttgactttgtcgcgcttggcctggcgcttgactttgtcgcgcttggcctggcgctcgcgctcgacgcgcagccgctcacgggccgccgtcttcgccgcctggctgttccgcttgctcatagtggtgatctccatgtgggacgcgcacaggtcgtacgcgggatacgtatgggggactgctgtcgctcaggcgaatacggccgagcgaggcggtccacgccgtcccagggagtgcacgaacaggcgcgtacggacggtggagatccggcgcgcggggcgcgccggccggcgtaccggagtgagtcgtacggtcaccgcgctgaccgcgagcagcagcggccggaacgcgctcaccgccgccgcgcgcagcaactgggccagggcgcgctcgccgcggcgcagccaggcggccgccagcagcccggtgccgacgtgcgcggcgagcagcagccaggcggcggccgggtcggcgtgtgcgagcaggacggcggcgcggtcgctgccgccgccggtcacccgggcgagcggggcgccgacgccgttgccgccgcacagcacgtcgaggccgaccgagcgcagcgggcccgcgaccgggccgcccaccttcccgtagcagacgtgctgccccatggtgaagaccgtgtcggcggccagctcgagagggaccagcagcgcggcgatctttccgaagccgcgctcgcggcccgccagcgcgtacgcgacgacgaagacggtgcccgcgatcgcggccacggtggacagcggcagcggcacccgggacagcagtacgtgcgacgtggtggagagcgtcacgacgactgcggtgaacagagccgcgcgaagggctctgaggtgggtcccggatatgtccatagcgctggagagtgtgccacgtaccgctgtaggagacccctaaagggtccctgtgagtcgacgccggcctacaggcccggaatccggccgttgcggaacaggtccacgaagatctggtggtccgcacgcgcgcgtgcgccgtactcgtgcgcgaagtccaccaggaggcccgcgaagccgtcctcgtcggccgcgacggcggcgtcgatggcacgctccgtcgagaacggcacgagggactgcccggacaggtcgtccgccgccgcgtgcatggcggccgtggcccggccgaggtcggcgacgaccgccgcgatctccttcgggtcgtcgatgtcgccccagtccaggtccacggcgtacggcgagatctcggcgaccagctgacccgcgccgtccagctcggtccagcccagccaggggtcggcgtgcgcctggagcgcgcgctgcgagatcaccgtgcggtggccctcgtgctggaagtagtcgcggatcgaggagtccgtgatgtgccgggagacggccggtgtctgggcctgcttgatgtagatcaccacatcgttctccagggcgtcgctgtggccctccaggagaatgttgtacgacggcaggcccgccgaaccgatgccgatgccccggcggccgaccacgtccttcacccggtacgagtccgggcgggccagcgacgactccggcagcgtctccaggtagccgtcgaaggcggccagcaccttgtagcgggtggccgcgtccagctcgatggagccgccgcccggcgcgaaacggcgctcgaagtcacggatctcggtcatcgagtccagcagcccgaagcgggtcagtgagcgggcgtcgcgcagcgcgtccaggagggggccctcggcggtgtccagcgtgaagggaggcacctcgtcgctcttggcgccggtcgccagggcgtggatccgctcccggtaggccgccgcgtagacctggacgagctcggtgatctgctcgtcgctgagcgccttcgcgtaaccgatcagtgccacggaggccgagaagcgcttgaggtcccaggtgaacgaccccacgtaggcctcgtcgaaatcgttgacgttgaagatcaggcggccggtggagtccatgtacgtgccgaagttctcggcgtgcagatcgccgtggatccacacccgggaggtccgctcgtccaggtacgggccgccccgcttgtcggcgtccaggtcgtggtagaagaggcacgccgtgccccggtagaacgcgaacgcggaggccgccatcttgcggaacttcacgcggaacgcggccgggtcggcggcgagcagctcgccgaacgcggtgtcgaagacggcgaggatctgctcgccgcgttgctcggcgctgagctgcggaaccgacatcgctgggtgcctcctggtgcaggtggtgcgtgacgtgtggaacggatcttccgtcgtcctccggacgaccggaccgcctttggtccaacggacgaagatacgcgggagtgcccgcgtccccgcatgaaggtacgggggagaagccgccgagtgtcagtgccgaggcttagacttcgacgctgtccccagactgcccgcagccggtcgggaagccgtcgacccacggccacccgtcacccgaccaccgcccctcatcgcggcgctttgcgccgtatctgttcacttggaggccgaagccgtgtcaaagccgccgttcacgcacctgcacgtccacacccagtactcgctgctggacggtgccgcgcggctcaaggacatgttcaatgcctgcaatgagatgggcatgacacacatcgccatgagcgaccacggcaacctccacggggcgtacgacttcttccacacggccaagaaggcgggcgtcacgccgatcatcggcatcgaggcgtacgtcgcccccgagtcccggcgcaacaagcgcaagatccagtggggccagccgcaccagaagcgcgacgacgtgtccggttcgggtggttacacgcacaagacgatctgggcggcgaaccggacgggcctgcacaacctcttcaagctctcctcggacgcgtacgccgagggctggctccagaagtggccccggatggacaaggagaccatctcccagtggtccgaaggtctcatcgcctccaccggctgcccctccggcgagctccagacccggctgcgcctgggccagttcgacgaggccctgaagtcggccgccgagtaccaggagatcttcggcaaggaccggtacttcctggagctgatggaccacggcatcgagatcgagcgccgggtccgtgacggtctcctggagatcggcaagaagctcggcatcccgcccctggtgacgaacgactcgcactacacctacgcgaacgaggcgaccgcgcacgacgccctgctgtgcatccagaccggcaagaacctctccgacccggaccgcttccgcttcgacggcacgggctactacctgaagtccacggacgagatgtacgccatcgactcctcggacgcctggcaggagggctgcgccaacacgctcctggtcgccgagcagatcgacacctccggcatgttcgaggcgaagaacctcatgccgaagttcgacatccccgagggcttcaccgaggtcacctggttccaggaggaggtgcgccgcggcatggagcgccgcttccccggcggcgtccccgacgaccgtcagaagcaggccgagtacgagatggacgtcatcatccagatggggttcccggggtacttcctcgtggtcgccgacttcatcatgtgggccaagaagcagggcatcgcggtgggcccgggccgtggttcggcggccggctcgatcgtcgcgtacgccatgggcatcaccgacctcgacccgatcccgcacggtctgatcttcgagcggttcctcaaccccgagcgcgtctccatgcccgacgtcgacatcgacttcgacgagcgtcggcgcgtcgaggtgatcaggtacgtgaccgagaagtacggcgccgacaaggtcgccatgatcggcacgtacggcaagatcaaggcgaagaacgccatcaaggactccgcgcgcgtgctgggctacccgtacgcgatgggcgaccgcctcaccaaggcgatgcccgccgacgtcctcggcaagggcatcgacctcaacggcatcaccgacccctcgcacccccgctacagcgaggccggcgagatccgggcgatgtacgagaacgagccggacgtgaagaaggtcatcgacaccgccaagggcgtcgagggcctggtccggcagatgggcgtgcacgccgccggcgtcatcatgtccagcgagcccatcgtcgaccacgcccccatctgggtgcggcacacggacggcgtgaccatcacgcagtgggactacccgcagtgcgagtcgctcggcctgctgaagatggacttcctcggcctgcgcaacctgacgatcatggacgacgccgtcaagatggtgaagtccaacaagggcatcgacctcgacctgctgagcctcccgctcgacgacccgaagaccttcgaactgctccagcgcggcgagaccctcggcgtcttccagttcgacggcggccccatgcgctcgctgctgcgcctgatgaagcccgacaacttcgaagacatctccgccgtctcggcgctctaccgtcccggcccgatgggcatggactcgcacacgaactacgcgctccgcaagaacggccttcaggagatcacgccgatccacaaggagctggaggagcccctccaggaggtcctggccgtcacctacggcctgatcgtctaccaggagcaggtgcagaaggccgcccagatcatcgccgggtactcgctcggcgaggccgacatcctgcgccgcgtgatgggcaagaagaagcccgacgagctggcgaagaacttcgtcctcttccaggagggcgcccagaagaagggctacagcgacgaggccatccaggccctgtgggacgtcctggtgcccttcgccggatacgcgttcaacaaggcgcactcggccgcgtacggcctggtctcgtactggaccgcgtatctgaaggcgaactacccggccgagtacatggccggcctgctcacctcggtcaaggacgacaaggacaagtcggccgtctatctgaacgagtgccggcgcatgggcatcaaggtgctcccgccggacgtcaacgagtcgatgtcgaacttcgccgcgcagggcgacgacgtgatcctcttcggcctgtccgccgtccgtaacgtcggtacgaacgtcgtcgagtcgatcatcaagagccgcaaggccaagggcaagtacgcctccttccccgactatctcgacaaggtcgaggcggtcgcctgcaacaagcgcaccaccgaatcgctgatcaaggcgggcgcgttcgacacgatggggcacacccgcaagggcctcaccgcgcagttcgagccgatgatcgacaacgtggtgcaggtcaagcgcaaggaggccgagggccagttcgacctcttcggcggcatgggcgaggaggagagcgacgagcccggcttcggactcgacgtcgtcttcaccgacgacgagtgggagaagacctatctgctcgcccaggagcgggagatgctcggtctgtacgtctccgaccacccgctcttcggcttggagcacgtgctgtccgacaaggccgacgcgggcatcgcccagctcaccggaggcgagcacgcggacggcgcggtcgtcaccatcggcggcatcatctcgggcctccagcgcaagatgaccaagcagggcaacgcgtgggcaatcgccaccgtggaggacctggcgggctccctggagtgcatgttcttcccggccacgtaccagctggtgtcgacccaactcgtcgaggacgcggtcgtgttcgtcaagggacgcctcgacaagcgcgaggacgtgccccggctcgtcgccatggagctccaggtccccgacctgtcgaacgcgggcaccaacgcgcccgtgatcctcaccattccggcgctgaaggtcaccccgccgatggtgagccggctcggtgagatcctcagccaccacaagggcgagagcgaggtgcggatcagactccagggtccgcgcaagacgaccgtgctgcggctcgaccggcaccgggtgaagccggatccggccctgttcggcgatctgaaggtgctgctcggcccgtcctgcctggcgggctgagcgccccctctccggggctcggttcgctcccggggtgtctgagcctcactcgccgggtgtacgcaaggggcgcatccgcaaccggatgcgcccctcggtgtgtgcctgggcttcaacagcccgcgcgatgaattcagttgtggccgaagcgcttctgctgcttacgggcaacatccgcggggctgccctgggtgtgcggcatcggcgactgctgtgcctccgtcgcagacctctgcgcgtgctcctgtgcctgctcggcctgggagctgcgctgctgctggctgccctgcttgcggttcttgttcttggccatggtgatctgcctcctgagggggatctaggggccagagacgggaccagattcacataggccgacaagccgcgcatttcggagaattaccgtgtgtaataagcgctgtcggagagcgatacgccgatacgccacgccgaagatcgagttcgggccgttaacctccgcagggtcgggcagactcgaaggaagcccaaagcaaacctcccggaaagagggtggaccgcgtggaccgctgcatcgtcctggtggacgccgggtatctgctcggggccgccgccagtctgctcgccggagagccttcgcgctcccggatcaccgtcgaccatgccgccctcatccagggactgcgcgagcgcgccgagttcgacacggaacggccgctgctgcgcatctactggttcgacggcgcccccgaccgcgtgccacagccggagcaccgcagactccgggtgatgccgcgcgtgaccgtccggctgggcgcgctgacccgcagtgacgggcggtgggcgcagaagggcgtcgacgcggcgatgcacgcggagctgaccgagttggcgcgcaaccgggcctgttccgacgtggtcctggtgaccggcgacggggatctgctgccgggcatgatggccgccaaggagcacggggtcgccgtacacctgtgggccgttcaggccgcggacggcgactacaaccagtccgaggacctggtcgccgaggccgacgagcggcgtgtgctcgaccgggcctggatcaccaaggccgtacgcgccaaggaggtgggcggggtctgcgcgccgcagcccgtcccgcggccggagatcgccgcgatcctgtccgcgccgctgcccgagtcctcgctcgcgggcgccgccgagcggaccgccgaggagccggagcaccggtcggcggcggacgcgcagaacggggcgcaggagcgggtgtcggccccgaagggcgtgccgacaccgaaggacctggccgctctccgcgcgcccggcacccagtcccctcagcatccggccagtgcgacgctgcggtggtcctccgacaaggggtgggtggaccggcccggtgcggcggccgagtccgcggacgccgcgtcgctgccgacgctggcgcaactcacctcggcggagcagcggtgggccgaccgcgaggaggacatcaccacggtcggcggggacccgtacgaggtcggacaggtgttcgcccggcggtggatggagcgactgaccgaccagacgcatctgcagaagctgtcggccatgtatccacgggttccgcaccgggtcgacggggagctgctgcggtacgccgcccggttcgggctgctcgcgcacaaggacgaccagatcgacgagcacgaccggtacgcgatcagggcggggttctggcgggagatcgatgtacggacggcggcggagcacgcgccggcgggagattagccggggctgccgcgccggagttctatttcaggacgggggttggatttcgggcggactccaccaccccgtactctcgtcccttgtgagtacgcgcacggcacaggcatgtcgacagggtggcgatgtcgtgtgcgccgtgcgggggctgaccaagacctacccggccgtgcgcggacggcgtggcgccccgggaacgcccgaggtgcgggccaccgacggggtacggctcgacatccggcgcggcgaggtcttcgggctgctcgggccgaacggcgccgggaagtccaccctcgtccgccagctgaccgggctgatgcggcccgaccggggcagcgtcgacatcctcgggcacgacatcgtgcgccatcccgagcgggccgcgcggatcctcgcctacctcgggcaggagtccaccgccctcgacgagctgacggtgtcgctcgccgccgagacgaccgggcggctgcgcggtctcgacgtccggcaggcgcggggcgagcgggacgccgtactcgacgaactgggtctcgcggcggtcgccgggcgcccgctgaagaagctgtccggcgggcagcgcaggctcgcctgcttcgccaccgtcctggtgggggagcggccgctgctcgtgctcgacgagccgaccaccgggatggaccccgtggcgcggcgggccgtgtgggccgccgtcgaccggcggcgcgccgagcgcggcaccaccgtcctgctggtcacccacaacgtcatcgaggcggagaccgtgctcgaccgggtcgccgtgctcgacagcggacgcgtcatcgcctgcgacacaccgggcgggctcaaggagcgggtcgcgggggaggtgcgcgtcgaactcgtctggcgcgagcgggcgccgctggacgttcccgaggtcgccgcgctgcgggcccgtgccgtcgagtccgggcgccgctggtcgctgcggctcgcgcccgacgaggcccgcgccgcggtcgccacggtcaccggaggagccgccttcgccgccctggacgacttcaccctggccacgccgagcctggaggacgtctatctggcgctcggcggcaacgcgcaggggctggtgaaggcgtgaggggcatgaacgtacgggccgccgcggccgtatggaacggggccggagcgaagaggagcagctcgacgtgagtgtcgtacccgctgaggttctgcccggcgtcacggccctggacgacggcgctcgaaccgaggcgccgctcgggccgcgggcgcggctgtggccgtcgctcgccgccgtctaccgggcgcagctgtcccgggcgcgggtcgcgcggatcccgctgctgttcgtggcgaccttccagtccgtcgggatcatgatcatgatgcgcggagtcgtcgacgacgcggacgaggcgcgggccgtggtcgccggggcgaccgtcctcgtcgtcgcgttcgtcgcgctgaacctgctcgcgcagtacttcgggcagctgcgcgccagcggcgggctcgaccactacgcgacgctgcccgtgccgcccgcggcggtggtgctcggcgcggccggcgcgtacgcctccttcaccgtgcccgggaccgtcgtcaccgccgtcttcgggtgtgtgctcttcgggctgccgctgacccacctgtgggtccttgccgcggtgatcccgctcgcgggggccgcgctcgccgggctcggggccgccttcgggctgctcgctcctcggcccgaactggccacgctgctggggcagttggggatgtccgcggcgctgctgctcggtgtgctgccggccgaccggatgccgggggtcgtgcagtgcgcgcgggatctgctgccgtccacgtacggggtcgaggcgctcgcgcggaccttcggcgggcacccggactgggcgttcgtcctgggtgacctggccgtgtgcgccgccgtcggggtcgcctcgctggccgtcgcgacctgggcctatcgccgagcggccgtccggtgacgcggccgacggacccgcctggcacgatggcagggtgaccgctccgctgactccgcctccgccgccgcacgaccagccctcccaggacccctggcaggcgccgcccgccggtggtgccgtgggcgtggccgggtacgaagaggacggccccgggatgaagaccgaagtccgcgaggccgccgtgatcacggtcggtcttgcgctctgcggagtgctgctcggggtgctgtggtggtggctggcgccgcatgtgccgctcatgggcggcgtggtcggcaaggagtgggtcgtctacctcaaggacaccgagggcgagcaggctgtcggggtcgatggaaccttcaccctgctcgcgctggccttcggcgcggtcagtgcgctcgccgtgttcctgtggcgccggcggggcggggtgccgctggccgtgtcgctcgccgtgggcggggtgctcgggtcgttgctcgcgtggcgggtgggggtctggctgggacccacgcagaacgtgctcgcgcatgccaaggccgtgggcaagggcgtcaccttctccgcgccgctgaagctgggcgcgaagggggcgctgctggcgtggtcgctggcggcgctgctggtgcacctcggactcacggcgctgttcgggccacgggatccggatccgtacgcgagcccgtacgacgcgcctccggctccgcccgccgggtaacggttcggcgcgttgtggccgcggcggggtgttccgccccgccgcccctgcccgtccctgcgggccgcacccccagcccccttcggcgtgccggcaggccctcaagcgccggtcgggctgagggaggtgtctcctacgccggcctcctgccgtggttcgcgttgcccttgcgcgtacgccatttccgcttgcgcgtcctcttcgacatgttcctcgtacttaaccgaggacggggcgtccgtcgaggggtcaggcacgggcgatcggggcggggaccgcttccgtgagcttcgccaagtcgtccggggacagctccacttcgaggccccggcggcccgccgagacacagaccgtgtcgtgggcggcggccgacgcgtccaggaccgtgcggagcttcttgcgctggcccagcggtgagatgccaccgcggacatagcccgtcgtgcgctccgccagcacgggatccgccatcgccgcgcgcttgccgcccaccgccgtcgccagcgccttcaggtccagcgagcccgcgaccgggaccacggcgacgaccagcgcgccgtccacgtccgccaccagcgtcttgaagacgcggtcgggcgagacgcccatcgcctcggccgcctcctcgccgtacgaggggtgcgcggggtcgtgctcgtacgcgtggaccgtgtacggcacgcccgccgccgtcagggccaccgtcgcgggcgtgccgcccggctgctgcttcttcgacttcttcgccacggtgccgctgccttcacgtcggttcagttgagactggtcgggccgcgcgtcagctcggacgctggcaacgacggcagattacggatgatcgccgtctccgtgcgcagcagtttcagctcctcgcgcagccgtgaggccgtgtccggggcctggagcagccgctgtttcgccggggtgtcgagcatcacggccgccgcgacgaggtacgagacgacggacggctcgtccggcaggtcggcgctcgtggagatggagcgctcgcgggcgccggccaggcgcttctggtactgccggaacgcgcgcagcacgccctcggcgagcgcacccgccccgtcgcccgggtcctcgggcagttcctccagctcggccgtcagatacgggcccgacgcgtccacggagagcagcttgacgcgtgtcgtgccggtcgccagcacctcgaagccgccgtcggcgcgctcccgcacggtcgccgcgtccgcgatgcagcccacggagtggaaggccttgaccgggtcgtcgccgaagccggccgcgggcccgcgctcgggcacggccgtcgggtccggcatgccgggcgcgctcggcgcgacctcgtagccgtcgcggatggcgacgacggcgaaccggcgcggttcgtcctcgggggtcttcagcagatcgcgcatgagggcgcgatagcgctcctcgaacacgttcagcgggaggacgagcccggggaacagcaccgagttcagcgggaagagcgggagccggacggtggtcacgacgcgaaagcctaatggtcgccggagcgggagcgtccgtcgtgcccactccgtggatcccgcgggcgctcacccggcggtccgagggggaggccggaggcgacctcgaggcggactccgtcgcgcagttccaggaactgcccgagcgggtcgtcggagatccggtcccaggggaacgaggtggcgtacgggccgatcatgcgcagttgctgcaacgcgtcctcccagcgctggagccgcaccaggacataggtgaggaggttgcggacctccgcgggccacgggtcggcggccgcgtactcgttcgagagcgcgatggcccggtcggccgccgcgtccaggcgctcgcgccccacggccgccccgccgccctcggtcagataggcgaaggcggcgcgcacgggcagcatctggaccagggagccgggcagggcgtcctgcgcggccgtctcggcgaagtcgaagcactcgcggtgcgagcgccggggggtgtgaggggtgtccccccgctgagcacagcaggcggcggacaagtactggagggcggcgacatggcagccgtagtggtgcgaggagcggcgcaccgcctcgccccacagccgttcgaactcggcgtgcccggcgttggtgccgcgcgcgtggtcgagggcgatccgccagggcaccgggtcgcgcggggcgccctccgcggcggcggtgatcagcggggcgacctggcgcaggagttcggcgcgggcgggcgactcccagccgcggcgcaccgccagctcggcccggacgagcagcgcgtccgggtcgtgcgggcgggcgcgccgccactcctcgagccactcgggccgggagcgcgcgaaggccgcgaggcgggtcgtgtaccggtcgcggttctcccactcggcggcctcgcgggagccggcgagcagctcggccgcgggctcgtactcgccgcgtcccgccgcgaccagcgcgggggcgaggtgttcgtcgggcgcgtcgaggagcacctcgtcgtcggcgggcagcccgaccgcgaggcgcggggagttcctggccatccgggccgtacggaggatcgcgcgcagcagtgccatggtggaagccattgaaagccgcaggtcggggctgtgtcagggggtgtgtggtgacgctttcgtaaccttcgattggttgtatgacggacggtcaagggcaagtaaaaggtgactgttgttcaactgttgacggtctgtccgccggctcgggccgccctgtccgtcagctgcggcgcagcagtcgggtggcccccgccgccacggtcgtcgccaggatccagccgagcaggatcaccgtcgcggccagccactgccagccgccgcgcagctgccactggccggcctggccgaggtcgatgaccggcagcagcagatccagcgcgaacagcgaggcgttccacgacggatgcccgtcgccgttgaccggggggtgcccggcgtgcgagaaggcgaccgacgtcaccgcccacaggaccgccatccacagggcggcgcgccccggccggtacccgtaggcgaccgcccagtcctgtacgtacccccacagcttgcccgcgaccggcagggtctcccggcggcggcgctgcttggcgagcagcacctcccgcgcgtcctcgtcctcgccggagttgcgcagcacggccgccaggcgctcgtacggctccgggttgtactcggcggtcgccgcggccacccactccaggcgctcggtcagcgggaaccggccgtgcggcacgaggttctcgtagccgaagccgcccatctgcagccggcccgggcccggccagctctccgccctgtcgaccaggttgacgatccgcgcgcccgacaggacgacccggccgcgctcggggtgctcgctcaaaaagcgcagctcgggcgtctggacccggcgcagtgacaactcctggtcgtcctcgaagacgaagcgggcccgctccaggtccaccgcgtccccgaaccgcccgtcgtcgagccggatcccgccccggcacgcgaaccgctgcacccgggtgccccgcgccggagtggcgccgctggtcagcggcggattgccgaggccggcgggggtcaggtacagcgtgcgcccgacggtcagctgaggcgcgttcagggccaggggcgtgtagctgttggtcagcagggcgccgcgcaggctcagcgagacgccgatcttggcgctgcgcagactcagctcgccgtgcgactccatcatctcggcctggaggtcctgcccgacggtcatgccgtcgccggtgagcgaacgcccgcgccggtcccggtagaccaccgcctggttcagcagcagatccgtgccgatgtgcgcgtccgtgagccgtacgccgttgtggaaccggcagcgcggcagatgcaggtcgccctcggtgtgcacccgtgccgcctccaggcgcggcaccgagcagtccacgaaccgtacggtcgtgaagtgggcctccggcagcaggacctccttctcgaaccggcagcccttcagttcgaggtacggcacgacggtgccgccggagagatcgagcgagtccttgatctgtacgccgacgagcttcagggacgccacccgccccgccagggccggcggcccgtccaggagcagccagcacacgatgcgggcccgtacggtgcgctcggggccccaggggtggccgccgtgcggatcgtccacggtcgcgttcccggcgcgcaggtcgtacacagtgccgttgcggaaggcctgccacatgccggcctcggcggcggtcaggtcgtccggcaggtccccggcgtggataccggcaccctcggtcacggcgcttccttcctcccgcccccggctgctcggttgctcggcccctctgtctctcttttctcgctgtctctctgtccctcggttactcacgggtttcgtacagtcgttcatgcccgctgtgtgaccgtctgaacgctaatggtgagggtgatcttccggagagcgggtgggatctgtatcagccattgatacgggcgtccggcggccgacgccggtctgagagaattggctatgtgatctcccgaatcgatctgcgcggcgacgccctccccgagggctccgccctgcgcgacctgctgccccgagccgacttcgacgtctcggccgccctggagaaggtgcgtccgatctgcgaggccgtgcatcatcggggcgacgcggcgctgatcgacttcgccgagaagttcgacggcgtacgcctcgagtccgtacgggtcccggcgcgggccctcgccgacgcgctggagcagctcgacccggcggtgcgcgcggccctggaggagtcgatccgccgcgcccggctcgtccaccgcgagcagcgccgtacgacgcacacgacccaggtcgtgccgggcggctcggtcaccgagaagtgggtgccggtcgaccgcgtcggtctgtacgcgcccggcggtcggtcggtctacccgtcctccgtggtcatgaacgtcgtcccggcccaggaggccggcgtcgagtcgatcgccctcgcctcgccggcgcaggccgagttcggcggactcccgcacccgacgatcctcgcggcgtgcgcgctgctcggcgtcgacgaggtgtacgcggccggcggcgcgaccgccgtcgcgatgttcgcgtacggcaccgagtcctgcgcgcccgccgacatggtcaccggccccggcaacatctgggtcgccgcggccaagcgctacttcacgggcaagatcggcatcgacgccgaggccggccccaccgagatcgcggtcctcgcggactccacggccgaccccgtccacgtcgcctccgacctgatcagccaggccgagcacgacccgctggccgccgccgtcctggtcaccgactccgtcgagctggcggacgcggtcgagaaggagctggaaccgcaggtcgcggccaccaagcacatcgacgaccgcatcgtcccggcgctgaagggccggcagtccgcgatcgtgctcgtcgacggcgtcgacgagggcctgcgggtggtcgacgcgtacggcgccgagcacctggagatccagacggccgacgcggccgccgtggccgaccgggtgcgcaacgcgggcgcgatcttcatcgggccctgggcgccggtctccctcggcgactacgcggccggctccaaccacgtgctgcccaccggcggctgcgcctgccactcctcgggcctgtccgtccagtccttcctgcgcggcatccacatcgtcgactacacgaaggacgcgctggccgacgtggcgcaccacgtggtgacgctcgcggaggcggaggacctgcccgcgcacggcgcggcgatcaaggcaaggttcggttggaaggtgcctgagagcaagtgagcttcggaatcgacgatctccccgtacgggacgagctgcgcggcaagtccccctacggcgcgccccagctcgacgtccccgtacggctgaacaccaacgagaatccgtacccgctgcccgagccgctcgtcgagcggatcgccgagcgggtgcgggaggccgcccgtcacctcaaccgctaccccgaccgggacgcggtggagctgcgcacggagctggccacgtacctgacgaacaccggcaagcaccccgtcggcatcgagaacgtctgggcggccaacggctccaacgaggtcatccagcagctgctccagaccttcggcggacccggccgcacggcgatcggcttcgagccgtcgtactcgatgcacgccctcatcgcgcgcggcacgggcaccgcctggatctccggtccccggggcgaggacttcacgatcgacctcgccgccgcccggcaggccatcgccgagagccggccggacgtcgtcttcatcacgacccccaacaaccccacgggcaccgcggtcccgcccgagacggtcctcgcgctgtacgaggccgcgcaggcggtgaagccgtcgatggtggtggtcgacgaggcgtacatcgagttcagccacggcgactccctgctgccgctgctcgaaggccggccgcatctcgtcgtctcgcgcaccatgtccaaggcgttcggcgcggccgggctgcgcctcggctatctcgccgcgcacccggcggtggtcgacgccgtccagctcgtacggctgccgtaccacctgtcggccatcacgcaggcgaccgcgctggccgccctggagcacaccgacaccctgctcggttacgtggagcagttgaaggccgagcgggaccggctggtcgccgagctgcgcgcgatcggctacgacgtgaccgagtccgacgcgaacttcgtgcagttcgggcggttcgccgacgcgcacgaggtctggcagcagatcctcgaccggggcgtcctggtccgggacaacggcgtaccgggatggctgcgggtcagcgccggtacccccgaagagaacgacgcgttcctcgacgcggtccgtgagctgaagaaggagcagaacgcatgagccgcgtaggccgcgttgagcgcaccaccaaggagacctcggtgctcgtcgagatcgatctcgacgggtccggaaaggtcgatgtgtcgaccggggtcggcttctacgaccacatgctcgaccagctcggccgccacggtctgttcgacctgacggtgaagaccgagggcgacctgcacatcgactcgcaccacaccatcgaggacaccgccctcgccctcggtgccgccttcaagcaggcgctcggcgacaaggtgggcatctaccgcttcggcaactgcacggtcccgctggacgagtccctcgcccaggtgaccgtcgacctgtcgggccgcccgtacctcgtgcacaccgagcccgagaacatggcgccgatgatcggcgagtacgacaccacgatgacccggcacatactggagtccttcgtcgcccaggcgcagatcgccctgcacgtgcacgtgccgtacgggcgcaacgcgcaccacatcgtggagtgccagttcaaggcgctggcgcgggcgctgcggtacgcgagcgaacgcgacccgcgtgccgccggcatcctcccctccacgaagggcgcactgtgagcgggctgtccaccgtcctgatcgtcctcgggctcttcctcctcggcggggtctactccttcgtcaagcagaagatgccgacgagcctcatcgtggtgctgtcgatcggcgcggtgatgtgcctggccgcgggcgtcgtgcgactggaggtgtggaattgagtaccgcgaagaaagtcgtggtgttcgactacggcttcggcaatgtgcgctccgccgagcgcgcgctcgcccgtgccggcgccgaggtcgagataacgcgtgacttcgacacggccatgaacgccgacggactgctggtgcccggtgtcggcgccttcgccgcctgcatgaaggggctgaaggaggcgcgcggcgactggatcgtcggccgccggctggccggcggccgccccgtgatgggcatctgcgtcggcatgcagatcctcttcgagcgcggcatcgagcacggtgtggagaccgagggcctcgacgagtggcccggcacggtcgggccgctcgaggccgagatcgtgccgcacatgggctggaacacggtcgaggcgcccgggggatcgcagctcttcgcggggctcgacgccgacgcgcgcttctacttcgtccactcgtacgccgtccacgactggtccctggacgtcgcgaacccggcgatgcgcgcacccctggtgacctggtcgacgcacggcaagccgttcgtggcggccgtcgagaacggcgccctgtgggccacgcagttccaccccgagaagtccggcgacgccggagcgcagctgctgaacaactggatcggaaccctctgatggcttcgaagctcgaactcctccccgccgtcgacgtccgtgacggccaggccgtccgcctcgtgcacggcgagtccggtacggagacgtcctacggctctccgctcgaggccgccctcgcctggcagcggtcgggcgccgagtggctgcacctcgtcgacctggacgccgcgttcggcaccggcgacaaccgcgcgctgatcgccgaggtcgcgggggcgatggacatcaaggtcgagctgtccggcggcatccgcgacgacgacacgctcgccgccgccctcgccaccggctgcacccgggtgaacctgggcaccgccgccctggagacccccgagtgggtcgccaaggtcatcgccgagcacggcgacaagatcgcggtcggtctcgacgtacgcggcacgacgctgcgcggccgtggctggacccgcgacggcggcgacctctacgagaccctggagcgcctcaactccgagggctgcgcccgctacgtggtcaccgacatcgcgaaggacggcacgctccagggcccgaacctggagctgctgaggaacgtctgcgcggcgaccgaccgcccggtggtcgcctccggcggcgtgtcctcgctggacgacctgcgggccatcgccgcgctggtgccgctcggtgtcgagggctcgatcgtcgggaaggccctgtacgcgaaggcgttcaccctggaagaggccctggaggcggtagccaagtgagcgacgtacgacgcgtcagcaccggcgcgccctgggaggacacgttcggctactcccgtgcggtgcagctgccgaacggtctggtgctggtctccggctgcacctccgtgatcgacggatcgatcgtcgacgacggcccgtacgagcaggcgctcaactccttcaatgtcgcgttcgcggcgctgaaggagctcggcctcggccgcgacgacgtcgtccgtacgcgcatgtacctcacccatgcccgggacgtggaggagatcggacgcgcccacaagcagctgttcgactccgtccgccccgccgcgtccatgatcatcgtctccggtttcgtggacccgcgcctggtcgtcgaggtcgaggtggaggcgtaccgagaggccccgcagtcatgaccctggccgtacgagtcatcccctgcctggacgtggacaacggccgggtggtcaagggtgtcaacttccagaacctgcgcgacgcgggcgaccccgtcgagatggcgaaggtgtacgacgccgagggcgccgacgagctgacgttcctggacatcaccgcgtcctccggcaaccgcgagaccacgtacgacgtcgtgcgccgcacggccgagcaggtgttcatcccgctgacggtgggcgggggcgtgcggacgcccgacgacgtggacaagctgctgcgggcgggcgcggacaaggtgggcgtgaacacggccgccatcgcccggcccgagctgatccgtgagatcgccgagcggttcggccggcaggtcctggtcctgtcggtggacgcgcgccggaccgagagcggcagcttcgaggtcaccacccacggcggccgcaagggcaccggcatcgacgccgtggagtgggcgcaccgggccgccgagctgggcgcgggagagatcctgctcaactcgatggacgcggacggcaccaaggacggctacgacctggagatgatcgcggcggtgcgggcgcacgtgaccgtgcccgtcatcgcctccggcggcgccggcaagctcgaccacttcccgccggccatcgcggcgggcgccgacgcggtgctggccgcgtccgtcttccacttcggtgatctgcggatcggcgaggtgaaggagacgctgcgggcggcggggcatcccgtgcggtgacgccgcgccgcgtcggccccggtcacctggtggccggggcttctccttgagcagacgcgaaaggaaagttgtgcaatttttgttgcgcaacttttctttcgtatctacggtggagccgtgaccgccaaggagaaccgccccatcaccgacatcggcacgctcaaggcgctcgcccatccgctgcggatgaagctctaccgggccctgtgcgtgacccgcaccgcgaccgcctcgcagctcgccgagcaggtcgacgaaggcgtctcgctggtcagttaccacctgcgcaagctcgccgaccacgggctgatcgaggcggcccggccgcagagcggggacggccgcgagcgctggtggcagccctcctcacagggcgtgagcatcaaggacaaggacttccgggacgcacccgagaaggcggccgcgcacgcggcggccacccgtctcttccacgagcagcgcgccgacctgtaccgccgctatctcgacgagcgccccacctggggccccgagtggaactccgccgcgcccgaccaggagtccctgctgcgcctgacccccgccgagctggccgagctgggcgcggagttgctcgccctcgccaggaagtacgacgagaagggccgtgccgccgaggccgccggcgacaccgaagggcgcgagaacgtcgcgctgcatgtgtacggcttcccgttccgcccctgatccgcgtcggcttcgagagggaaccgcttcccgtgaccgccacactcataccgccggtccacgccgccgcccacaagccggcccaccgcgactccaacgtccttcgctggctcggcgcctacaccgcgtcgatggtgggcgacaacgtctactacctcgcgctgtcctgggccgcggtccaggccggtacgccctcgcaggccggcctcgtgatggccgtcagcgccgtgccgcgggccctgctcatgctgggcgggggagtggtggccgaccggttcgggccgcgcagggtcgtcatcggcagcgacgcggtgcgctgcgctgccgtcctcgcggtggccgcgctgctgttcgcggcgagccccgggctgtggccgctcgccctgctcgccgttctcttcggcaccgtggacgccgtgttcatgcccgccgtgggcgcccttccggcccgcgtcaccggccgcgaccagctcgcccgcgtccagggcatgcgcggcctcgcgatccgcttcgccaacgtggtgggcgcgccgctcggcggcctgggcgtggcgctcggcggagcggcggccgcgttcggactggccggactcctgatcgccgtctcggtgccgttgctgatctccgtacggatgcgggacctgccggcggacggggaggggggcggggaagcggaccgggaggcgggcgggaaggcggaccaggaggcggggccccaccgcatgggggccgcgcaggacaccgtcccccgcaccaccccctggcaggacctccgcgacggtctgcgctacatccgtggccaccgtgtgctcgccccgctcctggtcgccatcgccctcggcgacctcggcttcgtcggaccgctcaacgtcgggctgaccctgctcgccgagcagcggggctggggcgcctccggtatgggctgggtgctctccggattcgggaccggggccggggtggccgccctgctgctgaccgtacggggtcggctgccgcacgccggacgtgtcgtcgcggcggcgatcctgccgggctccgtcgcgatcggcgcgctcgcgtacgcaccgagtctcgtcgtcgccgtcggcacggctctgctggtcgggctgctcgccgggctcagcggcgccctgtgcggcgcgctgctccagacccaggccgaccccgcgtacctgggccgggtcagctccgtggccggcatcgtcagcctcggcttcgccccgctcagcatgccgctgagcgcggccgccatcggctggtggggcaccggccccgtcttcgtcaccagcgccgcggtctgcggcctcggcggcgtcgtcgtgctgtgctccggcccactgcgccgcgcccagctgcctcgctgagcgcgccggggggaccgggggggggcgaggcggggaggcgcgagccgggggggtgagccgcgggggtgtgagcggggggtgcgagccgccctcggctcgcagcgcgcctgtcggcgggcggggaaggcgcgggctgccgggaccgggtgattttgcgttccgatacgggcgctgctcgcgacgccgctggccgcatcgccgctcgccgctcgccgcggatggtctctcaccgcaccggtcgtgggcgcgcagaccgccgaccacccctgcgcgcggaccggccgccccggtcgggcctcgaggcgccgaccggaccgtacgcggcgtcgccagtcggcctggaccgcgtggggagcgcgtatcgcgaggtgccgggcgtcgcgaggcagcggggaatttgtcgacgaactctagggaccgaccggacggtatgccatccttcgggaccaaggactgctccggagccgcccggcgggggacgaacgccgtgctgggcaccggtgcgaaccgaaccggtggaggaccgcgatgccgaacgccgtacgagcccgtgtccgggcggtgcccgggctgccgcccgcctcgccgcccgtccgttccctcgtcgacgcggaggccgtcgccgtgctgcgccgcgcggccgccgtcctgatggacgacctccccgaaatcaccgaacggctgctcgccgtgctccaggagcaggagccggcctaccgggcggccttcgaaacggacccctcggggctgtggcaggaggtgcaccgctccctgcggcacaacgtcggctccctgctgcgccccagggagtgcagggacgccgcccggcgctgctcatggcggatcggcgccgaacgggcggaacaggggatgccgttggacgcgctgctgcacgcctttcggctcggcggcgccctggtgtggcggaggctcgtcgaggaggccgcacggcgcgaccccgacgacgtacgcctgctggtgcatgtggcgtcggacgtgtggaacttcgtcgacgagcactgcaccctggtcgccgacgcctaccggcatgtggaacggcagctcgcctggcggcgcgagaaccggttgcggctgatgaccaccgccctcctcgacggcacgacccgcatagccgacctgccggacgtggccaccgcgctggaccttcccgagcagggcaggtacgcggtggtgagcgtggccgtcgcccacccggccggccacgtgggcacacaactgctgtccgtgccacccggtatgcgggcgctctggcacaccggcacggacgtcgagcacggcatcgtccacctcggcgagcgcgagccgaaggatctggtcgaccgcgtgaccgtaccgatcggggcccgggtcggtatcagccgcgcggtcgacggtctcgcggcggtcggtgacgcacgccggctcgccgagaccgctctgcgcgcctgcccggagagcggcggcaccgtcctgctcgacgagcatctgcccgcggccctgctggtgtccgcgccggccctgggcacggcgctcgtcaaccgggtcctgggaccgctgctcagcctcgacccgagcgaccgggacctgctcctggacaccgtcagcgcctggctcgacaacgacgggtccgcccagcgcgcggcgagccggctgtactgccaccgcaacacggtcctcaaccggctgcgccgtttcgaacagctcaccggccgctgtctcacccggcccgcggacgtcgtcgacacctcgctcgcgctgaccgcccggcggctcctcggggactgaccccgtccctcccttggagcggctcctcggggactgaccccgtccctcccttggagcggctcctcgcggactgaccccgtccctcccttggagcggttcctcggtggccgaccctgcctcttggagcggctcctcggggggctgaccgcgccctttgggacagcgcacagtccgtggacggcgggccacgacatgcgcacacgtcccgcacgcgtcccgtgggcatccccgccgggcttccgccgggcttcctcccgcgcctgctcggttcgccgccgccgcgccgggcggacggccccggcagcgggccgggctccgcgcgggacgcggcacgctgggcagcggcacaactctccgcccccgacgctgggagccggtcccgagacgcggccgggcgctgtacgcgaccgtgggcgcatgctctcgtagggccacttcccccgtatgtccgcgtcgtgcggaaccgaggagttgtgatgccctctttgtcatcggacggcgcccggcaggacatacccctgccgggcggaccgcccccgaaggacccgcccccgaacgggccgtcggtgctgcacgtgcgcgacctcgacgtggcctacgggcgcgccctgaccgcgttgcgaggtgtctgcctggaggtgcccgcgggcggggccgtggccctgctcggcgccaacggcgcgggcaagagcaccttgctgcgctccctctccggcaccctgcgcctgcatcgcggagcgatcaccgcgggcagcgtccactacggcgacgtgcgcctgaccggacaggacccggtggccgcggtgcgcgccggtgtcgtacaggtccccgaaggccgccgggtgttcgccggactcaccgtggacgagaacctgcgggccggcggactgggcctcggccgccgtgccccggcggtcgtcaaagccgcccgcgaacaggtcttcggactgttcccccggctcgcggaacgccgcgcgcagcgcgccggactgctgtcgggcggcgagcagcagatgctcgccatcgggcgggccctgatggccgcaccccggctgctgctcctcgacgaaccgtcactcggcctggccccgctgatggtcgagcgcatcgccgaggtgatccgggagatcaacgagcagggcacctcgatcctgctcgtggaacagaacgccgcgatggcactggcactgtccgaccacgcgtacgtcctcgaagtcggcgaggtgcggctcgccggcccggccgccgaactggccaggaccgacgcggtacggcgcctgtacctgggggaggaggccggacccgaggcgatggggcccggcgaggccaccgcggctccggacactccgggcccgcaccccgcgccgcccggcccgccccctggtccggaggccggtacggacggtgcggtcggttcgtctcctggtccggaggccggtacggacggtgccgccgggccgccccccgatcccgacaccggcacggaaggcgccgccggcccgcccggcgggcagcgcaccacgaccgagggccagcgcaccacggccgaagggcagggcgtcgcatgagcgtgtcacccccgcccctgcgggtcgacgacgtcacggtcaaattcgccggactcaccgcgctggactccatcggcttcaccgtggcgcccggcagcgtccacgcgctgatcgggcccaacggagcgggcaagtccacctgcttcaacgtcgtgtccgggctgtgccggcccacgcacggcagcgtcagcctcggcgacacggaactcacccggctgcccccgcaccggatcgccctgctcggcatcgcccgtaccttccagaacatcgtcaccacggcgggcaccgtgggcgacaacctgatgctcggccggcacgccctgtcccgcgcggggttcaccgcgaccgccctgcgactgccgggcaccgtgcgcgagcagcgcagccaccgggcccgcgcccgcgagatcgccgaactcaccggcctcggcacgctgttcgacacgccggtcgccctgctgtcgtacggcgaccgcaagcgcgtcgaactcgcccgcgccctgtgcctggagccgcgggtgctgctgctcgacgaaccggtggccggcatgaactccggcgaacgcgcccgcaccgtcgaggtcgtgcgcacggtccgcgcggaactgggcctgtccgtgctgctggtggagcacgacatgggcctcgtcatgcggctggccgacgaggtcaccgtcctcgacttcggccgccgtatcgccgcgggcaccccggaccaggtccgccaggaccccgaggtccgccgcgcctacctcggcaccccgaccactccccaggagcacatcgcatgagcaccgccctggacaccgtactgaacgggctcgccctcggttcggtctacgccctggtcgccctcggcttcgtcatcatcttcaaggcctcggcagtgatgaacttcgcgcacggctccctgctgctcctcggcggctatctgaccgcggtgctgcacgaccggctcggcttcgcgggcgccctcgccctcgcggtcctcgccaccgcggccgccgccgggctgatcgactggctgctgctgcgccgcctcgacccgcacgccgcgcacgtactgaccatcctcaccatcggcgtcgacatcctgctgatgacggacctcacccgccgcatcggcggggacctcctcaccctgggcgacccctggggctccgacgtgaccgagctcggcccgatcaccgtcgccgacagccggatcgcctcgatcctggtgtcactggtcgtcatcgccgccgtcttcgccgtcttccggttcacttcgtggggcctgtccctgcgagccgccgccgaggaccacgaggccgccgcgctgatgggcatcaggctcgcccggatccggaccctcgcctggtgcctggccggcgcgctcgccgcgctcgccgccgtcttcctggccgccttcccggcccccggcctggagcgcaccaccggacagatcgcgctgaaggccttccccgccgcgatcctcggcggcatggcctcgccgccgggcgcgctcgccggaagcctgctgatcggcgtcaccgaggcgctggcggccggctaccagtccgaactctccgcgctcggcgagggcttcggcgacgtggtgccgtacgccgtgatggtgctggtgctcctcgtccggcccgccggtctcttcgggacgagggaggcggcccgtgtctaggcgcctcgtcatggcgggcgctgccgtcctcctgtgcgtactgcccttctatctgggcgcgttctggctccaggtcggactgttctcgatggccgccgcgctcggagccgtcggactcaccctcctcaccggcaccgccggccagctctccctcggccacgcgttcttcctcgcggtcggcgcctacggatacgtgtggctggcgggcgaccccgggccggggctgccgccgctgctcgccctggtgctggcggtctgtctgagcggtctggtgggcggcctgttcagtccggtcgccggccgggtgcgcggcgtctacctcggggtggcgacgctcgccctggtcttcctcggccaccacgtgatgctcaacgccgactccatcaccggcggcttcaacgggcggtccgtgccgcccatgtccctcggcggcttcaccttcaccgcgagcgatccccaactgaccgtgctgggcgtcccgttcggcgccgaggagcgcctgtggtacctggcgctgatcctgctcgcggtgggctggttcgccgcccgcaacctgctgaacggccgcccgggactggccctgaccgcgctgcgcgacagcgagaccgcggcggccgtgatgggcgtcccggtcgcccgccggcgctcggccgccttcgtggtctcctccatgtacgcgggcctggccggggtcctgctcgcgctcgtcttccgccggatcgtgccggactacttcggcctcgcactgtccatcgactacctcgcgatgatcgtcatcggcggcctcggctcggtggcgggcgccgccgcgggcgccgtcttcgtcaccgcgctgccgttgctcatggcccgctacgccgaccagttgccgctggtcgccgcgcccggcgccgcgggccacgcggtgggccccaccgaggcctcccgctatctgtacggcgccgccatcgtcctcgtcctgctcttcgcccccgacgggctgagcggcgtcgcccggcgcgccggcgccgcggtccgccgacgccggaccgcgcccccgcgcacggcgtccgccgatgtcgcatcaccggcctccgcatcaccggcctccgaatcaccggcctccgcatccccggccgcctccaccccggccgcgtccgcatcagatcaacgacccaaggagcgcacctcgtgaacacgacgggacgcacagcactcgccacgacccttgccgcctttctgctggccggcgtcggatgcagcaccaaagccggtgactccggcggcgacaccgccgcggacggcgtgaagaccggccccggcgtcaccgccgacaagatcgggctgggcgcgctcacggatctgagcggcccctacgccaccctcggcaagagcatcgtccaggcccagcagatgtgggccgacgagaccaacaagaagggcgggatctgcgggcgcaaggtcgagatcgtcgtcaaggaccacggctacgacgtccagaaggccgtggccgcctacaccgagatctccccggacgtcctggcgctgccccaggtcatcggctcgcccgtggtctccgccctgctcgacgacgtggagaaggaccacctcctcaccttcccgcaggcctgggccgcctccctgctcggcaaggacgccgtgcaggtgctcggcaccacgtacgacatcgacatggtgcgcgccgtcgacttcctcacccgcaagcagggcgtgaagaagggcgacaagatcggccacgtgtacttcgagggcgactacggcagcaacgcgctggaaggctcctcgtgggcggcgaagaaggcgggcctcacggtcgtcggacagaagatcaaggccaccgacaccgatctgtcggcgcaggtcaccgccctgcgcaaggccggggtcaaggcgatcctgatcagcgcgggccccagccagaccgcttccctggtgggtgtcgcggcttcacgcgggctgaaggtcccggtcgtcaccagcgcccccggctacgcgccgcagctcctcaagacaccggcggcgcccgcactgctcgccatgctgcacgtcgtcagctccgccccgccggtcagttccgaccttccggccgtcaagaggatggtcacctcgtaccagaagaagtaccccggtgagctcgtggacgcgggcaccttgtcgggctacaacgcggccgaactcatgggccgcgacctgaaggccgcctgcaaggccaaggacctcacccgggagggcctggtgaaggcgcaccgctcgcagaaggcggtggacaacggcctcggcaccccgcaggacttctccgacgcctcgcgcccggcggccatggccgcctacgtgaccaagccggacaagaaggccacgggcggcaccgtgctggtcgaggacgcccgcgcactgcccgcggaacagaagttcctggactcccgcaagaagtgacaccgggacacggcgccccggcacgtgtcgcaccgcccggcgggccgaccgccgggccgcggccctccggctggagggccgcggcgtcaggagtgtcggtccgcccccgcgctgtgattcccggggcaacccccgggtctccggccgggagaccgtcgcgtcccggagcggtcggtccgcccccgcgctgtgattcccggggcaacccccgggtctccggccgggagaccgtcgcgtcccggagcggtcggtccgcccccgcgctgtgattcccgggggcggatcgacgtgtccgacgcctgcggccccgccaccgcccggccccccggggccgcccaccgagcgctcggcggatgcagcggtgtggtgagccgctccgcggaccccggcggcccggcgagccgttcggcggaacccggtggcccggtgagctgctttgcagaccccggtggcccggcgagctgctcggcggatcccgtcgacgcggacccgcccccgcagactccggcggcccggcgagctgctttgcagactccggtggcccggcgagccgctcagcggaccccatcgacgtggtgaccggccccgcggaccccgacgccccggtgagccgccccgcagaccccggtggcccggtgagcggcgggagccgccccgcggaccccggtgcctcagaggccgagttgcttcgtctcgtgcagtctcgcgatcgcttccttgtccccgtccagctcgacggccgccacgttctgccgcccgcacgcgaagatcagcagctccgagggctcgccggtcaccgtcaccaccggtgtgcccttgtgcgcgaccaccgtctgcccgtccggccggcgcagcacgaggccggtcggcgcgccgcggcccaccagacgggccgtgcgctccaggcgggaccacagggtgtcctggaagaccgggtccagcgcgcgtggcgtccagtccggccgcgcccggcgtacgtcctcggtgtggacgtagaactcgaccgtgttcgacgcctcgtcgatctgcttcagggcgaacggggagaagcgcggcgggccggtacggatcagctggatgagctcctcgtacggcttcgcggcgaactccgccatcacccgctcgagccggggcgcgagctgcttgatcagcagcccgccggccgcatcggcccggcgctcgcgcaccaccacgtgcgcggcgagatcccgtgtgttccagccctcgcacagggtgggggcgtccggtccctccgcctccaacagatcggcgaggagaagtcgttcacgcttcgcatgggtcgacatgaggccagcctacgaccgcccggccggtcggcccagtggacacccgggaggaacccgccgcgcggtccgcccactggacgtccgccggggatgtccgaccggcgcggcacaatggtcggcatgaccagcacgccccagcccagcaggcccagcagcctggacgccgagatcgccgcgcgcctcaagcgcagcgccgacgggctcgtccccgccatcgcccagcagtacgacaccggtgaggtgctgatgctcggctggatggatgacgaggcgctgcaccgcacgctcaccacgggccgctgcacctactggtcgcgcagccgcggggagtactgggtgaagggcgacacctccggccacgtccagtacgtgaagtccgtagccctcgactgcgacgccgacaccgtgctcgtcaaggtcgaccaggtgggcgccgcctgccacacgggcgcgcacacgtgcttcgacgccgacgtgctgctcaaggacggcgattccggcgtacccgcagcggatcagtaaggtcagccgccatggacctcgagacgttccgcaagctggccaccgaccgccgtgtcattcccgtcagccgcaaactcctcgccgacggcgacaccccggtcgggctctaccgcaagctcgccgccgagcgccccggcaccttcctcctggagtccgcggagaacggccgctcggcgttcaaatggtcccgctactccttcgtgggcgtccgctccgccgccaccctcaccgagcgtgacgggcaggcgcactggctcggcaccccgcccgtgggcgtccccacggacggcgacccgctcgccgccctgcgcgccaccatcgaggcgctgcacacgccccacgaggagggcctgccgcccttcaccggcggcatggtcggctatctcggctacgacatcgtgcgccgcctggagaagatcggccccggcgagcgcgacgatctgaaacttcccgagctgaccatgctcctcaccagcgatctggccgtcatggaccactgggagggctccgtcctgctgatcgccaacgcgatcaaccacaacgacctcgacacgggcgtcgacgaggcctacgcggacgcggtcgcccgcctcgacgccatggaggcggacctgtcgcgcgcggtcgcgcagccccccgccgccctcccgccctccgaactcccggagtacaccgccctctggggcggccccgacttccaggacgccgtcgaggacatcaaggagcgcatccgggcgggcgaggcgttccaggtcgtcccctcccagcgcttcgaaacgccgtgcacggcaagcgcgttggacgtctaccgggtactgcgggcgaccaacccctcaccgtacatgtacctcttccgcttcgagggcttcgacgtggtcggctcgtcccccgaggccctcgtcaaggtcgaggacgggcaggcgatggtccaccccatcgcgggcacccggccgcgcggcgcgaccccgcaggaggaccaggccctcgcggacgagctgctggccgaccccaaggagcgcgccgagcacctgatgctcgtcgacctggggcgcaacgatctggggcgggtctgcgagcccggttccgtcgaggtcgtcgacttcatgaccatcgagcgctactcgcacgtgatgcacatcgtgtcgaccgtgaccgggcgggtcgcgcgggggcgtacggccttcgacgtgctgacggcctgcttcccggccggcaccctctccggcgcgcccaagccccgcgccctgcagatcatcgacgaactggagccgtcccggcgggggctgtacggcggctgcgtcggctacctcgacttcgcgggcgactccgacaccgccatcgccatccgcacggcgctgctgcgcgacggcacggcgtacgtgcaggcgggcgccggcatcgtcgcggactcggacccggtcgccgaggacgacgagtgccgcaacaaggcggcggcggtcctgcgcgcggtccacacggcgaaccggctgtagcccgtccaccgtggccgcggtgaaccccgggtgacggttcgcccggggttcaggcgatagtggagtacgtgactgccgtaccaaccccccgatccgaagccgcgggacccgcccggtccggccgccggagccttgccgtggccctgctgtgcggtgcgctcggcgccgccgtggcgctgctgtcctcccggcagggctgggcggcggggaccgtggcggtggccggcggcgacttcccgctgaccgccaagggcagcgacgtcacgggcgtgcccgcggccctcgccatagtgggcctcgccgcgctcgtcgccgtcttcgccgtccgcagcgccgggcgcctgctggtcgccgcgctgctcgcgctgtccggcgcgggcacgatcgccgccgcgctcctcggcgtctcggacagcgcggccctcgacgagaaggcggcccaggcgtccggcgacacctccgcgaccgccgaggcactgacccacaccgcctggccgtacgtcgccgtcgcaggcggcgccctgctcctcctcgccgggctgctcgccctgcgctacggacggctgtggcccgcgatgtccggccggtacgagcgcgacggcacgccccggccgcgccaggcccgggtggaccccgaccggcccgaggacctgtggaaggcgctggaccgcggcgaggacccgacgggcccggacccggcgtaggcccgaccaggcacgtcgtcgccctgggtgtccgactcgcgggacggaccccgcgctcagggcatccgcccgggtacgggacaatgggcgacgagcgtccgactcacacacgcatagcaacgaggagcaagtcatggcgggcagcagccacggtcacaccccggccgcctggaccggtgtcatcatcgccttcatcggtttctgtgtatcgggtgccttcatggtgttggccaacccgctgggcttctgggccggcatggtcatcgtcgtcctcggcggtgtcgtcggcggcatcatgcgcgcgatgggcctcggccagcagaagaccacgcacccggtgcaccacgtcgcgagcgccggcgcggagagctgagcccgcaaggcttcgagaggcggtcccggcgtccagtgccggggccgccttcgcgtgtccgtacccggcgggtgggcggcgcggacggggcgggggcagaatgcgtggggtgaacgcacaatcccagtgggtgacgcggccgggcgcggatcagccgggcgcggatcagccggacgcgggcgcggggcccacggccgtgctgcggcggctcgctgtccccggcggggtgctcgcggccgtcgtcggggccttcgcgtacgtcggggcggtcgatcccaaccagccggggcactacccggtctgtccgctgctccgcttcaccggcgtctactgccccggctgcggcggactgcgcagcgcgcacgccttcgtgcacggggacctctcggccgcgctcacggacaacgcggtggccgtggccggctacttcgtgttcgccgtggtgtggactttctgggtggtacgggcggcgcgcggacggccggtgcggatcgacctggggccggtgcatctgtggagcgtgggcgcgttgctgctggtcttcaccgttgtccggaacctgccgttcggtggctggctgcatccttgatcgaatggcaaacgtccaggtagtgggaccggcatccaccggatgcggagccttggccgtcctccggataccatcggagtgaccgtcggtatcgcccagagaggcggtcccgatgtccccaagcccaccgcttgaacttcaaccgtcaggaagggggccgctcgcgtgagtgtgctcgacgagatcatcgacggagtccgtgccgacctcgcggagcggcaggcgcgggtcagcctcgacgagctcaaggagcgcgtggcgaaggcacccgcggccaaggacggcgtggccgccctgcgcggcgacggcgtcaaggtgatctgcgaggtcaagcggtccagcccgtccaagggcgcgctcgccgcgatcgccgaccccgcggctctggcggcggactacgaggcgggcggcgcgtccgtcatctccgtcctgaccgagcagcgccgcttcggcggctccctcgccgacctggaggccgtccgcgccaaggtcgacatccccgttctgcgcaaggacttcatcgtcacgtcgtaccagctgtgggaggcccgggcgtacggcgccgacctcgcgctgctgatcgtggccgccctggagcagcccgccctggagtcgctgatcgagcgcgccgtgtccatcgggctcacgccgatcgtcgaggtgcacgacgaggacgaggccgagcgggcggtggacgcgggcgcgaaggtgatcggcgtcaacgcgcgcaacctgaagacgctcaaggtcgaccgcaccacgttcgagcgggtcgccccggagatccccgaggggatcgtgaagatcgccgagtccggcgtccgcggcccgcacgacctcatcgcgtacgccaatgccggcgccgacgccgtcctggtgggcgagtccctcgtcaccgggcgcgacccgaaggcggcggtcgccgacctggtggcggccggtacgcatcccgccctgcggcacggccggggctgacacctcgatgaccaccgccgaccgggctctcgccgccgtcaccgtccgtccgggctccggcctcgacggtggtggcgccgtggcgtgcgtgcggtcggtcgtaccggtgccggtggtggccgctcaggcgcccctctccgcggcccgggacccctatgcccggctggcccgcggctgccgtccgcgcggctgccgggcaccggcccgacgggtgcacgggcgacgggtgcggtacgtgatcggcgacgagccgggccaggtcaacggcatgcgatggcgccggggtgcgcgcgtgcgcaccctgcgggccggctgaaccgactccggttcgcgaccggtgccgctgccgctgccggcgatcccccgacgggggttcgggccggttcggcaccgccgacctgcgccgtgggagtagctcgccgtcgcgacggcgtgagccgcccggcggcgggactctccccggggcagagcggcggaacgctccccttccgagcgctgtctcccgcgctgcccctgccgacggcgggagcgggcggcggacgagacacccccggtggagccccgcgcgcgctactgacgtgaccgttgtccgacctgtaaccggggctgtcgcccctgcgaggtaaccgcatgtccagcgagttcttcattcccgaccccgagggtcaagtccccaccgccgagggctacttcggcgctttcggcggcaagttcatcccggaggccctggtcgccgccgtggacgaggtcgccgtcgagtacgacaaggccaaggccgaccccgagttcgcccgtgaactggacgacctgctcgtccactacaccggccgcccgagcgccctcaccgaggtctcccgcttcgccgagcacgccggtggcgcccgcgtcttcctgaagcgggaggacctcaaccacaccggctcccacaagatcaacaacgtgctcgggcaggccctgctcacccggcgcatgggcaagacccgcgtcatcgcggagaccggcgcgggacagcacggcgtcgccaccgccaccgcctgtgcgctcttcggcctcgactgcaccatctacatgggcgagatcgacacccagcgccaggccctcaacgtcgcgcggatgcgcatgctcggcgccgaggtcatcgccgtgaagtccggcagccgcaccctcaaggacgccatcaacgaggcgttccgggactgggtcgccaacgtcgaccgcacccactacctcttcgggaccgtcgccggcccccaccccttccccgccatggtgcgcgacttccaccgcgtcatcggggtcgaggcgcgccggcagatcctggagcgcgccggacgtctgcccgacgcggccgtcgcctgcgtcggcggcggctccaacgcgatcgggctgttccacgccttcatccccgacaccggcgtccgcctcatcggctgcgagcccgcgggccacggcctggagacgggtgagcacgcggccaccctcaccgccggcgagcccggcatcctgcacggatcgcgctcgtacgtcctccaggacgacgaagggcagatcaccgagccctactcgatctcggccgggctcgactacccgggcatcggacccgagcacgcctacctcaaggacagcggtcgcggcgagtaccgcgcggtcaccgacgacgcggccatgcaggccctgcgcctgctctcccgcaccgagggcatcatcccggccatcgagagcgcccacgcgctcgccggtgccctggagatcggcaaggaactgggcaaggacgggctgatcctcgtcaacctgtccgggcgcggcgacaaggacatggacacggccgcccgctacttcggcctgtacgacaccgacgcgtccgtcgccgcggacgccgacagcgacatcgccgagatcgagggggacgccaagtgagcggcgccgcattttcccgtcagaggggccaactgctgagcgacaccctcgccgccgcgaaggcggaggggcggtccgccctcatcgcctatctgccggccgggttcccgaccgtcgacgggggcatcgccgccatcaaggccgtcttcgacggcggcgccgatgtcgtcgaggtcggactcccgcacagcgaccccgtcctcgacggccccgtcatccagaccgccgacgacatcgccctgcggggcggcgtcaggatcgccgacgtcatgcggacggtccgggaggcgcacgaggcgacgggcaagccggtcctcgtgatgacgtactggaaccccatcgaccgctacggcgtcgagcggttcaccgccgagctcgcggaagcgggcggagcgggctgcatcctgcccgacctcccggtgcaggagtcggcgctgtggcgggagcacgccgagaagcacggcctcgcgacggtcttcgtggtcgcgcccagcagcaaggacgcccggctcgccgagatcaccgcggcgggctccggcttcgtgtacgcggcctcgctgatgggcgtcaccggtacccgcgcgtccgtgggcgagcaggcgcaggacctggtgcggcgcaccagggccaccaccgacctgcccgtctgcgtcggcctcggcgtctccaacgccacgcaggccgcggaggtcgccggcttcgccgacggcgtgatcgtcgggtcggcgttcgtgaagctgatgctggacgccgaggacgaggcggcgggtcttgaggccgtacgggcgctggccggcgaactggccaagggcgtgcgcggcggcgactgacagcgggccctccacgacgcctgcgcgtacgtaggggacaaaccgctcacccgaacgggtggacctgggaccggggaggcgcgctgtgcctccccggttcgttctgccggatgtgagcgagaagaaccgtgagggaaagcgcaccgcccgtgagcggctggtggtcgagcgtgagaagcaaaaggccgccgagaggcgccgccgggcgctgatcgtcggggcgtcggtggtgtgtgtcctggctctcgcggccgtggtgggcgtgctggccgcgaactccggcaaggacaagaagagcgcctcggacggcccggccgtggcgccctcgggcgcgacgggcaaggacggcctggcgatcccggtcggcaaggacaccgccaagtcgtcgctcacggtgtgggaggacttccgctgcccggcctgcaagatcttcgagaccacataccggcccacgctgcacgaactggtcggcgccggaaagctgaagatcgactaccacctggtcacgatcatcgacgacggcaggggcggcagcggctcccgccaggccgccaatgccgcggcctgcgcccaggacgccggaaagttcaccgcgtaccacgacgtcctgtacgacaaccagccggacgagaccgtggactcgttcgcggacgacagcaagctcatcgaactcgccggcaaggtcgacggcctggacaccccggcgttccggaagtgcgtcaaggacggcacgcacaacagctgggtcgtgaagtcgaacgccgccttcgacagcggcggcttcaaaggcacgccgaccgtgctgttcggcggcaagaacctcgccgcggacccgacgatgaccccggcgaagctgaagcagatggtggaggcggcgaacaagggctgaggcccgcgaccgcccgctgcgccccggtccgaaagggccggggcgccctgcgttatggagccgtagccgggtgggttgccaggctgtgtgtccggcagggtagcgtcgtccctgccatggaacttgcctacattcccagcccggcgcgtggggtgctgtacctcggccccattccactgcgcggctacgcgttctgcatcatcatcggcgtcttcgtggccgtctggctcggcaacaaacgctgggtcgcccgcggtgggcgccccggcacggtggccgacatcgcggtctgggccgtgccgttcggtcttgtcggcgggcggctgtaccacgtcatcacggactacgagctgtacttcagcgagggccgtgactgggtggacgccttcaagatctgggagggcggcctcggcatctggggcgcgatcgcgctgggtgcggtgggggcgtggatcggctgccggcgccgcggcatcccgctgccggcctgggccgacgccgtcgcccccggcatcgccttcgcgcaggccttcggccgctggggcaactggttcaaccaggagctgtacgggcgcgagacgcacgttccctgggcgctgcacatcacgtcctcgacggacggacgggtgccggggtactaccacccgacgttcctgtacgagtcgttgtggtgcgtcggcgtcggcttcctggtcatctgggccgaccgccgcttcaagctgggccacggccgggcgttcgcgctgtacgtcgccgcgtactgcgtgggccgcgcgtggatcgagtacatgcgcgtcgacgacgcccaccacatcctgggtgtgcgcctcaacgactggaccgcgatcgctgtgttcctcctcgcggtgctctacatcgtgctgtcgtcgcggaagcggccggggcgtgaggagatcgtcgagccgggtgcctccgacaccggaaccggtgcggacgacccggtggacctcggcaaggacgaggataaggccaccacggacaaggccacggccacggacacgtccacaaccacggacaagtccacggaccggggcaagaacgaggacgagaacgagggcgaggacgccgagccgtcggagaagacggagagcgcggccgagtcggccaagaaggtctgagggtcgttcatacgtcgatgagggcgccgtatcgctggatacggcgccctcatcagttcaggcggcgcgcgagcgccagtgtgcgctgggcccccgtcaccaccgccgtgtcgatgaagcggccgtccgggagggcctgggcgcccgggtccctcgccgcggccttgacgatctcctcagccgtggcgatctcctgcggagtcgggagataggcccgctcgatgaccggcagctggcgcggatggatcgccgcgcggcccaggaaacccagggcccggccgcgggcgcaggacgcggccaggccctccaggtcccggatgtccgggtggatcgactgcgtcggcggcggcagccgcgccgcccgtgcggccaccaccacccgcgcccgcgaccagtccaggcccgcgtcctcccgtacccccagatccgcccgtagatccgtctcgcccagcgagacgccccgcacgtccggatgcgccgacgcgatcgcgaacgcctgttccacgcccagggccgtttccaggagggcgtggagcgggatcgcgccgccctccgcgcgtgtgccgccctccgtgggggcggcgcgttccgcgacgcggaccacgtccgcgggcgaggtcaccttgggcaggcgcaggccggagaggcccgggagcgccgtgagtgccttgagatcggcctccagccagggaccgtccagggcgttcacgcgtacgtggaccgggaccggctgccgctgcgtgagccgttccgccgtcgcggcgcgggcgtagtccttgcggtccggggggaccgcgtcctccaggtcgatcaggacgacgtccgccccgcaggcgagggccttgcccaccacctcgggtcggtcgccgggcgcgtacagccaggtgagcgggaaggactccgcggtcacagggcgccttccgatctcagcgcggtgatctcggcttccgccaggcccagttcggtcagtaccgcctccgtgtccgcgccgtgcggacggcccgcccagcggatcgcgccgggggtggaggagagccggaagaggatgttctgcatccggagcgggcccagttcggggtcgtcggggatcgtggtgaccgtgtccagcgcggcgtactgcggatccgtcatcacgtcccgcacatcctggatgggggccaccgccgcctccgccttctcgaacgcctccaggacctcggtgcgggtgtggcgggcgatccaggcacccaccgcctcgtccaggacgtccgtgtggcgggcccggtccgcgcccgtcgcgaaccacggctcggcgatcagctccgggcggcccaccaggatcatcaaccgttccgcgatcgactgcgcggacgtggagaccgcgacccacgaaccgtccgccgtgcggtacgtgttgcggggcgcgttgttcgcggaacggttgccggtgcgcggctgcacgtggccgagctggtcgtaccagatcggctgcgggccgaggaccgtgaggatcggctcgatgatcgccatgtcgatcacctggcccgcaccggtgcggtcgcgggcggcgagggccgtcatcaccgcgtaggcggtcgcgaggcccgcgatcgagtcggccaggccgaagggcgggagcaccgggggcgcgtccggctcgcccgtgatcgccgcgaagccgctcatcgcctccgcgagcgtgccgaagccggggcggcgcgcgtacgggccgaactggccgaagccggtgacccgggcgaggacgagccgggggttcgcggccgacagctcctcccatcccaggtcccacttctccagcgtgccggggcggaagttctcgatgatcacgtcggtcgtcgcggcgaggcgcagcagggtcgtgcggccgccgggccgggacaggtccagggtcatcgtgcgcttgttgcggccgaggagcttccaccacaggcccacgccgtccttcgacgggccgtggccgcgggagggatccggtttcgccgggtgctcgaccttgatcacctcggcgccgaagtcgccgagcatggtggcggcgatcggtccggcgaagagggtcgcgaggtcgacgacgcgcagaccggtgagcggggcggcggtgtcgggcggcgtactcatgagggctgcccgtcggtcgcgccgccgggtgccgtacggacgtcccgtcccgtcacgggctgcccgcgccgcggtgcctcggtgacgtacgcgaccaggtccgggttcgtgctgcggagcacggcgatgtgggtcatgggcggtgggcctcccggtgtgtgaggtgggcgagggtgtcgaagccgacgccgttgaagtcggccacggaggtggcgagtcggttcttgaggggggtggtccagcggtcggggagggcggtcgggcggccggccagcagaccggcgatgccgcctgccgtcgcgccgttcgagtcggtgtcccagccgcccgccacggcgcggcagacggagccgctgaagtcgccgtccgcgtgggtgagggcggcggcgatcagggcggtgttggggacggcgtggacccagtggtagccgcggtgggtggcgtgcagttcgtcgacgaccgtgtcgaagtcctctgtggtggcggccaggtggaccgcgtgacggacggccctggccagccgggagtgcggcgggacgacggtgaggccggtgcgcaggcagtggtggatgccgtggtggccggtggcggcctcggcgatggtggcggccgtgaacatcgccgcgtagacgccgttcgcggtgtgggtgagggtggcgtcgcggtgggcctgggccgcggcggccgccgggtctcccgggttggtccagccgtgcacgtccgcgcggatcagggcgccgatccactcgcggaacgggttgcggtggcgggccgtgcgcgggggctcgatgccgtcgaggaggttgcggtacgcgatgcgctccgcggtgaacgtgcggccggcggggagttcgtcgagccagaggcgggcgacttcggcggtgctgaagcccttgccgtggcgctggagcaacaggatgttcaggagggggtagttgaggtcgtcgtcctccggcatgccgtcgatgttctcggcgagggaggtggttgccgagcggcggttccaggggtgggccgcggcgagttccggggggaggccgcgggccgtgaaccaggtgtgcaggggccagttgccggtggcccgggcgagccggcggatgccgtcgagggggagcttctccaccggcttgcccaggaggcagccggccgctctgcccagccaggcggcttccagacggtcgtgggccggtggcgtggcgggggagggctggggccgcgacggccacttcgggcagcgggccctgatgttcgccaggtccgtcggctcctggtccgccagccggctcggcaggtccgccagttcggccagcaggtcctcggccagtatccgcaggtacggcgagaccggtccccgcgacgcgcccgcccgttccggggccttttggccgcccgccgcccgccagcgggccgcgatcgcgtacggttcgcggccgtcctgggccgcctggtggagttcgtggccgagcaggtcctcgggctggacccaggtcagccggagcgcgctcaccgccggtccgccagcgtcgcgtacgccgactcgtgggcccggcggcggcggacgtcccgttcgaagatctcgcgggtgacctccgtgagggtccgcgccggggcgtgcaggtcgaggcggctcgcccgcgccaccgtcttcgcccagtcgtgcgggacggccgcgcccagcgcgcccgcgaccgcgccggccatcgtggcgatggagtcgcagtcccggccgtagttgaccgcgccgagcacggcgtgccggtagtcgccgccggccaccaccaacatgccgagggccaccgggagttcctcgatcgcgtggaggcgggaggggcggcgggcgccgagggaaggggtgcggtagtccgggcccacggtgtcgaacggagccaccgccgcgcgcagcggcccgagggccgactcgaagtccgtgtgccgggacgccgcttcgcagaccgcctcgatcgccgagcgggtgccgtccttcgccagcgccaggcacgcggtgaccaccgagtccgccgtcgcgcccggtgcgcaggccgccgcgaccgccgccgcgaggacaccggccgcctccctgccgtacgacgactggtgcgcgcccgcgatgtccagcgcctcggcgtacgcgcccgccgggttggccgcgttgaccaggccgaccggggccatgtacatcgcggcgccgcagttgacgatgttgccggcgccggcctcacggggatcgacgtggccgtagtgcaggcgggccaccagccacttctcggcgaggaagatccgttggagggggagggcctcggcctccagttccgggatccagcggggggaggtcatcaggtcggggacgaggtgctcggcgatcgcgtacgcgtcgaggtgatcgcggaccgtggcgtacacacgtaccagcgcgtgcgtcagcaaggtgtcgtcggtgacgtgcccgtcgcccttgtggtacggggcgatggggcgggccgtgcgccaggcgtcgccgttccaggggccgacgacgccgtggacgcgcccgccgtggcgttcgaggatctgctcgggcgtgtagccctcgacgggaccgccgagggcgtcgccgaccgcggccccgacgagggcgccggtgatccgtgcgtcgaggggcggggtggacgtctcgtcgaggggcggcggagacgtctcgcagaggggtgatttgggcgtcatgcccgaatcatccccccggtgtggtcagttccgtggctcccaggagttcggcgagttctaccaggtcggtgccggtcaggcggggcagcgcgcagccggagagggtgcggcaggcgtcgcgccaggcggccgggatctccgcgccgccgccgagcgcgccggtcagcgcgcccgccagcgccggggccgagtccgcgacccgcgacaggcaggcggcggcgggcacggcctcggcgatccggccgcgggcggcggtggcgagcgcgagggcgaccggtacggtctccgccgcggcgatgccgtagctgtagacgtggtccacgatctggtgctcaaggaggggcacgatggcgaacgtgccgtcgcccgaacgggccagccggagcgcgtgccgggcgttgcggccgatctccgtcgactcggggagttcggcgagggccgcgtccgcgcaggcgtcgacgtccgccccggcgagggcgagcgcgagcgcggcggccatggcgcgggcgccgtgcactccgtcgccgtcctgggtgtagcgggcgtcgaactcggccagctcggcggcgagccggggttctccggggtgcgcgacggccaggacgcaggcccgtacgcaggccgcgtcgtcgaagtagtgggggttgtcgtggccggtggcgggcgggcgcagccccggtggcgaggttgccgaggcctgcccgcacggagatccgggcgcgcagcgggagcagcgcggactcgacctcgggggcgcgttcggccgcggcggcgacctcgctggcgacggcgttccaggacaggtcgatggccgcgcgcatccgccgctcgtggctcaggtccccgagcacgttcccgtcgccggcccgcagtaccgcctccgccgcgaacgccgcccactcggcgtcgtcggacgggccgagccgcagtggctccggcggctgattgagcgcgatcggcacggggagggtggtggtcgcgttctgctcggcgaaggtgtccagctcacgggtgagccgccgggtccactcgggcatgcgtgcggcccggtgccgggcggcgggccagccggcggcgtcccccgcggcgaggcccaggaggaggccttcgatacgacgggggtgcggtgcgccgacggcgcggatgtcgagggcgcggtcggccgcgggcgcggggggcggatcgtgcgcctccgccgccgaggcccccgagctctcacccggctcgtctcccaccaggccgggcctcatcgctccacctcgtcgtcgtcgccggccggtacgaacgcgtccgaggcgagcacgaagacgcccggatcggggccgggccaccggcggggcagctctcgtacgagtccgcccggcccccgtacgagcccgtccgcctccttgccccgcccccccaggccgcccagcccgcccagtccgtccagtccggcgaggccggcgagtccgcccagtccggcgagtccggccggcccgtccagtccgttccagccgggggccagtacccccgccccccacttcccctcgtcctccgcgcccggtgtcagcaactccgcgatgtccaggacgtggtggccctccatggacggcaggcaactgccgcgcgccgggccgatcgccgccgcccacgccgccgggatcgacgaggcgccccgcgtcgcacccgccagggcgcccgccaccgccgccgtcgtgtcggcgtcccgccccatgttgaccgcggtgagcaccgactccgtgaagtcgccgtcggccgccgcgtacgcgccgaacgcgagggcgaccgcctcgggggcgaggtccgtccacgggtagccgccgatcacgaccgcggagcggaccgcgcgttcgccgcgatgggcgaccgcgaccgcccggcgcagcgagcgggccgtccaggagtcttcggggacgaccgccagggccgaggccaccaccgcgatcgtcggcgcgccggccatcgccgccgccacgcccgcggccaccgcctggccgccgtagattccctcgccgtcgtggctcaccgagccgtcgatcgccaccagccgggccgcttcggcggggcggcccgccgcgaagacgccgaagggggccgcgcgcatcgcgagcccgtcgctccacgcgtgccggtgctgggccgagatcggtgcggcaaggccccggcgcaggttctccagcgtgccccgctcgctgaatcccgcccctttgaacggcccctcgtcccggtcggcgatccactggtgccaggccgcctccacatgcgcgaccgtgagcgccgagccgtgccgggccaggaggaggccggagaagatcgcgtactccgtgtcgtcggtgcccgccgggttgtcggccacgtaccccgtgatgcgaccccagcgcgcccggatctcggacggcttcatgttctcggcgggcgcgcccagcgcgtccccgacggcgaggccgagcagcgcgccgcgcgcccgttcacggagatcggcggcgtctccgggcgccgggaccgagggaatgcaggcgatggaagccatgggtgcctctcctctcagggcacggaccccctttgcggatctgtgccacctgaggggcggagcagagcctcaggcgccccagagtcacccggtcgacatctgtgcagggccctccacgaatgagcattgaagggtaaaagcgcaggttagcgcagcctttccttgctggcgggaaggaatggagcggcgtactttcgtagttgtcaaaaagtggaaacagtccaatcaacaccctgggggaccgggccatggccatcatcgagaccgaggcgacgctgcacgaggcgcaccgcgacaaccacacccaccgcgatgtcaacggtggctggctgcgccccgccgtcttcggcgcgatggacggcctcgtctccaacctggccctgatgaccggcgtcgccggcggctcggtcggccagcagaccatagtcatcaccgggctcgcgggcctggccgccggcgccttctccatggcggccggcgagtacacctccgtcgcctcgcagcgcgagctggtcgaggccgaactcgacgtcgagcggcgggagttgcggaagcacccgaaggacgaggaagcggagctggccgcgctctacgcggcgcgtggcgtcgagcccgagctggcccgggaggtcgcccggcagctgtcccgggatccggagcaggcgctcgagatccacgcgcgcgaagagctgggcatcgacccgggcgaccttccctcaccggccgtcgccgccgtgtcgagcttcggctccttcgcgctcggcgccctcctgcccgtactgccgtatctgctcggcgcgagcgccctgtggcccgcgctgctgctcgccctcatcgggctcttcgcgtgcggcgcggtcgtggccagggtgacggcgcgatcctggtggtacagcgggctgcgccagctcgccctgggaggagccgcggcgggtgtgacgtacgtcctgggcagtctcatcggcgcggccgtaggatgactggcgcagctttttatgcgagggaccgtataaatagccgttactcggcggtttcgaatgcttaaccaccgggcatgagccgtaagcgccgcgggcaatgaggcctgcgccgcactcagccgcggcgggcgacgttgcctgccgcgctccgggccgacggtcactgatctgtccgcttaggtcctcaatcttcatcaatcttcatcaccgtgcgcggaactcgtgccgcagcccggcgatgccctcgccgccagccacggcgtccgcatgttggaacgaagtatccggttcccgagaatcgctccatcatgtaacctgcacgaaattttgcactccacagcagagggccaacgtcgtccctcggcacatgcatatgccacgacgacgacgggagagccgatgcgtacgccgcgccagccgtcccagcactccacgaatggccagaagtggtccttcatggatgctcgccctgctgcgcagggtatgtacgacccccgcaacgagcacgacgcctgtggcgtcggtttcgtggccaccctcaccggcgaggcgagccacgcgctggtcgagcaggcgctcacggtgctgcgcaacctggagcaccgcggtgcgaccggctccgaacccgactccggcgacggcgcgggcatcctgtcccaggttcccgacgccttcctccgggaggtggccggttttgaactgcccgccgccggtgcgtacgcggtcggcatcgccttcctgcccgaggacggcacggacgaggccgtctcacagatcgagacgatcgccggcgacgagggcctgacggtcctcggctggcgcgaggtcccggtcgcccccgagctcctcggcgccaccgcccgctccacgatgcccgccttccgccagatcttcgtgagcgacggacagtcgcagggcatcgacctggaccgcagggcgttcgtgctgcgcaagcgcgccgagcgcgaggccggcgtctacttcccgtcgctgtccgcccgcaccatcgtctacaagggcatgctgaccaccggccagctggagcccttcttcccggacctgtccgaccgccgcttcgcctccgcgatcgcgctcgtgcactcccggttctccacgaacaccttcccgagctggccgctcgcccacccgtaccgcttcgtcgcgcacaacggcgagatcaacacggtcaagggcaaccgcaactggatggcggcccgcgagtcccagctcgtctccgagaagttcggctccgccggcagcggggccaagggactggagcggatcttcccggtctgcacgcccgacgcctccgactcggcgtccttcgacgaggtccttgagctgctgcacctcggcggccggtccctcccgcactccgtgctgatgatgatcccggaggcgtgggagaaccacgactccatggacgcggcccgccgcgccttctaccagttccacgccacgatgatggagccctgggacggcccggcctgcgtcaccttcaccgacggcacccaggtcggcgcggtcctcgaccgcaacggtctgcgccccggccgctactgggtcaccgacgagggcctggtcgtcctcggctccgaggtcggcgtcctcgacatcgaccccgccagggtcgtccgcaagggccggcttcagccgggccggatgttcctcgtcgacaccgccgagcaccgcatcatcgaggacgacgagatcaaggccggcctcgccgccgagaagccctacgccgactggctggaggccggcgagatcgagctggaggacctccccgagcgtgagcacatcgtgcacacccacgcctcggtcacccgccgccagcagaccttcggctacaccgaggaggagctgcgcgtcatcctcgcgccgatggccaaggccggtgccgagccgatcggctcgatgggcacggactcgccgatcgccgcgctgtcggagcgcccgcgtctgctcttcgactacttcacccagctgttcgcgcaggtcaccaacccgccgctggacgcgatccgcgaggaactcgtcacgtccctgcgctcctccctcggcccgcagggcaacctgctggagccgacggccgcgtcctgtcgtagcgtcaccctgcctttcccggtgatcgacaacgacgagctggccaagctcatccacatcaacgccgacggcgacatgcccggcatgaaggccgcgaccctgtccggcctgtaccgggtctccggcggcggcgagtccctcgccgcgcgcatcgaggagatctgctccgaggccgacgccgccatcgagaacggcgcccggctgatcgtcctgtcggaccgccactccgacgccgagcacgcgccgatcccgtcgctgctgctcaccgcggccgtccaccaccacctcatccgcaccaagcagcgcacccaggtgggtctgctcgtcgaggccggtgacgtccgcgaggtccaccacgtcgccctgctcatcggcttcggcgccgcggccgtcaacccgtacctcgcgatggagtccgtggaggacctcgtccgcgccggtacgttcctgtcggacatcgaggccgagcaggccatccgcaacctgatctacgcgctgggcaagggcgtcctcaaggtcatgtccaagatgggcatctccaccgtcgcctcctaccgcggcgcgcaggtcttcgaagcggtcggtctggacgaggagttcgtcaacaagtacttcagcggcacggcgacgaagatcggcggcgccggtctcgacgtcatcgccaaggaggtcgccgcccgccacgccaaggcctacccggcctccggcatcgcgcccgcgcaccgcgccctcgacataggcggcgagtaccagtggcgccgcgagggcgagccgcacctgttcgacccggagacggtcttccgcctccagcactccacgcgctcgggcaagtacgacatcttcaagaagtacacggaccgggtgaacgagcagtccgagcgcctgatgacgctgcgcggcctgttcggcttcaagtcgggccgcgagccgatctccctcgacgaggtcgagccggtcagcgagatcgtcaagcggttctcgaccggcgccatgtcgtacggctcgatctcccgcgaggcgcacgagaccctcgccatcgccatgaaccagctgggcggcaagtccaacaccggtgagggcggcgaggacgcggaccgcctgtacgacccggcgcgccgctcggccatcaagcaggtcgcctccggccgcttcggtgtgacctccgagtacctggtcaacgcggacgacatccagatcaagatggcccagggcgccaagcccggcgagggcggtcagctgcccggccacaaggtgtacccctggatcgccagcacccgtcactcgaccccgggtgtcggcctgatctccccgccgccgcaccacgacatctactccatcgaggacctggcccagctgatccacgacctgaagaacgcgaacccgcaggcgcggattcacgtgaagctggtctccgaggtcggcgtcggcacggtcgccgcgggtgtctccaaggcccacgcggacgtcgtactgatctccggtcacgacggtggtacgggcgcgtcgccgctgacgtcgctcaagcacgccggcggtccctgggagctgggcctcgccgagacccagcagacgctgctgctcaacggcctgcgcgaccgcatcgtcgtccagaccgacggccagctgaagaccggccgtgacgtcgtcatcgccgcgctgctcggcgccgaggagttcggtttcgcgaccgcgccgctcgtcgtctccgggtgcgtcatgatgcgcgtctgccacctggacacctgcccggtcggcatcgccacccagaacccggtgctccgcgaccggttcaccggcaaggccgagtacgtcgtgaacttcttcaagttcatcgccgaagaggtccgcgagatcctcgccgagctgggcttccgctccatcgaggaggccgtcggccacgccgaggcgctcgacgtggcccgcgcgatcgagcactggaaggcgcagggcctggacctggctccgctcttctacgtgcccgagctgcccgagggcgcggcgctccaccaggtcatccagcaggaccacggcctggagaaggcgctcgacaacgagctgatcaagctcgccgccgacgccctggccgcgaacagcgtgaccgacgcccagccggtccgcgcccaggtcgcgatccgcaacatcaaccgcacggtcggcaccatgctcggccacgaggtgacgaagaagttcggcggcgcgggtctgcccgacgacaccatcgacatcaccttcaccggctcggcgggccagtcgttcggcgcgttcctgccgcgcggtgtcacgctgcgcctggagggcgacgccaacgactacgtgggcaagggcctctccggcggccgcgtgatcgtccgtcccgaccggggcgccgaccacctcgccgagtactcgacgatcgcgggcaacaccatcgcgtacggcgcgaccggcggcgagctgttcctgcgcggtcgtacgggtgagcggttctgcgtccgcaactccggcgcgacggtcgtgtccgagggcgtgggcgaccacggctgcgagtacatgaccggtggccgcgcggtggtcctcggcgagacgggccgtaacttcgcggccggcatgtccggcggcgtcgcgtacgtcatcgacctcgaccgcgacaacgtcaacgtcggcaacgccggcgccgtcgaggagctgaccgaggacgacaagcagtggctgcacgacgtggtgcgccgccacgccgaggagaccggctccacggtcgccgagaagctcctcgccgagtggtccgtctccgcgcagcgcttcagcaagatcatccccagcacgtacaaggcagtgctcgccgccaaggacgccgccgagcgagccggtctcaccgagaccgagatcaccgagaagatgatggaggcggcgaccaatggctgatcccaagggcttccttacgcacggccgcgaggtcgccaggacccgtccggtcgaggagcgggtcaaggactggaacgaggtctacgtccccggctcgctgctgccgatcatctcgaagcaggccggccgctgcatggactgcggcatcccgttctgccacaacggctgtccgctcgggaacctgatccccgagtggaacgactacgcctaccgcgaggactggacctccgcgtccgagcggctgcacgccacgaacaacttcccggagttcacgggccgcctgtgccccgctccgtgcgagtcggcgtgcgtgctgggcatcaaccagcccgcggtgaccatcaagaacgtcgaggtctccatcatcgacaaggcgtgggacaccggcgacgtcaagccgcaggcccccgagcgcctgtcgggcaagacggtcgcggtcgtcgggtccggccccgccggtctcgccgccgcccagcagctgacccgggccggtcacacggtcgcggtgtacgagcgcgcggaccgcatcggcggcctcctgcgctacggcatccccgagttcaagatggagaagcggcacatcaaccgccgtatcgagcagatgcgcgcggagggcaccaagttccgcacgggtgtcgagatcggccgcgacatcgacgccgcgaagctgcgcaggcgctacgacgcggtggtcgtcgccgcggggtccacgaccgcccgtgacctcccggtccccggccgtgagctcaagggcgtctaccaggcgatggagtacctgcccctggccaacaaggtgcaggagggcgacttcgtggccccgccgatcaccgccgagggcaagcacgtcgtcgtgatcggcggcggtgacacgggcgcggactgcgtgggcaccgcccaccgtcagggcgcggcctcggtcacgcagctggagatcctggcgaagccgggcgaggagcgcgccgcgcaccagccctggccgacgttcccgatgctctacaaggtcacctccgcgcacgaggagggcggcgagcgggtctactccgtcagcaccacccacttcgagggcgacgaggacggcaacgtccagtggctgcacctggtcgaggtcgagttcgtcgacggcaagctgacccagaagccgggcacggagcgcaggatcccggcgcagctggtgacgctggcgatgggcttcacgggcacggaccaggacaacggactggtcacccagttcggcctgggcctcgacgagcgcggcaacatcgcgcgcgacgcggacttccagaccaacgtccccggtgtcttcgtcgcgggcgacgcgggccgcggccagtccctgatcgtctgggccatcgcggagggccgctcggccgccaagggcgtcgaccgcttcctcaccggcgcgagcgaactgccggcgccgatccgtcccacggaccgctcgctgatggtctgacggccccgaacgtgacctgagggtcacgcacatacgtcccgcacaaaggcgtgcggaacacagacggcgcctgcccgccagtccccgaccggacgactgggcaggcgccgccgcatgtccgcgaggtgaaccgggacctgccaggtcagggggcgtacggaggcatcacggcacccggtaccgctccccgtacacccgccactccagcggcgtgcgcaggtccaggttgccgtcgtacaggaaccgccgctgggccgtgtcgatgcgggtcgtgtcgtggtgggacttctcggacttcatcaccgtgcggcgcacgtccaggaaggcgtccaggtacctcgtctcggagccgccctccgcgggggtgtccgcctcccgcagggcccgggcgcggatgccctggagactgtgcgggtcggtgcccgggccgtggacgaccatcgcgtcgtagtagatgaactggccgagcgcgcccaggccgtcgtgccgggcgagacggacggccgggtcgaagtagacgcggtcgcgttccgcgtcctgggccgcgcggaaggccgcgacgccggcctccgcccgccacgccgccgtgaacgcccggcccaggcccgcgtgggagtccgtgccgtccaccgcgcgcagcgcgggaaggaagcgggccaggccgttgccggggtggtccttcgtgtagcgctcgaccagggtgagcagatcgtgcgtgccggtgcagaagccgatgacgcccgccgtgtagccccggccgtcaccgatgtcctcgacgtagccgtaggcgctgcgccagtccagggtggagttctccgcgctcgccacgatctcctgcgccagctccttcttggcgggggcgttcaggccctgcgcgctcgcggaggactgccgcgacgggggcttggggctctcggtcctgtccgggtccgagggcgcgaggccgaagaggtagaccgccgtcgccgcggcgacggcggcggggacggccgtgagcagcaggagagcggcacgtttcatggcgttcagcgtacgggcgcgggtatccgctcagcccgtcagcccgtcagcccggacaccttccccaccgtcaggaccagcaggagcgccagcaggcccacgcacgcggccgcctggagcagaccgcgccgggggccgcgcggtacgtacgcgtacgccagcgtgaccaggccgcccgccagcagtccgccgaggtggccctgccaggacgtgaggcccgccgagatcagcagccacagcagcagacccgcgatgaagcggttgacggcgcgcatgtcggcgcccaggcggcgggccatcacgtagtacgcggcgcccagaccgaagatcgcccccgaggcgccgaccgtgggggtgtcgggcgcgatcagcagcaccagcaccgagccgccgagcgccgacagcagatagagggcgaggaagcggacacggccgagctgggcctccaccacccggcccaggttccacagcgacaccatgttcatcacgatgtgcaggatcccgaacgtgccctcggtgggcggcagatgcaggaacgcgccggtcagcagccgctcccactccccgcccacgacaccctccgcgtggaaggacgaggggtacgggtcctgccacaggtagtgcccgccgtccggcccggcaagacccgcgcccagcatctggaaccggtccacgagcgccggccgcagcacctcgcccaggtaggccagcacattgaggccgatcagtacgtacgtcaccaggggggccgtcgtgatccgcccgccgaaggccgtgcgggcctgccgtaccgaccgcgcgccttccttcacgcactccacgcattgatgaccgacggacgcctcccgcatgcagtccgggcagatgtaccggtcgcaccggatgcagcggacgtgcgactccaccttgggatggcggtagcaggtggtgacagcggagtcggcggactcaggtgactcgggggagtccggggtctcgggtgactccggggacttgggttccacagccggctcctcgaaggggtgcggacggacgatgagccggtgggggtcggcggcgaacaaaatagcgaactccggggacagtgatcgacgaggggcagctgtgacataccctcggcactcccgtcaccgccctgaagggagcccgcatggccgcgatcagcctcgccaaggtggaggagaccgcgcccgcgctggtcagcctgtacaagagcgccggggtgtccctgcacaagcacggccttgacggtcagcgggccgccgtctatctcgtggtcgactactcggggtcgatgaggccgtattacaaggacggcagtgtgcaggcgctcaccgaccgggtgctcggtctgtcggcgcacctcgacgacgacgggaccgtgccggtcgtcttcttctccacggacatcgatgccgtcacggacatcgcgctcgccgaccaccagggccacatcgagctgatcgtggccggactcggacacatgggcaagaccagctatcacctggccatggacgccgtcatcgaccactacctcgacagcggttccaaggaccccgccttcgtcgtcttccagacggacggtgggcccaccagcaagccggccgccgaacggtacttgtgcaaggccgccgagctgcccctgttctggcagttcatcgggttcggggacccgggaagccgacagttcgaattcctgcgcaagctggacgagttggcggttccgcacaagcgggtggtggacaacgccgggttcttccacgccggtacggatccgcggaaggtgtccgacggcgagctgtacgaccgactggtgggcgagttcccccagtggctggcggccgcccgcacccacgggatcgtccggtgaccgtcctgcttcccgccgccgaacgcgtggccgtggcctggaagaacggcggcggggtgacccgcgagatcgccgccgcgccgcccggtgcggacatggccgccttcgcctggcgcgtcagcctcgccgaggtcgccgcggacgggccgttctccgcgtttcccgaggtggagcggaccctcaccctcgtcgagggcgccggcatggacctgacggtgggcgggcggcggcggctcgtcgacacgcggtacgtgccccaggacttccccggtgacgtgcccaccgactgccggctgctcggcggccccgtcgtgaacctcaacgtgatgtggcgcaggggcggcgcggccccgaccgtcgccgtcgtacgcggccggctgcgcctgcccgcggcgcccgccctggtggtcgccctcgacgggggcgcggacctggccggggtgcggctcggccgctacgacgccctgttgctgaccggcgaggacaccgtgctgcacgcacacgggccgacggcggtcgtcggactcacccccgcccgggggctcgcggccctcacgcacgacgagcggcactgaggacatcggcactgaggacgtcggcccggcactcggccggcgagccccacgccgtgcgcagcgcacgggccttggtcagccacagggagaggtcgtactcggcggtgtagccgatcgcgccgtgcagctggagcgcggtgcgggcggtcgcgtacgccgcctcgcaggccgcggccttggcggcggccacgtcccggggagccagtgtcaccgcggctccgaagagcagcgggcgcgcgaactccagggcggtcttcgcgtcggccagtcggtgcttgaccgcctggaacgaaccggtgggaacaccgaactggacgcgccgcgtgacatgggtgaccgtgcggtcgaggagggcgagaccgacgccgagggcctgggcggcggtggcgaggcgggcccagtcgaacgcgtgccccggcacccgcgaggagatccgttcgccgccgggcaggggcgtggtgatccggcggcctggatcgagcgacggccgtacgtccgcgacgcccggcgcgagccacaactccccgccccgcacggcgagcacgacgtccgcggcgtccccgtccagcgcgtacggagcgcccaccgtggccacggtctcgcccgccgccagccccggaagcagccgcttggccggacccggctcgggcagcgcggccagcagcgccgccgccagcaccgtctccaccaccggacccggcaccgcatgccgccccagctccacgaacgccacggccaggtccaccggcagcggacccatgccctcgtacgcctcgggcaccgccggcgcgaagacgcccgcctccgcgatccgggaccacagggcgcgccgggccgtgtggtcgccgcggatgaccgagggggtgtcggcggccgtcagcatcgcgtccagggagcgggcgaagtcccgctgctgcggcgacagcagaaaacgcatcagcggcgccccttcggcaggccgagcagacgctcggcgacgatgtcgcgctggatttcgttcgtgcccgcgtagatggggcctgccagggcgaagacatagccctccgcccagtcggtgtccgcgagctccccgtcccggccgaggagatcgagggccgtctcgtgcagcgcgatgtcgtactcggaccagaagaccttgttcaggctggactccgggccgatgggctcgccgtccaggaaccgggccgcggccgcgtaggcgaacagctggtaggcgcgggcgccgatcaccgcgtccgccacccgctcacgctcctgcgacgggctgccccgcccgcgccagagctccaccagccggtcggcggcggcgaggaagcggccgggggagcggagggtgaggccccgttcgttgcccgccgcggacatcgcgatccgccagccctgccccggctcgccgatcacgtcctcgtcggggacgaacacgtcgtccaggaagatgtcggcgaaggccggtttgccgtccaggcgcccgatcgggcggaccgtgacgcccggggcacgcaggtcgaacatcagatacgtgaggccctgatggggcttcggggtgcgcggctcgctgcggaagaggccgaacgcgcgatccgcgaacgccgcccgcgacgaccacgtcttctgcccgttcaccagccagccgccctcggtgcgcacggccttcgaggtgagcgaggcgagatccgagcccgccccgggctcggaccacgcctgcgcccagatcacctcgccggtggccatcggcggcagcacacgcgcgcgttgctcctcggtgccgtggtcgaagagcgtgggggcgaggaggctgatgccgttctggccgacgcggcccggcgcgcccgccgcgtagtactcctcctcgaacaccagccaccgcaggagcccggcgtcccgcccgccgtacgcggccggccacgacaccaccgaccagcggtccgcggccagctccgcctcccacgcgcggtgcgccccgaagccctcctcggtctccagggagggcagcgggacggccggaacgtgcgcggcgagccaggcccgggcctcggtacggaacgcctcgtcggcgggggagtgcgtcaggtccacgggcggcacccttcggaaacggccttccctaacaagtgtttggtaggttagcgtggggccatgacagacgtcgaggccccggtgtacgtgtccgggcacggcctgctccaggggcgcacggccgtcgtcacggcggcggcgggcgcggggatcggcggggcgaccgcccgccggttcctggaggagggcgcgcgcgtactgatcagcgacgcgcacacccggcgcctcaaggagtacgaggcggagctggcccgggagttcgagggcgcggccgtcgccgcgctgccgtgcgacgtgacggacgaggaccaggtgcgggccctcttcgacacagccgtccgactgcacggcggactcgacatagtcgtcaacaacgccggtctgggcggcacttcggacctggtcgacatgacggacgagcagtggtcgaacgtactcgacgtcacgctgaacgggacgttccggtgcacccgcgcggccctgcgcctcctcagggagcagcccggcggcggagtgatcgtcaacaacgcgtccgtcgtcggctggcgcgcccaggcggggcaggcccactacgcggcggcgaaggcgggcgtgatggccctgacccggtgcgcggccatggaggcggccgggtacggggtccgggtgaacgccgtggcgccgagcctcgccatgcacccgcacctggtgaaggtgacgacccccgaactgctggaggaactgaccgggcgggaggccttcgggcggtacgccgagccctgggaggtggccaacgtgatcgtgttcctggcgtccggctattcctcgtacctgacgggcgaggtcgtctccgtcagcagccggcatgcctaggggcaggtacgaaggaccacaatggatctgtgcctaccaagaagaacccccaggtgaccgccgcaccggagcgccgccgcgaactcctcgacaccgcagccgaggtcttcgccgagcagggctacaacgccaccaccgtacgcaagatcgcggaccatgccggcatgctcgcgggcagcctctactaccacttcgactccaaggaatcgatgctggaggagatcctgcggaccttcctcgacgagctctgggacggctacgacaccgtcctggacgccgaactcgggccgcgcgaaaccctggaggcgctggtcaccgagtccttccgggagatcgaccggcaccgtgcggccgtcgcgatctaccagaaggagtcgaggcaactcgtggcgcaggagcggttcgcgttcctcgccgagtcgcagcgcaggttcgagaaggcgtggctggccacgctggagcgcggggtcgccgccgaggtgttccgggccgacctcgacatccggctcacctaccggttcgtacgcgacacggtgtgggtcgccgcgtcctggtaccggcccggtggacagcaccgcccggaggagatcgcccggcagtacctgtcgatggtcctcgacgggatcgccgtccgtacgtcgcccctcacgttgcccgtccgtacataacccactggtgagtccggggagttgccatggccgaggcctacatcgtcgaagcggtccgtacgcccgtcgggcggcgccggggagggctggccggggtgcacccggcggacctgggcgcgcacgcgctgacggcgctggtcgcacgctccggcatcgatcccgccgccgtcgaggacgtggtcttcggctgcctggacacggtcggaccgcaggccggcgacatcgcccgcacgtgctggctggccgccggactgcccgaggaggtgccgggcgtgacggtcgaccggcagtgcggatcctcccagcaggccgtgcacttcgcggcacaggccgtgctgtccggcacgcaggacctggtggtggcgggcggggtgcagaacatgtcgcagatacccatcgccttcgcctcccggcaggccgccgagccgctcgggctgacccaggggcccttcgcgggcagcgagggatggcgggcgcgctacggggacctgcccgtcaaccagttccacggcgccgaactgatcgccgcgaaatgggggatcacccggcgtgaccaggaggagttcgcgctgcgctcgcaccggcgggccgtccgcgcgagcgacgagggacgcttcgaccgggagaccgtggcgtacgggaaggtcacggccgacgaagggccgcgccgggacacctcgctggagaagatggccgcgctggcgcccgtgatcgagggcggcaccatcaccgccgcctgttcctcgcaggtctccgacggcgcggccgcgatgctgctggcctcggagcgggcgctgcgcgagcacgggctgaccccgcgtgcccgcgtccaccatctgtccgtgcggggcgaggacccgatccgtatgctgtcggcgccgattccggcgaccgcgcacgccctgaagaagaccgcgctggccatcgacgacatcgacctcgtcgagatcaacgaggccttcgcgccggtcgtgctggcctggctcaaggagacgggcgccgacccggagaaggtcaacgtcaacggcggcgcgatcgccctcggacatccgctcggcgccacgggcgtgcggctgatgaccacgctgctgcacgaactggagcgcaccggcggccggttcggcctccagacgatgtgcgagggcggcggccaggcgaacgtgacgatcatcgagcggctctgacgatcactgagcgccccgtctcagggcggctctgacgatcaccgagcggccctgagacgctccaggcctttgagtgtccgttccgcctcggccatgatccgctccaccagttccgcgcacgacggcaggtcgtcgatcaccccggcgacctgccccgaggccatcacccccagatccgtccgcccgtccaccattgaggacctgagcagcatcggcgtgttcgcggcgagcaggacctggctccaggtcagttccttgccgtgcttcatggcgagcccgtcgcggatcatccgggaccacgtcaggcccgacagcttccggaagcccgccgccccgcgcaccgcccggaccagcgccctcgtacggccagcggtctccagggagccgacgaacggcgtgcgcagcatgcggtgcggcaggccgtccacggccgtcgtcaccgtgacgtccttgacggtcgccgccagatacgccgccttcaccgcgtccgggaccgtcgagtccgaggtcagcaggaaccgggtgcccatggcgacgcccgccgcgccgtacgccagcgcggcgaccagcccccgcccgtcgtggaagccgcccgccgccaccacgggcaggtcgacggcgtccaccacctgcggcagcagtacgctcgtcgccacctcgcccgtgtgcccgccgccctccccgccctgcacgatcaccgcgtccgcaccccaggcggccaccttctcggcgtgccgccgggcaccgatggacgggatgacgacgacacccgcgtccttcagctcggcgatcagctcacgggagggggcgagggcgaacgatgccacccgcaccccttcctccacgatgatccgcacccgctcgcccgcgtccccggcgtccgcgcgtagattcaccccgaacggcgcgtccgtacgggaccgcacctcccgtaccgcgtcccgcagccggccgggggtcatggtcgcggaggccagaatgcccagcgcacccgcgttcgccgtggccgagaccagacggggacccgccacccatcccatgccggtctgtacgacgggatggcggaccccgaccagacgggtgagcgcggtgtccatcaggtccgcacctcacggtcgcggctgttgcccgggtcgatgacctcccggatcaaccgcagctccgccggcgtcggttcacgggtgaacggcacaccgtcagggaccgtcagctcgaatccggtcgccgcccgcacctgctccaccgtgacccccggatgcagcgaggccagccgcatcgagtggtcgggggtcgcgaaatcgaagaccccgaggtcggacaccacccgggggatgtggtggaaacgggccgtgccggggtgctcggccgcacggtcgtagccgacgccgcacaccatgtcgacccgctcgacgaacacgcgcttcgagtgcctcgggatccagtaactggtcggattgttcagggtgttgaccggtgcgccgcgcaccccgagcagctgtcgcgcgggggcggcccagtcgccgatgcaggagatgttctggttgccgaagcggtcgatctggctcgcgcccatcatcacgtgccgccggccggtcgtgacgagggccagatgctgccggtacggcagccagccctccggtgtgccgtccgggccgacgagcagcgcctcgccgtcggtcagcagcaggtccggcgagaaggtgcgccgggcgagccgcgcgccgacggacgggaccgggcccatgggggcggcgaggatctccccggcgtcccgccaggcctcggcgcaggcgatcacgcagtgctcggcgcgggtggcggtcctggagagggtcatatccgctccttgcgccagtcctggaccgcggaccggtaggccggttcgccgccgccgaggaaccgctcggcgaactccggccacggcgtggtcgcgtagtacctctggagggcctcgtcccggccgtagtcgggtacgcaggaggtgaagtccgcgccgttcggcgcctccacgacgcccgtcaccgtgtgccgcttcaccaggagcgtctgcggtgccgcctccttcgtcagctccgccgtgtcgacgacccgctcgcaggagacgtacgccgtgtcggccgcctcgcagaacaggtcgtcgaagtacgggtccgggcccaggtactggccgttgccgaggcggtccgcgcggttcagatgcaccagcgccgcgtccagccgcagggcgggcatcgcgacgaaggtctccccgtcaacgtacggcgaagtgatcgtccgcaggccggggttgacccgcatcacgtcggagccgatgcccgcccgcaccggcagaaaggggagccgaccggccgccgcgcgcagtccccacaggaacatcgcctcgtcgatctccatcagctccagcgccccgcgctcgcgtgccgcgcggtagtgcggttcgagcgggatcgagtcgagggtcacgaaggcggcgaccagtttccgtatccgcccggcggccgcgagcatgccgacgtccgggccgccgcacgagacgacggtgagatcggtgatcccggagcggagcagtgctcgcaccagggccatcggcttgcggcgcgaaccccagccgccgatgccgagggtcataccgctccgcaggcgggagacggcctcgtcggcggtcatggtcttgtcactcacctgggcacctgcccttccgaaggcttcccgaacgtgtcgcggacgcggtcggcgaccccgtcgaggccggcctcgaaggtgaagccctgctcgaagcggtagctgcggcgcacgtccaccgggtcgatcccgttgatggcggccttcgcgagccgcagcagccggccgtccttggcggcgatctcgcgggccagctccagcgccgctccgtggagttccgcgcgcggtacgaccttccagaccgagccgtgcgcccgcagttcggccgccgtcgccgtccgcgacgtgtagtagagggcgcgcatcaggtgctgggggaccagccgcgcgagatgcgtggccgcacccagcgccccgcggtccagctcggggagcccgaacgaggcgtcgtcgctcgccacgatcgcgtccgcgttccccgccaggcctatgccgccgcccagacagaacccctgcaccgccgcgacgacgggcacctcgcactcgtacaccgccgcgaacgcctcgaagcagccgcggttggcgccgatcagggcgctgtggccgttcgcctgtagctccttgatgtccacgcccgcgttgaacccccgcccctcggcggccagtacgacacagcggacccgggggtcgcggcccgccgcccgtacggcgtcggccaggtcctgccagccggtcaccggcagtgcgttcaccggcgggaagtcgaccgtgacgacggcgatccccttttccgggaacgaggtggagacagtcatggaagcatcagctacctttccaccaaacgtttgttaggtggaaggtagcagcggatggagctgaacgggaaggtcgccgtcgtcaccgggggcacccgaggcgtcggcgccgggatcgcgcgggccttcgccgcggcgggcgccgaggtggtcgtctgtgcgcgcagaccgcccgaagtgctcctgaaaggagccgagttcgcgcgcctggacctgcgggacccggatgccgtaggggccttcttcggtgcgctgccccggctcgacgtcctggtcaacaacgcgggcggcaccccgtaccggaggctggccgacgtggacgcggcccgtcacgcgcgcgtggtcgagctgaacctcgtcgccccgctgaccgcctccctcgccgcgtacgagcacctcaagcgggccgggggcgccgtcgtgatggtcggcagcgtgagcggcggccgtccgtcacccgggtcggcggcgtacggcgcggccaaggcggggctggagagcctcgcccgttccatggccgtggagtgggcaccggagatccgggtcaacacgctcgttctcggcatggtccgcaccgagctgtcccacctccactacggcggtgccgagggcgtcgccgccgtctcccgcaccgtgccgctcgggcggctcgccgaaccgtccgacgtcggtgccgccgccgtcttcctggcctcggacgccgccgcgtacatcagcggcgcgagcctgctcgtgcacggcggcggggagccgccggcgttcctcggcgcggcaacggccaacagggggacgcgacacgagatgccacgggagaagcgacgggagaagcgacaggaggaggagtgggcccgacaggaggaggagcaggaggaggagtggggatgaccggtatcgccgaggggcgggtcgtgatcgtcaccggcgcgggccgggggctcggccgcgcgcacgccctcgcgtacgccgcggagggcgcgaaggtcgtcgtcaacgacctcggggtcggactcgacggcgcgccgggcccggacagcccggccgggcgggtcgtggacgagatccgcgcggcgggcggcgcggcggtcgcccacggcggcgacatcgcgacgagtgcgggggccgcgtccctggtggccgccgcgctggagacgtacgggcggctcgacaccctcgtcaacaacgcgggcttcctgcgcgaccggatgctcgtcaacctcgaagaggacgactgggacgccgtgctgcgcgtccatctgacagggcacttcctgccgctgaggcatgcggcggcgcactggcgggcggagacgaaggcggggcggacaccgcgggccagaatcgtcaacaccagcagtggggccgggctgttggggtctgtggggcagggcaactacagcgcggcgaaggccgggatcgtcggactgacgctggtcgcggcggccgagctcgcgcggtacggcgtccaggtgaacgcgatcgcgcccgccgcccgcacccggatgacggagcgtgccttcgccgggacgatggcggcgcccgacgccggcttcgacgccatggcccccgagaacgtgtcgccgctggtggtctggctcggctccgccgcgagcgccggggtcacgggacgcgtcttcgaggcggagggcggccggatcaccgtcatggagggctggcgtccgggcccgaccgccgacaagggagcacgccggacgccggcggaggcggggaagacggcccggaaactgctcgcggaggcggaggtgccgggggtggtgtacggggcggggtaaggggcggggtagggggatcggcggcgcgcggaagcggggcagtcggactcgcgtcctccggcagggcggtgggggacgggtgggggatgggtggccacgggcctccttgggcgccgctctgaggcgggctgtcactctgaggcggactgcccttctgcggcgcgctgctctttcgcggcgccccggctcttcgaggcgcgctgtgtctctgcggcgcggtgcctctatgaggcgcgctgcccctccgcggggacggccggaaggcgtccggccgcccccaggcgcaccgccggtggcgccgaccgcggcgcccggcatgcgcggcacggctctcgcggcgccggcgcacggcatacgcgcggcacggcatacgcggcgcccggcgcgcggcatacgcgcggcccggctcaggcggcgcccggctcacgccggcccggctcacgccggcccggtcacctgcccagcttccgcaggatctccgtcccgagggcccgccgcagtgggtccggggagcgggaccaagcggtcgccgcggtgaaggtctccccgcccgcccggcggacgagcaccgacaccgcctccgtccagtcgtcgttggcgggatcgccgcagcgcagggcgcggtcggcgagttccgggaccggggtggcgatccccagcgcggcctccaggagcgtgatgatggccgcgtggcccgtctgctggtcgttgcccgccatcgtgcgttccccggtgcggagttggacctcgacggtgatgccgccgtcctccggaatccggtgggtcaccatctcgtggccggagccgtacatctgctcaagacccgcgcgcagttcggcctcgacgtcgagtgccggccagcgccgcgcctcgtccagcgccggggagcgtgcgccggccccgtgcgccagcagcgcgcgcacacaacccggggagccccgccgcgccgcggcgaccagcggggcctcgccggtggggccggggcggtccggatgcgcaccggcggccaggagttccgtgaggatctccacctgcccgcgctgcaccgcccacgtcagcgcccggaagccgaactcctcctccaggtcggccgtcgccccggccgccagcagggcgcggacgacctccgcgtggcccccgcaggccgcgccgcacaacggggagtccgcgtccgcgctcagccggtcggggtcggctccggccgccagcagcagccgtacgatgccgggctcgttgctcaccgccgccagatacagggccgtctgaccgtcctcgtcccgcgcatcggcggccgtgcccgcgcgcagcagccgcacgaccgtgttttcgtccccttcgtacaccgccgtgaaaagacccgccggttcttgcgtgttcatgcctcgaccctcgctcgcgaaggcgccgggagcaaaggattaccgggtgttctgtgccacctctcgcgtgacggcccggtgtcacctgcccggtgcccgggcgaagccggcctacgtgtcgcactccagcaccgtccggcacagcgtgcagcgtgcccggacccggccgcgcaccgggatcctgatgcgctggtgacaggtggggcaggggaacgacacccgcaggaggccgcggtcgccgggggcgaaggcgtaggggacgcccggctgcgggccgggggagcggtggtcctgggcgtggcggcggtccttcgcgtaacggtggcggcccgcccagcccgccgccgtcagcgggggctgctgctcgtcccggcgggcctgcgccatgcccttcgtgtacgccgtgtacgcctgcgggctggtgaaccagatcgaggggtcctcaccgaagaccagggcccgcttggcgaggacgtagccgaactcctccggcgtcagatacccgagcttctgggacgaggccgcgtcctcgcggaacgcgtcgagaagcagccagcccgcgcccagataggtcgccgccgtgtccgtgaggatctcgttgtcgcgggtgcccgggaaggacaggtccaggcggtgcaggtacacgtgcatcacctcgtgcgccagggccgcgccgatgtcccggcggtgggtgcggaagcggtcgttcagctcgatgaagtactccggccccgcggcgagttcgacgttcgccgcatgggtcatctcgcggaagccgacgatcatccgggcgtccggcagccggtagtgccgcaccatctcgtgtgccacgcgctgtgcgcccaggtgcaggtcgtcgtggtcggcgaaggccacgtcggcgggggccacgctggccgcgaaggtgtggatggtgtcgtaggagagccgtttgtacagcgcggtgatggccgcccgcaccgtgtccagatgcgggtagccgtgctcgacgggaccgccgttcgccacgtccgcaccccctgaagacgccgccactggattccactgtaggcggggttcctcccggtggcggggcgggcgcggacgcgccgggtcacgcctggccaaaaaccggtccttgccgagcctgttcgaccgtctaaataattcgtaaaggcttggcgggtgcatgccattcaggctgtgcggcatgccgtgcggtgctccgcggtgcccccgccaggcgtgcaaccccccacgagaggaaccacgttgaacatcccgaagatcctgaagagattcggcggcctcaagagagccctggccgtcggcgccgtcacgctcgccgcggtctcgctccagccgctctccgcgcaggccgcgccgcagcccgtcgtcggcggcacccgggccgcacagggcgagttcccgttcatggtgcggctctccatgggctgcggcggcgccctgtacaccaagcagatcgtcctgaccgccgcgcactgcgtgagcggctcgggcaacaacacctccatcaccgccaccgccggcgtcgtcgacctccagagcggcagcgcggtcaaggtcaagtcgaccaaggtgctccaggcccccggctacaacggcaagggcaaggactgggccctgatcaagctcgccgccccgatcgagcagcccaccctgaacatcgccaccaccaccgcgtacaacaacgggaacttcaccgtcgccggctggggcgccgcccgcgagaacggcgcccagcagcgctatctcctcaaggccacggttcccttcgtcagcgacgcctcctgtcagcagtcgtacggcagcgacctcgtacccggcgaggagatctgcgccgggttcccgcagggcggcgtcgacacctgccagggcgactccggtggccccatgttccgcaaggacgactccggcgcgtacgtccaggtcggcatcgtcagctggggcgagggctgcgcgcgggccggataccccggggtgtacaccgaggtgtcgacgttcgcggccgacatagccagggcggcggccggactctgacggcagccgcgcagacgtacccgtaggtacgcggggtgtccgcgacccgccccggtcgcggacaccgtgccgtgctcgggaggagcggacgccctgctgcgcccgggagaagcggacaccctgccgtgcccggcaagaagcgcggacaccctcccgtgccccgggaaaatacgttcggcggcggcccgtacgcgctggcatactccgcgccatgaccatggaccaacagccttccatcaccgcgtcgttgcaggtgggcgagaaggacagcccactggaacggcggctcgacagggaactcaccgccttcaacgcggacgccaccggcgccggcgaacccgccccgctctccgtccgcgtcaccgactccgcgggcgacctggtcggcggcctgaccgcctgggtctggggcagctgctgcgcggtcgacatgctgtgggtgcgcgaggaccagcggcacgcgggctggggcggaaaactgctgcgggcggccgaggaggagagcgcacggcgcggctgcaccgagatgatcgtctcgtccttcaccttccaggcccccgacttctaccgcggccacggctaccgcgagacaggccgcaccgaaggcatcccgggcggccatcaggacgtccacttccacaaagtcctggagcccaccgcccgttgaaccagcagccccgacgactcctccctcggcctccgcttccgcgaacaacagggccgtacggtcccggacggctggagcaaccaggtgccggaccccgacgcccacccatgaccgaacggcgccgcaccccgggatgtcccgccccgtagggtttacgcccatgaccaacagcaacacccgcaccggcaccggtgacgtcgaccccgccgtccgcgccgaactcgcccggctgcgcgacagcatcgacaacatcgacgccgccgtcgtccacatgctcgccgaacgcttcaagtgcacccagcaggtcggccacctcaaagccgtacaccagctgccgcccgccgacccggcccgcgaggccagccagatcgcccgactgcgccggctcgccgagaacgccaaactcgacccggcgttcgccgagaagctgctgggcttcatcatcgccgaggtcatccgccaccacgagcgcatcgcggacaacaccgcgaacggctcggtgagcgcaccgccggccaccgaggacgacaccaccggccccgcggagtgacccgcgacgcccgacgacatcgcgcccggaacgcgcatgtgtcaggtcacgcgtacacacgatgaaccggttcaggcttaagctggttcgccaagcgaggggacgtcgggccgaggggacgtcgggcaatgccgtcggatgccaggatcctcatcgtcgacgaccatgaggacacgctgtacgcgctggagagcacgctggccccgctcggctatctgctgtcccgcgcgaccagcggcgacgacgcgctcaaggaagtcctgcgcggccaggtcggactcctgctgctcgacgtacgcatgcccggcgtcagcggactggacgtcgtgcgctacatgcggcgcctggaacagacccagcacatccccatcatcctgctcaccggcttcggcctggacgccgaactcaccaccaccgccttcgcactcggcgtcgccgacctggtcacgaaacccgtcgacccctggtccctgcgcaccaaggtccgctacctgtacgacgcccaccagcgcagccaggccctggaacgagaagtgcgcgaactgcgcgccctcgccaagaacgagcacccccagccccgctcccaggcccagccccacccgtccccagcccaaccccagccacacgcccacgtccccgtcccacgcgagccccccgcccagaagccggcgcaggaccgcacctgagacctgtccgacggatccaccggatccaccagatccgtacatagcacgtgtaccgggccgcccctgtgccctgtcggcgccatcaggcagcatgtccctcatgtccgtactgacgcgcgacgaagcgcagacccgtgccagtctcctcgacgtccaccactacgcgatcgccctcgatctgaccgtgggggacgagaccttcgactcccgcaccgtcatcaccttcacggtacggggggaccacgacgtcgcggacaccttcgtcgagctgaagcccgccgagctgcgctccgccaccctggacgggcagcccctggacaccgcgaccctggtcgagaaccgactgccgctgacgggcctgacccagggcgagcacgagctgcgcatcgacaccgccatgggctactcccgcaccggcgaaggcatgcaccgcttcaccgaccccaccgacggcgagacatacgcctacacccagctgttcatggacgacgtgcagcgcgtcttcgccgccttcgaccagcccgacctcaaggccgtcttcgaactcgagatcaaggcccccgaaggctggaccgtcctcgccaacggcgtcaccaccgacgtgggcgacggcacctggaaggccaccgccacccccctcatctccacctacctcgtcgccgtcgccgccggcccctggcactccgtacacaccgaacaccgaggcctgcccttcggccttcactgccgccgctccctcgccccccacctcgacgcggacgccgacgaactcctcgacatcacccgcgcctgctacgaccgctaccacgagaagttcgaggagccctaccccttcgactcctacgaccaggcgttcgtccccgagttcaacgccggcgccatggagaaccccggcctcgtcaccttccgcgacgagttcgtctaccgctccgccgtcaccgacaccgagcgccagacccgcgccatggtcatcgcccacgagatggcccacatgtggttcggcgacctcgtcaccctgcgctggtgggacgacatctggctgaacgagtccttcgccgagtacatgggctaccagaccctcaccgaagccagcctcggggggtccggggggactccccccagaaagtggggcaccgacacctggaccgacttcggcgtcacccgcaaaccctggggctacgacgccgaccagcgcccctccacccaccccgtcgccccggaagccgtcgacgacaccgcctccgccctcctcaacttcgacggcatctcctacgccaagggcgcctccgccctgcgccaactcgtcgcctggctgggcgagaaggacttcctcgccggcatcaacacccacttcacccgccacaagttcggcaacgccaccctcgccgacttcatcgactccctcgccgccgccaccgaacgcgacgtccacgcctgggccgactcctggctgcgcacgaccggcgtcgacaccctgaccccggacatcaccacggcccccgacggcacctgcgccctgaccgtcgagcgcgacggcagccgcccgcaccgcatcaccgtcggcctctacgaccgcgacctcaacgacgaggcccgcctcaccctgcgccgccgcctcgaactcgacatcccccaggaccccgccgaaccacagcccctcggcaagcgccccgccctgctcctcctcaacgacggcgacctcacctacgccaaggtccgcttcgaccccgaatccttcaccaccgtccgcgccgccctgtccggcctgcccgaccccctcacccgcgccgtcgtctggaacgccctgcgcaacgccgtacgcgacggccatctcccgcccaccgcctacctgcagaccgcccgcgcccacctcccgcacgagacggacctcgccctcgtccagggcgtcctggccttcgccaccacccacgtggcgggccgctacctgtcggccgccgaccgacccgccgccctcgccaccctcaccgacctgtgccgcgacctgatccgccgcaccgaggacggctcccagcccggcctgcgcctgaccgccgtacgccacctcatcgacgtcgccgcccaccccgacaccctcagcagctggctctccgaaggcaccgtccccggcggccccgaactcgaccccgaactgcgctggcgcatcctcggccgcctcgccgtcctcggcgccatcgacgacgacgtcatcgaggccgaactcgtccaggaccccagcgccagcggccaggaaggcgccgcccgctgccgggccgccctgcccgaccccgagtccaagcgacgggcctgggaagagatgttcaccaccgaccacctctccaactacctgttcaccgccaccgcccagggcttctggcaacccgaacaggccgacctcgtacgcgcctacgtcgagcggtactggaccgacgcggtcgccgtcgccgcccgccgcggccccgccatcgccgccgccgcgggccgctgggccttccccgcccacgccgtcagcccggacaccctccgccgcggcgaacagtgcctgcgcgaggccgaccccatcccggccctgcgccgcaaactcgtcgacgaactcgacgacctggcacgggccctgcgggtccgggaggcatagcccccggacaccgggcacacccggcccgctccgccgacccggcgggctgatcacccctcctggctccacccgccgggcgggatgatcagcccgcgggcacccacgcctagcacgcccgtccaccccccacctttcctccgcacggcagtaccccctttcgggtcggatcgttgtgctgcacaagcgcgccgaaccgattcgcgtacacgctgaacccccacgctgtgcgcgcccccggaggacatccatgagctcgccgcccctcgcctcaggtcccgaaggcccccacgcgctgcggccgctgctcgagaccgtgctcgacgcactcacggaaggccgccaggcacgcggcggaccactgcccgcaggcggaccccaggccgtcgccgcgcgggtgcgggccacggtcggcgacgccctgccacagaagggcgacccggacgccgtacgccacctcgtccgcatgctcgccgaaggcgccgccgaccccgccgaccccctgtgcgccgcccacctgcactgcccgcccctcgccgtcgccaccgccgccgacctcgccgcctccgccctcaacccctcactcgactcctgggaccaggcccccgccgcctcggagctggaggcgctggtgaccgacgctctcgccgcggagatctacgccggcacaaggacgagtgaccgagcacggccgaccgtcgacaccagcaccagcgccccggaggcgaacgagccacacacgagcacagccctcgtcaccaccggcggcaccgagtccaaccaactcgccctcctcctcgcccgcgaagcccacagcggcgcccggctcgtctgcggagccaacgcccaccactcactcacccgcgccgcctggctcctcggcctgcccgaacccgtcgtcgtccccgcccccgccggcaccctcgaccccgccgccctcgacgaagccctcaccgaactaccgggcccacgcggctccctcgtcgtagccgccaccgcgggcaccaccgacgccggcctcatcgacccgctcaccgacatcgccgacctgtgcgccgcccacggcgcccgcctccacatcgacgccgcctacggcggaggactgctgttcagcgcacgccaccgccaccgactccacggcatcgaacgcgcccacaccgtcaccctcgacctgcacaaactcggctggcaacccgccgccgccggcctcctcgccgtacgcgacccccacgacctgcacgcactccaccaccacgccgactacctcaacgccgacgacgacacccaagccggactccccgacctcctcggccgctccctgcgcaccacccgacgccccgacatcctcaaaatcgccgtcaccctcaaaaccctcggccgcgacggactcggcaccctcgtcgaccaggtctgcgcccacgcccaggaactcgcccgcctcatccaggcacaccccggcttcgagctctacgacccacccaccatcagcaccgtcctgttccggcccgccgaagcctccgacgacaccgtcgccgcggtacgccgcaccctcctcaccgaaggccgcgccgtcctcggccgcgccgtcctcgacggacagctctggctcaaagccacccttctcaacccccacacccggccgggcgacctggccgcgctcctgaaactggtggaaggacacaccccccgatgagcccgacgccccaccccccacgccacgaacccgaagcaccccgcgacctggcgggcatcggcatcggccccttcaacctctccctcgccgccctcgcccaccccctcaccgaactcgacaccgtcttctacgaacagcgccccagcttcgactggcaccccggcctcctcatcgacggcgccaccctccaagtccccttcctcgccgacctcgtgaccctcgccgaccccaccagcccctggtccttcctcaaccacctcaagacccgcgaccgcctcttccccttctacttcgccgagcgcttccacatccagcgcgccgaatacgacgcctactgccgctgggtcgccgacagcctccccggcctccacttcggccaccaggtcgacgccgtccgctggaaccccgaacgcgacgtcttcgaagtcgacttcacccaactcgacaccgacggcgaagccgaagccctcggacgcacctacagcaagaacatcgtcctcggcgtcggcaccgccccctacgtccccgaacccctcaagcccctcgtcgaagcccccggcgtgcccgtcatccacgccgcggactacctccagcaccgcgaccgcttcctgaccgccgaacacatcaccgtcatcggctcaggacagtccggcgccgaagtcttcctcgacctgctccgcaaccgccccgccggacacgagaggatccactggctcgcccgcacggaggccttcgcaccgatggagtactccaaactcggcctcgaacacttcacccccgactacacccgctacttccacgccctcaccgaacccgtccgcgaccggctcgtcgccgcccaatggcaactccacaaaggcatcgacgccgacaccatcgccgccatccaccacgagctctaccggcgcaccctgcacggcggctggcccgacgccgtcctcacgcccggcgtcaccgtccgcaccgccggtcgcctcgccaccaccaaagtcgaactccacctggaacacgcccagcagggcacccgctcccgcctcaccaccaacgccgtcgtcctcgccaccggctaccgcgaacgccccctcggccgcatcctcgccggcctcgacccctacctgcgccgcgacagcgccgaacgcccccgcatcgacaaccagttccgcctcgacctcgacccctcggtcaccggcaccgcctacgtccagaacgccgaactccacacccacggcatcggcacccccgacctcggcctcgccgcctggcgcagcgccaccatcctcaactccctcaccggcaaggacctctaccccctcccacaccgcaccgccttcaccaccttcggactccagcagcaaccacacatcccacccgcccgccaggtccacgccctcacgcccctcatcgacggacgctgacaacacacgccaacggcgccgacgaaaaccaccgccgacgccgctgacacacccctgccggaccccgcaggcccctgccggaccccgcttgcccccttagaacaccggcgaaccgtcccgcgtcagcttccagtccaccgacgcgaagtccttcggatccagcacacccttcgcggtcacccactccgcgatccgggtccggatctccgtcgactccgaccacaactcagcggccgacgccacatacgggaaggcaccgcccccgttcgcacggtagttgttcaccgcgaacacgaactgctgcgcatcatccagcgccgcaccgttgtacgtcaggttcttgatccgcgaacccgccgcctgcgcgatgtcgatctcgtaccccagacccgacacatagtcgtagttgtagtccggccggttgttcgcgttcgtcagcttctccgtgtcgaccaccgtgcccgccgccgtctgcacgaaatactccgccgagtactccaggtacgcccgcagctgcgcacccgtcagcaacttcgcgaccagcgtgttgtcatacacatacagactcgacagatcccggatcgtcaccttcccggccgggatctccgacgtccgcgagaacggcgacgcctgcgcgatcaccggcaacgacgcgtactgcgtgcccaccagcgccgccctgacgacatcctcctgaaccttggtgatcagatcgatgatcggggcgtccttgtagcgcgcctcgaccgtcgtcagcgtctccgtcgccgtaccgaccacctggttcacatacttcacgaccgtcgcatgctcgtccgacagcagcttggtgatccgcgggtcgtccgcgaccgcgttcgtgttccgcagcgacgcgaccaccgactccacctcccacttccccttctcgaacaccaactcgaagtcgaagagagacaaccgctccgcgtaacacaacggctccgacagcacgaccgtcttcccggtcttcgcgttcgtcaccttcagctcgggaatctccacatgcgcgtgaccgaccagaatcgcgtcgatccccggcacctgctgcgccaccagcgccgccgaattctcgatgtacggcaactgatcaccgtacgacgacgtcccggacgaccccgagtgcgccgacacgacgacgacatccgcacccatcgaccgcagcttcggcacccacttcgccgcctgctcctcaagccccgggaacgtcaacttgccctgcacatacgccttgtcccagatcgcgatacccgggttcgtcagccccagcacagccaccttcaccggcggcgcacccggcacatggaacttcttgatgaagtacggagggaacgccggcttcagcgtcttcgcgtccagcgcgttcgcacccagcagcgggaaacggcactgcgactcgaacttccgcagcgtctcgatgccgtagttgaactcatggttgccgagcgccaccgcgtcatacccgatcgcgttcatcgcctgcgccatcggatgaaccggaccacccttcgcggtgatcgggtccaccttcgcgtagtagtacgtcagcggcgtgccctggatcgtgtcacccgcgtcgagcagcagggtgttgcagcggcccttctccttgcgcacctggtccaccagagtcgaaatccgggccaacccctgcgcgttccccgccttgtcggagtactccgcgtccttgaagtagtcccagttgaagacatgcccatgcaggtccgtcgtgcccatcaccgtcagcgaataccgcttcggacgcttcccggcacccttcgccgccccgcccttcacctccgcggcctgcgccgccggagccgcgaccgcgccggtcagcgcgacccccgccccggtcacggccgacttcttcaagaacttccgacggttcaacggcatgtctcgtactcctcgggaaaggccaatgacgcgcgtagattctggcccaccagccacacccccgaacagcccccgcaggttgcgatctgatgaccagtagccaccccaccgcaccccccagtgacagagtgggacgtatgacccccaccgcggaggaaccccgccccacaggcccctacggcacccccgaagccccccgcatcgccgtccgcggcgaagcccacctcgaagtcgaccccgagatcgcccgcataggcatcaccgtcagcgcccgcggcaccgacagacgcgacgcactcaccgacctcacccgccgcaacaccaccgccctcgacctcgtcaaaacctacggggaagccgtcgagcgactggaaaccggcgccttctccatcacccctgaactcaccaaacacggccgcggcgaacgcatccgcgcctaccacggccgcgtccacatcaccgccgaactcaccgacttcaccgcactgggcgaactcacgacccgactggccgacctcgacctcacccgcgtcgacggcccctggtgggccctgcgccccgactcacccgcccaccgccaagcccgccggcaagcagtgcgcgaagccgtccagcgcgcccgcgaatacgccgacgccctcggcaccaccctcgccgccctcgtcgaactcgccgacatcggcgccgacaacctcccgccctaccctccggcccccggccgcgccatgcgctccatggcctacggcgccgccgcccccgaggaaaccgcccccctcgacctcgaacctcaacgccagaacgtctacgcccaggtcaacgctcggttcaccatggtcccgccgcggctgtagccgacggcacacggaacgcactcgaaaacacgccgaacgaactccgaaatgctcataggagcggcccggcgcacaattcaacagttgtcaatagccctttacccaaaggttgttgagtagtcatgcccgaccaattctctacccgccagtaaggcctaggctcaaaccatgcgccgagcaaagatcgtctgtactctgggccccgccaccgactcgtacgaccagatcaaggcactggtcgaggccggaatggacgtagcccgcttcaacctcagccacggcacctacgccgagcacgaggagcgttaccagcacgtccgcaaggcctccgacgagaccgggcgcagcgtcggagtcctcggcgaccttcaaggtccgaagatccgcctcggccgcttcaacgaaggacccgtactccttgaacgcggcgacaccttcaccatcaccgtcgaggaaggcgtcgaaggcgaccgccagacctgcggcaccacctacgccggcctcgccgccgacgtcactcccggtgagcgcatcctcgtcgacgacggcaaggtctgcctcgaagtcacctccgtcgacggcccccgcgtccacaccaccgtcgtcgaaggcggcatggtctccgaccacaagggcctgaacctgcccggcgtggccgtctcggtccccgccctctccgacaaggacgaggccgacctccgctgggccctccgtcagggcttcgacgtcatcgcgctgtccttcgtacgcagcggcaaggacatcaaggacgtccaccggatcatggacgaagaaggccgccggctccccgtcatcgccaaggtggaaaagccccaggccgtcgagaacatcgacgacatcgtcgccgccttcgacggaatcatggtcgcccgcggagacctcggcgtggaaatgccgctcgaacaggtcccgatcgtccagaagcgcgccatcaaactcgccaggcgcaacgcgaagccggtcatcgtcgcgacgcagatgctggactccatgatcgacaactcccgcccgacccgcgcggaggcctcggacgtcgccaacgccgtcatcgacggcaccgacgcggtgatgctgtccggcgagacgagcgtgggcaagtaccccgtcgaaacggtccgcaccatgtcccgcatcgtggaagcggcggaagaggacatcctggccacgggcctgccgccgctgaccgaacgcaacaagccccgcacccagggcggcgcggtggcccgcgcggcggccgagatgggcgacttcctcggcgccaagttcctggtggcgttcacgcagtccggagacacggtccgccgcctctcgcgctaccgttccccgatcccgctcctggccttcaccccgatgccggcgacgcgctcccagctcaacctgacatggggcgtggagacgttcctgggcccgcacgtggattcgacggacgcgatggtggaccaggtcgacgagctgctgctcaagtacggccgctgcgagaagggcgacgtggtggtcatcacggcgggctcaccccccggcgtctcgggctcgacgaacctggtccgagtccaccacatcggcgaggacgacagccccaagtaggggcgggacgatcagtacttggggcctacgtgggcgtccatgagggcgacggaggctttgcgggcgacggagatgttgtacgggtttccgttgcgggtgcagtgcgtccactggatgccgagctggtcgagggtgtcggtgtagagctggcggatgtcgtcggacacattggtgaagaagtaccgcgggtactcgtagcgtttgcgctcaccgccgacgagccgggtcgtccagttggtgatgcggcacccgtcggagtggatgagtccgcggatgaactcccacgggtgggcgtcgacgatctcctgctgccaggcttcgaggacgatggggcgctcgtgcttcttgccggggccatgctgcgggaacatgcaggtccagtgcttggtgtaggacttcacctcgacgcagcccggcttgtagcgctgcttgacactcggcagcggcatcaccttgcgcatggcctcttcggcggctgtaatcagccccgtctgcattgcgttgcagaagacagacaggtggtgctgcttgcgcttcgagatgatgtgtccatcaccgagatagaggcctagtaggtaggcgtacgcagcatggtcgaactcgcggcccgtgcagtgggggcagtcggttggctgctcataggcttcgccgcgtgctctgcgatcctcgctacgccaccagccgaccgtccctcgtggaacgttgaggcgctccgcgactatgcggttggggatgccttggcgcatgagtgcgacagcgtgagcgcgaatcgaagggctgtgctgttccatgcggccactctgcgtcaccggtcgtgacctcatgcgccaaaaagcggatgttcacgagaacgagaacatccgcttctgattgcgaccttggaatcgaaggaaaagtgccccgagtcggattcgaaccgacgctgtcggtggtttgagcaccgtgtctctaccgctggactaccggggcttcctgtaaaacaaaggatggcggtcacccgccgtgcccccaccttaccgcagctaggtaggctcttgggagcagtacccgcccctgaacgaggagcccccgtgaccgcccccgagtcgccccagcccgtagacgcgcccgacgacgacaagtcgcacgtgcctccgctgacgacccgtgtcgtcatcgccgaggacgaggcgctcattcgtctcgacctcaaagagatgctcgaggaagagggctacaccgtcgtgggggaggcgggtgacggcgagcaggccgtggagctcgcccgcgagcaccgccccgacctcgtcatcctcgatgtgaagatgcccaagctcgacggcatctcggccgccgagaagatcgccgaggagagcatcgcgcccgtcctcatgctcaccgcgttctcccagcgcgacctggtcgagcgggcgcgtgacgccggcgcgatggcgtatctggtgaagccgttcagcaagagcgacgtcgtgccggcgatcgagatggccgtgtcgcgcttcgcggaactgaaggcgctggagcaggagatcgtcgatctcacgcagcgtctggagacccggaagctggtggaccgtgcgaagtccgttctgcagacgcagtacgggctgaccgagcccgccgccttccgctggattcagaagacctccatggaccgtcgtatgtccatgcagcaggtcgccgaggcggtcatcgaggacgccgaggagaagaagtccgcgaagggctgagcccgtcccgcagccgtacatcaagggaggcccgcacccgggaacatggggtgcgggcctcctcgtatgcccgtaggggcggggcggggcgggcgtgccgggctcagtcctcgcccaggtacgccttgcgcacggactcgtcgtgcagcaggtcctgtccggtgccggagaggacgatgttgccgatctccatgacgtggccctggtcggcgagtgagagcgccgcctgggcgttctgttcgacgaggaggatcgtcgtgccctgggacttgagctcggcgatggtggccatgatcttctgcatcatgatgggcgagagtcccatggagggctcgtcgagcatgagcagtttgggctgggacatcagggcccggcccatggccagcatctgctgttcgccgcccgagagggttccggcggcctgcttcctgcgttccccgaggatggggaagaggtcgtaggcgcgctggatgtccttctcgatgccgggcttgtccttgcggaggaacgctccgagctggaggttctcggcgatggtcaggcgcgggaagatgtgccggccctcgggggagtgggccaggcccagggcgacgatcttgtgggcggggacgctggtgagcggttggccgtcgaagacgatgcggccgccggtcggcttgagcaggccggagagggtgcgcagggtggtcgtcttgccagcgccgttggtgccgatgagggtgacgacctggcccgcttcgacgctgaaggagatgcccttgacggcttcgatcttgccgtaggagaccctgaggtcctcgacctcgagcagtgcggtcactgggcgtctcccttggtgccggtggtgctggtcgtgccggtggtgctggtctcgctggtgctgtcggccgcttcggccgcttcggcctccgcggcttcggcgtgggcttcggcggcttcgacctcggcggcctcggcgtcgccgggggcgccttcgaagggttcgccgaggtaggcggcgatgacgcgctcgtcggcctgtacgacctccgaggtgccttcgatgagcttctcgccctggacgaggacggcgacgcggtcgcagaggttgaagatgaagcgcatgtcgtgctcgatgacgaggacggcgatgcccatgtcgcggatggcgaagaccagttcctcggtcgctcgcgtctcctgcgggttcatgccggccgtcggctcgtcgaggagcagcaggcccggttcgctggcgagtgcgcgggcgatctcgagcttgcgctgttcgccgtaggggaggttgcgggagaggtggtcggccttgtgggcgaggccgatgaactccagcagttccatggcgcgttcgcgggaggcggtttcggccttgcggaagccggggccgcgcaggagggccgaccagaggccttccttggtcctggtgtggcgtcctacgaggacgttttcgaggacggtcatgttggcgaagagccggatgttctggaacgtgcgggcgatgcccgcgcttgtcaccaggtggggcttcggcggcaggaccttgcccttgtaggagaccttgccctcggtggggacgtagaggccggtgaggcagttgaagaaggtggtcttgccggcgccgttggggccgatgaggccgacgatttcgccgctgttgacggtgaggtcgacggagcgtacggcggtgagtccgccgaagcgcatggtgacgccggaggcttcgaggacggtggaggtggccgtggtggtggtcatgtcggtcacgcccctgccttcgtgacgccgacggtgggttcggtcaggcgttgttccggtacgtcgatctggtcggtctcgtggaattcgagctggcggcggcggttggcgatgatgccttcggggcggaagcgcatgaggaggacgagcgcgatgccgaaggcgaggagctggtactccttcaggaaggagagcttctcggggatgaggtagagcagggtggcgccgaggatggggccgttgacggtgcccatgccgccgaggacgaccgcggcgagcaggaaggcggagttcgggggcacggagccggcgaactggtacggcgccgggttgacgctgtagccgacgtgggcgctgaccgtaccggcgaggccggcgagggaggcgccgagggcgaaggcgatgagtttgacgcggaagccgttgatgcccatggcggtggcggcggtctcgtcctcgcggatggcgatccaggagcggccgatgcgggagtccgaggccctggtgaagaccagcaccacgagtgcggtgatgatcagcatcaggaagaagtagttcgcgaagcggcccacggtgaaggagccgacgtcgtgggagatcccgaggttgaatccgaagatttcgaggtcggggatccgggagatgccgttggggccgttggtgaggttgggtccggaggagccgtcgaggctgttgacggcgatgcggaagatctcaccgaagccgagggtgacgatggcgaggtagtcgccgcgcagccggagcgtcggggcgccgatgaggacgccgaagacgagtgaggctcccatgccggtcagtgccgctgcccagaaggggaactggacgccggcgaagcgggagaactcggagccggagacgagggcggcggcgtaggcgccgacgccgaggaaggcgacgtatccgaggtcgaggagtccggtgaggccgacgacgatgttgaggccgagggcgacggttccgacgatcaggatgttcacgccgaggttggcgttgtggtcgtcgctctgggtgaaggggaagatcgcggcggcgaggaaggccagggtggtggcgaatcctttgtgctgggcgttgatcgtggagaaccggtcgaggaggccggcggcgaagagtgcccaggcgccgaagacgacgaggaagaggaagccgatgaaggtttcgctctcgtcgtcgttcacgccgatgccgtaggtgaagacgatcagggcgaggagggtggcgagggtgatgacgaggcgctggacccagggggcgagttcgccggcgggcgggatgttctccgccttggcgaggtagtcgcgccaggtgccgcccggggtggggagggcgagggcgccgaggagggcgatgagggaggcggccatggcgacgtaggcgccggggtcgaggttggcgaggccgccgaggtcgaccgcgatggcgatgccggtgtaccagcagacggtgaaggcggaggccgcggcgagggcgatgggggaggcggcgttcgcggggttggcccagcgcagggcggggatgtcccagcgggtgaggccgaggaggagggtgatgacggcgccgacgatggcgagggtctggaggcccgcggggtagccgtagacggtgaggtcaccggggaaggcggcggtccaggtccaggacatgaaggcgctggcgatggtggcgagggcgccgatgacgatgaggaggcgggcggcggcctgggggagcgggatgaggccggccgcggtcttctcggtgctggtggcgggggtggtcatggtgatcacgccctgtccgcgacgcgttcgccgaggaggccttgtggccgcagcagcagtacgaggatgaggaggacgaaggcccagacgggggcccagctgccgccgccgagctgctgcatgccggggatgccgtcgatgtaggcggtggcgagggtttcggcgacgccgaggacgactccgccgagcatggcgccgtagatgttgccgatgccgccgaggacggccgcggtgaaggccttgaggcccatctggaagcccatgtcgtacttgatctggccgtagcgcaggccgtaggcgacggcggcgaccgcggcgaagagtccgccgatggcgaaggcgatgacgatgatgcggttggtgtcgatgcccatgagctgggcggtgtccgggtcctgggcggtggcctgcatggcgcggccggtgcgggagaggcggacgaagaagccgagagcggccatacagatgggggcggcgatgatgatgaagagctggccgctctggatgtggacggagccgatgttgaaggactcggtgcccagctgggggaaggtcctgtcggtcttggcgtccgggtagaagttgaagaccacctgctggaggccgagggagaggccgatggcggtgatgaggggggcgaggcgtggtgcgccgcgcaggggccggtaggcgaagcgttccgccccgacggcgatgagtacggcgatgaggccgcctccgatgagcatcgccgggagggctatccacatggatgtgccgtctggcaggacgtagaagtagaccgtgagtgcgccgaagcctccggtcatgaagatctcgccgtgggcgaagttgatgagctggacgatgccgtacaccatcgtgtaaccgatggcgatcagcccgtacatcgagccgaggaacagcccgttggccagctgctgcggcagggtgtgcaccgcgcggcctccatgtgggtgtggaaggtgagcagactgagtggagcgggccgcgcggctggcgtgtggtgggtgccgcgcggcccgggtggtgctgtggtgccgggtgggtcagccggcgttgtaggtgccgctcttgacggccttccacttgcccttgacgacctggtagacggtgagctgcttgttggtggtgtcgccgtactcgtcgaaggcgacggggccggcgatgccgtcgaacttggtcttctggacctcgtcgacgatcttggtgcgggcgtcggaggggaccttgccgtccttcacgacgttgccgatggccttgatgatggcggtggcggcgtcgtaggagtagccaccgtaggtgccgtagtcgccggggtacttcttcgccttgtaggtggcgatgaactccttggcggcgggcagggtggtgacggggacgccgacggaggtgacgaggtcgccttcggagggcttgccggcggtctcgatgtaggtgtcggagaacatgccgtcgccgccgaacagcgggatgtcgacgccgccgtccttgagctgcttggtgatcttctcggactcgtcgtactggccgccgtagtagaacaggtcggcgccggagttcttgaccttggtgacgagcgaggagaagtcggtgtcgccgacgctgatgtggtcctcggcggtgaccttgccgcccgcctttttgaagttctgcttgaagagcttggcgaggccggcgccgtaggtctgcttgtcgtcgacgatgaagaccttgcgcttcttcagggtgttgtaggcgtagtcggccgcgaagccgccctggagggcgtcggtggtggcggtgcggaagtacgtcttgtaaggacgttccttcttgctctgccagttcttgccctgggtcagctcgggggcggtgttcgacggggagatctggacgaggccggccgtgtcgaagacctgctgcatctgggtggcgacaccggagttcagcgggccgacgacgccgaggacgtccttgttggcgacgagggcggtggcgttctgctggccgctggccgggacggccttgtcgtcgagggccttgaccttgaacgtgacgccgggcacgaggttcttcttgttggcgtcgtcgacggcgatctggacgccgtactggatgccgaggccggtggcggagttctggccggtgaggggcgcgtcgacgccgatgaccacggtcgtcttgctgccgctgtcgctgcccttgtcgtcgtcgcgcgatccgcaagcggtgagcgtgagtgctccggtggtgagcacggtggtgagtatcagcaaggaacggtgtcgcacgatcaatcctctccctggcgcgaccctcctgctggagggccgtgtgtctcgccgggccgtactggggtgttgctgggccgtgctgcagacgcgcccggcggcgcggtgactggccgtgactataagcgcaggtggcggcgtcggggaggagatggggacaggctgtgacgctcttgttatgccgtgggttgggctcgggggtggggggcggtcggtcgggggcctggcgcggtgctccccgtgaccgcatggtgagaacgccctgttccgctcaggggctccaagtgatcttgcgagggctggggcggggctgggcggggcgtctgagggagcgttggcaaggcggcgcgacggccattccttgtattgcatgcaggttacacagtgttacttccctgtggggggcacgcggtgtgcggcagccgggagagggtgcgtgggcggttgccgccgacgaggaagctgtacggctgctgtgcttgtggggtgcgcaggatcaggtccaggcgggggatgttgacgccgtggggcagggcccggcagtcgggtacggagatgcgcgcggcgaggcgccggggccggccggccttgactgtcagtggcggggagggtgtcgtgcgggtggcgagagctggtaggtcggcgcggcggggcgggggcggcggccgtcgccagggcggcggggagcgcctggagggcccggcggtggtggacgggcggtgtggcccaacggtccggcaggcggggggagttcgcccccgacggcgtcgtcgggggcggggtgaggggcgtcggggcgggtgggaagtccggttcgacgggcccgaggccggtcatgcttcgtgctgggccaaaggctccggttccgccggtacccggtccgtcccgtccttccccgcccgtcccgccgccccccgaacggccgctatttcgcggggagttcgcgcagcaggcaggtcaggcgggcggtgcacacgcgcttgccctcctcgtcgctgatcacgatctcgtacgtcgccgtggagcgcccccggtgcacgggtgtggccactccggtgaccagcccggaccgtacgccccggtggtgcgtgcagttcaggtcgacgcccacggcgagcttggagctgccgccgtggagcatggagccgacggagccgagggtctcggcgaggacggcggaggcgccgccgtgcagcagcccgtacggctgggtgttgccctcgacgggcatggtgccgacgacccgctccgcggaggcctcgaggatccggacgcccatgcgtgtgccgaggtgtccggcggagaagagggcgggcaggtcgacgccgagtgccgcgtactcgtcgatgacctcttgcgggaacgtcggggtgtgctgctcgcccatggggcccggctccgttcgtcgtgtcgctgtggaccgatcttgctcactgcctggctgagcaaacgctcagtcggttgtcgattgttccagacggacgacgacggacttgctggccggggtgttgctggtgtcggcggtggcgtcgagcggtacgaggacgttggtctcggggtagtaggcggcggcgcagccccgggcggtggggtagtgcacgacgcggaagccgggggcgcggcgctccacgccgtcctgccactcgctgaccaggtcgacgtacgagccgtccgcggcgcccagcgccttggcgtcctcggggttgacgaggacgacccggcggccgttcttgatgcctcggtagcggtcgtcgaggccgtagatcgtggtgttgtactggtcgtgcgagcgcagggtctggagcagcagccggccttcggggagcgccgggtactcgaccggtgccgccgtgaagttggccttgccggtggctgtcgggaagcggcgctcgtcgcggggcgcgtgggggagcgcgaagccgccggcggaaccggtcacgcgcgcgttgaagtcgtcgaagccggggatcacgcgcgcgatgcggtcgcggatcgtcgcgtagtcattctcgaactcctcccagggggtgcgggatttgtcgccgagcacgcggcgggcgagccggcacacgatggccgtctcggacagcaggtgcccgctcgcgggctccagacggccgtgtgaggcgtgcaccatgcccatggagtcctcgacggtcacgaactgctcgccaccggcctggaggtcgcgttccgtacggcccagggtcggcaggatcagggcgcgcgcgcccgtgacagcgtgcgagcggttgagcttggtcgacacatgcaccgtgaggcgggcgcggcgcatggccgcctcggtcacctcggtgtcgggcgaggcggacacgaagttgccgcccatcgcgaagaagaccttcgcctcgccgtcgcgcagggcgcggatggcccgtacgacgtcgtagccgtgctcgcgtggcggggcgaagccgaactccttctccagggcgtccaggaaggccggggcgggccgttcgaagatgcccatcgtgcggtcgccctgcacgttggagtggccgcgcacggggcacacgcccgcgcccgggcggccgatgttgccgcgcagcagcaggaagttgacgacttcgcggatcgtcggcaccgcgtgcttgtgctgggtcaggcccatcgcccagcacacgatggtgcgctcggaggcgagcaccatgcggagggcttcctcgatctgctgctgggtgaggcccgtcgcggcgagcgtcccggcccagtcggcggtgcgggcggcctcggcgaactcctcgtatccgtgggtgtgttcgtcgatgaacgcctggtcggtggcgccgttcgtctcgaggatcagtttgttgaggaggcggaagagggcctggtcgccgccgaggcggatctgcaggaacaggtcggtgagggcggcgcccttgaacatgccctggggggtctgcgggttcttgaagcgccccatgcccgcctcgggcagtggattgaccgtgatgatcttcgcgccgcccgccttggccttctccagggcggagagcatccgggggtggttcgtgccggggttctgtccggcgacgatgatcaggtccgccttgtagaggtcctccagcaggacgctgcccttgccgatgccgatcgtctcggtcagcgccgaacccgacgactcgtggcacatgttggaacagtcgggcaggttgttcgtgccgagttcgcgggcgaacagctggtacaggaacgcggcctcgttgctcgtgcggccggaggtgtagaagagggcctcgtcgggggagccgagtgcggcgagctcctcggcgacgatgtcgaaggcccgctcccagggcaccgcctcgtagtggtcggcgccctccgccagatacatggggtgggtcaggcggccctgctggcccagccagtagccgctgcgggtggcgaggtcggccacgctgtgggcggcgaagaagtccggggtgacccggcgcagggtggcctcctcggcgacggccttcgcgccgttctcacagaactccgccgtgtgccggtgctccggctcgggccaggcgcagccggggcagtcgaagccgtccttctggttgacgcgcagcagtgtcagcgcggtgcggcgcacccccatctgctgctgggcgatgcgcagggtgtgcttgatggccggcagccccgctgccgcctgcttcggctcgctgacctgcggcgcgtcctgaaccggatcgcccttgggcggcttcgtggccatcgagctgctctccttcgcgtccacgtgtgaggtacgtctccgatcctcgcacggggcggtgacagcgccggggcccgggcctggagggcgctcgggcgaccggggcccggtccgaacggctctcactgtcagtggggcgtggcaggatcgggggcgtggcagaaacagcatcgaagaagaccgagaagacctccggcggcgcgcgtccgcggctgatgctcatggacgggcactcgctggcgtaccgcgcgttcttcgcgctgcccgcggagaacttcacgaccgcgaccggccagccgacgaacgcgatctacggcttcgcgtcgatgctggcgaacacgctgcgcgacgaggcgcccacgcacttcgcggtggcgttcgacgtctcgcgcaagacgtggcgctccgaggagttcacggagtacaaggcgaaccgctccaagaccccggacgagttcaaggggcaggtcgagctgatcggtgagctgctcgacgcgatgcacgcgcagcggttcgcggtcgacggcttcgaggcggacgacatcatcgccacgctcgccacgcaggccgaggccgagggcttcgaggtcctcatcgtcaccggtgaccgggactccttccagctggtcagcgatcacacgacggtgctgtatccgacgaagggcgtctcggagctgacccggttcaccccggagaaggtcttcgagaagtacgggttgacgcccgcgcagtacccggacttcgcggcgctgcgcggcgacccgtccgacaacctgccgggcatcccgggcgtcggcgagaagaccgcggccaagtggatcaaccagttcggttcgttcgcggagctggtcgagcgcgtcgacgaggtcaagggcaaggtcggccagaacctccgcgaccacctggagtcggtgaagctgaaccgccggctcacggagatggtgcgggacgtcgagctgccgaagtcggtcgccgccctggagcgcgctccgtacgaccgcacggccgtcgcgatggtcctggacaccctggagatccgcaacccgtccctgcgcgagcggctgctggccgtcgacccgggcggggaggaggccgaggaggcgccggtcgccgcgggcgtcgcggtggacggcgcggtgctgggcgcgggcgagctgaagccgtggctcgccgagcacggcacgacggtcctggggctggccacggtcgactcctgggcgctcggcgcgggtgcggtggccgaggtcgcgctcgccgcggccgacggggcggccgcctggttcgacccgtcccagctggacgaggccgacgagaacgcgttcgcgacgtggctcgccgaccccgcgaagcccaaggtgctgcacaacgccaagggtgtgatgcgggtcttcgccgagcacggctggaccgtcgagggcgtgtccatggacaccgcgctcgccgcctacctggtcaagccgggccgccgctccttcgcgctggacgcgctgtccctggagtacctcggccgtgagctggagcccgccgcgacggccgacgggcagctggccttcggcgcggacgagggggccgaggccgacgcgctgatggtgcaggcgcgcgcgatcctcgacctgggcgaggcgttcggcgagcggttgaaggaggtcggctcggccgacctgctccgcgacatggagctgccgacgtccgccctgctggcccggctggagcggcacggcatcgcggcggacaaggcccacctggaggccatggagcagatgttcgcgggcgccgtgcagcaggcggtgaaggaggcgcacgcggccgcgggacacgagttcaacctgggctcgcccaagcagctccaggaagtcctcttcggtgaactgggcctgcccaagacgaagaagacgaagacgggctacacgacggacgcggacgcgctggcgtggctggccgcccagacggacaacgaactgccggtgatcatgctccgtcaccgtgagcaggcgaagctgcgggtgacggtcgagggcctgatcaagacgatcgcggcggacggccgcatccacaccacgttcaaccagacggtggcggcgaccggtcggctgtcgtcgaccgacccgaaccttcagaacatcccggtgcgcaccgacgagggccgcgcgatccgccgcggcttcgtggtcggcgagggcttcgagtcgctgatgaccgcggactacagccagatcgagctgcgtgtgatggcccacctgtccgaggacgagggcctgatcgaggcgttcacctccggagaggacctgcacacgacggtcgcctcccaggtgttcggggtggagcgctcagcggtggacgcggagatgcgccgcaagatcaaggcgatgtcgtacggcctcgcgtacggcctgtcggccttcggtctctcgcagcagctgaacatcgatgcgggcgaggcgcgggcgctgatggacacgtacttcgagcgcttcggaggagtacgcgactatctgcgccgcgcggtcgacgaggcgcgggcgacgggctacacggagacgctgttcggccgccgccgctacctcccggacctgaacagcgacaaccgccagcgccgcgagacggcggagcgcatggcgttgaacgcgccgatccagggcaccgcggcggacatcgtcaagatcgccatgctgaacgtggaccgcgcgctccaggaggcgaacctcaagtcccgcatgctcctccaggtccacgacgaaatcgtcctggagatcgcgccgggcgagcgggcgaagacggaggaactggtccgccgggagatggcgtccgccgtgcagctgagggctccgctggatgtctcggtgggcgacggcggggactgggagtcggcggcgcactagcggaccggggcggggtgcgccgggggtgatccggacgggtgtcgtcgtcccggtaggtgagccgcccgggccgccgaggtgtggccgaggcggccctgggcccggccgacggacgtcgcccggtcccagggccggcttgtgcaggaccctgcgggcgacggtcttttttccgggcagtggccggcagggctggaccggtgcgcaggccacctcggggcggcccgtcccccagccgcccgccgacgtcggtcagcccgccggtgacggtcaggaggcggccgggcggctcggctccttgccggccccgttcccggtacgcgcaccggcaccggcctcgtccccgacgccggcctccgtcccggcgcccgctccaccggccgcggccggacggcgcaccctgatccccaccgcgtacagcagcgtcccgaggaccagcccggcgcccgccccgaagcacagggtcgggatgagttcccacggcttcgccgtcgcgccccagtactcccaccaccgcgacgcccgctgcatcgccgccaccacggcacacccgccgatcaccgcacccgcgacccaccggtccgaaccggacagcaccggcacccccgccggcccgccaaaacccgaacccgaacccgatcccgaaggtgaaggtgaaggtgaaggtgaaggcgtgggcaacggcacccgccgcagcgcgaccaccacgaacaccgcgatcacgaccgccgccaccgccgaactgccgtactggaggaaccagtacagcggaaagcccccggcctcctgccccagcaccggaaacagccgaatcccccaccggtcgtgatgcgtgaacgcgtcccacacgacatgggtcagcgcgcccagcgccgcggacacgtaccaccacagcaccgccgaggcccgcatccgcgcccgcggcaccccgcagcgcagcagcgccgccacccgcccctgccgggcccgcggcagcagcgcgaccagcggttcgcgcagcaccagccaggcaccggccaacgcccaggcgacgagcacgtcgaaggtgaggacaccggtgaacgagtgcgtgaaatcgccgaattccatcgctccggacagcacactcgccgcgtagtaggtcatatcgggagcgaacgagccggcgacgaggaccgtgggcaccagtcgcccgcgtccggtcccgtccccgcgcacgccgggcagcacggccgccgcatgactgagagtgaacggcaagtcggccctccgtggctgtcgtcggccggacacaaccgtccggcgatcacagtcgtccagtatgaggggcgcatgaaaatcgtgcggcgagccacccggctcccgcatccgaccagcgccgcagtcggccggccaccggcaatcgggcaccaacgggtgcccgggcgacacaagttgtcgtagggtcacctgggtcaccgtgccggggagcacggtcgaacgccggtgacaccagcgacacgggcacgcagcaccagcacgtaacaccggcatgtaacaccagagcgaacacgcaggtggtcgtccacgggaggggcttactcaatggcggcgcatttcggcagcaggctgcgcaggggggcgacaaccaccgccgtggcggcggccgcggtcgcggccctggccgcgtcccaggctcctggagtgaccaccgacgaccagggcagacagaccaccggctccgaggccacacccgacgggaacggcgacggctccgccacgggcaacggccgctactacaccgacctcccgccgctcgacagccccaccgcctcgcccagcccgggcaccggctccacgacccccgccggcaccgcggaggcgggcatacccgccaccgtcctcgacgcctacaagaaggccgagacggcactgcgctcgtccaagccgggctgcaacctgccgtggcagctcctcgccgccatcggcaaggtcgagtccgggcaggcccgcggcggccgcgtcgacgcgaacggtacgacgtactcgaagatcctgggccccaagctcgacggcaacggcttcgccctgatcgccgacaccgacaacggcgcgtacgacggcgacagcgcgtacgaccgcgcggtcggccccatgcagttcatcccctccacctgggagtgggcgggccgcgacggcaacggcgacggcgcgaagaaccccaacaacatctacgacgcggccctcgccgccggtcactacctctgccgcttcgaccgtgacctctccgtccagtccgagctgaacaaggccatcctcggctacaacaactcgcaggagtacctgaacaccgtcctgtcgtggctggagtactaccgcaagggcacgcacgaggtgccggacggcacgggcacgctgccctcgcacagcaacgacgacggccagggagcgagccccgcgcccagtccgtcgccgccgaagacgccgaagccgccgaagacgacgaagccgacgaagccgggcacgcccggcgacggcggttccacgagccccagcccgtcgccgccgccgcccagcacccccaagccgccgagccccacgcctcccacccccaccgacacggtggaccacctggaggacgcgggcaccgccaagctcaccgcgacggcgggcgacacgttcgaccagaaggtcgccgtgcgcaccgagaccaaggccggcaaggccgtcgcgaaggtgcgggtgcgattcaccatcgtcggcgacacggacgccacgttcaccggcggcgagaccgtggccacgatcgtcaccaacagcgccggcaaggccaccgcgcccgcgctggtggcaggacagaagaccggcgacttcacggtccgcgccaccgtcgtgggccgctccgtcgcgggcctcgactacacggcgaccgtcaccgaaccccaggccgacgccctcgcccgcaccagcgccaccgagctgacctgtgtgcccggcggcgagttcgcggaccaggtcgaggtgaaggccacgtacaagaacgccgtcgcggacggtgtcgccgccaccgcgacgatcgtcaagtcggccgacgacgcgaccgagaacgacaagggcccgtccttcaaggacgcggacggcaagaccgtacgcaccctcaaggacctcaagacggacgcgaacggcctgctgaagcttccgaagctgtacgcggacgacaccgtcggcacgttcctgctccgcatcgacaccacgggcggcgcgaccctcacggtcgagctgaaggtggccgcggccaccaccacgacgccctagcccgcgtaacccccaagcgcgcccctccgcttcccgcggaggggcgcccttgttgtgtgtgcaacgtgttctcatctcaccccgccgttgctacggtgccggacctgacgacgcatcagctccaggattcccggggaggccccgtatgcgtgccctcatcgccgccgcgatcggtctcgccctggcgctcgggctgatgttggtcgtcacggtcatgggcccaccacccggcgagacgtcgccgaagcccttgctcaccaccgtccccaagcacccgtaaccagccgggagggccgcccagatgcgccgcaaggccagcctgatcctgctcgccctggccgtgttctgcacggctctgtccccgctggtgcgctggtacgccttcccgcgcctggccaagatccccgcgaaccagtaccaggacatggtcctggaggcgaagaacgccaccctcctcgactacggcaccatgaaggcgaagacggtccccaaggtcaccgtcgtgcagaccctcaggggcaacgtggaggcctcacagaagatcgagaagaccgccggcaaggacgtggtcgtctgggacggcctctcctacgtccagggaccggacggcaaaatggtctcccggatccccgagcgctacatcttcgacgcacacacccaggaacccgtccacgccaccggcgagatggtcgacggcgacccggtcacccgcgcgggcctcgagttcaagtggccgttcctcacggagaggcgggactacgagtacttcgacgcccaggcgcgcaccacggcccccatccactacaagggcacgcaggacttccgcggtgtgcgggtctactacttcgagcagaccgtcccctggaccaaggtccccttccccaaggccatgcccgtcaagggcgtcaccccccggtcgctcgcgaagacgggcacgacgcgctggtacaccacggtccggaagttctgggtcgaaccggtgaccggagcaccggtctacggcgaggagatccacaaggaggagctgcgcggcggcacgctcctcggcggccgcgacaaggtcacggccttcgccggccacgtcaagatgcgcgaggactacatcaggtcgacggtcgccctggtcaagtccaaccgcaccgtggtcctgctgatgacctcgtacctgccatggggcctcctgctgctgggcctgctcctgctgaccctgtccctgtggctggaggcccgcggccgccggccggcggacccggcccccaccgaggcctcggcgccggaaccggtcagcgcctgagccgcgcgttcgtgtaccgggtcggctcggccgtggccgggtcctcgggccacgggtgcttggggtagcggccgcgcagctcggcccgtaccgccttgtagccgtcccgccagaacgaggcgaggtcggccgtgacggcggccggccggccggcgggcgacagcagatggacgagcaccggtactccggcgaccctcggggactcgtggcggccgaacatctcctggagcttcacggcgagcacgggctgctccgggttgccgtagtcgatccggatcctggacccgctgggcacctcgatccgctcgggagcgagttcgtcgagccgggccgcgtccccggtcgcccacggcagcagccgggccagtgcctgcccggcgtcgatccgcgccagatcggcccgccgccgggcacggctcagctccggctccagccactcgtccacgcgcgcgtggagcgcgtcgtcggacacgtcgggccagggggcgccgacgtgcaggtgcagaaaggcgagccgccgccgcagcacctcggcgtcagcggaccaccgcaccaggccgagcccttcctcccgcagcccttcgaggagcgcgtcccgtacgagaccggggtcggcgtcacgcagcggccgcaccgccaactccacggcccccagtcgctcgacccgccgcgcgacgacatccccgtcggcccagtggacctcggcgcccgcggaacgcaggggcgccgcggcccgccgcgccgtgtcctcgtcgaccacggcggcgagccgcacgcgcgcgtgccccgcgccgacgggacggtcggcgaccgccacggcgagccagggggcgccgcgcagcgcggagccgtcgccgatgtcggcgcgggtcccgctgaccatgaggcaggagccgccctgtgcccgcgcgagccgctccgggaaggcgagggcggccacgagcccggcgatccgatcgtcccccgagcccgctcgcccggccgccccggatccggtgggctcggacccggtggggccgggcgccgagccctgcccacccgtcccggccggagccccggcgtcccgctctcgcggagcggagtcacggtcacgggcgggcgggcgcgcacgatctgtcgccccggcccgcagccgccgcgcctccgcacgccagcgccccgcgtacgcgtcgcccccacgccgggcagcccgccaggccgccgccaggtcgtcgccgtactcccgcggcggctcctcgctcagcagcgcgaccacctccgcggcccggtccgcgccgacctccggcgccgcgtccagcagagcccgcgccagtcgcgggtgcaggccgagccgggacatgcgcacccctcgctccgtggcccgccccgcggaatccaccgcaccgatcgcggcgagaacggaccgcgccgccgccatcgccccgcccggcggcgcgtccagcagggcgagcccggacgcctccggatcgccccagcacgccgcctgcaacgcgaacgccgtcaggtcggccaccttgatctcgggggaggggaagcgcggcagacgggcgtcctccgcctccgcccagcagcggtacaccgtccccggcgcctcgcgcccggcccggcccgcccgctgccgccccgccgcctgcgaggcccgtaccgtcgtcagggcgctcagcccgcgcgcgtgatccacacgtggctcccgcgccagtccgcagtccacgacgacccgcacacccggcaccgtcagcgaggactcggccacggacgtcgcgaggaccacccggcgccccgcaccgggagacagcaccgcgtcctgtaccgccgccggcgcccgcccgtgcacctggagcacctcgaccccgtccaggtcccccagctgccccgccacgcgcgcgatctccccgaccccgggaaggaagcagaggacatccccctcgcgttccgcgagcgcccgccgcaccaccgatgccacatgcgtcagcagtacggggtccacccgcatcccgtgcggcggccggacgggccgcaccggaggcgtccacacgacctccaccgggtacgacacacccgccgcctcgaccaccggcgccccgccgagcagccgggcccaccccgcggcgtcggtcgtcgccgaggccgccaccagccgcagctcgggccgcagcgcctcccgcacgtccaggaggaaggccgccgccgtgtccgcgtccagatgacgctcgtggcactcgtcgagcaccaccacgtcgacgcccgccaactcctgatcccgctgaagtcgttgcagcagcacaccggtcgtgacgacctccacgcgcgtgtggcgccccaccacgcgctccccgcgcacggtgtagccgacgctgtcgccggccttctcgccgagcagccacgccatccggcgcgccgcggcccgggcggcgatgcgccgcggctccgcgacgacgacacggcgtaccggccccttcgcggccccctccccgagcagaccggccagggccagcggcacgagcgtggtcttgcccgtcccgggcggcgccacgaggaccgcggcgcctcccgcgtccagggcgtcgttcaggccgggcagcgcgctgcgtaccggcaggtccagggcgtcgtagcggatcacccgctcagtctcgtacgcacacgaagatcgccgtgcccgggatcaggttcccgcgcagcggggaccagccgccccactcctgggtgttccaggcgggccactccggctcgaccacatcgagcagccggaagccgcccgccaccacgtcgcgcacccggtcgccgatcgtccggtggtgctcgacgtagaccgccccgccctcctcgtcctgctccacgtacggcgtgcggtcgaagtaggaggcggagaccgacaggccctcgggcccgggctcgtcggggaaggcccagcggatcgggtgcgtcacggagaagacgaagcggccgcccgggcgcagcacccggtggacctcgcgcaggacgcgcaccgggtcggcgacgaagggcagcgcgccgtacgccgagcaggcgaggtcgaaggaagcgtccgcgaacggcagggcgcccgcgtcggcctccaccagaggcacgtccccgccgatgcgcagcgcgtgctggagctggcggtgggagaggtccagggccaccgggcgcgcgccctggccggccagccagcgcgagcactgggccgcgccggcgccgatctccaggacgtccttgcccttgaggtcctccgccgggccgagcagctcggcctccacttcgtcgagcccctcggggcaccacacgaaccggtcgtcgccgaggaacgtgccgtgctcgacctggtagtcgtccgcgttccggtcccaccagccacggttggcgcgggaactctccgtggcgccggcgtcacgtcgggtggcttcgggttcgaacgtatcgggctcttggatgatcggctccctcgtattagtctgcgggcacttccgtcgaacccgttccggtggtgtcacggaaggggtcctgcggccctgtgtggcctcggaagacagttcttgtgccgggtatgcggtgttctgccccgggtgtgcggcttcgcgcattgaccctgcccggctgcccccgtatgctacaagttgcgctgcgggcctgcgctcctcagacgtagcaggctgcgctcgcatctgtatgtatgtcccctcggttgtcgaggcgctcaccggaacactggtggcgcttccttggctgtccggccttctgcagagcgaaacgggctcccggcgtaagcagtacctacgactcactgtccgtaccggagccctttcccacatgacgagcagcaccgagaccacctctaccactccgcaggtagcggtcaacgatatcggtaacgaggaagccttcctcgccgcgatcgacgagacgatcaagtacttcaacgacggcgacatcgtcgacggcgtcatcgtgaaggtcgaccgggacgaggtcctgctcgacatcggttacaagaccgaaggtgtcatcccgagccgcgagctctcgatcaagcacgacgtcgacccgaacgaggtcgtcaaggtcggcgacgagatcgaagcccttgttctccagaaggaggacaaggaaggccgcctgatcctctcgaagaagcgcgcccagtacgagcgcgcctggggcaccatcgagaagatcaaggaagaggacggcatcgtcaccggcaccgtcatcgaggtggtcaagggtggtctcatcctcgacatcggcctccgtggcttcctgccggcttccctcgtcgagatgcgccgcgtccgcgacctccagccctacgtgggcaaggagctcgaggcgaagatcatcgagctggacaagaaccgcaacaacgtggtcctgtcccgccgcgcctggctcgagcagacccagtccgaggttcgccagacgttcctcacgaccctccagaagggtcaggtccgctccggcgtcgtctcctcgatcgtcaacttcggtgccttcgtggacctgggtggcgtcgacggtctggtccacgtctccgagctttcctggaagcacatcgaccacccgtccgaggttgtcgaggtcggccaggaagtcaccgtcgaggtcctcgacgtcgacatggaccgcgagcgtgtctccctgtcgctgaaggcgacgcaggaagacccgtggcagcagttcgcccgcacgcaccagatcggtcaggtcgtgcccggcaaggtcacgaagctggttccgttcggtgcgttcgtccgcgtggacgagggcatcgagggtctggtccacatctccgagctggccgagcgccacgtggagatcccggagcaggtcgtccaggtcaacgacgagatcttcgtcaaggtcatcgacatcgacctcgagcgccgtcgcatcagcctctcgctgaagcaggccaacgaggccttcggtggcgacccggcttcggtcgagttcgacccgaccctgtacggcatggccgcgtcgtacgacgaccagggcaactacatctaccccgagggcttcgaccccgagaccaacgactggctcgagggcttcgagtcccagcgtgaggtgtgggagacccagtacgccgaggcgcagcagcgcttcgagcagcaccaggcgcaggtcatcaagtcccgcgaggccgacgctcaggccgaggccgagggtgctgccgctcccgccgccggcggttccggcgcgggtgtctcgggtggttcgtactcctcggagtcggacgacaactccggcgccctggcgtcggacgaggccctggctgccctccgcgagaagctcgccggcggccagagctgatcacagctcaccgctaggcagtagttcgtgactgcgggcccgcacccatctgggtgcgggcccgcagtgcgttttccgaggcccgggcagcccggcgcgaacagcccttccgtgccctcggagcaggcgacttcacgctcaccggacacggcgccgccaagggcccgcccgcgttccgcagtggatggccaccctcgaccacttccgtgaactcggcgttcccgtcgaggtgttcaccaaagaggcgccggtgcggggcgggagcgggaatgcccgcgccccggacggcgttgtggcctaggaacacgaggaggagcggtcactgtgcttgatccgcagggtttgtacgcctgggagccgaagggcctggcagtcgtcgacatggcgctggcccaggagtcggccggtcttgtcatgctctaccacttcgacggatacatcgacgcgggcgagaccggcgaccagatcgtcgaccggcttctcgactcgctgccccaccaggtcgtggcccgtttcgaccacgaccggctggtggactaccgtgcccggcgtccgctgctcaccttcaagcgtgaccgctggaccgaatacgaggagcccacgctcgacgtacggctggtccaggacaccaccggtgcccccttcctgctgctgtccggtcccgagccggatgtcgagtgggagcgcttcgcggcggccgtccagcagatcgtggagcggctcggcgtccgcctgtccgtgaacttccacggcattccgatgggcgtcccgcacacccgccccgtcggcctcaccccgcacggcaaccgcaacgacctggtgcccggccaccgcagccccttcgaggaggcgcaggtccccggcagcgccgagtccctcgtcgagtaccgcctcatggaggccggacacgacgtcctgggagtcgccgcgcacgtgccgcactacatcgcccgttctccgtatccggacgccgcgctgaccgtcctggaggccatcacggccgctacgggactggtcctgccgggcctcgcgcactccctgcgcacggaggcgcaccgcacgcagacggagatcgaccggcagatccaggagggcgacgaggaactggtcgccctcgtgcagggtctcgagcaccagtacgacgcggcggcgggcgccgagacccgggggaacatgctggccgagcccgtcgagatcccgtccgcggacgagatcgggcaggagttcgagcggttcctggcggagcgggaaggcgagggctgagcgagcctcgggcctgccgaggggcctgtcagtggcaagccctaggctggtgggcatgctgaaggtgggcctgaccggcggtatcggcgccggcaagagcgaggtgtcgcggctgctcgtcgagcacggagccgtgctgatcgacgcggaccgcatcgcgcgtgaggtcgtcgcgcccggaactcccgggctcgccgcggtcgtcgaggccttcgggacggacgtactcgcgccggacggcagtctggaccgcccgaagctgggctccatcgtcttcgccgacccggacaagctcgccgtgctgaacgcgatcgtgcaccccttggtgggcgcccgctcccgcgaactggaaacggccgccgccgcggatgccgtagtgatccacgacgtcccgctcctcgccgagaacggcctcgcgccgctgtacgacctcgtggtcgtcgtcgacgcgagccccgagacccagctcgaccggctcgtccggctgcgcggcatgaccgagcaggacgcacgcgcgcgcatggccgcccaggcgacgcgcgagaagcgcctggccatcgccgacatcgtcatggacaacgacgtacccctggaggagctggagcggcgcgtgggggacgtatgggcagatctcgtgcacagggcgcaccagccaggggagtcacaggaatagcggtcgccgccgggggcgttgaaccggtgcagtgagggaaggactcagccgtgcccgagaccagcggttggaccggacgtactccggagacgcatgtcatcgacttccgcgccgccgagcagttgctcgccgcgcgcgacccgcggggcgcggtgaagctgctcgatccggtgatagccgcgcaccccgagaacacggccgcacggctgctgcgcgcgcgtgccttcttcgccgccgcgcaactgcgtcccgccgagctcgagttcaccatcgtgctggagcgcgagccggacaacgcgttcgcgcacttcgcgctcgcccgcacctatgagcgccagctgcggccggatcaggccaagaggcacttccgcctcgcggcggcgctcgacccgaacccgcagtacttgaaggcggcacgcttcgactcgtaggcggccggggttcctggggactggggctgtccggcgggtcagggcctaggggtggcggtgttccggcggtcggtacggtgggacgtcgcggcccggctgccagtgcggcccctggtggatgtgccgcaggatcatggtcatgtccgcggtgacgatcagccacaggacaccgcaggcggccgcccatccgggcctcccggcgagggcgaacgcggccgttccggcgatcgcccagatcaggccccacacgctcagccagaagcgcagccgcagggcactgcgcgctgtcgtcggttcactgcctgtacgcatcgggaccaccgctcctcctacgaaaagtactcttcgtggtgcacgttcaccatgggacggtggacggatccacgggggaggcgacgatgctgctggatgcgctgcgggcggacgcgaggctcgccgagtggctgcgggacctggagagcgagggcgatccgcgggtggaggtcgcgctgcccggcgcggacgaactcccggacgtactgctggacctgtccgtgccgcacgaggacatcaacgagttcgtcgcgctgcgcgcccggctggcggacgacgcggaggcgatgaccctcctcgcccggtgtgtcgcccgcttcgtacgggacatgggggagatcgggaagggctgggagccgccgccgttcccgacgtcgacgggggacctcggacgctgcttccctctgtacgtcttcgtcggcgcgctgccgcacgtacgcgcgtaccaccaccggcgcggggtcccggccgaggtgtcccggcgcacgctcgccgatctggggcggcatgtggcggtgcaccgtcggcggctcggcacgggcgggctgctgttcccgtggtggatcgcgctccccttccacggggagttgttccagctgggccggctgcagttccagcgcgcgcggctggggcagcgcacggggcgggccgtcgcgggggccggcctgggcctggggccgggcgacccctgtctgagcctgcacatacccgacttccgcggaccgctgtcgccgtccgcctgtgagcggtcgctggcgctggcacgggagttcttcgcccgccactatcccgacgagcggtacgaggtggccgtgtgccactcctggctcctcgacccgcagctgaagcggtacctgtcggcggagtccaacatcgtccgcttccaggagcgcttcgagatcgcgtacgcgcagacggcgccggaggacggggtgccggtcgggttcgtcttcggcgatccggagctgccggtggcggacctgccgcggcggaacagcgtggagcgggcgatcggggaccacttgcgggcgggcggccactggtacggcgggcatgggtgggctccgctgtagctgtcaccctatcgagtgacccggtcggggaacgggcgtgcgggcgcggtccgttggacgggtatgaggctggaaatgcgtgagggatacgagggaacgggacccggggcgatcaccccggacggctgcgcggtcgagctctactcgcggctgcccgtcggggaggaaccggacatcatcgccgcggcagtgcccacgggggcccgcattctggaactgggcagcggggtgggccgcatgacccatccgctcctggatcgcgggttcgaggtcacggccgtggacgagtcgtcggagatgctggcgcgcgtccgtggggcgcgcacgatatgcagcccgatcgagggactcgacctgggtgagacgttcgacgtggtgatgctcgcgtcgttcctcgtccacgcgggcgacgtcgaggtgcggcgggggatgctgcgggcgtgcgcgcggcatgtcgcggagggcgggtgcgtgctgatccagcgcgaaggggaggactatcactcgaatgtgccccgtgagcgggtcgatcccagcggcttcacgctacggatcctgtcggcggagccggcgggtgacggggtcaactcggtcagcgcggagtacgtgttcccggacgcgacgtggacccatacgttcctggcgcggccgctgaccaaggagcagttcgaggaggcgctcgccgaggcggggctgagggtggaccggtatctgacggaggacggcgtgtgggtgagggcggtgccggctgaggagtaaaccgcacccgtggaggagaagaccgcacccgtggaggaggaaaccgcataggaaagtgcggtgcgcggcgatgagttgcgggcgtcggcccggtctacctctgtgacagcgatacggaactgcttcacagaggagacccccatgtcccagaccaccgctcccgtcacccgcgccgcctcggctgcctccgcctccggtggcacccgcagtcgtcgtgccgagatttccctgcgtgcgcttcagatcgtgctcgcgctcttctacggggtggcgagcgcgctgccgaagctgatcgcgcacccctcggccgtcgagtccttcgacaagatcggctggggcagcgcggggatgtacaccatcggcgcgctcgaactggccggagctgtcgcactgttgataccggcgctcatgtcggtggcggcggtggcactcagtgcgctgatggtgggtgcgttcatcacgcagctcaccgtcttcgacgggcagtacgcagcgacaccgctgatcctgatcgtgccgctcgccctgatcgcgtgggcgcgccggaaggggacggcggacgggctggggcggctggtgcggctggtgcgacgaggggcgtgaccttgggcgacggacggcgcggaaggctccccgctgctggtggggagccctcgacctgtgagggcttgcttcgggtttgcttgcgttgggtttgcctgcggcgggattggttgcgccgggtttgctgctcagcgctcgcgagggtgcccgggtgcacctcggcttcccggggcagcctggatttcgggtcagtccggccttccggggccacccggtcttcgggtctgccctgcattcagggtcagccgcgtgtcccgggtcagcctcgtgtcctgggtccgctctgctttccggagctgctccgctttccagagctgctctgcttttcggagctgctctgctttccgggcctgttctgctttccgggatcgtccggggccgcggtcccgccgtgttccccgtccggcgggtcgccgaagcccctgaggcgttccagttcgcggcggtcccgtttggtggggcggcccgtgccgcggtcgcggatgccgatcggggcgacggcctcgcggggcgggggcggcgggctgttgtcgacgtagcactcgaccgcgaccggcgcgccgacccgtttgcggatcacgcgcttcacgacgaggatccgctcccggcccgcgtgccgcagccgtacctcgtcgccgacccgtaccgcgtacgcgggcttgacgcgttcgccgttcacccggacgtgcccgccccggcaggcggtggcgcccatcgagcgggtcttgacgagacggacggaccagatccaactgtcgatgcgcacggtctcgccgttcgccggcccggccgcgtcggcggccaccgttgcgtccgtgtccaactcgtccgtggccgccgcgcccgtgtccaccgcgtccgcgcccaccgtctcctcatccgcactctcggaagccatgcctcgactttaggccctgccgtcaggcgagggcggtcgcccggaaactccgtcgcacggttcaccccggacgcggccgcccccgagagggcggcgatcagctggtcgtaccgtgggggtatggagggcacggagggcagggacagcagcttggcggagggcggccgcctggcggagggcagcagcctgagtgacctggacgagcacatcacggggtgccgtgcctgcccgcggctggtcgagtggcgcgaagaggtggcccgtaccaagcgcgccgctttcgccgactggacgtactggggacgtccggtcccgggtttcgggcccgtggacgcctcgctcctcgtcgtcgggctcgcacccgccgcgcacggggccaaccggaccgggcggatgttcaccggggacaggtcgggggacgttctgtacgcggcactgcacgacgtgggtctcgcctcgcgggccaccgccgtgtccgccgatgacggccttgagctgtacggggtgcggatcacctcgcccgtgcactgcgcgccgcccgccaacaagccgacgccggaggagcgggacacctgtcggccctggctggtgcgtgaactcgagctgctgcggccgacgttgcgggccgtcgtggtgctcggcgccttcggctggcaggccgcgctgcccgccctcgccgaggcggggtgggcggtgccacggccccggccggccttcgcgcacggggtgcgggtgacgctccggccctcagcagggccgcccgccaagtcgctcgacgtcctcgggtgtttccacgtcagccagcgcaacaccttcaccggacggctgacgcccgccatgctgcgggacgtgctgcgtacggcggcggaggcggcggggctgccgacactgccggatgcggggcagtacgcctaacggcgggcccgggaccgttctcccgccgacgatacgaactggagttccagcgtggctgggggaggggcgatgcccgggccccccgcctcggcccagcgcactatctcgtccgtgcagtcgtcgcccatcgaccagccgatccaggttgcccggccgccgcgtctgcggccctccccggagggctgtacgacgatgatgttcgcctggtcgcagggcccgaggcagtccgtcgtgcggaccgtgatccgcccgccggaggccgcggccgccgcccgcaggcgctccagttgccagtcgtggtcgtagccggggtacttgcgcgggtcaccgcagcagcagccgcggcagacgacgagcgtgcagggacgggtccgggcggcgccgattgccgtacgggtggtcacagttctcccttgttgccggccgcaccgaagaggtgacggaccgtcgagcggtggttggcccggacgtgggacagggcgtgcgcgggcgcgatccgggtcgcatgaagtcatcttcgccgactcgggtccgggtccgggccggcgctggttacgccgactcgggtccgggtccgggtccgggctcggaggcagacgcggactctgctccgggctccggaaccaccgcggtcgccgtgatctccacgagctggcccgtgtacccaagacaggccacgccgatcagggtcgaggagtgcggcccgatactgagccccgatgcctcgacgacgtcccagaccgcggagagcacggcaggctcgccgctgacgacatacacgtccgtcgaaacgacatgcgccaggtcgctgccgaccgcgcgcagttgctcggcgaggttggcgagcacctgcgcggcctggcgtacggggtcgccctcgccgacgatcttgccgtcggcgtcgagcggcacggacccggcgaggaaggccaggcgggtccccgcctcgacgacggaggcgtgggagtagacggggggcgggcagagggtggggacggtgacgcggttgatcacggggtctccagggattcgggcgggccgacggttgagggacaacctgccggcggagggacaacctgccgagcatgcgcgacgtggggaggcgggcgcattcgaatttgcggagcgaagtgccaccacgccatcctcatcccatgcgcaccacgtacctgggacgtttcaccggggcggacttctagcgggccacgccggaagtcccggcgggccctcggaggtctgccatgtcacgcaccgtccatcacgtccccacgagacaccgcacccgccccgcctactggcccaccggtacggcgggcccgtgcaccgcgcacgccctcaccgaccaccgctacagccgccaggagctggcccgagcccgccgcgcgggccgtcgccccgtaccgacgcgtgtcgaccgttccttcgccgcctacgtgtttccgcgtgccctgggtgcccacttctggagcccgtacgagtccgccgcccgtgctgacctgcgcactttccgcacggccgcctgcaagctcctccgtgccgcaccgccgggcgccctcctcgcggcggccgaggacctggaccatccgccgacccgccaccgccaccgcgacctgtggtgactgacgtaccgcccccgcgggccacggcaggcgcccgcaacgcgacgagggagcccggcggacgcggccgcccggcctgggctggaaccgcgcatagaggctgaacggctgcttggtgccgtccaggtccgtgaagtcgcagagtccgagctggtgcgggtgccgctctcgggtacggcccggccctcacggcccgggccggctccggggcgccaggagtcggctgcggcgttgaggtgcaggagctcttcgcgtacagaaggtacggccatgctccgtacccccgctttcgattctgcctgatcagggcgcgagggccggacacgcgccactcgatgcccatccggaacctcggaccgtggaggtgcggctacgaggaaccggacattccgggatcaagaacccgccacacgggaacgccacgttcgcatcggatctcttgcttcgcaggctgaacacgaccactcagctcgtaatcagggggttccatgcgcatcgcgcaccacagatacgtcgtcgtcgcggccacagccgcggcgattctcgcactcgccgacataccggccgaggcccagaccggtccggccgccgctgccctgccgtcctcggtgagtgccgacaccacgggacttgccgggctcgccgagagctacctgcagcagcgggccgacatgctgacgacatctcctcccacggcgaaagccgccatcgcccatgtccgggccacgcgttccatggccgcccagacgcaggacgaccttgccgcgctcgcggagaagggcaagcggtacaaggaggtcgacggcggctatacgcgggcgcaggtcgacgtgaaagtcgacgacacgaccgtcgacggcgggacggcgacgcttcagctgaccgaacacacccgcctccggctgccgttcacgccgcaggaggtcgaggaaggcgcgccggagttcgaggaactctcgctcccgcacaccgtgaagttcacccagggatccgacagcgcgtggctgctgtcgtcggacaaggccgacaccgcgggcgggccgaccccgacgacacaggtgtccgacacggacgccgaggccaccaccgacgatgggggcggcgcaccggacgaggacgagggcggcaaggacgacgcggccgacaccaccccgctgcccgacagcggcgcgtccgacaccgtcaagccgggggtctcggccgcctacagctacaacaagatggtggcctacgccgacaggtactgggaccaccacaacggcgcgtaccggacctacggcaacgactgcaccaacttcatctcccaggcgatgctggccggcggttggggtcccaagggcggcgccctcatccagcggaccagcaacaagtactggttctacgggccgacgaagtggaccacgagctacacctgggcgggcgccgagaactggtactggttcgcgaagaagcacgcgaagaggaccaagatcctgggcaacgtgtggcaactggccaagtcggacgtgctccaggcggactggacccgcaacaacaacatcgaccactcgatgatcgtcacgaagaagtaccggggcacgccatacctgacctaccacaccggcgacacccacaacaaaagcctcagcaagctcctgtccgaccaccctcgtgcctggtggtacgcgcaccgcacctgacaggctgccaccccccacaggagaacccgcagatgaacaaggagcgcgctgtggaacgtcgacgtctcttggccgtgctggccgccctggccgtcgccaccggctgctcgacccatgatgacaaggccgagccctcccgttcggcatcctccgacggggcacgccacgccgtcgaggcctacgtggacgccctcaactcccgcagtgccaccggcctgatcaaggtcggcggcgtcaaggacgagagctggtcgcgacaggaggccgcgcggatgctggcggacaggggcgggcgggagtggaagatcaaggatgtccggatcgaccacgacatgggtcctgacaccggatcggcccgcctcctcgccaaggacaaggcgggcaagtccctgcgtgacaccttcaccgtgacacgcgagaagggggtgtggcatctggccgtcttcacccaccagccggacgggaaggggaaggagtcctcctcgaccgacaagcccgcttcctgacaccacggaagcagcctccccgcgccgcgttcagggcgcgcccgcaggcgtagggaggcgtagctcggcccatacggtcttgccgggtgtggcgaggcggaggtggaagtcgcggccggggacgtggccgtgccggacggcgttcgcggtgagccctgccgcgatcagggtgacggtctcgttggcggctgacgtgtacggggtggccccactcgttcaggcggtgcgagatgagacgacgggcgagtcgtgcgccgcacggggtcgaagtgaaccgcatggcgaactcgtctacgaccactgggcgttgcggcatatgcctgtgtgtgggggggaattaccggcttcatggggagaacggccccggcccgtccgtagctttgaacaggcgtgacgcgctgaccggtgccggttgtacgcggctggagtgcggtgtacacgcggtgaggcgtgaccggccttccgtgcggcgtgttggtcgcgggagcggtggatgttgcggttgcggggtgttcggtggcggcggtggaacgtacgggacgttcgtgactcgaaggatgagcgggcctcatagtgagccttacggcgaacgcccggaccgacttcgtcgggtttgccgcccggcgacggcgacccgcgtaagccaggcgcgactttgccgtgccccgtgaccttccgcgagcggttacggggcactggtacggggcctcgattgcgttcataaagaaaccggcatcccggccaaccgtcacttccccgaaatccccgcgccccactctcgctggatctcccctctaccgtgggcaccacatcccggccgacgtcgcccgagagcacacccccgccctcgcccgtcaggagccctgtgacccgcctcagtgccgccgtaccgccctggctcgctcatgccctgcgtgcccagcgggggccgatcccctggagtgcggtcctgcgtggggcgctggccggcgggcccctcctgctcgcggccgtgctgagcgggcgcagctccataggtgtcgtcgcagcgctcggcgccatgctcgccgggatcaacgaccgccccggcagccggcggacctccgtcaaacggctcggtgtgcccgccctcgcaggtgccgccggactgctcgtcggctcgtacgccggtcagcacgcctcggccgccccgctgaccctcctcctcacctgcctcgggttcttcgccggcgccgtcagcgccatcgggcccgtcgcctccggggccgggacgcagctcctcgtcgcctccgccatcggggccggcatgccgctgcccgagcccggctggcagcgcgccctcttcttcctcgccggggccgggtggctgctcgccctgcggctcgtgctgcccacgcccggggccacctccggcgactaccgcttcgacggggaacggaccgccgtcgccgccgtctacgacgctgtcgcacagttgctcgacgccgtgggcgcggtcgacgcgggcacccgtcgcgccgggctcaccgccgccctcgaccacgcggaggacgccctcgccgggccccggctgcgccgccgcgccggctccgcgaccgagcggcgcctgcacgcccagtacgccgtcgcactgcccctcgccgaagccgcgaccgcgctcgcctgggcgggggacgcggtgcccgcgcgggccgccgaagggccgcgccggctcgccgccgccgtgcgcgacagcacccacaccggaccgctgccggcacccgcccgctccgcacccgcgctgcgcgccctcgacgacgccctcctgcacgccgccgaggccttcgaccggggcgccggaggcaacctgcacacccggcgccgtaccgccgcatccctggtccgcaccgcactcgactccggcgggcgcgagtacggcctccgggtcgccctctccttcggcgccggcgtcgccgtcgcgcaggccctgaaccacgcgcgctggtacgggctccacacccactggtactggctgcccgccaccgccgtcttcctggtcaagcccgacctgggaccgctcgcgtcgcgcgtactgtgccgggcggcggggaccgtcctgggcgccgtcctcttcgccggactggccgccctgctgccgcggcccgagggcctggtcgccctggtggtgatcagcggtgcgctcatccccgtggccacccggcacttcgccgcgcagaccgccgtcgtcaccgttctcgtcctcgccctcgtcatggtgggcggggagccgcaggcctcctggaaccggatcggtgagaccgcgctggcctgcgcgatcgtgctgctcgtggggcatctgcccacgccggggcagcgtggcggtggcgtacgggcccggctcgcgcgcgcccacgacgccgcgcacgcgtacctcgcccacgtcctgagcggctccggcgaccgcaccggccgctgggtgctgcgccgcgaggcctatcgggcgctcgccgaggcccgcgccgccatcgacctcgccgcggccgaactcccggccctggcgcggcacacggagggcacggaggaggtcgcggccgtcctcgaacggctggtggacacgacgaccgcctgcgccgtgcacctcgacgacgcggggcggctgcccgcccggcaccgtgagcggatcgccgagttgctcgccgaactcacggacgcccacgaacacgcgggcctagacacacccgaggcgccccgcctgcccgtcgccgtctgagtctcgaggacggcgcggacagcggacggcggtcggcgctcggaggacgccctcggggcggggcgactccttctgccgtggcgcgcccggcggtccgcggaccggacggcgcacgaggacgacccgcggcgactgacggcacgtcaagtttcggaccaccggctcagcttgtgaccgagcacgccggagtcacggcacgcggatccgggagtacggcacctgatcccctctgcataggctgaatcccatggatcccgccgaaggcctcctcgccgacccctacgccgtctacgaccggctgcgcgacaccgcccccgtacaccgcatcgccggcaccgacggcaagcccgcctggctggtcacgcggtacgacgacgtacgtgaaggactcgcgaacccgctgctctcgctcgacaagaagcacgcgctgcccgggaattaccgcggactcgcgctcccgcccgccctggacgcgaacctgctcaacatggacgcgccggaccacacccgcatccggcgcctggtcggccgggccttcaccctgcgtcgcgtcgaacaactccgcgagcccgtacgggagaccgcccaccggcttctcgacgcactcgggacgcacggcagcaccgacctcatcgcctcgtacgccgcgcccctgccgatcaccgtcatctgcgacctgctcggcgtgccggacgaacaccggcgggacttccgggcctggaccgacccgctcgtcaccccggacccggcccgcccggacgtcgccagggaatccgtcgtctcgttgctcggcttcttcaccgggctcctcgccgacaagcgcaagaaccccgcggacgacctgctctccgacctcatcgccgtgcaggaagagggggaccggctcaccgaggacgagctgatgtccctcgccttcctcatcctcttcgccggctacgagaacaccgtgcacctcatcgggaacgccgtactggcgctgctgcgccatccggagcagctcgccgcgctccgcgaggacccggcacggctgccggacgccgtcggggagttcgcccgctacgaagggcccgccctgctcgccatccgccgcttcccggtgcgggacgtgacgatcggcggggtcaccgtgcccgcgggggagaccgtgctgctgtcgctgtccgccgccaaccgtgacccgagccggttccccgaccccgaccgcctcgatctcggccgcgacgccgcaggccacctcgcgctcggccacggcgtccactactgcctgggcgcgccgctggcccggctggagacggaggtcgccctcgccgcgctcctcgaacggttcccggacctcgccctcgcggaaaccgaaccgcgccgacggccctcgctgcgcgcccgcggcctgctcgcgcttccggtgacgtactgactccgtggctccgtggctccgtggctccgtggctccgtggctccgtagctccgtgatcccgtgactctggggctccgtgatcccgtgacctggtgaagggccagggctggtgacatggagcgggagaggggcgagagacccctcacagtgaatccgtgaagaagtgtcggctacgtctcagtacggtcactcagcgagccgttcacgccatgtcgggcgtttaactctacgagtacagcgcgacatggaggtgcagggtgaacgggcgaacggtgctggagcgctttcccgccggtggaccccgcgggtcgtggcccgcggaggagttcgcacaggcgtgccgcctggagggccaggccgcggaggtcgtcatggacctctccacggacgcgtttctggtgatcgtcaggggcgcggaccgcatcgagtgaggtcgaccccggctttccccctcagcccgccgccacgagccgggcaggggccacttacgggttcacgcgctgatcggccgcgaccacgccggaatcgtgtccatgacccggcacaaggccaggtagagggggatcggcggggtgtaaggaaggatgccgtccggccggtggacgagcgcggggacgcaaggcgtgaccgggaccaccgcaccggtggcgtagtgcgcgggcgccggccattccagcgcgacgtcggagtcggcgggcacgatccaccaccagtacgcgctgtcggcgtacacacagcccacccgcggcaggcgcggcatcagcagcggtcccaggtgcgcgggcacggccaccgcgtcgcagcccagcggcagcgtcatgccctcgggtatggggagtcgaccggacgacgcggggccctgctgtccgcgcctgaggcggaccaaggtgtccaggttcaggacctgggcggcccctgacccactcgccgacgtgtccctcacacccatccggcctccgctccccaggacgcctccgccccggttccccggctttcggccggcgtcttcttcgcactccaccccaggtccgacctggcctcggtgttctccgccggggagcgggaggcgtcgtcggaatcggccgcgagacagtacgaagcggccgtcgtagagcgggacctgtcgccggaacgcgacaggtcccgtggagccgggggtgccgcccggcggggcagatccgcccagaccagcagccccggccccgtctccagggcaccccatgccctgcacagagacgcgatgaggagcaaccccctcccgtgctcctcctcgggtcgctgtggcgagggatgcggctcccccggcgcacacccctcgtcgcgtacggctatgcgcacgagctcgtcaccgtcgtgcagctcgcacacgacgtgttcgctcgcggtgtggacgatcgcgttggtgaccagctcggagacgaccagggcggccgagtcacaggtgtcctcgcagacttgccagcgggtcagccgagcacgcgtcagacgccgggcctgggccacggatcccgggtgtgcggccagctcgaagcggaaccggcgctcggcggccgcgtgggggcgcaccccagcggcgtcgcggagaccggatcggtcttcggcggcgtctgttcctaacggcgcggacggagtcacgcttgccactatcgcccccgccgcgaacacttggcaagagtcactctgaaaattgcagagtgcagtgtgactccgagaaggggcgtggcacactgctcgcaacagcacgccgagttgcgccagttgggactggaaagggctttcgggtaaagccgcccgggctgtcaggactaggtggaggtgctaggtgagcgaaccgcggtccgcgccgacggtcggccaggtcgtcctcggccggcgcctgctggacctgcgggaacgcgcgggtctcaagcgcgaggaggccgcgcgcatcctgcgtgtcgcgcccgccaccgtccgccggatggagatggccgaggtctccctcaagatcccgtacctccaactgctcctgaaggcgtacggagtgggcgaggaggaggccgaggccttcgtactgctggccgaagaggccaacaaacccggctggtggcagcggttccacgacatcctgcccggctggttctcgatgcacgtcagcctggagggcgcggcggccctgatccgctcgtacgaaccccacttcgtgcccggactgatgcagaccgaggaatacgcccgtgtcgttctgaaatcgggggccatcggccagaccaggcccgaggacgtcgaccgctatgtggcgctgcgcatgcagcgccaggagctgctgacacgtgaggacgcgccccggatctgggccgtgatggacgagaccgccctgcgtcgccccgtcggcggccccgaggtgatgcgggcccagatcgacaagctgctcgaggtcacgaagctggcccatgtgacgctccaggtgatcccgttctcctcgggaccgcaccccggcacgtacgggcccttcgtactgttccgatttgccatgccggaactgccggacatggtctacagcgagtacctgaccggtgccgtctacctggacgcgcgagccgaggtggcaacccacctcgaggtcatggaccgcatggcggcgcaggccgctacggcacatcgcacgaaggagatcctgatggatctccgcaaggagctgtgaatggaacgcgccaagccgcgcatacgcaacgagcgcccgtacagcgagcgcatctccagcgagcggatctacaacggcatgcccgcccgtgagctgggaagcgagggctggcacaagccgtggagcggaggcaacggcggcaactgcctggaggcgatgaagctcgccgacggccggatcgccgtacgccagtccaccgacccggacgggcccgccctgatctacaccccggacgagatgacggcgttcatccagggggcgaaggcgggtgaggcggacttccttctctcgtaaggctcttgagaccgctcaccgggtctccgagacttgttgctcagcgcacttcgctacttttcagtccactgcttcagtccgccgcttcactccacggcttcactccacggcttcactccacggcttcatccattgcttcacttcaccgcttcacttcactggttcagttcgctgcgtccacttcatcaccttggcgttcagttgatcactaactgtcttagacacttacggagttcgtcatgaccgggcagaaccccgcaccggacgagatcgtcatcgacaccggcaatccgcaccccgcacgcatgtacgactggttcctcggcggcaaggacaactaccccgtcgacgaggagatgggccgacaactgctcgccctggacccccgggtcccggtgatggcaaaggtcaaccgcgcgttcatgcaccgcgccacgcgctggctggccatgaacggcgtacgccagttcctggacatcggcaccgggatacccaccgagcccaacctccaccagatcgcgcagcaggtcgcgcccgagtcgcgcgtcgtctactgcgacaacgacccgatcgtgctggcacacgcggcagccctgctgcgcagcacgcccgagggggtgaccgagtacgtacaggccgacgtgcgggaccccgacaccatcgtcgagcaggccggcaaggtcctggacttcagcaagccggtggcactctcgctcgtcgcgctgctgcacttcgtctccgacgaggacggcgcgtacgaactcgtcgaccgcctgctggccgaggtgccctccggcagctacctgatgctgtcccacgcgacggcggacttcaccccgaagaagtccgaggaggcgggggagctgtacaaggcccgcagtctgacgctggcactgcgcagccgcgacgaggtggcccgcttcttccgcgacctcgaactcgtcgagcccggtgtcgaggtgcccgacaagtggcgtcccgaactgggcgaaccggtgcccggccaggacgacgagccgatccccggctacgcggcggtggggcgtaagccgtgacgctcgtacgtggtggtggggcgtaagccgtgacgctcgtacgtggtggtggggcgcaagccgtgacgctcgtacgtggtggtggggcgcaagccgtgaggctcgtacgtggtggtgggctgtaagccgtgacgctgagggcggtcccgtgccggccgtcccggccgcccgcaggcggaccgccttcggtgaactgcacccccgcttcccggcagggcagcgggggtgcagccacgaacggcatcgcacagccgccgctcaccccggcggcagcgccccgcacaacgcctcgaccgccgccccgtacgcatgctccgccggtgtcgcgtaccccacgaccagcccgtccgtcaccgccatcgtcgcctccgggtgccggaactccgcgagcccgtccagcgcgacgccctgccatgtcgccgccttcaccgcggaccgctccgtccccggcggcagccgcagcaccgcgtgcagccccgccgcgatccccgtcacctcgatgtgcggcgcccgctcggcgagcgcggcgacgagccggtcgcgccgcccccggtaccgctgccgcatacgccgcacatgacggtcgtacgacccggagacgacgaagtccgcgagcgccagctggtccaggacgctcacccacgcctcccgctcgcccttgaccgcgagcaccgcgtcgacgtaccgctccggaaggaccatccaccccagccgcagcgcgggcgacaggctcttgctgaccgagccgatgtggatcacccgttcggggtcgagcccctgaacggcgccgaccggcttgcggtcgtaacggaactcaccgtcgtagtcgtcctccagaatcaccccgccacgcgcgcgtgcccagtcgacgaccgcggcccgccgcgccggatgcagcggtccgccggtcgggaactggtgtgcgggcgtgagcagtacggcccgttcccggcccaacccgcccacccgcgcgccgtcttcgtccaacggcagcggcacggtccgtacggacgcggcggccagcagctcacggtggaagccgaggccgtacgactcgaccgccagcgggcccttgagcacgccggggaagagcagccgcagtgcgtgcgcgaagccggagcagatcacgatccggtcaggctccgtccgcaccccacgcgcgcgtgccaggtacgcggcgagcgcctgccgcagctcgatccggcccgcgggatcgcccggcccgaagacctcgttgggggcctgctggagcgcccgccggtacgacgcgagccacgccgcgcgcgggaacgacgacgcgtccggcgtgccctgccgcagatcgtgccgtggcccacgcgcgcgcggcggcagctttttcggtacgcgcgcgtgggcaccgccgagcggcgcggcgcggtcggcgacacgcgtgcccgagccctgacgtgcggtcagccagccctcggcgacgagttcggcgtacgcgtcggcgaccgtgttgcgggccacgcccaggtcggcggcgagcgaacggtagggcggcaggcgagtgcccggcgcgagcctcccgctgcgcaccgcctcacgcagcgcccgaatcagcgaagcccggcgcccgcccgccgccgacagctcaagatgcaggtcggcgccgatgcgctccgccgaattgacccatgattccgccatagaaatgaaccatacggcaggtctttggccgccgtagattcatggtcatgacgacgaacacgacccacacgacccacacgacgaacacgaccgacacggtggacacgaccggctctcgcctcaacttcgcgaaggccgccccgaaggtcttccgcgcgctcatcggcttcgacgcggcggcccgcgagggaatcgacccggccctcgtcgaactcatccagatccgcgcctcgcacctcaaccactgcgcgtactgcctccacatgcacaccaacgacgcacgcaaggccggggagagcgaggatcggctgcacatggtggcggtgtggcgcgaggcccgccacttcttcaccccgaaggagcaggcggccctcgccctgacggaggcggtgaccctggtcgccgacgcgggcgtccccgccgacgtctacgccgaagccgccgcccacttccccgaggaggaactggcccacgtcctcgccctgatcctcacgatcaacacatggaaccgggtcgccctgtcgacgggaaaggtggccggcacggacgaacgctgacggacgaacgctgacggagaacgccgacggacgaacgccgatggctgtggcgaggtgggtggccgacgtgggctacgccctcatcggccggtcgtacggccctatcggcgccggcagcttcgacgcggcgcccgtcagccggcggtccaccgccgccgccaccgctcgcccctccgcgatcgcccacacgatcagcgactgtccgcgcgccgcgtccccggccgcgaacaccccggggacattggtcgcgaagtccgcgtcccgagtgatcgtgccgcgcgggtcgagtgcgagaccgagctggtcgaccagcccgtcgtcccggtcgggaccggagaaaccgagagcgagcagaacgaggtcggcgggcagcgtacgcccggagccgggcagcggccgacgccgcgcgtcgacctcgaccaggtgcaaggcccgcacatgccccgccgcgtccccggcgaagcggagcgtggacgccgcgaacagtcgtgcgtccgcgtccgccgcgggcgccgtcttcaggtcacgggcttcctcgtgcgcgggcgacatccggtagatcttcggatacaccggccacggctcgatgtcctcgtcccgctccgcctcgggcagcggatagatgtcgagctgggtcacggacgccgcgccctcgcgcaccgcggttcccaggcagtccgcgccggtgtcgcctccgcccacgatgatgacgtgcttgccggccgcagacagcggcgagacctccagatccccctcgcacacccggtcggccagcggcagatactccatcgcctgatgaatgccggccaactcccgtccgggtacgtccagttccctccaggccgtcgcgcccacggcaaggaccacggcgtcgtaccgcgcccgcagctcctccgccccgatgtcccgcccgatcgccgtcgacgtgcggaacttcgttccctcgtcccgcatttgttcgagccgttggttcagatgccgcttctccatcttgaaggccggtatcccgtaccgcagcagcccgccgatccggtcggcccgctcgaacaccgcgaccgtgtgcccggcccgcgtcaactgctgcgccgcggcaaggccagtggggcccgagccgacgaccgcgaccgtcctcccggacagccgctccggcggacacggcggcgtgaacccgtccgcccacgcccgatccgcgatggcgacctcgacgttcttgatggtgaccgcgggctggttgatggccagcacacaccccgcctcgcacggcgcgggacacaaccgcccggtgaactcgggaaagttgttcgtggcatgcagccggtcgctcgcggcacgccagtcctcccgcgagaccaggtcgttccactcgggaatcagattgcccagcggacaggcctcatgacagaaggggaccccgcagtccatgcagcggtcggcctgccgactgatgatcggcagcagcgcgccggggacgtacacctcgtcccagtcccgcacccgttcctcgacgggccggcggggccattcctcgcgcggtgtggtgagaaaacccttgggatcggccatggccgtctcccttgtgcacacataaaggggcgtttcgtatggccacgatacgactccgccgcccggcccgccgctcggcaccgaccgggaaccgtgccaggcggcaccggccgagaacctggtgagacctggtgggccctggtgagacgcacccggccgagagcctcgtggcgcggtgccggccggctcaggtgagcgcgaggacgtacgacacggcggcgccggccgacgcgaccgcacggatgtggttccagatcgtccactcgcgcacgtacgaacgccagtacgtggcggtctccggggcgcccggatccatcttgaggagcgcgtcattgcggggcacattcgcgacggccgtcactccgaacgtaccgaacagatacagcccgctgcccaccagcagttccaccgtgcccgcgtcgggccacagcacgaacgtgaccacggcgagcacggcacacagcaccgccgagccgacgaacacgatcatgaaggcgggggtcagcgcggcgacgttgatcgcgttcatcgcggcgacgccctgcgcgggcggcagcgaggcaagccccttcatcacgaacgtcgagaacccgcagaacaccccggccaccagcccggtcccgagcaccccgagcaccgtcagtacgaagtacggcccgtcgatcatgtcaactcccgcatagttcccccgagccccaagatcctgcccacccgaccgcccggtcactgccggcgaatccaccgctggcgaatccactgccggcgaatccactgccggcgaatccgctgcaggcgcatccatcaccagtgaatctccgcaggagcctcaccgaccatggccgtatctcgcgaagccatacgcgagcgtccagggaggaggacatggggggagaggggggcgcgggggaggaggggggcacgggggaaaggaggggacgcggggagaagtacgccggggaacgggctcaaggtggcgccccgccccactcccgtaacgtcgcctccaccacccccgcgatccgtcgccgcgcctcatgccgcggcaccccgctcatcagcagccggtcgtacggcgtctccttgtgccgcacggacgcccgcaccgccgaggccaccgccgtccccgacaacgcacgccccgcagcgctgcgcccgacccgcccacttccccgcagtgacgcatgcgcggcgatcgccaacgcccgctcggccggacagcggggatacagccgccggatctcccgcgcgaaggcgtccgtgaaccgtacgtcctccgctgcccgccgccgagcgtcccgcacccggcgccgccgccgcgcctccgcgtcggccagacaccgctcctcggccagcgccagcgccgcctcctcgactagcaccccctgccgctcgtaccgactctttcgccggttgaaccgaaccaccaccgccgacagcccactctcctcccgcgaccgccgagtcagcgcggagtgcccccgcggcagaaacaccagatgcccgaggtcggcacagtccagacaccgaggtgcgccctcctcccacaccaacagcgaacgcggcccgctccgacactcggcacagaggcgtcgcgtgatcggctgaatgaccagaagtaccggcgcggaacggcgcagcccgccgtccccccacccctccgccccccaccccgcccccgccctctgtcccctcgtctcgtcggccgtcatgcccgcggccgggccgtcatgtccgcaaccggaccggaccgtcatacccgcgaccgggccgctccccccgcccacggacgcactccgcgccgggctcagcgcaacggtcggccggctccctgtcggcgcgcggcatgatgggcggtgtgcgactcgaagcgatcacctgggaacggctcggcgacctcctcgccgaccgtctgctcgacctgaaaccggacgacggcagcccctggccgcgcatcgccttcgacggagccccggccgcccgccccggcgacctcgctcagcgggtgtccgaggcgctgcgcatacgcggccgtccttcgctcgtcgtcggcgcggccgacttcctgcgccccgcctcgctgcggttcgagtacggccaccgggacatcgaggcctactacgacggctggctcgacaccggcgccctgtggcgtgaggtgttcggtcccctggaagccggcggcagcggccgcgtcctgcccgacctctgggacccgctcaccgaccgcgccacccgcagcccctacgcccaactaccgcccggcggtgccctgttgctgcacggccccctccttctccggcactggttccccttcgatctgaccgtccacctactcctttccccgggtgccctgcgccgccgtacccccgaatccgagcactggaccctccccgcctacgagcgctacgaggccgaggtggacccggtcgccgcggtcgacatcctggtacgcgcggacgacccccggcacccggcgtggcgcggctgaccgagcggatatggcgtggtcggccgagcctgtacccccaagaccttttgcatgcatgtgcatgtagttactctggtcccatgacactctccttcgacgactcggtccgcaccctcctcgacggcaagaacttcgccggcgtcgccaccctcggtcccgacggcgctccccagaactcggtggtctggatcaagcgcgagggcgacaccgtcctcttctcctcgaccgcaggccgccagaaagtgcgcaacctgcgacgggatccccgcatcagcctctcggtcttcgacctcgccaacccctatacctcggtcgagatccgcggcaccgccgagatccttcccgacgagaacaagcgcctcccgtacgagctctcgcacaaatacctcggcatcgatccgccggcggagaaggacgacgaggtgcgtgtgatcatccgcgtcgtcccgcagaagatcgtgggcttctcggcgtagggcccggccccaccgacggccacccggaaccacgaacctccgggtgcgtaccgctgcggacacggcgagaatgaaaggcgccgggactagcggtgtgtcccgcgccgcgccggccgtccggcaccgggaggtacttcatgaccaccgccggagaaatcatgcaccgtggtgcccagtggattcccgcccacgaaaccctggaccgcgccgcccagctgatgcgcgagctcaacgtcggagccctgcccatcagcgacgagaacgaacggctctgcggcatcctcaccgaccgcgacatcgtcgtcggctgcgtggccatggggcgcgacccggcacgggtgaccgcgggcgagatggcccagggcaccccgcgctggatcgatgcgagtgccgacgtcactgaagtgctcgacgagatgcaggggcaccagatccgccggcttcccgtcatcgaggacaagcgcctcgtcggcatgatcagcgaggccgacctggcccagcatctgacggacgaccagatcgccgtgtgggtcgagagcgtctacgcgaggagcgtgacgcactgacccggctggtcttccggtccccagccgcccactgcctcgccgcgtcacagccagtcgttgcgcttgaagccccggtacagagtgacgcagcccacggctatgacggccatgaccatcgggtagccgaacctccagtgcagctcgggcatgaactcgaagttcatgccgtacacaccgcacaccatcgtcggcaccgcgatgagcgaggcccacgcggtgatcttccgcatgtcctcgttctgcgcgacgctgacctgcgcgagatgcgcttgcaggatcgagttgagcagttcgtcgaacgcggcgatctgctcggacacccgcagcaggtggtcggagacgtcccggaagtacgcctgtatctcctggtcgatcactcggatcggccgggtggccagctcctgtacggggcggctgagtggcatcaccgctcgcttcagttccaggagttcgcgcttgagctggtagatgcgtcccgcgtcgacccgcgcaccgctcgccgcgaacacatccgtctcgacctggtcgatgtcctcctgcaccgcgtccgtgacgctcagatagtcgtcgacgacatggtccgcgatcgcatgcagcaccgcggccggccccttggcgagctgctgcggtgtggcctccagctcctcgcgcagggggccgagagaaccatgccggccgtgccgcaccgtgatcacgaaggcggggccgatgaacaccatgatctcgcccgtgttcaccacctcactcgtcgcggtcagctccgtgtgctcgacgtagcagaccgtcttgaagaccgcgaacagcgtctccccgtaccgctccagcttcgggcgctgatgagcctccaccgcgtcctcgaccgccagcggatgcaggtcgaacagctcggcgatgcccgcgaactcctggtccgtcggctcgtgcagcccgagccagacgaagccgtcgtccttcttgcggacccgctccacggcctcgaccagatcgtgaccgcccggcatccgtacgccgtcctgatacatcacgcagttcaccaccgcggagcccaggggcgacctggcggggtgactcaggtcgacccgcgcacggcgttgcgccagccgtgccaccttgcgaaggcccccgaccctgtcgaggcctgtgaccttccgcagattccctgccatggacatccggatctccttgcgtggatctctccgcgccgcaccttgcgccttcgcgggccagtctgccagtccggttcgagcgccggaaaagcctgtgggaacggaatgttccgcttcggtatggcggttgtgagacgaccgtgtgccgcgattgtgcgcagaagggcgcggagcgtcgccccgcacggacaagtcggtcaactgggatgatctcgtcatgacgcgaaccgacgggtatctcctcgacaaccggcagcccgaggcggggcagagttacgacgccgtcgccgccgtcttcgaccccacgacgttccggcacatcgagggcttcggcatcgggtccggctggcgctgctgggaagtcggcgcaagcggcacgtccgtgatctcctggctggccaagaaggtcggaccgacggggaaggttgtcgcgacggacaccgacacctcgtgcgcggcgtcggccgcgcgccatccggtcgaggtgcgcacgcacgacgtgggggtggaggagccgccgggggagggcttcgacctcgtgcacgcccgcctcgtactggtccatgttccggaccaggagcgggcgttgcggtcgatggtcaaggcgctccggccgggcggacggctgctgctcgaggacgccgacccggcgctccagccgctgctgtgccccgacgagcacggccccgagcagcagctggcgaaccgcctgcgcgacggattccgcttgctgctggccgagcgcggcgtcgacctctcgtacggtcgtaagctccctcgcctgctccgtgcggcaggtctgcgccgagtggaggccgacgcgcacttccccgtcacctcgcccgcctgcgccaccctcgaggccgcgacgatccgtcagatccgggaccagctggtctcctcaggccatgccacgaacgcggacatcgacctccacctggccaatgtggcggccggcgccatggacctggccacggccccgatgatctcggcgtggggccgcaaggcgtgaggggcggggggaagcgttcccggttcttcgtcatgccgcacctcaatcgagtttgaccgcacccctgttctggcgcgtgccgctcggcggtctcccgcccacccctgccaccgcggcagcacccgcccggcacccttccgccgcggcctgggcgggttccacgccgaccaggagggccgcgaggaaggcgcccgtgaaggcgtcgcccgcgcctgtcgtgtcccgaggcgtcgcgggcgttgccggtacccgcgcccggacggcgcccgcctctgccaccagcgctccctccgcgccctgcttggcgaccaccaggggaacgtggcggctcaacttggccgccgcgtccgccggatcgggcaacccggtcagcagacaggcctcgtcgcggctgggcagcaggacgtccaccccctcgatgagggccaggaagcggtccactccaagctccgccaggaaccccgccgacgccggatcaagactcaccggcaccccacgcgcgcgtgccgattccaacgccgccgccaccagcgcccgactctgctccgagaacagcagataacccgacagatgcagtcgtacgacaccgtcgagcagcgcgttcgaccagtccccgggcgccagccgcagcgaggccccgctgtccgtcaggaaggtgcgctcggccgaagcgcccgtgtccaccagacagatcaccgttcctgtcggcacgtcgggatcgacgaccagacgaggacgtacccccgaagccgtcagctcccgctcgtgccaggcggccccgtcggcccccacccgcccgagcagccgtacgtccgcccagccccaatgagccgcccagcaggcaacgttggcgcccgcgccacccggcaccgtccggatggcggcggccgtgtcggtgcccgacgcgagcggcccccggtgccgcgcgacgacatcagtgacgacgtcaccgacgacgagcagcgccccggcgccgggagcgttcatgccccggcccaggccgccgcgatccgccccgcgaggcgtacgttgccccgtaccgccgccaggttggcgctcagcgaggcaccctcggtgtggcgtaccaggtagtcgaggaggaacggggtgaccgcctggcccgtgacgccctccgcctcgcacgcgtgcagcgcgtcggcgagtacgcgcgcgtggagctcgggatcgagctgttcgtcctcggggacgggatgggcgacgatgagcgccgactccgggccgtcgagcgcgtcctgcgcgcgcatgacatccgcgacctgccgcggcgaccgaagcgtccagtccaccggatacccggagtcggacagatagaagccgggaaagcgcgccgtgccgtacccggccaccgcgactcccagggtctccagccgctgcagcgtcgcgggcacgtccaggatggacttcacgcccgcgcacaccaccgtgatccgggtgcgtgccagcagtcccaggtcggccgactcgtcctgcgtcaccgtccactcgcggtgcaccccgccgagaccgcccgtcgcgaacacccgtacgcccgcgagggccgccagcagagcagtcgccgacaccgtggtcgcgccgctcgcgcccgccgccaccgcgagcggcagatcgcgatgccccagcttgcggatcccgtcctcgttggcgacccgctccagctgttccttgtccaggccgacacggggatgcccgtcgagcacggcgatcgtcgcgggcacggcaccctcctgccgtacgacgtcctccagctccagagcgacctggagattgcgcggacgcggcagcccgtgcgcgatgatcgtggactccagagccaccaccggccggtgcgcggcgagcgcctcccgtacctcttcggacaccaccagcacgcgcgcctcctgtctgtcggtctttcctcatctctggcgggcggcgcgcccggccaaacccttgcgagctgtgggggacggcaccagcctgaggggtatgacggacaactcgccacgtctcgaccatgtcgtcctctgggtacgggacccggtggccgcggccgacttctacgagaagacggtcggcctcgaaccccttcgggtccccggtttcgccgcggggaaggacccgttcccctcggtgcgcctcaacgaggagacgatcttcgacctcgccccgctctccctggtggagcacatgaacatgctccctggggccgccgacagcgccgggcaccccgtcaaccatgtgtgcctgtcccttcagagggacgatttcgacgccctacgggcgcgcctggaggatcggacggtcccggtctcggacttctcgtacgactccttcggcgcccggggaaaggccaagcgcagcttctacttccgtgacccggacggcaacgtcttcgaggcacgacactacgagtaggcgccgggggcaccgcatcaccggggccgccccgacgcacgggcagggcatgggtgcggccggtcgccggaggcagcggccgtccggctagggtgaccggccatgaccacgaacgcccagtccaccccgtccttcgccgtccacatccccgacgcggaactcgaagcggagccgctcgacccggcccagatcgtctccggcgccccggtcgtgacgggcaaggtgctgtgggaatccgccgacggcaagcaggtgcggggcatctggcagatcacgccgggcgtggtgaccgacaccgaggcgaacgaactcttcgtggtcgtgagcggccgcgccacgatcgaggtcgagggcggcgccgtcatcgaggtcggaccgggcgacgcggcggtcctgcgcgagggtgaccggacgacctggaccgtgcacgagacgctccgcaaggcgtaccacatcagcctctgacgcccttccccgtagagctcctcagaacagcggttccggcagcaccccttcgagcgccagcagcttccgcttggcctccagcccgccgccgaaccccccgatgccaccgtcgctctcgaccacccggtgacacgggacgaccaccggcagcggattcgagcccatggccatgcccactgcctgcgccgcgcccggctgaccgacccgccgggccaggtcgccgtaccccacgaccgcgccgtacggcacgccggacgccagctcgcgcagcacctggcggttgaagccggagatcagggaccagtccaagggcagctcgaagtcgcgccgctcacccgcgaagtacgccgtcacctggcgtatcgcctcggccaggaacggggagccgggatcctcgacgggctctgaaccgagccgggacgcgagccgctccagcgccttgtcgcgcaccgcgtccgtcgcgtggaacaccacgttcaccaggccgtcgccggtcgcggcgagcagcagcggaccgatgtccgtgccgacgacggcccacacgacctgctgctcgctgcgctcaacactcttcatgcgcccaccgtacggcgcgccactgacaacccccgggggtgcggacacggcccatgtccgcacccccgggtgaaggaacggttccacaggagggtggacggccggttcagtacgcggtcaccgcccgccggaccacgtcgggagtgttcgtgatgatgccgtccacgccgtagcgggtgacacggcgcgccgtgtcaccgctgttcacggtccaggtgaggatctccagcggcttgccgtgcggtccgtcgaacgagtggagcgcggagacgtaaccggccgagatcgaggtgtacgaggcgttgatctggtcggcgaactccgcgtacgcgggcagggccgcgatcgacggcgtgcccaggtaaccggtcttgatgccggggcgcagccggtggaccgtgcgcaggctcccgatgctgaagctctgcacgatcagccgcctcttgaggcgaccgggcttgagccacccctcgttgccgagcagcctgagggtctgacgctcgatgcccggatagagctccgggttcttgatctccaaaacgagtttttgatggttgcgcgagacgcggttcatgtactgcttcagcgtcggcacgcgtgtgcccttgtaccgggagccgaaccaactgcccgcatcgagacgcgagatctcctcggcggtgaagtccttcaccttccagggtgcccggttcggatacacctgttcgacgtcggttgtgcgcgcaagagtgtcgtcgtggatgacgacgagttcaccgtccctggtgcgctgtacgtcgttctcgacccagctgaagcccatggcggccgctttgtcgatcgaggccagggtgttctcgggcgcgtacgcggaggccccgcggtgggagacgatcaccgggccgtcgccggccgcggccccggcgtgaggcgtggggagtatggcgacggtggccccgataagcgcggtggtcgtggcggcggcaacgcgcgcgtgcatgcgtactcctcgcgtcgagcaatcacggacagcacaagagtgacagcagacggtcatcggaagcggagtgcaggatgggcacagattgaatggtgttgcccaaatccgttcacaggcgccacacaaccggggtaggcgcgtgtttctttgccggaaaatcgttcgaccattccggtgggggtcatactctctgcgtcaaccctggccgttgtggcggtactgggggcggaggtattcaccgggatttcaggacgcgacagggtggggaggacggccgcgcatgcagggcaccgtcgacggcttcagctacggactcgtcacaccgctggtggcgtacctcatggccttcctgggcggtgcgctcgggctgcgctgcaccacccggtcgatgctggtcgcccggtcctggcgggccggctggctcgccctagggtcggccgcgatcggctccggcatatggacgatgcacttcatcgcgatgatggggttcagcgtcaaggaaacccccatccactacgaccaggcgaccacgttcgcgagcctgggcgtcgccatcctcatggtcggcgtagggatcttcatagtcggataccggggggcttccggagcggctcttttcaccgggggcacgatcaccggtctgggagtcgcctcgatgcactacctgggcatggccgggatgcgcctcaacggaaagctcgagtacaacaccctcaccgtctccgcctccgtggtgatagcggtcgtggccgcgatcgccgcgctctgggcggccggacaggtgcgcggcttcatgtggagtgtgggcgccagtctcgtcatggggctcgccgtcagcggtatgcactacaccggcatggccgccctcagcgtccatctgcacggctcggccggcgcaccggcgggcgactcgcccgccgccctgctcgccccattgatgatcggtccgctcgtcttcctgtgtctggccggcgtcgtcgtactgttcgacccgatgatggtcatgggcaagcccgactggacccccaccgagaacaggccgggcgtccccgcccaccccaccgtcacccacaccggccggcgccccgcgtcccgccccggcgagcgccatggacaccgcggcccccgcaccccgcagcgctggtgatcggaccccgttgtcagtgcggggtcgtacggtggattgcatgcggcccgtttccaagatcgaacgcacggtggcgcccttcgaggtcgtcagtccctaccagcccagcggcgaccagccggcggccatcgctgagctcgaccgacgtatccgtgcaggtgagaaggacgtcgtcctgctcggcgcgaccggcaccggcaagtccgccaccaccgcgtggatgatcgagaagctccagcgccccaccctcgtgatggcgccgaacaagacactggccgcccagctggccaacgagttccgcgagctgctgccgaacaacgccgtcgaatacttcgtctcgtactacgactactaccagcccgaggcgtacgtcccgcagtcggacacctacatcgagaaggactcctcgatcaacgaggaggtcgagcgcctgcgccactccgcgaccaactcgctgctcacccgccgcgatgtcgtcgtggtcgcctcggtctcctgcatctacggcctgggtactccgcaggagtacgtggaccggatggtcccgctcagggtcggcgacgaggtcgaccgcgacgacctgctgcgccgcttcgtcgacatccagtacacgcgcaacgacctggccttcacccggggcaccttccgggtccgcggcgacaccatcgagatcttcccggtctacgaggagctggccgtccgcatcgagatgttcggcgacgagatcgaggcgctctccaccctgcacccgctcaccggcgagatcatcagcgacgaccagcatctgtacgtcttcccggcctcccactacgtcgcgggccccgaacgcctggagcgggccgccaacgacatcgagaaggagctgggggagcgcctcaccgagctggagaagcagggcaagctcctggaggcccagcgcttgaggatgcggacgacgtacgacctcgagatgctccgccagatcgggtcctgctccggcgtcgagaactactcgatgcacttcgacggccgcgagcccggctccccgccgaacacgctgctcgactacttcccggacgacttcctgctcgtcatcgacgagtcgcacgtcaccgtgccgcagatcggcgccatgtacgaaggagacgcctcccgcaagcgcaccctcgtcgaccacggcttccgcctgccttccgccctggacaaccgccccctgaagtgggaggagttccaggagcgcatcggccaggccgtctatctgtcggcgacgccgggcaagtacgagctctcgcgcggggacggtttcgtcgagcagatcatccgccccaccggcctcatcgaccccgaggtcgtggtcaagcccaccgagggccagatcgacgatctggtgcacgagatccgcaagcgcaccgagaaggacgagcgcgtcctggtcaccacgctcaccaagaagatggccgaggacctcaccgactacttcctcgaactgggcattcaggtccgctacctgcacagcgacgtcgacaccctgcgccgcgtcgagctgctgcgcgaactgcgcgccggtgagtacgacgtactggtcggcatcaacctgctgcgtgagggcctcgacctgcccgaggtctccctggtggcgatcctcgacgccgacaaggagggcttcctgcgctccggaacgtcgctgatccagaccatcggccgcgcggcgcgcaatgtgtccggccaggtccacatgtacgccgacaagatcaccccggcgatggagaaggcgatcgacgagaccaatcgccgccgggagaagcaggtcgcgtacaacaaggagaagggcatcgacccgcagccactccgcaagaagatcaacgacatcgtggcgcagatcgcccgcgaggacatcgacacggagcaactgctcggctcgggctatcgccaggcgaaggacggcaagggcgcgaaggcaccggtgccgtcactcggcggaaaggcggcggccaagggcgccaagtccgccaagggcaaggccaaggagacggtgccgaccgaccgtccggcggcgaaactcgccgaggagatcgaggaactgaccaaccgcatgcgcgccgccgcggccgaccttcagttcgagatcgcggcccggctgcgtgacgaggtctccgagatgaagaaggagctgcggcagatgaaggaggcgggcctggcctgacgggcacgcacgggtgccggccacgcccgggccggcaccccgaaccgccccgtccgaccgccccccgatccgctgccctgcaccgttccccgtcgtaccgcggctccgctgtccgcggtgctcgcgcacaccgctgtgttgcaagaccgacacaaacggcggcccggggttcggcactgtcagtggcgctgcgtagggttttggttatccgcgggctccgcggcaacaggggacagttcgagaggggatcagcgcgtgacggtcaacatgaccaagggtcaggccatcagtctgcagaagaatgacgggggcaccctgaccgcggtgcgcatggggctcggctggcaggcggccccccggcgcggcctgttcggctcgcgcacccgggagatcgacctcgacgcgtccgccgtgctgttcgcggacaagcagccggtcgacgtggtgttcttccgccacctcgtcagcgacgacggctccgtgcgacacaccggcgacaacctggtcggtggtgtcggccagggcggcgacgacgaggcgatcctcgtcgacctgcagcgcctcccggtccacatcgaccagatcgtcttcaccgtgaactcgttcaccggccagaccttccaggaggtgcagaacgcgttctgccgtctggtcgacgaaaccaacggcgaggagctcgcgcggtacacgctggcgggcggcggccagtacacggcccagatcatggcgaaggtgcaccgggcgggtgcgggctggcagatgaccgccctgggcacgcccagcaacggccgtactttccaggacctgatgccggcgatcctgccgcacctgtaaggggttcggcgcggcagacggacacgacgagcagcggcgcggcgcgcagcggacgcggtgacagcagggggacgaaggcgatgacggccgagctggtccgggggcagaaccatccgctcccccaggcccgacttgaggtccgggtatctgccggcacaccgatcgtggccggggccacgctcggcgacgagcagggcaaggtccgcggcgtcgagtgggtggcccatccgggtgcgcccacgctgcccggcctcgaggtctccaagcaggcggcggccgaccaccgcctcgccttcgacctggacgccctgccagggaccgtgcaccgcgtgcatgtactgctcgccctgccgacgggaggcggtggcccggcccggttcggcgccgtcgcggcccccttcgtcgcggtcaccggactcgacggcgccgagatcgccagctacacgatcaccggactgaatgccgagtcggcggtggtggctctggagctctaccgcagacaggacgcctggaaggtgcgcgcggtcggtcagggatacgcgggcggtctcgccgagctcttcgccgaccagggactgccgcaggcacagcagctcgcggccggcatcaacgaagcagtggcccaaggtctggcgcgttcggtggcggcaccgccacgcctgccggacggggagcgcacgccccccgccgcctccgccccgggctcggaccagacgcacgcccgaccggtatcgcagggcgcagcgcaggtcgccgccgaccacgtacagccgcaccaggggacccccggcaggccccagcccggctcgccgtacgacggcgcgggcccgcagagcggtgcggcaccgcagccagatcacgccgccggccgttcggtgccgcaggaagggcaccccggcgctcccgtccggccggactccgccgccgcccggcccgcaacgcccggcgcgggcggcccgatcgactacagccaccccgcccggcagaacgtcgcgcccccgccgcccccgccgccggccgcgccggggcattccgcacagcccgtcgcgggagacgcgaccggctggaccatggaggagcggctctacaaccaggtgtggggcatgttcgaggacctggcgcgcgccacggccgcgtaccgcagcgccgtcgacttcgcggactcccgcagggaacaggagctcgacaaggccctgtcggatccgcgcagccgcatcggcgggcagggcgacgccgtgcgggaggcggcccaggccaagcacgcccaactcgtcgaccaggcccgcgcggcactcgaccgcgacctcgcccagctcatggccgagtcggacgtcgtcgagcccgcgctgcccccggcttacgcgcgctgggacaatccggtctggcacggctaccgggtgccgatggagacccccatggccgtgcgcctgggcgatctccacctcccggagagcgaaggactgcgcatccccatgctggtcaggctgccgttggagcgcggtctgtggatcgacagcggccgcgccggatcccgtgacggctcgctcgccgacgccgacgagctgcgccgcctcgccatggacacggcggtggcgcatgccgcgcggctgctcgccgtccatccggcgggcgagttcaccgtgcacgtcatcgacccggccggctcgggcgcctccgcgctcgcgcccctgacacagtccggggtgctcgccgacccgcccgctgtcggtgccgcgggcgtggcggacatgctggcccggctcatccagcgcgtcgacctggtgcagatggcggtgcgcggcggcgcggccgactcgctgccccccgacctggacacggccgaacagctactgatcgtcaacgactttccgcacggcttcgacgaccgtgccgtgacccagctgcgctatctcgcggacgagggcccggccgtcggcgtccatctgatgatggtcgccgaccgggaggacgccgccgcctacgggccgctgctcgacccgctctggcgctcgctgctacgcctcactcccgtccccgacgaacacctcgccgacccgtgggtgggccatgcctggacgtacgagcctgtgacggtgccgccgggcagccaggtactgcaccaggtgctcgcgcacatcgcggcggctcgccgcgcatggaaccgctgacgacaggctggacgcgtcgagcactggccgaggctccctcctccaagacccaagccccaagagcgggtaaagatgccctgaccaggcaacttgggattttctttgctaattcctttacctttccttggtgattcgggtactgtctttcgtacggaggggagtactccctacctgctgcggcgtacccgtcaatacggatcaggccagatcccggggcgtcggcccgcaggcgctgggcgcatcaagcgtcccggccgtctcgggtggaagagacctccggtagcgacgacgctgaaatctgccgttacgtactgccggaggcgcagtggatgtttccctgaccctgtgggtcctgacaatcgtgggccttggcgccctcatcgcggtcgacttcttcatcggccgtaaaccgcacgacgtgtcgatcaaggaagccggcacctggaccatcgtctggatcgtcctcgccggactcttcggcctgggactgctcgtcttctccggcggtcagccggccggagagttcttcgccggcttcatcaccgagaagtctctgagcgtcgacaacctcttcgtcttcgtcctgatcatggcgaagttcgcggtgccctcgcagtaccagcagcgagtgcttctcatcggtgtcctcatagccctcgtcctgcgggcgatcttcatcgccgcgggtgccgcgatcatctccagcttcgcgtgggtcttctacatattcggcgcgttcctgatctacaccgcctggaagctcatccaggaggccagggctgacgagccggaggaggagttcgaggagaacaggctgctcaaggccgcggagaagcgcttcggcgtggccgaccgctatcacggcacgaagctgtggatcgagcagaacggcaagcgggtcatgacaccgatgctggtcgtcgtgctcgcgatcggcaccacggacgtgctcttcgcgctcgactcgatccccgcgatcttcggcctgacgcaggatccgtacatcgtgttcaccgccaacgcgttcgcgctgatgggcctgaggcagctgtacttcctgatcggcgggctgctcaggaagctggtccacctctcctacggtctgtccgtcatcctcggcttcatcggcatcaaactggtgctgcacgcgctgcacgagtccggcgtccacgtacccgagatctccgtcccggcctccctcggtgtgatctgctcggtcctcgtcatcaccacgatcaccagcctgatcgcctccaggaagcaggcggcgcagaagcagaccgaaggcgctccgaaggacagcatcgacgtctgaccgcgtcgaggacaggaacaccagggcggccgggcagtcggcctctcagtggacgaggccgccgttcatcgacggcgacgtgcgtgagatgaccgacccgaagaagtgcccggcccgctgccctcaacccggcccgggccccgcgcggtcggcgtgcggggcccgggccggagtgcggggtccgggcgggcctgggacgatcgccgcatgatcgttcggctccggtcccttgtgatgcagtggacggccgtcgtgcccgtggccgcgatcgtcctgcttgccctcacctggggccgcgacctgcccggcgcggtcgtcgcactggtgacgctggtactggccggagccgtgctggccgccgtgcatcacgccgaggtcgtcgcgcaccgggtcggtgaacccttcggctcactcgtcctcgccgtcgccgtgacgatcatcgaggtcgcgctgatcgtcaccctgatggcggacggcggcggcaagagcgcgaccctggcgcgcgacacggtgttcgccgccgtgatgatcacctgcaacggcatcgtggggatctgcctgctggtcgcctcgctgcgccacgggctcgcggtcttcaacgcggagggcaccggagccgccctggcgacggtcgcgacgctggccacgctcagcctggtgttcccgaccttcacgaccagcaagccgggcccggagttctccacgacccagctcaccttcgccgcgctcgcctcactgatcctgtacggactgttcgtgacgacgcagaccgtgcgccaccgcgactacttcctgccgatcacccggcacggcgaggtgatcgacgcggagacccacgccgacgcgcccaccgcccgaaccgcaggcatcagcctcggactgctcggcctcgccctggtaggtgtcgtcggcctcgccaagggggtgtcgcccaccatcgaatccggcgtggaggcggccggaatgccgcagtccgtggtcggcgtgatcatcgcgctgctcgtgctgctccccgagaccatcgctgcgctgaggtccgcccgccgcgaccgggtacagaccagcctgaacctcgccctcggctcggcgatggccagcatcggcctgacgatccccgccgtcgccctcgcatccgtctggctctccggccccctggtgctcggcctcggctccacgcacatggtgctgctcctgctgaccgtggtagtgagctccctgaccgtggtaccgggccgcgccacaccgctccagggcggtgtgcacctggtggtgttcgccgcgtacttggagctggcggtcaatccgtaggccgcgctcgggcgagatgcggcgggcgcccccgggtcccggcgttcgggtcccggcgttcactccgtcgcctgcaccgccgtcatgcgcggcaccggccgcgtctccggaagcagcgcgaagcagcccaggctgagcagcgcgatggccgtcagataggcgccgacgccccagggcacccgcccctcgtgttgcgccagcgccgtggcgacgatcggcgtgagcgcgccgccgagcactccgcccaggttgtagcccacggcggcgcccgtgcagcgcacccggggctcgtacaactccggcagatacgcggcgatcacggcgaacatcgtgatgaaggcgatcaacgcccccaggatgccgaggaacatcagcacaggctcgccggtcgacagcagcgcgaccatcgggaacatccacagcacggcgcccgcacaacccgcgaggcacaacggccgccgcccgtaacggtcgctcaggtgggcggccagcggcgtcagggagcccttcaccacgaccgcggccatgatgcaggccagcatgacggtacgactcacccccagatgctcggtcgcgtaggagagggaccaggtcgtcaccgcgtagaacaccgcgtacccgactgccagcgcgccggccgtcagcagcaccagccgccagtgtccacggacgacctcggcgaacggcacgcgcgcgtggtcgtcgatttcgaggaatcgaggactctccaccagcgaaccgcgcagccacagcccggccgccgcgagcacccccgccgcccagaacggcacccgccacccccatgccgcgaactggtcctcggacagcgtcgccgacaggatcagcagaccgccgttggccagcacgaaccccagggacggcccgatctgagggaagctcgaccacagcccacgccgccccgcgggcgcgtgctccgcggtcagcagcaccgccccgccccactccccgccgagcccgaggccctggaggaaacgcagcacgaggaggagcacgggagctgccgtaccgatcctgtcgtacgtcggtacgcagccgacagcgacggtggccgcgccggtcagcagcagggagccgacgaggaccggccgccgcccgcgccggtccccgatgtgcccgaacagcaccgaaccgagcggccgtgccacgaagccggccccgaacgtgacgaacgccgcgagcgtccccgccaccggtgagaacgtcgggaagaacagcggccccagtaccagggcggcagcggtcccgtagacgaagaagtcgtagaactcgatggccgtcccggcgagcgaggcggccgcgagccggagcatggagggcgccttcacggtgcgtacgtcgtgcatgccgcgtcaactacccacggtgacggacggttacgggggcgcgcgggagcgccctcagcgtcagcgggagcgcccgcggcgtcagtacgtcacggtgatgcgccgggcgggcccgtcgacccgtacgacaccgccgtacgggatgaccacctggggatccgtgtgtccgagatccacatcgaagacggccatggtgtcgggggcatatatcttcagggcgcgcagtacgctctcgcgctgctcggcggcgtaacgtgcgccttcctccgggctgttggggcgttcgaaggaccacgtcctggcgcggcccatcagcaacgccgggaagcgtcgcagcagtccgcgctcgcccatgttccggaggatgatgaagacctcctccccgctgggcatgtcctccgaggtctccaggaagagcactccgccgtcgtacacagcgaggtcccgcgagatctcacggtcggccatcagcagccaggagacgatctccagacagccgccccaactgcgtccctcgaccacacggtcggcgttcacccaggaccagccgtacccgggccgggtctccggctccgactcgaaggtcgccggatccgcccagtcccggctgacgtcgccccaccgaggggcgggcttcagctcgtactcgccggaggtgaagagggcggcccgcagggagtcggcggagatcgaggccatcgcgccgggccggccgaactcgaccatcaccgtgccgccgtgatagctcacgatccccgtgttccacaggaacgcgtgcaggttggtgttgtcgctgtacccgaagaacggcttcgggttcgcgcggatcaactcccggtccaacagcggcagcacggtgatctggtcctcgccgccgatcgacgcgatgaccgccttgacggtcgggtcggcgaacgccgcgtggatgtcgtccgccctctcccgcggggtggagcccatcctgcgggtcgccggatactcgacgggcaccagcccgaactcctcgcgcagccgcttcaggcccagttcgtgggggagcgggagaagccccggcagccccgaggacggcgagatcacggctatgcggtcgccccgtacgggcttgggagggtacgacggtgcggtcatggggggagggtacgggcggtcagctgtttgacgcaccgtgataaaccgggaccgagcagcggtcctcaagggccggcagacccgaacggaccggaggaaccgtgccccgcacccgaaccctcgccaacgccccgatcatgatcctcaacgggcccaacctgaacctcctcgggcagcgccagccggagatctacggctccgacacgctggccgacgtggaggccctgtgcgccaaggcggcggccgcgcacggcggtacggtggacttccggcagtccaaccacgagggcgagctggtggactggatccacgaggcacggctgcaccacgtcgggatcgtgatcaacccggccgcctactcgcacacctccgtggcgatcctggatgcgctcaacacctgtgacgggctgccggtggtggaggtccacatctccaacatccaccagcgcgaggagttccggcaccactcgtacgtctccctgcgcgccgacggggtgatcgcgggctgcggggtgcagggctacgcgttcgccgtggagcgggtcgcggcgctggcggagacgggccgggcggacgcctagagcgggggccgcgggcgggagccggcgctgttgcccgtcatggccctagccctcctgaagccgccccgcctccacgatccggtgcagaaagcgccgcgtgcgctcctgctgcgggtcgccgaacacctgctcggccgtgccgcgctccagcaccacaccgccgtccaggaagcacacctggtcggcgacctcgcgggcgaagcccatctcgtgcgtggccagcaccatggtcatcccgtcgtccttcaggtcccggacgacggccaggacctctcccacgagctccgggtcgagcgcggcggtgatctcgtcgaggagcagcagccggggtcgtacggccagggcccggacgatcgcggcgcgctgctgctggccgccgctgagccggtccgggtactcggtcgccttggcgcccagcccgagccggtcgagcagctcgcgcgcgtgctcctcggccgccgcgcgccccacgccgtgcacccggcgcggcgcgagggtgatgttctccagcacggtcatgtgcggaaagaggttgtacgcctggaagaccacgccgatccggcggcgcaccgcgtcctggtcggcacgcggatcggtgatctcctcgtcgtccagccagatcgcgccgtcgtcgatctcctccagcagattggcgcagcgcagcagcgtcgacttgccggaccccgacgcgccgatcagagcggtcaccgtgtgcggggcgacctccagatcgacgtcccgcagcacgacggaaccgccgaaggtcttgcggacggactccatgcgcaggaccggggacccgtccgtggacgtggtgctcatagggttcctccctgcgcccgctgccggtccatccgggccgtgacccagtccgtgaagcgggtcatcggaatggtcagcgcgacgaagagcagtcccgcgacgatgtacggcgtgtagttgaggctgcggcccacgatgatgtcggcggcccgcaccgcgtccaccgcgccaccgatcgagacgagcccggtgtccttctggagggacaccaggtcgttgagcagcggcggcacctggcggcgtacggcctgggggagcaccacgtggcgcagcgcctgccggttggtgagcccgagcgagcgggccgcggcgcgctgcgaggggtggacggactcgatgccggcgcggaacacctcggcgacgtacgccgagtacgtcagcgtgagcgccgtaccgccgaggagcaccgggtccacggtgaccccttgcagccgcagtgcggggacgcccaggaccacgatcatcaggttgatgatcagtgggagcccgcggaagaagtcggtgtacgcggcggcgagcgcccgcagcgggaagaacaccgggccgcgcagggtgcgggcgatggcgatgagcatgcccaggacgagcacggcggcgccgcacaccagcagcagccggacgttgagccacagcccttcgaggaccttggggagcgcctcgcgcgcgtactgcgcgtcgaagaaggtttccttggtgcgtggccagccgggtgcgccgacaacgacgaagtagaggacgacgccggtgatcagggtcgagagcgcggcgatcgcggtggcgcggcgggcgcgggtgcgcttgtagcgctcgcgttcgatgcgccgtggcgaggggacgtacgcgtcgcccccgccggacatgtcacccctgtcgtccgcgtcctcctggccggactcctccttggtgacggtcacttgagcaccggggcgtcgacggcctcggagagccactgcttctcgatcttcgccagcgtgccgtccttgcgcagggcgtccaccgcggaggtcacgcacgaggtgagggcgctgcccttgtcgaggacgagtccgaactgctcgggcgtgccgccctggttctcgaactgcccgacgatcttcgcgtcggtcacctcggcggcggtgatgtagaacgccgtcggcaggtcgaccacgatggcgtcgacctgaccgttcttcagcgcggacttggcctggtcgttcttggcgtacgcggccggctcctgggtcggcttcacgacgtcgttgatgtagtcgaggctcgtggtgccgacctgagcgcccagcttcaggcccttcaggtccgcgacgctcttcgccttggcggccttggagctcttcagtgcgatgacggcctggcgcacgtcgtagtagccggaggagaagtccacggccttcttgcgctcggtgctgatcgagacctggttgatgtcgaagtcgaacgtcttctcaccgggtgcgaaggccttgttgaaggggacgctctgccacaccacgttccccttggcgtagccgagctgcttcgccacggcgtacgcgaccgcagactcgaagcccttgccgctggcgggcttgtcgtccttgaaccagggctcgtacgcgggctcgtcggtcgcgatcgtcagcttgccggaggtcttggtctgcaacgtgctcttcgcgcagctctccgcgctcgttccggaggccgtggctttgtcctccggctgcggggcacagcccacggcgacggcgagcagggcgacagtggcggcggacgcggtgcgacgcagggcgcgttgggcgagatgcatggcgggagagtggcagtgcggcgtcctgtttgtcgaggtcacgggggcaactgtccgcatagtgggaacgcgtgttgcatttttgtgaacgctcgtgggatcgggaccgggggcggacgcgcacgccggggccgccggccgagggcgggggtcgaaaggccggcggcccgttccgcgcaggagccgtcatcctgtgcggggctgtctccagtggactacgccagtgtgcgcgccgggagcgcgcgcgtgacaccggcgcgtgcgctcggttcacacggggcgcgtgacggcgtgcgcggtggcgagccctcgcgcgaggccgagggctcgtcgactcctgctgggcggcgggtggttcaccagccccgcgcgtgccactccggcaggtgcggccgctccgcgcccagcgtggtgtcgttgccgtggccggggtagacccacgactcgtccgggagcacgtcgaagatcttcgtctcgacgtcgcggatgaggctggcgaaggccttcgggtccttacgtgtgttgcccacaccgcccgggaagagacagtccccggtgaacacatgagggtgcccgtgcgggtcgtcgtagacgagggcgatcgagcccggtgtgtggcccaccagatggcgtgcggtcagctccacgcgccccactcggatggtgtcgccgtcgtcgaccgggacgtccgtcgggacggggatgccttcggcgtcgtcccggcccgcgtacgtacgcgcgcgcgtgaccgccacgacctcggcgagcgcctgccagtggtcgccgtgctgatgggtggtgacgacggacgcgatgccgtcgtcaccgatcatcccgagcagcgtcccggcctcgttggccgcgtcgatcagcaactgctcgtcggtggcccggcagcgcagcagataggcgttgttgtccatcggacccaccgcgatcttcgtgatcatcaggtcctgcagctcgtgcacatcggcagggccgccgaccttcaccgctccgctgtacgtcatgacgatcagcctatagcggggggagggcggggagtggtccgccgtcgacggtcagtgccgatccgtcgcgacgaccggcgagccagccgagcagatcggcctgacggccggtgacgacgagcggttctccctcgcggcggccggaggagatcatgcggccgtcgtcctgcttgaccaggagggcgggtacgtcggggtgcccccggaaccgttcggcgaggaagttgatctcgcgctgggtgaacccctccggaagatcttcgagctcgtacccgatgcccaggtccacatggtgcagctcgacctccacccaccgccggaacggcacccgggacgcggaatcggtgaccccgttccgcagctccaccgtgcgggaccagtccgcgggtacggccgcctcgtcctggaagcgggccccgctctcgcgtacatcggtgacctggacgtccagggggcgcggtgcgtcccgctcgatgtcggcgtcccggacatcggcggaggcgtacatcggacgtccggcgaggacgttcgtgagcgcgtccgcgttgcgggcgagatgggcgaggacgtgaccgcggctccagccgggcagccgtgacggctcggtcacacgggcgttgtccagtttggtggctgcggtgagcagccgttcggtcgcgtcacgtacagacgccaggtcgcgcacatgatcgttcatggggccgacgatagcggcgccacacgtttgggtgaaggtggctgagcggacccgtaaatcgaatgcgcgtgctatatggtcgagagtggcgtcgggcatgctggaaggtccgggattgttaccaaccaggtaaaccgaaccggcgctgtcagtggctccccctagtctgagaaagacgggggcctcggcccctgtcacttctctcaagaaaggtgcggaccggcgtggccgaccgtctcatcgtccgtggcgcgcgcgagcacaacctcaagaatgtctcgctcgacctgccacgcgactcgctcatcgtcttcacgggcctgtctgggtcgggcaagtcctcgctggccttcgacacgatcttcgccgaggggcagcgccgctacgtcgagtcgctctcgtcgtacgcccggcagttcctcggccagatggacaagccggacgtggacttcatcgagggcctctccccggcggtctccatcgaccagaagtcgacctcgcgcaacccgcgctcgacggtcggcaccatcacagaggtttacgactatctgcgtctgctgttcgcgcgcatcggcaagccgcactgccccgagtgcggccgcccgatctcgcgccagtcgccgcaggccatcgtcgacaaggtcctggagctgccggagggcagccgcttccaggtcctgtcgcccctggtgcgcgaacgcaagggagagttcgtcgacctgttcgccgatctccagaccaagggatacagccgtgcccgggtcgacggccagacgatccagctcagcgacccgcccacgctgaagaagcaggagaagcacaccatcgaggtggtcatcgaccgcctcacggtgaaggaaggcgccaagcgccgcctcacggactccgtggagaccgccctcggcctggccggtggcatggtcgtgctcgacttcgtcgacctccccgaggacgaccccgagcgcgagcgcatgtactcggagcacctgtactgcccgtacgacgacctgtccttcgaggagctggagccccgctccttctccttcaactcgccgttcggcgcctgccccgactgctccggcatcggtacgcgcatggaggtcgacgccgagctgatcgtcccggacgaggagaagtccctcgacgagggcgccatccacccctggtcgcacggacacaccaaggactacttcggccggctgatcggggccctcgcggacgcgttgggattccggaccgacatccccttcgccggtctcccgcagcgcgccaagaaggcactgctttacggccacaagacccagatcgaggtccgctaccgcaaccggtacgggcgcgagcgtgtgtacaccacgcccttcgaaggggccgtccccttcgtcaagcggcggcacagcgaggccgagagcgacgcgagccgcgagcgcttcgagggctatatgcgcgaggtcccctgtcccacctgccagggcacgcgtctgaagccgctcgtcctcgcggtcacggtcatggagaagtcgatcgccgaggtcgcggcgatgtccatcagcgactgcgcggacttcctgggcaagctgaagctcaacgcccgcgacaagaagatcgccgaacgcgtcctgaaggaggtcaacgagcggctgcgcttcctggtcgacgtcggcctcgactacctgtcgctgaaccgcgcggccggcaccctgtccggcggcgaggcccagcgcatccgcctggccacgcagatcggctccggcctcgtcggcgtcctgtacgtcctcgacgagccgtccatcggtctgcaccagcgcgacaaccaccggctgatcgagaccctggtccggctgcgcgacatgggcaacacgctcatcgtcgtggagcacgacgaggacaccatcaaggtcgccgactggatcgtcgacatcggccccggtgcgggcgagcacggcggcaaggtcgtgcacagtggctccctgaaggagctgctggccaacgccgagtcgcagaccggccagtacctgtccggcaagaagtccatccccctgcccgacatccgacgcccgcgcgacccgtcccggcagctcacggtgcacggcgcccgtgagaacaacctccaggacatcgacgtgtcgttcccgctgggcgtcctcactgccgtcacgggcgtgtccggctccggcaagtcgacgctggtcaacgacatcctgtacacacacctggcccgcgagctgaacggcgcgaggagcgtccccggccgacacacgcgcgtggacggcgacgacctcgtcgacaaggtggtgcacgtcgaccagtcgcccatcggccgcaccccccggtccaacccggccacgtacaccggagtcttcgaccacgtccgcaagctgttcgcggagacgaccgaggcgaaggtgcgcggctatctgcccggacgcttctccttcaacgtcaagggcggtcgctgtgagaactgctccggtgacggcaccatcaagatcgagatgaacttcctgccggacgtgtacgtcccgtgcgaggtctgccacggagcgcgctacaaccgggagaccctggaggtccactacaagggcaagtccatcgccgacgtcctgaacatgccgatcgaggaggccatgcacttcttcgaggccgtcccggcgatcgcccgccatctgaacacgctgaacgacgtcggcctcggctacgtccgcctcggccagtccgcgacgaccctgtccggcggcgaggcgcagcgcgtgaagctggccagcgagctccagcggaggtccaccggaagaacggtgtacgtcctcgacgagccgaccaccggtctccacttcgaggacatcagcaagctcctcgtcgtgctctccgggctggtcgacaagggcaacacggtcatcgtcatcgagcacaacctcgacgtcatcaagaccgcggactgggtcgtcgacatgggccccgagggcggcgccggcggcggtctcgtcgtcgccgagggcacgccggaggaggtcgccggggtgccgacgagccacaccggcaagttcctgcgcgagattctcgacgccgatcgcatcagcgacgcggcgtccgtgaaggccccgcgcaagacggccgccaggaagacggcagcggccaagtcgacgacgaagaagacggcgacggtcaggaccaccaacaacacggccaccaagaaggcggccgccgtgacgaagaagaccgcccccgcgaagaagaccacgcgggcgcgcaaggcctgaggcacactggcgaacaaggcctgacaagtccggaaaacgcggcgccccacgggaactccccgtggggcgccgtgcgttgtacggtcagccgccctgaccctgggctcgacgaaccgcatgtccgactggaccctgcaccctgcagcttgacaacatcacctagcggcccggcctcgaagtcaagactgaagtgaccgcgccggatctcacccgtcgcctcgaacccggcgagcctccgcccgtccgccaagaaggatctgcgcgtcgccaggatgcccacgtcaccagggactgttccggagtgccgtgctcccgccggcccggcctgacccggtctggcccggatccgcggaccgccccgccgatccggcccaccgacccgccgccggaccggctctagaacgcgcccagttcagaggcgtacggaggttccgcacccgcccgtgagcaggtgatcgccgccgcccgggcggcgaaccggagcagttcggtccagccctccgcgtccaagcccgcgagcccttccggagacagggcgtcgcgggcggccaggccgtgcagcagggccgcgttgacggtgtcgccggcaccgatcgtgtccaccacgtcgaccggttcacccggcacggagtgctccgcgccgtcccgggtgaagacggtcagtccgtcgccgccccgggtgagcaccacggccgaggggcccgaggccagccactcgcgcgggctgccgcccagccacgtggcgtcgtcctcggagagcttgagcagcgtcaccgacgccagccagctcttgaaacgcgcccgataggcgtccgggtcggggatcagtcccgcccggatgttcggatcgagcgtggtgaacaggccctgcgcggcggcgctccgcagcagttcctcgtaggcgctcgcgcccggctccaggaccagtgagcaggtaccgaaggacaccgcccgcgtggcgcccggcagccggtccggtgccgcgaactgccggtccgccgtgccgtcgacgtagaaggagtacgcggccgagccgtgctcgtcgatcgtggcgaccgcgagggtggtcggctcggccccgcgctgcaccgccgacacatcgacgcccgctgtgcgcagcccgtcgagcagggcctcaccgaaggcgtcccgcgaggtgcgggagcagaaggccgtgggggagccgagccggccgagggcgacggccgtgttgtaggggccgccgccgagtgccggcttgaggccggcgagcgcgcccgcgccctgcggtaccaggtcgatcagggcctcaccggcgacgacgatcacgagacgggtcccttctcggagctgtgggggtggtcggggcagccgcacgaggtgcggtggacgaacgtgctgggcaaccgcagggtgcgggagggccggtccggcgcggccagccggtccaggagcaggcgtacggcctgtgccccgatctccttgctgggctgggagatcacggtgagccggggtgcgaacaggtccgcccaggcgaagtcgtcgaagcagcacagcgccagatcgtccggcaccgacaggccgcgcccgcgcagcgcgcgcagggcgccgatggtcatcgcgttgttggcggtgacgagcgccgtggggggagccgcgagcgacagcagggcggtggtggcgcgctcggcgcccgccgcctcggagtcgccccgcgccacgagccgctcgtcgtgggggagcccggcggccgccaggccgtgccggtaaccggagagccgctcgttcgtggtgctcagcccgggcagcccggcgaccagaccgatgcgccggtggccgaggtcggcgagatgcgtgaccagccgggccatcggctcggcgttctcggcgccgacctggtcgaagcgggcggtgccgtccgaggggacgtcgaccagccggtcgaggaacacggtcggtacgtcgtgccgcccgaggtaggcgacgaggtcgcccgggtccgccgacggcgcgacgatcatgccgtccacgcgtcgttcgtgcaggagccggacgacccgctgctcgtgcttcgggtcgtcgtgcggatcggcgatgagcaggctgtacccgtgctccagcgcacctgcctcgacgccctggaggatctccgtgaagtacgggttgctgatcgccgacaccgcgagtccgatcgacctggtgcgcgaggtgacgagggagcgggcgagggtgttcggcgtgtagcccagttcgtcgacggcgtccaggaccgcctgccgggtgtggggcagtaccgggcgggtgtcgttcagcacgtgcgagacggtggccacggacacccccgcgcttcgcgccacgtcggccatggtcgccatcgtgtccccctccctgggccctgcggcaaggctcctcgggcctcatggccgggaacgtatctcattcggcggccgggcgtaaacgcttgcgcaagcgtttacgccgactctggccggcccggggcgcagtgatccatgccggtatcgtcgacggcacgtgccgacccctggtcacccccggtcggcatgcaccgccccctgaccagtggagatcctcatgcccggccgtcccgccgcgagccgtcgtaccgtccttcgaggagcggcgctcaccccggtcgccgggctcggcctcgcggcctgttcgtcgggagcggacggcggttggccggccacgcccaccgcgccggtcgagctgggcgcggagagcgagatccccaagggcgccgcgaagctgtaccgggacgcgaacgtcgtggtgagccgggccggggacgggtccctgaaggcgtacagcacgatctgcacgcacgcggggtgcgccatcaacaagctggcggggacgaccctcacctgcccctgtcacggcagcgagttcgatgccacgaacggcaaggtgctgcaggccccggcgaccgagccgctgcacgagctgtccgtcgaggccaggaacggcaagatcgtcgcgggctcgggcgcctaggtcattccgccgagggcccccggccctgggacggagaccccgcggacacgcctcagctcactcccagtcccacccgatccccacgatccccgaccgcaccctcggctcgaccaggtggaccgagcggtgttgtccgctcagcgacagctcctggcggccgctgcgcggggcggcggccgagtgctgggtgaaccggtggcagcgcaccggcagcgccgcttcgtcgaaccgcacctgaagcgcgtactgcccgccggggaagccgaacccgcgaacgtactcgctggacgggccggccgtgccgtcgtcgaagccgtagcggaagaggaacgtatctcctgagcgcagccgggtgtcgaagagcagctcggccaccagcacccccgtctcggggtgccggcgcacccgccccgtacggcagttctccagcgcgcgcaccgccatccgctccggagcgcaccccgggtcaccgtggtggacggccacatagcggtccacgccatccttgtgcgcacgcactatgtggtgcgaatcgcggcccagcagctcgcggtgggccccgatccgtacgcgttcgtggtggccgagggtgtgcagtccgccgtcgagcggcgaccccaactcggcgaacagtcgctccagcacccccgaagcctccaccagggagcggtacgaacggctcccgggacggtcggcgccgggttgctcgtcggccgtggcgagcagccggatcagcgactcgtccggcagctggaggatctcctccagcgcgcgtacggcccgcagcgactcggggcgctgcggccgccgggcgccctgctgccagtagctcaggctcgtcacgccgaccttgaccccgtaccgcgacagatggtgctgcacgcgctgcaagggcagcccgcgggcggcgatcgcggtgcgcagcgccacatggaagggtccgccgcgcagcgccgtctccaactcgtccgtggcgaggtccgcgtgctgtgtgccgtgccgcatgcagggggcctttctgtgagtgttcacgacggctggtcgggccgttcgcgtacggggtcgtcggggccgcccggtgggcgtgcggggcgtgctcgcaggtgggcgcggtgtgcggaccccgagttccaccgcattgaagcgtgttgcccaagctccgacaacacctgatgcgcaacctgctgaactgcggcgtccggatgcgctccctccttcgccggcgccctcgtggccgtcacctcgcacgtctttcacctcgacgacgtcctcgcatcgttgcccagcacctcccgaatggcccgagccgaccccggcatcggccgccgcccgtgggccacggcgacggtccgccgggcaggccccggccttgtccacagggtcgccgcgctgtcagcccccgccagtagggtgtgagacatggccgacccctccagctaccgccccaagccgggagagatcccggactcacccggggtctacaaattccgcgacgagcaccaccgggtgatctacgtcgggaaggcgaagagcctgcgccagcgcctggcgagctacttccaggacctggcgggcctccacccgcgcacccgcaccatggtcaccacagcggcgtccgtggagtggacggtggtgtccacggaggtcgaggcgctgcagctggagtactcctggatcaaggagtacgacccccggttcaacgtcaagtaccgcgacgacaagagctacccgtacctcgccgtgacgatgaacgaggagttcccgcgggtgcaggtgatgcgcggccacaagcgcaagggcgtgcggtacttcgggccgtacgggcacgcgtgggcgatccgcgacaccgtcgacctgctgctgcgcgtcttccccgtccgtacctgctcggccggcgtcttcaagaacgccgcccgcaccggccgcccctgcctcctcggctacatcggcaagtgctcggcgccctgcgtggagcgcgtctccgccgaggagcaccgtgaactcgccgaggagttctgcgacttcatggcaggccgcacgggtacgtacatccgccgcctggagcggcagatgacggacgcggccgaggagatggagtacgagaaggccgctcggctgcgcgacgacatcggggccctgaagaaggccatggagaagaacgcggtcgtgctcgccgacgcgaccgacgcggacctgatagcggtcgccgaggacgagctggaagcggccgtgcagatcttccacgtacgcggcggacgcgtacgcggccagcgcggctgggtcaccgacaaggtcgaggccgtcaccaccgcggatctcgtcgagcacgccctccagcagctctacggcgaggagaccggcgactccgtgcccaaggaggttctcgtccccgcgctgcccgaccccgtggagcccgtccaggaatggctcaccgggcgccgcggatcgatcgtgtcgctgcgcattccgcagcgcggcgacaagaagtccctgatggagaccgtgcagcgcaacgcccagcagtcgctcgcgctgcacaagaccaagcgcgcctccgacctgaccacccgctcgcgcgccctggaggagatcgccgaggcgctcgacctggacagcgcgcccctcaggatcgagtgctacgacatctcgcatctccagggcgacgacgtcgtggcctccatggtggtcttcgaggacggactccagcgcaagagcgagtaccggcgcttccagatcaagagcttcgaaggccaggacgacgtccgctccatgcacgaggtgatcacccgccgcttcaggcgctacctctccgagaaggagaggaccggcgagtgggccgacggtgacctgaaggacggtgagctgaaggacgacgagggccgccccaagcgcttcgcctacccgccgcagctggtcgtcgtcgacggcggccagccccaggtcgcggccgccaagagggcgctcgacgagctcggcatcgacgacatcgccgtctgcggcctcgccaagcgtctggaggaggtctggctgccggacgacggcgacccggtcgtcctgccccgcaccagcgagggcctctacctgctccagcgcgtccgtgacgaggcgcaccgcttcgcgatcacctaccagcgcaccaaacgcgccaagcgtttccgggcgagccccctggatgacgtggcgggtctcggcgagactcgcaaacaggcgctgatcaagcatttcggctcagtgaagaagctgcgatccgcgaccatcgaccagatctgtgaggttccgggcatcggccgcaagacggccgagacgatcgccgtggccttcgcccaggcggccccggccgtccccgccgtgaacacggcgactggagagatcatggaagacgaggaacccgggacgacggcgggttcctcccaggagcccgtgtccgcgggcacctcggacgagcgacgggggcaggagacatgaccgagcacgaagagcgccaagaagaacgctcagcgcagggccaggaagcgcacaaggaatcaggcgaggatcaggccccgcagcaagcggcacaggaaaacggagcacaggtgagtacgggcatcgaaacagccggggtccccgacgcggtcatccccgagctggtgatcatctccggcatgtccggagccggccggtcgacggccgccaagtgtctcgaggacctcggctggttcgtcgtcgacaacctcccgcccgcgctgatccccaccatggtggagctcggcgcccgctcccagggcaacgtggccaggatcgcggtcgtcgtcgacgtacgcggccgacgcttcttcgacaacctccgcgagtccctcgccgacctggagtcgaagaacgtcacccggcggatcgtcttcctggagtcctccgacgaggccctggtccgccgcttcgagtccgtgcgccgcccgcacccccttcagggcgacggccgcatcgtcgacggcatcgacgccgagcgcgagctcctgcgcgagctgcgcggcgacgccgacctggtgatcgacacctccagcctgaacgtgcacgagctgcgcgccaagatggacgcccagttcgcgggagacgaggagcccgagctgcgggccaccgtcatgtccttcggcttcaagtacggcctcccggtcgacgccgacctggtcgtggacatgcggttcctgcccaacccgcactgggtcccggagctgcgccccttcaccggcctcaacgaggaggtctcggcgtacgtcttcaaccagcccggcgccaaggagttcctcgaccgctacgccgagctgctccggctcatcgccgccggctaccggcgcgagggcaagcgctatgtgaccatcgccgtcggctgcaccggtggcaagcaccgctcggtcgccacgtccgagaagctcgccgcccggctggccgccgagggagtggagacggtcgtcgtccaccgggacatgggccgagaatgaccggacgtgctctgcggctgagcaggctgcgccgcatggcccccgaggagcgcggcggcaaggcccccgaggcgcgcggcggcaagccgcgccgccggggcgcccagcccaaggtcgtcgccctcggcggcggcatgggcctgtccgcctcgctcgccgccctgcgccggatcaccggcgacctcaccgccgtcgtcacggtggccgacgacggcggctccagcgggcgcctgcgcgacgagctgggcgtgctcccgcccggcgacctgcgcaaggccctcgcggcgctgtgcggcgacgacgactggggccagacctgggcccgcgtcatccagcaccgcttccagtcccagggagacctgcacgagcacgccgtcggcaatctgctgatcgtcgccctgtgggagcagctcggggatcacgtccaggccctcgacctggtcggcaagctgctgggcgcgcacggccgggtgctgcccatgtccgccgtgcccctggagctccaggcgctggtcaagggacatgacccggaccggcccgaggacatcgacaccgtccggggccaggcgaccgtcgcgctcacgcccggcgaggtgcagtccgtgcacgtcgtgccgcacgacccgccggccgtgcccgaggccgtcgcggcggtcctcgacgcggactgggtggtgctcggacccggctcctggttctcctcggtgatcccgcacctcctggtgcccgaactcctggacgccctctcgcagacgaaggcgcgccgggtactctcgctgaacctcgccccgcagcccggagaaaccgatggcttctccccgcagcgtcatttggaggttttgggacgacacgcccctaaactcgccctggacgtggtgctggccgacgaggccgccgtgcccgaccgagagtcgctcaccgatgccgccaagcggttcggggcagcggtcgagctggcgccggtggcccggaccgacggttctcctcggcacgacccggagctgttggccgccgcgtacgaccgtatttttcggatgcatggaaggatcggcccatggcgatgacggcagcggtgaaggacgagatttcccggcttcccgtcacccggacctgctgcagaaaggcagaggtctcggcgatcctgcggtttgcgggcggcctgcacctggtgagcggccggatcgtgatcgaggcggagctggacaccgcgatggcggcccgccgcctcaaacgggacatcctggagatcttcggccacagctccgaactgatcgtgatggcgcccggcggactgcgccgcggctcccgctatgtcgtccgcgtggtcgcgggcggcgaccagctggcccgccagaccggcctcgtcgacggccgtggccgtccgatccgcgggctgcccccgcaggtggtctcgggggccacctgcgacgccgaggcggcctggcgcggcgcgttcctggcccacggctcgctgaccgagcccggccgctcctcctccctggaggtgacctgcccgggcccggaggccgccctcgccctcgtcggcgccgcccgccgcctgtcgatcgcggcgaaggcccgcgaggtgcggggcgtggaccgcgtggtcgtacgggacggtgacgccatcggcgccctcctcacccgcctcggcgcgcacgagtccgtgctggcctgggaggagcggcggatgcgccgcgaggtccgcgccacggcgaaccgtctcgccaacttcgacgacgccaacctgcgccgctcggcccgcgccgccgtcgccgccggtgcccgggtgcagcgcgcgctggagatcctcgccgacgaggtgccggagcacctcgcggccgcagggcggctgcgcatggagcacaaacaggcctccctggaggagctgggcgcgctcgccgacccgccgttgaccaaggacgccgtcgccggccgtatccgccgtctgctggccatggccgacaagcgcgcgcaggacctcggcatcccgggcacggagtccaacctcaccgaggagatggcagacaacctcgcaggctgacgcgcgaggaacgacgcaggccgagagtccaacacgccggtgccgacacccacttgggtggtcggcaccggcgtttcgctgtctttgaggcgcccttgactcgatcatggagtgtcatgagcctggcatctgttcgctgctgtggcgaaccactgcaaggggggctcatgagacgaagagcgagatcgatcctcgctgccggcgcgctgctgctcgggggagcgggcatggcgcccatcgcccaggcggacagcggcagttcgcccaagccggatgcggacgccgtgaaggtgttccgcgccgaggtcacgaagcagcaggtacccctgctgctcgcggccgggcaggacggccatgaactcggtgcacaggcgccggagaagggcacggccacggtcgaggtctacctcaccgacaagcaggcccggaagctggagaagcagggtgtggagctcaccgagcacacactttcggccaaggccgaggcgcgtgtcgaggacgcggcgcagggcgtgttccgcccgtacagcggaaagggcggtctcgaggaggagatcgtcaggacgggcgcggcccaccccgacctcaccaaggtcgtctccatcggcaagaccctgaacggccaggacatcctcgcgctcaaactgaccaagggcgcgaagaagaccaaggacggcgccaagccctccgcgctgtacatgtccaaccagcacgcgcgcgagtggatcacgcccgagatgacccggcggctgatgcactactacttggacaactactccaaggacaagcgcatcaagaagatcgtcgactcgacggaactgtggttcgtcctctcggccaaccccgacggctacgactacacgttccagaactccgacacgcgtctgtggcgcaagaacctgcgggacgtcaacggcgacggcacgatcagcaccggcgacggcgtcgacctcaaccgcaacttctcctacaagtggggctacgacgacgagggttcgtcccccaaccccaccagccagacctaccgcggcgcgagccccggctccgagcccgagaccaaggccctggacgccttcgagaagcgcatcggcttcacgtacggcatcaactaccactccgccgccgaactgctcctctacggagtggactggcaggtggcgacgccgagcccggacgacatcgcctacaagtccctcgccggtacgccggacaactccgcggtcccgggctaccgcccgcaggtttcctcggagctgtacaccaccaacggcgaggcggacggccacgcctcgaacgtcaacggcatggcgatgttcacgcccgagatgtcgacgtgccagaccgcgtcggacatcgacccgaacgacacctggaacgcggccgactgccagtcggtcttcaacttcccggacgacgagaagctgatcaagcaggagttcgagaagaacatcccgttcgcgctctccgtcgccgagaccgccgcccatcccgacaagccgtcctccacggtgggcatcgacgcgcccgacttcaccccggcgacgttctccacgtcgtactcccgcggcgccgaccaggaggtctccgtcgtcgtacgcaagtccgtgcgcgacaaggagctcaagtaccgcgtcaacgccggccgcaccgaggacatggcgctcaaggcctggaagggcggcgagacgtacgggggcgacgacaacctgtacttcgacgagtaccgcaccaaggtccaggacggcgagccgggcgacaaggtcgaggtctggttcaccggcgagaccaggagcggcaagaagacgtccagtgcgcacttcacgtacaccgtggccgagcggccgaaggcggacaccctcgtggtcgccgaggagggcgcgaccgccacacaggcccagaagtacgtcgacgccctgaaggccaacggccacaaggcgctcgtctgggacgtcgccacccagggcgcgcccgacgcgctcggcgtgctcgaccacttcaagaccgtcgtccactacacgggcgcggcccggccgggcaaccccacccagctccagctgcgcgccttcctcaacgagggcggcaagctgatcgaggcgggcgagctggcgggcggcagcgtcgacctcggcgacggcaccctgtcgaacgacttcagccagtactacctgggcgcctattcgcgtacgtcgactccgggggccaacggcttcaccggctccggcaagctcgacgggtccacgggcgccctgggcgacgcgccgggcaacccgctgaacgcggcgggcacctacggcgtcacctcggacgagctgtccgtcgccacgtatccgcagttcgcgagcgccggtgcgggccagttcgccgggaccgtcaacccgtacggaccgcacgggggctcctccatggcggccgccgtccacaccgacgacgcctacaagcgactcacccgcaccatcgatctcaccggggtgggcgcggccgacaagccgaccctgcgcacccagctcctgtgggacacggagcccggctacgaccacgcggtgctggagatccacaccaccggcgccgacgactggacgaccctccccgaggcgggcggcgccaccggagccaccgtcccggcggactgtgaggcagggttcctcgtcgccgagcacccctggctcaagcactacctgaccgtggcggccggcggctgcaccgcgaccggcaccagcggctcctggaacagcttcaccggcgcctccaccggatggcagcaggtcggcttcgacctgagcgcgtacgccggcaagtcggtcgaggtctcgctgagctacatcaccgacccgagctccggcggtcacggtgtcctcgccgacgacgcctccctcgtcgtcggtggcaccgccacccaggcggagggcttcgagacctcgctcggggcctggagcgtgcccggaccgcccgcgggcagcccggccgtcctcaaggactgggcgcgctccggagcgctcttcaagacctacggagcggtcaccacgcgtgacaccgtgctgttcggcttcggcctggagcacgtcaccgcggcggccgaccgtacggcgctgatcgggaaggcgctgacggcgctgggtggctgactccggtcggtcaacggcagttggtgtcgtgtaaccgaaacgagtggtcaggcctcaaggacggggcggtccgtacccctactggtgggtacggaccgcctcgccgtgtatggggcatctcgatgtcaccacaggggcttcagggaggtagggtcgtaggcggtcggggacatcccatacaactcgccggcgtcgaatgccggcgtacctaacgaggagatcggttcgtgacgatccgcgtaggcatcaacggctttggccgcatcggtcgtaactacttccgcgcgctgctggagcagggtgcagacatcgagatcgtggctgtcaacgacctgggtgacaccgcgaccaccgctcacctgctgaagtacgacacgattctgggccgtctcaaggccgaggtgacgcacaccgccgacacgatcaccgtggacggcaagaccatcaaggtgttctccgagcgcaaccccgccgacatcccgtggggcgagctgaacgtcgacatcgtcatcgagtcgaccggcatcttcaccaagaaggccgacgccgagaagcacatcgccggcggcgccaagaaggtcctcatctcggctccggcctccgacgaggacatcaccatcgtcctcggcgtcaacgaggacaagtacgacccggcgaagcacaacgtcatctcgaacgcgtcctgcaccaccaactgtgtggcgccgatggccaaggttctcgacgagaacttcggcatcgtcaagggcctgatgaccaccatccacgcgtacacgaacgaccagcgcatccttgacttcccgcacaaggacctgcgccgcgcccgtgccgccgccgagaacatcatcccgaccaccacgggtgccgccaaggccaccgcgctggtcctcccgcagctcaagggcaagatggacggcatctccatgcgcgtcccggtccccacgggctcggccaccgacctggtcgtcgaggtctcccgtgaggtcaccaaggacgaggtcaacgccgcgttcaagaaggccgccgagggcgagctgcagggctacctgtcgtacaccgaggacccgatcgtctcctcggacatcgtcggcgacccgtcgtcctgcaccttcgactcggccatgaccatggtcatggagggcacctcggtgaagatcctcggctggtacgacaacgagtggggctactccaaccgcctcgtcgacctcacggtcttcgtcggcaaccagctctaagtcccggagcaggcacctcgatgtagagcagggctcgggcagcgcaaagccgcgctgtccgagccctgtctcacgtactgatcgatcagccctcccggatcaccagagccttcctaggagtcccttcatgaagacgatcgacgaacttctcgccgaaggcgtggacggcaagcgggtcttcgtccgcgccgacctgaacgtgccgctggccgacggcctcatcaccgacgacggccgcatccgcgccgtcctgccgacggtcaaggcgctggccgaggccggtgccaaggtggtcgtcgcctcgcacctgggccgccccaagggcgccccggacccggccttctccctgctgcccgcggcggagcggctcggtgaactcctcggcgcgcccgtcgcgttcgcccaggacaccgtgggccccgccgcccacgacgccgtgaacggcctccagcccggccaggtagcggtcatcgagaacctgcgcttcaacgcgggcgagacgtccaaggacgacgccgagcgcggcgcgttcgccgaccggctggcggccctggccgacatctacgtgggcgacggtttcggcgccgtgcaccgcaagcacgcctccgtgtacgacctcccggcacgcctgccgcactacgcgggctacctcatcgccaccgaggtcaacgtcctgaagaagctcaccgaggacgtcaagcgcccctacgtggtcgcactcggcggcgccaaggtctccgacaagctcgccgtcatcgaccagctgctcggcaaggccgaccgcctgctgatcggcggcggcatggcctacaccttcctcaaggccaagggctacgaggtcggcatctccctcctccaggaggaccagatcccgaccgtcaaggagtacatggagcgcgcggagaagaacggcgtcgagctggtcctccccgtcgacgtgctggtctccacggagttcccggacctcaagacgaaggccccggccaaccccaccaccgtcgccgcggacgccatcccggccgaccaggagggtctcgacatcggtcctgagacccgcaagctgtacgcatcgaagctcgccgacgcggccaccgtcttctggaacggccccatgggcgtcttcgagcaccccgactacgccgagggcaccaaggcggtcgcccaggccctcgtcgactcccaggccttcacggtcgtcggcggtggcgactccgccgcggccgtccgcatcctgggcttcgacgagacggcattcggccacatctcgaccggcggcggcgcctccctcgaatacctcgagggcaagacgctccccggccttgccgcactggaggactgaacaccgtgacttcgcgcatgccgctgatggcgggcaactggaagatgaacctcaaccacctcgaggccatcgcccacgtccagaagctcgccttcgccctggccgacaaggactacgaggcctgcgaggtcgccgtcctgccgccctacaccgacctgcgctccgtgcagaccctggtcgacggcgacaagctcaagatcaagtacggcgcccaggacgtctcggcgcacgactccggcgcctacaccggcgagatctccggctcgatgctggccaagctcaagtgcacgtacgtggcggtcggccactccgagcgccggcagtaccaccacgagaccgacgagatcgtcaacgccaaggtcaaggcctccttcaggcacggcctgatcccgatcctgtgcgtcggcgaggagctggaggtgcgcgaggcgggcaaccacgtcacgcacacgctcacccaggtcgagggcggcctcaaggacgtcccggccgagcaggccgagaccatcgtgatcgcgtacgagcccgtctgggccatcggcaccggcaaggtctgcggcgccgacgacgcccaggaagtctgcgcggccatccgcgccaagctcgccgagctgtactcccaggagctggccgaccaggtccgcatccagtacggcggctccgtgaagtccgggaacgtcgcggagatcatggcgaagcccgacatcgacggcgccctggtcggcggtgcctcgctcgacgccgacgagttcgtcaagatcgcgcgcttccgcgaccagtgagtatgcggtagcggcgatccgtcgtacccttgcgggggccgagggctctgaaagtgagcacgcacagagctcaccggaaaagcttcggcccccgttgtcgtccatccagttccgaggaagttggtccagccgtggttttggggttctcgatcgccctgatcgtcttcagcctgctgctgatgctgctggtgctgatgcacaaggggaagggcggcggcctctccgacatgttcggtggcggcatgcagtcgtccgtcggcggctcctcggtcgccgagcgcaacctcgaccggatcaccgtggtgatcggtctgttgtggttcgcgtccattgtcgtgctcggcatcctgatgaaggtcaacaggtaggtagtcgtgggctgacgccggcacgaccacgcatatcgcacgtaacgccccatgttcggtacgagtcttcggacgcggcctatcatggggcttgcgtctggagggcggggtgtaactccaatcactggacgcgcgttgggccttacgtagactgaggcgctcgcagcgaagcgtcacgccgactcgcttcgcggcaccatcacgcagggagttacgaccgtggcaagtggcaacgcgatccgaggaagccgggtcggggcggggccgatgggcgaggccgagcgcggcgagtccgcgccgcggctgcgcatctccttctggtgctccaacgggcacgagacgcagcccagcttcgccagcgacgcgcaggttcccgatacctgggactgcccgcgctgcggctttcccgccggacaggaccaggacaacccgccggacccgccgcgcaccgagccgtacaagacgcacctcgcgtatgtacgggagcggcgcagtgacgcggacggcgaggcgatcctcgccgaggcgctcgccaaactgcggggcgaaatctaggaattgagaaccggccgggcactgaggagtgcctggccggacgtgtttcgcacggcctcgccgctcgctgcgcggtcgactgtcagtggtgcccgttacggttcgcaggagtggaccgggagggggcgctgtgacgacggccgaggcgagtggtgtggcagcacccgcatggcgcgggggcttcgggcggctgtggagcgcggcagtggtgtcgcggttcggagacgcgctgcggaccgccgcgttacccctgattgccgtgcggctcaccgacgatcccctcgtcatcgcctccgtgaccgcctgcggctacgttccgtggctgctcttcggtctgctcggcggcgccgtcgcggaccgggtggaccagcgccgggccatgtgggccgtggacacggtacgcggggcactggtggcgtccttcgcgctcgccgtcgggctcggacacgcgtcgatcccgctgctgttcgtgctcgccttctcgctgaccaccctccagacgctcttcgacaacgcctccacggccctgctgccgtccctcgtggatcccgaggccctgggcagcgccaacgcgaggctgatgacgggccagcagctcgcgggcggcctgctcgcgagccccttcgtgccgctgttgctggccgccggggccgccgtgccgttcgccgcggacgcggtcacctatctgctggccgccgccctcgtggccttcctgcggatccgggcgcccgagcgggcgccacgcccggccggcagcaccctgcgggcggagatggccgacggcctgcgcgcactccggcgtgaccggccgctgcgcgcgatctgcgcggccaccctgctgtgcaacatcggcatgggcgccctgatcgccaccgtggtgctgcacgtgacgcgctggctgcacacggggaacgcgggatacgcggccgtgatgacggcgtactcggccggaagcctcgccggtggcttcgtcgcccagcggatcgcgaaccgcgtggggagagtccgcgccctgctcctgtgcgtcggcgtccagacctcgtccttggtgctcatcggcaccgtccgccagctcgccgccctgatcgtcggcatggcgctgctcggcgccatgggcatggtgtggaacgtcaaccaggtcacgctgatgcagcagcgcagcgagccgtccatggtcggccgcatcgccgcggccttccgcacggcctcgacgtccggcgccccgctcggcgccctgctgggcggcgccgtggcacaggtgtacgggctgaacgggcccgcgctgttcgcggccgtcctgttcgcgctggccggcaccgcgttgatacccgcgctcacgccggacgtacctgttgtcgagccggacgacggcgcgacgacagctcacgtcacgccctgatcaattaggttgggaccggcagcggggcaagggacgcagcagcacacgcaggaaagaaggcggaagtccgagatgaacgcagacagccgtaccaggctcaaccagaggcctgagtggaccgctctggccaagcaccgcgaagaactcgcgggcacccatctgcgggacctgttcgcggccgaccccgggcgcggtgccggatacaccctcgaggtcggcgatctgcacgtcgactactccaagcacctcgtcaccgacgagacgctgcggctgctgcgcgagctggccgccgcgaccgatgtgttcgggctgcgggacgccatgttccgcggcgagaagatcaacgtcaccgaggaccgcgccgtcctgcacacggcgctgcgcgccccgcgggacgcggtcgtcgaggtcgacggcgagaacgtggtgccggccgtgcacgccgtgctcgacaagatgagcaccttcgcggagcgcgtccgtacgggggagtggaccgggcacaccggaaagcccatcaagaacatcgtcaacgtcggcatcggcggctcggacctcggcccggccatggcgtacgaggtgctgcgctccttcaccgaccgttcgctgaccgtccggttcgtgtcgaacgtggacggtgccgacctgcacgaggccgtccgcgacctggacccggccgagacgctgttcgtgatcgcctcgaagacgttcaccacgatcgagacgatcaccaatgccacctcggcccgcgactggctgctgaccgagctgaaggccggtcaggaagccgtcgccaagcacttcgtggcgctgtcgacgaatgccgagaaggtgtcggagttcggcatcgacacggcgaacatgttcgagttctgggactgggtcggcggccgctactcgttcgactcggcgatcggcctgtcgctgatgatcgcgatcgggccggagcggttccgcgagatgctcgacgggttcaggatcgtcgacgagcacttcgagagcgcccccgccgaggacaatgtgccgctgctgctgggcctgttgggcatctggtacggcaacttccacgatgcccagtcgcacgcggtgctgccctacagccactacctgtccaagttcaccgcctacttgcagcagctcgacatggagtcgaacggcaagtcggtacagcgggacggcaacccggtggagtgggagaccgggcccgtcgtgtggggcactccgggcaccaacgggcagcacgcctactaccagctcatccaccagggcacgaagctgatcccggccgacttcatcggcttcgccgagccggtcgccgatctgctgcccggcctggtcgcccagcacgacctgctgatggccaacttcttcgcccagacgcaggcgctggccttcggcaagacgccggacgaggtgcgggccgagggcgtgcccgagcagctggtgccgcacaagacgttcaagggcaaccacccgacgaccacgatcctcgcgaaggaactgactccgtcggtgctcggccagctgatcgcgctctacgagcacaaggtgttcgtccagggcgcggtctggaacatcgactccttcgaccagtggggcgtcgaactcggcaaggtcctcgccaagcgcgtcgaaccggcactgaccgagggcgcggacgtgccgggtctggacgagtcgacgaaggcgctggtcgccaagtaccggcagctgcggggccggtaggcgggcggggagcgggcggcaggaggccgcccgctcccggagacccctctgcggccacccgccccacccgctccaccggctccacccccccccacgcgcaccacctgcaccacgcgcgcaccacctgcaccactcgccccctcgtgctccggacaacgggcgaggtgccgtgtggtggtcaggccaccgcgctcaacgtgtccgccagcctgcggcggcccgaccgtgccgcgggcagtgcggcgagcgcggcggcacccagcaccgcggccgtgccgaagagcagcaggagcaccggggacggcccctgggcgaccccggcgccgatgccgctcgacctcccctggacatcgatcagccagtgcgcgaggggcattccgagcgtgctgccgacgaggaccgcggccaaggcggtgcagcctgtggcggtgacggtgaccgcggtgatctgccgcggggacagcccgatcgccttcaacgccagcagatcccgctcgccctcgcgtatggtgccgccgatcgcggtgagcagttcgatgagcccgatcagggccagtacggcgatcagcccgaccacgacgccgcgcaggggagagagcccgtcggccggattcgtcacggggtggacgtcgaagcgcccgtgcgcggacgcggtcagctcggcggcgacccggtgcgggtcggcgtgggggcgcagctggagctggtagagggtcggccggagccccgggtcgttctcgcggagcgtgtcgagcgaggtggagatgacccgtccgccgttctccggctcgatgctgcgtcccacgatgtgcaggatctgcggctgcgcccccacggtcatccggacccagtccccgatgcgcacgtccagcaggtcgagcagcccctgaccggccaccgcctcgtcggggccgcgggcggggcggccctcggccagtgagaacgggtacgggtcccggcgcgtgccgagcccgcgcagcgcgatcgtgccggtctgccccgggaccagggccgcgacctcgacgcccggatggacggcggcgacccgcgggttctgggccagcagggtccgcgcgtccgggtcgctcagactctcgtccgcccggacggtgagcgcggcggcgagaccgatctgttcgggcctgctgtggaagcggtcgatggtggtccacgcgctcagcgccaccacgatcagcagcagcggcagggcgagccgggagacggtcgccagcgaacgcggccgccgcgtgaacgccttgtgccagcccaggaccagcgcgggcggcagccgcagccccagcacccggagcccgagcgccccgcgcgcgacacccgacaggcgcccgccgagcggagccgcggcccgcagtaccggcaccggagggacccggccggcccgccatgccgcgaggccggtcgtcgcaccgatgaagaggaccgccgccacgggcaccgcgaagagcgccgcggtatgtcccggcagcccctgccacacgcccacggcgtctccgagccggcccgggatcagccggcccagcgcctgggtgagtgccgcggcgaccaccgcgccgagcaacgcgaacgccaggtgctggagcaggaagatgcgcaccacctggcccggcgtgaaaccgatcgccttcagcacggagatgtcgcgcagatgaccgcggatacgggtaccgatcgcgccgtggacggccagggcggcggcgaccagcgcgccgagcccgaacaggccgagcacctgcccgagcagccggttgtcgccctgggccgcggcgcgtgcctggcgccagtcggacacctcgctgacggctccggaaccgaggacggtgacggcccgctggacggcgtagtccgtgtcctcgggatcgtccaggcgcaggccgatgacctggccgccgcgcccgtcggcgcgccgcacggtggacggcagcgaccatacgaggcccggctgctccccggggcggtaacgaggctcggcgctgtcggcgacgcccagcacggtcagcgtgcggacggtgcccggcagcgtgaggatgtctcccggctcggcccacagcgaccgggcgaggctgctctccaggacgacgccgtccggctcggcggggtccagccagcggccggcggtgagcagcgggcggccgctgccgggcggctcgaccgtgccccgcagctcgacggtggcgcgggtaccgcgcgactcgacggtcgtggcggcggtgggatacgggcccgacaccgccgcgacgccgtccagctcggcgagccgcgcggcgtcggccgacgggccggtgtggatccacacatgggcaccgtgcgactgcgtgaacacccgctgccaggggttggtggcgtagccgaacagcgccgcggcaagcagcagcgaggcgacgatgccggcggtggcgagcacgatgaacagcgcctcgccgcgatgcgtgcgcagatcggcttgcgcccagcgcagagtggcccgcacgccgcctcagcctctcggcccgggccggtgccgcggcgcgtgcacgccgggccggctcagcggaccgggtgtggtggggcggtgcgatccggccacgccgggccggtgcatcagtccgcccgcgccacggcggccgtaccgaccgggcaccggccacgggctcggctcgtgtgcgctcggccggtgtgcgctcggcccgtgtgcgctcggctcgccccagggctcacgtacgacggagcggtcccgctgcggatggtcgtgcacggctgatcagtccctcagttccagcacgccggatatcccggcgccgcgcgacggggtgccgtcgagttccgcgtcgtcggcgatgcgcccgtcgaagaagctgatcacccggtccgcggcgctcgcgagccgggcgtcatgggtgacgagcacgatggtctggccgcgctggtggaagcgggtcagcagccgcatgacctcgcgcgtgcccttgctgtcgaggctgcccgccggctcgtcggccagcagcaggggcgggtggttgaccagggcccgggccagcgccacccgctgctgctcgccaccggacagctcgcccggcatgctgcgctccttgccctcgaggcccagctcggcgaggagctgctcgcgctcggcgcgcgcccgcttgggagagaccccggcgagcagggccggcagctcgacgttgtcggcgaccgacaggttcgacaccaggttgaagaactggaagacgatgccgatacggcgcctgcgctccaccgcccagcgggcctcgccgtacgcgtcggtgcactcgccgtccagccagagggagccgctgtccggccgctggagcccgccgagcagatgcagcaaggtcgacttcccggcaccggacgggccggtgacggccacgaactcgccctgccgcacggcgaggtccaccccgcgcacggcgtacgcgggcgcaccctcgccgaagtgggtcttgaccagaccctcggcgcgcaccaaaggagcggtgtggctcactccagctcctccaactcctcctggcagcgctccagccagtcgaggtcggcctggagatgcagcatggcgccctcgacgagcaactgggcgatgcggttgtcccggttctcggccgcggcgagcttcgacagactgcgcatggtgttcaggtattggcgccgctgtttgttgatcagggcgatccggtcggcgagaccggtcgtcggggcgagcgcgagtttcatgaagaactcgtcccgcacccgcggctcgtccgccgtctcctcgtaccaggcgcgcagcgcctcccgcccggcatcggtgaggtggtagatcttcttgttgggccggctcgactgctcgacttcctcgccctcgatcagcccggacttctccaggcggccgagcgtcacatatatctggccgacgttcggctgagggtacgcggcacccagcatctgctcaaggtcctgcttgagctcgtagccatgggccgggccacgcgcaagcagcgccaggaggggcagccgcactcccgctctcctcctcgcgttcttgttctgtgccgcaggccggtgtgccgggggccaatgtgtcgcaggccctagtatcgcccatacctaacaggtatacatggcctctgactccgggcgacggtgcccggcgccggtgtacagggaggaacctatgcggtggatacacgccgccggtaggggcctcctggtcgcggcggtgatcctgaccggttacgtggcctcgggcacgcagtccgacgggccccgcgaaggcggtcgcggcccgctcacactggccaccgcgggcgacctcaccaactatctgggacccctgctcgacggctggaaccgcacccaccccggcgagcgggtcaccctcgtcgaactgccggactccgccgacgagacccacgcgcagatgacgaccgacctgcgcggcggcgaccggagccgcttcgacgtcctcaacatcgacgtcgcctggacctcggagttcgccgccgccggctggatcgcgccgctggagcggtcgcgtttcccgctcgggagtttcctgccgccggtcgtggacacggcgacgtacgacggaaggctgtacgccgtcccgtacgtcaccaacgccgggctcctcctgtaccgcaaggacgtcctcgccaaggagggtgtcccgccgccgcgcacctgggccgagctggagcggcaggccagggacatcgcccccaagtacgggctcgacggctacgccggccagttcctgccgtacgaggggctcaccgtgaacgccgccgaggcggtctactcggcgggcggcacgatcctcggtgacgagggcgaacgcgtcaccgtgaactccgccgcggcccgtgagggcatcgggttcctcgcccgcggcgtgcgcgacggctggatcccgaagacggcgctcgcgtacaaggaagaagagtccaagcaggccttccaggacggacatctgctcttcctgcgcaactggccgtacgcctacgtcggcgcgtcgggcaagggctccgcggtcgccgggaagatcggtgcggtgccgctgcccggacccgacggcccgggcgcgagtgtgctcggcggctccaatctcgcggtcaacgcgcatgcccggcatcccgggtcggccgcccgcctgatcgcgtacctcaccagcgagccggtgcagcggcaggtcctcaccaggggtgcgctgccgcccgtacgggcggcgctctaccgggacccggcgctgatccggaagttcccctatctgccgacgctgcgcgcgagcgtgctcgccgccgccccgcgtcccaagagtccccgttacgaccaggtcagcctggccgtgcaggccgtggtgcgcgacgcgatgacggggcacgagacgccgacaacggcggtacggcgactggcgcgggagctggcggacatctcgcaccgcggctgacccttcacgcggtcgtctcagctcttcttagttacatgttaggtatcgcgctgatctcgctgcggcctcaaaggcgtccataaaatggggcgtaagggaccaactttccgctgtttcctgcctactcgttgacacctcttcgacatgcctacttaacatgcatgcataaccgctggcacgaacagacaggtcgacgggtgtccctcaacacgcaccactggtggcgcgacgcagtgatctaccaggtgtacgtccgcagcttcctggacagcaccggggacgggatcggcgatctcgccggggtccgggccggactgccgtacctgaagaagctcggcgtcgacggcatctggctgagccccttctacccctccccgcagcacgaccacggctacgacgtggccgactactgcgacgtggacccgctcttcggcgatctcgcggagttcgacctgctgatgacggacgcccggcggctcggcatcaaggtgctcctcgacatcgtccccaaccactgctccagcgagcacccgtggttctcccaggcgctggactcggcgcccggcagcgcggcccgcgcccgcttccacatcgccgacggccgcggcccggacggggccgagccgcccaacaactggcacgccatgttcggcggccccgcatggtcccgcatcaccgagccggacggcacgcccggccagtggtacctgcacatgttcacgcccgagcagcccgatctgaactggcgcaaccccgaggtcggcgcccacttcgaccacgcgctgcgcttctggctggaccggggcgtcgacggcttccgcatcgatgtcgcggccggcctcttcaagcaccccgacctgcccgactcgcccgaccccgaggccgacgcccgcacccgcgactcggtcaacccgctggcctggaaccagcccgaggtgcacgacgtctggcggcactggcgcacggtctgcgaggagtacaccgcccgcgacggccgcgagcggctgctcgtcggcgaggtctccgtgcccaccgcgcgcgaacacgcccagtacgtacgccacgacgaactccaccaggcattcttcttcgacctgctgagcgcgccctggaacgacgacgccttccgcaaggtcatctccgaggccatgcaggacatcgccggcaccggctccaccgtcacctgggtgctcaacaaccacgaccaggtccgcacggtcacccgctacggcgaactcggcaccgagggcagcggtctgggcgccgcccgggcccgcgccgccgcactgctgatgctggcgctgcccggagccgcgtacatctaccagggcgaggagctcggccttcccgaggtcgtcgacctgcccgatgacgtgctgaccgacccgatcttccaccggaccggcagccgtgcccggatccgcgacggctgccgggtgccgctgccgtggtcggggcacgcctcgccgttcggcttcacccccggcgtcgagagcgccaagccgtggctgccgcagcccgcctacttcgccgagtacgccaccgaccgcgccctcgccgacacccgctccttctggcacctctaccgcgacgggctccacctgcgcgccggactgccccagctgggcgaagggacgctgcgctggctggacaccccgcccggcgtcctcggcttcgtccgcggcgacggcctggtgtgcgccgtcaacttcggtacggcccccacgcccgcgcccgtctccggcacccccctgctgtccagcggcccctgcgcgcccggcgtcctgcccggctcgacggccgcctggtggatcagcgactccaccaacccctgagtgactcccgggccctccggatctccgtcagttcttcacccctcgaagggacatcaacgatgatgcgacgacgtacgaccctgctcgccagctgcaccgccctcgccctggccctgggcgccaccgcctgcggaggcggccccgtcgccgcgggtggcggcggcaagtcgctcagcgggcagacgatcaccgtggccggtgtctggtccgggagcgagcagaagaacttccagaaggtcctggacgccttcaccgagaagaccggcgcgtcggcccggttcacctctaccggcgacaacgtctccacggtcgtcggcagcaagatcgagggcggcaacgctcccgacgtggtgatggtcccgcaggtcggcgtgctccagcagttcgcgaagaagggctggctcaagccgctctcccggaccgcccagcagtccgtcgacgccaactacgcgagtgtctggaagaagtacggcagcgtcgacggcaccctgtacggcctgtacttcaaggccgcccacaagtcgaccgtctggtacagccccgacgccctcgaccaggcgggcgtcaagccgccgaagacgtacgacgcgatgctgaaggccgggcacaccgtgtccgactccggcctcgcggccttctccgtcgccggacaggacggctggaccctcaccgactggttcgagaacatctacctctcccaggccggacccgagaagtacgacgccctggccgcccacaagatcaagtggaccgacccgagcgtggtcgaggccctcaccaccctcggcaggctcttcaaggacaagcagctgatagccggcggccagaagggcgccctgaacaccgacttccccggctccgtcgagaaggtcttcggacccgaggcacaggcgggcatggtctacgagggcgacttcgtcgccggcgtcgccaaggaccagttcgacaagaagatcggccaggacgccgacttcttccccttccccgcggtggacggcggcaaggcacccgtggtcagcggcggcgacgcggcggtcgtcctgaaggacggcaagaaccagaaggccgccacccggttcctggagtacctcgccacccccgaggcgtccgccgtctgggccggggccggcggcttcctctccccgaacaagaaggtcgacctcgcctcctacggcgacgacgtcacccgcgagacggccaagtccctgatcgccgccggggactcggtccgcttcgacatgtccgaccaggccccggccgcgttcggcggcaccaagggcaccggcgagtggaagctcctccaggacttcctgcgcgacccgtccgaccccaaggcgaccgccgccgagctggagcgcgcggcggccaaggcctaccaggactgatcgccatgaccgccaccctcgtgaaagagacgagccccccggccgccccccgggccgacggcaggcgccgggccaggcgccgcggccggatcatcgccctcgtcttcgtcttccccgccctgctcctgctcggcgcgctcgtcgtctatcccgtgctgttcaccgtcgggcgcagcttcttcgacgcctccggcacccggttcgtgggcggcgacaactacgccgagatgttccgcgaccccgccacgctcaaggccatccgcaacaccaccatctgggtggtcgtcgccccgaccctgctcaccgggctcggcctggtcctcgccgtgctcgtcgagaagatccgctgggcgacggcgttcaagctgctgctgttcatgccgatggcggtctccttcctcgccgcgggcatcatcttccggctcgcctacgacgaggaccccgacaagggcgtgctgaacgccgccgtggtcggcgtccacgacgccttcgcgggcacgtcctcctacccgaccgcccgtgcccgcgacggccagggcctgaccagggcaggcgacggctcgtacggtacggccgacggcgtgtcccccggccgcaccgtcagcctcggactggtcggtgtacgccccgacgacctgcccaaggacgcgaggccggcgtacacggccgccgggcgcacgtccgccccggacgaactgcgcggtgtcgtctacctggacttcacccccggcgggggaggccggcagggcaaggccgacaaggcggagagcgggctgccggggatgcgggtcgaggcggtgcgcgacgggaagacggccgcgcgcgccacgaccgccgccgacggctccttccgcttcggggacctgggctccggctcgtacacgctccggctgcccgcgtcgaacttcgcgccgccctacgaaggcgtctcctggctcggcccggcgctcgtcacgccggccgtcatcggggcgtacctgtggatctggaccggcttcgccatggtcctgatcggtgccggactggccgcgctgccccgggacgcgctggaggcggcccggatggacggggcgggggagtggcagatcttccgccggatcaccgtgccgctgctgggacccgtactcacggtggtcttcgtgaccctggtgatcaacgtgatgaaggtcttcgacctcgtctacatcatcgcgccgggaccggtgcaggaggacgccaccgtgctcgccacccagatgtggctcgtgtccttcggcggcggcaacaaccagggcctgggcagcgcgctcggagtgctgctcctgctgctggtcatcccggccatggtcttcaacgtccgccgtttccgagggagtcagcgatgaacgcgctcaggcgagggctcggcaacagcctgatacaggccttcctcgtgctggtcgggctgatctggctcaccccgctcgccggactgttcctgtcgtcgttgcggtccgcgcaggaccaggcgcgcggcggctggtggacggctctgaccagtcccgcacagctgtccttcgacaactactcggcgctgctgggcaatgcggggatgacgcaggcgttctggaacaccgtgctgatctccgtcccggcgaccacactcgtcgtcgtcatcgcggcgctcgccggatacgcgttcgcctggctggagttccccggccgggaggcgctcttcctgctcgtcgtggccctgttggtggtgcccgtccagatcgggctgctgccggtggccaaactcttcggccagctgggcctgttcggcacgatcccgggcgtcgtgctcttccacgtctcctacgggctgcccttcgcgatcttcctgctgcgcaactacttcgccgagatgccgcgggagatgctggaggccgcccgcatggacggcggcagcgagtggcgcatcttcacccggctcgtccttccggtcggccgcccggccatcgcgagcctcgcgatcttccagttcctctgggtctggaacgacatgctcgtcgccctgctcttcgccgacagctccgcacagccgctgacggtggaactccagtcgcagatacggcagttcggcagcaacatcgacgtactcgcgccgggggcgttcctgtccctggtggtgccggtggtcgtcttcttcgccttccagcggcactttgtgcagggggtgatggcgggctccgtcaagtagcgcgggacgaagacgaagggggcggcgaggcggaagaaccgccccaccgccccctcgtcgtgccgcagccagccgtcaggccagagccggcggatacagcgagcgcggcagctgcgaggccgccgccgcgtccagcagccacagggtgcgggagcggccgtgggcgccggccgccggggcctggagctcgcccgcgcccgacagggcgatggccgccgcctccgccttgtcctcgcccgccgccagcagccacacctcacgcgcggcccggatcgccggcagcgtgagcgtgatccgggtcggcgggggcttcggcgctccgtgcacaccgaccaccgtccgctccgtctcccgcaccgccgggtgctccgggaagagcgacgcgacatgcgtgtccgggccgacgcccagcatcaggacgtcgaaggtcgggaccgcgccatggttctcgggcccggccgccctggccagctcctccgcgtacgcggccgccgccgcgtccgcgtcggagccgtgcgggccgtccgacgcgggcatggcgtgcacccgcttggggtccagcggcaccgcgttcagcagcgcctcacgggcctgggtgtcattgcgttccgggtcgccctcgggcaggaaccgctcgtcgccccaccacaggtcgagccggccccagtcgatggcgtcccgggcgggctcggcggccagcgcggccagcaggccgttgccgttgcggccgcccgtgagcacgaccgaggcgtagccgcgggaggcctgcgcgtccacgatcttcgtgatcagccgggccgcggcggcctgcgccatcagctccttgtcgcgatgcacgaccagttggggagtactcactgcgggtctgccttcttgaccgggggcatctgggccggagacggacggccgacctcgctgtcgcccgccggggaggccggcgcgggagccgacgcggccgtccggctgggctcagccgattcctgcaccggccggaccgggagtggcgtcgtggcctgtgcgggagcctcggaccttcgcgaggccgagtgggtcccgccgagccggtccaccccgaaccggagcgccgacgcgtaggtgtcgtccggatcgagcctgcgcagctcctccgcgagcaacccggacgtttcgcggcgcttgagcgccaccgcgcggtccggctgccccggcagcgccagcgtggccatcgttccgtccgaccggtgcagcgtgatggggccaccggtcgtttccatccggacctgggtcaggccgggaccggcggagatcacgcgccggacgtgcacatggagccggtcggcgagccacatggccagcagttcgacgctcgggttgaactcctcgcccgccacctcggcggagatgacctcgcagttgatctggtcgagggcggcggccagcatcgagcgccacggggtgatccgggcccacgccaggtcggtgtcccccggctcgtagctctcggcgcgggcccgcagctcgtcgacgggcttctccgccgcgtagctgtcggtgacccggcgctggcccagggcgccgagggggtcgctggccgggtcacgcggggcgtccaccgaccaccagaccaccacgggcgcgtccggcagcagcagcggcaggacgacggactgggcgtggttcgcgacctcgccgtacaggcgaaggacgaccgtctcgccggtgccggcgtccgcgccgacccgtacctcggcgtccagacgcgacttcgtgcggtcccggggcgagcgcgagacccgcttgacgaccacgagcgtgcgcgaggggtgcgcgcgcgaggcgtcgttggcggccttcagggcgtcgtaggcgttctcctcgtcggtgacgatgaccagggtgagcaccatgccgacggcgggcgtgccgatggcgcggcgggcctgcacgagccccttgttgatcttgctggcagtggtgtccgtgaggtcgatcttcatgggcgacgccagctccgtccgtctcgttcgagcatttcgtccgcctcgacgggaccccacgtgcccgcggggtactgcgcgggcttgccgtgcttgtcccagtgctcctcgatcgggtcgaggatcttccaggacagctcgacctcctcggtgcgcgggaagaggttcgagtcgccgagcagcacgtccagaatcagccgctcgtacgcctccgggctggactcggtgaacgactcgccgtacgcgaagtccatcgagacgtcccggatctccatcgaggtgccgggcaccttggagccgaagcggacggtgatgccctcgtcgggctggacgcggatgacgatcgcgttctggccgagctcctccgtcgccgtgtggtcgaagggggagtgcggggcgcgctggaagacgaccgcgatctcggtgacgcggcggcccaggcgcttgccggtacggagatagaaggggacgcccgcccagcggcggttgtccacctcgagcttgacggccgcgtaggtgtcggtcttcgacttggggtcgatgccgtcttcctggagatagccgacgaccttctcgccgccctgccagccggccgcgtactgtccgcggacggtgttcttgctcaggtccttcggcagcttggcggcgccgagcaccttggtcttctcggcggcgagcgcgtccgcgtcgaaggaggcgggctcctccatggcggtcagtgccatcagctggagcaggtggttctggatgacgtcacgggcggcgccgatgccgtcgtagtagccggcgcggccgccgataccgatgtcctcggccatggtgatctgcacatggtccacgaaggaccggttccagatcggctcgaacatcgtgttggcgaagcgcagcgccaggatgttctggacggtctccttgcccaggtagtggtcgatgcggaagacctggtccgagccgaagacctcgtggacgatcgcgttgagctcctcggccgacttgaggtcgtgtccgaagggcttctcgatgaccgcgcggcgccaggagccgtccgactggtcggccaggccgtgcttcttgagctgctggatgaccaccgggaaggcggacggcggcacggacaggtagaaggcgaagttgccgcccgtgccctgtgccttgtccagttccccgatggtgtcgcgcagccgctcgaaggcgtcgtcgtcgtcgaaggtgccctggacgaagcgcatcccctggatgagctgctgccagacctcctcgcggaactccgtacgggcgtgttccttgacggcgtcgtggacgacctgggcgaagtcctcgtgctcccagtcgcggcgggcgaagccgacgagcgagaagcccggcggcagcagcccgcggttggcgagatcgtacacggctggcatcagctttttacgtgacaaatcgcccgtgacgccgaagatgaccaggcccgacggccccgcgatacgcgggagccgtcggtctgcggggtcacgcagcgggttgctgctcgacaaggtttcagccctccgagggggcgaggcgctggagctccgcctcggtcgacttgagcaggtcgttccaggacgcctcgaacttgtcgacgccctcttcctccaggagctggaccacgtcgtcgtacgcgatcccgagcttctcgacggcgtcgaggtcggcgcgggcctgctcgtacgtgccggcgatggtgttgccccggatctcgccgtggtccgcggtggcctccaaagtggcctccggcatggtgttcacggtgttcggcgcgaccagttcctcgacgtacatggtgtccttgtacgccgggtccttgacgccggtggaggcccacagcgggcgctgcttgttggcctgcgccttgtcgagggcgagccagcggtcggtggagaagaccgcctcgtacgcctcgtaggcgagccgggcgttggcgaggcccgccttgccgcgcgcggccttggcctccggcgtgccgagggcgtcgatccgcttgtcgatctcggtgtccacgcgggacacgaagaaggacgccaccgagtggatcttcgacaggtccaggccgcgctccttggccttctccaggccggcgaggtaggcgtccatgaccatgcggtagcgctcgagcgagaagatcagcgtcacgttgacgctgatgccgaggccgatgacctccgtgatcgccgggatgcccgccttggtggccgggatcttgatgagcgtgttggggcggtcgaccagccaggccagctgcttggcctcggcgaccgtcgccttggtgttgtgggccaggcgcgggtcgacctcgatcgagacccggccgtcctggccgtcggtggcgtcgaagaccgggcgcaggatgtcggcggcgtcgcggacgtccgccgtggtgatcatgcggatggcttcttcgacggtgacccggcgggcggcgaggtcggagacctgctggtcgtaaccgtcgccctgagagatggccttctggaagatcgacgggttggtggtgacgcccacgacgtgctgctggtcgatcagttcggcgaggttgccggacgtgatccgcttgcgcgacaggtcgtccagccagatcgcgacgccttccttggagaggcgcttgagtgcgtctgtcatggaaaatgcatctcctacgtgtcgtatatcagcgtcagcgctgggctgcggcgatcgattcccgggcggcgtcggcgacgttctcgggagtgaaaccgaactcccggaagagcaccttgccatcggccgaagcaccgaagtgctccagcgaaacaatgcgtccggcgtctccgacgaaccggtgccaggtaagaccgatacctgcctcgaccgcgacccgcgccctcaccgacggcggcaggacgctgtcccggtacccctggtcctgctcctcgaaccactccacggacggcatggacaccacccgggtcggcacgcccgcggcctggagctgctcgcgcgcctcgacggcgacgtgcacctcggagccggtgccgatgagaatgacctcgggagcgccgccctcggcctcgaagagcacgtaaccgcccttggccgcgtcctcgttgggctcgtacgtcggtacgccctgacgggtcagcgcgaggccgtgcggggcgcccttgccgaacaccttggtgtagcgcttgaggatctcgcgccaggcgatcgccgtctcgttggcgtccgcgggacgcacgacgttgaggccggggatggcgcgcagcgaggcgaggtgctcgacgggctggtgggtggggccgtcctcgccgagaccgatggagtcgtgggtccacacgtacgtcaccggcaggtgcatcagcgcggagaggcggacggcgttgcgcatgtagtcggagaacaccaggaaggtgccgccgtagatacgggtgttgccgtgcagcgcgatgccgttcatctccgcggccatggagtgctcgcggatgccgaagtggatcgtgcggccgtacgggtcggcctccggcagcgggttgtccgccggcaggaacgaggagttcttgtcgatcgtggtgttgttcgagccggccaggtcggcggagccgccccacagctcggggatgaccgcgccgagtgcctggaggaccttgccggacgcggcacgcgtcgcgatgcccttgcccacctcgaagaccgggagcttctcctcccagccggccggcagctcggtcgcggcgatgcgctcgtactcggcggcgcgctccggctgggcggtgcgccaggcggcgaagcccttctcccactcggccttggcctcgcggccgcggtcgagggcctcacgggtgtgggcgaggacctcctcggcgacctcgaagctcttctccgggtcgaagccgaggacgcgcttggtggccgcgacctcgtcctcgccgagcgccgagccgtgcgcggcctcggtgttctgcgcgtgcggcgcgggccaggcgatgatcgagcgcatcgcgatgaacgacggcttgtccgtgaccgccttggcggcctggatcgcgtcgtagagggcgtgcgggtcgaggtcgccgtccggcttcggggccacgcgctgcacatgccagccgtacgcctcgtagcgcttcaccgtgtcttcggagacggccgtctcggtgtcgccctcgatcgagatgtggttgtcgtcccacagcaggaccaggttgccgagcttctggtggccggccagcgaggacgcctcgtgggagatgccctcctggaggcagccgtcaccggcgatcgcgtagatgaagtggtcgaacggggaggtgccgggtgcggcgtccgggtcgaacagaccgcgctcgtagcgggaggccatggccatgcccaccgcgttggcgacaccctggcccagcgggccggtcgtcgtctccacgccgggcgtgtgcccgtactcggggtggccgggagtccggctgccccaggtcctgaaggacttgaggtcgtccagctccaggccgaacccggccaggtagagctcggtgtagagggtcagggacgagtggcccgcggaaaggacgaaacgatcgcgcccgacccagtcgggatccgccgggtcgtgccgcatcaccttctggaagagggtgtacgcggcaggcgcgaggctcatcgccgtaccgggatggccgttgccgaccttctgtacggcatcggcggccaggacgcgggcggtgtccacggcccgctggtccaactcggtccactcgaggtctgtggtggtcggcttggtgctcaccctgagtcagggctcctctccacatgttccacatgtcatgccgatgtgcttggcgcccaccggccgctgtcgagcctacccccgtaagtacgtgcgttttttcgagtcattccagactgccgggactctccgggatccgcctcccgaccggtccattccgcattcggcaggtgaatacggagccgctcgtccgagtgctcaattgagtggtgatcggctcttcggaagatgtcgtaccgagcggcctcggacgcctcggccgacctccggatcagccctccgcgcggtgcctcccaacacgagcccacccccgcgaaggccggggtctgggcaacgtctacagtggcgtggtacgcgcgagcctttaccgggagttcacacccggaggcttgctgggatgtctctgtcaggggtgtacgtgacggccgtcgaatcccgtccaccgggagtgctcaccacgagcagcagccggggccagcggccgtttggggcccgtgtaaaggcgttcgtggcgctgaccaagccgcggatcatcgagctgttgctgatcaccaccgttccggtgatgttcctggcggagcaaggggttccgagcctgcgcctcgtcctgctgacctgcctcggcggctacctctccgcgggcggcgccaacgcgctgaacatgtacatcgaccgtgacatcgacgccctcatggagcgcacctcgcagcggccgctggtgaccggcatggtcagcccgcgtgagtgcctggccttcggcatcacgctggcggtcgtctccacgctgctgttcggtctgaccgtcaactggctgtccgcctggctgtcgctcggagcgctcctcttctacgtcgtcgtctacacgatgatcctcaaacggcgtacgtcgcagaacatcgtgtggggcggcatcgcgggctgcctcccggtgctcatcggctggtcctcggtcaccgactcgatgtcctgggcgccggtcatcctcttcctcgtcatgttcttctggacgccgccgcactactggccgctgtccatgaaggtgaaggacgactacgcgcgcgtgggcgtgccgatgctgccggtcgtcgcctccaacaaggtggtcgcccgccagatcgtgatctacagctgggtgatggtcggcgtctcgctgctgctcaccccgctcggctacacgggctggttctacaccctggtcgccctgctggccggcggtttctggctgtgggaggcgcacgggctgcagaaccgcgccaaggccgaggtgacgggcggcaagctcaaggagatgcgcctgttccactggtccatcacctatgtgtcgatcctcttcgtcgccgtcgcggtggaccccttcctccgctaggaccccttcctccgctaggacaccttctgagggagcgtggtcaaggccacgcacccctcccgtcgccgttcgatctacccgtcggtagcatcctggccatggcagacacgcagcaggttgacgagggcaccgacgccaagcaggccgccagggccgagcgcaaggcggccaagctcgccaaggagatcaacgccttcgccaagacgcacggcggggccgaggcgcatgtggcgtacatcgggcaggccggcacccggatcgtgctcgtcggcgaggacgacgcctggggcgacctcgtcgcacccacgtacgccgtcgccgagcaggcggtggagaaggccggcgtcacggttcacgaggcgttcgacggcgaattcgcggccaaggtgaagaccgggccgtacgagtggacgcgcatggcggggatccaggtgggcggcccgagcaacggctgacaccgcgaccgccgcacggtcgcggccgcacggccggcacgcgtcggccggaccccgcggtgtccggccgacaaccatcggacgttcgcacggggtgtgcatgaccaacacctgacgcccggttcacccgttaggacctgaagaggcacggtccagtcgcgggggagttgggatgatcgaaacgccgtccctggtggaccagtactgccacggcgtactgcgtacggagctgggtctcggcaccttcgaggcccacctcgcccgtaccgagggcccgcccgcccccggcaccaccctgttcgacacccagacgggtttcgcggtacgccgctggtgtccgccgctgctcggtctggagccgcactgcccgccggcccgctatctggcccgacgccgtgaactcggcgttctggaatcgggccgcaggctgctgcgcggcagcggcatcaccacgtatctcgtcgacaccgggctgcccggcgatctcaccggacccggcgagatggcctcggccggggccgccgacgcgcacgagatcgtccgcctcgaactgctcgccgaacaggtcgccgacacctccggcaccgtcgagtcgtttctcgccaatctcgccgagtccgtccacgggaccgccgccgacgccgtggcgttcacctcggtcgcgggcgtacggcacggactggcgctcgcgcccgagccgccggggccgggggaggtgcggggcgcggcggggcgctggctcgcgggccggagggtcggcggcccgctgtcggacccggtcctgctgaggcatctgctgtggatcgcggtggcctcgggccggcccctgcaactgcactccgggctcggcgaaccagggctgcgcatcgaccgcaccgacccggtcctgctcaccgacttcgtccgggccaccgccgggctcggcacggacctcgtcctgctgcacggctatccgtaccaccggcacgcggcacatctggccggcgtcttcccgcatgtgtacgcggacctgggcgcggcgctggtgcggacgggggcgggggcggcggccgtgctctcggagatcctggagctggcgcccttcggcaagattctcttctccagcggggcacatggtctgccggaactccatgtggtgggcgcacatctcttccgtgcggcgctcgcacgggtgctcggcgcctgggtcgccgagggggcctggtcgctggcggacgcacagcgggtggcagggctcatcgcggcgggaaacgcgcggcgggtctacggggtggagtgaaccctcttcaccggaacaccagctgacttcagactgtgcggatgaccgatgacgccacggctcgtctcctcgaccgcttcctcgccgatctgcgcgccctcgccccggtcgccgtgtgggcgcacggttcgctcgccggcggcgactaccaggagggccgcagcgacctcgacctgatcgcagtcctggagggtccggtcccgctcggcaccgtgcgcgaggtggcgcggctgcaccggcggctgcgcgccgacgaggcgctcgccgagaagctgcactgcagctatctgacgccggacaccgtggccggcgcggagcggtcgcatctcacctgggcgcacgaccgcctgatgaagcgcccggtcactccggtcacccgccgggaactgcacgccttcggcctggtcctgcacggcgaaccgccgaaggacctgctcccgcccaccccggaccgcgaactcgacgccttcgtcgtacgggaccagaaggagttctggcggcccgcggtgcgcaaggcccggctgtggaagcagtccgtctgggtcgacctggggatggtcaccttcgcccgtgcgaccgtcaccctgcgggagggccgcctgatctccaagaaggaggccttggcggcacttcccggactgggggcgcccgccgacgtggtcgaggacatcgggcggcggagatacgcggaccccgcgccgcccacggaggagtggacggcacgccgggccgagctcacgagggcctacctgggccccgccatcgacggccttgtcgccacctacgaaccgctcacgcgcgcgtgagcgccgactccgtcgaaggacccggcaggtccgccacggcctcgggacgttcgcgcagcgacagcagcacccggagcacgccgatccagaccaggcaggagccgagcatgtgcagggcgaccagggcctcggggaggtccgtgaagtactggacgtaaccgatgacgccctgcgcgaggaggatcaggaacaggtcgcgggtgcggtgcagcgggcccttgggggcgtcgaccgccttgagcacgaaccacagggcgaaggtcagcgtcaccacgatccaggccaggacggcgtgcagcttgctgacggtctcccagtccagcggcatgcgctcgacgtcgctcgagtcacccgcgtgcggacccgcaccggtgaccaccgtgccgaccgcgatcagcagcacggaggcggtgaccaggaaccacaccagctgctggacggccttgccgaccagcgggcgcggtgccccgtcgccctcgcaggcgcgctgccacatgagcgtggcgacggcgatgagcgccgtggagagcaggaagtgggccgcgaccgtgtaggggttgaggccgaccaggaccacgatgccgccgaggatcgcgttgctcatgacgatccagaactgcgcccagccaagccgggtgagagagcgccgccacggcttctgcgagcgcgccgcgatgatcgcccagccgaccgccgcgcacagcacgtacgtcagcatgcggttgccgaactcgatgacgccgtggaagcccatcgcgctggtggtggtcagcgagtcgtcggtgcacttgggccaggtcgggcagccgagcccggacccggtcagccgcacggcaccgccggtgaccacgatgaccaccgccatgacgagcgcggcgagggccgcgcgccgaaccgtccggggggccggagtccagcgttcggcgatgagggcgagggggttgcgcgcggcggcgagggcatcggcacgggtcacgtttggcacgcgcaccatcgtaggcgggacgcttgtgcacggtttcacgagggtccgctccgccacgccgggtgctcctggggagctactcccagcggaagaacttcccggccgccgccagccccacgactccccacacggcgaggatccccagatccccccacggcatccccgccccgtgttgcagcacgtcccgcagcccgtccgaaagggccgagatcggcagcaggccgaggacgtcctgcgccgcgtccgggaacttgtccagcgggacgatcacaccgccgcccaccagaaggagcagaaagaccaggttcgccgccgcgagtgtcgcctccgccttcagcgtgcccgccatcagcagaccgaggcccgagaaggcggctgtgccgaggatcagcagcagcaggacggccagcgggttgccgtgcggtgaccagcccagggagaaggcgatcgccgtcagcaggatcacctggaggagctctgtgacgagcaccgacgccgtcttcgcggccatcaggccccagcgggggaggggggaggcggcgaggcgcttgaggaccccgtagcggcgctcgaagcccgtcgcgatcgcctggcccgtgaacgccgtcgacatcacggcgagggcgaggatgccaggggcgaggaagtcgacggacctgcccttgccggtgtcgacgatgtccaccgagctgaagaggaccagcagcagcgtcgggatgaccaccgtcagcagcagctgctcgccgttgcgcagcagcatcttcgtctccagcgccgcctgcgccgcgatcatgcggggcagcggggcggcgccgggcttcggcgtgtacgtaccggcgatggtcacgaacgcagctccttgccggtcagttcgaggaagacgtcttcgagagtgtgccgctccaccgagatcttctccggcatcaccccgtgctgcgcgcaccaggaggtgacggtagccaggagctgggggtcgaccttgccgcccacccggtacgcgcccggtgtcagctccgcggccgtgcagtccgccgggagcgccttgagcagcgagccgacgtcgagcccggggcggcccatgaagcgcagcgtgttctcggcgccaccgcggcacagctcctcgggagagccctgggcgacgacccggcccccgtcgatgatcgccacgtcgtcggcgagctgctccgcctcgtccatgtggtgggtcgtgaggacgaccgagacgccgtccgcacgcaggtcgcgtacgaggtcccaggtcgcccggcgcgcctgcgggtccaggcccgccgtcggctcgtccaggaagaccagttccggacgccccaccacggccatcgccagcgcgagccgctgctgctggccgcccgacagacgccggtacgccgtccggccgcagctgccgaggccgagacgctcgatcagcgcgtccacgtccagggggcgggcgtgcagcttggcgacatggcgcagcatctcgtccgcccgcgcgccggagtagaccccgccggactggagcatcaccccgatgcgcggccgcagcgcggaggcttcgcgcaccgggtccaggcccaggacgcgcaccgtgccggagtccggcctccggtacccctcgcaggtctcgaccgtggtggtcttgcccgcaccgttggggccgagcacggcggtgacaccggccccggccaccaggtcgaggctgttcaccgcggtcttgtcgccgtaccgcttcaccagggcctggacctggacgacggggtcactctgcatgagcgccaagtctagggacgcggccgacggcctcggtgggcggggccccgcagcccctcgtcacccggacggtgcagtgccggccaccgtttcgcgtccgccacggggaacaggcgtacgtccgccgcgccgcgtacgacggaacggtcccgttcgacgtcatggcccagccagatggaagctcgcgcacgtgtcgtagcccgcgccgaggagcagcacccgggcccccaacttcgccagtccggccgacgggctgcgctcgccgagccggcagtcgggcgcgtggccgtcgagctgggtggcgaccgtgttccgagtgacgagtgggccggtcggagggggtgcggacatggccggggagtcttcccgacagcctcctccgccgccgccggattgatcgatcagagatcgttttcgcaggtcagtttaggtatgcctaagtgacgcagcgcaccgcccggccggacgggcgcgggttgtcaggccctgaggaattacgcaacaatggcgttgtgaaaaacgtcggcgaggcacgggagacccccacgggggcccctcaggaggaactcgcgaccggtgagcgctccacgcgcaaccgtgtcgtgcgctccatcctggaccacgggccgtcgaccgtcgccgagctggccggacgtctcggtctcacccaggccgccgtccgccgccatctcgacgcactggtcaccgacgacatcgtgcagccgcgcgagcagcgggtctacggggcgcgtacgcgcggccgtccggccaaggtcttcgccctgaccgactgcggccgggacgccttcgaccagtcctacgacaagctcgccgcggacgccctgcgctggatcgccgagcgcgagggcggggaggaggcggtcgccgccttcgcccgcgcccggatcgccgcccaggccgccgcgtaccgcgcggccgtcgaggccgccgcgcccgaggagcgcaccgaagcgctggccaaggccttgagcgcggacgggtacgctgctacggcgcgcagcgcaccggtcggtgagcagctctgccagcaccactgcccggtcgcgcatgtggccgagcagttcccgcagctgtgcgaggcggagaccgagatcttctcccagctgctcggtacacatgtccagcggctggcgaccatcgcgcacggtgacggcgtctgcacgacgttcatccccaagatttccaagaccgatcacggccacaacgcatccgcaagcaccgccgggaggaaccccgcatgacgctccccatcgaggagaccgcccaccccgagctcgagggtctgggcacgtacgaatacggctgggccgactccgacgtggccggtgcctctgccaagcgcggcatcaacgaggacgtcgtccgcgacatctccgcgaagaagaacgagccggagtggatgaccaagctccgcctcaagggcctgcgcctgttcgagaagaagcccatgccgaactggggctcggacctctcgggcatcgacttcgacaacatcaagtacttcgtgcgttccacggagaagcaggcggagtcctgggaggacctgcccgaggacatcaagaacacgtacgacaagctcggcatcccggaggcggagaagcagcgcctcgtcgccggtgtcgcggcccagtacgagtccgaggtcgtctaccaccagatccgcgaggacctggaggagcagggcgtcatcttcctcgacaccgacaccgccctgaaggagcacccggagctcttcaaggagtacttcggcacggtcatcccggtcggcgacaacaagttcgcgtcgctgaacaccgcggtgtggtccggcggctccttcatctacgtgccgaagggcgtgcacgtcgagatcccgctccaggcctacttccgtatcaacacggagaacatgggccagttcgagcggaccctgatcatcgtcgacgaggacgcctacgtccactacgtcgaaggttgtacggcgccgatctacaagtcggactccctgcactccgcggtggtcgagatcatcgtgaagaagggcgcccgctgccgttacacgaccatccagaactggtcgaacaacgtctacaacctggtcaccaagcgcgccgtggcgtacgagggcgcgaccatggagtggatcgacggcaacatcggctccaaggtcaccatgaagtacccggccgtctacctgatgggcgagcacgccaagggcgagaccctgtccatcgccttcgcgggcgaggggcagcaccaggacgccggctccaagatggtccacatggcgccgaacacctcctccaacatcgtctccaagtcggtggcgcgcggcggtggccgtacctcgtaccgcggtctggtggagatcggcgagggcgcggccggatcgaagtccaacgtgctgtgcgacgcgctgctcgtcgacacgatctcccgctccgacacgtacccctacgtggacgtccgtgaggacgacgtgtccatgggccacgaggcgaccgtctccaaggtcagcgacgaccagctcttctacctgatgagccggggcatgaccgagttcgaggcgatggcgatgatcgtccgcggctttgtcgagccgatcgccaaggagctgcccatggagtacgcgctggagctcaaccggctgatcgagctgcagatggaaggcgcggtcggttaggacccgcagtccccggcagcttacggcccgcctctttcggcgggccgaggatcgcaactgacgtaggaagagagcagaccgacagccatggctgaggctcagaacatccccgtgggctccaccaccgcgggccagatcgcggtggccgccgagtcgaccgtcgccacgcgcatgagcgcgcccccgtccttcgacgtggcggacttcccggtcccccacggccgcgaggaggagtggcggttcaccccgctggagcgcctgcgcgggctgcacgacggcaccgcggtcgccaccggcgacggcgtgaaggtcgacgtgagcgcccccgagggcgtcaccgtcgagaccgtcggccgtgacgacgcccggatcggcagggcgggcaccccggtggaccgcgtcgccgcccaggcgtactccgcgttcgagaaggccggtgtcgtcaccgtccccaaggagacggtgctcaccgagccgatccgcatcgccgtgcacggcgagggcggggtcgcctacggccatcaggtcatcgagctgggagccttcgccgaggctgtcgtcgtcatcgaccacaccggtgacgccgtcctcgccgccaacgtcgactacatcctgggcgacggcgccaagctcaccgtcgtctccgtccaggactgggacgacaaggccgtgcacgtgggccagcacaacgcgctgatcggccgggacgccacgttcaagtcgttcgtggtcaccttcggcggcgacctcgtacgcctgcacccgcgcgtcgcgtacgccggcacgggcggcgaggccgagctcttcggtctgtacttcacggacgccggtcagcaccaggagcaccgcctcctggtcgaccacaacaccccgcactgcaagtcgaacgtcgcctacaagggcgcgctccagggcgacggcgcgcacgcggtgtggatcggcgacgtcctcatcgaggccaaggccgagggcacggacacgtacgagatgaaccgcaacctggttctgaccgacggcgcccgcgtcgactccgtgccgaacctggagatcgagaccggcgagatcgtcggcgcgggccacgcctcggcgaccggccgcttcgacgacgagcagctcttctacctgatggcccgcggcatccccgccgacgaggcccgccgactggtggtccgcggcttcttcgccgagctggtccagcagatcggtgtcgccgacatccaggagcgcctcctcgtcaggatcgacgaggagctggaggcgtcggtctgatgacgaccttcgtacgcgcctgcgggctgagcgagctggaggaggacaccccgaagcgggtggaactcgacggcacgccggtctcggtcgtgaagaccgagggggaggtgttcgcgatcaacgacatctgctcgcacgcgaacgtctcgctctccgagggcgaggtggaggactgtcagatcgagtgctggctgcacggctccgcgttcgacctccgcaccggcaagccgtccggtcttcccgcgacgcgccccgtccccgtatatcccgtaaagatcgaaggggacgatgtgctcgtctccctcacccaggagtcctgaggaacccatggcaacgcttgaaatccacgacctgcacgtcaccgtcgaggccgacaacgccacgaaggagatcctcaagggcgtcgacctcaccgtgaagcagggcgagacgcacgccatcatgggccccaacggctcgggcaagtcgaccctcgcctactcgctcgcgggacaccccaagtacacgatcaccggcggcaccgtcaccctcgacggcgaggacgtcctggagatgtccgtcgacgagcgcgcccgcgcgggcctgttcctggcgatgcagtacccggtcgaggtccccggcgtctcggtctccaacttcctccgtacgtccgccacggccatccgcggcgaggcccccaagctgcgcacctgggtgaaggaggtcaaggaggccatggagcgcctcaacatggacccggccttcgccgagcgcaacgtgaacgagggcttctccggcggtgagaagaagcgccacgagatcctccagctcgagctgctcaagccgaagatcgcgatcctcgacgagaccgactccggcctggacgtcgacgccctgcgcatcgtctccgagggcgtcaaccgagtccgcgagaccggcgaggtgggcaccctcctcatcacgcactacacgcgcatcctgcgctacatcaagcccgacttcgtccacgtcttctccggcggccgcatcgtggagtccggcggcgccgagctcgccgacaagctggagaacgagggctacgaggcttacgcgaagcacgaagtcgacacgaagggtggcgtatccgcgtgacgcagctgccgggcctcctcgacaccgaggcgatccgcaaggacttccccatcctggaccgtcaggtccacgacggtaagaagctcgtgtacctggacaacgcggcgacgtcgcagaagccccgccaggtgctggacgctctcagtggctactacgagcgctacaacgccaacgtccaccgcggtgtgcatgtgctcgccgaggaggccacggcgctgtacgagggcgcgcgcgacaaggtcgccgcgttcatcaacgcgccgagccgcgacgaggtgatcttcaccaagaacgcctccgagtcgctcaacctcgtggccaacatgctgggctgggccgacgagccctaccgcgtggaccacgagaccgagatcgtcatcaccgagatggagcaccactccaacatcgttccgtggcagctgctggcgcagcgcacgggcgcgaagctgaagtggttcggcctcacggacgacggccggctcgacctgtcgaacatcgacgagatcatcacggagaagacgaagatcgtctccttcgtgctggtgtcgaacatcctgggcaccgtgaacccggtcgaggcgatagtgcgccgcgcccaggaggtcggcgctctggtctgcatcgacgcctcgcaggccgccccgcacatgccgatggacgtccaggccctccaggccgacttcgtggccttcaccggccacaagatgtgcggtccgacgggcatcggtgtcctctggggccgccaggagctgctggaggacctcccgccgttcctcggcggcggcgagatgatcgagaccgtgtcgatgcactcgtcgacgtacgctcccgccccgcacaagttcgaggcgggcacgcctccgatcgcgcaggcggtcggtctgggcgcggcgatcgactacctcgactccatcggcatggacaagatcctcgcccatgagcacgcgctcaccgagtacgcggtcaagcgcctcatggaggtcccggacctcaggatcatcggcccgacgacggccgaggaccgcggcgcggcgatctcgttcacgctgggtgacatccacccgcacgacgtgggccaggtcctggacgagcagggcatcgcggtccgggtcggccaccactgcgcccgcccggtctgcctgcgctacggaattcctgcgaccacgcgagcgtcgttctatctgtactccacgccgaccgagatcgacgcactggtcgacggcctggagcacgtacggaacttcttcggctgaggggctggctgagaacgtgaagctggattcgatgtaccaggaagtcatcctggaccactacaagcacccgcacgggcgcggtcttcgggatggcgacgccgaggtgcaccacgtcaacccgacgtgcggcgacgagatcacgctgcgcgtgaagtacgacggcgaaacgatcagcgacatctcgtacgagggtcagggctgctcgatcagccaggcctccgcctccgtgctgaacgaactcctcgtcggcaaggagctggccgaggcgcagaaggtccaggagaccttcctggagctgatgcagtccaagggccggatcgagccggacgacgcaatggaggaggtgctggaggacgcggtcgcgttcgccggtgtctccaagtatccggcgcgggtgaagtgcgccctcctgagctggatggcgtggaaggacgcgacggcccaggcgctgggcgaggccgacgccgaaaggaagacggcatgagcgagaccattgagacgaagccggcctcggaggaagaagtccgtgaggcgctgtacgacgtcgtcgaccccgagctgggcatcgacgtcgtcaatctcggcctgatctacggcattcacgtcgacgacgcgaacatcgcgacgatcgacatgaccctgacgtcggcggcctgcccgctcaccgacgtcatcgaggaccaggccaagtccgccacggacggcatcgtcaacgagctgcgtatcaactgggtctggatgccgccgtggggcccggacaagatcacggacgatggccgcgatcagcttcgggcgctcgggttcaacgtctgaccccgtgtgctgacgcgcgaggccccggtgctgatgcaccggggcctcgcgcgtttgccgccgcccccctcgcgcgcgggtccgtacggtccgaagagcctcagtcccagcccttcaccagctggaacgcggagtcggcccggtactggccggtgttctcgtacgggtcgaggcggagcaggaagtccttgtggcgcagatagcggccggggtagttcaccgactccagcatgacggcgccggagtacgacgacgtgcgggggcagaaggtggcgtccttcttgaagagcgcggtgccgtcgttgcggtcggcgcgcaggcggaaccgggagtggcgcaggtaggtgccgtccgcggtggcgaacgagtagcaggacgcgtcggcgagccccttgaccagtttgaaggtggcgtcctgcctggtcgtggccgagctgccggagctcacggggtcgagccggccggtgtcaccgccgagatgccagtagcggtcggggtagttgaccgaccggacggacttccacacggcggagggcttcgagcccgaggacgtgccggtggacgaggccggcttcgaccgctcggccgcgggcttcgacgcggagccgtgccgggcggggtcggccgaggcggagccgtcgggagtggtctgcgcggctcgctcgctcgaccggccgctcttggcgccggggtaggtactcggccccgcggagggggaggcgaacgtgaggagaccggggtcggccgagtccagcttggtgtcggcttccttcgcggccgaggtgtcggccgcgtggtccgtcgtggtgagcgcggtcacgcaggcgacgacggtggccagggcgagggcgccggccagccagagccgtcgggtcccgggtacgcgggaggtgtccggcgtaccgcccggctgccacggcgtcggcggctcctccgtcggcagcggcagatgcccggggtgggacggttcggacgccggcgaactcgcgaaggggctccacgggcggggggcggactcgtccggagtgggctcggactgcctttctggcatgcgctgttcctccggcgtcgctcagggcgaacgcacacttgtcggctgtcttcggcataagaggaatacgaagtcgcgggtccacggagcgggaggggctgtgaagaccgggtgggcgactggttgaaacagtaacggaagtggggcttccggggcagccgtttccttcggtcatctgcaggcggtccgcgggaaccggccgtcccgtgaccgctacgcggtgatccgtacgatctgtgcgtcggggccgctcgctgccctccaacgcccctgccgcgatggagaattgagggacactcagatggcctggcctgatcacgcgagcgtccgaagcgggtgcccggtgacgaggggtggcgaggggcgcacgcgggtgcacgcgggggcgaggtcgaaatcaccatcggcgccgacgaacacgcgctgccgggactgtgcttcgtgtccgtcggcgagtgaaaggccgtcaagaaccggctccacctcgacctcgcgcccgacgaccaggacgctgaggtcgagcggatccttgcgctcggggcgcgccgcgtcgacgccgggaagggcgaggacgtcacctgggtcgccctcgccgaccccgagggcaacgagttctgcgtgctgcggccgaagacttcactgccgggtcgatcgagtcaccggtcggctgggccggtcactgcggggctgtgagcgagtcaccggtcggctgggcgagtcatcgcggggctgtgagcggtccacggtcggccgggcgggtcactgttgagccgaggccgcccgtagcagtgtgtcggccaggccctccctgcggatgcgctggtcgatgtagaggagtgacgtgatcagcggcacgaacaccgcggcgaacagctggaccaggagagtgccggccgccgatatcgccagggagacgcccaggtcgggcagcatctgctcgaacacggcccgggcgctctcgggctgcccggacgacgtgtcgtacggctgcatggtcggcgtgaagaacatgagcggaagccggaccatgtacgacatggcggccgccatcaggctggcgagcagcgtgatcccgaagacccgccaccaggcgccgcggaccagccgcgcagagcggcgcagcgccgtcaccggggccgccgcctccagtacggcggccgccggcgcgaaggagaacagggtgtagagccagaccgccaccggcgccgcgcccaggaggagcaggaaggcgatcccggccggcagcgccgaccaggagctcagcgccaggagggtgagcgacacgaacaccgccgccaccagcagcatcggcaccaccgccaccaggccctgcaacagggccacaccgatgaccgagggagtgcggggccaggcccgccgccacaccgaacggaacgtggcgcgccggccgagtaccgcgtcgtgcaccgtcgccacacaggacgcctggacgagggcggaggcgaccatcagggccagcatggcgaacacccatacggcgaggaacgcgaacaccagtggctggacgtcggcccagtgcacatcgcggtggtggtcgatgagcgcttccagccggtcccgtacggccgcgtaggcgatgactgccgcgccggcgaccagggcgcccagcacggcgtacgcgagagcggcgaggccgaagagcggcgcggcgtagcggcgcatggtggcgaaggcgccgccgaggatggactccacgccgagcggcgccaggggtatcacgcccggcttgggcgggggcggcggcggtgcccagccccagccgcccggagagcccccgtacgggcccgatggtccccaccccgctgtgttcgacatcgcttccgcgctccgatgctccgggagtcccaggactccgcgcccccactgtgatcgcgaacgatatcccgtgccggggcttcgtcgcgcgggggttctccgcacggatgtgcgcggtgccgcgcacggtggcaggacgtgtgcggcgcacgacggcgggccgtgatgtgtacgaccgtacgcatcgctgtgtacactcgtacgcatgggatatgtcctgctggccggcgccatcaccgcggaagtggccgccacgacggccatgaagtacagcgacggcttcagcaggctgtggccctcgctgctcaccgccctcggttacctcgtcgccttcgcgctgctcgcccagaccctgaagaccgtctccgtcggcacggcgtacgcgatctgggccggggccggcaccgccgccatcgcagcgatcgggatggtgttcctgggtgagggcatgaaccccgctaagctcgccgggatcgcgctgatcatctgcggggtcgtggtgctgaacatgggcggtgcgcactgatggctgcgggaggcggacgctgatgcctcgtcgttacgaccccgaccggcggcagcggatcatcgacgcggcgatccgcgtcgtgggcgacaagggcatcgccgggctcagccaccgttccgtcgcggccgaggccgatgtgccgctcggctccaccacgtaccacttcaagaccctcgacgacctgatggtcgccgcgctgcgccaggccaacgagggcttcgccaaggtggtggccgcccgcggtcatctggaggacccgcgggccgacctcgccggggacatcgccgcactcatcggcgactggctggccggggaccgcacgggggtggagctggagtacgagctctacctcgccgccctgcgccgccccgctctgcgccccgtcgcggccgagtgcatcgacggtttcgcggaagccgtcgcccgccgcaccgacccggtcaccgcgcgggcgctcgtcgcgctcgtcgacgggatctgtctacaggtgctgttgacgggggcgccgtacgacgaggcgtacgcgcgcgagctgctggcgcggctcattccctgagccggatgtccggggcgggccgttgagccggatgtccggggcgggcccctgagccggatgtccgggtccggagcggctgttggtgccccgtgcctccttgccgccgtcgatccgttccacgccgctggtccgtcctgcgccgtcgatccgtctagttgccgtcgatccgtggaaaccgtgaactcttcgccgcgcagcggggaatagggggtgacacgctcggcacgacacaacagggggaggccttgtgagcggaccaccgccgtccacggcacgagtggacgacgatgcggaggtcgtcgcccagtcgctggagcaaccggagctgttcgcccggctctacgacaggtacgcacccgacatccaccggtacgcggcccggcgcctgggtgacggcgcggcggacgacatcaccgccgacaccttcctgaccgccttccgcatccgctcccgttacgacctgacgcgcaccaacgcgcgcccctggctgtacggcatcgcgggcaacctcatcggcaagcagcggcgcgccgaggtgcgcgcgctcaaggcgctggcccgcaccgggcacgaccccgtcgccgcgtcctgggtcgaggacaccgagagcaggatcgccgcacagggcccgctcgccggcgccctcgccgccctgcccgccggtgaccggcatgtgctgctgctcgtcgcctgggccgacctcacctatcaggaggtcgcccaggcgctggacatcccggtgggaaccgtccgctcccggctcaacagggcgcggcgcaaggtacgtacggcgctgggcgcggacccggcgttcgtgagcgacgcggcggaggtggcatagccatggacgagatgacccgggtgcgcgagctgcgcgccgacgcacccacacccgatcgcggccggctcgcgccggggcgcatgcggctggtcgaggcggcacggacgggggagaggcggcgcgcggtctgggcacggcgggagttcgtgatcgcgggagtggtcgccgcggtgaccgccgtcgccgtcaccgcgtccgtgctggccgacgggggcgaccaggggcggaaggcgtcgcccgcggtctccccgaacctgaacctgaaggggctgagcgccagggagctgctggaacgggcggcgacggtgctggagacacaaccgccggtgaccgtgccgaaggccaagcagtggatctacacgaagtcgatgtccgaggggcaggaccccaagctcctgaaggagatgggcgaggaggcgttcgtccaggagagctggatccggtacgacggcagcgcctccgcccaccagttgcccggcaggcactccgagcttcagatcaccaagatgcacttggagaacggcggcgagggcgacgaccgctcgccgcgggagatgtaccgcttcctgtccaccctgccgaccgacggagagggggcgctgaagaccctgcgggagaagaacgccatcgccgacgggaaggagtcccaggcggcggcggaccgtactgagatcttcgtgctgctcagcgccgacgtcatgccgcccaaggggctggcagggctctatcgcgcgctggcgacgctgccgggcgggaaggtgaccgaccatctcgtgaagaacgcggccgggcgccgggtgatcgctctgcactacggcggggacggcatcgggagcgacggccaggactggctgctcgacccgcagacgttccaggtcgtcggccagcggctgtacgcccccaagggcggggcggacggcggcaagggcgaggtggccggcggcaactcgctgatcaccaaggccgtggtggacaaggcgggccggcgcggctgacccgccgagcacgggcggcccgcgtcacgggggtgcgtgggccgcccgggtacgcccgttccctgagacgccccgcggacgagttcgcccgcacgccccccggccggttaggtttccctcatgaccgacacgactgctcctcgtaccaccggtgccgcggccgccgggctcgccaccctcgccgccgacggaaccgtcctcgacacctggttccccgctcccgaactcaccgcagagcccggcccggccggcaccgaacggctgtccgccgagcgtgccgtggagctgctcggcgagggcgccgccaaggcgctcggcccggacgcccgccggggcgtcgaggtggtcgcggtccgcacggtcatcgcctcgctcgacgagaagccgatcgacgcgcacgacgtctacctgcgtctgcacctgctttcccaccgtctggtgcagccgcacggccagagcctggacggcatgttcggcttcctcgccaacgtcgcctggacctcgctcggcccggtcgccgtcgacgacgtcgagaaggtccgcctgaacgcgcgcgccgagggcctgcacctccaggtgacgtcgatcgacaagttcccgcgcatgacggactacgtcgcgccgaagggcgtacgcatcgcggacgcggaccgggtccgcctcggcgcgcacctcgccgagggcacgaccgtcatgcacgagggcttcgtgaacttcaacgcgggcacgctcggcacgtcgatggtcgagggccgtatctcggccggtgtcgtggtcggcgacggctcggacatcggcggcggcgcctccaccatgggcacgctctccggcggcggaaacgtgcgcatcacgatcggcgagcgctgcctggtcggcgccgaggccggcgtcggcatcgcgctcggcgacgagtgcgtcgtcgaagccggcctgtacgtcaccgcgggcacccgcgtcaccatgcccgacggccagatcgtcaaggcccgcgaactctccggcgcctcgaacatcctcttccgccgcaactcggtcacgggcgcggtcgaggcccgcccgaacaacgcggtctggggcggcctgaacgagatcctgcacagccacaactgatcaccggcggccgtgacccgcggccgcctgattgatcaacgctctgacctgctgctgagctgtcggcagtggtcgacgttggtcatcgttgagcgcccttccacggccctaggacggccagggagggcgctcgtgcgttggggagaggctcctgccttgtaagggcgggtgtgcgaggtggcgatggagcgcaggccactccgggttcggcaagcccccagctcggcggagtctctggactgccgcgaaccgtcgttgaccgtggttgaccgcccgatgtggcacggctgtggcacgcgccgcctcggtcttggagcccaagtaaggtctcccctggaacgacctgaacggcagggggggctatgtcgggacaactgttcaccttggtaggtgtgcttgtcggcgcggcagcgtcttacgcaggcggagctctgatggagagattgcgatggcaccgccagctctcgacgcgatgggacgaacgccgtctggagtcctatcttcggtacgccgacgcgatcaagagattcacctccttggcagggcgtctggcggcaggcaaggggctgttcgatctccctcagccactcgcacaggaaactgggttggagatgctggcggacgccgaacttgaacgcggttacgcgttcgaggctgttcttctcatgggagactccggaaccattgcggcggccagggcactacagcgccaggcttgggtgctggagcacttcgctcgtgaccagcgctcgggaacatcagaggactgggcgcaggcactcaggcaatttcaggagaagcgtgatgcgttctacctcgccgcgcgcaagagcttgggcgtatccgcagagtttcgactgcggactgaggacccagccatcctggggccagacccgcggcaaatgtagaggtcggcggagcggctttgggcgggagctgccatggggcgagtgatcatggtcccttgagcttccggcgaggcgggcagtctgtggacctgccctgagcgagtacctcggccaccatggcccggccttcacgctccgcacctacacgcgtctgatgccgtcgagcgaggctcggactcgggtcgccgtggatcgcgtgttccgcgggcaggacgtaacctacgacggccccgcgacggcccagggcgcaggctgacggcctgacctgctgcgacatcagaacagccacaactgaaccggcgtaccggcacgagcgacgccggcgtatcgagcgccctcccgcggcattccgtccgcgggagggcgtttcgctgtgcgcttccggtcgcgcgccggtgtgcggtcagcggcggatcgtcgccgcgaactccgccagtaccgtgaagtcgggctcgcgcagcccgagccgcgggctgacgtggcgcagcagcgcggggccgggatggtgcgcggccacatacgcctcgtccgccgggctgtgttcgtcgtccacccaggcgaagggccgctcgccggcgtgggcgaccagcgcctcggtcttccagtggaccccgtcggggcgctgcgagaagaggccggtgccgaagtcgacgtagggcaggtcgggaaggccgatgaccggcccgatccagcggttcgcggcgtccatccacgtggtggcccagcacagttcgtagtcgagggcgagcagtgcccggccgtggtcgggatggagccagacccgtagcgggcgcccgggggtcagggccacccggatcgtcgtgtagccgtcgggccggcgttccggctgggccgcgtacgggttgagggggccgtcgacgtccaggtacagcagcggtcggctcacctcgccaacgtacgccaggagcgggcggggccggggggaatttctgcgggtgagaggcatagcggcaggcctgtgcacgcgtcacaaggagcacaggggccgggcacagagtccgccggggaagagaaggtgacgatggatgccgcagggcaggagagtttccgggagttcgtggcgaaccggtcgtccgcgctgctgaagacggccgtgctcctcagcggcggggaccggcacgccgccgaggacctgctgcagaacgcgctgatcaaggcggccgaccggtggagccggatcgacgaaccggaggcgtacgtccggcaggtcctctaccggcagcaggtcagccgctggcggctgaagtggcggcgcagggagctgagcgtcgccgagccgccggaggcgagtacgggcccggacgccgcctccgccgccgagctgcggctcgtgatgcgcggcgcgctcgcccggctgaccgcccggcagcgcaccgtgctcgtcctgcgctacttcgaggatttgccggaggccgacgtggcccggatcctggggtgctccgtggggaccgtacggtccacgacgcaccgctcgctggcccggctgcgcaccctcgcgcccgaactggcggcactgggcccggccgacgccgagcaggagccgtcccgtgactactcgcccgtggaggtgcgtccgtgaacgtcgatgaactggtgcgggacgccttccgtgagcaggccgcggaccacatgcccgcgcccccctacttcgccgaacgggtgctggccgtccggcgccgccgccgcacccgcaggctcgcgtccgtcgccgtggccaccgccgccgcggtcgccgtcggagtggccgtccccctcctgggcggcggcggggacgatgtgcggcccgcgagcgagatcaaccagagcgacatcatcgggcacccggaccagtccccgccgaagggcatgatcgcggcgggtgacacggtgctggccgcgttctacgtctacaagaacgtcaagcagccgaacggcgacagcgtcaccacgcgggtgtacggactcctcgaccagaacacgggcacgtaccggaagaccaagtgggccttcctggatgtcgcgcccggcacccgtaccgccgccgtgctggagggcgagttgcccgcgaagcgcatcgggctgctcgacatgatcaccggcaaggtggaccgctggattccgatggaccggggcgtcgggggtgtctccttctcgccggacggcaagaagctcgtcgccacgacgtacagcaagaaccccgaccgcaacttcgccgaccacaagcagaacgtcaacggcaaggaggtaccggggcccgtgcagagccggaccgggttcgccgtcgtggacgtggcctcgggcaagtccgactggcacaaggcatcggacaagccggacgagatgggctggttcggcaactcccgcgaggacttcgactggagccatgacggcacgctggtctacgcgaacagggcgatgaagccgtaccgcgagtactacggtctggacggggccgaggccaagtggccggccgacgagaagtacctcacctacgtcgaggcgggcctctcgcccgacgggaaactggcggcgggggatttcgccggcgacggcaaggagatcgccgccgcgatcgacgacccgaagaccggcaagcgcgtcgccaaggttccggggcagcagctcctcgcctgggccgacaacaagcgcctcatcgcctggggctgcgaccccaagaagtgctccggcaagggcgagttccgcaaccagctgctcctggtgaccatcggcaccgacaaggtcgtaccgctgagcgacttccgcaaggcgagcgacgactaccccggccggtggaccccgctgttcagctcacgctgaccaactcctcgtacagcgccagcagcccgtcggccgtctcccggccggcgggccgcagcggtgcccggaccgggcccgagggcaggccgagccggccgagcagggccttcgacgtgaccgtgcccggcaggccggccgccatcatcgactcgatgagcggaacggcccgttgctggagacgggccgcgagagccgggtcgcccgcgtcgaacgcgtcgagaatcgaccggaagtggccgggcgccacattcgccaccgtgctcacatatccggccccgccgctcgcgtacagcgcgaggacgtactcgtcgcagcccgtgtagtacgccaactccgtgcgggccagcaccttctgggtgccgaggaggtcgtacgcgcagtccttgaccgccacgatccggggatgttccgcgagccggatcatcgtggccggctcgatgcgtgtgccggtgcggccggggatgtcgtacaggacgagcggcagcccggaggcgtcggcgatgtcccggaagtgtgcctcgaccgcctcctgcgggggccggctgtagtacggggtgaccaccagcaggccgtccgcgcccgccttctcggcctccagggccagctccacggtgtgccgtgtgtcggccgtgccgacgcccgccacgatcgacgcccggtcgccgaccgcctcgcgcaccgcccgcaccagcgcggacttctcggcgtccgtcgtggtcggcgactcgcccgtggtgccggacaggaccagcccgtcacagccctcggagaccagccggtcggcgagccgccgcgcgccgtcgaggtcgagcgtgcccgccgcggtgaagggcgtgatcatcgcgcagagcgcacggccgaagggagcggttccctgtgcggttccttgtgtggtcatacggtcagtctcggcagcccgaccgtgaagctccacttaattctgctacgggataggggagaggaacgctacgagaacctccgggaacccacgggaacctacggggacctacgggaacctcagcgggagtccgggaccacggtcccgcgaggaatgccctagtgccaaacgggacttcatgggtcaccatggccgggacggtcaccaacagcgggaggcgtcatgaagttgggcaaggcagtcgcgaccggggtcgcccaggagcggccgggcgcgcacgaagaggagacggaactccaagtcgccgaagccgtcgaggagttggaggcatccgctcccgaagaggtcccggtcgcgcgatgagactgcggctccccgaggaacgcccgacggagccgccgaccggatacaagatcgcccacccggtgctgtcccaggacggcacccgggtcgggttcaccggcgtctcgctgggcggcgcactgccgtacggggtcctcgacgaggcccgctgcgtctacgggctgcggcaccgggcgccgcaccgccgctgtgactgcggcttccactgcgttcacgaccgcacggaggccgaggcactgctgtgcaccgccgagcaccgggcggccgtcctgctcgaggtctccgtgctcggcgcctacatccgcttcgaacgcggcttccggtacgcccgccagcgggtgcgcaccgcgaccctcgggccctgcggctgcggggcggtggcggcggcactggccgacgccggctgggggcggccgggctggcgcgcactgaccgccgcgtgcgcggggtgcgtacgcggtcgtacgtccctgtcgcccgccgccttcgcccgactggccggagaggggctgcgggtgcgggccggcagcggtgtcgccgagcagcccgccggcctcggagtctccgaactcgtcgccgaggccgcgctgctccaggcgcgactcgactggttccagacccagttggcgcagctcgacgaacggggttcgcaggggtaggcggcgccggtccgggtacccgggtgtcccgaagagagaggaggcgggacaccgtgaccgggaccatggacaccaggccgcccgtgtccggcgagcaccactccgtgggcgaactcgtcggacaggccgcggaacagctctccctgctggtacggcaggaagtgagcctggccaaggaggagctggccgagaaggggcgccgggccgggcgcggcggcgggctgctcggcgcggcgggtgccgtcgcgtacgtcggggtgatggccctggccgccacgggcgtcgccgcgctctcactgacgctgccggtctgggccgcggcgctcatcgtcacggcggtgctcttcgccgtcgcgagcgtcctggccgcggtcggccgcggccagttgcgccgcgccgcgccgcccactcccgagcagacgctcgacagcgtcagggccgacgtcgacgagatcaaggaaagggcgcaccgatgacggacgacagcacgggagcggagaccgcgaaggcgacgggcgcggagacgacgcccggagcgggcgctgcgggcgtggcgggcgagaaggccgcgaacgccaagaaggcgggagccggggcggcgcagaccgggacgagcgcgggcgccgcgaaggtgccgggcgcggctgcggccggtgagaaggccgtggggcggaagaaggcggcagccggggacgccggggcggccgcggccgagaaggccgcggacaccgtgagcggtgccggcgcggcgcgcgccggggccgggccgggcgctggtgacggtgccgatgccgcacgggccgccggggccgaggggccgcaggagctgcggcggcagatcgccgagacgcggagccaactcggcgacaccgtcgaggaactggcggcgaaggcggatgtgaagggccgggcccgggcgcgcgccgcggacctcagggaccgggcgggcgcgctgacggtccagttgcgcagtacggccgcgcacgccggtcacatcgcccaggacagggcggtccgggccgggcacaccgtgcagggcaccgcgggccgggccgggggtgccgtacgggacaccgtgccggggcccgtgaagacggccgccaccgcggtcgtccaggccggtctgcgccatcgccggccggtgctgatcgccggcgccggcgcgggcgcgctggtcgcggccggcctgctgcgacggcggcagggcggacgccactgacccgacagggcgcccggcggggcggacacccgaacgcgccgtcggtggcgggaccggaaaccggttccgccaccgacggcgtccgcgctcggtggacgaagagcccggccccccggacgacggggccgggctcttccgcgtgcagtccgcgtggtgtccgtctggtgtccgcctggggtccgtgtcgggcgactacggacccggggcgactacgcggctacggacggaaccgcaggacctgcgggtcgtggtcgctgacctggtcggagaactccgagttgaggtggacgctgtcgtagtcgacgtcgcagccacgccggatcgacgggctgaccaggatctggtcgaggacctggctgttgccctggtagtcgtacgtgtaacgctcgctcttcggcagcgacttgatcgccgaccagagctcgccgtcgccctcgaggatcttcgccgtgtcggagaactcgaagtcgttcatgtcgccgagggctatgacgtccgcgttcttctgcgtgtcgaggacgtccttgacgaacgcgttcaccgcggtcgcctgcaagtggcgctgcgtctccgagctgcgcgccggcggctggtactgcgcggccagcccctggtcgccgcccttcgaggcgaagtggttggcgatcacgaagaccgtcctgccgcggaagacgaactcgcccgcgagcggcttgcggctgctgttccaggccgcgtcggacgggtcgatccggcccggggacacggtcagctgcgccttgccgcgcaccttcgtcacgccgacggcggtcgtcgagtcgccgcccgcgcggtcggtgaaggacacccggtccgggttgaagaggaagacctggcggatgttgccgcccggctcgccgccgtccttgtcgttgaccgggtctatggagcgccattcgtacgccgggccgcccgccgccacgatcgcgtcgatcagcttccgcaccgtctggtcggcggcgaccgtgccgtcgtccgtcgcgccgttgttgtcctggatctcctccagggacacgatgtcgggcgactggaggttgttcacgatcgcggcggcgtggtccgcgaaggtggcgtcggacgggtccaggttctccacgttgtacgtcgccacggccagctcgccgcgcgactgcttacgggtcgtctcccgggccaggccgcccttctccagggtgccgagctggttggcgacgagcgtgtagccgccgtactggttgaagtccagcgggcccgcggtggtgcccttgagctcgtcacccacgttcgcggtcgggaagtccgcggtcgagcccagcgactggatctggagccggccggtgttctgcgactcgtacgagccgtagaccgtgcccccgcggcggttggcgtgctcgcgcggcttcaccgtgacccacagctcggagtacgggtcggtggccgtgaccacgcgggcgtcggcgacctggacgttcatgccctcaagggactcgtagtagtccagggcgtacttggccggctccagggtgaggccgttgatcgagccgcccgcggccgtgtcaccggcggcggtgtaccggctcggcaccgaccccgcgtcgacgacggcgggggccggaacggtgttgccgccggagagcaccgtcaccgtcggcttcgtgatctccgtcagcgactggttgccgctcgcggcgccgcccgggacgtactccgagaccgtgcccgacaccgtgaccgagtcgccgacggcgaccttcggggcggaactggtgaagaccaggacgccctcactggtggccgggtcggcgtccggggccgggtcctggatccagaaccccttcgaggaaccgtaggtccgcacacccgtgacgatgcccgccacgtcggtgaccttctgcccggcgagcggggaaagccgggtggtgccctggatgtcgtggatgtgcacactgtccgcctgggcgggcgatgtgagaaccaccgcggagaccgtggaacagacggctgcgacggtgagcgcggcgaggcgcgcggaagacttgctcggcaacgggatccctccggggacatgcgtgggtgccgggacgagggtgggtggtgcggtggggggagcgcgaccggtggggcggtcggtgacgcgcgtagaagaacaggtgcacgactgtccactcgtttctacgcgcgtcaatctcgtgtgtgggaaggccacttgtcaaggtttcagccaggtgcggcctccgggggagagaggaaccgggcggcatgggtggaaatccgtctaggctgagaccgcgttctccggggcacccccttggccccgcgggcacgcccggggcgtccccccggtccgcaggtatgtccggggatgtcccctcggcccacaggtacgtcccaaggagatccccccgatgtcagacagctcctccttgccgccggttcggctgcactccgaagcggagctcgcgcgggacgcgctcgccaccccgttgttctcccgcgccgcgcgcctggcccgctgggccggtccggacacccgcgtcggcgtcggcggtgaactcgaggaggagcagcttcccggggcggccgaagcgctcgggctcgcgggcgacgacgcggcggccctcgcgagcgaggcctggcgggtcgctgtcgacacggggctcgtcgtgatcgtggacgaggaggagggcacggtcgccgcggcaccggacctcgcgctgctcacctccggaagcccgcacgacgtgctcgggttgtggctcggggcgctggagacggtgctggccgacgcgagcgtgcccgatctcgacgacctcggcgacgcgatggacgaggacggcacgatcgacttctccgaactcgactgggatctcgaggcggaggcggagttcctcgacggagtgctggggaacctctatctgctgacggtcggcgaggagggccccggcgaccatcccgtgccgctgccggccctcgccgcgtcgatgatcgtgcccgacgacatgggggagcccaccaacgacgtcctggagcaggtctcggacgcgatgatgcggctcgacgaccagttccggctgctggagccgatcgggctcgtcgagttccggccggtcgacgaggcgctgatggcggacgccgaggacggcgaggacgccgcggacgagccggccgcgccggtcgacgacacggacgtcagccggtacgggatggtgcggctgacaccgctcgggctgtacgggctgcgggcacggctgctcgaggccgggatcagcgcgcccgcggtgggggatctggtcgacaagggtgcggacgcgctgctcgacggcacgtccacgttcccgccgatggcggcgcaggcggagaccgagcagtggctggcgcggcgcgaaccgctcacggcggcacgggagttgctggcggcggcgcggggcggggacacgggtgcgccactgcgccggctgcgctgccagcaggcgctgtcactggtcggtacggaggcggagccggcgcttcgggaggtgctggacgacgcggagctgggcggcctcgcccgggtctggctcgcggagcggggagcggccgacgtgcccgcgcccccggagtcgatggtgttctggctgaccatcgacacggtggccgcgcagctggcggccgaggggaactcgacggaactccaggcgctggtggaggggctggcccagcagcacagcggcttcttcgcgacggcgtggcgagtggaccacccggccacgccggacgtcttggaggcgatgggccgactgcacccggacaagaaggtggcgaaggcggcccggaaggcggcgttcaaggcgcggtcgcagcaagggggttgaggctgcggggtcggtgcgggccggggttggtgcgggccggggtcggggctggtgcttgccggggctgaccctttccgtgcgacggtgcccccaccgcgaccgcggtgttcatcggcgtcggcacggtgattcgccacgtccgcggtgttttttccccccgggcctccggccccgcgcacgctgcgcggggatcgcggccggtccgacgccgtcacgcacggctgccgtgtaccgccgtcgggcggctcgcgtcacgcaccgccgtcgcacaccgccgtcgggccgttcgccgtcacggcggggaggctggtgggggctttgcccggcggcggggaggccgggggtgcccggtgtggcggggaagccggtgggggcttgtccggtgtgggggagggggctgcgggacctcgccggcggcgtcggtcgcgtgggcgctcaggtggattcacggaacgcggtccccttacgtcggcccgtgttcaactgccgttcaggcgcgggcgggacggtgtggccgcaacgaggtgcgccacccccttcgacgtcccactccaccgtcacaggagacagcatgtcgctcacccgcagggacttcgccagacgatccgcgctcaccggcgccggcgtcgccctggccggcagcgtcggcgccctcgccaccgcgccgaacgccctcgcgtccaccgacaccgagagcgcgggcgaggaatccgcggaccggcacggcagcgtcggttacggcccgctgatccccgacccgaagggcatcctcgcgctgcccgccgggttctcgtaccgcgtcatcacctacagcggaaagaccaagctggagtcgggcgagttcaccccgtccaaccacgacggcacggccaccttcgacggcccccggggcgccaccctcctcgtcaacaaccacgagctcaagggcccccgcgccaactggaagtacccggtccccctcaccgagggcctcgtctacgacccggccgcggccggcggctgcacggtcgtcgaggtccgccgcgacaaggtcgccgagtgggtcggcatcgccggcacctccaccaactgcgcgggcggcagcaccccctggggcacctggctcaccggcgaggagaccgaggacagggccggccagaacggcatgaccaaggaccacggctacatcttcgaggtggatccggaagaccgccgccgcaaccgggaccccaagcccgtcaaggctctcggccgttacgcccacgaggccgtcgtcgtcgaccccaagcgcggccggctgtacctgacggaggacgcgtccactcccaacggcctcctgtaccgctggaccccgccgcagggcttcgagcacggccacggccggctgcgcaccctcgccgacgacgcgggcgccctccaggccttcaagtgcttcgactccggcggccggttcgtcgacgacctctcccgtgccaccaggatcggcaccgtgtacggcgtcgactgggtggacgtaccggaccgggacgccaagacggtgtccgtccgcaagcagttcgccgccggagaggtcacccgcgcccgcaaactcgaaggcatgtggtggggcgacggcggcgtgtacatcgtctcctcgtacgcccgcgaggagagccccgtccagcacgacggccaggtctggttctacgaccccaagcgccgcacgctcaccctgaaggtgctcctcggggtgaaccgggacccgtccgccgacggcgccttcgacgggcccgacaacatcaccgtctccccctacggcggcctcgtcatcgccgaggacggcgagggcgtccagcacctgttcggcgccaccgacagcggccgtacgtacccgatcgcccgcaacgacctcgcattgacaccagccgctgccgcagcgggcggcaccgaagcggagccgtcgtacagcgagttcaccggcgtcaccttctcgcccgacggcaggaccctgttcgccaacatccaggatccgggcatcatgctcgccatcaccggcccctggaagcgccagaagcgcgggtagttaattcactggctcaccccgcggcccgcctcctagagtgatgaacgtccaggtgcgaaggcaggacctacttccactgataatggggcggccgcgggttcgagtcccgccaccggtacaacgcgccggtgtagctcaggggttagagcacctaatgtcggttccgccgacctgaactctggacagcacaatttcatgcacctcccggtgcgcaggctgcggctacttctttgcaacagaatccgatgccgccgccgtttttgatctcgggaggcgcagcacatggtgtgtgcccggtgcgcaggcaacggttacttcattggatcggacggttgcgggttcaagtcccgtcatcgacttcgggtcggtgtagctcaatcggtagagcatctggctagtccgtcgccgactcctgatctcgggcacgctccatttgctgcgcctcccctcgaaagcacggcccagaagccgtaaaggaattcgggggaattcaccatggcgcgattcaacaagaagacggcgaaggcgcagcccacctcgcgcgtgacgtcgacggggcaggtgctccgtacccaccagggcggccgcggccaggagcgcgacgtgcgctcggagctgttcctgctcgccctcgccaacttcgtctcgcagcagaccttctacgagaccggcgcggcccgcgacgaccggttcgccgcactcgtgcgcgagctggccgtggccgacccgtcgtggacggccgcgctgctcggctggctgcgcggcgagggcaacctccgtacggcctccctcgtcggcgccgccgagtacgtcaaggcgcgcctcgacgcgggcgtgaccgacggcccgtcgaaccgcgaggtcgtcgcctccgtactgcgacgcccggacgagcccggcgaactgctcgggtactggacctcgcagtacggccgcgcggttcccaagcccgtgaagcggggcatcgccgacgccgtacggcgtctgtaccacgcgaagtcgctgctcaagtacgacaccgcgtccaagggctaccgcttcggcgacgtcctcaacctggtgcacgcggcgccggacccggacaagccgtggcagggcgacctgttccagtacgccctcgaccggcggcaccacccggacacggccgtggtcccgaagacgctgcccgtgctcgtcgcccaccgtgacctgatggagctgcggcccgccaagcggcgcaaggtcgtgaccggagcgcacggcgcgcagcgcctggcggacgccggcatgacctgggaggcgctggccggctggttgcagggcccgatggacaaggcggcctgggaggcggtcatcccgtccatgggcgcgatggcgctggtccggaacctgcgcaacttcgacgaggcgggcgtctcggacgaggtggcggcccaggtcgccgcgaagatcagcgacccggcggaggtggcgcgctcgcggcagttccccttccggtacctcgccgcgtaccagcacgcgccgtcgctgcgctggtcgtacccgctggagcaggcgctcgcccactcgctgggcaacgtgcccgcgctgccgggccggacgctggtgctcgtggaccgttcgggttcgatgttctactcgcgtctttcggaccgttcggagctcaaccgggccgacgccgcggcgatcttcggtacggcgctcgcgctgcgggcggcggacgcggatctggtggagttcggcacgagcagcaacgccgtgaagttccgcaagggcgagtcggtgctcaaggtgctcgaccgcttcggcgacctcggcgggacgaacaccagcgaggccgtgcgccggcactaccggaagcacgaccgggtgctcatcgtcaccgacgagcaggcggcgtacagccatcacggcgacccgaccgagcaggtaccggccgacgtcccggtctacacctggaacctggcgggccaccgcgcgggccacggcccgtccgggacggcgaaccggcacaccttcggagggctctcggacgcggccttccggatggtgccgctgctcgagggagcgcgggacgccgactggccgtgggcggcctgagccgaaccccgggtgggcgcgggctcgccgccgaggtgctgtacgcccacctcggcggcgagcccgcgcgcctgtcgacccctaccgggcgccgtgctgatccttcggccggcgtccggtgatgaccaccgccacgaccagcagcgcggtcaccgctaccagcgagcccaccccgaacgcccgggacgcaccctcggtgaggatcgccgacggggagccggtcgcgtgccgggtcgccgtgccgtacaccgtgaccaggacggacaggccgagggtgccgccgagccattgcagggtctgcaacaggccggaggccgcgcccgcgtcgcgtggttcgatgcccgcgaggatcgtggcgttgagcggcatgaaactcatgccgacgcccatgcccatcaggatcagcggcccgagcagcccggtgacatagccgtcgccgggctcgagccgccacagccagccggccgcggccacgagcagcgtcgtgccgatgagcagcagcggcttggcgccgtggcgctggaggagacgcggcacgaagcgcacggtggcgaacagtgcgagcgtcatcggcaggaacgcgaaccccgcgcgcaacgggccgtatcccaggacctgttgggtgaacagcgtgaggaagtagaaggcgccgaacatgccggccggcagcagcagtacgcccgcgtagccgcccgcgcggttgcggtcgcggaagagacgcagcggcatgatcggctggccggcgcgggattcgacccgtgcgaagcccgcgagcagcgcggccgcggtcgtgaagccgagcagggcccgggtgtcgctccagccccgctccgagacccggatgaacgcgtagaccagcgaggtcgtgcccgccgtgccggtcagtgcgcccgccgcgtcgaagcggcccgcgtggcgcggggtctcggcgacgaagcgggggagggcgagggccactccgatgccgatcggtacgttgatcagcagggcccagcgccaggaggcccaggaggtgagcatgccgcccaggatcagcccgatggaggcgccgatgctcgccatcgaggtgtagacgccgagggcgtggtggcggcgcgggccgtcggggaagttggtggtgatcagggcgagggtgctgggggcggtgagggcggcgccgatgccctggagggcgcgggccgcgagcagccagccgctctcgcccgcgagaccgccgagcagcgaggagagggcgaagagcaggacaccgcaggtgagggtgcggcggcggcccgcgatgtcgccgatccggccgccgagcagcaggaggccgccgaaggcgagcgtgtaggcgttcaggacccaggacagaccggtgggcgagaagcgcaggtcccgctggatgtcgggcagcgcgacgttgacgacggtggagtcgacgccgaccatcaagtaggcggtgacgatgacgaagaggacggcaccgagcctggcggggtgcgggtccgcccgcggtgggccggtggtggacgcgggcggggtggacggggtggacatgggatgctccctgtctgatgtccccggtcgacatgggtacgggcagcacggactgcccgcagagataagcggggactgtctccgtttaatgctcgataagatacggagacggtccccggttcgcaaggagtatctggatggcgcaggtcaagcccatgcgtgccgatgcgcggcgcaactatgagcggctgatcgaggaagcggcggtcgccttcgccgagcatggggaaggggcgtcgctcgacgacatcgccaagcgggccggggtcggctcgggcacgctgtaccggcacttcccgaaccggcaggcgctgctggaggccgtgtacgtcgacgccatcgaggcgatcgcgatgcgggcggacgagatcgcggcccggctgcccccgggtgaagcgctggtggagtggctgaacgagctgagcgagcggatgatccaggtccgggggctcaagacgctgctgggctcggccgtgacggacgggagttccgccgtgctcaccgcctgcggcagctccgtgaagggcgccgcgacccggctggtcgaggcggcccagcgggaggggaccgtccggccggacgtcgagccgatcgagattctgcggctggcgcacggagtggccacggcgtcggaactggcgaacggggaggggaagcacatccggcggtatctgtcgctgctcacggaggggctgcggccggaacgccgacgggcggacggcgggccggggccggagaactgacggcggggcgccctcttccgaagagggcgccccggactgcgtacgggctgttgtccggccccttacagcgcctgcgccgaaggcttcaccatgccgcggaccgtgcgggacttcacgaagtcgcccagggccgtcatctcccactcgccggagaactgcttgatcagcttggccatcatgacgccggtctgcggctcggcgctggtgaggtcgaagcggaccagctcctcgtccgtggcggcgtccacgaggcggcagtaggccttggcgacctcggtgaacttctggccggagaaggagttcaccgtgaagaccaggccggtgacctcctgggggagacggccgaggtcgacgacgatgacctcgtcgtcgcctccgccctcacccgtgaggttgtccccggagtgcttgatcgcgccgttcacgatcgacagcttgccgaagtagcagctgtcgatgtggttgcgctgcgggccgtacgcgatgaccgacgcgtccaggtcgatgtccttgccgcggtacgcgggctcccagccgaggcccatcttgacctgggtgagcaagggacggccgcccttgaccagggagacggtctggttcttctggaggctgacccggcccttgtccaggttgatcttgccggcgccgggggcgggcgcggggggtgccggcggggcggccgggaccgggggtgcggagacgcgcgggtccaggggcggggccggcgcagtcaccgggggctggacggcgggcgccggcgcggcggccggttcctccacggtgacgccgaagtccgtggcgatgcccgccaagccgttcgcatacccctggcccaccgcgcgggccttccacgctccgttgcgctggtagatctccacgaccaccagtgccgtctccgtgccgagctgcgggggcgtgaacgtggccagtacggagttgtcgtccgcgttgcggagcgtggccgtgggttcgatgccctggaaggtctggccggcggcgtccgggctcgcggtcacgacgatcttctcgatgcccggggggacggcggtggtgtcgaccgtgatcgcgtccggggaggtgccgccacccgagcggtaggtcacgcccgggccggtgggctggttgtagaagatgaagtcgtcgtcggagcgcaccttgccgtcggcggtgagcagcaggcccgaaacgtcgagccgcacgggggcggcgacgtccaccgtcacgcgggtgacggggagagggatgttcgagccgggggtcatagctgtcatgactggggtaacgagcgagggcgctttgccgttcccttacctacgggttttgctgcccggaggattccgcccccgccgccccgctcatttccgtcgcgagggatgggaatgagcagggggcgccgggggcggaaacccgcgccgcggtgctacggcaccaccacgatcttcctccccacccccgacgcgaactgctccagcgcctggggataccgcgccagcgggatgcggtcgctgatgaagacgtccggatcgaggacgcctccggcgaacagctccgccgcccgttcgaagctgtgcagcacggccatcgaaccggtgatcgtgatctcctggttgtagatgcggtacgggtcgatcgtcacgcgcgtcgcgtagtccgcgaccccgaactggaggaacgtacccgccttcgccacccggccgaggccgtcctggatcgccgccgcgttgcccgtcgcgtccaccacgacgtcccacccctgcggccggtccagttcgtcggcgttcgcggcggagccggagacacccagctgccgggccgtcgtcaggcgtgccgggttcacgtccaccacgtccacgctcgccgcgcccgtccgcttggccagctccagcatcatcagccccatcgttccggagccgtagaccaggacgtgcgcgccgagccgggaccgcaggacgtcgtagccgcggaccgcgcaggacagcggctcgatcagggccgcgtcctgggtgcggacgtgttcggggagcttgacgcagttggcgaccggagccaccgcgtaccgcgccgcgccgcccgccgtcgtcaccccgatcgccgcccagcgctcgcagaggttgttgtggcccgtacggcagtaccggcactcgtagcagtagagggacgggtccaccgccacccggtcgccgaccgacacctcggtgacctgggtgcccagcccgaccacctcgcccgcgaactcgtgccccggcacgatcggcagcttgggcgcgaactcgccctggaggatgtgcagatcggtgccgcacagcccgcaggccgcgacctcgacgacgacctcccggggccctggcgtcgggtccgggacctcggcgacgacggccttgcccacggactcgatgacggcggccttcatttcacggctcccagtgacaggccctggaccagtttgtcctgggcggcgaaccccgcggcgagcaccggcagggagatgacgagcgacgcggcgcacaccttggccaggaacaggccctggctggtgatgaagccggtcaggaagaccggggcggtctcggcgaccacaccggtgagcacccgggcgaacagcagctcgttccagctgaagatgaagcagatcagggccgtggcggcgatgccggggagggctatgggggctacgacccgggccaggatcgtcggcagtttcgcgccgtcgatctgcgccgcctcgatcaccgccaccggcacctcggcgaggaacgactgcatcatccacaccgcgatcggcaggttcatggaggtgtagaggatgaccaggagccagatgttgtccagcattccggtgttcttcgcgaacaggtagatcgggagcaggcccgccacgaccggcagcatcttcgtcgacaggaagaagaacaggacgtccgtccacttcttcaccgggcggatcgagagcgcgtacgccgccgggaaggccagcagcagcacgcagagcgtcgagaccagcgacgccaccagggagttgaccagcgccggccaggggctcgcgccgcctcccgtgccgaagaagtcgcggtagccgtcgagggtgagggcggcgccgaacgaggggggattggtcgccgcgtccgactccgagtggaaggacgtcagcgccatccaggcgatgggcaggaagaacagcagaccgagcagccaggccaccaggcccaggcccgctccccgggtgagacgggtgcgtacggggcgtacgggtcgtacgcgtggcgcggtggcactcatgcgcgggacacctcctcgcggaacagggacgacaccacgcgcagcgcgaaggtggcgatgatgatcgagccgatgacgaccaggacgccggcggccgaggcgaggccgttctcgtgggcctggtagaagctctggtagacggtgtagggcaggttcgcggtgcccaggccgcccgaggtgatggtgaagaccgcgtcgaagttctgcacgatgtagatcgagccgagcagcgcgcccagttcgaggtagcggcgcagatgcgggagcgtcaggtggcggaagatctgccagtcgctcgccccgtcgacccgcgccgcctcgatctgctgctggtcgcggctctgcagacccgccagcaggatcagcatcatgaagggcgtccactgccacaccagggaggcctcgaccgcgagcagcggggtgttggagatccagtccggctggggaccgcccacgtagtgcagcaggccgttgagaaggccgtactcggggttgtagagcacgtgcttccacaggagggccgccgccaccgggaccaccaggaagggcgcgatcaggagcgtacggacgacgccccggccccggaacctgcggtccaggaggagggcgaggcccaggcccaggaccaggcaggcgagcaccacggtgaccgtcagcaggatcgtcgtccacaccgagtggcgcaggtccgggtcggccaggacctggtggtagttgtcgacgcccgtgaagtggcgggccttcgggtagagcgcgttccagtcgaagaaggagatcaccagcgtggccacgaacggcagctgggtcacggcgatcatgaagatcagggcgggcaggagcggggcccgggtggcccaggcgcgcagccgggtggagggctgccgcgtcgtgcggacgggagcggcggccacgggggccgttgtcgtggcggtcatcgtccctcgtactccttcgagatctgctcggcgagcttctgggacttcttcagggccgagtcgacggactggcgtccggcgatggccgcgctgatctcctgggagaccttggtgccgaggtcggtgaactcggggatgccgacgaactggatgccgggcgcggggcggggctgcacaccggggtcggtgggccgggcgccctcgatggcctcgcgggtcatctcctggaaggcgccggcctccttgcggtagtcggggttcgtgtacgtcgacgcccgcttgcccgcggggacgtccgaccagccgaccgtgtcgccgacgagctgctcgtactccttgctcgacgcccaggagacgaacttccaggccttgtccgggttgcgggacgccttctgcatgccccaggcccaggtgtagagccagccggacgacctggtcttctcgaccggtgcgggtacgtagccgatcttgcccttgaccggtgacttggccgactccagggaacccgccgcggacgtggcgtcgtaccacatggcgaccttgccctgcgtcatgttgttgaggcactcggcgaagccggactgggccgcgccggactcgccgtgggcgcggacgaggtccacgtagaaccgcgtcgccttctcgaactcgggggagtccaggcgcgccttccagttcttgtcgaaccaggtgccgccgaaggtgttcacgaccgtggtcagcggtgccatgacctcgccccagccgggcagtccgcgcagacagatgcccttcatgccggactgggcgccgtccacgtccgtggccagcttgttcacctgctcccaggtcgggtgcgcgggcattttcagccccttctcggcgaacacgtccttgcggtacatcaggaaggacgactcgccgtagaagggctgcccgtagagccggccgtcgtcgccggtcagcgactggcgcatcggcttgaggatgtcctgctggtcgaacgcggtgtcgccccggacgtagccgtccatggagtgcagccagccgttcctggcgtagatcgggatctcgtagttgctgagggtggcgacgtcgtactggcccgcctggttggcgaaatcctggctgatcttgtcgcggacgtcgttctccggcaggacggtgaagttcaccctgatgccggtcttcttggtgaagttcgtggcggtgagcttttgcagctccaccatctgcgggttgttgaccatcaacacgttgatggagtcaccgccggaaccggacccgcctgctccgacccaacagccggaaagcagcggggcgagcagcgtccctgcggcggccatggcgagcgtggctcgcggcctccgtcggctctgggttcgcatggatcgctcctggacgtatggggagttatggggtgcttgccggcatgggggtgccctgaagaccgagtgagtcgggttttcgtacgcgctcgtgcgggtcggtgggaatgtcagacgcggatgacctggggtccccgcagtgagtagcggtgtgcctcggacgtcggcagcagggtgctcgtgacgatcgcctccaggtcgccgacctccgcgaaccggcagaagctgaccgccccgaacttggtgtgcacgcccgcgaagaccgtacgccgggacgcccggatcgcctgggccttcacctcgctgaccgccgggtcgggggtggtcagtccgtgttcgcgcgagatgccgttcgcgccgatgtacgccagatcgatgacgaacccggccagcattttcgtcgtccagtggtcgacggtcgcgagcgtgcccggcctgacccggccgcccagcagcagcacgctggtgttctcggcctccgcgagcgctcccgcggtggccagtgacgcggtgaccacggtcagcggccggtccctgggcagcgcctcggcgatcagctggggggtgaagccctcgtcgacgaagacggtctcggcgtccccgaggagctcggccgcggcggccgcgatccggcgcttctcgggtacgtgactggtggcgcggaaggcgagcgtcgtctcgaagccggcgctctcgacggggtaggcgccgccgtgggtgcggcggagcaggccgtggtcctccagtgcgcgcagatcccggcgtacggtctccttggccacgcccagttcggcggcgagcgcggtgacgtcgaccgaacccgtgacccgggcggcccggacgatctcgcgctgccgttcctccgcggtccgcgtcgtcttcgccgccatggccgccacctgctccctgtgcgcactgcccgttcgggcccggtggggcccatgggggaagttctacagcgggtgcgcggcactgaccaggcctgttgcaggtccgaccgcgcccgaatgtgcctgcttggcgaaaccgccgcccgtcgcggacctggggtggagccgggtggggagtgggatcgggcagcttccgtgcccgaacagcacggcgggcgggcccgttcggtgcccgcccgcctctgtgtgcccgtgttccggccgcgtcagtacggccagaccggcgggtcggtggtgaagtggccgcccaggtggtcgtgggccgggttgtccgggtccagctcgccctgttcggcgatgagcttctcggcgtacggctcggagtcgtcctgcggctggtagccgagcgcgcgggcggtcgagaggtcccaccacaggcgggtgttcgcggacgagccgtggacgacggtgtgccgtacgtcctcggcggtcagggccgcgtggaagaggcgggcgccgtcctcggggctcatccagaccgagagcatgcgcacgctcgtgggctcggcgaagcaggagccgatgcgcacggagaccgtctccaggccgtgcttgtcccagtagaactgggccaggtcctcgccgaacgacttggacaggccgtagaacgtgtccgggcggcgcggggtgtcgaccgggatcagggggtcgtcgccccggggccggggagtgaagccgatcgcgtggttggaggaggcgaagacgatccggcgtacgccttcctcgcgcgcggcctcgtacaggttgtacgtgccctcgatgttcgccttcaggatcttgtcgaaggaggactccagggagatgcccgcgaggtggatgaccgcgtcgacgccccgtacggcctcgcgcagcgcctccttgtccccgaggtccgcggtgatcgcgtccggctcgccctcgatcggcagcaggtcgaggagacgcagttcgtagccgtaccgcggcagcagtccccgcatcagggtgccgagtccgccggcggcgccggtgagcagaacggtgcggggagcgggcatcctcgggtctccttggatcggcagccgtatgtccagccacatggtcagccgtatgtatgtacgaaattcacatgcgtggacacgctatggaggggtgacaggtgccgtcaagtgtcgcgcggacgtgggcaatccgctcccgtgacccgggcgtgtgtgcttgaccgcccctgagggagcgctttagcgtaggcgcgttcagaaatatagacatggatcagaaacgtgcaccggtgtgggtgccggcctgagcgcctgtttcaagggagagccccgtgacgtcagcacctctcgccgctcgactcagcatccccagtggcccgctgttcttccccgtcaccgcctaccgtccggacggcgcgctgaacctcgacgtctaccgcgagcacgtgcgccggggtgtcgaggcgggcgccgccgccgtcttcgcgtgctgcggcaccggggagttccacgcgctggcgcccgaggagttcgagcgatgcgtcggcgcggccgtcgaggagaccgcgggacgcgtacccgtggtggcgggcgcgggctacgggacggccctcgccgtgcggttcgcgcggctcgcccaggacgccggggccgacgggctgctcgccatgccgccctatctcgtcgtcgcggggcaggaggggctgctgcggcactaccgggagctggccgcggcgacctccctggagacgatcgtctaccagcgcgacaacgccgtcttcacccccgaggccgtggtcgagctggcccgcacggacgggatcatcggcttcaaggacgggctcggcgacctggacctgatgcagcgcgtcgtgagtgccgtgcgcaccgaagtcccgggcgacttcctgtacttcaacgggctgccgaccgccgagctgaccggcctggcctatcggggcatcggcatcacgctctactcttctgccgtgttctgcttcgcgccggagatcgccctggccttccacaaggcgctgaactccggtgacgacgccaccgtcaaccggctgctcgacggcttctaccggcccttcgtcgatctgcgcgcgcagggccgcggctatgccgtctcgctggtcaaggcgggggtacggctgcgcggcctcgacgtcggcgaggtgcgcccgccgctgcacgagccgaccgaggaccacgtcaaacagctggcgcagctcgtcgaccgcgggtacgcgctgcttcaggagggcatgtgaaggcatccgcattcgtctatccctgggatgtcaacggggatccggcggcggccgagcggatcgccgggctcggcgtaccccaggtgacgctcgcgtccgcgtaccactccacgcgcgcgctgaccccccgccacccccgccaccggatcgtcaccgccgaacacgccgccgtgctctacccgccgggcaagcggtggaagggccggactctgcggccgtacgccgccggggactgggcgctgggcgacgcgtacggggaggccgccgaggcgctggccggggccggactcgacgtgcacacctgggtcgtgctcgcgcacaactcccgtctgggcgaggagtttccgtgcaccaacgtggtcaacgcctacggggaccgttatccctgggcgccctgcatcgcacagcccaccacgcgcgcgtacctggtcgacctcgcggcggaggcggcggtacggcccggtgcgcgcggtacggaactggagtcgctcggctggtacggactggcgcatctgcacgcccacgacaagatcggcgggacggggctcggggacgccgggcagtacctcatgtcgctctgcttctgctcggcctgccggcaggggtacgcgggtcgggaactcgacgcgggcgcgctcgcggtggccgtacgggcggccctggagcccgtgtggcgcggcgccccgtccgacgggggctggacgacggtcgagaagctcctgggcagtgaactcgcgacggccacgcgcgcgtggcgcgaggaaacggcgcgcacgctccaggaggcggccgtcacggcggtccgcgcggccgccccggacggcttccaggtcctgctgcacgcggacccggtggcgtaccactgcggggcgaacgccggggtcgacccggcgcacatcctgtccgtcgcggacggtgtggtcgtgccgtgcacgggcggcgcggccctgctcaccccgttcgccgagcagggcaccggcgccgtgctcgcggccaacctcaccgtcgtctcggggatgggcggcagcccgggcacactggccgaggacgcggaccgggccgctcgtctgggcgccacggaactgcggctctaccacgcggggctcgcctcggacgccgacctggccacggttcaggaggcgctggcacggctcggccgggcacccgcgcgcagcggcaccgacgctgtcgccagcagggcgagacccagcagcaccaacagcgtctgacggtcgacgagtccgaccagacctgccccgacggcgagtcccaccgcgttcggcgcgaacatcagcgtgtgggcggtggccgtgacccggccgagcagggcgccgggcgtctcgcgctgcacggcggtgaacgcggcgatcagcacacagggaaggccggcgcccaccgccgccgcggacgtcagggcggccgcgtcggacgggaccgcgcgcagcgccagggccgccgcggtgagcgcgatcccggacgaggcgaagcggcgttcgccgagccggcgcaggaggggacccgcggccaggccggtcgtcaccgagccggcgccctggacgacgtacagcaggccgacgtacgcgggggagcgccccaggccgtcgacgaccgcgtagatcagggcgccgttgacacccgcgaagagcatcgtcgcgccgcccgccaggacgagcgggcgcaactccccccggccccacagatggcgcacgccctcggcgacccgcgcccgcaggccgtcgggcggcggctccggcccgtcctcgcgcacccgcagcagcgcgtacaggccggccgccagcacgaaggtgaccgcgtccagaagggcgaccatcgcgccgccgtacgccgcgtacaggcccgccccggcgagcggtgccacgagcttcatgccctcgttggccgtcatccgcaggccgttgaagtcgcccagcagggagctgtcgacggcggcggccaccagggccgactccgccgcgtcgtggaccacgccggccgcgccgtacaccagcaggaccgcgaacagcagccacagactgcccggcgagtccacggtgaagagggcgagcagcagggccgccacgcccaggttcgtgccgatcaggagcgggcggcggcgggtgcggtcggcgagtgtgcccagcacggggccgacgagtgtgggtgcccagagggcgaagacgcacagtgcggccaggccgttcgaaccggtcaggtccttgacccagatgcccgaggccagccacatcgccgacgatccgaagccggagaccaccaccccggccaggtacaaccccgcgttgcggtccctcaggacacgcgtcatcgtccatgtcatgcctggtcatgctggctctgaggccccaccgtgcggatcgggcagatgccctatgaccaggacgtgtggtgggcgggcgatgagttccgcctacgccgccggtctacccctggagtggaacagaactcagagcagaccccagagcagaccccggaggagaagcggatgactgaccacacgaccctcgacctcggcccgcaggcccgcatcgtggcgcgtctcgcggaggcggtgcgtgaggagcagctcacggccgtcactccgtgtcccggctacgcggtgcaccacatgctgggccatctgctcggcctcaccgtcgccttccgggacgccggccgcaaggacctgggcgccacgacggacaccagccctgaagccgccgtgccggacatcggaccgggctggcgcgaggagctgcccaaagtgctcgacgaactcgccgagacctggcgcgacccggccgcctggaccggtgagacccgggccggcggcgtgaccctgccgggcgcggtcgccggggcggtggtggccgacgaactggtgatccacggctgggacctggcgcgggccaccggccaggagtacacgccggaccagggcgcgctgcgggccgcgtacggcttcctggtcgccgcggccgaggacccgagccgcggcggcggcatcttcggccccgtcgtgcccgtaccgcgggacgcgccgctgctggaccgcgcgatcggcctgagcggccgggaccccggctggaagccctagccctagcccttgccccagccggagcgagagcgcggcgcggctggagggtcgggcctgcctgccaacacacgcaaaccggcggatcgcgtggccggagaaccgtacgctccgggcatgcccctcgccctcaccgtcctcggcaccgcttccccgcacccggcgccgggccgcccctcctccggttatctgttgcgcggcgggggcgccgaggtgtgggtggacgccgggttcggaaccttcgcggagttgcagcggcacacggatcccgcgcggctcacggccatctggatctcccatctgcacgcggaccacagcgccgatctgctggcggcggtgtacggactcgcgtacggagggctcaccccgccggcgccgattcccctctacgcgccgcgcgcctgcgggcagcggctcgccgggttcttcgggcggcccaacgagcggttcctcagcggggtcttcgacttccgtcccttgtacgacgggcacaccgtccggcactggaacctccgtctcaccgcccgcgccgtcgcgcacgacatcgaggcgtacgggctgcgcgccgagtgccaggggcgcgtcctcgcgtactcgggggacagcggcccgtgcgggacgctcaccgaactcgcccgcggtgccgatgtgttcctctgtgaggccgacatcgaccggcatcgcgaaggcgaacaggtccatctgacccccgaggacgcgggggcggcggcccgggaggcacgggtgggtgagctgctcgtgacccacgtgggacccacgctcaccccggaggcggcggccggacgcgccgccgcggtcttcggccgtcctgccgtcaccgcccgcgaaggcaccaccacaatcgtctgacgtcatcgcgacctcctttgtcagaagcgttgacgaaccgcctgcgcgctcctaccttcaacgcgtcgtacttcgtacgtcatatatgagacgcgatatgtgagatccgagaggcgcgcatgacctctgtgcccaccccgatcccgtcccgcacgcagtacgtgctggaggggatcaaacaccgcatcctcaccgggcagctgacgcccggccaggccctggtcgagaccgaactggccgcacagttcggggtgtccaagacgcctgtgcgggaggcgctcaagaccctggccgggaccgggctcgtcgtgatgaaccagtacaagggcgtcacggtgcgcatggtggacgcggacatggcgcgcgaggtgtacgacgtgcggctgctcctggagcccgaggcgctgcggcgcgcggtgcggcgcggcgcctccctggccgcggcccgtgacgcgctcacccgctccgaccgggccgccgacaccgccgaacgctccctcgccaaccgggagttccaccgcgccctctatgtgtgctgcggcaacccgctgctcggccggatgctcgacgaggtccgcgaccaggccgcgctcgtctccgccgtggcctgggccgccgacccctcctgggagcgcgaggccgacgagcaccgggagatcctgcggctcgccctggacggggacgccgacggcgcggcgagcgccctccacgcgcacatcgcgtcgttcgtgcaacgggcctttcccgaggcccagggagaggacggtcaggaatgacagcgacgtacgaggcccagcggacggcgctcgccgaggtcgtggcgatccccgtgaccccgttcgccgaggacgggtcggtcgaccgcgacacccaccgggctctgctgcgtcgactgctcgacggtggcgtcaagaccctcaccccgaacggcaacaccggtgagttctacgccctcacccccgaagagcggcagctcgtcaccgagttgaccatcgaggagacgggggaccggggggccgttctggtcggcgtcgggcacgacgtgccgaccgccgtggcctcggcccggcacgcccgggcgcacggagcgcagatggtgatgatccatcagcccgtgcatccgtacgtctcggacgccggctgggtcgactaccaccgggccgtcgccgaggccgtgcccgagctgggcgtcgtgccctacctccgcaatccgctgctgcccggtgcccggctggccgaactcgccgaccactgccccaatgtcgtcggcgtgaagtacgcggtgccggacgccgcccgcttcgccgccttcgcacgggacgccggcctcgaacggttcgtatgggtggccggactggccgagccgtacgccccctcgtacttctcggccggtgccaccggcttcacctcggggctggtgaacgtcgccccgtccgtctcgctgaacatgatcgaagcgcttcgatcgggcgactaccaggccgcgatgaaggtctgggagcagatccgccgcttcgaggaactgcgcgccgcgggcggctccgcgaacaacgtgagcgtcgtcaaggaggccctcgcctcactcggcctgtgccgccgtgacgtccgcgcccccagcaagccgctgcccgaggacgagcgggcggaagtcgccgccatcgcggcggggtggtccctgtgaagcgcccggaggagttcagaagccaccagtggtacgggagcggcgtctcgtcgggtctgcgctccttcagccaccgggcgcgcacccgccaactcggctacctgcccgaggagcacctgggcaagccggtcatcgcgatcctcaacacctggagcgacatcaacccgtgccatgtgcatctgcgggaccgtgcgcaggcggtcaagcggggtgtgtggcaggcgggcggcttcccgctggagttcccggtgtcgacgctgagcgagaccttccagaagccgaccccgatgctctaccgcaacctgctcgcgatggagaccgaggagctgctgcgctcgtacccggtcgacggcgccgtgctcatgggcggctgcgacaagtccacgccggccctgctgatgggcgccgcctccgtcgacctgccggccgtgttcgtgcccgccgggccgatgctgccgggccactggcgcaacgaggtcctcggctccggcaccgacatgtggaagtactgggacgacaagcgggccggcctcatcggcgactgcgagatgtccgaactggagagcggcctcgcccgttcgcccggccactgcatgaccatgggtacggcgtccacgctgacggccgcggccgaggccctcggggtgacggtgccgggcgcctccagcatccccgccgtcgactccgggcacgaccggatggccgcggccgcggggctcaggatcgtcgaactggtccgcggcgaccggaaactgtccgacatcctcaccgaggaggccttcgcggacgccgtgacgaccgtcctcggcctcggcggctcgaccaacgccgtcatccatctgatcgcgatggccggacgggccggggtctccctcacgctcgacgacttcgaccgcatcgcccggaccgtgccggtgctcgccaacgtccggccgggcggcggcccgtacctcatggaggacttccacttcgcgggcggactgcccggattcctctcccggatcaccgatctgctgcatctggaccggccgaccgtctcgtacgacaccctgcgcgagcagctcgcctccgcccaggtgcacgacgacgacgtcatccgcacccgcgcgaacccggtcgcggacgaaggcggagtcgccgtcctgcgcggcaacctctgtcccgacggcgccgtcatcaagcacatcgccgccgagccgcggctgctcaagcacaccgggcccgcggtcgtcttcgacgactaccggacgatgcagcggaccatcaacgaccccgggttgggcatcaccgccgacagcgtgctggtgctgcgaggcgccggccccaagggcggccccggcatgcccgagtacggcatgctgccgatcccggaccacctgctgaagcagggcgtacgggacatggtgcggatctccgacgcccggatgagcggcacgagttacggcacctgtgtgctgcacgtggcgcccgagtcgtacgtcggcgggccgctcgccctggtgcggaccggggacacgatcaccctcgacgtcgaggcgcggagtctgcggctccacgtggacgacgcggagctggagcggcgcggggcccggtggacgccgccgcccgagcggtacgagcgcggctacggcgcgctctacaacgaacagatcacccaggcggacaccggctgcgacttcgcgttcctggcccggccgggcaaggtgcaggacccgtacgcgggctgaggagaggccgtaccggccgcactccgcatgaccgacataccgaacgccgtacgcgaagcgcttcaccacaagaccgcgcaccacaagaccgcgcaccgcaagcgcagcgcttccccgcacaggacatgcacaagaacggagaccagtcatggcccaagccgcagccgtggcgaaacagcccgcgccaccccggcggcgccgtggctcggcgacgccccgcacactgccgtatttgccgtatctgctgatcgcgccggcgggcctgctgatgctgggcttcatcgcctacccggtgctcagcgtcttctactacagcctgcggaacttcaacccgaccaagccgtggcgcaacggctacgcgggcttcgacaacttcgtccagatcttcaccaaggacacccagttctgggacacgctgaccttcagcgccaagtgggtcgtcgtggaggtcggactgcaactgctgttcggcctggcgctggcgctcatcgtcaaccagaccttcgtgggccgggcgctgggccgcgcgctcgtcttctcgccgtgggccgtctccggtgtgctgacctccgcgatctgggtgctgctctacaactcccagaccggcatcacccgttacctcgccgacatgggtgtcggtgagtacggcaccagctggctgtcggacacctcgaccgtcttcccggcggcggtgatcgccgacctgtggcggggcgtccccttcttcgcgatcctcatcctcgccgacctccagtccgtctcgaaggacctgtacgaggccgccgaggtcgacggcgccggccggctgcgccagttcttccacatcacgctgccgcacctgaaggacgcgatcgtcctgtccacgctgctgcgcgcggtctgggagttcaacaacgtcgatctgctctacacgctcaccggcggtggccccgcgggcgagacgaccacgctgccgctctacatcgccaacaccagtgtcgacgcgcacaacttcggttacgcgtccgccctgaccacggtcgcgttcacgatcctgctcttcttctcgatcgtctatctgcggctgagcaagttcggaggtggagacaagtgatcaccaaggacgccgagatcagcgccccggtggtgcccgcgcccgagcccgcggcgccgcagcagtggccgcggaagacccggcgcgcctgggacgaggcccctcgctggcagatctacctccccctcggcagctacctgctcttcaccctgatccccttctactggatcctgctcttcgccctgcgcccggccggctccacgtcgctcgtgccgtggccgatgaccttcgagcacttcgagaaggtgtggaccgagcgcagcttcggcacgtacttccagaacagcgtcctcatcggcgtcgccacgctcgtcatgaccaccgtcatcgcgctcgccggcggctacgccctcgcccgcttcgacttcagggtcaagcggggtttcctgctggccctgctctgttcccagttcgtgcccggcgcgctgctgctcgtccccctcttccagatcttcgccaagctccagatgatcaactcgctcggcagcgtcgtcatcgccgagaccgtcttccagctgccgctgtcgatgatcctgatcagcggcttcatcaggaatgtgccgtactccctggaagaggccgcctgggtcgacggctgcaaccggttcacggccttccggatcgtcgtcctcccgctgctgcggcccggactgatagccgtcggctccttcgccttcgtgcacgcctggaaccacttcctgttcgccctgatgttcctcagcaaccaggacaagcagaccatccccgtcggcctcaacaccctgatgagcgcggacagcgtcgacctcggcgcgctcgccgcgggcggcatcatcgccgccgtacccgtggtcgtcgtcttcgcgttcatccagaagtggctgatcaccggcttcagcgcgggggcggtgaaggggtgaggcggattccgcgaccgacctccgtggccgacccggtgggcgcgctgctcagcactccggccgaccccgacgacactgctcctggggccgcttccatgactgcttccgtgaccgcttccgtgactgctcctgagaccgctcctgtgccgatcgttctcgcgggcgcccgtggccacggccgctggcatctggacaacatccgccggctccaggaccgggggctcgtccggctcgcgggcatctgcgagctgaccccgctggccgaggaggagctggacgggctcggcgtgcccgagcagtccgccgacttcggctctctcctcgacgccaccggcgccgcgatcgccgtgatctgcaccccgatccccacccacaccgacctggcgctgacagccgcggagcggggtgtgcatctcctcctggagaagccgcccgccccctcgttcgccgagttccggcggatggccgacggggtcgccgcggccggagtcgtctgccagatcggcttccagtcgctgggctcgggcgccgtgcccggcatccggaagctgatcgccgagggcgcgctcggcacggtggccggcatcggggcggccggggcctgggcccgcgacgaggcgtactaccggcgtgcgccctgggcgggcaagcgccggctgaacggcgtcgacgtgatcgacggcgtcctcaccaatccgctcgcgcacgccgtcgccaccgccctcgcgctcgacggctccacccgcgccgaggacgtcaccgacatcgagaccgagctgctgcgggccaacgacatcgagtccgacgacacctcctgtgtgcgggtgacgacgaagtccggcggccggatcaccgtcgccgccaccctgtgcgccgaggagcccgacgagccgtacgtcctggtgcacggcgaccgcggccggatcaccttctggtacaagcaggaccgggtgctggtgcagcgctcgggacacggcccgcaggagatcgagtacgaccgcaccgacctgctggagaacctcgtcgggcatctgacgcacggggccgagctgctggtcacgcccgagtcgacgggcgccttcatgaaggtcgtcgaggcgatccggcaggcacccgatcccgtcgcgctgccgggcgatgcctgggagctgattcccggtgagaaccgccgggtcgtccgcggcgtcgacgggctggtcgccgccgccgccgacaccctcgccctctactccgaactgggcgcctcctgggcccttccgaacgaggtgagcagccgatgacccctttgacgaacaggacgaacagcggcgactgtccggtcctgcggatcgcgggccgccccgtcggccgctacatcacgcggcccgaactgcccggccggatgtccccgcgcccctatctgcacccggtcaccaccctggccggcacggctgtcaccgaacgcggccccgccgaccacacacaccacctcggcgtcggtgtcgccgttcccgacgtcgaggggttcaacttctggggcggccgcaccttcgtccgcgaccagggccccaccgagctggacaaccacggcgcccagcgccacgccggcttccagctgcgcgaccccgacgggttcgtcgaggagttgcgctgggtggccgcgggcaacgaactgctgcgggagcgccgtaccgtcgccgccaccgcgctcaccgactccgcctgggccctggacttcaccttctcgctcaccaacatcacccccggcccgctctcgatcggcagccccgccaccaacgggcgccccggcgcggcctacggcggcttcttctggcgggcccgcaaggaggccggcgcgccccgcgtcttcaccgccgctgccgagggcgaggaagagatccacggcacccgcgccgactggctcgccctggccggcgccacctggacgctggtcttcgccggggcgaccgagcggacccgccgggatccgtggttcgtgcgcgccgccgagtacccgggcgtgggctcgtccctggcgcacgaggaacggctgcccgtcgcggccggggagaccgtcgtacgccgcatcgtcacggtcgtcgccgacggcagcctgggccggggcgaggccgccgccctcgcccggacggcggtgagcccgtgatcctcacctccgacctgggcgacggcacctaccgcacccccgtcctgaacgccgactggtccgaccccgaccttctccgcgtcggtgacgacttctacctcaccgcctccagcttcggccgggccccgggcctgcccctgccgcactcccgcgacctcgtcaactggaggctcgtcggccatgcgctcccgcgcctcgaaccggcgcacgagttccggaccccgcgtcacgactgcggagtgtgggcgccctccctgcgccaccactacggctggctctggatctccgcgcccgccgggggagtgcagaccggctggcagggcgccttccgctcgcccggcttcttcgggccgtacgaggagcggatcgtgctggagcagggcgacaccgacgtcgacggaccgcaccagggcggctgggtgcgcaccccggccggcgaggactggttcgcgcacttccaggcgcggggcgcgtacgggcgggtcgtccacctccagctgatgcgccggggctcggacggctggccggtgatcgggaatgagggcgtccccgtggccgtacacaggaagccggacctgccgcggcagccgccctccgcgcccgccaccgacgacgacttccccggcggccggttcgggcgtcagtggcagtggaccgccaaccctctccccagctctcggctgcgctcgagcaggggtgacccccatgacggctgggccacccagctctccggcgacgggctgcgactgacctgcgtgcgcaccgccgacgcgcacgacctgcgcaagctcccgaacgtgctcacccagcggctgcccggcgcgcccgccaccgtcgaggtggagctgcggctggacagcgaggaacccggggcccgggccggactggcggtgctgggcgacgcgttcagctggatcgggctccaacgcggcagggacggctcggtccagctggtgcaccggttcgacgaatccgtcgccatgggggcaccccccacaccttcggggcagtgggggaaggagcgggacgccgcgcacgcgcggctcgcgcccggcgggcgggcccggctgtggatcgagatcggcaggggagcgcgctgccgcttctcgtacgacaccggggacggccgtcggccctccggcccggtcttcgccgccaccccctggcgctgggtcggcgccctgatcgggctcgtcgcgctcgcgcccgtcggcgcgggccacgccggcgcggccacgttcacccggttccgcggcaccgccgccggctccgcctccctctctgcccccgcctccacctcggcctgaagtcgccccaccgttcgcctgttgggagccgcaatgtcgcacctccgtagcaagcgcttgccgcaagaccccgcaaccccgttggatccagaagaagagagccggccaatgaagatcagcatccacagaagcaggcgcgccgccacggccgtcgccctgggctccgtgctcgcgctcaccgccaccgcctgcggcgacgacggcagcggcgccgcgggcgacaagggcaccgagggctccggcaagggcgagatcaccttctgggacaacaacggcggtgtccgcaccgacatctggaagcagatcatcgccgacttcgagaagaagtacccggacatcaaggtcaactacgtcgggatacccgccgcgagcgcccagtccaagtacgacaccgccatccagggcggtggcctgcccgatgtcggcggtgtggggaccgcgatgctcgccgaggtcgcggtccagggggcactggagccgctggacagccggctcaagaagagctcgctgaacggcgagctgagccagaacctgctcgacagcagccgggccgcgggcggcggggacacgctgtaccaggtgccgacctccgccaacaacggcacgctgtggtaccgcaccgacctgttcaagagcgcgggcctggacgcgccgaccacctggtcgacgttctacgaggccgccgacaagctcaccgacaagggcaagaacaagttcggcttcaccatccggggcggcgaagggtccatcgcgccggccctggacgcggtgtacgggcagaccggcatcaccgagttctggaacggcgagaagaccaccgtcaacgacccgaagaacgtcgccgccctcgagaagtacatcgccctgtacaagaaggacaccccgtccgcggacgtcaacaacgacttcaccaagatggtcgcccagtgggacagcggcaccatcggcatgctgagccacaacctcggttcctaccaggaccacctgaaggcactgggcgcgggcaagttcaagggcatccccaacccgacgcgggacgacggcacacgcgtgcagatctccaacccggtcgacgggatgagcgtgttcaagtccagcaagaacaaggcggccgcctggaagttcatcgagttcgccgtctcctccgcggagaactccaagttcaacgagtccgcgggccaggtcccggcgaacaccgaggccgccaaggacacctgggtccagcaggccgagcccaccaagctggccgcggaggcgctcaacggcgccgacaccaagatcgtgcagctgccgtactacctgccggactggaacacgatctccaaggccgacaacgagccgaacttccagaagctgctgctcgggaagatgtcggcgaaggagttcctggacacgttggccgatcagctgaacaaggcgcaggcggactggaaggcgaaccactaactccgttggtcgggccgggtgcggtcggttcggggtcgttcggttcgatgtgcgacctcgggccggtcgtggctggtcgcgcccacgcggcggagccgcgcattgtcacagccccgcgccccttcggggcgcgtcacctcacccctgctgaaaggcacatccctgtgtcgctcacccgcagacaagtcgcctcggtggccctcgccgccttacccgtcgccgtcgtcgcgacggggcccgcgtccgcccatacgaaccgtcgggcacgcaccctctacatcgccggtgactccaccgccgcccagaagtacgccgacgccgctcccgagaccgggtggggcatggcgcttccgttctttctccgggaggacctgacggtctccaaccacgcggtgaacgggcgcagttcgaagagtttcatcgacgaggggcgtctcgacgcgatccttgaagtgatcgcacccggcgacttcctcctcatccagttcggtcacaacgacgagaagagcgccgacccgacgcgctacaccgagccctggacgacctaccaggactgtctccgtcagtacgtggacggggcgcgggcccggggtgcgcggccggtgctcgccaccccggtcgagcgcagaaagttcgacgcggacggcaacgccgtgccgacccacggcgactacccggcggcgatgcgcgccctcgccgaggacgagctcgtggcgctgctcgacatccaggccctgtcgatcgccctgtggcagaagctcggcgtcgaggagacgaagaagtacttcaactggaccgcgaccgagcaggacaacacgcacttcgacccgccgggcgcgatcgccgtggcccggctcgtcgcggccgggctgctgcaccgccgggtgctggcgccccgggacgtgcgccggctcgacgcggaagtccccgagtcctggatcacctggccacaggccaccgcgtaacccctcccgaatcgctcccacagcctttcccacagcctctcccgcagcctcttccgaagaatgcgagccgcacaatgaacgcacagacatggcatgggcacgtcaccacgacggtgctggtcggctgcaccgccctggccctcgccgtcaccggtaccaccgccacggccaccgcccaggcccaggcgcagccccgtgacctgggccgccagaccctcgccgccggtgacggctgggcctccgacggcaccggcaccaccgggggcgcggccgccgacgccgcgcacgtctacaccgtcaccacctgggccgggttcaaggccgcgctgaaggacggcggcaccgcgccgaagatcatcaaggtgaagggcacgatcgacgccaacgccgagggctgcgactccttcgccgccgccggctacgacttcgacgcctatctgcggaagtattcgccggagaactggggttacggcgccaacctggacgccgagccggacgacagccccgagggtctgcggcgcgtctccgccgacacccaggccaaggccatcaaggcgagcgtccccgccaacaccacgatcgtcggcctcggcaagaacgccggcttcgagggagccagcctccagatcacggccgtcgacaacgtgatcatccgcaacgtcgccttcgagagccccctcgactgcttcccgcagtgggacccgaccgacacctccgtcggcaactggaactccgagtacgacagcgcggtggtctacggggccacgcacatctggctggaccacaacacgttcaccgacggggagcaccccgacagctcgctgcccacctacttcgggcggatctaccagcagcacgacggcgagctggacatcgtcaagggcgcggaccacgtgaccgcctcctggaacgtcttcaccgaccacgacaagacgatcctgatcggcaacagcgacagcgcgtccaccgcggcggtcgaccgcgggcacctgagggtcaccttccaccacaacctgttctcgggcctcgtcgagcgcgcgccccgcgtccgcttcgggcaggtcgactcgtacaacaaccacttcgtggccggctccgcctactcctacagcttcggcatcggcatggagtcacaactcgtcgccgagcacaacgcgttcacgctgcccgaggggatcagcgcggcgacggtcctgaagaagtggaaggaggcgccggtcaccgccgccgacaactacgtcaacggggcgccgacggacctgatcgccgtgcacaacgcggagatccccgcggagacccttcagtccggcgccggatggacgccgaccctgcgcacgaaggtcgacccgccgagggcggtgccggggatcgtggatcaccgcgcgggcgccggcaaggtctgctgaccatggccggactcccgctcagcagacgggcgttcgtcgccgcgtgcaccggagccgcgctggctccggtactcgcggcccccgcccatgcgaccacgagggcgcctttcggacgctacggttcgcccgccgcccgcctcaccgagcagaccctgtacgtccatcccggcgggctcggcgaccacaccaccgtccaggccgcggtgaccgcggctgggggtacctcccaggcgttcagcactgggggaggcagcggccgcacgctcgtcctcgcgcccggcatctaccgcgagacggtcgccgtcggcgtcgcccgtacggagatgacctggatcggcgcctccggagacccgcgtgacgtcgtcgtcgtgtacgacaacgcggccggcacgcccaggcccggcggcggcacctacggcacgaccggctcggccaccaccaccgtgcaggccgacggcttcaccgcccgctcgatcaccttcgccaacgacttcctgcgcgccgaccaccccgagatcaccggcacccaggccgtcgcgatcaaggtccagggcgaccggtcggccttcctggggtgccggttcctcggccaccaggacacgctgtacgccgactcgatcgcgctcggcacgttcgcccgccagtactaccgcgactgctacgtcgagggtgatgtggacttcgtcttcggccgggcgacggccgtgtacgagcgctgccacttccacaccctgaaccgcacggacctggccggggccccgtacggcttcgtgttcgcgccgtccaccgccgccgccgacccgcgcggctacctggtcacccgcggccgtgtcacgagcggggccccggacgcgtactacaagctcgcccgcccctgggtgcccagctcggaccccaccgcccggccgatgctgacggtccgtgacacccgcctcgccgccgggatcgacgcggtcgcgccctacaccaacatgtcggacagctatccgtggcagagccagcgcttcgccgagtaccggaactccggtccgggcgccgaggtcacggtccccgggaaccggccccagctcacccgcggggaagccgggtcggcgacccgcgaggcgtatctgggtgactggacgccatggagggggtgttgagatgcgccgacgtgcgttcctcgccagtgcggccggggcggccggtgcgctgacggccctcggttcgacgcccgccccggcttcctcgtgccggacgctgcacgtccgccccggcgactccgtccaggccgcggtcgacgcggtgaccgggcccggccggacgatcgtcgtgcacccgggcacgtaccgcgaagtcgtcacgatccccgccgacaaagccggcctgacgctgaggggtgccacacgcgacccgcgcgacaccgtcatcgtccacgacaacgccaacgggacggtgaagcccgacgggaccacctacggcaccgcgggctcggccaccttcacctcggcggcgcccgggctgaccgtccacgggctgacgctcgccaacgactggctgcgcgcggaccacccggagatcacggggacgcaggcggtggcggcgtacgtcacgggagaccgttcgtccttctcgcgcgtgcggctgctggcgcaccaggacaccctgttcgcggacaccaccgcgctcaccgccttcgaccgccaccactaccgcgactgctacatcgagggcgacgtcgacttcgtcttcgggcgggccaccgccgtcttcgagcgctgccacttccacaccctcgaccgggacgtcgccttcaagcccgaggggatggtcttcgcaccgtccacggcccgcgcgaatccgcacggcttcctggcggtacgcagccgggtcacctccggcgccgaggacggggcgtacaagatcgcgcggccgtgggtgcccacgtacgagacgacggcctggccgtccctggtcgtacgggagacggagctgggccccggcatcgacgcggtggcgccgtacaccgacatgcgcgaggcctacccctggcagtccatgcgctttcgcgagtaccgcaacacgggccccggcgcggagatcaccgcgccggagaaccgtccccagctcacggacgcggaagccgcgtcgcacacgcgtgcggcgtatctcggcgactggcgcccgtgatgtccccgcaccgaccaccgctgtagctccaccaacccgcatcgacgaaaggaccgcactccatgtctcgtcgaaccgctctcgccctgggcgccaccctggcgctcggcgccggactcgccgtcctccccacccaggcccaggcggcgaccgtcgtcgtcagcaccacggctgatctcaccagcgccatcaagaacgccaccgccggtaccgtcatccaggtgcgcggcggcacgtactacccgacggcgaccctccagtcgaccgccaacggcacctcgtcgagcccggtcaccctccaggcgtacggctcggagacggtgaagatcgacgggtcgtcgctgcccgccggcgactggatcttcaagctgaccgccgactactggaacgtctccaacatcaccttccagaactccccggacagcgccgtcgtctgccagtcctgcaccggcacgaactggaacaacatcaagaccatcaacggcggcgactccggcttcaccctcaccggcgacggcaccgtcaacaacacggtcaggaacatcgactcgtacggccactacgacgccgccacccatggcgagaacgcggacggcgtggccgtgaagttcggctccggcaccggcaacctgatcaccggcgcccgcctgtacaacaactcggacgacggcatcgacttctggtccttctcctcgaccgtcaccatcgagcacacctggtccttcggcaacggcaagaaccgctggggcgactcggccttcgcgggcgacggcaacggctacaagctgggcggcgacggcgaggtcgtcgcgcatgtcgtcaacaactccgccgcctgggacgacgccggcagcggcttcaccgagaactccaacaccggcgcgatcgtcatcaaccgcaccaccgcctacgccaacggcaagtacggctactacttcgccaccagctccgcgaagctcggcaagaacctggcggtgagcaacgggtccgcggcggtctccaagggctcctcggtcacgtcctccggcaacaactgggactcgggcatcgccacgccgtccttcatctccacggacgcgacgacgacgtacaactcccgccagtcgaacggcgcgctgccgacgacgacgttcctgacgacggggagcacgacgatcggggcgacgatgaactaggtgaactaggtgaactaggtgaactggtcgtcagcaaccgctccgtgcgggaagcggcacggccggccgcttcccgcacgccgacggacgctcagcccaagtgccacagggcgtacgccaccacgcacaggatcacacccgcgaacgccatcagcgcgcccaggaaccggagatagccgggagtcgcgaaaacagtgggcgacccgcccaggcgacccatcgccgcccagctctcctcattcctacggcgaatccgctcggcgcgccgggtggtgatcccgcgcacgtcgaacgcccaactcaccccgcaccagaaggcgaccaggccgcccgacaggaagacggcgaggacgaccggcgaggggccgttcgatcccgcggcgaggtggagtccctcagtcaattttccgttcccttcgtgcaggaccatgccgtcgccgaggtcatcgcccctgcggtgcaacccgcctgacgcatcgttcgcatgtgcgttccgaccctaggagaaccggttcaagagaaggtcaagacggcgtcagtcgcgggcaatgcgtcccaggaggtgcttcctgtgcgtgagatatcgatcggataaagcctctcgcgccgcgtgcgtgatgcgcgtagacagtctctgacctggtgcggaatgacctggttaccaaccctcccagatccggagaacccatgcggaagtccctcagagcggctgccatcggcgccgcttgtgccgtcgccggtgccgccctgtacggcaccggcgtcgccaccgccggccagtcgacggcgaactcgacccatgagccctacaacatcgggctcctggtcaaggacatcgacacctactacggcgccacgctcgacagcaacggcgtgtaccaggcgtccaaggacagccagtacgccaaggacctggcgcgcctggagtcgggcgccaagcgctacatcgacaaggcggcgcacaaggcgaagcgccacggagacaagcccgcggtcgtcttcgacatcgacgacacgctgctgctctccctcgactacgagaagaagaccaactacacgtacaactcgaccacgtgggccgactacgtggccaaggccgaccgcccggccgtcttcggcacccccgaactcgtcgcgtacgccaagtccaagggcgtcgaggtcttctacaactcgggcctgaaggagtcgcagcgcgtctccgcggtcgcgaacctgaagaaggtcggcgccgacatcaacctcgacgccgaccacatgttcctcaaggacgcggccaacccgccggcgtacctgagcgcctgcgccaccgccgccgcctggaactgcacgaccgtgcagtacaagtccggcacccgcaagcacatcgagtccctcgggtacgacatcgtcgccaacttcggcgaccagtactcggacctcgagggcggctacgccgacaagacgtacaagctcccgaacccgacgtacttcgtgagctgaggtccgtctccggaccggtcctgctcacaggaacgacgccaggccgaccgccgcttcgcaggaagcggcggtcttgtcgtacctgggctctcatgatcaccttcgatgggacacatgttctaatggaccggttttcggcatgaacgcaccggcccggcgcaggagtcgctcgctccgctcctgccccgggccgtgaccggccgctagtttgcgcgcacgggcctgaccgactccagcgtcggtgtcaccggctcgatcgttccgtcggccgcgaaggtcatccggtcgatggtcgtctcccggtgcgtgccgtccccgcccgccttcccgggaccgctcagggcgaaccggtggtagacgatgtaccagtcgtccgtgccgggcacgttcaccaccgagtggtgaccggtccccttgatgccgtactcggggcgcttggacaggatcgtgccccgcttggtccacgggccgagcggggacggtccggtcgcgtaggagacgtggtagttctcgctgccggtgtcgtcctcggaccacatgaagtagtacgtcccctgccgctcgaccacgaaggatccctcgcggaagtccggctgggtgatgtccttcaccttcgtcgcgtcgtacgacaccatgtcgtcgttcagcggcacgacgtacccgtgtccgttgccccagtagagatacgacgtgccgtcgtcgtccgtgaacaccgccgggtcgatcatctggcccgccaacttccccttggcgaccaggggcttgcccagtgcgtccttgaaggggcccgccggggagtcggccaccgccacgccgatctgctgctccgcgcagaagtagaagtagtacttcccgtcgcgctcggcgatcgccggggcccaggcgttcttgtccgcccacgtcacatcaggccccaggtcgaggatcacgccgtggtccttccagtggaccaggtccttcgacgagaacgccttgaaccgtgtgccgctccagccggggaagccgtccgtggtcgggtagatccagtaacggccgtccaggtactggatgtcggggtccgcgtacagcccgggcaggaccgggctgcgggtcggtaccgcctcgacggtccaggtgcgcctcgtgccgtccgccgccgtcaccgtgtacgtctgcggcctgcggaaatcgcgccgcgtaccggagcgcgggctcagggtcgcgcccgcgccgacggccagggccggggccagtctccgcaggtccgcgtccggcttcatcggcagcacgaccttcgcggtgtcctcggagacgaccgcgtaccccttctgccccttcgccgtcgcgtccaccaccgaggtgccgctcaccgggtacgcggccaggagccggtcgtactcggcccgcgtcacgggcatgaccgtcccgtgccgcgggctcgcgggcagctggtagtccgtcgacatggtccactcgcccgagtcgaggtcggtcgtctcgaaggggacgtaaccgcggccgccgtactcgtcgatgaacaggtaccacttgttctcggtgttggacttgaagaccgtggggccctcaccccggtcgatcgaaccgctgccgatgcagtcggagacgaagtcgtacgtcgggtccgtgagcgacgtcgacttctcgccggtgatgaacttcgaacaggggctggacgagctcgggtcgcgctcgtccttggtgtagcggtagtaactgcccttgtgcttgatgacggtcgagtcgatcaccgagtagcccgggtcgtcccagaccttcggctcgctgaaggtgcggaagtccttcgtggtcgcgtacagcatcttgttgtacgtcgagcccgtgtggtcggggtcgtcgtccgcgtagagcttcgacgcccagaagacgacgtacgcgcccagcgtgtcgtcccaataggcctccggcgcccaggtgttgcccgcgttgccgggggcgacccgcaccagccgctggtcggtccagtggaccagatcggtggactcccagatcatgatggacctgctgccgtgccgctggacctggtcccagctgccgctgctgttccggtacatcttcaggtcggtcgcgatcaggaagaacttgtcacccttgggggagcggatcacgaacgggtcgcgcagccccttctcgcccaggtccgaggtgaggacgggctttcccgcgttcaactcccgccagtgcaacgggtcgttgccgcggctgagggcgtagcggatctgctcgccgtcggcggtgccctccccggtgaagtaggcgaagagatagccggcgtacttggcggcgttcacgtggggtgctccggactgtgcggcggggctgggcggcgcggcgagcaggcccagcagcagagcgaggagaggcaccaggagtgtgcgggcggtgcggcgcatgaaacatcctgtgggggtctggtggattctgttggatgagctgtcctcggagtgtcaccagtgggggacggtgcgtcaatcggtgtgcgtggggcgccccggagcgaaaatttcgatcgctttcgtccggaccacggcaaccctttccggcagtggcggcgaccaggagtcagaagcgggccggggcggcccctccggcccgtttcgcttcccctgtctcccccggaaaggaaccacccctgtgcgccagagcaccggacgccaccgcagaacccgcacgctctcgatcgccgccgcggtggccgtcgccgcgggggcgggtggcgtctgcctcggcctgtcggacaacggatcggcgcaggccgcctccaccacggtcacggtctccaccaccgcccagctccagtcggccgtcgcgaacgccgccgcaggcaccgtcatccaggtgcgcgccggcacctactacccgacggccaccctcaagtccacggccgacggcaccagttcggcgcggatcaccctccaggcgtacggcagtgagaaggtgaagatcgacggctccaagctccccgccggctcctggctcgccggtgtctacggcgactactggaccgtccagaacatcacctggcagaactcgcccgcccagggcttcgtcgtcacctcgtcggccggcggcgtcttcaagaacctcgtcaccgcgaacaacggcgactccggcttcaccctccgcggcgacggcacgacgaacaacctcgtgcagaacctggacagttacggcaactacgatgccgccgggcacggacagaacgccgacggcatcgccatcaagttcggctccggcaccggcaacaaggtcaccggggcgcgcctgtacaacaactcggacgacggcctcgacctctggcagttctcctcgcccgtcaccatcgagcactcctggtcctacggcaacggcaagaaccgctggagcgactcggccttcgagggcaacggcaacggcttcaagctgggcggcggaggcgtcaccgtcgcccacgtcgtgaacaacaacgcggcctgggacaacaccctgaacggcttcaccgagaactccaacaccggtgccgtcctgctcaaccgcaacaccgcgtacgccaacaccgaggtcggcttctacttcgccaccggcaaggcgcggctcgccaagaacctcgcggtgagcaacaagggcggcctggacaagctcggctcgtccacggtgtccgcgggcaacaactgggacagcggcgtctccacgccgtccctcaagtccacggacgcgtcgacggcgtacggggcccgctcgtcgagcggctcgctgccctcgacgacgtttctcacgaccggctccacgacgatcggctccacgatgaactagcccggccgaagagcgcgaacgcccccgccggtcgtcaccggcgggggcgttcctctgactggccgaggggggctcaggccagcagatccatggtgtccgtcttccgcacactggaagggacgtcgaaaacgaacatgtggttgtttccccggtacgaatccgtcggtgtcactcgtagctgacgtcggacgtcttgaacttgcagctggtgccgtccgggccgctgcccagctcggtcggctccttgccggtgttgttgcccttgaagcggacgcacggcttgatcttcttcttggtgtcgccgtggatgcggatcctggacagcgtcgccgtgtccccgtagttggagttgatgccgacgagcgccttgcccggcgcggtcgcgtcgatgtcgctgagcacgaccgtgcgcttgtactgcgtcttgcagttgccgcaggagcgcaccagcttgccgaagttctccacctggaagccggtcacggtcagcgtgccggccccgttgaactggagcaccttgtcggaggccgacttcgcgccgccgccgatcaccttgtacgtcgccgacgaggacttgctcttgaagctcgccgcgtcctcgccgacgtccagccaccacacgttctgcagcgtgcaactgcccaggcagtggacgccgtccgcggccggggtaccgatgatcacgttcttcaggaccgcaccgtcctcgagctcgaagagcgggccctggtcctcggactggtcggccgtcccgaggtccccgctcccggagaacttcttcagcttgccgtcgtacgtgcccgacacctcgatcgtcgacgacacggccttgctgcccgtggcctcgggccaggacgtcgcggcgcccgcggaggacagcagcgacgtcgtgacgagcgcccccgcggtgaggccgagggcggcggccgaaccgatcaccgcccgccgcttggtgacccggcggcggtggcggacgcgctgttcagatggtgcagtcatgtaccgattccttgtgtggcaggacgttcttgcgtcttctggtcgccactggtgaggaaagggttgccgggtccgcggatctttcttcacggacgttcgctacgagtcgccgtcgtcggtgacccgggccgcgaagtcaccacgcacggcggaccgtccgccgtccttggcggtggccgtcgccgagtagctgtcgtccttcgcgtcccggccgccgcggtcgtggtcgtactggcccgcgaacacccactcgcccggccagaccgtgtggtccggcttgagcacccaggtgtagacgaggaagccgcccttctcgacgaccgtcgtcgtgaagtcgtcctcgggcagcgaacgccaggcacccgcgtcggtgaccccgccggactgcctgatcttcaaccggacggtgagcgacgtgagttgctcgctcgtcttcagggtcacattgctctgtgcccagaagtcgttgctgtgcgggtcgaccgagccgtcggaccagacagggccgtccgtgtcgcccttggcgggcggccggtcggtggcggcggagctctcggacgtcggggtccccgagggcggcgaactcggcttcccggacggcttcgacgtaccggatcggtgggtggggtccggggcgagaggcgcccggctcgtcgcgtccggcgtcggatcgggggtcggcgagaccgcgacggtctgctgcggcggggtgtcgtccttcaccgccgaggcgaccgcgtagccgcccaccgcgagaacacccgcgaccgcggcggtggcacccacgacccgtgcccagccgagcaggggcgggcgcgccgcgcgcggcgcgggccgccgctcgccggctcccgccatcccgcgctccacccgggccaggatgcgtgcgcggtcgggctcgtgcgcctcggccgcctcacgcagcccggcgcgcagctcgtcgtgcacgtcctgccccttcctcatcggtcccttcctccggctccacccgtgggcagcactcccgcgtgcacccggatcggggcctcgtcggtgccgagaagccgcttcaactccgccatgcccttcgacgtctggctcttcaccgtacccacggaaacaccgagggcgagagccgtgtccttctccgagaggtcgaaagcatgccgcagaaccacacacgcgcgcttgcggaacggcagtctgcgcagcgcctcctggacatcgaccgtgcccggtatatcggggttctcggtcttgtcctcgcgctgcgaccagaagagcgtgatccgccggcgctcgcgcaccgcgctgcggatccgggtgcgggcgagattggcgaccacgccgcgcgcgtacgccaccgggtggtccgccgcgcgcacccggtcccagcggtgccacagggcgagcagcgcatcggccgccagatcgtcggcggcgtccggttcgcctgtcaacagggctgccagacgcgccagttcggcatagtgccgttcgaagaaggcgtggaattccacggaggcggcgtcgtcgacgaccgtgcccacgggcgacctctcctcgctgcgactccaggcaccggtacaggtgcccgcgtatacggcccccgtgtgtcacccgtgaagaaacggtgtccccgcggggcgagatcgggaagcgtaccagcgttcgtacggggtctcgaacgccgtatggcctgccgaactcgattccgtaacacggggaaaacctgaaagcggttcaacgcgggaacaatccagccagcatccgcacaccagcaccgccgggtacgaggagtctcgccatgtccgaaacgcagcaggtgaccgacctgccaagtgccgtgcccccaggggggaacggcatcgaccggttcttcaagatctcggcccggggctccaccttcggccgggagatacgcggcggcttcgccacgttcttcaccatggcctacatccttgtcctgaaccccatcatcctgggcagcgccaaggacaagttcgggcaccagctcgaccacgtccaactcaccaccgccaccgcgctggtggccgcggtgatgacggtcgtcatgggcgtcggcggcaacctcccgctcgcgctcgccgcgggcctcggcctcaacgcggtcgtcgccttccagatcgccccgctgatgagctgggacgacgcgatgggcctggtcgtcctcgaaggtctgctgatctgtgtgctggtggtgacgggtctgcgcgaggccgtcatgcacgcgatcccgcagccgctcaagcaggccatcagcgtcggtatcggcctgttcatcgcgttcatcggcttcgtcgacgccggcttcgtcagccgtgtcccggacgtcgcgggcaccaccgtgccggtgcagctgggcggcaccggcacgctgaccggctggccggtcctggtcttctgcctcggcgtcctgctcaccatcgggctgctcgcgcgcagggtcaggggcgccatcctgatcagcatcgtgacgatgacgatcgtggcgatcgtcatcaactccgtcgccgacgtcaagaactggggactgaccgtaccgaaggtccccgacgacgtcgtggcctccccggacttcggcctgctcggccacttcagcctgttcggcgccttcggcgagaccggcgcgatcaccgtcgtcctgctggtcttcaccctcgtcctgtcggacttcttcgacaccatgggcacggtcgtcggcatcagcgccgaggcgggcctgctcgacgaggagggcaaggtgccggatctcggccgcgtgctgctcatcgacggcgcggcggcggtcgcgggcggcgccgcctccgcctcctccgcgacctcgtacatcgagtcggcggcgggcgtcggcgagggctcacgcaccggcttctcgaacctggtcacgggcgggctgttcgcgttcgccctcttcctgaccccgctgctgacgatcgtgccgatgcaggcggcggccccggccctcgtcgcggtcggcttcctgatgatgacccaggtcaagcacatcgactgggacaggtacgagatcgccatccccgcgttcctgacgatcgccgtgatgccgttcacctactccatcaccaacggcatcggcgccggcttcctcgcctatgtgctgatcaaggcggtgctcggcaaggcgaaggagatccactggctgctgtgggcgacctccgcgctgttcctggtgtacttcgcgatcgacccggtcgagcagatcctcggcgtgaagtagtccgaggtgtgcgaagggccgccctccaggggagcgagggcggcccttccgtctgtgcgcggcggtgtcagttcttcagtgccgcccgcatcatcgccttcgcgaccggcgccgccagcccgttgccgctgacctcggagcgggccgcgccggactgctccaccatgaccgcgacggcgacctccttgctgctggagtcggacttcgcgtacgaggtgaaccaggcgtacggcgtcttgctgttgttctcgccgtgctgggccgtgcccgtcttgccgcccacggtcgcgccggggatccgcgcgttggtgccggtgccttcctcgacgacggtctgcatcgcggaccgcaactgctcggcggtcgacgagccgacgatctccttggtctccgtgctgtcgtcgtagtccttcagcaccgtgccgtcggcgtcgctggtctgcgacaccatgtgcggtgagaccagcttgccgtcgttcgctatcgccgcggacaccatggccatctggagcggggtcgcggtcacatcgaactggccgatgcccgacagaccggtctgcgccttgtccatgtccgagggatagacactcgggtacgcccgcaccggcacgtcctgcgacgtgtcgttgaagccgaacttctccgccatcgccctgaccttgtcctggcccaggtcgacggccatcttcgcgaagacgttgttgcacgagtactggagcgcgacacggatcgaggcgttctcgcagggcgccgaggcgttctcgttcgccaggacctgggtcgtgcccggcagcgtgtacgggttcggactgtccgtgtccttgtccaccgacgagtagagcccgtcctccagggcggcggccgcgacgaccagcttgaaggtcgaacccggcggcagcggctggcgcagtgcccggttcgtcatcggcttgtcggcgtcctcggtcagcttcttccacgcggcggagttgccggcgctgaacgtcgaggggtcgtacgacggggtggagacggccgcgaggatcttgccggtcttcggatcgatcgcgacggcggcacccttgttgtcaccgagtgcccgatatgcggccttctgtacgtccgggtcgatcgtggtgaccacgtcgcccgggtcggcgcgcttgttggtgatcgtgtcgagcgggttcttcagctggttgtccgtgccgtcgagcaggttctggtagatgccttcgagctgggtcgccccgaacacctgcgagctgtagcccgtcacggccgcgtacagactgccgtccgtgtacgtccgcttgtacgcgaggtcgctgcccttcgtccgtgcggaaccggtgatcgcgtcgccggccacgatgatgttcccgagcgggttcgcgtacagctcgatcgcgttccgccggttgtccttgttgtccgcgagtgccttgccgtcgtagaactgcacccaggtggccctgaccagcagggccagcacgagcagcagtgtgaagacggcggcacgcctgatcgtcttgttcatcccgctcagaaggacgagcgggacggggtcgatcgttcccttccgcccggttttctcatgtgccgttcatgaagccgggcgcacgcgcgtgtgccgttcgtgaagccgggcgcacgcgcggtcacagcctgcgcgtcgccagtgtcagccggtcccgcgcgtcgaacagcgcgtccttcaccatctgctcgtgcgccggggtcagccgcgccaccggcaccgagcagctgatcgcgtcgcgggccggggtgcggtacgggatcgccacgccgaagcagcgcaggcccagcgtgttctcctcgcggtccaccgcgaagccctggtcgcggacctggcgcagctcctcgatgagcttctcgcggtccgtgatcgtgtgctcggtgagggccgggagcgtctccgggagcatcttgcggacctgctcgtcggtgtgcgtggccagcagcgccttgccgagcgaggtggagtgcgcgggcaggcggcggcccacccgggtgaacgggcgcagatagtgctgcgactggcgcgtggccaggtagacgacgttcgtgccgtccaggcgcgccaggtggatcgtctccgtcgtgtcgtcggagaggcggtccagcgtcggacgcgccgccgcgacgacctcgtcgccgtcgatgtacgacgtgccgaccagcagcgcccgtacgccgatgccgtaccgcgtgcccgtcgcgtccgtctccacccagcccagctccacgagcgtgcgcagcagcatgtacaggctcgacttggggtagcccaccgcctcctgcacggcggccagggagtgcatgccggggcgtccggcgaagtactcgagcaactcaaccgtccgtaccgcggacttgacctgcgccccgccgcccgtctcgcctgccgacatcgcccttgaccccttcgttggacgggaaatagtctcgcatcaattcatcatccgagacagcgttcagtatatcgaacgtctccgctggatgacgtaagaactgcggcatgaacatctggagggacccgcggtggcagcagcaccagtctggagtgtcgacccccgaaccgggaagcagcgtgaacaggttgcggtggaggccacggcccaggaggtggaccaggtggtccgcgccgcacacgccgcgcgcccgtccctcgccgaccgcaccgtccgcgccgcgttcctgcgcaccgccgcggaccagctggaggccgccaaggaccagctcgtcgaggccgccgacgcggagaccgcgctcggcccggtccggctcaccggtgaactcgcccgcacctgctaccagctgcgcgcgttcgcggacatcgtcgacgagggcgccttcctcgacatcgtgatcaaccacccggacgacaccgcgaccccgccgatccccgacctgcgccgctacaaggtgccgctcggcgtcgtcgccgtctacgccgcctccaacttccccttcgccttctcggtccccggcggcgacacggcgagcgcgctcgcggccggctgcccggtcgtcgtcaaggcccaccccgaccacccggggctgtccgagctggtcgcgtccgtcctgcgccgggccgccgccgagcacggcatcccggccggtgtcctcggcctcctgcacggcttcgaggcgggcgtcgagctggtcaagcacccgctggtcgccgcggccggcttcaccggttccgtacgcggcggccgggccctcttcgacgcggcggcggcgcgccccacgccgatccccttccacggcgagctcggctccctgaacccggtggtgatcaccgaggcggcggcggccgagcgggccgaggcgatcggcgcggggctcgcgggttcgatgacgctgggcgtcggccagttctgcgtcaagccgggcctggtcctcgcgcccgcgggagcggcgggcgaccgcctggtgaagtccctcacggacgccgtcagcgacaccgacgccggggtcctcctggaccaccgcatgcgcgacaacttcatcgccggtgtcgccgagcgcgccggactccccggcgtggaggcccccgtgacgccgggctcgggcggcgagcactcggtgagcccgggcttcctgacggtgccggccgagaagctggcggcaccgggcgcgcacgacctgctcctggaggagtgcttcggtccgctgacggtcgtcgtccgctacgaggacgacgccgaggcgggcgcggtgctgtcccggctgccgggcaacctcacggcgacggtccatctctccgaagaggagtcggcgggcgagggccgcggcgcggagatcctggcggaactgacgccgctcgcggggcgcgtgctggtcaacggctggccgacgggggtcgcggtggccccggcccagcaccacggcggtccgtacccggcgacgacgtccacgtcgacttcggtgggcgggacggcgatcgagcggtggctgcggccggtggcgtaccagggggtgccggaggcgctgctgccggtggagctccgcgacgggaatcagctggggttgccgcgacgcattgacggccgtccggaacgctgagagctcttcgcgaagcgccgttgggcgtgggggcgttcgcggactgcgggtccgttgtggctggtcgcgcccacgcggcggagccgcacgagcacagccccgcgcccctttcaggggcgcttcagtgggcctgggacaatcatcggatggacgtggaacttcccgaactccctttccccctgcgcacttacgggccggacggtaactggtcctacgaggacggtgtgctcaccggctgggcgggcgcacgtcaggaccgtttcgtgccgcccaccggtgaggcactcgaccccgccgccgacgcgccccggctgctgggggcgccggagggcgacttccagctgatcgcccgggtcacggtgggcttcgccgcctccttcgacgcgggagtgctctacgtgcacgtgggcgagcgggcctgggcgaagctctgcctggagtactccccggacgtgcccacggtctgcacggtcgtcacccgtggacactccgacgacgcgaactccttcaccgtggagggcagttcggtctggctgcggatcagccgcacgggccgggccttcgccttccacgcctcccgcgacggcgagcactggacgttcgtccgcctcttcacgctcgccgacgagggaccggcctcggcggcactggtcggcttcatggcgcagtccccggtcggcgagggctgcgtggtcaccttcgaccacctcgcctaccgggactcctggccgcaggggctaagagacggcagctgagccgcgcagccggaaggtcgccgtcgcggtcagggcgagcagggcggcggcgagcgcgagactcacccggaggcccgagccgaagccgccggagaccagggagccgaacgccgcgatggccaggccgccggccacctggcgggccgagttgaggacgccggccgccagccccgcccggtccgcgggcaccgcgtccatcatcgtcgccgtcagcggcgggatggtgagcgcgcagcccagggccatcgggacgagcagtacggccaccagcgccgggggagtcgacgcgtcgacgaacagcaggaccagcaggcccgctgccgccagcgactgccccagcagcatcggcagccgggctccgtagcggcccgacagcttccccgccgcgatgttcgtcaccgcgatcagccccgtcatcggcaggaacatcagccccgcggacagcgcggaccgcccctgcgcctgctggaagaagagcgagaacaggaacaccaccccgtagaaggccacgctgcacgccgcgccggcggcgaccgccaccgacaccgtccggctgcggaacagaccgagcgggacgaccgggtacgcctgccgggcctcgatccggacgaagaggacggccgccgtcaccgccacggccagcgcgatcagccccccggcgccgccctcgatcaccgcgaacgtcagcgccgtgagcgccacgaccgccgtcagctggcccggcagatccaacggcgcgggccggcgctccgagcgcggcgcccgcagcaggaggacgagcgccagcgcacccaggggcaggttgatgaagaagatgccccgccagtcccacgccgtcgtcagcgcgccgcccgccaccggacccagcgccaccgccaccgagccgcccgccgcccacagcgccaccgctcgcgcccggcgtgccgcgtccgggtacgcctgccgcaccagcgccagcgaggccggcagcaccacggccgccgccaccccctgcgccacccgggcgccgatcagcaccggcaggccgggcgcgagcccgcacgccgccgaggccagggtgaacacggcgatcccgatcccgtaggcccggctcgccccggcccggtccgcgaacgctccggtggacagcatcagcgccgcgaaggcgagggtgtacgcgtccacgacccactggagcccggacatcccgcccccgaacgccgagccgatcgacggaagggccacgttcacgacggacgcgtcgagggtgatcagcgcgaagccgaggagtgcggcggcgagggtgagcgagggagaggtgtggtgctccaactcgcttgtggcagaggtgagtcgggggtccgtcgggggagtttccgtggtcgggttcgtagccatgccctccatgctgctgatctccggcggcgtacagtagtggccggaatgacatatgaccggaggttctggccatggcccgatccacgtccccggcccggggtgtccgccggatcgccgtcgtcgcggcgtcccccgtctcgatgttcaacctcgccatccccgagctgctgttcgagaaggtcgagatcgacggcgctccgggctacgaggtgaccatctgcgccccggagccgggcccggtgcccaccaccggcggcctcgacctgtacgtccggcacgggctcgacgccgtacgggacgcggacacggtgctcgtcgcgggcaccgggctgcgctacacgcccgacccgcgcacggtggacgccgtccgcgaggccgccgccgacggcaagcggatcgcgtccatctgcagcggcgccttcgcactcgccgaggcggggctgctcgcgggccgccgggccaccacctactggggacaggccgaggaactgcgcaagcggtacccgtccgtcgacctcaagggcgatgtcctgtacgtgcaggacggcccgatcatgacctcctccgggtacgccgccggaatcgacctgtgcctccacatcatccgcaccgactacggcgccgccgccgcgaaccgggtggcccggctcgccctcgtcgcgcccgtgcgccccggcggccagacccagttcacccagaccccgctgccgcccgagcgcggcaccgcctgcgccgacacccgcggctgggccatgcgtcacctcgacagtccgctcacgctcaccgacctggcccggcacgcgggcgtcagcgtgcgtaccctcacccggcgcttccacgcggagagcggggtcagcccccttcagtggctgctccaccagcgcatcgagcgggccaaggaactcctggagacgaccacgctcccgatggaccaggtggcccgcgcctcgggcctgggcaccgccgactcgctccgcggccatctggtgcgccgcacgggactgaccccgagcgcctaccgcacccagttcagccgcctgggaagcggaccgggaccgggaatggaacaagccgcttgaacgttcacgcaagcggcggagggaggctccgtcacccttccgacctggagagaagccgaagaatgcgcgtcgagatctggagcgacatcgcctgcccctggtgctacgtgggcaaggcccgcttcgagaaggcgctcgaagcctttccgcaccgcgacgacgtcgaggtggtgcaccgctccttcgagctcgacccgaaccgcgccaagggcgacatccagcccgtcctcacgatgctgaccaagaagtacggcatgagcgaggcgcaggcccaggccggcgaggacaacctgggcgcgcaggccgccgccgagggactggactaccgcacccgggaccgcgaccacggcaacaccttcgacatgcaccgcctgctgcacttcgccaaggagcagggcaggcaggacgagctgatcgggctcctgtaccgggcgaacttcgccgaggagcgctccgtcttcgacgacgacgagcggctcgtcgagctggccgtcgccgccggtctcgacgcggaggccgcccgcacggtcctcgccgacccggccgcgtacgccgacgaggtccgcgccgacgagcgggaggccgcggagctgggggcgagcggtgtccccttcttcgtcctcgaccgcgcctacggtgtctccggcgcccagcccgcagaggtcttcgcccaggccctgaagcaggcgtggggggaccggccgccgctcacgctcatccaggacagtggtgacgcccaggcgtgcggtcccgacggctgcgccgtgccgcagggctgaggaccccgggaaaccgcaggtcggagcggacctgtaagcgatccttgggggaaccacgtaaaactccgcaatggacggggggttcgcggggccgcagagtggtcccatggagaccttcgagcccctcgtccgtgccgagttcgccccgaagaacacctacctgaacaccgcgagcaccggcctcgtaccggcccgcacagtggcggccatgcgcgtcgccgtggagtcggccgccgccgggcagccgaccgacatgttcgcggacgtcgaggcggcacgcgcctccttcgcccggctgaccggggtacccgtccgccgggtggcggccggggcctcggtcgcggtctacagcgggctgatcgccgcctcgctgccggagggcgccgaagtcctcaccgccgaggccgacttcagctccgtcgtgaaccccttccacatccgccgcgacctcaaggtgcgcgccgtcccgctggagggcctcgccgagtcggtgcgccccggcacggcgctcgtcgcggtcagcgccgcccagtccgccgacggccgggtcgccgacctgccggccgtccgcgcggccgcccgcgcgcacggcgcccgtacgtacatcgacgcatcccaggccaccggctggctgcagatcgacgcggacgcctacgactacgtctcctccgtcgccttcaagtggctcgtctgtccgcgcggcgtggccttcctggtcgtcccggaggacctcggcggcctcaccccgctgttcgccggctgggtcgcgggacaggcgccgtgggacagctgttacgggcccgtcgaggaactcgcccactccgcacggcggttcgacgagagccccgccctcttctcgtacgcgggcgcccgccactccctcgcgctgatcgaggaactgggcgtggagaacgtacgggcccatgacctcgcactcgccgaccgcttccgtaccggcctcgcgtccctcggccacgaaccggtccccgcaccacacgcgccgatcgtgtccgtgcccggcctcggcgaccggcagccggccctcagccgcgccggagtcgaagtctccgaccgcgcgggcaacctgagggcggccttccacctctacaacacgcccgccgacgtcgaccggctccttgatgtcctgtcgggcctgtccggccgccccctggcgtagcgcccccggggacgccaggaaggcaccacgaggcggtggtgcccgtggagtcgacggccgacacagccgcaggaccgcccgccgacgcggaactgcgtcggcggctggtgtacggggacgagtccgcgctgggcgaggcgtacgccgcgtacggggcgctcgtccggcgggtggcccggcgcgtcacccgcagcccggccgccgccgaggacgtggcgcaggaggtcttcgcccagctgtggagcaggccgtacgcgttcgacgcgcgccgcggctcgctgcgcacctggctgtccgggggacacgggagccgcggccggcgtactggcgcgggcggcttcgctgggctggctgtagagcctggctgcagacacagcacggcccgggttctcccgccccatgggagaacccgggccgtgccgggcggcggtcaccgcaccggcgtgaagtcccgcgccccgatgaactccggacgccgtaccggcgccgagaacggctccaccgccgtgttctccacgctgttgaacacgatgaacacattgctgcgcgggaagggtgtgatgttgtccccggagccgtgcaggcagttgcagtcgaaccaggtcgccgaaccggcccggcccgtgaagagccggatgccgtgccggtccgcgaacttggtcagcgcctcgtcggagggcgtgcccgcgtcctgcatctggagcgacttcttgtagttgtccttcggggtggccccggcacacccgaggaacgtcttgtgcgaccccggcatgatcatgaggccgccgttggtgtcgtagttctcggtcagcgcgatcgagacggacaccgtgcgcatgttgggcaggccgtcctcggcgtgccaggtctcgaagtccgagtgccagtagaagccgctggccccgaagccgggcttgacgttgatccgggactggtggacgtacacgtccgagccgaggatctgccgtgcccgccccaccacgcgctcgtcgcgcacgagctgggcgaagatctcgctgatcttgtgcacctcgaagaccgaccggatctcctgcgactgcggttccacgatggagcgctcgtcggcgcgcaccgcggggtcgtggatcaggcgttccaactcggcgtggtagagcgcgacttcgtcatcaccgatgagctgcgggacggcgaggaagccgtcgtgctcgtacgactggaggtcggccgccgtgatggggcccggtgtgtccggcgtgccccacaggaccgggtcctggcgggggaccgacacctcggcggcgccgcggctcgggtacaggtcggtgatcgtggtcatggggctcagacctcctcgggttcggtcagcagcgggtagacgccgttctcgtcgtggtcctcccgtccggtgacgggagggttgaagacgcagacgcaccggaagtcggtcttggggcgcatggtgtggcgctcgtggccgtccagcaggtacatcgtccccggcgtgatccagtgcttctcgccggtctcgtcatcggtcagttcggcctcgccctccacgcagagcacggcctcgatgtggttcgcgtaccacatcgacgtctcggtacccgcgtacaggacggtctcgtgcagcgagaagccgaccttctccttggcgaggacgatgcgcttgctctcccaggtgccggacgcggccttcacatgccggtcggtgccttcgatgtccttgaacgaacggactatcacggtggtgcgatgcctctctctcgtgctctcgggtgtggtgcgggtctctggtgccggtcaggcggtttcccgtacggcgcgggcgagggtacgcagcccctcgtcgagctcctcgggcgtgatcgtcagggccggaagcagcttgacgacctcgctctccgggcccgacgtctcgatgagcagcccgagctcgaaggcgcgctgtgcgatgcgcccggcgcggtccttgtccttgaactcgatgccccagacgaggccccgcccgcggtactccttgacgtcggcgaggttctcctcggtgatggagatcagcgcctgctcgacctgctcaccgcgggcgagggtctgcttctccatggcggatccgtcggcccagtacgtctggagggccgcggcggccgtgacgaacgcggggttgttgccgcggaacgtgccgttgtgctcgcccggctcccagatgtccagctcgggcttgaacaggcacagggacatggggagcccgtacccgctgatggacttggaaaccgtgacgatgtccggtgtgacgcccgcctcctcgaaggagaagaacgcgcccgtacggccgcagcccatctggatgtcgtcgacgatgagcagcatgtcctgccgcttgcacagctcggccagggcgcgcagccactcgggacgcgcgacgttgatgccgccctcgccctgcacggtctcgacgatcacggccgcgggcttgttgaggccggagccctggtcctccaggagccgctcgaaccagaggaagtccgggaccttgccgtcgaagtagttgtcgaacggcatgggcgtgccgtgcacgaggggtatcccggcgccggcgcgcttgaaggcgttgccggtcacggcgagcgagcccagcgacatgccgtggaaggcgttggtgaaggacacgatggcctcgcgccccttcaccttccgcgccagcttgagcgcggactccacggcgttggtgcccgtcgggcccgggaacatgaccttgtacggcaggtcacgcgggcgcaggatcaggttctggaaggactccaggaaggcgcgcttggcggccgtcgacatgtcgagcccgtgcgtgacgccgtcccgctccagatagtcgatcaacgcccgtttgagtacggggttgttgtggccgtagttgagtgagccggcgccggcgaagaagtccaggtacgcgtggccgtcctcgtcgtacatgcggctgccctgcgcccggtcgaagacggtgggccagccgcggcagtagctgcgcacctccgactcgacggtctcgaagacgctcaggtcgggctgggtgatggtcacggcgaaatcgctcctcggtgcgtggggggtcagtgggagagggggccgatgcggtacaggacctcggggtcgtgcggggcgtcggggaacagccctgcctcgaacaggacctcacgctcgaggtccgcgccgtggcgctgcgcatacgaggtgaacaggcgttcggaggcggtgttgccgggggagatcgtcgtctcgatgccggtcaccccgtactcgtccgtgacgcgtgcggtcagtccgtcgagcatgcgcgcggccagcccgcgcccgcggtacgccgcgtcgacggccacctgccagacgaggagggtgtgcgggcgctcgggccgcacgtacgcggtgatgaagccgacgggcgtcccgtcggcggctcgtgccaccgccgtggtgccggcgaagtcacggcaccacagcagatagctgtacgaggagttcaggtcgagggtcttggagtccttggcgatgcgccagagtgcggacccgtccgccacgtccgggcggtcgatccgcagtccctcgggcatttccaggaattccgcttgcaggtctgcgtgtgcggcggtcatgccgactgaatttaccgagggaaattcgaaattgcatcgtcggatggggttacgaaatgagccgtcatgtgttatcacgcgggcgcgggtgatcgcgcaagacggcgtcgataacccccattttgtccggaaaatacgggaggaaaggggtgcgatgtggagtcgatcacaagtggacgacccgtgcgggacctgcccgaattaagccggttggtgttcgcgaaatctttgcgtttagcacgaaagaaagcgggcagaagaatgcgggaagctgttctgaattaataacgggataagtgtgtggggaatctctgcaattcacggcgagaagcgatggaaagtgccgggggaagtggcgggaggggtcaggcccaggcctcggccaccgcgcgccgggccccctccaggtccaccggcacgccgaactcggccagcgcggcccccagcgcacccaggcaggactgcaccacaccccgcgtcgcgccgggtccgtagtggttgacccggaccatctcgcgggcgagcgcgcccccgcccgcgacgagcggcagcaccggatccgaggccagcgccttggcgaccagctccgaggcgtcgatcccggccggcgtccgcagcgtcgtggcgacgggcgccgcgtccgcggcctcgtgcacatacggttcgagcccgccacccagggcgaccgccccggcccgcgtggccgccgcggccgaggcgtgccgggccatcacggcctccagcccctcggcctcgatccgctccacgcacgcctcgagcgccagcatctccagctgcgccggcgcgtgcagcagcgccttgcggccgccgtcgacccaccgctccttccagtccaggagcgacaggtacgaccgccggggcgccgccgggttggccgccatccgcgcccacgcccgctcgctcaccgacaccgccgacaccccggccggcccgcccatcgccttctgcgccccgatcacgcacaggtcgacgccccacgcgtccggcagcaccggctcggcgccgatcgacgcgacggcgtccagatagaacagcgcaccgtgctcccgtacggccgcgccgatctccgcgaccggattcgtgttgcccgtggccgcctccgcgtgcaccagcgacacgaagtcgatctccgggtgcgccgcgaacgcctcccggatccgcgcggccgtcaccgccgtgtggaacggcacggccagatcgatcaccgtcgcgccgcagtcccgcagccagttcccgaaggtctggccgtaggggccggtgatgacgttgagcgcggtcgtgccggggcccgcggccgcgcgaatggcaccctccagcgggagcagcgcctcgccctgcatgatcacgacgtcctgctcggtggcgagcagccgggccacccggtcctcgatcgaggcgaagtgcgcggcgctcaggggtgccaggtccaggaaggggtgggtcacggcgatgctctcttcgctcacgggttccattacgcgagatcgagggtatccgccgggtgctccgccgatcccgccgccgcggcctcggtcatacggtccggatgccctgccgaggcaggacatctgaggccatacggcccaacagccatgggattgatttgagtgagtcaaacctttccttataatcggaacccacagttccctcataggaggtcccccgtgaagacggtcctcggacgccggtcccgcattctggccgccaccaccgcgacggccgggctgctgctcgtggccggctgctcctcggacaacgggggaggcaagaccaccgtgaagggcgtcccgctcgtcaaggcggggcagatcaccacctgtacccacctcccgtacccgccgttccagtcggagatcgacggcaaggtgcagggcttcgacgtgtcgctcatcgacctggtcgccaaggacctcggcgtgaagcaggccatcgtcgacacgcccttcgagaacttcaagacgggcgccttcctcaactccggccagtgcgacgtcgccgcggccggcatgaccatcaccgaggagcgcaagaagaacgtcgacttctccgacccgtacttcgaggccacccaggccgtgctggtcgacaagaagagcggcgtcgactccctcgccgacgtgaaggccaagggcaagaagctcggcgcccaggcgcagaccaccggcgaggagtacgcgaagagcaagggcttcgacgcggtctccttcgagtcctccgacgcggtcctcaacggcctgcgcaccggccaggtccaggccgtcatcatcgactacccggtggtccagggctggctgaaggacaaggccaacgccgacgccttcaaggtcgtcgacaacctcaacaccggtgaggagtacggcttcacggtgaagaagggcaacaccaagctcctcgccgagatcaacaaaacaatcaagcaggcgaaggccgacggcacgtacaagaagatctacgagaagtggatcggcccgtacaccgcgtccgcggccaccgcctccccgtccgcctcatgagtgatgccgacgcacagctccagccccgcaggtccggtctgagcagacggcagaagcgtgccgtctcgcgcggcgtgcagtacgtcgtcttcgtcgcggccgtcatcgccttcgcggtgctggccgactggggacagctgaagaaccagttcgcgcagtgggacctggtcaagcagatgttcccggacgtcatcacactggcgctgaagaacaccgtgctctacacgatgtccggcttcgtcgtcggactcgtactcggcatggtcatcgccctgatgcggctgtcctcggtgggcccctaccgctggctcgccggcatctacatcgagatcttccgcggcctgcccgccctgctgatcttcgtcttcgtgggcgtcgccgtgccgctggcgttcccgggtacggagatccccggcggcacctacggcaaggtggcactcgcgctcggcctggtctcggccgcctacatggccgagacgatccgcgcgggcatccaggcggtgcccaagggacagatggaggccgcccgttcactgggcttctcgcacgcgcgggccatggtctcgatcatcatcccgcaggcgttccgcatcgtgatcccgccgctcaccaacgaactcgtcctgctcttcaaggactcctcgctggtgctgttcctcggcgtcaccctggaggagcgcgaactgacgaagttcggccgcgacctggcgagccagaccgccaactccacgccgatcctggtcgcgggcctgtgctatctgctggtcaccgtgccgctcggattcgtcgttcgccgcctggaggccaaggccggggaggccaccaagtgagtacgccagagatcgacgtccggggcctgcacaagtccttcggcgacaacgaggtgctgcgcggcatcgacctggagatcggctccggagaggtcgtctgcgtcatcggcccgtccggctccggcaagtccaccctgctgcgctgcgtgaacctcctggaggagcccaccaaggggcaggtcttcgtcgccggtgcggaggtcacggaccccgacgtcgacatcgacgccgtacgccgccgtatcggcatggtcttccagcagttcaacctcttcccgcatctgtcggtgaccgacaacctcacgctgccgcagcgccgcgtcctcgggcgcgacaaggcgcaggcggccgaggtggccgccgacaacctcaggcgcgtgggcctgtcggagaaggcggaggcgtaccccgcctccctctccggcggccagcagcagcgcgtggcgatcgcccgcgcgctcgccatgggtccccaggtgatgctgttcgacgagccgacctcggcgctggaccccgagctcgtcggcgatgtgctcgcggtgatgcgcaggctcgccgacgagggcatgacgatgatggtcgtcacccacgagatgacgttcgcacgcgaggtcgccgaccgggtcgtcttcatggacggcggcgtgatcgtcgaggacggcacgcccgagcaggtcatcggcaacccgcgacacgaacggacccggcacttcctgtcccggctcctcgaccccgcgatggcggacgtggaggaggagatctcggaccaggtggggaagagcgagcagccgccgaactagggtgccgtccatgagcgatcacgcggtgctgcacgtgaaggggcgggtgctcgtcggacccgacgacgtccgcgacgaactctgggtggtcggcgggagaatcgcctacgcgcctcccgccggcgcccgggacatccgtaccgtcgagggctgggcgctgcccggtctggtggacgcgcactgccatgtcgggctcgaccggcacgggccggtccccgacgacgtctccgagaagcaggcgctcgccgaccgcgaggccggcaccctcctcgtccgcgacgcgggctccccgtccgacacccgctggatcgacggccgcgacgacctcccgaagatcatccgggcgggccgccacatcgcccgcacacggcgctacatccgtaactacgcccacgagatcgagcccgaggacctggtcgcgtacgtcgcgcaggaggcccggcgcggcgacggctgggtgaagctggtgggcgactggatcgaccgcggcacgggcgacctgagcgcctgctggccgccggacgccgtccgggccgcgatcgcggaggcccaccgcctgggggcgcgcgtcaccgcgcactgcttcgccgaggattccctgcgggacctggtcgaggcgggcatcgactgcgtggagcacgcgaccgggctgaccgaggacaccatcccgctgttcgccgagcggggcgtcgccatcgtaccgacgctcgtgaacatcgcgctgttcccgcagttcgcggccgacggcgaggccaagttcccgcgctggtccgcgcatatgcggcgactgcacgagcggcgctacgacaccgtgcgcgcggcgtacgacgcgggggtcccggtgtacgtcgggaccgacgcgggcggttcgctggcgcacggactcgtggcgggcgaagtggccgagctggtgaccgcgggcatcccgcccctcgatgcgctgtcggccacgacgtggggtgcgcggcggtggctggggcgccccggactcgacgaaggggcgccagcggacctcgtcgtgtacgagggtgacccgcgcgcggacgtccgtgtgctcgcggcgccgcggcgggtcgtgctgaacgggcgggtcatcggctagccggggtcggggctggggccggggtcgtggccgtggccggacagggtcgtggtgggcgagatcccctcgcccaccacgacccgcccccgcctcacctcagcggtccgccaacgtgaccgcccggtccaacgcctggagaaaccggttcaccgtcgcccggtcccgcaccgccagccgcagccactcctcgcccagccccggaaacgtgtccccccgacgcacggcgaagcccagcccgcgcaagtgaccccgcaccgcggccgcccgcggaagccgcaccaggacgaaaggaccctcggccggctccgccacgcacagcccgtcggaggcgaactcccgcagccccgcgaccagatgcgcccggtccgccgcgatacggtgcgccgcgtgcgcggcctccgccagtgcccgcggcgacacgcacacctccgccgccgccagcgcgggcgtggacaccggccacagcggctgcgcccgctccagctcggcgaccgtctcgggcgcggcgagcacgtagccgatgcgcagccccgccagcccccatgtcttggtgagactgcgcagcaccaccagaccggggacgtccgtccgcccggagagcgcctcccgctcacccggcaccgcgtccatgaacgcctcgtccaccaccaacgtccgcccgggccgggccagttcggcgatcgacgcggccgggtgcagtaccgacgtcgggttggtcggattgccgatcacgaccagatccgcgtcctcgggcacggcccccgcgtccagccggaagccgtcctcctcccgcagcagcacccggtccaccgtgtgccccgcgtcccgcagagccgcctccggctccgtgaactgcgggtgcacgaccaccggccggcgcaccttcagagcccgcgcgagcagcacgaacgcctcggcggcgcccgccgtgagcagcacccgctccacgggcagcgcgtgccgctgtgccaccgcggcccgcgccgcacgcccgtccgggtatgccgcgagcccgcccagcgactcggcgatccgctcgcgcagccaggccgggggcgtgtcggcccgcacgttcacggcgagatcggtgagcgccgacccctcgtcacggacctcggcgtcaccgtgatgacgaaggtcgtgcgggccgtcgccctcagtgggcgtgtgaaggcgcatgaccgtggtgtccgtgtccgtgtggcccgtggtggtggtgaccgtcgtcgtccgggtggaagtgcggctgctgcggcagccccaccttgtcctcgaagccgggcagcgcgatgcggtacacgcacgagtcgcagttcatccgcagatcgccctgcaccgcctcccggtaccgctccatcaccagatcgagcaactccggctccggaccgatgacatcggcggaccgcacctcgacctcggggtgcgcggccgcccagccctcggtctgctgccgcacccggtccgggaggatgccggtgaacaggaagtagggcaggaccacgatccggcgggcgcccagcttcacgcaccggtcgagacccgagggcacgtccggcgccgccagcgacacgaacgccgtctccacgcccgcgtaaccccgcccctcccacagcagccgcgccgccttgtgcacctcggcgttggcatccgggtccgtcgagccccgcccgacgagcagcacggtcacatcggcccggtcctgcggcgtacgggggccgccgccgagcgcgtcgtcgagccgccgctccaggacgttcagcagcgacgggtgcgggccgagcggacggccgtacgtgtacgagatccccgggtgccgctccttctcgcgggccagagccgccgggatgtcccccttggcgtgtccggcggacaccagcatcagcggaacggcggcgaaccggcgcaccccccgctccaccagctcgcccaccgcctcggtgagcgggggcggggacagctcgatgaagccgcccgcgacgggcagttcggggtggcggcggcccagttcgcggacgaagtcgcggaacgcctcggctccggcctcgtcccgggtgccgtgaccggcgatgagcagggcaggggcaggggtggtcacgatttctccttcgaagcgggtgcggcgaggtggtacagcagggcgttgagcgcggccgcggcgaccgccgaaccgcccttcatggacacgttgctgacagcgggcagcccgctctcgcgcaacgcggccttcgactcggccgcgccgacgaacccgacgggcagaccgatgacgagcgccggggaggcgtccagggtgagcagttcctccagcgcggtcggggcgcagccgatcacccacagcgcgccggggccgacctcctcgtacgcgagccggaccgcgtgcgccgaacgggtcagccccggaccggacctggcgtccttgagacggcagaccgtcccgcgccgggtgatgccggccgcgaccatctccacgtccaccaccaccggcgcccccgcgtgcagcgcggcgtgtgcccgctccagcgtgccctcgtccatgacgaggtcctcggcgtagtcgagatcggccgcggagtggatgacccgctccacgaccgcccgggtcagcggcgggaagtgcgaggtgtccagacgggcgcgcagccgccggaacgactcctgctcgatggggtggacgacacggtcctcgggtacgaacgcccggttcactcggactcctcctgccagcggtagccgcgcggcgtcaccatgcgcccggcgatctcacgggtcgccgtgttccccacggtcacgaccgtcatcatgtccaccgtcgccggatccagtcccgcgagcgtggtgaggcggctggactcgtccgtccgcgaggcgttgcgtacgacaccgacgggcgtcgtcggctcccggtgtccggcgaggatcgcgagcgcctcgggcagctgccagccccggccccggctgcgcgggttgtagaacgtcaccacgatgtccgcctcggcggcggcccgtacccgccgctcgatgacctcccacggcgtgtgcaggtcggaaaggctgatcgacacatggtcgtggcccagcggcgccccgaggatcgccccggccgccagcgccgccgtgacgcccggcacgccgaccacgtcgatgtcgtcggacgcctcggccagcgcgggcgacgccatcgcgtacacaccggcgtccccgctgccgatcagcgcgacggcgtgcccgcgccgggcctcggccaccgccgtgcgggcccgctcctcctcggcgccgagccccgactccaggacccgggtaccggggcgcagcaggtcgcggatctggtcgacgtactggtcgagccccacgagcacggaggcgcggcggagttcgtccctggcgcggggcgtgagcagatcccgggcgccgggtcccagtcccacgacggcgaggcgcccgcgggccggccgccgtacgacggcacaggtcgccatcgccggctgtgcggccgacttgcgcttcggcacgaggagttcacccccgcgtacgagggcggcggcctccgcgacggagggcgtaccgacggcggcgagcggcgcgtcggacgggttcggcacctcgaccgccgccagttccccggcggagtacgtcaccaggggcaccccgagccgcgcggccgcctcgacgatgccgggctcgtcggccttggcgtcgacggtggcgagctcggcgagggacttcacggacagccccgcgtcacgcagggcgccttggaccaggccgaggacctcctcgacgggtgcgttcctggaggccccgacgccgacgacgagggagggcggccggagcacgacctcgcgttcgccgggctcgacgagacgatcggtgagccggatcgcgtaccggccctcggcggcgaccgggagcggcggcagcggccagctcacctccgcgtccagcgccacggcctcgccgtccagcagggcccgggagaccccggagacatcgccctccacggggaagccgagcgtgtcgaggccgggcagccccacggcgtccgtcgccgtcgtcacgacgggctcggcccccagcaactcgcccacctcacgggcgagttcattggcgccgccgccatggccgccgaccagggacacggcgaaccggccggcctcgtcgacgcacacgacgcccgggtcggacgtcttgtcgccgaggagcggcgccaccagacgcaccaccgcgcccgtcgccaggaaacacacgagctgctcgcactccgcgaaggcccgccgcacggcctcgccgacgggcccgtcgtacacacgcgtccgcgcgggccaggccgcgaccaaccggtcgcgggccgcggcgcccgccgccgtcgcggaaatcaggccgatcactggagtgctccttcggtacgggccggaggccgggcgccccacagcagaaaaacgggattggtcgccgcgagccgggtgacgtccccgggcagcggggcgagccgggacgactgcaacagcacaccgtcgcagccgaacccggccccggtgagcgcctcgcgcacggccggcacccggtcgagcgcggccatcgccacgacgaccgtccgccgggcgcgccgcgcgcacgcggtgacgagggcgggcagttcgcgcccgccgccgccgatgaacacggcgtccgggtcggggagagcggtcagcgcgtccggcgcggccccgtgcacgacgtggacgtccacgccgtgcgcccgcgcgttggcgtggatccgctccaccccgtcgagcgtcttctcgaccgccgtgacggcggcaccgaggcgcgcgcactcgacggccaccgacccggagcccgcgccgacgtcccagacgaggtccccgagccgcgggccgagccgggccagcgccagggcgcgcacctcgaacttggtgatcatcgaatcgcggtgggcgaagtcgccctcttccagggcccagcgggcgggaccggccggcgggcccgcgaccgtgcgcacgggagcgagggcccgggaggcgtccaggcacagcaccacgctgaccgccgtaccccagtcgcgggccgcggcctcggccggcgtcacccgctccacgcgttcgtgctcggggtcgccgagcgcgctcgccaccacgaggacccgcgcgccgaacccgtgggcgagcgcggcccccagctcggcgggcccggcgccgggcccggtcagcaccgccaccttgggacgcgaccggcagacgttcagggcggtgcgcagatcacgtccgtgcgcgctcaccaccaccgcgtcgtcccagggcagcccgagccgcgcgaaggcggtcgccacggacgagacacccggacgcacatccagccgctcggcgccgaaccgctcggccagtgcccgtacgatcccgaagaaccccgggtcgccggaggccagcaccaccacccgccgttgcttctccagagccgcctcgatcgcgtcgagagcgggcgccagcggccccaggacgatccgctcggccccgtccggcagcgcggccgccgccagatgccgtcggccgcccaccacgagccccgccccggccagggcgcgcgcggcgtccgcggacaggggcgcccccgttcccgtaccgacgacggtgatcacgacggacttcccttgcgggccgcccgcagctccgcccgcgcctgcgggtcggccttgcggaacccgtggaagtggcccgggtggtagaggtgcgagcgggtgccgtgcgcgccgagggccgggccgaccaggaagagcgtgtgcttccagagcttgtgctccttgaccgtctcctccagcgtctcgatcgtgcacgtcacgatcagctcctccggccaggtcgcctggtacgcgaccacgaccggcgtggacgtcgggtagccgccctccagcagctcccgtaccagctgaccgctgcgggcggccgacaggaacagggccatcgtcgtaccgtggcgggcgaactcgcggacctcctccccgggcggcatcggcgtcttgccgccgccgagccgggtgaggatcacggactgcgcgacctcggggatggtcagctcgcgcccggcgagcgccgcgaccgcggagaaggaggagacgccgggcacgatctcggtctcgatgccgatctccgcacaccggtcggcctgttcctgcgtaccgccccacagggccgggtcgccggagtggatgcgggccaccttcaggccctccgcgtgcgcccgccggtacacggcgacgacgtcctccagggacatcgtcgcggaatccaggatgtccgcgcccgcgcgcgcgtggtcgagcacctcggcctggaccaggctggccgcccagatcacgacgtcggcctcggcgatggcgcgcgcggcacggaacgtcagcaggtcggcggcgccggggccggccccgacgaaggtcaccttgccggtgggggcatcggccatgggaatcggtcctctcctacaaaaaactcgggtcgtgcgaaaagtcagtgcgtacgtggccgtcgggcatgcgcgaacgggggtcgatcggatagcaagggcgtatggcggtcttcgtcgcgctcggcgcgttcctgatgacgctggccggcggctggacggcacagcgggtgaccgaccgtcgccacctggtgctgggcctggccggcgggctgatgctcggcgtggtcggtatggacctgctgccggaggcgctcgacgcggcgggcggcaaggtgttcggcgtaccggccgcactgctgctgttcgtggccggcttcctgctggcccacctggtggaacgcctgctggcgcaccggcaggccgcccacggcggcgcggagagcaacggccgggcgcccgaggtgggcctgacggccgccgccgcgatggtcggacacagcgccatggacggcgtcgcgatcggcgccgccttccaggtgggcggcggcatgggcctggcggtggccgtcgcggtcatcgcgcacgacttcgcggacggcttcaacacgtacacgctcacggccctgtacggcaacgcgcgccgcaaggcggtcatcatgctcgtcgcggacgcggtggcccccgtgctgggcgcggcgtccaccctggcgttcaccatcccggagcgcctgctcggcggctacctcgccctcttcggcggcgcgctgctctatctcgccgccgccgagatcctcccggaggcacaccacgagcaccccgcccgctccaccctgctgtgcaccgtggcgggcgtgggcttcatctggctggtggtgggcctcgcgggctgatctcccgccgtctcttccgtcggtcacagcttcccgccgcgtccgccctcgcgccgcgcgggggcgatcagcgtggagaggtagggcagcggcccgccgtcgaggtccgcggcgggccggatggactcctccgccagccccagcgccgagccccacacggcgtcgtcgatccggccggtctcgcgcagcgcctcggccacctcgtgcgcctgccgcccgaacttgtacgcgacgaccgtgccgggcccgttcagcgcctccttgagcacggccgccccggcggtcaccgggacgagggtcaggggttcggtcccctcggtgaggacggcccccgaccgggcggcgaggtcctgcatggcggtgatgccgggcacggtctcgacgacggtccccgggaccaggtcctggatcgtgtgcgcgagataggtgaaggtcgagtacacgttggggtcgccgatcgtggcgaaggcgacggtgccgtgcgccgtgagcagctcggccacccgcccgcccgcggcgtcccaggcggcctcgcgccggccgcggtcggcacgctcgttgagcgcgaacacgacccgcaggaccttctcctcgggcacgtagtgcaggacggtcgcctcggcgcgcccccgctcgccgccgtccgtcccgtccggtgcggccatcaccggtacgaccacgacgtcggcggcccgcagagcgttgacgcccttgacggtcaccagctcggggtcgccgggtccgaccccgactccgatcagcttgctgctcatgacgtccggcacctctcgacgaacctgtgggcgacaccgggcgcggcggcccagtgcgtgtgcagataactcgcgtgcacaccgtgttgtacgaaaccttcgacccgccgaaccggggcgcgtaccccccaggcgggagccgcccccgcgcccggctcgacgacggtccggtggaactcgtggccgcgcatccgggtcccggccgcggcgagcacgctgtcgccgacggcgacggcgtcgcggtagccgagcgtgagcctgccggacatccgcgcctcggcgtcgagcacaccgcacatgggctgcccgtcgagttcacggcagagatacagcagcccggcgcactccgcggcgacgggcgcgcccgcgagcgccagctccgcgacggccttccgcagcggctcgttggcggacagctccggcgcgtacacctcggggaagccgcccccgatcaccaacccggcactcccgtcgggcagtcgctcgtcgcggagggggtcgaaggtgacgacctcggccccggcggcggccagcagctcggcgtgttcggcgtaggagaaggtgaaggcggggccgccggcgacggcgacgaccggacgttccgtcggacgttccgtcgcggagagcaccggtggctcccacgggtcatccgacagtgcacccgcaccgcgcgccagcgcgaacagcgcgtcgaggtcgcagccctcgcgcacctgcgcggccatcgcggccaccgccgccacggccgccgccagccgctcggcgaccggcaccagcccgagatgccgcgacggcgtgtccacctgctcggcccgccgcagcaccccgagaaccggtactcccgccgagtccagcgcctcccgcaacagctcctcgtgccgatccgaagcgaccttgttcaggatcacgcccccgacccgcacccgcggatcccaggaggcgaacccgtgcaccagcgccgccaccgaccgcgactgcgacgacgcgtcgacgaccagcaccaccggcgcccgcagcagcttcgccacgtgggcggtggaggccagctcgccctccccggcggccccgtcgaacatccccatcacaccctcgacgacggcgagatcgcagccccgcgccccgtgcgcgaacagcggcgcgatcagctccgccccgcacagatacgcgtcgaggttccgtcccacccgcccggtggcgagcgcgtgatacccggggtcgatgtagtcgggccccaccttgtgcggggacacggcgagcccccgcgcggtgaacgcggccatcaaccccgtggcaacggtggtcttgccgctgcccgaggagggcgcggcaatgaccagccgagggacggacgacatcaccactcgatgcccctctgccccttctgaccggcgtccatcgggtgcttcaccttggacatgtcggtcacgaggtcggcgaggccgacgagcttctcgggcgcgttgcggccggtgatgacgacgtgctgggtaccgggccgctcccgcagcacggagaccacctcgtcggtgtcgacccacccccagtgcatcgggtaggcgaactcgtcgagcacgtacagcttgtacgtctcggccgccaggtcccgcttgacctgctcccagccctcgcgggccttctcctcgttgtccatctgggcatcccgctggacccaggaccagccctcgcccatcttgtgccagtcgacggacccgccctcaccgctggcgccgagcacccgcagcgcgttctcctcgccgaccttccacttcgccgacttcacgaactggaacacgccgatcggccagccctgattccaggcgcgcagcgccagcccgaaggcggcggtcgacttgcccttcccgatgcccgtgtgcacgatcacgagcggccggttgcggcgctggcgggtggtcagtccatcgtccggtacgacactcggctgcccctgcggcattacgcggccctcctgttgcttgactgaacgtctcgtacgagcccggcgatcgagtcggcccgcaactcgtccagcgtgacgggcgtcccgcccagctccccggcgagctgcccggccagcccgagccgcaccggccccgactcgcagtcgacgaccacggacgcgaccccgtcggccgcgaacagccgcgccgcccggcccgcgagcgccaccggctcggggccgcccgtcgcccgcccgtccgtcaccacgacgaccagcggccggcgtgccgcatcccgcagccgctccacccgcagcacgtcgtgcgccttgagcaaccccgtggccagcggcgtccgcccgcccgtgggcagcgactccagccgcaccgcggccgcgtccaccgaagaggtgggcggcagcgccacctcggccgcggacccgcggaaggtcaccagccccaccttgtcccgccgctgatacgcgtcgagcagcagcgacagcaccgcgcccttgacggcgctcatccgctgccgggccgccatcgacccggaggcgtcgaccacgaagagcacgaggttgccctcacgcccctcacgggtggcctgccgcagatcgtcccgccgtacgacgagcccacgccccgaccggccgcgcgcccgctgatggggtgccgcggcctgcacggtcgccgccaggtgcagcttggtgagcgtcccccggggccgccgggccccggtcgtgcgcccgtgctcggtccgcgcgcgcgaacgccggcccgccgcgccctcgccgagaccgggcacgctcagcaccttcgtacggaacggctcaccggcccgcacggcctgctgctcaccggcaccggacgcccccggctgccccgactcaccggcctgaggccgcgcggcctcgtcaccacccggttccgagctgtcggccccgtcctgaggcccttcctgagatccgtcctgagggccgtcctgaggtccgccctcggggccgttctccggtggctgcccgccaccgcccggcccgtccggatccggatcgtcgtcgccttcgtcctcgttttggccgccgaactcctccagcgtctcgtcgagcttgttctcgtcgagccccggcgcgtcgaacggattccggcgccgccggtgcggcagcgcgagcagcgccgcctgccgtacgtcctcggcgagcacatcggagcgcccgtcccacgcggccagcgcggtcgccgtccgcgccatcacgatgtcggcccgcatcccgtcgacctcgaaggccgcgcaggtcgccgcgatctgccgcagcgccccgtcgccgagccgcacggacggcaacagctcccgcgcggccacgatccgggcccgcacggcggactcctcgtcggcccagcgcgcggcgaaggcctccggatcgtcgtcgtacgcgagcctgcgccggacgacctcgacccgctgatcgggctcccgcgaggccgcgacctcgacggtgagcccgaaccggtcgagcaactgcggccgcagctcgccctcttcgggattcatggtcccgacgagcaggaagcgggcggcatgccgtacggagacgccctcgcgttccacgtacgaggcacccatcgcggccgcgtccaggagcaggtcgaccaggtggtcgtggaggaggttgacctcgtcgacgtacaggatcccgcggtgcgcgtcggccagcaggccgggctcgaaggccttcacaccctccgcgagcgcccgctcgatgtcgagcgcgcccacgagccggtcctcggaggcgccgacgggcagttcgaccatgcgcgcgggacgccgaacgcccggcccgacctcgtgcggtccgtccgggcacgccgggtcgggggagccgggcgcacacgagaagcggcagcccgcgacgacgtccacctcgggcatgagggccgaaagcgcgcgtacggccgtggacttggccgtgcccttctcgccgcggaccagcacgccgcccaccgcgggcgacacggcgttcagcagcagcgcgagccgcagatcgtcctggccgaccacggccgtgaacggaaacggggtactcactggtcgtcgccctccaaatcgccttcgagctccagataggtggcgcgcagccgctccagcgtctgtgcgtccggctcggcccacagcccgcgctcggccgcttcgagcagccgttccgtgatcccgcgcagcgcccacgggttggacttcttcatgaagtcccggttctccgcgtcgaagacgtactccgcgctgagcttctcgtacatccagtcgtcgaccacgccggccgtggcgtcgtacccgaagaggtagtcgacggtcgccgccatctcgaaggcgcccttgtagccgtggcgccgcatcgccgccatccagcgcgggttgacgacccgcgcgcggaacacgcggtgcgtctcctcgccgagggtccgggtcttcacctggtccggtacggcgctgtcaccgacgtaggcctccggactcgcgcccgtcagatgccggaccatggcgaccatgccgccgtggtactggaagtagtcgtctgcgtcgacgaggtcgtgctcgcgggtgtcgacgttcttcgcggcgacggcgatgcgcttgaacgccgtctccatgtccccgcgcgccgcccgcccgtccagcccgcgcccgtacgcgtatccgccccacaccgcgtacacctcggcgaggtccgcgtcggagcgccagttgcgcgcgtcgatgagcgggagcagaccggcgccgtacgcacccggcttggagccgaagacacgggccgtggcgcgtcgccggtcaccgtgctcggcggtgtcctcgtcggcgtgcttgcggacgtagttcaggtccacgggctcgtccagttcggccaccgcccgcaccgcgtcgtcgatcagcccgaccacgtgcgggaacgcgtcccggaagaagccggagatccggaccgtgacgtcgatgcgggggcgcccgagttcgtccaggggcacgacctcgaagccggtcacccggcgcgaggcgtcgtcccagacgggacggcagcccagcagcgcgaggatctcggcgatgtcgtcgccctgcgtacgcatggcggacgtgccccagaccgtgaggcccaccgacttcgggtactcgccggtgtcctggagataccgctggatcagcgagtccgcgagcgactgcccgacctcccagctcagcctggacgggatggccttggggtcgacggagtagaagttgcggccggtcggcaggacgttgacgagtccgcgcgtcggcgaacccgaggggcccgccgggacataaccgccgttcagcgcgcggaggatgtggtcgatctcgtccgtggtccgggcgagccgcggcacgacctcacggcacgcgaactccagcaccgccacggcgtccgggagttcgctgcccaggacctcgcggacgagtgcggggacggcggcgacgtcccagccgcgctcctccatgccctcggcggcccgtcggcacagctgctccagcaggtcgatcgcgtcggccgccgaccgggacggcccctcgacgaggtcgctcagctcggccggcaccttcaccggcgcacccggctcgcccagcaactccttctcgaccaggccgaaatgggccgccagcgccgccctcaggcccggcagggcgttggcctgaccgccccacacctgcgaggcccgcagcacggccagcacgaggttcacgcgcggctcggcctccggcccgccgccgagaatgtgcaggccatccctgatctgcacatccttgatctcgcacagatagccgtcgatgtgcatgacgaactcgtcgaacgcgtcgtcgtccggctgatcgtccacgtgcaggtcgtggtgcagctcggccgccttgaccagcgtccagatctgggcgcgcacggccggtgccttcgtcgggtccaggtcggacacgagcgcgtactcgtcgaggagctgctccagcttggcgaggtcgccgtacgtgtccgcgcgcgccatcggcggtacgaggtggtcgacgacggtggcgtgcccgcggcgcttggcctgggtgccctcgccggggtcgttgacgatgaacgggtagaccagggggagttcgccgagtacggcgtcgggggcgcagccaccgctgagcccgagccccttgcccggcagccattccatcgtgccgtgcttgcccatgtgtacgacggcgtcggcgccgaaactgttctccagccaccggtaggccgccatgtagtggtgcgacggaggcatgtccgggtcgtggtagatcgcgatcgggttctcgccgaagccgcgcggcggctggatcatcacgacgacgttcccgaactggaggcaggccagcacgatgtcgtcgccgtcgacgtagagggagcccggcggctcgccccaggcctccagcatgccctcgcgcagagcggggtcgagcgtctcgaaccacgcccggtagtccgcgagcggcacgcgcgccggagcggcggcgagctgctcctcggtcagccactcgacgtcgtggccgccggccgcgatgagccggtggatcaactcgtcgccgttgtcggggtattcggtgaggccgtagcccgcgtcccggagcgcgtcgaggacccgtaccgcggaggcgggcgtgtcgagaccgaccgcgttgccgacccgcgagtgcttggtcggataggcggtgaagacgatcccgagctttttctccgcgttcggcttgtgcttcaacagggcgtgccgcagggcgattccggcgacccgcgcggcccgctcggggtcggcgacatacaccgggacgtcgtcggggccctgctccttgaaggagaaggggaccgtgatgaggcggccgtcgaactccgggatcgcgacctgcatcgccgcgtccatgggggacagggcggcgtccgacccctcccaggcggcgtgcgaggaggtgagacagaggccttgcagcaccgggatgtcgagatcggtgagcgcgccgatgtcccacgcctcctcgtcgccgccggcggatgcctgggaggcgtgggtgccgcccgcggcgaggacggtggcgacgagcgcgtcggccttgccgaggatctcgtacagcccggtgtccgcgccgcgcagcgaaccgcagtacacgggcagggcgttggcgccccgcgcctcgacggcatcgcacagcgtgtccacgaaggcggtgttgccgctcagctcgtgggcccggtagaagagcacgccgacggtcggacggccctgcgtgtacggacgctcgccgtggacgccgtactccggcatctgctgcggctcgacgaagccctcgccggtcagcagcacggtgtccgacaggaagcgggccagctcgacgaggttggcggaaccgccctcgaccagataccgcagcgcctcggcgaccaccccggcgggcacggacgactcggccatcagctccgcgtccgggacggtctcgccgccgaggagcacggtcggaatcccggacgccttgagcgccgccagcccgtcctcccaggcgcgcttgccgccgaggagccgtacgacggcgatgtccgagcccgcgacgagcgcgggcagctcttcggacacgtcgacccgggtcggattgccgatccggtacggggcgccggaggcgcgggccgccagcagatcggtgtcggcggtcgacaacaacaacactgtgctcatgcgggcgctcccggtggaatgaaaggcagtcctgacggtgcgcccgactcgatgagccgccacagcgcgtccgtgtccgcgtgttcctcgatcagatcgccgagccggtccagctgctcctcgcgcagcccggcgaacgacgtgccggcggccggtacgaagcggcggcccgcggcggccgccacctcgcgcaggaaggcccggcggaaaccgtccgactccagcgagccgtgccagtgcgtaccccacacggcgccgacccggcagccgtccaggaaggggtcgccgcccgtgacgtcggcgacgccgtggtggatctcgtacccctcgacgtgctcgccgagggcctcgccgacgggccgggtgagggtcttctcccgggcgaaccggacgcgcacggggaggagtccgagcccctccacatggccccgacggctctcgacgtcgtcctcgatgtgctcgccgaggacctggaaaccgccgcagatcccgagcacgggccgtccggccgcggctctgcgccgcagcgcttcggcaagtccccgctcccgcagccactccagcgccttgaccgtcccgcgggtccccggaatcaccacgaggtcggcgtccgccagctcctcgggccggtccacgaaccgcacgacgacgcccggttcggcggccagcgcgtccacgtccgtgaagttggacatgagggggatcgcgcagacggcgacgcggaggatgtcctcgccgacgggggaggacaccgccgactcccgtacggatccccgcaacgacacccgcagtccgtcctcctcgtcgatgccgaggccgtgctggaaggggaggacgccgtacgagggccgcccggtgaggttccggagcatgtcgaggcccggctccagcagggacacgtccccgcggaacttgttgacgaggaacccggcgacgagttcctggtcctcgcgcgacagcagggcgacggttccgaagaaggaggcgaagacgccgccgcggtcgatgtcgccgacgacgagcacgggcagccgcgcgttgcgtgcgatccccatgttcacgatgtcggtccgccgcagattgatctcggcaggactgccggccccctcacagatcaccgcgtcatacgtgccccgcaactcggcgagacagtccaggacggtcccgagcagcgcctcctgccgcccgccgtggtagccgcgcgcgctcatctcgcccacgggcctgcccatcaggacgacctggctgcttctgtcgctcccgggcttgagcagcacggggttcatcagcgcggtgggctcgacccgggcggcctgtgcctgcatggcctgcgcgcgcccgatctcggcaccttcgcgcgtgacgaaggagttcagggacatgttctgcgccttgaagggcgcgaccttgacgccctggcgcaccagccaccggcagatcccggcggtcacgacgctcttgcccgcgtcggaggtggtaccggcgatcagcagtccgccgctcatgacgtccctccccgtttccacagccgcccggcggcggccacgcccagggcgagccagcccacccgccgcgacaggcgtacggcccgctcgatgtccttgctgtccacggcccgtccgccgccgttgagcacgggccggtgttcgaccctgcccccgtacgagagcgttccgcccagccgtaccccgagagcccccgcgaaggaggcctccaccgggccggcgttggggctcggatgccgggcggcgtccgagcgccaggcgcgcagggcgccgcgcggatcgtgtccggcgagggcggcgagtacggccgtcagccgggcgcccggccaccccatgacgtcgtcgagccgggccgaggcccacccgtaccgcagataccggggagaccggtgcccgaccatggcgtcgagcgtgttgacggcccggaaaccgacgagccccggcacgccgccgacagccccccacaccagcgcccccacgaccgcgtcggaggtgttctcggcgacggactcgacgacggcgcgggcgatcccgtcggcgtcgagggcccccgggtcgcgcccgcacagatgggggagccgctcccgggccccctcgatgtcccccgcgtccagggcctgcccgatggcccgcgcctcgcgcccgagggaggtcccgccgaccacggcccaggtggcggcggcggtcagcgcgacggaagcggtacgggaggtgcgtacggaacgggcggcgacggcggcgaggcccacggccccaccggcacagacgacggtgtgcagcgcgccccacccgcggtggtcccgccacagcacccgctccacgacgcccgcggcccgcccgaacgcggcgaccggatgcccgcggcggggatcgcccaggagcaggtcgccgatgagcccggcggcggcgccgtacgcgaagacgcgatcggcacgcatggggtcagcccgccgtcggggggaggagaggccgcgtgctgaacgtactggtgagcaagacccgcaacgggcagccgcgcatggcgatatgtcctcactcagggtgtccacgccctggttcgacgagaccggcggtgagagttcctggctcccggggacttacttccccggtgacagtggcgggaccgcgccggactcacaccggcttcctcttctgccgccgtacttggctccggcagtccaccatggctcccgaacacccgtcaacttgctgttgacctgggacggaggagtgtgctgaggcccacacgcacacggcgtgcggggcgcgttcgggcgtggggcggggcgcacgcgcatggagcacggggtgcttatgcgtggggtgcgggacgcatacgcgtggggtgcgggacggatggtccgtcccgcaccccaggtgcgtgtaccgccgtgcgtcaggcgacgatcagatagatcccgtacgccaccgccgccgcgcacgccgcgaagcaggcgtaggcgccggtggtcgccagtgcggccgacccgccctcggccgactccttcttggtgaggccgacgatgcccagggtgaagaggcccaccaggccgacggtgaccacgaggctgactccgaagacggagcccagtgctgcccagtcgatgctcatgctgttcgttccttacaccgtggccggacgggtgggctccgcgcccggggacggggccgggatggtggtcttcaggtcggcggtggcgtcgaccacggagaccgggcccgccggcggcggggtgaccgcggcgatcgcggtggtgacgacacccgcgggctcggccgcgatgtcgttgacgttgtcgacggtcaccggctggcggcgggacagggcccagatggcacccgcaccggcgaccagcagcacgccggtggcgatggtgccccaggtgccctgcttggtgaggagttcggcgcccgcgccgaccaggccggcggccggcagggtcagaccccaggcggcgaacatccgggtcgcggtggaccagcggaccaccccgcccttgcggccgatgcccgcaccgaggacggagccggagcagacctgggtggtggagagcgagaagccgatgtgcgaggaggccaggatggccgtcgcggcgctggtctgggcggcgaagccctgcggcggggccaggtcggtcaggcccttgcccatggtgcggatgatccgccagccgccgaggtaggtgcccagcgcgatggccgtgccggccgagacgatgacccacatcggggggttcgagccgggggcgacgacaccgccggtcaccagcgcgagggtgatgatgcccatcgtcttctgcgcgtcgttcgtgccgtgggcgagggagaccaggccggccgaggcgatctgcccggcgcggtagcccttcttggtcgccttctcgtcggcgcgggcgccgatccggtaggtgaggcgggtcgccagcatcgcggcgattccggccacgaccggcgcggcgacggcggggatcaggatcttggtgacgatggtcgggccgttcaccgacgaccagccggccgacatgaccgcggcgcctatcaggccgccgaacagtgcgtgggaggagctggagggcagacccaggagccaggtcagcagattccagaggatggcgccgacgagcgccgcgaagatcacttcgacgcggatgccctcttcgttgatgatgccgccggagatcgtcttggcgacctccacggagaggaaagcgccgacgagattcagcacggcggacatggccaccgccgtcttgggtttcagagcgccggtcgagatggtcgtcgccatcgcgttggcagtgtcgtggaaaccgttcgtgaaatcgaacacgagagcggtaacgatcacgatcccgaggagaagcgtgatgtgttccatttacccaggcttctgttggacgtcagtggcaggtggaccgtaagcaacctgggtgaacggaagatgaactgaggcgggctgtggggtgtctctatcggagtcccgtcgctccgcttgtgacgaagcgacggtatctccctttcgaacggaggcggaattccggcctccggaggcttgtggcggggtcgggtcagcccttggcgaagcgcttcagtccggtcatggacccgttgaagagattctggtcacccggcaggctgccgctgttgtcgtactgccagaacgtccagaacgaccagcccgccggaagcgcccccgcgttcgcggagtcgtagcgggccagccacagcgcgtggtcggcggcgaaggcggcgctgccgccggtgcacttgttccaccagtgcgtggtcgtgtagatcaccgggcggcggccggtctgccgtttcacctcgtcgctgaacgactggatccagccgaccatcctggccttgctcaggccgtagcacttcttcttgctgtacgggttgtactcgatgtcgagtgcgggcggcagcgtccagccgtcggcgcgccagccgccgccgttgcgcacgaagtacgcggcctgggcggcgccggacgacttgtccggcagtgcgaagtggtacgcgccacggagcaggccggcgttgcgcgaaccgttgtactgccggccgaagaaggggttgcggtagtcggtggactcggtcgccttgatgtagacgaacctggcgcccttcgcctgcgcgcccgaccagttgacatccttttggtgggacgagacgtcgtggcccagcggcttgcccgccgccgaggcgggaagcccggcgaagacggtccccccgatggcgaacaccgccgcggacgcggcgaggacgcgggcgcggcgacgggacggtttgtgatcacgggccatatttccccccggaatggcgacgtgtgcggcaaatctcccagaggttactgggagatcggcccaagtccgtcgaccaccggccaatcatcgcgagcaggcgatatgtatcggtatgcgcccttacggacgtatggcttccgccctaaagtgcccaggtccaccggcggccccggccctcgcctggcaggatcgcggcatggctgagcagcggcgcgacgggcgggatgcggggggcgtgcgggagcacccccaggagcggcgcgaggaggggcagcgggacgaggtggcccgggcctgggacgacctcgtggccaccgcccgccgcacggtgtccgacggtctggtcgtcggcacgtcgggcaatgtctccgtgcgcgtgggggacaccgtcctggtcacacccacgggagtgccctacgagcggctgacgcccgccgatgtcgtgggcgtcggcctcgacggccggcaggtgctcggttcgctggtcccgacgagcgaactgcccatgcatctggcggtctaccgcaccaccgacgcgcgcgccgtcgtccacacgcacgccgtgcacgccacggccgtgtcgacgctcgtaccggagctgccgctgatccactacatggcgggcgcgctcggcgggccggtccgggtcgccccctacgcgacgtacggcacgccacagttggccgaaaacatgcgacgggccctcgaggaccgcacggcctgcctcctccagaaccacggcacgatcgcctacggcgcgaccctgccccaggcgtacgaccgcacggcccaactcgagtggatgtgccgcgtatggctgacggcgtcctcgataccgggcctgaccccgacgctcctcacggaggaacaggtggcggaggcgggggagcgcctgcgggggtacgggcagccggggcggtagcgcgggcgccgggatcgcaccgcggggacggcgcggtcctggccgggcggcgccgcggaccccgccggcgcatgccggttcggtggcggggtacccggcgcggcacgggaaacaacacctccgaacccggcagggagcctcgccccgagccgtcctccggctggccggtggcggactccgcaaggagactgaatccgtgcgcacagtcaaagcgacggccgccgccgtcaccgtagccatagcagccggcgcggccggtgtcgccgccggccggttcgccagcgacgccgcgctcaaggcgccgccgggcagaccgctgcccaccgaaccccgcctcaccgtgcactccacggccgcgggccagatcacgctcacccgcgccctggcctcccaacggcccggcacctacggcatctccggcgacggctcccacgcggtcgtcggtccggtcctcgccgccgctccccactccgccgacacggtcgtacgccgcctggaacgcgtcacccacggcaccctggagcccggcgacaaggtctggctgacaccgaacgtgcacatcggcaaccccagctccgccctcggcctcgagcacgccgacgtcgacatccccggcgagctcggccccttgcccgcctggttcgtacccggcgtccgcgacacctgggtgatcaccgtgcacggcctcggcgccacccgcgaacaccccatgaacgtcatggggttcctgaaccgccaccacttcccggtgctcgacctcgcctaccgcggcgacctcggcgcgccccgcccccaggacggcctgaaccacctcggcgagaccgagtggcgcgacctggacgcggccatccgctacgccgtgcgctacggcgccgagcgggtcgtcctgcacggctggtccaccggcgccaccatggccctgcgcgccgccgcgcactccgggctgcgcgagcggatctccgggctcatgctggactcgcccgtactcagctgggagaccaccgtgcgcaccctcgccgcggcccgtcgcacccccggcgcgctgctgccgctcgccgtccgcgccgcccagggccgcaccgggctgcacggcgaccgcatccaggtggccgccgacccccagcacctccaggcgccggtgctgatcttccacggtccgggcgacaccgtcgccccctggggcctctcgcgccgtctggccgacagccgccccaatctggtcaccctccacacggtcaccaacgccccgcacggagccatgtggaacgccgaccccggagtgtacgaagaggccatgcgccgcttcctcacccccttgatgtaggcacacctccgacagcccctcgcaaaggggcaaagccgcttccggttcgggtttcaccaagtgctccctcacccgtctcgagcgcctgcccagacctgtccattggccacccctgtcgccccccgtgacattccgtttgggttttcggaccgtcaaccggaagactgcacccgtgacgtcccgtaacccgcgcgactccaggctccgactcgtccgcccgcggcccctggccgcagcctcccgagcggtgacccagcgccgcacgcgccgcccggcaccccggccgccggagggcacccctccgcccgcggaactggcccgcatggcacgcaccggcctcgccgacgcggcccgtgtcgcccgctgggccgacgccgcgctccgcccggggcacggcgtagggccctccgacggcaggggcaccctctccgacaccaccgccgaacgggccgccgccgatctgggcctgaccccggctcaggtccgtgccgactgggacaccgcacgcctcgcgggcctcgtcgaggtgcacggcgacagtgcccgccccggctggcggctgcgcgcgtggaaccgcgacgacagcgccgtactgcgcggctgggtcgcccttttcgacgcctggtcgctcgcctacccggaacccgaggagcacgagcacgccgccgtcgccgaggtcgtctccgcgatgccgcaggtgctctccttcctccagctgtcggcgggccccgtccccttcgagcaactcctcgacctgctcgaccagcgggtcaccgagctgcgcacggaacgctgcgaggtcccgtacggcccccaggcggagcccgtcgaggtccccgcggggcgttccggcggtgtcttcggcatccccggtgagcgcctcgccgaggacaccccgctctcccccctcctcgactgggccctgcacgccctcgcctccgtgggcgcgctcacctgcgccgacgggcaggccacgctcaccccgctcggcagttgggcggtgtgggtcaagctggagcagatctgcgtggccgcgcagagccccgccgggaacatcgagcagaacgcggaggacatgctccgcggctgtgcccagctgcgcccgaacgccgcccgtgccgagtaccgcgcctggctcgccgcccgcaccgtcggcagcgccgtcaccgagctcctcgacgcggcccgcggcgacgacgccctcctgcgcggcctcgccttcgaggcgctgcgcgtggtcggcgctcccgccgagcccgatgtgcgcgccgtggccgaggccaccccgctgcgcccgtacgccctgctgtggctcgcggagcacgacggtcacgaccccgaggacgcccacgaggtgctcacccgcgaggagtccacctggctgtgggtggacaccgcggcggccgtcgccgaccacggcgaagccccgctcctcgtgcgccacctggagtccgcggtacagcccaccgtgccggcgctcctcgacgaggtacgcgcggtcgggcacccccgcaccgtgcaggtcctggtcgcgctcgccgccgcccaccccgatccggcactcgccagggcagtccgccgtgcggccttccaggtgcacacgggcgggagctagcccaggatccggcctggtccccaagacgcgccctggtcgcccgggggagcgtcagccctgtatctcgggggcgtacgtgccgaagctccagatgttgccctcggcgtcccgggccatgtagtcccgcgagccgtagtcctggtccgtcgggggcatcaggatctccgcgccgtggtccacggcgcgccggtggtgggcgtcgacgtcgtccaccacgacgtacaccccgcaggggcccgcgttcttcatcgcctcgtcgaagcggccgccgcggcccttcgagccgagcatgaccgcgccgttgccctgcaccagctcggcgtgcatcaccgagccgtcctcgccctcgtacaccgacagctccgtgaagccgaaggcctccgtgagctgcttgatcgccgccttcgcgtccgcgtacagcaacgacggacagatactcggacgcccgctgtccatgcctgccatgccgatcaccccttatcgcctcgtcgccggaatgtgacccgccacacagtgtggcatcgggcactgacaacgcggccccgggcgaaggaccgaaggaccgaaggaccgaagggtcgaaggaccgaacggccgaacggaggacgcacccgggcccgcccgccgtgtcacggcagccgtccgccgtacccgcgcctacgctccgcctggtccgtgggcagcgctttgagggggcgaggtggtcgctttgccgaccgggacgacgggggagggccccggcgaccagcgctacgcggccctcaccgacggccggcccgcagcgtcccgcgccgacagccggcccaccgcccccaccgcccacgcgcgcacgccggccccgcgcgccccgcgaacccgcaggccgagcaccccgcgacccgcacagccgagcgccccgcgaacaccgaagccgcgtggactgtgaacgcctctccccgcccccgcctccccaccgaccccctgcccccgccccacttccgccgtctccaccgcctcctgcccaccgccctcgcgctcctgctcggcgcctccctcctcgccgcggtccaccacgcccgccccgccccctacggagatcgcctcaccgtccacgcgcgcgtggcgcccgccgtggagcccaggttgcgtatgcgaggggccgccgtcgaggcgtacggcggccgcggcggctcggttcactggacctacgcgcgggcggggcgtcgaccgctcgccgtgctccccgcgcgcggggacgccatcgcactgtgggacgacggcctggtgaccgccaccgacgccaccggcgtccgctggcaccgcgccctgcccgcggccgcggactggctggcggcccacggcggagccggggtcctgcggatgctcgatccgggcacccgcatgctcgccgtcgtcaccccgcaccgcatcgccgcgtaccgtctcgccgacggcgatctgcgctgggtgctgcccgcccgccagggctgcgccttcgcccccgcgcgcgcggtgcaccgcggcggcgccatcctgatcgcgcagccctgcctcgcggcagactcctggagcggcgagatcgtcgccgtggacgacctcggcccgatcgccccgcgccgcacaccgctgggcaacgaatggcagggcgaacggcggggcgagcatcacagtgccgaacacccgcacacaggaaatctggttgcacggccccgttagacttggcccatggccattctcctcgcgcattagacggcgggaacgccctcagctgcccaccccgccaatacttccgccctggagtctgtccgtgatctccgcctccggtatcgagctgcgcgccggcgcccgcatcctcatcgagtccgccaccttccgcatcgccaagggcgaccgcatcggcctggtcggccgcaacggcgcgggcaagaccaccctcaccaaggtcctcgccggcgagggagtccccgccggcggcaacgtcacccgctccggcgaggtcggctacctcccgcaggacccgcgcaccggcgacctggacgtactcgcccgcgaccgcatcctctccgcacgcggcctggacaccctgatccgcaagatgcgcgagaacgagcagcgcatcgcgaacggctcgggtgccacgcgggagaaggcgctgcggcagtacgagcgccaggagacggagttcctcaccaagggcgggtactccgccgaggcggaggccgccaccatcgccgccgcgctcaacctgcccgaccgcgtgctcggccagcccctgcacacgctctccggtggtcagcgccgccgtgtcgagctggcccgcattcttttctccgacgcggacacgctcctcctggacgagccgacgaaccacctcgacgccgactcgatcgtctggctgcgcgactacctgaagacctaccgtggcggcttcatcgtgatctcccacgacgtcgacctcgtcgagacggtcgtcaacaaggtcttctacctggacgccaaccgctcccagatcgacgtctacaacatgggctggaagctctaccagcagcagcgcgaggccgacgagaagcgccgcaagcgcgagcggcagaacgccgagaagaaggccgccgcactccactcccaggccgacaagatgcgcgccaaggccaccaagacggtcgccgcgcagaacatggcccgccgcgcggacaagctcctcgcgggcctcgaggcggtgcgccagcaggacaaggtcgccaagctccgcttccccgagccgtcgccgtgcggcaagaccccgctcacggcggagggtctgtcgaagtcgtacggatcgctggagatcttcaccgacgtcgacctggccatcgacaagggctcccgcgtcgtcatcctcggcctcaacggcgccggaaagacgacgttgctccggctcctcggcggcgtggagacgcccgacaccggcgaggtggtcgagggacacggcctcaagctcggctactacgcgcaggagcacgagaccctcgaccccgagcgcacggtcctcgagaacatgcgctccgccgcccccgacctcgacctggtcgaggtccgcaagacgctcggctcgttcctcttctccggcgacgacgtcgacaagccggccggcgtgctgtccggcggcgagaagacccgcctcgcactcgcgaccctggtcgtctcctcggcgaacgtcctgctcctcgacgagccgaccaacaacctcgacccggccagccgcgaggagatcctcggcgcgctgcgcacctacaagggcgcggtcgtcctcgtcacccacgacgagggcgccgtcgaggcgctccaacccgagcgcatcatcctgctgcccgacggcgtcgaggacctctggggcgccgactacgccgacctcgtggccctcgcctgaccgacctgtaaggggtcaccccacgggtcacccccgcttgatcgaatgagtgatccactgcgtatggatcattcggccgatccgtgatccatcatctgtgtgagatctcctcgtaccgaggtgtgccctacatcgatttcgcggccgagtcctttcatcccgagggctcggccgtcgcgcgtcgctgacctggtgattcacggatgaacccgttcggccgtacggatgccaccgggcggaacaccggattccgctcgtggggatgtgctcctgtcgtcaaaaccttgtcttacggaccttgccgaatgggtggccatgaagcccccgaggggtgatcatgaggagaccagagcgcacttcccttgaggaggcacgggtggccgagactctgaagaagggcagccgggtgaccggcgccgcgcgcgacaagctcgcggcagacctgaagaagaagtacgactccggtgcgagcatccgagcgctggccgaagaaaccggccgctcgtatggcttcgtgcaccggatgctcagcgagtcgggcgtcacgcttcgtgggcgtggcggtgcgacgcggggcaagaaggccactacggcctgaggccggcgcggtccatcggcttcggtggtgccacccggtcggtcgagtgatcgaccgggtggttactgtgcagtcacttacggatgcgtgctacttctccgtggcaccgcatccacgatgaccgcacccatcggaggcgccccatggcttcgcatgagcacgagacggacgtcgacaaggaccccggcaaggtcctcgatcccgtactcgacaaggacggcgtacggctcaccgtcgacgaggctgtcgccacggtgacgctgaccaacccggccaagcgcaacgcccagagtcccgcgctgtggcgggcgttggcagaggccgggcgggtactgccgggctccgtccgtgtcgttgtgctgcgcgccgagggcccgtcgttctcggcggggctcgaccggcaggcgttcacgcccgaggggttcgacggcgagccgtcgttcatcgagctcgcgcgcagttcggacgccgagctggacggaaccatcgccgagtaccaggagggtttcacctggtggcggcggagcgacatcgtgtccatcgccgcggtgcaggggcacgccgtcggcgcgggtttccagctggccctcgcctgtgacctgcgcgtcgtcgcggacgacgtgcagttcgccatgcgcgagaccagcctgggcctcgtccccgacctcacgggtacgcatccgctggtgagcctggtgggttacgcccgcgcgctcgaaatctgcgcgacgggccgttttgtgctggccgaagaggccgaacgcaccggcctcgccaacctcgccgtgcccgccgagcagctcgacggcgcggtacgggatctcgccggcgcgctgctcgccgctccgcgtgacgccgtcatcgagacgaaggcgttgctgcgtggggcgcaggagcggacgtacgaggaccagcgcgcagccgagcgtgccgcccaggctcgccgcctgcgggatctggccggggtcggcgactagggccggcccaccgccgtgaccaccacggcgaccgacgggtggtccggcagggcctccgtcaccgccgagcggaccgccctggccacatcggcggtccgccgttccgccgtcaccgccagttcgacgcgaacgtgacggtgcggcagggtggtcttcccgccgacgtcctcgatgtggaccgggcggcccagggcgtccgtcagacgggcgacgcccgggacggacagcgcggccgaggccgcccggagctcgtcggcaccggtcggctgggcagtcggccgctcgtcgtcagggcgtacggcgacgggcgcctcgtccgccccgttcgacaactctgtcaccagcagatccacctccgtgaccgtcagaccgagccgctcctccgcggccgcggccagggccaggcgcaggcggtcggccgtcgtggggagcgggtcgacgcccggcgccgtggggtccgccgagacggtgaactccgcgatgatgcggagggggccgggcggcagcgcgctcggcgggggcggcacgaccggctcgtgcacctgctgctccgggtcggcgagggagatccggagcgtgccgaggcggacctcgcgcacgggatccgccgcgcgccgcagcaccgagccggccgcgctctccgtgatccacgagccgtcgtgggggaggccgaggggcagcagcctgccgagcctgagcagatgccgtacttcctgagtccaccggtctgccgtcattgttccagcctgccgcaccccaggcgcgagaggccgcaacccggcctactgtgggttgggggacgaccgaaagggaggtgcggcgatgaccgacatgacggagcggaaccggccggagacccccgagggcgcggtggagtcgccgcaggcacgcagggccaccaagcgaggcggcggcgaccccgcgacccgaggccgcaccaccatcgccgacggcgtggtggagaagatcgccgggctggccgcccgtgacgtactcggcgtgaacgccatgggcagcggactcagccgttccttcggggccatgcgcgaccgggtgcccggcggcaccaagtccgtcgcccgcggggtgaaggcggaggtgggcgagctccagaccgcgctcgacctggagatcgtcgtcgactacggcgtgtccatcaccgatgtcgcccgcgccgtgcgcgagaacgtcatcgcggccgtcgagcgcatgaccggactcgaggtcgtcgaggtcaacatcgccgtcagcgatgtgaagctgccggacgaagaggaagaggagccggagacacggcttcagtagtcacggggtgaccgcacagctgaggagcgcaccatgagcttggccgtgatcggcatgattgccggaatggcgctgggcttcgccgggtacttcggcggattcggcgcgtttctgctggtggccgccctgggcgccgtcggcctcgtcgtcggccgggtcatcgagggggacctggagttcggcgacttcttccgcccccgcgacgaccggcggcgatgacgggtgcccggccaggccggtgagctcgaacagcgctacgggccccaggcggtccggcggcccccgacggccgtggcgccggccgagcgcggggccaccaggatcgccgaccgggtcgtcgcgaagatcgccgcgcaggcggcgcgcgaggcagtgctgccgctgaccaggggcgccgagtcgccgcacgccacggtcgtcgtgcaccacggcaccgcccgcgtccgcatcagtctcgaactcgactatccctccgacatcggtggccggtgccgtgcggtgcgtcgtcaggtcgccgagcgggtaggcgctttgacggggatggaggtgcacgaggtggccgtccaggtggagcggctgcaccgggcaccggcacccggcgcggcacacgggaggacgcagtgagcgagccccagggacacgagggacacgagagcacgcagcggctgccggtcatcgagaagaccgacgacacggaccccggccggtccgcctccccggaggcctacgaaccgggcccggtcccggccgccgacgagggcgcccgcgacggccgcttctggtcggcccgccgtgtcccggcgggcctcctcgccctgatcgtcctcctcggcgccggcctcctcctgtacgacgtcgtggccgtacgcgcccaccggcccgccatgcactggcgcagattcctggcccgtcagctcgccgagcggcccctcgacgacacctgggtgctcgtcggcgcgggtctcgccgccgccctcggcgtctggctgctcgtgctcgccacgactcccggtctgcgcggcttcctgccgatgcgccgcgcacaccccgacgtacgggccggactgcaccggaaagccgccgcgctggcgctgcgcgaccgggccatggaggtgtccggcgtgcagtccgtgcgcgtccgtgtgcggcgcaggaaggcggacgtccgcgcggtgtcgcacttccgtgaactcgacgacgtacgcgccgacctggacgccacgctcgccgacggcgtccgggggctggggctggtccggccgcccgcgctgtcggtgcgcgtggggcgtccccggcggaaggggtgaggacggtgctgaggaccgtcaaccgtgtgctgctcggactcgccgggctgatcctggtcgccctcggcggctccgtgctggccgtcggactcggcgtccggccaccctcgtggtggatccacgacggacggcgcgacgtgctcctcagctacgccgagcggacgcggtggcgggacgagggctggtggtggccgaccgtcatcgccgtgctagccgttctcgtcctgctcgccctgtggtggctgtccgccgtactgcgcaggcggcggctcgcggaggtgctcgtcgacaccggcgacggcgagggcgcgatgctgcgcggacgggccctggaggacgtactcgccgctgacgcggagcagttggacggcgtcgggcgcgcacacgtcctgctgaccggccggcgcgccgcccccgaggcccgggtgcggctcctgctggaaccgcacgtggatccggggaccgcgctgcacggcctgaccactcggtcgctcgcccacgcccgggactccgcggccctcgcggcactgcccgcggaggtccggctgcgcgcggtcaaacaccgggcggagcgggtgagttgagggacaccgcggacaacggcgggcgggttccgctgcttcccgcggccccggtccaccggaccggccctagaacccgtgccgcatcccgccgtccaccggcagcatgatgcccgtcagatacgacgccgccggcgacagcaggaacgcggccgcgcggccgaactcctccggtgtgccgtagcggcgcagcgggatgcgggactcgttggccacgcgggtggcctccgggtcggcggagagcccgtcgagttcacggacacggtccgtgtcgatgcgggacgggagcaggccgacgacgcggatgccgcgcgggcccagctcgtccgcgagggacttggcgaagccggcgaggcccgggcgcagcccgttggagatggtcaggcccgggatgggctcgtgcaccgagccggacagcacgaagccgatgaccccgccctcggccagctcggccgccgccgcacgggccagccggaccgcaccgaggaacaccgactcgaacgcggccgtccactgctcgtccgtgttgtcggcgacgaacccgggcggtggtccgccgacgctgatgaggatgccgtcgaagccgccgaagtgcgcacgcgcggccgcgacgaggcgggccggcgcctcggggtccgcgttgtccacggccaccccgaccgcgttcgggccgagcgcggacgcggcgtcggcgacactcttgtcgtcccggcccgtgacgaccaccttcgccccgtcggcgacgagttcccgcgccgccgcgttgccgagcccacgggtcgccccggtgacgacgtacacacgatcctcaagtccaagatccatgccccctatcctgcctcctggtcaccgaagagggcgagggcggtgctcaccaggccgaggtggctgaaggcctgggggtagttgccgaggaagcggtccgacgccgggtcgtactcctcggcgagcagacccacgtcgttgcagagcccgaccagccgttcgaacagggcgcgggcctcctcggtgcggcccagccggtgcagggcgtccgcgagccagaacgaacagaccaggaacgtgccctcgtcgccgggcagcccgtccacctctgccacgtcggtgctgtaacggcgtacgaagccgtctcggcccagctcctcgcgcaccgcgtcgaccgtgccgatcacccgcggatcgtcgggcggcagaaaaccgacccgggggatgagcagcagcgaggcgtcgagtccacgtgagccgtagaactgtgtgaaggtgttccgctcggcgtcgtagccgcgctcgcacacctcgcggtgcacctcgtcgcgcatggcccgccagcccgccagatcgccgccgagctgcggctcgttctccagggtgcgtacggcgcggtcggcggccacccaggccatcaccttcgagtacacgaaatggcgacgcccgccgcgcacctcccacagcccctcgtccggctgccgccaggccgagcacaggaaatccatcagggcgcgctgcacctgccacatgtgcggtttggccggcagacccgaacaccgggccagcgacagcgagtcgatgacctcgccgtagacgtccagttgcaactgcttcgcggcgtcgttgccgatccggaccgggaccgagtccccgaatcccggcagccagggcagctcgaactcgggcagccgccgctctcccgacagcccgtacatgatctgcagatccgccggatcgcccgcgaccgcgcgcagcagccagtcgcgccagtccgcggcctcctcgtggtacccggccgacagcagcgcgtccagggtgagcgtggagtcgcgcagccagcagtagcggtagtcccagttgcggatgccgccgagctgttcgggcagtgaggtggtgggggcggccacgatgccgccggtcggggcgtaggtgagggccttgagagtgatcagggaacgcaccacggcatcccggaacggtccgtcgtaacggcactgcgacacccactcccgccactgcgcgagactgccgtgcagcgactcgtacgggtccacgagcggcgggcgcggctggtgcgagggatgccaggtgaggacgaaggcgaccttctcgccctccccgacggtgaactcggagtgcgtgcagaagtcctcgccccaggtgtgcaccgcgggctcgctgcgcagccacacggcgtcggggccggccaccgccacgcgatgcccctcggccctgcgcatccacggcacgatcgagccgtagtcgaagcgcagccggatcgcgctgcgtacggtgacgcggccgcgcagcccctccacgatgcgtacgaggtcgggggcgctgtcgcgctggggcatcaggtcggtgacgcgcagcgtgccctcgggggtgtcccactcggagtcgaggacgagggagtcggtgcggtaggcgcgacgggtgcaggggcccgcgcccttgggggcgatacgccacttgccgttgtgctcgtcgccgagcagcgcggcgaagcaggccggcgagtcgaagcgggggaggcagagccagtcgatggatccgtcgcgggcgacaagggcggcgctctgctggtccccgatgagggcgtagtcctcaatggatgcgctgaatgctggggactcgacagatttgtgcacaattgccgggttcccgctggggggtgggggcaatccgggggtgggcccgggcgggtgatgcgcgggcggaagggcggccggtggggtgcggtgggggccggaccgtcgtgggggcgctggggcgctggggcgcgggactgccgggctccgtgcggcgggtcgggccctggctctagacggccgccggggccgtctccttggtctccgtctccttcgccgctgccgcctccgcgcggtcgcggcgttcgcgccgggccaggacgacccagccgacggggacgcccgccgcgaacagccaccactggacggcgtacgccatgtgggggccgatgtcgctgtggtcgggggccggaatcagctcggggctgtcccccttgggccggggcgaggtcagctcgacatagccgccgaggacctgcttgccgagggccttcgcctgctgtccgctgctgatcagcatgatctggcgggccggcagcccctggacgttcttgatgccgctctcggcggtcgtctcgtcgggcatcagccgcccggtgacggtgatctcaccgttcgcgggggcggggatcttcgggaactcggtctgcacgccgttcgccgggatccagccccggttgaccaggatcaccttgccgtcgtccagcacgaacggggtcaggacgtggaaaccgacctcgccgtccacgttcgtacggcggcgtgcgacgacctcgtgcgcggtgtcgaaggtgcccttcgcggtcacccggtggtacaggtcgtcgtgcttgacggtcgcgccgggcgaggtgagcgactccgccggcaccggcgtggcggccagcgagttgccgatcaccgtgttgagcgcgacgcggtgctcgtggcggtgcagctgccagaagcccagctcaatcatcgtcgggatgagcgcgagcgtcacaagggtgaggatcacccactgccgggacaacaggaagcggtacaccccacgaccgtacaactcggtcgtggggcgttgggaggggggtgggcggtggacggcgggcagggggctcagaccttgtcgacgattcccgccctcccctccgcgcgagagcagtgcgcaccgcagaaccagcggcccccgacctcgactccctggccgatgatctggacgcgacagtgctcgcagatcggtgccatgcggtggatcgcgcaggagaagcagtcgaagacgtgcaccgcgccctgcgcgtgcacctcgaacgtcatgccgtagtcgtttccacagacttcgcaacgtgccatgcgccacagggtgcggcgccgacccgggacgggcgagcggccgccgggcgagtcgtccgccaatcacccgtctgacgcctcaccaccggttcgagccgccgcgggtcacccctgcgaggccggctccacgtcccgcagcagctggccgaacgccgcctcgtcgatcaccggtgtcccgtactgccgcgccttggccgtcttggacgtacccgagccggggtcgttggtgacgagcaggctggtgagccgggacaggctcgtcgccacatgcaggcccgcctcgacggcgcggtcctcgaggagctcgcggtcgaccgaggtgtccccggagaacgccacccgcatgccttgcttgagcggtttgccctcttcgtagcgacccgggttgggataggggcatacggggcgtttgcgggaggggcgccaactgccggacggatagccgccggagggctgccggccgatccgcggggtggcgttccactcggtgagcggcaggcactccagcagcggcagccggacgccgtcccgcgccgccgcgtgcagactcggccggaacgcctcggccagcacgcgcgcgtcgtccagggcgtggtgggcccgctgctgtacgacgccgaagtgcgcggccagcgactccagcttgtggttgggcagcggcaggcccagctccttggagagcgcgatggtgcacagccgctgccgcaccggcgcctggctcttcgcgcgcgcgtactcccgggcgatcatcgaccagtcgaagaccgcgttgtgcgcgacgagcacgcggtcggcgagccgggacgcgaactccgccgcgatgtcctcgaagagcggtgccccttcgaggacatcgctcgtcagcccgtggatccacaccgggcccgggtcccgctccgggttgaccatcgtgtaccagtggtcctcgacctcgccgcgcgcgtccagccggtagacggcggccgagatgatccggtcgtcccgggccaggccggtggtctccacgtcgacgaccgcgtacccctgtggatacgcggccggccagggggctggggtcgctgcggtcgtacggtcttcgagcatggtcaatgaggataagggccgccactgacagctctgtccccggactccgccctctcaggacgggcccgggccgcgggcggtctcaggcgccgcctccaacagcccggcgaccagggccttcacggatgccgtgaacaccttctccggatcgacgggccaggcgagtgttcgtgcgagcgccgggtccccgtccgccgtacgtgccccccacagctcctgctcgccggggcgctgcgccggggcacgctcgcggttgcgctcgaccaggacgtgcccgacgaccaggaactgcacggcccgtacgacctcggcggcccgcgcgccgcgcagtcccgccgcgtgcgcctcacgcaccagcgcctgctgtgcgggcaggaacatgcgttctgtcagaccgcgttcgtgcaccatcgcgacgagatgtggatggtcgcgcaactgccggcgcagggcgcgggcgacggaggcgatgcggcgcgcgggcgtgcgccccaccgggcggatctcgccgagatcggcgacggtccgctcgaccagcgcgtcgagcagggactcgcggttgccgacatgccagtagatcgaggtgaccgcggtgcccagctcggcggcgagcccccgcatcgtcagcgccgccgggccgtgccgcttcaccagatccgccgcggagtccaggacctcgtcgcgggtgagtgccggtctcgccatcccgcccccgtccatgttcgtgcacacgtatttacccggcacgaggtctgctgtaactgtgttacaggtgacggcccatcagaagaagggcggtacgacatggcacgagtgcgctatggcgcgcggaccgacgcggagatcgcggccgcgcgctccgcgagctcccggctccccgacatctggtccaccggtgtggtggccgtctgggagaccgacccggacgcggtcgcggcggtgctgccgcccccgctcaaacccaccgggcggcccctggcccgggtcaacatcagcaaggtcgacctgcccggataccggctgggcgcgggctcgttcgcggtcgccgccgcgcacgacggcgtcgagggctggtacccgctcgtcatgccgatgacccatgagcgggccctcatcggcggccgtgaggtgttcggggagccgaagaagctgggcgaggtcacggtcgaacgggacggcctcgtcgtacgcgcggcgctggcccggcacggcatcgcgttcgtggaggtgcgcggagcggtcagcggtgatctgccgcttccggagcccgtccggaagaccgacttctacttcaagttcctgccctcggtggacggtccgggtttcgacaccgccccggtcctggtgcactgcctgcgcaacgagaaggtgcgcaggctggagcggatcaccggtgacgtcgtcctgcgcgagtcgatgtacgacccggtcgccgacctgcccgtacgccggctcgtcgagatcaccatcggtgagaagaccaccgaccagaagggcaaggtcgtcgaacaggtcagtgcccaggccctgttgccgtacatccaccagcgctacgacgatccgcagcagttgctcgacggtccgccgcaggggagtgtctgatggatctccgggcgggacaggtcgccgtcgtcaccggcgcggcgagcggcatcgggctcgcgatggcacggcggttcgcggccgagggactgaaggtggtcctcgcggatgtcgaggagggggccctggagaaggccgcttccgcgctgcgggaggacggggccgaggtgcacgcgcgcgtggtcgacgtcggggagcgtgatcaggtcgaggcgctggcggccgggacgtgggagaggttcggcgccgtgcacgtgctgtgcaacaacgcgggcgtcggctccggagccgagggccggatgtgggagcacgacccgaacgactggaagtgggccttcgcggtcaacgtgtggggcgtcttccacggcgtccaggccttcgtgccccggatgatcgcggggggtgagcccggccatgtggtcaacacctcgtcgggggacggcggcatcgcgcccctgcccaccgcctccgtgtacgccgtcaccaaggcggccgtcgtgacgatgacggagtccctgtacgcgcacttgagggcggagcacgcgcgcgtgggcgcctccgtgctgttcccggggccgcacatgctccgtaccggcctgtgggagtcgcaccgcaaccggccctcgcgctacgcgaagcacaagccgaggaagaccccctaccgcagcctcgaccagtgggaggccgcgatgcgggaggcgggccgggaagtgcgcttcacgccggtcgaggaggtcgccgagctggtggtggacggcatccgggcggaccgcttctggctgctgcccgagagcgagcacagcgaccggcagatcagggcgaggtcgcggtcgatgctcgagcggaccgacccgtcgtacttggaaagcttcatcctcgactgaggagaccgtggtgaccgacaaggacgcgaccggcagggacgtgacggaccaggatccctacctgatcatctcctccgactgccacgccgggctgcccaccgaggagtaccggccctacctggactcccgtttccaccgggacttcgacgaattcctcgccgggcgcgaccggcgccgcgaggagatgacgcggctcggcatccgcaacgaggcgttcgcggacaagtggttccaggacaacgaggagggcctgcgcggcggctgggacaccgcccagcgtctcaaggagctggacggcgacggggtggccgccgaggtcgtcttcccggacgccgacgccgtggacagccggaccgccgcccccttcggcgtgggcctcggcctctccggcgaccaggatccggagctgggcatggcgggcgcgcaggcgcacaaccgctggctcgcggacttcgtctccggacaccccgaacggcactgcggggtggccctgttgcccgtcacggccgagcccggccgcgtggtcgcggaggtgtaccgggccaaggagtcgggcctcggcgcgctgatgatcccctccatgtgggtcgacaaggagccctaccacgaccgccgttacgacccggtgtggaccgcggcggccgagtgcggcatgccggtcctcacgcactcgggggcggcgccccggcacgagtacggcgaccatctgggcatctatgtgagcgaggtgacctggtggccggcccggccgctctggttcctgctgtggtcgggcgtcttcgagcggcacccggggctgcggttcggcgtggcggagtcgggctgctggtggctccccaatctcctctggttcatggaccgcctctacctcggcgcgcacggcggcaagaagctgtcgcccttcgccgaactgacgcgcccgccacacgcgtacctggaccggcaggtcttcatctgcgcgacgaacaccaagcgccgcgaactggcccagcggtacgagatcggcgtcgacaacatcctctggggcagcgatttcccgcaccccgagggcacctggcccgacacgcgcgcgtggctgtcgaaaaccttccatgacatcccggtcggggagacgcgccggatgctcggcctggcggccgcggaggtcttcggcttcgacgtcgagaagctggcccccctcgcccggcggatcgggccgaccccggccgacctcggccagtccgacgaccgggcggccgtcgaggcgtcctgggcgcgctcgcgcgaggtgggccgccactggctgaccggccacgacttcccggccctggggacgaccccatgaccgacgaccggtacacggtgatctccgccgactgccacgcgggcgccgatctcctcgactacaggccgtacttggcgaagcggcaccacgacgcgttcgacgcgtgggcggccacctacgtcaatccgtacgaggacctgctcgccgacaccgcggaccggaactggaactccgagcggcgcctggcggagctggcggcggacgggatcgtcgcggaggtggtgttcccgaacacgatcccgccgttcttcccgtcggcgtcgctgatggcgcccgcgccgacggcggcggagttcgagcagcggtgggccggcctgcgggcccacaaccgctggctggcggacttctgcgcggcggcacccggccgccgggcgggcgtcttccagatcctcctgaacgacgtggaggaggcggtgaaggagatcagctgggcggccggcgcgggcctgcggggcggcctcctgctccccggcaccccaccgggctcgggcctgccggagctgtactcgaaagcgtacgacccgatctgggcggtgtgcgaggagctggacgtgcccgtgaaccaccacgcgggctcggcgtccccgccgctgggcgacgaaccggccgcgcgggcggtcttcatggtggagacgacgtggttctcgcaccgggcgctgtggcacctggtgttcggcggagcgttccgccgtcacccgggcctgcggctggtgctcacggaacagggttcgggctggatccccggggtcctggacatgctggactactaccacggccgtctggtcgcggccggcccgaagtcggcgacggcggaggccaagttcggcgccggcctggaccgggccatgggcaaggggccgtcggaggtctggcgggacaactgtttcgtcggcgcgagcttcatgcgcccgcacgaggtgccgctgcgggaccgcatcggcctcgacaagatcatgtggggcagcgactacccgcacgacgaggggacgtacccgtactcgcgcgaaggcctgcggatcgcctacgcggggctgccgcgcacggagatcgcggcgatggccggcggcaacgcggcacgggtgtacggcttcgacctctccctgctcgacccgatcgcggcgaaggtgggaccgacggtggcggagctggcgcggccgctggaagagccaccggcggacgcgacgagtcccgtcttcgcgcggggagggtcggtacgcgtctggtgacaccgtgggtggcatcctcccctcgtgacggaacccacgcacgacgaggcacacgggggcgcgctcggctcccgcctgaactggctgcgggcggcggtcctcggcgcgaacgacggcatcgtctccaccgcgggcctcgtcgtcggcgtggcgggcgcgacgggcgcccgctccgcactgctgacggcgggtctggcggggctgctggccggttcgatgtcgatggcggcgggggagtacgtgtccgtctccacgcagcgggactccgagaaggcggcactggcgctggagaaacgggaactgacggagcagcccgaggcggagctggaggagctgacggagctgctggaggagcgggggctgtcccgggacgtggcgagggaggcggcgcagcagctgacggagcgggacgcgctgcgcgcccacgcgcgcgtggagctcggcatcgacccggacgagctggcgaacccgtggcacgcggcgtgggcgagcttcctggcgttcacggtgggggcgctgctgcccctgctggcgatcgtgctgccaccggccgactggcgcctgcccgtcaccgtgctctccgtcctcgccgcgctggtcgtcaccgggtgggtgagcgcgcggctgggggcggcgcggccggggcgggcggtgctgcgcaacgtgggcggcggcgcgctggcgatgggggtcacctatgcggcgggcgcgctgctgggggcggccggggtgtgagccggggacaggacgcgtgggccgggagaccgaccgtgcgcgcccccttggtggagatcaccaagaagcaagcgcataccgccggtaatacttgtcagtaacaacgtctggcggcagcgcgcggacagtcctacggtgcacccatgccgaacctgcccgatgtcgtgctgtggtcgatacccgcctttgtgctgctcaccgtgatcgagatcgtgagcgtacggatccatcccgaggaggacgcggaagggtacgagacgaaggacgcggcgacgagcgtcggcatgggcctcggcagtctcgtcttcgacctcctgtggaagatcccgatcgtcgcggtctacacggcgatctacgaactcacgcccctgcgcgtccccgtcctgtggtggaccgtcccgctgatgctgctcgcgcaggacttcttctactactggtcccaccgcggccaccacgtcatccgcatcctctgggcctgccacgtcgtccaccactccagccggaagttcaacctcaccaccgccctgcgccagccctggacctcgctcaccgtctggcccttctacgttccgctcatcgccctcggcgtccatccggccgcgctcgcgttctgttcctccgtgaacctcgtgtaccagttctggatccacaccgagcgcatcgacaagctgccccgggcgttcgagttcgtcttcaacacgccctcgcaccaccgggtgcaccacgcctcccaaggcgggtacctcgaccgcaacttcggcgggatcctcatcgtctgggaccggatcttcggctccttcgtccccgagaccgagcggcccgtctacggactcaccaagaacatcgccacctacaaccccctgcgcgtcgccacccatgagtacgtcgccatcgccaaggacctgcgggcggcgcgcggttggcgtgagcgggcgggcagggtgttccgcgggcccggctggcagcccgtgcggccggcggctgagcagccggtcacggagcccgtcgcgtgaggccggccgccgcgcgcgtgctgctcggggccttcgccttcgccgtcgtcgccgacctcgcctcccaggccctcgggtccgacaccggacacctgctcgccaagcccctcctgatgccgctgctcgccgcctacgcggccgtacgcggcggaccccgcctcctcgtcgtcgcgctgctcctcggctgggcgggcgacgtcctcctgctgtccgacgccgacccggccttcctcgccgggatgagttccttcgccgccgggcacgtctgctatctcgtgctcttcgcgcggcacggccggacgcgcgcgcgtggcgccctgctcgccggcggttacgggctcgtcctcgtcaccaccgtcgccctcctgtggcccggccttcccgccgggctgcgcgtccccgtcgtcggctacagcctgctgctgaccgcgatggcgtacggggccacccggctcgggcccgtcgcagggctcggcggtgccctcttcctgctctccgacacgctcatcgccaccggcgtcgccgactggccacagctcccacgacccgacttctggatcatgctcacctatgcggcgggccagtatctgctggtccgcggcgtgacggacaccctcggcgcgccaaccgcgccggcggcggcgtacggtgaggtgcgctcgaccaccccctgagcgcacgcaccggaacatcgcacgagaaggaccctcgccatgcgcgccaccaccatccacgccccgtacgacatgcgcgtggaggacgtgcccgaacccgtggtgcggcagcccaccgacgcggtcgtacgggtgctgcgcgcctgcatctgcggcagcgacctgtgggcgtaccgcggcgaggcggcccggcagccggggcagcgcatcgggcacgagttcctcggcatcgtcgaggagaccggctccgaggtgaccggcgtccggcgcggcgacctcgtcgtggcgcccttcatgtggtccgacggcgtgtgcgactactgccgcgagggtctcaccacgtcgtgcgagcacggcggattctggggctccgtgggccacgacggcggccagggcgaggccgtgcgcgtgccctacgccgatggcaccctcgtccagctgcccaaggacgcggcctccgacgaacacctgctgtccgcgctgctgacgctctccgacgtcatgggcaccgggcaccacgccgccctcggcgccggagcccgtcccggggcgaccgtcgccgtcgtcggggacggcgccgtcgggctgtgcgcggtactcgccgccaagcggctcggcgccgagcggatcatcgcgctcggacgccacgaggtgcgtacggacatcgcgcgccgcttcggtgccacggacgtcgtcgccgagcgcggggaggcggccgtcgaggccgtccgcgagctcacccgggggcagggcgcgcactgtgtcgtggaggcggtcggcaccgagcagtcgatgcggacggccgtggacatcacccgggacggcggcgccatcggcttcgtcggcgtgccgcacggcagcgggaccgggctcgacctgggggtcatgttcgaccggaacatcgccctgcgcggcggggtcgcccccgtacgcgcctacattccggagctgctccccgacatcctcgccggcaggatcgacccctcgcccgtcttcgacaggaccgtcgacctggaaggcgtgcccgagggctacaaggcgatggacgagcgcaccgccctcaaggtgctcgtcaccaactgacgctcaccagcggatcggcagcggcagcgccgtcagcagcgccgacaccgccacgaccacgcccagcgccaccacctccgcacgcgcgggcacacaggcgccgagcgggtcgtcggcacggcgcagccgacggcgggcccacagggcgagcacggcgacggcggccacgaggaacaccttggcgaccagggtgcgcccgtacgccgtcgccgtcagctggtgcgggatcgtgcccgcaggcatgcggcgcagcgagctccacacccccgtcgcggtgatcgcggccagcaggacggccgccacgcgcgcgtagaggcccagcagagccgcgccgggtccaggggcgcgccaccgccgcaccgtgcgcagcacatgcggcagcccgcccgcccacaggaccgcgcacgtcaggtgaacgagcgtcaggcccgagccgaccgacgggctgtgctccgtggtggggtggacgcgcagtgcctcggcgaccaccaccgcggccgacggccacacccggccggccgggcggcgcgacagcgcgcacaggccggccacggcgaacgcgttgacctccagcagggcgagggcgccgtcccgggtccggtacagcccgccgacgtcgatctcggcgaggcgaatccggtacgagtttcccggtggccacgaccgagggggagccccaggcgcggcgacggaaaccggcgccggccgcgaaccaggcgcccagccgcgcggcgcgtccgacgcgtctgccaagggcgcgcccggcacgcggcgggccaggcggcccgcgaaccactcgcccgcgggcatgcacaccgccgcgaacaggaccgtacgcaggagggcgatgccaccggctccgggcgcggccgcctcgccggtgccgtgcagcgcggcggcggggccgaggagcgggatcagcgcggcgaccgccaccagggcgagcacggcgacggcccggccgggggacaggcgccgggccggagcggcggcggggacgggcgaaggggccgcgtcaccgccgttcgggccggccggcggtcgtatcaggctcaccccaagaccttcaccagtcggcacagaccggggcaagcgcatcagaagaactgggggaacggcattccgcccataggtatgttttcggcaggtacggctcggcaggtacgtttcggcagtacgcgtccggcccgacgggcgactcaggcccagcgcgcgccatccgtcccccaagggctcggcggccgggcccagtcgaccggtccgccggcgaaggagacgggcggcagggcgtaccgcagccgccccagctcactgtcccgctcggcgagccaggcatccggcccgtcgtaggcggcagcccccgcgccggcgtacgcagcccccgcctcggcgtacgcggcagcccccgcgccggcgtgtacggcgttccccgcctcgcccgcggcgcgcccctccagcagccagcccgcggtccgcgccagcgccagtcgtacgaaccgggccccgccgtccgtcagttgctcggtgagcgagcgcagcacggccgccgccagcagataccccgtgccgtgatcgagagcctgggcgggcagcgcgcccggctcctgccgcccggacccctcgaccgccgcgatgcccgtggcgacctgcaccaggctgtcgaagccacgccgctcggcccacggcccgtacgcgccccacgccgagagctgcgccaccaccagcccgggccggcgctcggccagcgcctcgggcgagagcccgaaccggtcgagggcgcccggccggtagccggtgacgacgacgtccgccgccgcgagcagctcctcgaaggtgcgcctgtccgtgccgaggccgaccttggcggaccgtttgccgaagcccgtgtcggcgtgctggtccacgagttcgggcagctgcggggagtcgacgcgcagcacgtccgcgccgagcagggcgagcgtacgggtggcgaccgggcccgcgatgaccctggtcaggtcgagcacccgcagcccggcggcgggcagcagcggactgccgaagagcgccgccggccgacgggcccggcccccgcccggccgccgccgttcgaccagggggcgggcggcgacctcgacggcctgctcgtgccgcgcccactcctcgggggtgcgcagcgcgacggcgaggcctccggccccgtacacggcgtcctcgatctccctggaggagcgctcggcgagggccgcggcgacggacgcggggtcctccggaagtttcagtgcggagagcagccgctcccggtgatgcggatagttcgcgtgcgtccgcacccatccgtccgccgtgcgccagaagcgggacagcggcgcgaaggtgaccggcgcccgcccgtcgacgcgcagctgccgctcgctcacgaacgccgtggccaccgccccgtcgtcgacccgcaccccgggcacgtccgcgcgtccggcccgccgcgcgcccagttcggcggcggccagcgcgcaggtcgccacgcaggcccgcgcgagctcccgtaccggcagccgcgccttcagcgccccgtcccgtacgacggtcgagacccgctcggtcagtgcgggatcgccgcccagcgcggcccaggcgaactccgtgttcacagcagtcatgacggcactatgcagggtgtactgaatcaacatgtggaccaggggcggggatacggcaccgcacggcacggcacaggggccggccggcagacgccgaccggcccgaccacccgcgcgggagccctgcttcgcggaagccccgcttcgcgtgggtcctgctcggcgtgggtcctacttcgtgaccgcggccagcgcgttcacggtgccccagccgtagaagccgttgcggttcttcgtgccctcgcacaccgcgtcgatcttgccgtcggagtcgatgtcgtacgggtccgtgcacggcgtggcgtcggcctcggcgtacagcagcgccttcaccagggcggcgggggcgtgcggatgcgtcgacttgatgagcgcggcgacgccggcgacgtgcggggtcgccatcgacgtaccggccatgtagccccacgtgccgccgggcagcgggccgaggatcagaccgctggtggccggcggggccggggtctggtagcgggtcgagtcgccgccgggcgcggccacgtcgatgacaccgagtccgtagttggagaaggaggacttgatgcccttcgcgccggtcgacgcgacggtcaccacccccggcaactgggtcgggatgtcatagcacttggacgggtcgatcacccggtccgacggcgtgccgtcgttcggggagaccgggtcggtgatcgagtcggcggcgaggtcgtagctctcgttgcccgccgccgcgacattgaccgtgcccttcttctccgcgtaccgcgaggcccgggtgatggcgtcgacgagcgccttctggtccgggtcgtcggcgcagttgaagtaccaggggtcggtgtaatagctgttgttggtgatgtcgacgtggtgctcggccgcccacacgaacccgcagacgacggactcggtgtagaagtagccgcccgtggtcgacaccttgatgccggcgaccttcacgcccggcgcgacaccggtgatgccgacgccgttcttggcgcccgcgatctcacccgcgacatgggtgccgtgcgggctttccgcggcgctcgggcgccaggccccgtcggtcgtgtcgggcttgccggtcacacagttgaccgaggcgtcgcggtcgaagttcggcgcgatgtcggggtgggtgtcgtcgacgccggtgtcgatcacggcgaccgtgaccttcgagctgccgagcgtcttctcgtgcgccttgtccgcctggatggccggcagatcccactgcagcggctccaacgggtcctgcccgtcgaccgcctgagcgctcgccacctcctcggaggtgagcgccttcggcgtccccacgtcggtcgtcgactgggcgggcagcggcgcgttgcgggtggcacccgccgagtccaccccgcgcacacggcggacggtcttggcgaagtcggcgttcgacgagtggacgacgatcacgccgatctggtcgtacgacgtcacgatcgtgccgccggcctgggcgatggccttcttcacgacggacgaagtgccgtggccgggacggacgttgacgacgtagctcagcgaggtcgcgtccgccgtcacggtccccggggcggccgtctcggccgccgaggcgctgacattgggcagaaaggcgagagccgtgaccgtggccattcccagcggaatggccacggcccgacgggagcgcttacggggcgctgtcatggtgtctccagttcgttcgcgatatccagttcgttttcgcgataccagccgtgcgagctgtatgagccgtacgggccgtatgagccgtacgggctgtgcggatgctcgagcgacctacaggcggggtcacttcaccgcgcgcagcgcgttgacgatgccgaagccgtagaagccgttcacccgcttgccgcccacgcaggtcgcgtccacgacaccgtcgccgtccccgtcgtacgggtccgtcgggcagccagggttgtccgcctgcgccttgagcagcgcctggagctttgccggggtcgccgacgggtgggccgacttcagcagtgcggccacgcccgcggcgtgcggcgacgccatcgacgtgccctggaggaacgcgtactcgttgttcggcatcgtggagaggatgcggccgttcttcgacggcgtgtccgggagctggaacttgtcaccgcccggggccgcgatgtcgatgacgccgtcgccgtagctggagtagtacgacttggtgctcgcgacaccggtcgcgctgaccgtgaccacgcccggcagctgggtcggcacgtcgaagcacttgtgggggtcgaccgtgcggggcaccgcggtcgagtcgtcgggactggagtcgtcgacgagggcgtgcgagtcgaggtcgtcgttggagttgcccgccgaggcgaggttgagggtgcccttgtgctgggcgtacagctgggcccggttgaccgcgtcgacgatcgcccgctggtcggggtcgtccatgcagttgtacagccacgggtccacgtagtagctgttgttcgtgacctccacaccgtggtcggcggcgaacacgaaggcgcagacgacactctcggggtagaagagctcgctgaccgggtcggccaccttgatgccggcgaccttgacgttcggggcgaccccggcgacaccgatgccgttgcgggcggcggcgatctcgccggccacatgcgtgccgtggtagtggtcggcgttggccgggcgccaggcgccgtacgacgtgtccgccttgccgccgacgcagttggcggactgcgcggcggagaagttcggggcgaggtccgggtgggtgtcgtcgacgccggtgtcgatcacggcgaccgtcacgttcctgctgcccgggttgatcttcgcggccttgtcggcgccgatcgcccgcaggtcccactggtcggcctcgaggggctcctcacccgaagccgtgctccgcgcggcgatcttcgcggcctgagtcttcgtcaggtactgcgcggcgccctcgtcggtcgtcccggcggcggtcagcggcgcggtccgggtcgcgcccgcggactgcaccccgcgcaccgcccggagctgcttgccgaagtcggggttggccgagtgggcgacgatcacaccgatcttgtcgtacgtcacgacgacggtgccgtcggcccgggcgatggcccgcttcaccgactcgatcgtgtgacggtccgtcttggtgttgacgacgtaggccagttcggtgccgtcggcgggggaggcggaggccgaggcgggcgtgctgagcggggccgcggccgccgcgcccggcaggaagcccagggacgcggtgagggacagggcgacgggcacggcgagggcgagccggcgtctggaacgcagatgagccatgggatctccacatcatccggaaacgcagtcggcccgagacacaggtggtgctcgggcaggtacatggcgggtggtgcaggctgaagttatctcccgtcctcgctggccagcaatgacttccggcgacgacttcggaaagaacccgaccgagttgaaccgccccacgcgtggcgccgtgaccttggacagggagcgctaggacgatcgtgccccctttcggatcacaccccgggggcctaccatcaccacccggtttctgtgatccacatcactgtgaggtcagagccgccatgtccgtgcccagcccgtccccgtcggcgaacccccactcgcccccgtccaccgtcgtcaccgcatccgcaacgcgaggagactccgtggctaccgacgcaccgcccccctcgaaggtccatccccgatacccctccacggaggagttcgtcgcggagcaggagagcgccgagttcggtgaactgcgccgctcctaccgctcgttcgcctttcccctgaccatcgcgttcatcgcctggtacctgctctacgtcctgctgtcgaactacgccggcggcttcatgggcaccaagctcttcggcaatgtcaacgtcgccctggtgctcggtctcgcccagttcctgaccacgttcctcattgcctggtggtactcgcggcacgccgccgccgagctcgatcccaaggccgaggcgatcaagtcccggatggagggcggcgcatgagccccgcgatcaccctggccgccgacgcggccggcccacgtcttctcgccgccggtgaggcgagcgagcaccggccgctgatcatcaccctgttcgcggtgttcgtcgccgcgaccctcgtcatcaccgtctgggcgggccggcagaccaaggacgccgccgacttctacgcgggcggccgccagttcaccgccttccagaacggcctcgcggtctccggtgactacatgtccgccgcgtccttcctcggcatcgcgggcgccatcgccctcttcgggtacgacggcttcctgtactccatcggattcctcgtcgcctggctggtcgccctgctcctggtcgccgagccgctgcgcaactccggccgctacaccatgggcgacgtcctcgcgttccgcatgcgccagcgccccgtccgcacggccgccggcacctccacgatcgtcgtctcgatcttctacctgctggcccagatggcgggcgcgggcgtcctcgtctcgctgctgctcggtatcaccagcgacggcggcaagatcggcatcgtcgccctggtcggcgtgctgatgatcgtgtacgtcaccatcggcggcatgaagggcaccacctgggtccagatggtcaaggccgtgctgctgatcgccggcgccctgctgctcaccttcctggtgctgctgaagttcaacttcaacatctccgacctgctcggcaaggccgcctccaacagcggcaagggcagcgccttcctcgagcccggcctcaagtacggcgccacctcgacgaccaagctggacttcatctccctgggcatcgccctggtcctgggcaccgcgggcctgccgcacatcctgatccgcttctacacggtgcccaccgccaaggccgcgcggaagtcagtgaactgggctatcggcctcatcggcggcttctacctgatgaccctcgcgctcggcttcggcgcggccgcgctcatcaagccggacgagatcatcgcctccaacaaggcgggcaacacggccgcacccctgctcgccctgcacctgggaggcgtcgactccaactggggtgccatcctgctcgccaccatctcggcggtcgccttcgccacgatcctcgcggtcgtcgcgggcctgaccctggcctcctcctcgtcgttcgcgcacgacatctacgcgaacgtcatcaagaaggggcaggccagcgagaaggacgaggtacgggccgcccggtacgcgacgatcgccatcggcgtcgtgtccatcggcctcggcgccctcgcccgcgacttgaacgtcgcaggcctcgtcgccctcgccttcgccgtcgccgcctccgccaacctgccgacgatcctctacagcctcttctggaagcggttcaccaccccgggagcgctctggtcgatctacggcggcctgatcacggcggtcggcctggtgctgttctcgccggtggtctcgggcaagcccacgtcgatgttcccgggcgtcgacttccactggttcccgctggagaaccccggcatcgtctccatcccggtcggcttcctgctgggctggctcggcacgatcctgtcgaaggaggagccggacaccgccaagtacgcggagctggaggtgcggtccctgtcgggcaccggagcgcactgaggtcccacgcccacggccgcgtcgtagatccctacgacgcggccgcgtcgtacctcgtgggatcgggccgctctcgatgtcagtcctgtcacgtaggctcacaggtgtccgaggaatgtgatccgcatcgaggggagggggcccgcgtgctcatcgacacctacggccgggtggcaaccgacctgcgcgtctcactgaccgaccgctgcaatctgcggtgcacgtactgcatgcccgaagaaggcctgcagtggctggccaagcccgatctgctcacggacgacgagatcgtccgtctgatagacatcgccgtcacccggctcggcatcaccgaggtccgcttcaccggcggcgagcccctgctgcgccccggcctggtcggcatcgtggagcgggtcgccgccctcgcctcacgcccccagacgtccctgaccaccaacggcatcggcctcagccgcaccgcgaccgccctgaaggcggcgggcctggaccgcgtcaatgtctccctcgacaccctccgccccgacgtcttcaagaccctcacccgccgtgaccgtcacaaggacgtcatcgcgggcctcgaagcggcccgcgacgccggcctgacccccgtcaaggtcaacacggtcctgatgccgggactgaacgcggacgaggcccccgacctgctggcctgggccgtggcgcacgactacgagctgcgtttcatcgagcagatgcccctggacgcccagcacggctggaagcgcgagggcatggtcaccgcgggcgacatcctcgcctcgctgcgtacgcgtttcgagctctcggaggagggcgccgacgagcgcggctccgccccggccgagcgctggctcgtcgacggcggcccgcaccgcgtgggcgtgatcgcctcggtcacccgcccgttctgcgcggcctgcgaccgtacgcgcctgacggccgacggccagatacgcacatgtctgttcgccaccgaggagaccgacctgcgcgcggccctgcgctcggacgcccccgacgaggagatcgcccgtatctggcggctcgcgatgtggggcaagaaggcgggctcgggcctggacgatccctcgttcctccagccggagcggccgatgtcggcgatcggcggctgatcggcggccgcacccgcggcggcttcgtcagttctgcgcggcttcccagtcctcgagcctgacgacgtccttgaggaatccacggacgccgaggaactgggagaggtgctcgcggtgttcctcgcacgcgagccaagtcttgcggcgctcgggagtgtgcagcttcgggttgttccaggcgagcacccacacggcttcggcgcgacagccctttgcggagcacatcggggaggacggatcggagccggcgccgggggcgttgaaaatcacgctccgaccctaacccgcgcacggggccgcgatcccggcaccccgtagcaaccggtcgacacgaacaggcgacacgtgacaacgcgacacatcacaaaaggcgacgccgagcagccacggggggagctgcccggcgtcggtctgtcgctccgacgggggatgcggagcgcgtacgaagtatgtcacgcgtgacccggtgcccggcaccggaacaacatgattgatctgagcttttcttgagcttgatgcggagtgcgattccggttttggcgcatccgccgtggtcaggcccgctcgtgcggctcgctgcgcacctgggctccgggctcggccgacacgccctcggggtcgggttccgcggagtcgtccgcccgtggcggcgcgatcatcggacgcatcggggtggtgacgaacgtcgaggggagcgagggcgcgttctcccggcccgcgttggcgatcaccacggcgatgtaggggagaagggcgccgagcaccagcgcaaccacggcgacgtgccgttccacgttccagagggtggccgcgaggatcaccgagaccgtgcgcacggccatcgagatgacatagcgccgctgccgcccgcgtacgtcgtcggcgagaccctgccgggcgccggtgatccggaacacctcagcgttgccgccgttgccctgcttccgcatcacgttccaccatccgccttgtatcggactcgcccccgccccgtacccggctcgaacccggtcagggaccaggcccgaacacatcccacgttacgccgcctctgcgccgcctacgagaccggggcaccccctgcctgggcggaccggctgcgccgtaccgcgtacggctctgcccgacatgcgccgtatggcacaccggccgaaactgggcgtaatgctcacgtcgagccgtacgaggaggcagccatgggctggttgtgggcgatcatcgtcggatttgtgctgggtctgctcgccaaactgatcctgccgggcaagcagcacagcccgctctggctgaccaccatcatgggcatcatcggcgccatcgtcggcaacgcgatcgcacagggcctcggcatcgcggagaccaagggcatcgactggggccgacacggcctccagctggcggcagcggtcgtcctggtgttcctcggcgacatgctgtacatggcgatgcggggcagcaaacagcgggcctgacggcatggcgaagggggcggtccgtgacgggaccgcccccttcgtacgtcctcggcccgggccgagccaggatgctcagccgcccgtgacctccaccgccgccaggttcttcttgccgcggcgcagcaccagccagcgcccgtgcagcaggtcctccttggcggggacggcgtcctcggcggcgaccttgacgttgttcacgtacgcgccgccctccttgatcgtgcgccgcgcggccgacttgctggccaccagagcgacctcggcgaagaggtccacgaccggggccggctcggcgaccttgacgtgcggcagctcggagagcgccgcggccagcgtcgcctcgtccagctcggtcagctcgccctggccgaagagggccttggacgcggcgatcacggcggccgtctggtccgcgccgtgcaccagcgtcgtcagctcctcggcgagcgcgcgctgcgcggcgcgggcctgggggcgctcctcggtctgcttctccagctcctcgatctcctcatgggacttgaagctgaagatgcgcaggaacttggagacgtcacggtcgtccgcgttcagccagaactggtagaaggcgtacggcgtggtcatctcgggatcgagccagatcgtgccggactccgtcttgccgaacttggtgccgtccgccttggtgatcagcggggtgcccagcgcgtgcaccacggcgtccggttcggcccggtggatcaggtcggtgcccgaggtgaggttgccccactggtcgctaccgccggtctgcagcgtgcagccgtacctgcggtacagctccaggaagtccatgccctggaggatctggtagctgaactcggtgtagctgatgcccgcgtcggagttgagccgccgggagacggcctccttcgcgatcatcttgttgacccggaagtacttgccgacgtcgcgcaggaactcgatggccgacagtccctgggtccagtccaggttgttgaccatgatcgcggcgttcggaccctcgaagtcgagcagcggcgcgatctgcgcgcgcagccgctccacccactcggcgacgacctcgcgggagttcagcgtgcgctcggagttcggcttcgggtcaccgatcagaccggtggcaccgccgaccaggcccagcggacggttgcccgcctgctggatcctgcgcatcgtcaggatctgcacgaggttgccgaggtgcagactgggcgccgtcgggtcgaatccgcaatagaacgtgacgggaccgtccgcgaacgccttgcgcaatgcgtcctcgtcggtggagagggcgaccagcccccgccacttcagctcatcgacgatgtccgtcacggttctcgtatctccttgagtggtctcgtaatgcaggtacgaggttatacgccctggctgaccgagctcatattgaagtccgggatgcgcagagcgggcatcgcggcccgagtgaaccaatcgctccactcacgcggcaaagtcttctccgtgcgccccgcctccgtcgcccggcccagcagaccgaccggcgactcgttgaaccggaagttgttcacctcgccgacgaccgccccgttctccaccaggtagacgccgtcccgggtcagcccggtcagcagcagcgtcgccgggtcgacctcgcggatgtaccagaggcaggtcagcagcagcccgcgctcggtggcggcgaccatctcctccagggaacggtcctcaccgccttccaggatcaggttcccgatggccggcgcgaccggcagcccggtcagggccgcgctgtgccgggtggtcgtcagatgcctcagctcgccctcgctcacccactcggtggccttgagcggcagcccgttgtcgaacaccgaggcgtcgtcgcccgaggagtgcgcgagcacgaagggcgcggattccagccccggctcgttcggatcgctgcgcagcgtcaggggcagctcggagagtttgtcgccgatgcgcgtgcccccgccgggcttgctgaacaccgtccggccctcggccgcgtcccgggccgccgccgaccacatctggtagatcagcaggtccgcgaccgcggtcggcggcagcagcgtctcgtagcgtccggcgggcagctcgatacgccgctccgcccacgccaggcgctgcgccagctccgcgtccagcgccgccgggtcgacgtccttgaagtcgcgcgtcgagcgcccggcccacgccgagcgcgtccggtccggcgacttggcgttgagctccagggtgccgttgggctggtcgtggcgcagccgcagacccgtcgacgtaccgagatagctggagacgagttcgtggttggcgaagccgtacagctcccggccacccgcacgcgcgcgtgcgaacgattcaccgagcgccggcgcgaagtccgtgaagacggcggacgaggtctcggccggcgcgtccgtgaagtcgggtgcctgggggacgcccgtgaccagcggctgggcgtcctcggcgggagcggcaccgcgcgccgcggcctcggccgcccgcaccaggggctccagttcctgtgccgtcacggccgagcgcgagacgacaccggaggcggtgccctcacggccgtcgacggtcgcgatgacggtgagcgtacgtccgcgcgtgacgccgttcgtcgtcagcgcgttgcccgcccagcgcaggttggcggtggagtgctcgtcggcgatcacgacgcagccgtcggcccgggacagttcgagggcgcgctcgacgatctcgtgcggcttgttcgtacgagcggtcatcggccggcctcctgcgtggtgttcagaatgttgacgcccttgaagagggccgacgggcagccgtgcgagacggccgcgacctgacccggctgggccttgccgcagttgaaggcgccgcccaggacatacgtctgcggaccgccgacggccgccatggagccccagaagtcggtggtcgtcgcctggtacgcgacatcgcgcagctggcccgtgatccgcccgttctcgatcttgaagaagcgctgcccggtgaactggaagttgtagcgctgcatgtcgatggaccaggagcggtcaccgacgacgtagatcccgcggtcgacgccgccgatcagtccctcggtcgacagaccggccggatccggctggagcgacacgttcgccatgcgctgcaccggcacatgcccgggggagtcggcgtacgcgcagccgttggaccgctcgaagccggtcagcttcgcgatgcgccggtcgagctggtagccgacgagcgtcccgtccttcacgaggtcccaggactggccctcgacaccctcgtcgtcgtacccgatggtcgcgagcccgtgctcggcggtgcggtcacccgtcacgttcatcagctcggagccgtacttcagcttgccgagctggtcgaaggtggcgaaggaggtgcccgcgtacgcggcctcgtagcccagcgcgcggtccagctcggtggcgtggccgatggactcgtggatggtcagccacagattggacggatcgacgacgaggtcgtagatgcccgcctcgacgctcggcgcgcgcatcttctcggcgagcagctcggggatctgcccgagttcggactcccagtcccagccggtgcccgtcagatactcccagccgcgcccggccggcggagcgatggtccgcatcgagtcgaactcgcccgtggactcgtcgaccgcgaccgcggtgagctgcggatgcagccgcacccgctgctgtgtggtcaccgtgccggccgtgtccgcatagaacttgttctcgtgcacggtgagcagcgaggcgtcgacgtgactgaccccgtccgccgcgagcagccgcccgctccagtcggccagcagccccgacttctcctcgtcgggcacggtgaagggatcgatctcgtacgacgagatccaggtccgctcggcgtgcaccggctcgtccgccagctccacgcgctcgtcggaacccgccgccttgatcacctgcgccgacagcttcgccatcgccaccgcctgcgacgcgacacgcgcggcggcgtccatcgtgagatccacccccgaggcgaagccccaggtgccgccgtgcaccacccgcaccgcgtacccgaggtcggtcgtgtccgacgacccggcgggcttggcgtcccgcagccgccaggcggcactgcgcacccgctcgaagcggaagtccgcgtgctcggcccccagcgcacgggctcgcgcgagcgccgcgtcggccagggcccgcagcggcagtgccgtgaaggcttcgtcgatggaatgaggcacggaggtctccctgctgtcgtggcctgtcgggtccgatcatgtcgcgcgagccggggcggccaccacatctttccgcccgacgaccgcaccgatgtgcccggggccctcctcggcgcacggctttctgtagggatccgacagggagtcccccgcgccactgtcggtgcccgattgcccgtgggccggaccggaccgataggttttcgactacggcgcctgtcttgcaggggcttgcagggggttcagaccgctaatcgaaagggtgatccgttgagccgctcggttctcgtcaccggaggcaaccggggcatcggcctcgccatcgcccgcgcgttcgccgaggccggcgacaaggtcgcgatcacataccggtcgggtgagccgccggccaccctcacggacttgggctgtctcgccgtcaagtgcgacatcacggacaccgagcaggtggagcaggcctacaaggagatcgaggaccagcacggccccgtcgaggtcctcgtcgccaacgccggcgtcaccaaggaccagctcctgatgcgcatgtccgaggaggacttcacgtccgtcctcgacaccaacctcaccggcaccttccgcgtggtcaagcgtgccaaccgcggcatgctgcgcgccaagaagggccgcgtcgtgctcatctcgtcggtcgtcggcctcctcggctccgcgggccaggcgaactacgccgcgtccaaggccggcctggtcggcttcgcgcgctccctcgcccgcgagctgggctcacgcaacatcaccttcaacgtcgtcgcgcccggtttcgtcgacaccgacatgaccaaggtgctcaccgaggagcagcgcaagggcatcgtcggccaggtgccgctcggccggtacgcgcagcccgaggagatcgccgcggcggtgcggttcctcgcctccgacgacgcctcgtacatcactggagccgtcattcccgttgacggcggactgggaatgggtcactgatcaccatgagcggaattctcgagggcaagcgcgtcctgatcaccggtgtgctgatggagtcctccatcgccttccacaccgcgaagctggcccaggagcagggcgccgagatcatcctgaccgccttcccgcggcccacgctgaccgagcgcatcgcccggaagctccccaagcccaccaaggtcatcgagctcgacgtcaccaacgacgagcacctcggccgcctggccgacatcgtcggtgaggagctgggcggcctggacggcgtcgtgcactccatcggtttcgcgccccaggacgccctcggcggcaacttcctgaacacgccgttcgagtcggtcgccacggccatgcacgtctcggcgttctccctgaagtcgctgaccatggcctgtctgccgctgatgcaaagcggcggctcggtcgtcggtctcaccttcgacgcgcagtacgcctggccgcagtacgactggatgggcccggccaaggccgccctggaggccaccaaccgctatctcgcccgcgacctgggcaagcagaacgtgcgctccaacctcatctcggccggcccgatcggctccatggccgccaagtccatcccgggcttcagcgagctggcagccgtctgggactcccgcgcccccctggagtgggacctcaaggacccggagccggccggtcgcggtgtcgtcgccctgctgagcgactggttcccgaagaccacgggcgagatcatccacgtggacggcggtctgcacgcgatcggcgcgtaagcgtttgcgcaatcgcttacgcgcgaccgcccggtcgctttcgtacgaggccgacgccccgtttcccgcaccgcggggagcggggcgtcgcccgttcggcccaactggccgggcagccgggaccgggcagcacgcacgctgggactacgcaccgccccgcagccgaacggccgaggaggtcccccttgtgcgcctgtcccgccgcttcgccccggtgatcctcgccgtcactctggtgatggtcctgccgtccgacgccatgccccacgcgcgcgtggcggaccgaaaacccgctgacccgcagcctttcggcgccgagtgccgtaccagcgtcaccggctcccacgcggtcgcgtactgccacaacccctacgtggacacggatcgcgtacgcctgcacatcgaatgcgaccgctggtgggatctcgacaccgacagcgcgccggtcgacaccggaccggcgatgaccgtccggctgagcgggcggtgctgggaggagatccgctcggtgtgggtcagccacgagaagtgacggctctcgtcagccgtccgcgggggcggacttccgccgcccgggccggcacaggaacggatacccggcggcctccgtcgccgccgcctccgcgtcgcccgtacggatcgcgtcgaccaggcgggcgtggtccatgtacgtctccggagtcagctcctcgccgacgtcctcgcgcagccagtcgcgcagcacctcgcccaggtccgcgtacatcgccgtcatgacgtcgttgtgggacgcggccaccaccgccatgtggaaggtcgcgtcggccgtcacgaaggcctcggcgttgcccgactcccaggcctcctcgcggcgtacgaggagcgtgtccagctgcttcagatcgcgctcggtgcgccgcctcgcggccagcttcgcggcacccgactccagcgtggaacgcagctcggcgatgtgccgggggtccgcgtccgcgaaacggcggtgcatcacacccgccagctcactggtcgccgcgacgtaggtgccggaaccctggcggatgtcgagcagaccgttgtgcgcgagggcccggacggcctcgcggaccgtgttccgggcgacgcccagctgctcgaccagctcgggctcggtggggatgcgcgaaccgaccggccactcgcccgaggtgatctgattccgcagctcggcgatgacctgctcggacagtgccgaacggcgggggtggctcagcggcatgacggtccttcgtacgggcccgtgtgcggttctgcgcgcgtggccgggggctccggagcgtagcgcaagaggattggacagccattcatcccatgattctatgatgggcgacatggcaagcgaggagatccggacggcgacgtccacaccgatacgcagctccgcaggtacgggggccgacagcgaaacgccgtccacgcgcgcgtggaggacgcgtctggtggtcgtgggcatcgtcctcaccgcgctcaatctgcgtccggccatcaccagcctcggcgccctcctcgaagaggtgcgcgacgggctcggcatgagcggcagcgtcgccggactgctcacctcggtgccgccgctctgcttcgcggtcttcggcgtgatggcaccgcggctggcccgccgcttcggggccgccgccgtcgtgggcgccggaatggtcgcgatcaccgcgggcctggtgatccggccgtacgccgggggcacggcgggattcctcgccgccagcgcgctggcactcatgggcatcgccgtgagcaacgtcctgatgccggtgatcgtcaagcgctggttcccggaccgggtcggctccatgaccggcctgtactcgatggcgctcgcgctgggcacctccgccgcggccgccgtgacggtgcccctgaccgacgcactgggcggcagctggcagtccgggctggccgtctgggcgggactcgcggcggcggccgtcctgccctggattccgctggtacgcgcgcggggaggggccggaggctcgcacgggttcggctcgtcggaagcggccggagggtcgcacgggctcggctcgtcggaagcggcggccgccgcggcccctcaggaggccgacgggctgcggatcacccggagccgtacggcctgggcgctggccgtcttcttcggactccaggccaccgccgcgtacatcacgatggggtggatggcgcagatcttccgcgacgcaggtgtcgccgcgggcacggccggactcctgctggccgtcaccatggtgatgggcgtcccgctggccttcgtcatcccccggctggccacgcgcctgccgcaccaggggccgatcgcggtggttctcggggcgtgcggactcgccgggtacgcgggcctctacttcgcccctgcggccggcgcctgggcctgggcgctgctgctcggcgtctccaactgcgccttccccctcgctctgacgatggtgggcatgcgggcccggacgggtgcgggcgtggccaagctgtccgccttcgcgcagagcacgggctatctgatctccatccccggcccgctcctggtgggggtgctgtaccagcacagcggcggctgggggctgccgatcgcgctgatggcggggctgatgatcccgcagatcgtggtggggatcgtcgccgggcgcaatcggacggtggaggaggaggcggctcgctgagccgggccgacgcgcacacgggaaggcgtttgtgccgcgagtacctccgtgtcacgacgcggccggtcgcgaccccgggggagtccgggcgggcgatgggtgcgagactggccgtatgcccgtgctcgacccgaatccccagaacggccagaagaagatgctgctcgtcttcggcgcgttcctcgccatcttcgtgatcatcggcatcatcgcgtcgatcgcgtccccctgaccaacgcgcgtcggtcgccttcccgtgaccatcgcgtcggtggtcttcccgtgaccatcgcgtcggtcacctccccgtgacgaccggcccgagggccgaccgggcccaccgccgagggtggggttagccccccatcccctagggggtgagtgtcagggtcaagtgggtggaccaccggatgggttgacggctccggactccgtaacttcgaagtgtgaccgcgagggcgcggaccacggaccacccgaagacccacggaggcatcatgtcggcctgcacccccacccggccccacccggcgacctcgggcggcgtcgacatccggctgccctggtgggcgctcgccctgcccgccctcgccttcgtcgccctcctcgcgctgatcatcaacccgtcggacgcgagtgcggccgccggggagcccgcgatcacgcatcttctcgagcgcgtccggacggtgctgggccaggccctttagcagccccggcggaggccgcacagccggacgcggatgcggctgccaactccctgcgcccgttggcgtgtttcatgcgaagctgggactcatgagcgtcgcagaaccccgcaggattgtcctcttccggcatgcgaaggccgactggccgcaggtgtccgaccacgagcggccgctcgccgaccgggggcgcacggacgccgccgtcgccggacgcaagctggccgacaccggcatccccgtcgatctggccctctgctccaccgcgacccggacccgcgagacctggaagctcgccgtccacgagctcccgcaccggccgaaaaccgtctatgaggagcggctctacgaggcctcgcccggggagatcatcgccgtgctcaacgagaccccggacgacgtgcagaacgtggtcctgatcggtcacaaccccggtgtgcagggcctggccgacatcctcgccggctcggccgagggcgatacccgcacccggatggccgaccgcgacttcccgaccgccgccttcgccgtgctctccttcgacggcccctggaagtccctggagccgggtgtggccacactgctcgactactgggccccgaccgagtaacccaccgccgccatggaaggggcccggcacctgcgcggtgccgggcccctcgacgtatgtccccgcgcgccgcgcgggcgccctgacgcggtggtcagccggcgtcgtcgtcgtgcgtgtccgccgcctcgacctcttcccgggtgacaccgagcagatacaggaccgtgtccaggaaggggaagttcaccgcggtgtgcgcggcctcgcggacgacgggcttggcgttgaaggcgacacccagccccgccgcgttgagcatgtcgaggtcgttcgcgccgtcaccgatcgccacggtctgggccagcggcaccccggcctccgccgcgaaccggcgcagcagccgagccttgcccgcgcggtccacgatctccccggtgaccttgcccgtcagcttcccgtcgacgatctccagggtgttggcctgagcgaagtcgaggccgagccgctccttcagatcgtcggtgacctgggtgaacccgccggacacgacaccgacttggaagccgagccgcttcagcgtacggatcagggtgcgcgcgccgggagtgagccggacctcgctgcgcaccttgtcgatcaccgaggcgtccagccccttcagcagcgccacgcgcgcgtgcagcgactgttcgaagtccagctcgccgcgcatcgcggccgccgtcacctcggcgacctgctcctcgcagccggcatgcgcggcgaagagctcgatcacctcgtcctggatgagcgtcgagtccacgtccatgacgaccagccgctgggcccgtcggtgcagcccggccgcgacgacggcgacatcgacaccgagtgccgccgcctcggtcgccagggcggtgcgcagcgtctcggtctccgtgccggacacggcgaactcgaccgccgtcaccgggtacttggcgagccggaaaatacggtcgatgttgccgccggtcgaggtgatccgcgcggcgatggcggccgtggactccgcggtgagggggtggccgagcacggtgaccagcgagcggccgagtccgcgcggccggttgtcgcccaggccggagatgatctccgcctgcatcttcatggactccgcccagctgtggacggtggaccgcagatcaccctcgagcccggccggcggctcggtcacgagcgcgcacagcaccatccggccacgggtgacgacctgctcgatgtcgaccacgtcgacggagaaggcggcgagggtgtcgaacaggccggcggtcaggcctggccggtccttgccgaagatcttgacgagaagggtgcgggcgtcggaggtctgcgaagcactcatggtgttcccaccgtatccggcacccagtgcctttcgcgcctgaggtccgtctggcggacagggaacagtggatggcggactgatggcgcacgccttgatcacaggcgaagcgacgacgccgcgcccgccgcgccagccgggtcggccctcggcggggacggcaggtcagccgcgcccgcggaccgggccggcccccaccggcgaggacggcacgtcagccgtgcccgccgggtcggcccccagcggcggcgccgcgtcagccgcgcccgcgagccggatcggcctccggcgacctccggcgaggtacgtgcgtcagtcgcgcccgccgggtgggccctctgccgaggaccgtgcgtcagccgcgcccccggaccggatcggccccggcgacgacctcgcgtcagccccgcccgccgcgcccaccgcccccctgaggcctcccaggcggcggaggcggcggaggcgggggaggtggcgggggaggcggcggcccctcctccggcgaagccccaggcgcagccggcctggaccgtcgccccggcgaccggggcggtggcgtgatcggcccgatcacggtgggcgccccgtacacgtcgtcgggcggcctcacgccctgcgagggcgcggccccctccggcctccgcacatccctgtctcccggccgcacatccctgtctcccggcgccgcacctcccgccggccgccgggcctccggggcccgcccgtcctccggggcccgccgcccctccgccgcccgcagttcctccggcaccctcagataggggttcgtgtcaggattcgcaggccggtacggcctgctcggcgcgtacggtcccgcatgcttcggactctccgtccgctgcggcacatccgtccgctgcggcacatccgtccccagcgacacatccgtccgctgcggcccgaccggccccggtgcccccacgtcacccagtgccagcggcgccgcccgccgcccggccgctccgctcacgtacgcgagcaacgccccggccgcccccgcgcccgcaccccacaccgcgcccagcaccagcgccatccccaggtgcccgtgcagtcggatccccgcgccgaacgcgtcgaagccgagcaccgacagcgacgcgtccacggacacatccgtcagccagaccagcaacggcagtgccagcgcggtcaccacgccgagccgaagagcgcagtgccccgcgaagccgagggcacccccacctcgtacagccgcagtgcccggcaccggtccggaagccgcactcccgcctcgtacgtccgcacggcccttcctcggccgcgaggcggcacccggcccccgtacaaaaggcgtacgcgctgccgtcagcacccccgcgaacagcatcatgagcgcggccgcgacccccaacagccagactctgccgtccagttcggccaggcgccccagcgtgacgggctggtcggaccgcacgctcagcagctcgtccagggggtggggcagcagcgtggccagtgcgcccgaggccttgccgtcccatggcacgaacaggccgaccgggatgcccagccacaccccgttgggcgcgccgagcagggccgcgccggcgatccgccggggatggtcgtcgccgatcgccgcgtacgccgccgccgagagtcctgccacgaccgccaccagcagtacggtcaccagcgcggacacggccggccgcaccacccggtgcaccgcctcccagccgcgcggcaggggcgtacggcgcgacgccagcagcgcgatcaccagcactccgaccgcccagaccgcgccgccgagcagcgtgggcaccgtgtcgaccgagaagccgaccgccgccttcgccttcaccagatcgccgatccggtccggcagcagcccgccgatgtccccgagcccgggaatgtcgatcttgccgctcccgccgcctccgggcagtctgccgagcccgagccgttcgccgtcgatggtgatgacgtcgtgaccggcccaggcgagcccgcccagcatcgccacgaacaggacgaccaccgctgccgcgcgcgcgaggagttcggacggcgcgaccacaactcccgccgcgcgcagggaccgtaagaagaaccagcacagcagcagcgcgcccaccagccccacgccaagtggcgtgatctggatggcggtcgtcgcctccgctcccttcaggccgaacgccgacacatcgccggacggcgtcaccgaaccacccgccccaagcgccacaacggcggcggtcatcgggccgagcgagccctccgcgtccgcgtccagcagatgcagcccgagcgcggccgtccccgccatcccgatcaacgcccagctcacggaggcgatcgcggacagcaggacgtctccccacggcaccctcctgccgtggtccgcggtctcgatgctcatcgtcagccccccgatccgcgccgcggcgatccaccgcggatgtccccctcgcgtgggattacccctctccgggccggtttcaaccccgtcaacggaaacggacaagccgcccgtacttggtcttcacaaggtccgactttcggtcagggggctcctactgaaatagttccccacgatgttcgacatccctagactccctgtgatgggggtagctcgggggacaactcagtggggctggagtgccggaactcgtactggaattgaatggacggacctggacgctcgacgcgtcccggccctacaccctcggacgtgatccgcagggagacatcacgctcgacgacgccagggtgtcctggcggcacgccacgatcagctggaacggccgcagttgggtcatcgaggaccacggcagcaccaacggcacgttcgtgcagggccagcggatccatcagatggagatcggcccgggttcggccgtgcatctgggcaacgcgaccgacggaccgcgtctgaacctgtccggcgcggcggcggccgtcgccgcgccgcagcaagcgcagccccagcagcagccgtacgtggccaagggcgcgagccccggctgggcccagcaggccccgccgcagcagcaggccccgcagcagcaggcaccccagcagggctggcagcagcctcagcagagtgcggccgttccgcagcagcagggacccggtggtggcgcgggggcgccaccggtctacggcgaccgcagcccgaccacgttccaccagttctcgctcggccgcgtgatgcgcatcggtcgtgccctggagaacgagctggtcgtctccgaccttcaggtctcgcggaaccacgccgagttccacgcgacgcccgacggccgcttcgagatccgcgacctcggctcgcacaacggcacgtacgtcaacggtatgccgatcgccaagggcggctcggcgctcctcggcccgaacgacatcgtcggtgtcggccactcgacgttccgcctcatcggcgaccgcctcgaggagttcgtcgacaccggtgaggtctccttctcggcccgccatctgaccgtcacggtcgacggcggcaagcagatcctcaaggacgtctccttcggcgtcccggagaagtcgctcatcgcggtcatcggcccgtcgggctccggcaagtcgacgctgctcaaggcgctcacgggctaccgcccggccaaccagggcgatgtcctctacgacaaccggaacctgtacaagcagttcgccgagctgcgtcagcgcatcggtctggtcccgcaggacgacatcctgcacaaggagctgaccgtcaagaaggccctcaagtacgcggccaagctgcgcttccccgcggacaccacggggcaggagcgcgaggcccgcatcgacgaggtgctgcgcgagctgaagctggacatccacaaggagaagaaggtcacctccctctccggtggccagcgcaagcgggtctccgtggccctggagctgctgaccaagccgtcgctgatcttcctggacgagccgacctccggcctcgacccgggcatggaccgtgacgtcatgcagctgctgcgcggtctcgccgacgacggccgtacggtcctcgtcgtcacgcactccgtggccgagctggcgatctgcgacaagctcctggtcatggcgcccggcggttcggtggcctacttcggcccgccggaggaggcgctgaacttcttcggctacgacacctgggccgacgtcttctccgccttcgagaactaccgcgactacgactgggcgggccgctggaagggctcgcagcactaccagatgtacgccgcggacatcgacgccgtcgctccgcaatccgtacacatgcctccgccgcagcagatgcgcccgcccaagccacagggctggggctcgcagttgatgaccctgatccgccgctatgtgtcggtgatcgtgtccgacaagggcttcctggcgctgacggtgatcctgccggcggtactcggcgcggtgagcctgctcatcgactcggacaagggtctgctggtcaacccggcgaacccgaagaccggggtgcacatcccgaacggcacggccaccacggtcctgctgatcctcgcggtcggcgcgtgcttcgcgggcgccgcgaactccgtgcgcgagctgatcaaggaacgggtcatctacgagcgggagcgggcgaccggcctgtcacgctccgcgtatctgatgtcgaaggtgatcgtcctcggcaccatcaccgtgctccagggcgcgatggtcggcgcgatcggcttctccagccgcgagatccccgacaagggcctcgtcctgggcaacgcggtgctgctcgagctgtccatcccgatcatggcgctcggtttcacctcgatgatgttcggcctgatcatttcctcgctggtgaagaccgccgagaagaccatgccgctgctggtgatgttcgcgatcatccaggtcgtgttcacgggctgcctgttcacgctgcacggcgcggtcggcgtcaacgagttctcgtacctgatgccctcgcgctgggccgtcgccgccgccggtacgacgctcgacttcaacaacatcgccccgaacaccgacgacccgaccagcacggacccgctgtgggaccacgcggcgggcgcctggaccatggacatggccgcactgatcgtcctcggtgtcatctgcggcttcttcgtggcccgcttcctgcgccgccacgagccggaggtcatgcggaagtaggcgctttcggcaaccaccttcgtacgatgccgaagggcggcacccccgtatcggggtgccgcccttcggcgtacgtagaagaggtccgcgccaggcctcagtacgcgctgttgacgttgtccatcgagccgtacttgtcggccgcgtagttggcggcggccgtgatgttggcgaccgggtcgtagatgttccacgaggtgccgggcacgtggtacgcgttgaaggtcggcgggatgacctggagcaggcccttcgacgggatgccgttgatcgcgttgacgtcccagccgttgatggccttcgggttgccggacgactcccgcatgatgttgcggtacaggccgttgtacgagccggggatcttgtgcttcgccatgatgtcgagcgactcgtggatccagccgtcgaggttgttggcgtacgtcttcgcggcgaccggcttgacctcgacgcgctgggcggaccggctcgcggccgccttcgccttgcgcacctgcgcggccttcgccacggcctgcttcttggcggcggccacggcggccagcttcttggcggcggccgcgtcggcggcctgcttcttcgccgcgatcgcctcggccttgacggtggcgccggccagctggtcggtgatgctggccttgacgtccttgatctgctcctggctgtacaccaccggagcggacgacacggcggcggtctcctgcgtcggggtctgtgcgctgctcggcaccgcggagaacgcgagggcggcggcgccgagggcggccacaccggcgaccgagagcttgtgggtcttggtcagcttcggacgatgaccaggagtgttgatgttcttgggcatgactgatggacctcttcgaatagcgcggaggtcgctctcgagccggatggggactcagggtttccagcacaagcgccgtgggtacaggaccccggtgccgagcgacgagagccattgttagcggccgcaaaatcgcctggcaaaggtgtgacgtacgatccggggtagtggacacaggaagggcaaaacgggacagactggcacgtctgtcccgctcataacggacttacttatctcctatccttcttcgtacgtgatgtgcgccctatgtgcggggtcacatcgaccgagcggcagtctcacattaggttgcggaagcaatgcactgtgtgaggactctccgtccggaaggatgagatgtagatccccgaactcgtgccacaggtagagcccggccagcgcctcctcataactgcggtcgatcgcggtccgtcccgccagcgcctccagcatcagcagatgcgaggcctccggctcgtgcagcccggtcagcagcccgtcgaccgcccgcaccccgcgctccggggtcaccacgaggtcggtccagccctccgccggccggaccactccgtcggtgccggtcgccgactcgacggcccgcacggccgtcgtaccgaccgcgatcacccggccgccctcccggctcccgtccccacccctcgaagaggacgcctcgcgtggtgtccgatgcgcccgcgccgcgttgatcagccgcgccgacgcctccggaaccgcgaagcgctccggatacggcggctcgtgcgcctccgccgacgccacccccgtgtgcagcgtgatcggtgcgaactgcacaccacggctcaccagctccgccaccagccgcgcggtgaagggccgcgcggcactcggcatctccgcactgcccgctccgtcggcggacggcagggcgaacaccgtctgatagacggagaggggctgatccctttctgtataggagtaacggatggggcgcccgtgcccgcgcagcagcaccgtcacgtccgcgtccccgggggccgacacccgcgcccaccacaggcgctcgctccgcccggccagcggctcctcgagtacgaggcgtacgccgtccgggagacgcacctctgtgcccgcgggcccgcccgtacgcgcgcgtgtagtgccccttccgtcgggatcccgcagctcgacggcccatcgtccgtcctcgccccgcgtggagaaatgcaccaccacgcgcgcgtgcccgatccgcccgtccacggcggcggccagcgtgggggacgtgttgacgacgagcagatccccggcccgcagctgccgcggcagctccacgaagtcgtggtgcgacacctcggtcccgcgcgagaccagcagccgtacggaatcccggtcgaggccgggcccgcgctgctcggccggcacccgcgccgacaactcctccggcaccttcccccacgcgcgaccgcgcccgaccggggggacccccatcgcggtcgtcatcgccccgccggcagcgccgacagcgccgacgcgccgtagcggccgctcgccgggcgctcgtccagcagtccgatgaaggcgggcaccacactcgccggagccgggcgcggatcgtcgtcgtccggtacggccgccgtgtacaggtccgtgcccatgtccccggggtccacggcccacacccgcaacccgggctcctcctcgccgagcaccgccgacagatggtcgagcgccgccttggacgccccgtagccaccccacgtctcgtacgcctcggccgccgcgtccgagctgatgtcgatcaccgtgcccgcccgcgacgcccgcagtagcggcagcgcctcctggatcaggcccagcgcggcgaccacgttgacctccagggcgtgccgcagcccctccagcgtcagcgcttccagtcgtacgagcggctcggcacccagagcgctcgcgttgttcaccaggaggtcgagcccgcccagttcccgggccgccgtcaccagcccggcccggtgcccggcatccgtgacgtccccgggcagcgcccgcacccgcgttccgtacgcggacagggccgccgccgtctcctccagcacctcaccggttctggcgtcgagcaccagatcccagccgcgctccgccagggccgcgccgagtgcccgccccagccccttcgaagcccccgtgatgatcgctaccggcatgacaaccgtcccctcgttccaccaccgccgctccgggcggctgtcctcaacctaggaaccgggccgaccccgccgcctcgtgcgcgagccgcaaagaaccagggcccttcggcctaggcccaccggcccgggccgggaccgccacaggtcggatacgccctgtcacacctcgccggtacggtgaggtcatgagtcatggaccccggtccggcctgtccgcggtgagttccgcgctgctggccatgagcaggcatctcgaggtgcgcgacgtcctcaagacgatcgtcgcctcggcccgcgagctgctcgacgccgagtacgcggcgctcggggtccccgacgaccacggaggcttcgcccagttcgtcgtcgacggcgtcagcgacgcccagtggaaggccatcggcccgctcccacgccagcacggcatcctcgccgcgatgctgcacgaggcgaagcccgagcgcctcgccgacgtgcgcgaggacccccgcttcgagggctggcccgcggcccaccccgacatgtccgacttcctgggcctgccgatccgtgacggcgacgagatcatcggcgcgctgttcctcgccaacaagaggtgccccaaaccggagggcggctgcggcttcacccctgaggacgaggaactcctgacgatcctcgcccagcacgcggcgatcgccctcaccaacgcccgcctctacgagcgcagccgcgaactcaccatcgccgaggagcgctcccggctcgcccacgaactgcacgacgccgtcagccagaagctcttctcgctgcgcctcaccgcgcaggccgccgccgccctcgtcgaccgcgacccctcgcgcgcgaagggcgaactccagcaggtggccgcgctcgccgccgaggccgccgacgaactgcgcgccgccgtcgtcgagttgcgtcccgcggccctcgacgaggacggtctggtcgccaccctgcgcacccacatacaggtcctcgaccgagcccacaccgcgcgcgtgaccttcgacagccgcggtgtgcgcgcgctgcccgccgcccaggaggaggccatgctgcgcgtcgcccaggaggccctgcacaacgccctgcgccactcgggagggtcgcgtgtcgacgtgaccctcgtgaagcgcggaccgggcgtcgtcctgcgcgtcacggacgacggcagcggcttcgaccccgcctcgacccgccgtgcgggacgccacctcgggctggtctccatgcgggaccggacgagcggggtcggcggcacactgaccgtggattcggcgcccggcaagggcaccacgatcgatatggaggtccctggtggctgatgcaatcaaggtgctgctcgtcgacgaccaccaggtggtccgccgcggcctgcgcaccttcctcgaagtgcaggacgacatcgaggtggtgggagaggcgtccgacggcgccgaaggggtcgcccgcgccgaggagttgaagcccgacgtcgtcctcatggacgtcaagatgccgggcatggacggcatcgacgcgctgcgcagactccgcgaactcgccaaccccgcacgcgtgctgatcgtcaccagcttcaccgagcagcgcacggtggtcccggccctgcgcgcgggcgccgccgggtacgtgtacaaggacgtggaccccgacgccctcgccggcgccatccgctccgtgcacgccggacacatcctgctccagcccgaggtcgcgggcgcgctcctgtcccaggaggaggccaactcgggccagggcaggggaggttcactcaccgagcgggagcgcgaggtgctcggcctgatcgcggacggccgctccaacagggagatcgcacgcgcgctcgtactctccgagaagaccgtcaagacacacgtctcgaacatcctgatgaaactggacctcgccgaccgcacccaggccgcactgtgggccgtacgccatggagcggcgggctgaccgcggcacgagaacggtgctccaccccaggggtgctccggcgcccgcccgggcgaccggccgacgctgatactgccgaccgacagtaatacggacggatccactccagtctgagattcataccgtcgtgtgtatgtcccccggacggcgcatcctcggcggctcccggccgttctccagtgcgtgctgcggcgcctgccgcagtgatcgccagggagggctcagaagtgaagaacctgaagaaggtagccgctgtcacgatggtcgccggtgggcttgtcgccgcgggcgccggtatggcctcggccaccgacggcgcgtgggcgggcggcaaggccgtgggctccccgggtgtcggctcgggcaacgtggtccaggccccggtccacatccccgtgaacgcggtcggcaacaccgtgaacgtcatcggcgccctgaacccggccttcgggaacctgggagtcaaccactgagattccgctccggaaccctcgtgaccaccggcctcccaggcgctcctggggggccggtcaggcgtccgggggcgaggcggggagaccgtcgccaagaaggctgtccggcgggcgtcgcgggcggcggcgtcgacagcaacggcgccctgaaccggccgccgtcaaccagggcgtcagcgcaggccgatcgcggggccccgggtgcggcagcccccagggacgcccgcacccacaccggccaccagaaggccgacggtcaccgcaccccccgctcccgctcctccacaaacgcgttgtaggcggccacctgcgcccgacgggcagttcgctcgaccggcctgagcgccagcgacctcgccgcgatctccgacgcgctcaccgccccgccgtgcccgttctcgtacgccaccgaaatcagcagccccacccgctgggccagctccaacacgcgaaccgcacgcggcggataccccggcgccagcacctcgcgcccccgctcggcccgggcccgatacgcgtcgacggccgcctccgccaccggcccggagcccgccacatcgagccgcgacaacacctcggtggcctcgcgcagcgcctccgccagctcccgctcggcctccccgagggaaggcacatcggcgggcggcgcctcccgcacggcaaggcagtgccacacgacctccacatgcacatcgccgtcgggcccggcctcgtacacctcggggaccagcccgagcgcggccccgaaacagatcgcggcctcctcggcgtccagcgcccgcgcattgaattccggcggcccgctcagcccgagcggatgccccggcgcgggcagggcgacccgcagcccggtcacccccagcgcgcgcatccggccaagggcgagcgtgaggccgacgggcccggactcaccgggcagcccctcgacccggtgcaccgcgtcctccccgacgatggcgagcacggcgtcgtccggtgaaacaaatccggccaaaagggcatttccccatgcggccagccgtcctgagcgtggttccgagagcatgcctccaccctaaggaccgaccgatggatgggaccgcccgaccggtggcgtagatttcttcgggggctgcgcccacaggcgtacgcgactgccgagactggtcgacactgcaatgggagacaacgcgctcatgagcgatgttctggagctggaggacgtatccgtggtccgcgagggccgggctctggtggaccaggtctcctggtcggtcaaggagggcgagcgctgggtcatcctcggccccaacggcgccgggaagacgaccctcctgaacctcgcttccagctacctgttccccagcagcggcaccgccaccatcctcggcgagaccctcggccaggtcgacgtcttcgaactgcgcccgcgcatcggcgtggcgggcatcgccatggccgagaagctccccaagcgccagaccgtcctccagaccgtgctcaccgccgcgtacggcatgacggccggctggcaggaggagtacgaggacatcgacgagcagcgcgcccgcgccttcctcgaccgcctcggcatgagcgactacctggaccgcaggttcggcacgctctccgagggcgagcgcaagcgcaccctcatcgcccgcgccctgatgaccgaccccgagctgctgctcctcgacgagcccgccgccggcctcgacctcggcggccgtgaggacctcgtacgccgcctcggccgcctcgcccgcgacccggtcgccccttcgatgatcatggtcacgcaccacgtcgaggagatcgcgccgggcttcacgcacgtgctgatgatccgccagggcaaggtgctcgccgccggcccgctggagctcgaactcacctcacgcaacctgtccctctgcttcggcctcccactcgtcgtggaacagatcggcgaccgctggaccgcccagggcctgcccctgtcctgaccgggcaccggcactcgcgagaatcaccggccggccacttcgaccggatcggcgccctgtccgaggcaggacccgcggacctaccatgaccatgtgaacgacatcgaggcatgggtgtggtggctcgtcggcgcggtcgcgctgggaattccgctcgtggtgaccgccatgccggagttcggcatgctcgcgctgggagcagccgccgccgcggtcacggcgggtgtcggcggcggcgtcgtcctccaggtcctcgtcttcgccgtcgtctcggtcgcccttctcgccgtcgtacgccccatcgcggcccggcaccgggcccagcggccccaactcgccacgggtatagacgcgttgaagggcaagcaggccgtcgtactggaacgggtcgacggcgcgggcggccggatcaagctcgccggggaagtctggtccgcgcgatccctcgactccggacgcgcctacgaggtaggccaggaagtggacgtcgtggacatcgaaggggccacggcgatcgtcatatgacctcgtaagacgcaagtgaaccgaacgccccacgggacagccgacggtctgtcagactcgtccagcaagatcttcaacaagcataagatcttccggaaaaccgaggcggagaagggtacggggagcaacgatggaaccgatcatcatcgtcctgatcattctggtggtgttggtcttcatcgccctgatcaagaccatccaggtcatcccgcaagcgagcgcggccatcgtcgagcgcttcggccgctacacgcggacactcaacgcgggcctgaacatcgtggttccgttcatcgactcgatccgcaaccgcatcgacctgcgtgaacaggtcgttccgttccccccgcagccggtgatcacccaggacaacctggtcgtgaacatcgacaccgtcatctattaccaggtgaccgacgcgcgtgcggccacgtacgaggtcgccagctacatccaggccatcgagcagctcaccgtcaccacgctccgcaacatcatcggcggcatggacctggagcgcaccctcacctcccgcgaggagatcaacgcggccctgcgcggtgtcctcgacgaggccaccggcaagtggggcatccgcgtcaaccgcgtcgagctcaaggcgatcgagccgccgacctccatccaggactcgatggagaagcagatgcgcgccgaccgtgacaagcgcgccgcgatcctcaccgccgagggcacgcgccaggccgccatcctcaccgccgaaggtgagaagcagtcccagatcctgcgcgccgaaggtgaggccaaggccgcggccctgcgcgccgagggcgaagcgcaggcgatccgtacggtcttcgagtccatccacgccggcgacgcggaccagaagctcctcgcctaccagtacctccagatgctccccaagatcgccgagggcgacgccaacaagctctggatcgtgcccagtgagatcggcgacgccctcaaggggctgagcggcgccatgggcaacttcggcccgatgggcggcggttcgggcagcgggaactcaggcggctccggctcggagcgccgcgagaagccgccgatcacggactgacgcaaaacccgcgccccgaaaaggggcgcggggaaccgcgcgaccggccaggatctccccgcggctcacgaaccgcccacggtcttccggctcactgggggagcgtctaggcggccggctgtgccagccactccggcagcgactcgaagtcgtcctgccccagcgccagcagcatcgcgtccgccggtgtcggctcgaacggctgccgcagcagcggcatccccgcctgctccggcgtacgggccgccttgcggtgattgtcctccgcgcacgacgccaccgtgttcagccaggagtcctggcccccctgcgccctcggcaccacgtggtccacggtcgtcgcacgcctgccgcagtacgcgcacctgtgcctgtcccgtaccaggacacctcgcctcgaccatggcgcttgtcttcggaaaggcacccggacatagcggcagagcctgatcacccggggcaccggtatgtccagcgcggctccgcgcatacggagttcggggtgggcctgctcgacgacggccttgtcctgcagcaccagaatgacggctcggttcaacgtcaccgtcgacagcggctcaaagctcgcgttcagcaccagcgtgtcccgcatccagcccacctcccgtgtgcaccggcccaccccctggcgggcttggatcaactctggccgggcgcgccgagatggacaacgcaataaaaactgcccgcctctgatcacttccaagaccagagacgggcaaacgttcaatgaacgtcagtcttcagcgggaacctcgtactcaccgatgagctgggcgcgcgccaacgcgtggaaccgcaggttgaagcccaccacggcgggcgatgcgtccgcgtccggaccgagcttctcctggtccacggcgtagaccgtgaacacgtaccggtgcggcccgtccccgggcggcggcgcggcaccaccgaagtccttcgacccgtagtcgttgcgcacctggatcgcgctgtcgggcaggccctcgaacttgccgctccccgcacccgtgggcagctcggtcaccgaggccgggatgtcgaacgcgacccagtgccagaacccgctccccgtgggtgcgtccgggtcgtagcaggtcacggcgaagctcttggtctccggcgggaagccttcccagcgcagctgcggcgaggtgttccccgccgcgtagacctgagcgtccttgagcgtcgcacccggctcgacatcctcactcgtgaccgtgaaggacggcacgggcggatggaagtcgtgggggagcggcggcctcttgagctcggtcacctcggtacctcctgatgggtttccggaaagccggaaagacggaatctctcggtcccgagcctagaaccagctgcgcttgctgccgacctccgacagccactggtggagatacgcggtccagtcggtgccctggaagtcgttgagaccgacctggaaggagcggtacgagtcgctgccctcgctgaacagacccggcttcttgtccatctccaggatcacgtccatctcccggtcgtccgcgacgaagctcagctcgacctggttgagaccgcggtactgcgacggcgggaagaactcgatctcctggtagaacggcagccgctggcgggtcccccggatgtggccgcgctccatgtccgcgttcttgaagcggaagcccagctggacgaaggcgtccagaatcgccttctgcgccggcagcgggtgcacgttgaccgggtccaggtcaccggagtccacggcgcgcgcgatctccagctcggtcgtcacaccgatgttcatgccgcgcagggcctgcccgtcgatcatcgtgatcggcgtctcccacgggatctcgagcccgaacggcaccgcgtgcaccgctccggcctggagctcgaaggcaccaccgaggctcagcttggcgaactcgatgtcctgcttgtactcctggtcgtcgtggccctcgacctcgaccttggcctggaggccgacgctcagcccctcgatcgcctggttcacggacccgccctggatccgtacctcaccctggaccacaccgcccggaacgacgttgacctcggtcagtaccgtctcgaccgaagccccaccggcccccaggctcgcaagcagccgcttgaaccccatgtctccaccctcccaggcaatgcctgttccgtgtccgcgcccggacccccgtcgggtcccgtgtatgacgacgactattccttgatctctatcaacgcgatccggcgacggccggttccgcgccctcacccttccaaggggaacgcctcctggccaccccgatggcacacacctgagtggactacgctcgtacgccatgatcgcggcccctgaccgtacgcccctcacccgggagttcttcgcccgacccgtccttgacgtcgccccggacctcctcggacgcgtcctcgtccgcacgaccccggacggtccgatcgaactgcgcgtaaccgaggtcgaggcatacgacggcccgagcgatcccggctcccacgcatatcgcggccgcacggcccgcaacggcgtgatgttcggtccgcccggccatgtgtacgtctacttcacctacggcatgtggcactgcatgaacctggtgtgcggtccggagggccgagcgagcgcggtcctgctgcgggccggcgagatcatcgagggcgcggagctcgcgcgcacacgtcgactctcggcccgcaacgacaaggaactggccaaaggaccggcacgtctggccacggcgctggaggtggaccgcgcactcgacggcaccgacgcatgcgccccggagggcgggccgctgaccctgctgtcgggcacgcccgtgccccccgaccaggtgcgcaacggtccgcgcaccggagtgtccggtgacggaggggtccacccgtggcgcttctggatcgacaacgaccccacggtgagcccctatcgggcccatacgccccgacgccgacgaacttgacgcgtccctgggggctccgtaatgtagtccgagccgcttgaaccgggtactgcgttcagccagcagccgggagcggccaacccactacctacgactcccctcagcgggggccaattcggcgtgcctgcatgcctgaattcgagcttgcggaactcgattatgagttgcagcgggaatcggctagcgtagtgaatgtcgaaaggcacgggacggaaagtcccagacccaaggcaaaaccccccgacagggaatcggacacgaaagagtctgatagagtcggaatcgccggaaagggaaacgcgaaagcggaaacctggaaagcaccgaggaaatcggatcggaaaacggtctgatagagtcggaaacgcaagaccgaagggaagcgcccggaggaaagcctgagagagtctctcgggtgagtacaaaggaagcgtccgttccttgagaactcaacagcgtgccaaaaatcaacgccagatatgttgataccccgtctccggccgatcggctgggacgaggttcctttgaaaaagtcctgccgacgttgttcggtaggcgcacagcgaggacgctgtgaacggctgggcttattccgcccggctgttccgctctcgtggtgtcgtcccgattacgggaaaacattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggataatactctcgcaggcatctgtgagggttaaaagctccggcggtgcaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccgatacaatgagctgcgataccgcaaggtggagcgaatctcaaaaagtcggtctcagttcggattggggtctgcaactcgaccccatgaagttggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttctaaggagcacttctaagccgggcttgcccggttcagaggccagtacatcagcgactgtctgatgctggttgctcaagggtggaacgttgattattcggcacactcgacctgctcaggttggcaagtactgcttcggcgtggaaagcgaacatgggagggcgagggtgtcgggcacgctgttgggtgtctgagggtacggccgatcatggctgccttcagtgccggccccggtaaagatctgcttcggcgggttgtgacgggtggttggtcgttgtttgagaactgcacagtggacgcgagcatctgtggccaagtttttaagggcgcacggtggatgccttggcaccaggaaccgatgaaggacgtgggaggccacgatagtccccggggagccgtcaaccaggctttgatccgggggtttccgaatggggaaacccggcagtcgtcatgggctgtcacccatacctgaacacatagggtatgtggagggaacgcggggaagtgaaacatctcagtacccgcaggaagagaaaacaaccgtgattccgggagtagtggcgagcgaaactggatgaggccaaaccgtatgcgtgtgagacccggcaggggttgcgtatacggggttgtgggatctctcttttacggtctgccggccgtgagacgagtcagaaaccgttgatgtaggcgaaggacatgcgaaaggtccggcgtagagggtaagacccccgtagtcgaaacatcagcggctcgtttgagagacacccaagtagcacggggcccgagaaatcccgtgtgaatctggcgggaccacccgctaagcctaaatattccctggtgaccgatagcggatagtaccgtgagggaatggtgaaaagtaccgcgggagcggagtgaaatagtacctgaaaccgtgtgcctacaagccgtgggagcgtcgcgttgcatgcttgcatgcaacgtcgtgactgcgtgccttttgaagaatgagcctgcgagtttgcggtgtgttgcgaggttaacccgtgtggggaagccgtagcgaaagcgagtccgaatagggcgatttagtagcgcgctcaagacccgaagcggagtgatctagccatgggcaggttgaagcggaggtaagacttcgtggaggaccgaacccaccagggttgaaaacctgggggatgacctgtggttaggggtgaaaggccaatcaaactccgtgatagctggttctccccgaaatgcatttaggtgcagcgtcgtgtgtttcttgccggaggtagagcactggataggcgatgggccctaccgggttactgaccttagccaaactccgaatgccggtaagtgagagcgcggcagtgagactgtgggggataagctccatggtcgagagggaaacagcccagagcatcgactaaggcccctaagcgtacgctaagtgggaaaggatgtggagtcgcacagacaaccaggaggttggcttagaagcagccacccttgaaagagtgcgtaatagctcactggtctagtgattccgcgccgacaatgtagcggggctcaagcgtaccgccgaagtcgtgtcattgcagcgtatagccccaacgggtgctgtgatgggtaggggagcgtcgtgtgccgggtgaagccgcgccggaaggcagtggtggacggttcacgagtgagaatgcaggcatgagtagcgatacacacgtgagaaacgtgtgcgccgattgactaagggttcctgggtcaagctgatctgcccagggtaagtcgggacctaaggcgaggccgacaggcgtagtcgatggataaccggttgatattccggtacccgctgtgaagcgtcaaacatcgagcccattaatgctaaggccgtgaagccgccctggagccttcgggcaaaggggagtggtggagccgctgacccaaggtggtagtaggtgagtgatggggtgacgcaggaaggtagtccatcccgggcggtggttgtcccggggtaagggtgtaggccgtgcgataggtaaatccgtcgcgcattaaggctgagacctgatgccgagccgattgtggtgaagtggatgatcctatgctgtcgagaaaagcctctagcgagtttcatggcggcccgtaccctaaaccgactcaggtggtcaggtagagaataccgaggcgttcgggtgaactatggttaaggaactcggcaaaatgcccccgtaacttcgggagaaggggggccatcactggtgatccaatttacttggtgagctgggggtggccgcagagaccagcgagaagcgactgtttactaaaaacacaggtccgtgcgaagccgtaaggcgatgtatacggactgacgcctgcccggtgctggaacgttaaggggaccggttagtcaaacttcggtttggcgaagctgagaacttaagcgccagtaaacggcggtggtaactataaccatcctaaggtagcgaaattccttgtcgggtaagttccgacctgcacgaatggcgtaacgacttctcgactgtctcaaccataggcccggtgaaattgcactacgagtaaagatgctcgtttcgcgcagcaggacggaaagaccccgggacctttactacagtttgatattggtgttcggttcggcttgtgtaggatagctgggagactttgaagcccgcacgccagtgtgggtggagtcgtcgttgaaataccagtctggtcgtgctggatgtctaacctgggtccgtgatccggatcagggacagtgtctgatgggtagtttaactggggcggttgcctcctaaagagtaacggaggcgcccaaaggttccctcagcctggttggcaatcaggtgttgagtgtaagtgcacaagggagcttgactgtgagaccgacgggtcgagcagggacgaaagtcgggactagtgatccggcggtggcttgtggaagcgccgtcgctcaacggataaaaggtaccccggggataacaggctgatcttccccaagagtccatatcgacgggatggtttggcacctcgatgtcggctcgtcgcatcctggggctggagtcggtcccaagggttgggctgttcgcccattaaagcggtacgcgagctgggtttagaacgtcgtgagacagttcggtccctatccgctgcgcgcgcaggaatattgagaagggctgtccctagtacgagaggaccgggacggacgaacctctggtgtgccagttgtcctgccaagggcatggctggttggctacgttcgggagggataaccgctgaaagcatctaagcgggaagcctgcttcgagatgagtattcccacctccttgagagggtaaggctcccagtagacgactgggttgataggccagatctggaaggcgggtaaccgctggaggtgactggtactaataggccgagggcttgtcctcagttgctcgcgtccactgtgtagttcccagacaacgaacggttgtgctggctgaacagttccacttacttaattgaaaagtgtgcttgttcgctgccctgttcatggcctcgtacatatacgaggtgtctgaaagggtttcggtgatcatagcgtgagggaaacgcccggttacattccgaacccggaagctaagccttacagcgccgatggtactgcaggggggaccctgtgggagagtaggacgtcgccgaacaatctttggaggacctttggtcccagcgactcgctgggaccaaaggtcctttttttgttttcccaaagcgcgccgggtactcggctgcgcgagaatgacttgcggtaccgaagacaggagtcaccatgtccaccaactctcccgatgagcgaccggagcgcgacgagcgccgccgggacagtggtgaccgcggcggctaccgcgggggcccgcgccgggacaacgaccgcgctggctccggcgaccgcggtggttacggccggcgtgacgaccgccgtgatggtgaccggggcggagatcgcggtagtgaccgcggcggagaccggggtggtttccgccgtgacgatcgccgcgatgaccgtcgtggggatgaccgcggcggccgacccggcggcttccggggccgggacgaccggcgcgatgaccggcgtgacgaccgcggtggcgaccgtggcggagaccgtggtggcttccgtcgcgacgacaaccgtggtggcggcggcttccgcggaggggacgaccgcgaccgtggtggacgcccggcgttccgccgcgacgaccgcgccgccggaccgcgccgcgatgaccggggtgctggaccgcgtcgcgacgaccgcgctgctggaccgcgtcgcgacgaccgcgctgctggaccgcgccgcgacgaccgcgaccgtgatcgtgggttccgccgcgacggtgatcgccccgcggtccgtcgcgatgacgaccgtggtggcttccgtcgcgatgaccgacgtgatggcgaccgtggcggcttcgcccgtcgcgatgaccgtcgtggggatgaccgtggcggccgacccggcggcttccggggccgggacgaccggcgcgatgaccggcgtgacgaccgcggtggcgaccgaggcggagaccgtggtggcttccgtcgcgacgacaaccgtggtggtggcgaccgggaccgtggattccgtcgcgacggtgaccgtccggccttccgtcgcgatgacgaccgtggcggcttccgccgtgacgatcgtcgtggcgacgaccgtggcgatcgtggcggcttccgccgcgatgaccggcgtgacgaccgtggcggcgaccgtggtggcttccgtcgcgatgaccgcggtgacgaccgtggcggagaccgtggtggcttccgtcgcgacgacaaccgcggtggcgatcgcggtggtgaccgtggtgggttccgtcgtgatgaccggcgtgatgaccgcggcggcgaccgtggcggagaccgtggtgggttccggcgtgatgaccggcgtgatgaccgtggcggcgatcgtgggggcttccgtgggcgtgatgaccgcggttcgcgtggcccgcgtagtgatgaccgtggcggccgccccggcggcttccggggccgggacgaccggcagggcgacgaccggcgcggtggcggccggttccgcgacgagcgggaccgcgaccgtgagccgatcaagcggctgccgatcccggacgacgtcacgggcgaggagatcgacaaggacgtacggcaggagctgctgagcctgcccaaggggcttgccgaggacgtcgccaggaacctggtgatggtcgcgcggctcatcgacgaggacccggagagcgcctacgggtactccaaggtggccctgaggctggcgtcccgcgtcgccgccgtgcgcgaggcggccggcttcgccgcgtacgcgaaccagaagtacagcgaggccctcggcgagttccgtgcggcccgccgtatgaccggcggcgtcgagctgtggcccgtcatggcggactgcgagcgcggtctcggccggcccgagaaggcgctggagatggccggtgcgcccgaggtgcacaagctcgacaaggccgatcaggtcgagatgcggctcgtcgccgccggagcgcgtcgtgacatggggcagctcgatgccgccatcgtgacgctgcagagccccgagctggcctccaactcggtgcagccctggaccgcgcgactgcggtacgcgtacgccgacgcgctcctcgccgcgggccgcgagagcgaggcgcgcgagtggttcgccaaggccgccgagtccgacaaggacggcagcacggacgcctcggaccgccttgccgagatggacggtgtcgagttcgtcgacgcgctcgtcgaggacgaggagagcgacgagggcacgcggggcgagaccgaggccccagtggcagccgccgagggcgacgcggacgcggacgtggacgaggagcaggtcgacgtcgtacgcgaggtcgtagaagccggcgttgaagacggcgacggacacggtgacgacaagagcgacaacaacgacaacaacgacggcgacggcgacaagagctgacgtcatctcatgattgggcgggactccggaaggaggcccgcccttcgtgtttgaggggcggttctcagaccgtcagcgcgcgcagcaccagccccgacgcgggtttcgggccgaacgacgtcgacttgcggggcatcgtcacgccctggcgggcgaggtcccgtacgacctcctcgcggaccgggtgcaacagcacggccgtaccgccgtcgcgctccgccttctcgaccgtggcggccgtgtcgtggatgtaggcgatgtccgtgggggagtcctcggggatgttccagacgtggtccaggagcgtggcgtgcaggaccgtcgcgtcgagagtgcgccaggcttccgggtggtccgccgggatcgtacgcgccaggaggtccggggacgggtggtcaaccagatggaaggcgccatcacccgcgaggaggaaggcgttgcccgcgcaggcggagtcggccagcgcggccagggcgtccgcgagcggcaggtcgaggcggcggacgcggaacaggcccgtgagagcggccagggcgtccgccaccggcagccggtgcagcagacggtggatggcgcgtacgcgcagcggatagcgggccgtgtcgaccagcaggacgagcccgtagtcccaggggctcggcgaagggtgctccgcgcgtagacgcagatacgtcgcccagcggtggtggccatcggcgatgagtgcctggtggctgcccagatcggtctggatctcggccagctcggcggggtccgtcaccgcccacagccgatggctgaaaccgtcctccgtggtcgtcgagagcagcggagtgctctcgacggtacgttcgatgacggccgtcgtgccggcctcggagccgttgccgcggtaggtcagcagcaggggttcgaggttggcggaggtcgcgcgcatcagggccgcgcggtccgcgatgacgtgcggcatgacgtcctcgtgggggaggaccacgccgtccgacggctccgacaggcgcagggcgccgatgatgccgcgttgcagcatgctgccgtcgctttgttcgtagacgtacagacccggctcgctgtcggtggtgaggacgcccttggtgagccagtgctccagggtgtccgccgcctgttcgttgcgggcggtgggcgtgacggcctgggggaggatcagccggacgatgttgtacgggtccgccgattcgaggtggagcagcccgtccggccggacgacgacgtcgtacggcggcgatgtcacggcggccaggctgccgacccggtcggggtcgtagcgcaggccccggaacggtgtcaggtcgaggccactgcgcgccggggtttcctccgcgggacctgcatagttcattgaggcatcctaagtgtgtcggtgtgtcggtggcatgcgcgatgatcaggggaaagggatcgaacgaggagcgatgtgcaatgagccagaccgtcaggacgcggcccgagggcagtacgcaggccctgagtgaggcgtacgacacggcgctgctcgacctcgacggggtggtgtacgcggggggaaacgcgatcgctcatgccgttgagtcgctcggcacggcccgcgcgggcgggatgcacctcgcatacgttacgaacaacgcgctgcggacgcccgacgccgtggccgatcacctcacggaactggggataccgaccgggccctccgacgtcatcacgtcggcgcaggccgtcgcccggctgatcagcgagcaggtgcccgcgggcgcgcgtgtgctggtgatcggtggcgagggactgcgggtggcgctgcgggagcgcgggctggagccggtcgattcggccgaggacgacccggcggccgtcgtacagggctacggcggtcccgagctgccctggggacgtttcgcggaggcgtcctacgccatcgcgcgcggggtgccgtggttcgcgtccaacaccgatctgacgattccgagtgcgcgtgggatcgctccgggcaacggggcggcggtggaggtcgtacggatagcgaccggcgccgagccgcaggtggcgggcaagccgctgcccccgatgcaccgcgagacgattctgcgcaccggcgccgagcggccgctggtggtcggggaccggctggacacggacatcgagggcgcgttcaacggcgaggtggactcgctgctcgtcctgaccggcgtgaccgacggcgcccagctcctggcggcgccgccgcggcaccggccgacgtatgtcgacgcggacctgcgcggactgctgaccgggcagccggaggtcgtcgaggccggcgacgggtttcgctgcggtggctggaccgcgacagccggaagtgaacggctggagctcgcgggcgagggagaggccatggacgggctgcgggcgctgtgcgcggcggcctggacggctgcgggcgagggctcgtgcgagctggacggggggaaggcgctggcgcggctggggctttgaggccgccgtgagcgcgtggaagaggacacggctcccgggggagagctccagtcgcacgggcgcgacgccggcaggcggcttcaccgggtccggcgcggagggactccacggatgcggcgtggtccggcgggatcgagttccgcagcgagggtaggctaacctaacccccgtgttggtcgacagtccccccgaacagcgcgcggagaccgcccccgcgcccccaacccgccgggcgatacgtgccgttgggctccttgtgtccgttgtgatcctggtgctcgtcgccctggcgagcatcgcgatcggcgcgaaagagctgcccctggaccaggtctggcacggcctgttccacgactcggggacgtatgccgacgtcgtggtcggtgagcggcggtcgcgcaccgttctcggactgctcgtcggcgccgcgctcgggctctccggagccgtcctccaggcgctcacccgcaatccgctggccgacccgggactgctcgggatcaacgcgggtgcgtccgcggccgtcgtcaccgccatcacctatttcggcgtcacgacgctgagcggctatgtgtggttcgccttcttcggagccgccgcggtgggggccctggtgtggttcctcggtggcagccggggcgccacccccgtgcggctcgccctcgcgggcaccgcgatcagcgccgcgctctacggctacctccaggccgtgatgatcatggatgacgccgcgctcggcaagatgcgcttctggacggtcggttcgctggcctcggcgacggactcgatgatcatgcaggtcctgccgttcctggtgatcggcacggtcctcgcgctggccctcgcccggccgctgaacgccatggccatgggcgacgacaccgcccgtgcgctcggcgccaacctcaaccgcacccgtgccctgtccatggccgccgccaccgtcctgtgcggcgccgcgaccgccgcctgcgggccgatcgtcttcgtcgggctgatggtcccgcacgtcgtacggtccttcaccgggcccgacctgcgctggatcctgccgtacgcgaccgtcctgtcgcccgtcctgctgctcggcgccgacgtcgtcgggcggatcgtggcgcggcccgcggaactccaggtcggcatcgtcaccgcgatcatcggcggcccggtcttcatctatctcgtacgacggcggaggacggctcagctgtgaagaccacccgtaagccggcgctgcccacgcggaccgtgcgcacgcccggcggtctgtccctacggctcgacgtccgcgccgtcaccgtcgtcgtcctgctcctggtcgccgcgctcgccgcgagtgtcgtgctgatcggcaccggcgacttcccgattccggccgccgacgtcctgaggacgctggtcggcaacggcaacgccggccaggagttcatcgtcaacgagctgcggctgccgcgggttctcgtcgggctcctggtcggtgcctcgctcgggctcggcggcgcgctgttccagtccatctcccgcaatccgctgggcagcccggacgtcctcggcgtcggccagggctcgacggccggtgcgctcgtcatgatcgtgctgttctcgggcagcgccgcccaggtcgccctcggcgcgctcgtcggcggactcgcgaccggactggccatctatctgctcgcctggaagcggggtgtgcacggttatcgactggtcctggtcggtatcggcatctcggcgatggtcacggcggtcaacggctacctgatgaccaaggccgacatcgtcgacgcggcccgtgcggtggtgtggatgaccggatcgctcaacggccgtgggtgggagcaggtctggccgctggtctggctgtgcgccgtcctcgtaccgctcgtcctggcgaacgcgcgcggcctgcggatgaccgagatgggcgacgacgtgtcgtacgccctcggagtgcgcgtcgagcgcgtacggctgctgctgttgctgtccgccgtgctgctcaccgccggggccaccgccgccgccggcccggtcggcttcgtggcgctcaccgcgccgcagctggcccggcgactgacccgctcgccgggcccgaacctgattccctccatgtgcatgggcgcgaccctgctgatcgtcgcggactgggcctcgcagcgggccttcggcgccgaccagctgccggtcggcgtcgtgaccggagtgctcggcggggtctacctgctgtggctgctcgtcaccgagcgcaaggcgggccggatatgagcggccgagcgaacaagaacacccgaaggagcactgtgaaccgcctgtccgccgacaacgtcaccctcgcctacgaccagcgcgtcatcgccgagcagctgtcggtggagattcccgacaactccttcacggtgatcgtcggccccaacgcgtgcggcaagtccacgttgctgcgtgccctttcgcggatgctcaagccggccgaggggcgcgtcctgctcgacggacaggtcatccagtcgatgcccgcgaagaaggtcgcgcggacgctcgggctgctcccgcagtcgtcgatcgcgcccgacggcatcaccgtcggcgacctcgtggggcgcggccgctatccgcaccagggacttctgcggcagtggtcgtccgaggacgagcgggtcgtgcgggagtccatggagtcgaccggggtcgccgagctggccgaccgctatgtcgacgagctctccggcggccagcgccagcgcgtgtggatcgccatggcgctcgcgcagcagacgccgctgctgctgctcgacgagccgacgacctacctcgacatccagcaccagatcgacgtgctcgacctgtgcgccgaactccacgaggagcagggccgcacgctcgtcgccgtactgcacgacctcaaccacgcggcccggtacgccacccatctgatcgccctgcgcgacggccgggccgtcgccgagggggcgccgaacgacatcgtcacggccgagctggtcgaggaggtcttcggcctgcgctgccaggtcatcgacgacccggagacgggcacaccgctggtggtgccggcggcccgcagggcgcgggtggcagccgcggcggccggaccggccgcggaggccgcaacggtggctacggggggctcctgagacggacgcggggctgcgggctgcagaagaggctccaaagaggctcctgagccggtcgcggggctgcggcggccacagaaaggccgctgtggccaccgcggcccgtggcggtcacggaaggcgccgcggcccgtggcggtcacggaaggcgccgcggcccgtggcggtcacggaacaccgcaccccgcggcggccacagcacagaccggctacagaagacttctgagccggaggagatcgcgcaggcccgcttccagcttcacccggccggaaccccaggccttcgcgaagttcagctcgccgtcgaccatcgcgaccaggtcgtcgccggtcatcgtgagccgtatctgggccttctcgcggggcggaccctcatacgtgtccaccacttcgatccggccgtccttgagccggccggcgaaggtgatgtccaggtcggtgatacggcagctcagcgagcggtccagggccgccgcgccgcgtacttccccttcggaggccgccatgttgtccgagagcttgtcgagtgccgcacggcactcctcgatcgtcgccatcgtgatcgacggtaccccagtgcttcggggtagcgtcgaggcatgagcgactcagtgtcagaggccgaggtcccgccacaggcgtcggccacagagcctgcgcgggaggcggcggcacccgaggacgacccggccgcgcccgcgcccctgtacgtggcccgcacctccaccggcaacgccgaggtcgacgcccagctcgaccggctggccgacgccgaccacctcgccacggacggacacgtcgaggtgtacgaggatgtacaccgggggctgcgtgacgcgctcaccgcgctcgacgcccgcccgggacctccggcgccccccacctcgtacgaccgcaggagctgaaccgaacgtggcaggagtggcacgccgacgcctcgacgccgagctggtccgtcggaagctggcgcgctcgcgcgagcatgccggccagctgatcgccgcgggccgggtcaccgtcggtaagaccctcgcgaccaaatccgccacccaggtggagaccgcggccgcgatcctggtcacccaggacgacagcgaccccgactacgtctcgcgcggcgggcacaagctcgccggcgcgctcgccgccttcgtaccgcaggggctgacggtcgagggacggcgggcgctggacgccggcgcgtccacgggcggcttcaccgacgtactgctgcgggcgggggtcgcgcacgtcgtcgccgtcgacgtcggttacggacaactcgcgtggtctctgcagagcgatgaacgcgtcaccgtcaaggaccgtacgaacgtacgcgagttgacgttggaggcgatcgatggggagcccgtggatcttgttgtcggggatctgtcctttatcccactgggcctggtgctgcccgccctcgtgcggtgcacggcccccggggccgatctggtgatgatggtcaagccgcagttcgaggtggggaaggagcggctgggcagtggtggtgtcgtgcgcagccccgagttgcgcgccgaggccgtgcgcggtgtggccgggcgcgcctgggaactgggcctcggggtgaagggcgtgacggccagcccgctgcccggaccctcgggcaatgtcgagtactttctgtggctgcgggccggagcagccgaactggacccggccgacgttgaccgtgcagtggcggaggggccgcgttgactcagacccgagctcgtactgttttcctgctcgcccacaccgggcggcccgctgcgatccgcagcgccgaactcgtcgtacaggggctgctgagatcaggcctcggtgtacgcgtcctcgaggcggaggcggccgacctgccgctgccggacgaggtggagctggtcaaggaggcgactccgcagtgcctcgacggctgtgaactgctcatcgttctcggcggtgacggcacgctgctgcgcggcgccgagttcgcccgcgcctccggcgtgccgatgctcggcgtcaacctcggccgcgtcggtttcctcgcggaggccgagcgcgacgatctcgacaaggttgtcgaccgggtggtgacgaaggcgtacgaggtcgaggagcgcatgaccgtcgacgtcgtcgtgcacaagaacggcgacatcgtgcacaccgactgggcgctcaacgaggccgccgtgcagaaggtctccgccgagcggctcctcgaagtcgtgctggagatcgacgggcggccggtgaccgggttcggctgcgatggcatcgtctgcgcgaccccgaccgggtcgacggcgtacgccttctccgcgggcggacccgtggtgtggccggaggtcgaggcgctgctcatggtgccgatcagcgcgcacgccctgttcgccaagccgctggtgacctcgccgaactcggtcctcgcggtcgaggtccagccggacacgccgcacggggtgctgtggtgcgacgggcggcggacggtcgaactgccgcagggcgcgcgggtcgaggtgcgccggggcgccgtgccggtacggctggcgcggctgcaccatgcgtcgttcaccgaccggctggtggccaagttcgcgctgccggtggcggggtggcggggggcgccgcactaaggccggtccggcggatcaggccggccctgccgtacgaggcctcccgcgaggcctctcacgacgcctctcacgaggtctcatgcggctctcacgcggcgccgacgaccgtgatcgctcggcgccgcatcaccgcacgtaccggcagtccggtggccgacagggtgagcagcagcgtgcccgcgccgatcccggccaggacggtccacgggacgtacgggaccggggagccgaaggccgtgtcgaggatcggtgcgagggtgccgagggcgatcgcggcgcccagcagcagggccgtaccggcgaccacgaccgcctcccaggccgccatggcgcgtatctggcgggtctgcgtgccgatgacgcgcaggagggcgatgtcacggcggcgctcgaaggagatcatgcagagggtgttcgcggcggcgatcgcggcgaaccccgcgtacagcgccgtccccgcgtagtcgagccagacctcgcccgggctgcccggcgaacccgtgcggtgctcggcggtggtgtgcagcgcgatcttcgtcaggccgaagccgacgacgaggacgagcggcacgaccgcggccgagaaacgcctcggctgggaccggacgttgagcatcgcgagccgggcgctcgggccgaggcggccgacgagcgcggagaccaggcgggccgcgggacccacgatgcgcgggcccagcaggcccaccccggcgcagcagaggatgaggaccaggaacgcgccctgcccggccttctccgcgggctggtgggagagcaggacggagagggcgcacgcgcccgcgagcgccgtgaggccgagcggagcccggaggacgcccaggtgccggcggccggccgcggcctcggccagggccctggccgggcgcagcagcgagaagcgcagggaggacagcagggccgcgagcgtcgaggtcaccaccgccacccccaggcacaccggcagggcgagccacgcggggtggaagacgacctcccggggcagcagaccgtgctccttcatgcccgcgcaccacgcccgggccaggaagccgcccaggaggcatccgagcagtgcggccgggaccgaggcggccagtgcctgtccggcgacggcgcggcgcacctggcggggcctcgcgccgatcgcgcggaccatggccagctcgcggtactgctgcgccacggccgtgcccatcgtcgaggcgatcacgaaaatcgacatgtagatcgagccgatcagcaggacggccgccatgccgccgacctcgctctcggcgagctgtgcgcgggcccgtgcgggcagcccgtcggcgctcgtcgccaggagtaccgacgtggccgcgctcaccacggtcgacgcgaacagcgccgcgaccgccgtcccggcgaaggcgggtcggtgcgcacgaagggccgctcgggccaggccggtggtcatgggtccaggctggcgcgacgagtggatcttgcgccatggggagcgccccagggccgacaggggggccgcgccagcaccgggctggggaaaaccccacctccgcggcctttccgcgggccacccccgcgggtgacacggctccggatcgtgctcccgccacctgcgccttcgcaccagcggggcggggcccgtcgcacttccgctccctgacctcgtaaggtcgtgtccgtgttggaggagatgcggatacggtcgctcggagtcatcgacgacgcagtcgtcgagctgtcgcccggcttcaccgccgtgaccggtgagaccggtgcgggcaagacgatggtggtcaccagcctcgggctgctgctcggcggccgcgcggacccggccctcgtgcggatcggcgcgaagaacgcggtcgtggaggggcggatcaccgtacccacgggcgggtcggcggtcgtacgggccgaggaggcgggcgccgaactcgacgacggtgcgctgctcatcagccgtaccgtttccgccgaggggcgctcccgggcgcacctgggcgggcggtccgtgccggtgggcgtgctcgcggagctcgccgacgaactcgtcgccgtgcacgggcagaccgaccagcaggggctgctcaagctgtcccggcagcggcaggcgctcgaccggtacgcgggcgacgcggtcgccgcgccgctcgccaagtacgcgggggcgtaccggaggctgcgcgcgatctcggcggagctggaggagatcaccacgcgcgcgcgagagcgcgcccaggaagccgacatgctgcgcttcgggctcgacgagatcgcggccgtcgaaccgcgcgcgggcgaggacgtggagctggccgcggaggccgagcggctcggccacgcggaggcgctggcgtcggccgccacggccgcgcatgccgcgctcgcgggcaatccggaggaccccgagggcatcgacgcggcgacgctcgtcgcgggcgcgcaccgggcgctggacgccgtacggtcccatgacgcggcccttggcgcgctcgccgggcggatcggcgagatcgggatcctgctgggcgatgtggcgggggagctcgcgggctacgccgacgacctggacgccgatccgctgcggctggcggccgtcgaggagcgccgggccgccctcacccagctgacccgcaagtacggccaggacatcgacggcgtgctggactgggccgagcagagcgccgcgcggctcaccgaactcgacggcgacgacgagcggatcggggagctgaccgccgagcgggacgcgctgcggaccgaactgggcgggctcgcacaggcgttgacggacgcgcggacggaggccgccgaacggttcgccgccgccgtgaccgcggagctggcgtcgctcgccatgccgcacgcgcgcgtgtcgttcgacatccggcagaccgaggacccggagggcgcggaggtgggcgggcgcacggtcgcctacggcccggcgggtgtcgacgaggtcgaactgctgctggccccgcaccccggagcgccgccgcggcccatcgccaagggggcgtccggtggtgagctgtcgcgggtgatgctcgcggtggaggtcgtcttcgcgggcacggatcccgtgccgacgtatctgttcgacgaggtcgacgcgggggtcggcggcaaggccgcggtcgagatcggccggcgtctcgcccggctcgcgaagagcgcgcaggtcgtggtcgtcacacaccttccccaggtggcggccttcgccgaccggcagttgctggtcgagaagacgaacgacgggaccgtcacccgctccggcgtgaaggtcctggagggcgaggaccgcatccgcgaactctcccgcatgctcgcgggccaggaggactcccagacggcccgggcccacgcggaggaactgctggcgacggcccgggcggacggatagcggtccgggcggacggatagccgcccggctgacggccggggcggacgcccggggcggacggatagcgggtccgcggtgacggccggggcggacggttaccgggctgcctgtcagctggggcggacgggggagcggtctgcccgacggctcgggcggcggacgggtggcgggccccgggagggcccgcggatttcggtccctagggtggttcatatgatcacacgaagaggcggctcgttcgggctcgccgcggcggccacgcgcgcgggaatcgccgccctgcgcgccaacgcgcccggcggacgggggcgttgggagcggcagaactacgccgggcggaccgtcgagttgtacgccgggcccgccgccgtcgccggtgccgcgctcggggccgggcgggtccggccggccgcggggttcgtggtccttgccgccggggcgtgcggtgcgtacgacgacgtcgcgggggccggggatccgcggcgcgggttccgggagcatctcgccgcgctgcggaagggcgaagtcaccagcggtgcggtgaagttgttcgggatctccgccgccgggctcgtcgcgggggcgctcctcgaggagcggctcccggacaaggcgctggcgggagtcgtcatcgccgggaccgcgcacttcgtcaacctcgtggacgtacgccccgggcgggccgccggggccgtactggccctgggagcccccgggttgctacggcagggagccgcgggtgagctggccgcggccgccatgggcgcagctgccgccgtcctgcccgacgacctcggcgagcgcgcgatgatcggcgacagcggggcgcacgccctcggtgccgcgctgggcgccgcgatcgtcgcgggcaacggacgggccggactcctcgcccacgccgccgcgttggtggccgcgacggtgtacggggagagggtgagcgagctggcacgctcgatcggcgcgcggaagtgagcgtgcgcccctctgagtgggtgcgcaccgcgtgtacgcgccttggagacccggcaggggtggggcctggcgtcccaccccgcgcgcagcgctcgcactcggtacgcttctcactcatgtgagtgaccgcgtccgccctgaggtgcccggaccaccgtcgcagcgcgcgcccgccggtcccgcaacacccccgcgccctggcatccttgacgggaaccggagcacttcgcgcggtccacccctgccgcacgatccttctgtacgtttcttcgtgaccgtccgacgccgaaccaggagccccggccacgtgagcctcgtgagcagccactcaccgcacggccagtcgccgctgcgcaccgtgcaggtgctcggcggcggcagcgcgggcagcagcgcgcatgtgcgatcgctggcctcgggcctggtcgcccgcggtgtgcgggtcaccgtgtgcgctcccgccgaggccgatcgcacctatgacttcgcaggcgtcggtgccgaacacgtccccgtgccccgcagcggcgaccccgcctccgtcgccgcgctccgggccgcctgcgcggacgccgacctggtgcacgcgcacggactgcacgcctccttgcgcgccgccctcgcgctcagcgggcgccgcactccgctcgtcgtcacctggcacacccgcgcggaggccgagggcacccgggcccatctgctgcggctgctcgaacggcgggtcgccaaggccgccgcggtcgtgctcggcacctcctccgacctggtcgaccgggcccgcagccggggcgcccgggacgcacggctcgccgcggtcgccctcccggtgctccgcaagcccgtcgaccgggacgaccccgaccggctgcgccccaaggcccgtgccgaactcggcgccacgggacggccgttgctcatgtccgtcggctccctggaccggcagcgcggatacgaggtcctgctcgacgcggcgcgcgcatggcgtcggctcgaaccggtgccgctgctggtgatcgcgggggaggggccgctgcgtacggtcctgcaacggcggatcgaggacgaggagctgccggtgcggctcgtcgggcggcgcgacgacgtgggcgagctgctcgcggccgccgatctcgccctcctgaccagcagttgggagtcccgctccgtcctggcccaggaggccctccacgcgcgcgtgccactcgtcgcgacggcggtcggcggcatccccgaactggtcggcgacgccgccgaactcgtgccgtacggcgatgccgaagcgctcgccgtggccgtcgtacgcctgctggacgatcccggccgccgcgagctgctcggcgagaagggcgtacggcaggcggccggctggcccacggaggacgagacggtcacccaagtgctcagtgtgtacgacgagttgacccagccgacaccgctcccctgagctgccccgatccctaggggactaggggacgtgtctgcgggcccgcagcgccaggctcaacgccaggaccgtctgcgggtcgtccaggtccgtgcccagcaactcgccgatccgggcgaggcggttgtagagcgtctgccggttgaggtggagttcgcgggccgtctccgccttgcggcccgcgtgcgccagatacgtctgcagggtcggcagcagcggcggtttggaacggttgtcgtggtcgcgcaggggcccgatcgcgcggtccacgaacgccgccaggtccggatcgtcgcgcagccgccacagcagcaggtcgatgtcgagacgccgggcgtcgtaccaggggcggtcggacagcccctgggccgccgtcgccgtctgcgcggcgtgccgcagccccgccgacgcggccgcccagccgcccgcgaccccgaccaccacgaccggcggctgcgcccccggccgctgcataccggcccgctcgacacccgcccgcagggccgccgcgacgcggtccgccacggccgaccgctcggactccgagcgcagcccgagcagcagcgggacacggccctcgacgggacgtacgccgagcagcaccggtaccccgatcgacgcgagctcctccgcgaccgcgcgcgccagcaccgcccagccgccgcccggggagagcccgtcggcgagccgcatgaccaccggcaggagcggaccggcgcccggcttgaagccgaggacccgggcctgcgcgggggcgtccgcggcgtcgatacggccctccgcgaggtcggtgaggaagtcgccgcgtccgcgtgccgccagctcctcctcctggcgggcctgcatcaggaccacggcaaggctgcccgcggcccgctcggccgcgatccggtgcaccggcgccaccgggttgccgaccggcagcaggaccagccgggcccggaccgagccggcgccaggtccgccgccgggcacgtccacgatcgtcgtcccggccggcggcgcgtccttgtgctgcccgcgcagcccctcccacacctggagcggatccgtgtccgcgggtccggccccggcggcgtacaggagccggccgtccgcggtctccaggaagacggggttgccgctgaagtccgccaggatgcgaagcacctggggcactccgccgccgccaagcagggcctccgtgcagcggcggtggacctcctcggcacgctggagcagcgcgtagtggccgttgacgatctcggtgtgcacctcctccgtgaccgtcacgaagggcacctcccggtgcagctggaccagcgggagcccggcggtcctggccgtctccacgagggccgcgggcagccgggtgaagcgggggcccagttcgaccacgagggccgcgataccgcgctcggccagggtgcggacgaacgcgcgctggtcggcggggcgggtgcccaggccgtagccggtggtcaggagcagctcgccgcccttgaggagcgaggcgatgttcggcacctcgcccgcgtgcacccagcgcaccgtgcggtgcagccggtcggcccccgcgagcacctccggcaggccgctgcgcagcccgggcagctccagggcccgctgcacggtgatcccggcgccctgggtgttctggctgtcgaaacggctgtcggaacggctgtccatgcggtgacgctaccccgacgggcgggccccggccgggccccgcccgtcggcagtccccggggggcccggccgagcctcagccgccgtacgcgcccgaagccgtcagccggagagccgtgtcgatcagcggcacgtggctgaacgcctgcgggaagttgcccacctggcgctggagggtcgggtcccactcctcggcgagcagccccagatcgttgcgcagggccagcagcttctcgaagagcttgcgggcctcgtccacgcggccgatcatcgccaggtcgtccgccatccagaacgagcaggccaggaaggcgccctcgtcgcccggcagcccgtccacgccctcttcctcgcccgaggtcgggtagcgcaggatgaagccgtccggcgtcgacagctcccgctggatcgcctcgatcgtgccgatcacgcgcttgtcgtcgggcggcaggaagcccatctgcgggatgagcagcagcgaggcgtccagctccttggagccgtacgactgcgtgaacgtgttgcgctccttgtcgtagccccgctcgcacacgtcccggtggatgtcgtcgcgcagctcgcgccacttctccagcgggccgtccgcgtcaccggactcgatcagcttgatcgtgcggtcgaccgcgacccaggccatcaccttggagtgcacgaagtggcggcgcggaccgcgcacctcccagatgccctcgtccggctcgtcccagtgcttctccaggtagcggatcagcttcagctggaggagcgaggcgtagtcgttgcgcgccaggcccgtcatgtgggccaggtgcagggcttcgatgacctcgccgtacacatcgagctggagctggtgcgccgcgccgttgccgacgcgcaccggcgccgagctttcgtatcccggcagccagtccaactcggcctcgcccagctcccgttcgcccgcgatgccgtacatgatctggaggttctccggatcgccggcgaccgcgcgcagcagccactcgcgccaggcgcgggcctcctcgcggtagccggtgcgcagcagcgaggagagggtgatggccgcgtcgcgcagccaggtgtagcggtagtcccagttgcgtacgccgccgacgtgctccggcagggaggtcgtcggggcggcgacgatgccgcccgtgggcgcgtacgtcagggccttcagcgtgatcagcgagcggaccactgcctcacggtaggggccgtggtacgtacagtgctcgacccactcccgccagaactcctcggtcgcctccagcgcctgctccggctccggcagcgcgggcggctgcttgtgcgagggctcccacgagatggcgaacgcgatccggtcgcccggggccaccgtgaagtccgcgtacgtggtcagacccttgccgtaggtctcgcaggcggtgtcgaaccacaccgagtcggggccggcgacggccaccgtgcgcccctcgtgcctgtgcacccagggcaccacacgcccgtacgagaaacgcatccgcagggccgagcgcatcggcacccggccggtgacgccctcgacgatccggatcagctgcggggcgccgtcacgcggcggcatgaaatcggtcacccggaccgtgccgcgcggggtgtcccactcggactccaggatcagcgagtcgccgcggtaggtgcgccgggacgctctgggcggctcggcgtcggaggcgtgggccggaccgaggcgccagaaaccgtgctcctccgtgccgaggagtcccgcgaagacggcatgggagtcgaatcggggcaggcacagccagtccactgtgccgtcctggcagaccagtgcggcgatctgcatgtctccaatgagtgcgtagtcttcgatgcgcccggccacgtgcaactccagtcgaacggccacgtcgcccctcaaaaaggggcggtcgctctttgcggtcaaggggtcggtgtgaaaagtcgtcgttcaccgacccaacggaaatggtgcagtcgatgttcaacgaactgacgagctcttgttgttccggagacgggcgggggtgttgccgtttcccggggtgctcggcagcgagtgtccgagcaggatacgtcgcacctcgatgatccgcgtgccgctcccggcaacgcgactgcgccgaacgagtgagcaacgggtgagtgtcacgtgacggtcgtacgtccgtgtcgacgtatgtgcagagcgtggccggaagcagcctccccgcgtcgctgataccctggtagcccgtggaccggtgggcgccccaacgagaataagggtcccccgtaccgcagcgacggcacctccggaaacctccggttctggcagccgcaccgcacctcaagaccgcgaccacgggagccccctcttggccatgccgcccaaatccacgacgaccaagcacatcttcgtcaccgggggtgtcgcctcctcgctcggcaagggcctcaccgcctccagcctgggcatgctgctcaaagcgcgggggctgcgggtcgtgatgcagaagctcgacccctacctgaacgtcgacccgggcacgatgaacccgttccagcacggtgaggtgttcgtcaccaacgacggcgccgagaccgacctggacatcggccactacgagcgcttcctcgaccgtgacctggacggttcggccaacgtgaccaccgggcaggtgtactcgacggtcatcgccaaggagcggcgcggcgagtacctgggcgacaccgtgcaggtcatcccgcacatcaccaacgagatcaagcaccgcatccgccgcatggcgacggacgaggtggatgtcgtcatcaccgaggtcggcggcacggtcggcgacatcgagtcgctgccgttcctggagaccgtccgccaggtccgtcacgaggtcggccgggacaacgtcttcgtggtccacatctcgctcctcccgtacatcggcccctcgggtgagctgaagacgaagccgacccagcactcggtcgccgccctcaggaacatcggtattcagccagacgcgatcgttctgcgctgcgaccgcgaggtccccaccgcgatcaagcgcaagatctcgctgatgtgcgacgtcgacgaggccgccgtggtcgcctgccccgacgcccgctcgatctacgacattccgaagaccgtgcacggcgagggcctggacgcctatgtcgtccgcaagctggacctcccgttccgcgacgtggactggaccacctgggacgacctgctcgaccgcgtccacaagccggaccacgagatcaacctcgcgctggtcggcaagtacatcgacctgcccgacgcctacctctcggtcaccgaggcgctgcgcgcgggcggcttcgccaatcgcgcccgcgtgaagatcaagtgggtcacctcggacgactgcaagaccccggccggcgccgcggggcagctcggtgacgtcgacgcgatctgcatcccgggcggcttcggcgaccgcggtgtgtccggcaaggtgggcgcgatccagtacgcccgcgagcaccggattccgctgctcggcctctgcctgggcctgcagtgcatcgtgatcgaggcggcccggaacctggccgacatccccgacgcgaactcgacggagttcgactccgccaccggccaccccgtcatctccaccatggccgagcagctcgacatcgtggcgggcgagggcgacatgggcgggacgatgcgcctgggcatgtacccggccaagctcgccgagggctccatcgtgcgcgaggtgtacgacggcaaggagtacgtcgaggagcgccaccgccaccgctacgaggtgaacaacgcctaccgcgcggagctggagaagaaggccggtctgcagttctccggcacgtccccggacggcaagctcgtcgagtacgtcgagtacccgcgcgaggtgcacccctacctggtggcgacgcaggcgcacccggagctgcgctcgcgcccgacccgcccgcatccgctcttcgcgggcctggtgaaggccgctgtggagcgcaagacgggcaagtagcacaaggttgtacggttgccggggtgcgtgtctttcgggacgcgtgccccggctttcgtacgtgcgtgggaggaacagggcgacatgaccatcaaggacacccccgaggagtgggaggtcagggcgaccgagacccccttcaagggcaacaagacctccgtccgcaccgatgacgtggtcatgcccgacggctcggtcgcccgccgggactaccaggtccaccccggctcggtggccgtggtcgccgtcgacgacgagggccgcgtgctggtcatccgccagtaccgccacccggtgcgccacaagctctgggagatcccggcgggcctgctcgacatccccggcgagaacccgctgcacgcggcccagcgcgagctctacgaggaggcgcacgtcaaggccgaggactggcgcgttctcgtcgacctctacacgacgcccggcggctgcgacgaggccgtgcgcatcttcctcgcccgcgatctgtccgaggccgaggggcggcgcttcgaggtcgaggacgaggaggccgacatggagctgtcgcgcgtcccggtcgacgagctgctgcgcggtgtgctcgccggcgacctgcacaacaactgcctcgtgacgggcgtcctgtcactgatcgcggcccagaacggcgagggactcgacgcgctgcgcccggccgacgcgccgtggcccgcgcgccccttcgaggcctgaccccccgccgacggcattcgtcctacgatcgcctgatccgatcgggggacgtgcccgccgtgctccgccggaatcgtcgcagagcgtgaactaggctctgaaaacgacccgaccggagtcccggcgggcccgtgtgcgcagtgggacgggagcgtgacccgtgacggatcaggcggtggacacaggcggctctcagctgccgggaaacgagcagcggcccgctgccgcccccgctcccacggtcagtcagttcctcggccgcacaagagagttgaaggaactccgcgccgacatcgagcgcgcgggtctcgacaccctctccggccgcaaggccccccgcgcgcgggtgctgctcatcgcgggccggcccggctccggccgcaccgcgctcgccgaggagctcgtacgacaggttgcggaccgttaccgggacggggtgctgcgcgcccggctcaccgagcccgacggcacgcccgtcccgaccgagcgcacggcgcgcgagctgctggcggccctggaggtggccacgccccccggcgccgccgaggacgacctcaccgaggcgctgcgcgaggccctcgccgaccgccggacgctgctcctgctcgacgacgtggccgccgccgagcaggtcgacgccttgctgcccggcacccccgactgcctggtcgtggccgtctccgagggccccctgaccggcatcgcggacgtccggccgtgcaccctgggcggcctcgacacgaagtccgcgctggagctgctgggccgcctcaccggggcggtgcgcatcaccgtcgacccgcgagccgccgaagggctcgtcgaggagtgcgccggccagcccctcgccctggtcctcgcggggagctggctggccgcccgcccccaggccgccgtcgccgacctcgccaagcagctgcgctccgagggcgacgagggcccgccgacggcacgcctcttccggctcgcctacgccgggctgccggccaccgcccagcggatactgcgcctgctctccctcgcccccgcgggcctcgtcgacccgcacaccgcctccgcgctcgccggctgctcggtgagcgcggcccacacgaccctcgacgacttcgccgcgctcggcctcgtgcggctgctggaatcccccctgccacagtacgaggtgcccggctccctgctgccgctgctgcgcgccctcgccgagtcacgggagcgtcccgccgagcttcagctggcccgcgcccggatgctcgagcggaccgtgcggctgctgcagtcctgccgggccatcaccgagacggacagcatcgaggcgcgcgagaagctcctcgggatgccccgcacgctgcgcttcccgaacccccgggcggccgccgactggctgcgcgtgcggcagcccgcgctgttggccgccgctcgcagcgcggtcgccgacggggagctggacaccctggcccggcggctcatgtcccagctggtgcgcgcgatggtcgcccacttcggcacgcaggcgtcggcgccggagctgtacggcatccaccgcctggtcctcgacgtcgccgagcgccggaacctgccccgtgagcaggccgcggccctgctgaacctcgccgacctggacacgcggaccggccgcacgaccgaggccctcgcccgctaccgggccgcgctggacgccggccgcgaggcgaacgatccgtatgcgaccggccgcgcgatggaatccgtaggcggcgcccaccaggaactcggggactacgaccgggccgccgactggtacggccgggcgctggcccagcggctggcgcgcgacgagcgcgtggacgcggcgcggctgtacggccgtatcgccaccgcgcacacctatgcgggccgctacggcgaggcgctgcgcaactggcgctcggcggtcgccgggcaccgcaagaacggcgatgtggcggcccaggcgcgggcgttgagcgagctggcccgggtccaggagtacgcgggccgccccgaggagtcgctgcgcacctgccaggaggccgtggagtgggcgcgccgggccgacgacgtacgtctgcaggccgcgctccagctccggctggccgacaccctggagcacctcggcgaccccgcggcggccaagctgcaccgcggcgcggccgagcggatgctgggagaagagctcctggagagcgactcaggtgcggaacaagcccctaacgcctgcgaaatccgcagtgcatccagcaaagattgatgcattgaaaggctagacagcgggaacaccttcattagactggctctgccgcaccttctcctgcggtgtctcccggtgtgcccccatgcatccgggtatgtcatgcaataccccacaccccctgagccaaggaccgtgatcgacgtgaaggtcggcatcccccgcgaggtcaagaacaacgagttccgggtggccatcacccccgcaggcgtgcacgagctggtgcgctacggccaccaggtcttcatcgagcagaacgccggcgtcggctcctcgatcacggacgacgagtacgtctccgccggcgcgcagatccttccgaccgccgacgaggtctgggccatcgccgacctgctgctcaaggtcaaggagcccatcgccgaggagtaccaccgcctccgcaaggaccagacgctcttcacctacctgcacctggccgcctcccaggagtgcacggacgccctcctggagtccggcaccacggcgatcgcgtacgagaccgtcgagctgcccagccgcgccctgccgctgctggccccgatgtccgaggtcgcgggccggctcgccccgcaggtcggcgcctaccacctgatgcgcgccaacggcggccgtggtgtcctgccgggcggtgtcccgggtgtgctccccgccaaggcggtcgtcatcggcggcggcgtctccggctggaacgccgcgcagatcgccatcggcatgggcttccaggtgaccctgctcgaccgtgacatcaacaagctcaaggaggcggacaagatcttcggtacgaagatccagaccgtcgtctccaacgccttcgagctggagaaggcctgcctcgaggccgacctcgtcatcggcgcggtgctgatcccgggtgcgaaggccccgaagctggtcaccaacgagctggtctcgcggatgaagcccggaagtgtccttgtcgacatcgcgatcgaccagggcggctgcttcgaggactcccgtccgaccacgcacgccgagccgaccttccgggtccacaactcggtcttctactgcgtcgccaacatgcccggcgccgtccccaacacctcgacgtacgcgctgaccaacgccacgctgccgtacatcctggaactggcgaaccgcggctgggccgaggcgctgcgccgtgaccccgcgctcgccaagggcctcaacacccatgacggcaaggtcgtttaccgcgaggtcgcggagtcgctcggcctggagtacgtcgagatcgagtccctgctcggctgagtcccggcgtggcgaggagtcgacttctcggctcctgagtcgacctgggagtcgacttccgagctgacaaaaggcgatacgtcaacacaggtcgtcaacaccgcgcacccggccggaccttgctcgacaaggcccggccgggtgtgtgtcgggtcactttgcgacactcgatcaactcgccgcgaacgtaactcttcgaccgattcgcacacccgtgaaacctgccgtgcgacgcccttacgcccttgacagagggatgttcggtcgccgacacatcgggtcgggtccggcggattgtgttgctgcggaccggtgacacgccatagagtcgccaatcgtcggcatggtgccacgctgacctatctagaagtttcctggtcaccaaggaggtaagacgacttgtgaatgagtcgacatttactcccgggggtggtcaaccaggaatgccggcgcggggccagggccccacggggctcgaggctgtcggctccgtcgctgtccgaaccttcgcagcccacaagagtccccggatgactcagacagcacacccgagcatggatggccatcacgtgaacgccatggccggcaacggaagtggcgagaaccgcacccacttcgccgactacgacgaactgcccgaggggcacttctacgaccccgacgccgagtacgagcccgaccccgagtacgcggccacgctcgcgcccgacgctgcccgccagcgccgtgagcgcgtcggcccgaccggccgcccgctgccgtacttcccgatcccgggcccgctgaccgaccacggtcccgcgaagatcatcgcgatgtgcaaccagaagggcggcgtcggcaagacgacgtcgaccatcaacctgggtgccgccctcgcggagtacggccgccgggtcctgctcgtcgacttcgacccgcagggcgcgctgtccgtgggtctcggcgtcaacccgatggagctcgacctcaccgtctacaacctgctcatggagcggggtatggcggccgacgaggtgctcctgaagacagcggtcccgaacatggacctgctgcccagcaacatcgacctgtccgccgccgaagtgcagctcgtctccgaggtcgcgcgcgagtccacgctccagcgtgcgctcaagcccctgatggccgactacgactacatcgtgatcgactgtcagccctcgctcggtctgctcaccgtcaacgccctgacggccgctcacaaggtgatagtgccgctcgagtgcgagttcttcgcgctgcgcggtgtcgcgctgctcaccgagaccatcgagaaggtccaggagcggctcaaccccgagctggagctcgacggcatcctcgccacgatgtacgactcccggaccgtgcacagccgtgaggtcctcgcgcgcgtggtcgaggcgttcgacgatcacgtctaccacacggtgatcggccggaccgtgcgcttcccggagaccacggtcgccggtgagccgatcacgacgtacgcctccaactccgtcggcgccgccgcctatcgccagcttgccagggaggtgctcgcccggtgtcacgccgagtgagtctgccgggggccgacgaactgttccgtaccaccgggggaatggggctccaggcgtccacccccaggcgccaggccaacggcgaggcccgagtgccggctccggcgggcgagagcgacgccgccgccgccgcggagaacacgccggtctcggtgcccgtgcagggcggcgacggcgagggtgacgaacacgtcgcggcggacaccgccgaggcggaggcgggggagtcccgtacgcggtccggcggcgcggagcgctccgggcggcgtcagccgccgcaggaaggttctgcctcgccctcgtcgcagccgcaggcccagccgcgcaagcgcgggcggtccggcggacggcggcccagcggacgggagcggcacgacgagaagatcacggtgtacgtgtccgccgaggaactgatggatctcgagcacgcacgtctggtgctccggggtgagcacgggctcgcggtcgaccgcgggcggatcgtccgcgaggcggtcgccgtggtgctcgcggatctggagtcccgcggggacgcgagcattctggtacgccggctgcgtgggcggtaggcggtagcctgcgagggctatgacctcgtacgacccctcggtccccgcttccggccctgccggtcgtcggcgtgtgctgggacgggggcccggggccgtcgaacggcccgcggaaccgcccgtggcgccgtccgcggaaccacccgtggaggcgccgcccgcgcctgcgccgacggtggagcagatcgaaccggaggcggagcctgcggaggcggccccgcctccggctccacccgagccccaagccgatccccccgcgccgccggcccctcgggggcctgaggccggtcgtcccgcgtcgtcggcgctccgggagcccgaggccgagcaacccgcgccgtcggcccctcgggagtctgaggccgagcaacccgcgccgtcggctcctcgggagtctgaggccggtcgtcccgcgtcgtcggcgctccgggagcccgaggccgagcaccccgcgtcgtcggctccgcgcgagccccaagccgagcaccccgcgtctcccgccctcccggcgtccccgccggggtcgggcgggcccgaggaggccggtgacggtgtcttcaaggtgcggctcgcgaacttcgagggccccttcgatctgctgctccagctgatctcgaagcacaagctcgacgtcaccgaggtcgcgctctccaaggtgaccgacgagttcatggcgcacatccgggccatgggaccggactgggacctcgatcagacgaccgagttcctggtcgtcgccgccacgctgctcgacctcaaggccgcccgcctcctgcccacggccgaggtcgaggacgaggccgacctcgcgctgctcgaagcgcgggacctgctgttcgcgcgactgctccagtaccgcgcgtacaaacagatcgccgacatcttcaaccgcagggtggaggaggaggcccgccggtatccacgtaccgtcggactcgaaccgcaccacgccgagctcctgcccgaggtcgtcatcagcatcggggcggaaggcttcgccaagctcgccgtgaaggcgatgcagccgaagcccaggccgcaggtgtacgtcgaccacatccacgccccgctggtcagcgtgcaggagcaggccgggatcgtggtggcccggttgcgggagctgggcgaggccagtttccgcacactcgtcgaggacacggacgacacgctcaccgtcgtcgcccggttcctcgcgctgctggagctgtaccgcgagaaggccgtcgccctcgaccaggagaccgcgctcggcgacctgatggtgcgctggaccggcggcgaggacggcgagcagccgaaagtcaccgacgagttcgaccgaccgccccaggaagccaaggaggaccaggcgtgagcgaggagatcaccgaagtcgcggcggacctcgacagcgtcgcggggctcgatctgaagcccgcgctggaggccgtcctcatggtcgtggacgagcccgccaccgtggagcacctcgcgaagatcctggagcggcccaagcggcagatcgcggatgcgctgcgcgagctggccgacgaatacaccgggcaggggcgcggcttcgagctgcggctgatcgcgggtgggtggcggttctacaccaggccaaagtacgcgacggccgtggagcgcttcgtgctggacggccagcaggcccggctcacccaggcggcgctggagacgctcgccgtggtcgcgtaccgtcaaccggtcagccgttcgagggtctccgccgtgcgtggagtgaactgtgacggggtgatgcgcaccctcctgcaacgcggtctggtcgaggaggcgggcgcggaacccgaaacaggtgcgatcctgtacaggacgacgaactacttcctggagcgaatgggcctgcgtggcctggacgagctcccggagctcgcgcccttcctccccgaggcggacgcgatcgaggccgagacgcaggaaggtgtgccgtcgttcgatccggacgcaccggagacagacgacccgacgacgacggaactttgatgcgaagcagtggcagcggcaagagcggcggacgcggtaactaccgtggcgccggcaacgacagggaccagaagcaggggcaggggcagggtcgccccagcaagccccgccccgaggagcgccgctacgacgtgggccccggcgccacccaggacggcccgaaggccgggcgcggcaacgcggcgcgtggcggtgccaagggcggccccaagcagagccggcagcgcggcggccgtacggagcccgcgcgctcccgtgagtacgagacgcgggccgaggagcgcaaccgggaccggtacgcgggcaagccggaggtcaagacgcccaagaccttcccgggcgccgagcaggagggtgagcgcctgcagaaggtgctcgcgcgcgcgggctacggttcgcggcgttcctgtgaggagctgatcgagcaggcccgggtcgaggtcaacggcgagatcgtcctggagcaggggctgcgcgtcgacccggagaaggacgagatcaaggtcgacgggctgaccgtggccacgcagtcgtaccagttcttctcgctgaacaagcccgccggtgtcgtctcgaccatggaggacacggagggccggcagtgcctcggtgactatgtgacgaaccgcgagacgcggctcttccacgtggggcggctcgacaccgagaccgagggcgtcatcctgctcaccaaccacggcgagctggcgcaccggctgacccaccccaagtacggcgtgaagaaggtctacctcgcgcacatcgtgggcccgatcccgcgcgacctgggcaagcggctcaaggacggcatccagctggaggacgggtacgcgaaggcggaccacttccgggtcgtcgagcagaccggcaagaactacctcgtggaggtcaccctgcacgaggggcgcaagcacatcgtgcgccgcatgctcgccgaggccggcttccccgtcgacaagctggtgcgcgtcgccttcgggccgatcaccctgggcgaccagaagtcgggctggctgcgccgtctgtccaacaccgaggtcggcatgctgatgggcgaggtcgacctgtagccccgctgttctcatcacgtctgccgagccgcgggcgtccggattttccgggcgcccgcggcttgtcatatcccgcccggcctctttatagtcgagatgactattggtcgaagtgactattaagccgtggctgtcaaggcgcggctgtcaacgggggcggggggcgggcatgtgcgcatcggagaacactccacgcgcacccggcggccgtgcccccgagggctacgacaagcacgcgttcgagcccttcgctgtcaccgtcgacctggccgtcctcacgatccgcgcgggcgtgctccaggtgctgctcgtggaacggggacaggagccgtacgcgggccgctgggcgctgcccggcgggttcgtgctgccgcacgagtccgcggaggccgcggcccggcgcgagctggccgaggagacgggcctggcggatctgaccgggctccatctggagcagctgcggacctacagcgaaccggaccgggacccgaggatgcgggtcgtctccgtcgcgtacaccgcgctgctcccggaccctcccgagccgcacggcggaggggacgcggcgcaggcccagtggctgcgctacaacgccctcggcccgctcgccttcgaccacgaccggatcctcgccgacgcccacgaacgcgtcggcgccaagctcgagtacacgtgtctcgccacgtccttctgtccgcccgagttcacgctcggcgagttgcagcaggtctacgagaccgtgtggggcaccgcgctcgaccggcccaacttccggcgcaaggtccttgccacgccgggcttcgtcgaacagatcccgggcgccgcccgcctgaccggcggccgcggaaagcccgccgcgctctatcgcgcaggcggtgcgaccaccctgcacccgcccctgctgcgacccacttcggaaggacggccctgatgaccaccacgaccctcacgaaacgcgccgccaccggttccctgctggggctcgccctcggagacgcgctcggcttcccgaccgagttcaacgacgtgccgtcgatcctcgccaagtgcggcccgtggcgggagatggagctgccgagcccggcgatcgtcacggacgacacacagatgacgctggcgctggggcggggactgcggtcggcgatggaccgcgggctgctcgagccgcagcggatggaacggccggtgcgcgaggagttcgtggcctggtacgagtcgcccgagaacaaccgcgccccgggccgcacctgcctggtcgcctgcaacctgctgaagaccgaggggcgtccctggcagctggccagccagatcggttccaaggggtgcggggccaacatgcgcgtggcgcccgtcggtctcgtccgcggcctgagcgacgaacagcgggccggtgccgcgcagttgcaggccgcgctcacccacggccatcccacggcgctcgccgcgtcggacctgaccgcccacgcggtccgcctgctcgtccagggagtcgagccgaccggactggtggggctgctgcgctcgtacgcgtacgagaaccgcacccgctaccaccggcgctggctcggcgacctgtggaccttcagccaggaccccacgccggagcacttcatcgcgcgtggctgggacgagtgcctggagatactcggccgactccagcaggccgtgtgcaccgtgtcgcccgaggtcgacccctgcctggccaccggggagggctggatcgcggaggaggccctggccaccggtctgctgtgcttcctcctcttccccgaggagccgctgaccgccctgcgccgggccgcctgcacctccggcgactcggactccatcgcctgcctcacgggcgcgttcgccggcgcccacctcggcgtcgacgcctggccgaccgaatgggccgaccgcatcgagtaccggggtgatctgcagacgctcggagcgctctgggacgcttgacggatgcttgacgccctcgacatcgacctggcgcccgtggtggcggcgcagcccgacccggtgctgttcgccaccgtctccggagcgcacctgtacggtttcccctcgcgcgactcggacatcgatctgcgcggcgcccatctgctgccggcggccgagctggtcgggctgcgggagccgacggagacccggtcgcgcatgtgggaccgggacggcgtcgagatggacctggtgacgcacgatctgcgcaagttcgtccggttgatgctgcggcgcaacggctatgtgctggagcagctgctgtcgccgctcgtcgtgcacaccagcgacgcgcatcgggagctggccgagctggctcccggggtgctgacccgtcaccacgcccaccactaccggggcttcgcgacgacgcagtggcggctgttcaagaagaccggtgaactcaagccgctgctctacaccttccgcgtgctgctcaccggcatccacctcatgcgcagcggtgaggtgcaggcccacctgcccacgctcgtcgggcaggtcgacgctcccggctggctgccggagctcatcgcggccaaggcggaacgggagcacggcgccgccgatgtcgaccaggcgcgcgtacggctcgatgtggagcggttgcacgggctgctggacgaggcggagggcgcctcacggctgcccgacgccccgaccgcgtacgacgccctgcacgacctcgtcgtccgggtgcgcctggagggctgaggcgtggcgggtgcggatcaggaagtcctcgacgcggcgtcggtccggttccgcgggcagcggggtgtgccgggccgcctcgtccgtctccgccgccaggcgggtcatccgggactcgacctcgggccacgggacctcgccccgcttcaccgcgaggaggggctcgcgccggtcgcccacgtcgatcgtcagcgagcccgtgcgcagcaggtcccggcagctcgtcaggaggcgcagcaggtgcatggcgtgcttccagcgcggggcgccgtgggcacgcacgtcggcctccagcttcttgcgctggctcagggcgtagcgcgcgaacgtctcgtgcgtctggcgggagaggaacgcctcgcgcagggcgaggagttcacggcccgtcgcgtcggcctgctccaccagcggtgagtgcaggcactccaggatgttcgggttcgcccgcagcgccagctcgcagaagcgctccagctcccagctgaactgttcctccgccgggccctcgacgtgcgagggcggcttggcgaagctccagaacaggggagtgggggcgaggaacacgcctcggcggtccgtgtcgctgccgtccgtcgccagaccgaaggcgcgcgagcccatcacgcaggagtagatcgtgtggtggcggaccaggcgcgcgcccaggtccgggtctgtctcgggcatggacggagcgtacgtgtccgttcacgtcaggcggatcgaatttccctccaccgtgatcttctcggcaggcagcggacgcggcgcggggccggccgccacggaggcgtcggtgatgcggaacttgctgccgtgacagggacagttgatggtgccgtccgagacggtgctcaccgtgcagccctggtgcgtgcagaccgccgagaaggccttgaactcgccctgctcgggctgggtcaccacgaccttctcgtccttgaagatcgtgccgccgccgaccgggatgtcggaggtcttggccagttccggcccggcggccgcgccgccggacgccgtggcggacgccgtgccggacgggctgccggacggggtaccggacgtcgactggctggagctgttgttgctgtcgccgtacttgctgcacccggcgagaagcgcgaccgcgccgcccgtcccgagaagggtgcgccgtgtcgggcggatcgtcatgtcgtcactccgaacgtacggaagaaccagagggcggaggtcagccagatgcctgtgagcaccgcgaagacgagtccgccgacgatcggcagcagccagccaggcagtcgctccgcacgaagcaagagcattttggcactaaatgcaccaaagaagaagcaacccaggagcgagtgccacagcacgcgcggttcgtacgtctgatagcccagcgcgtacaggcagtgcaccgcgaccggcaccgccaccaggaacgccacccgccccgaccagcggtgcagcaccggcgcccagctcgggcccggcagcttgccgtacatcatgagtgcggagacgagctgcacgagtgcgaagaagaacgccgtggtcgccagccacgacttcaccgcgcccgtactgctgaagcccgccaggttgaaggcggtcccggccgggtcgtgcacctttccgtacgctccgaggcccaccgcgaccacggccgcgaccagtgcggggacgaggaagcgggcggcgcccgggccgcggtgggcgggctgggacggagggaagctctgagtggcggcgttcggatccacgggcatgtccggctccctgggcagggggatgtcgaaggacggggtcagggggtgacggggcgggccgtgagctgctggccgtcgaccgtcaccgcaccggtttccgggtcgatccggggggcggcctgcggcttgccgtcccggttgaggatgccgacctgcttgccgcccggcagcacgatccagccgccgtcgatcttggcgccgcgcacgctggccgtcgcgcggtacagcccggacggcttgagcgccttgtcggcggtgaagccgtagcgggtgccgcccaggtcgacggtgccgcggatccgcttgccctccttgagcttgccgttcagctcggcgccctgcttgccggtgagcttcatcgtgccgtcgtccttgacgtcacccttgagccacgactccttgttccggccgtcgcagaagtacgcgatcgccttgccgtcgcgcagggacacggcgaccgccgaggagttgtcgtcggtacggcccgcgtagtcggcgttcggcagggggctggtggacggcgacgggctgggtggcggagtcgaccgctcgggccgcgggctcggtgagaccgtggcggcgggcggctcctcctggtaggacgacgtgctcttcgtccccgtcatcgcgttcaacgacagcatgaacacggcgagcagcagtcccgcgagaagggtgaaaaggggtccggagcgcttcattacgggcctcccccgaggcgagtttcctgccatgagagcggactcgcggcccccgcgtccagaggcgcaccggggcgttctcgtccgaactggtggaacagggcgaatcgggtgacacgggaagggtgaggccgggcccggtgacggcgtctcggcagacgggcgccacgcacccgtgcgtggcgggctgactaggcttgtggtgaaagagccgtagtacgtacatcagcgaggagcagcactgtggcggtacgagcggtccggggcgccgtccaactggagcgggacgcggccgatcacatggacgagcaggtcagcgagctgctcaccgccattttggagcggaacgggctgaccgcggacgacctgatcagcatctggttcaccgcgacgcccgatctgcacagcgacttcccggcggccgccgcccgcaagctcggcatcgtcgacgtgccgctgatctgcgcgcaggagctggacatcaagggcgcgatgccgcgtgtcgtgcgggtcctcgcgcacatcgagtccgacaagccgcgggccgagatcgcccacgtctacctgggtgccgcgggcgcactccgcaaggacatcgcccagtgaggaccgcactcgtcatcgggaccgggctgatcggtacgtcggcggccctggcgctggccgggcgcggcgtcgtcgtgcacctcgccgaccacgacccggaacaggcgcgtacggcggcggcgctcggcgccggcacggacgaggcgcccgaaaagcccgtcgacctcgtcatcgtggcggccccgcccgcgcacgtggcggccaccctcgccgacgccatgcggcgtggcctggggcgcggctacctcgacgtggccagtgtcaagggcggtccgcgccgcgagctggaggcgctcggcctcgaccggtccgtcatgtcgacgtacatcggttcgcaccccatgtcgggccgcgagaagtcgggccccctcgccgcgaccggcgacctcttcgaggggcgcccctgggtcctgacgccgacccgggacacggacaccgaggtgctgaacctggccctggagctggtgtcgcactgccgtgccgtgccggtcgtcatggacgccgacgcccacgaccgggccgtggcgctcgtctcgcacatgccgcacctggtgtccagcatggtcgccgcccggctggagaacgccgaggagacggccgtacgcctgtgcggccagggcatccgggacgtgacccgcatcgccgcgtccgacccccggatgtggatcgacatcctgtccgcgaacccgggcccggtcgccgacctgctcaccgacgtgtccgccgacctcgacgagacggtgcgggccctgcgctccctccagtcctccgacgaggcgaagcggcgtgcgggcgccaccggcatcgaggacgtcctgcgccggggcaacgcggggcaggtccgggtgcccggcaagcacggcagcgcgccgcggacctacgagaccgtggccgtcctcatcgacgaccagccgggccagctggcccgtatcttcgcggacgcggggctggccggggtcaacatcgaggacgtacgcatcgagcacgcgaccgggcagcaggcgggtctggtccagctgatggtggagccgaaggaggcgccggtactgagcgcggcgctgcgggaacgaggctgggcgttgcggcagtaggggccgccgcgcgacgggcccgggaagggccagtaatacggggtccgtggagccagtaaccttgtgcggggcgcgctcgcgtcccgcacacatccaccaccccgcaccaggaaggtgtccccaccgtggaaaacggcgccgcccggaccgtaccggcagtgattgtcgccatcgacggcccctccggcacgggcaagtcgagcacctcgaaggccgtggccgcgaagctcgggctgagctacctggacaccggtgcccagtaccgggcgatcacgtggtggatggtgagcaacggcatagacatcacggacccgaccgcgatcgccgccgtggccgggaagccggagatcatctccggcaccgacccgtccgcgccgaccatcaccgtcgacgggaccgacgtcgccgccccgatccgcacgcaggaggtcacctccaaggtgagcgcggtcagcgcggtgcccgaggtacgcacccggatcaccgagctgcagcgctcgctcgccacgtccgccgagaacggcatagtggtggagggccgtgacatcggcaccaccgtgctgcccgacgccgacctgaagatcttcctcaccgcctccccggaggcgcgtgccgcccgccgcagcggtgagctgaagggcgccgacgtcaacagcacgcgcgaggccctgctcaagcgggacgcggccgactccagccgcaagacctccccgctcgcgaaggcggacgacgcggtcgaggtggacacctccgacctcacgctccagcaggtcatcgagtgcgtcgtcaccctcgtcgaggagaagcgggccgcgaagtgaccgaggcaccatcggtacgcggcgccgaggtcgggcggcgcatcggcgtcggcctgatgtacgggctgttcaagccgcgcgtcctcggggcctggaaggtccccgcgaccggcccggtgatcctcgccgtgaaccactcgcacaacatcgacggcccgatggtcatgggcgtggcaccccggccgacccacttcctgatcaagaaggaagcgttcgtcggcccgctcgaccccttcctgctcggcatcggccagctgaaggtggaccgcgagaccaccgaccgctcggcggtcacccgcgctgtcggcgtcctcgacaacggcggcgtcctcggcatcttcccggagggcacccggggcgagggcgacttcgcctcgctgcgcgccgggctcgcctacttcgcggtccgtggcggcgccccgatcgtcccggtcgccgtcctgggaagcaccgagcggcgcggacggttgatcaaggcgctgcccccgctgcgcagccgggtggacgtcgtcttcggcgaccccttcgaggcgggcgacggcagcgggcgacgtacgcgcaaggcgctcgacgaggcgaccgtgcgcatccagaagcagctgagcgcacacctggaaaacgccaggcgtctgaccggacgccgggaaaacgccgggcgccccaccgggcactaggcgacacttgagtagtggatctcccgatctgcgggcggtccaccgatcaccacgaatgaacgacgaggtacggacttcatgaacgaccacatccagcccgagggctcggccgagcacgagcacggggcgcttggcgatgccgagtacgcggagttcatggagctcgccgcggaagagggcttcgacatcgaggacgtcgagggcgcgatcgacgaggccggtcacggcccgctcccggtcctcgccgtcgtcggccgcccgaacgtcggcaagtcgaccctggtgaaccgcatcatcggccgccgtgaggccgtcgtcgaggacaagccgggcgtcacccgcgaccgcgtcacctacgaggccgagtgggcgggccgccgcttcaagctcgtcgacaccggcggctgggagcaggacgtcctcggcatcgacgcctccgtggccgcgcaggccgagtacgcgatcgaggcggccgacgcggtcgtcttcgtcgtcgacgccaaggtcggcgccaccgacaccgacgaggcggtcgtacggctgctgcgcaaggccggcaagcccgtggtcctgtgcgccaacaaggtcgacggccagagcggcgaggccgacgcctcgtacctctgggccctcggcctcggtgagccgcaccccgtctccgcgctgcacggccgcggcaccggcgacatgctggacgccgtgctggaggcgctgcccgaggccccggcgcagagcttcggcgccgcgatcggcggcccccgccgcatcgccctcatcggccgcccgaacgtcgggaagtcgtcgctgctgaacaaggtggcgggcgaggaccgcgtggtcgtcaacgagatcgcgggcaccacccgtgacccggtcgacgagctgatcgagctcggcggcgtcacctggaagttcgtcgacacggcgggcatccgtaagcgcgtccacctccagcagggcgccgactactacgcctcgctgcgcaccgcggccgccgtcgagaaggccgaggtcgccgtcatcctcatcgacgcgtccgagtccatctccgtccaggaccagcgcatcgtcacgatggccgtcgacgcgggccgcgcgatcgtcctggcgttcaacaagtgggacaccctcgacgaggagcgccgctactacctggagcgggagatcgagaccgagctcctccaggtggcgtgggcgccgcgggtgaatgtctcggcgcgtaccggacgtcacatggagaagctcgtcccggcgatcgagacggccctggacggctgggagacccgggtcccgaccggccgcctgaacgccttcctgggcgagctggtcgccgcccacccgcacccggtccgcggcggcaagcagccccgcatcctcttcggtacgcaggcgggcaccaagcccccgcgcttcgtgctcttcgcctccggcttcatcgagcacggctaccggcgcttcatcgagcgccggctccgcgaggagttcggcttcgagggcacgccgatccacatctcggtacgggtgcgcgagaagcgcggcaacaagaagaagtagcggctacggcggcacgcagaaggggcggtccctcccggggccgccccttgttcggtatgggggtcatcggtcacatgcccctgcgcggggcgggcggcagcgccgccgggacgtgatgcatccccgtggcgtgctggcgcgtgcccggctgccagatggcggtcgtggcgagatgcccggtcgcgtgctggggggtgccgtggcgcgcgccgtacccgaccgcgccgtacgagcccgtggtgtacgagccagtgcccctcggagtgttggcgaaggcggtgaagcccagatcctcctcgccgctgcggtctccgggcagcgatcggaacgatctgacgtactcggcgtagagcgcgtcgtagatcggggtggccgaggaaccgttcgccaggtcctgggccggtcgcgcggccggaaccggctggaacgacgggcggcgggggggatcgtatgcgtgcacgtatgtgccaacgaccccaccgcccaacagatgcggccaccgcgccgattgagcaggtcacccggagtggggcacgctccgacgggggcgcggggaactgcgtgacctgccacggcggacccgcggccgacggaccgcccctggttccccggcctcgtccggcgcagcgctcaggtgccggcgagcggcagcgccgccgccaccagcttgccgcctgccgccgccttgtcgagcgcgtcgcgcagcaggtcctcgcggggctggcggccgatcgagccgaccggggccgcgaacatgatcacctgctggtgcttgttggcggctgcgcgccagttctcggcgacctggagcgcctggtgcgcctgccaccaggcgaccggtgagccgccgccggtgcccggctggagcacggcgtgcagctggcccatggcgagcagcacggaccagccgtgcagcacggacggcaccgactcgatccgggtcagcggcatgaagccctgctcgatgagcagcggcaggaagtcgtcgccggcggcggtcgagcccgggcgcacgatgggtccggtcggctcgacgacgagcgccgggtgcaactcgccgctgatcaggaccagtccgctggtgacaccgagcacggcctgctcgggcaccggagtgccgggcccttcctcggcggcgatggagcggactgcgccctggagctgctcctcggtgacctggacgacctgcgagggcaggcaggtggcgtgggcgaaggcgaggacggcggtctcgtcgccgatgaacaggacggtgctggtgtgctcctgctcggagtcgcccggggtacggcaggacgtgcagtcgtaactgcccggggcgttctctccggcgagcagccggtcggcttcttcgtcgccgatctcggcgcgtacgtcgtcgctgacgtcgagcatgcgcggcacgggtggctccctcgggatgcggtgcgtggcgatgccgggtggctcccggctcacgggctcggggggtccccgggctcacgaagaagacaacgggcgatctgtggccggagtcacgcccggaagcgaacggaatcgaaccaaccggcgcgcagcgtgaagccgtgtgcggaatgcgttactccacgccaacttcccggggcctcaaggaagttgggtcggtgaggtgggtcacagatcatcagaccggcaggtcgacaaatccggaaatcggcgaatgaagtgggtggctgaaagtcgccgatacctcgggtaacggcgaactggcctggagtgacgaggagttggttgatatcgcgtcaccgccctctctagattgctccgccgtgtgcaacgagcaccgctcgggtacgtccgccggccgcacgacagccagtccagcaccacctccggcggacggggcgagcacggcgaccgcgtcctacgcgcagggagccgtgccccgccttgggggatcccgggtgattcgagagggaaatacatgtccgaatgtgccgatagcactcgtaaggttcgtacgactcgtacgacggcggtcctcgccggggcagcgctcctcgccccgctcggactgctcgccgcgaccggcgaagccgccgcggccgacagcggagtgtgggaccgcatcgcacagtgcgagagcggcggaaactggcacatcaacaccggcaacggctactacgggggactgcagttctccgccggcacctggcgcgcgtacggcggcacggcctacgcggcgaccgccgaccaggcgtccaggggccagcagatcgccgtcgccaccaaggtccagcgtgcgcagggctggggtgcctggcccacctgctcggcacgcgccggagcaggcggaagcgcgcccgccgcatcgggcaccggggcgagcggcgggtcgtcctccgccggttcggccaccaccgagtcggccgcatcggccaagcaggccccgtcgaagcagtcgaaggcgccgacgcgcgcgccggaacacaccaaccgcaactcctcccgcggcgactacaccgtccgcgacggtgacacgctcagcggcatcgcgtcccggcacgggaccacctggcagaagctgtacgccgccaacaagacggtgctcggcggtgaccccgacctgatcatgcccggacagcggctcgcgctctgagcggcgctcccccttcggtcccggacggcccctgcgacggcacgggcgtccgggcacgggtcccacccggtcggccgaccgggtgggaccccggcgcggctcaaggggcgggccggggcagctgcttagcgtgacgcgatgcgccccgtgtcccgccgccgcgaccgtgaccgcctttctgtgcgggtgcgtgcccgcgtcggcttcccgtacctggtggtggccgcgctggccgtcgtactcgcccccgcgggggcggtcgccgcgccaccgcccccgcttcccggcccccaggcggcaccggtgtcgtacgagtgcgccaaggacgagtggccctgggactgcctcgccgactgcgagagcagcgggcgctgggacgcgaacaccgggaacgacttctacggggggctgcagttccggcagcccacgtgggaggagttcggcggactgacgtacgccccgcgcgctgacctggccacgcgcaagcagcagatcgcggtcgcggagcgggtgctggccacccaggggtggcaggcgtggcccgcctgcgccaagaggtacgggctcgagggccgcgcgcacgtggtgaaggccggcgagacgctcgcctcgatcgcccgcgcgtacgacgtcaagggcggctggacggcgctctaccaggccaacaaggaagtggtcggggcacggccggaccggctgaagaccgggacggtgctgctgatcccgtagcgttccggccgcgcgcggcccctcgggcggggtgctgtgcgggccgcctccgccgtccgggggtgtccgcctcgtccgtcacggccgggcgagttcggccgcctctccgctgaaggcgacggcgccgcgccgcagttcgtggacgaggacggtacggcccgccggtccggccagaccgtgcggcaggcgctgctcggcgacgatcacacaggcgtcgaggccgctcagcagccggtaggtacgggccgcgacctccggtgacatgccctgtgccggttcgtcgacgagcaccacgcgcgcgggtgccgccagcgcccgggagagggcgagcatgcgctgctcgccgccggagagggtgccggcgcggtgcgggagcagcggctcgagctgcgggtaggcgtcgagggcgggcgcgaggtccccggccgtcagctccaggttctcccggaccgtgagggaggcgaacacggcccgccgctccgggacgaggcacagcccgcgccgggcccgctcgtacgcgggcaggcgggtcacgtcggcgccgtcccagaccaccgcgccgccggacagcgggacgccgccggcgagggcgcgcagtacggtcgtacggcccgagccgttgcggccgagcagcacggtgaggcccgggcccggcgcgaccagggacacgccgtgcaaggcctccagggggccgtagcgcacgcgcgcgtggcgcagggcgatgctcatgctccgcctccgcccccgccttcggctccgccgtccaggacacggtcggcgggccctgaggcgacgatccggccggcggtcatcacatgcacgatgtcggcgaggtcggcgaccaggtcgagatcgtgttcgacgacgagcagggcggtgccgtccgcggcgagggcccgcagcacgcgggccagcgcggtcacctcggcggtgtcgagacctgcggcgggttcgtcgagcagcaggacgcgcgggctgccggccagggcccgcgccagttcgacccgtctgagggttccggtcggcagcccggcggtgggcagcgcacgtacgggcccgtcgagtccgagcagccgcagggaccgtgccacggccgccggatcggggaggcgtccctgctcggcgccgatccgcacgttctcggccacggtcaacgaggggaagacggccaactgctgaaaggtccgcgcgataccgagccgggtccgggcgtgcgcggccagccgggtgacgtcgcggtcgccgaacagcacctgcccgcgcgcggggcgcagggtcccggcgaggcagtggaacagggtgctctttccggcgccgttggggcccacgacggcggtgacacggccgggcggcagctcgaggtcgacgccgtcgagggcggtgcagtcaccgtaggcggcgtgcagccggcgggcccgcagggtgtgcggggcgacgggggaggggcggggagccgcggcgcgaggcgcgttccgggagcgtgaccgcgggccatgggacgcaccggggccctggccggctgccgggcgggacacggcccccggcacaccggcggccccgtcggcgtccggccgggacgcgggccccggccgctccaccggactgcttcccgtcgggcgttcggccggactgcctgccgtcgggcgtccggccggactgcctgccgtcgggcgtccggccggactgcctgccgtcgggcgtccggccggactgcttcccgtcgggcgttccgccggagcgcctcccgtcgggcgttccgcggtcctcgagcccgccgccgccgtggcctccgggagcacgggccccccggccggccgcaccctccgccgtatccgcgcccccagcggtgtcaggctcggccggcggtgcggcggacgtcgtgcggccgtggcgcgcagggcctcgtacgggccgccggggaagcggccgacgaggaccgccaggacgccgatcagggccgccgccaccccgccccgcgcccccgcgtcgaggcccaccagcagggccgcggcagccagtgcgcccagcacgctgtccgcgccgaggaccacgacggccgcgaaccacagcagcccgcgcaccgggtcgtacgccgtcgcgtcgaaggcccgcagacccatgccgagcatcccgccgcccagcgcggccagggcggcgcccgccacgaacgccgtcagtttcagggccgcgacgtggacgcccgcggcggccgcgcccggctcgtggtcgcgcatcgccgcgagggcccggcccgtgcggccccggcgcagggcgctcgccgcccacaacgcgcccgccaggagcacgagttcgagtacgtagtaggcgcggtcccccgcgaagcccgccgggcggtccagggacaggcccgacgtcgcgtacggctgggtgaagacgaagcggctcaccccgacgcccaccgcgaaggtcgcgagcgcgagcgcgaggccgtggcggccgatcgcgggccggccggtgagcaggccgagcggggccaccaggaggacggccagggcgagggccgccagttcgggcacccggggcaggcccgggaagcggcccgccgccagcagcgcggtgaacagggcgcccagacccgcgtacgccgcctgcccgagcgagatctggccgccgcggcccgtcaccacgaccagggacagcagcaccacgcccagcgcgggcacctggaccgaggtgtgcaggtccgagcccgcgaaaccgaggggcaggaggaagaggaccacggccacgatccacgcgcccggcggggtcggcacccgggccgtcgccgtgcgggggagcgcgtcgcggccgccgacgccgggcaggacgagcgccgcgaccagcagcgccacgacgaacaggttcgcgccgaccgcctggagcaacggctccgcccagcccgacggatgcagccgcgtcaactggctctgggccacgccgatgccgagcgccaccaccacggccaccggcaggctccgcatccgcgcggcgaccgcgaccgcgaccacctccatgacgaggagcggcatcccgtacgggtcgaggcgcaccacgggagccaggagtacgcccgtcagacccgccgtgaaggagccgaacgcccagcccgccgccgccacccggtcggcgtcgatgccgccgagcacggccagcgcacggtcgtcgaccaccgcccgcagctcccggccgaagcgcgtccggcgcgtcaccgcccccaccccggcggccagcaccagcgccaccgccaactgcccccaggggtcggccgacacgagcgtcggcgcgtccgcgcgggccccggaaccccataccagcgtggccccgccgaccagcagcacgaacaccccgatggacgcgaccagcgtccgtaccggatcaccgcccggcacggacagcggacggaagacgaagcgctccaggacgatgccgatccccggagccaccaccagcagggtgaccgccgcaccggccgcgaggggccagccccactcgaccgtgaactgccgcagcagatacgcgcacaccatcgcgaccgccccgtgcgcgaagttgagcacgccggtcgcccggtgggtgacgaccagcccgacgccggtgagagcggcggcgctgccgaccgagagcccggcgagggccaggtcgtacgtgagcgaggccatcagccgaccggaccggggggcggcggctcacagatcgggcacgggccgagttccccgctcgcccacagccgtgaatccgccggtaccgcctcggacttgccggcgaccagcgggcagtcggcccggtgccacagcgtgccgcccggcaccctcagcagctccccgctggtggcgacgggggcggccgccgcctgccccggctccgccacgccggcgggctcggccgcgaccagcagcccgtacagctcctccacacgcgccgccgccgacgcgggcccgccgtgcgtgagcagcaccgctcccgcgatgatcagcgcggcgccgggcaccgtgcaggacgccagatacggcaactgccgctccgcgtaccgctcgccggagacgccgtaccagccgaggacgcagaacaccgcgccggcggcgagcgcggcccagccggcccagaggacgaggtgcgcggtccgcagtcgccgtgtccgcatccgggctcccacacgtcgtgtgtccgtcggtgtctgtccgcgcctgcctgcgtctgtccaagtgagccgatggcttgcactatgccttctggaagctgaccctgaaagctccgggcgcaccccgcccggaccgacacccggtggtgagccagatggttctcgggagcgacctcaggcgggcagacacacagcgggggcgcggccccggacgggcgacggcctgggcggccgtcgccgttctgctactcggcccggctctcgccgcgtgcagcgacgaaagcggcggcgagaacaccactccgccgaccccctcggtcgagaagccgaccggcgcgcagccgagtccgacggccccggcggaccccgccgcggccaagaaggagatcaagaagaactgggagaagttcttcgacccggccgtccccaccaaggacaagcaggccgtcctggagaacggcgacaggatgaccgcggtcctgcggagcttcaacggcgacaaacgcggcgggcaggtcgcggcacacgtcgagaaggtcgcgttcacctcgccgaccgaggcggacgtgacgtactcgctgaccctgaaaggccagaccgtcctgcccggtgccgccgggaccgcggtggagcagcacggcacctggaaggtgtccgtgaacaccctctgcgcgctcgtccagttgagcggcgatgcgtcggcgagcccggctcagggctgctgagacggccgccgcggtcctgctgctcctggtgggcgcgggctgcggcagccgcctgccggagagcgacttcgcacaccggtccgcgccgcccgcgtcgcggcgcaccgagccggtccgtgtcggcatcctcaccagcgccaccagcccggtcggcggctccgccttcaccggcccgcgcgacggcgcacgcgcctacttcgaccgcctcaacgcgcgcgggggcatcgacgggcggaaggtcgacgtgcggacctgcgacgacggcggcagcggcgtcggcaacaacgagtgcgtgcacaggctgatcgacgaggacaaggtcgtcgcgctcgtcgccaccaccgccctcacctacgcgggcgcctcccgggtgtccgccgcgggcgtgcccgacatcggcggccagcccatcggggccgcgtacgacacctatccgcacctgtacgggatctacggcagcctcgcgccccgcaccggcacacccggctggggcgggaaggtgtacggcggcaccgaggtctaccgctacttcaagcgggagcacggcgcccgtacggccgccgtcgtctcgtacaaccagtccgcgtcggccgcgtacgcctcactcgtcgcgcggggcctgaaagccgagggctacaaggtggtcaccgagcaggtcgacttcgcgctgcccaacttccgtgccgcggcggccgacctgaaggaccagggcgccgatctggtcttcgacgccatcgacacgcacggcaacgcccagctgtgcagggcgatggacgaggtcggcgccgacgtcatcgccaaggtcaccaacgtgcagaactggacgtcgtcggtccccgaggactacaaggactccccgcgatgccgcaacgtcctgtgggcgaccgggtcgagccgcaacgccgacgacacggccgacccggccgtacaggagttccgcgccgcgaccagggggctgaagacgcactcccagtggcagttggaggggtgggcggccgcgatgtggttcacggacgccgccaggtcctgcgcgacggacctcacgcgcgcgtgcgtcgaccgcttcatgagccgcggcacgccgtatacggccgacgggctgctgatccccgtcggctacgagcggctggccgagccgcccaggacccgcaggacctgcctctcggtcgcacgctggaaggacgccgaggggtgggtcgcccagggggacatgaacgccacctgcttcgtcgtaccgcaactcccttaccagccctgatgcattacacgacggaaaggttcctgaaaccggttaccgatggggcaactgttcgggaacgaaatgatgagggaacccaaccaacctccaacctccccggtctaaccatccggtaggcggacgagacagggaaacacggggattcggggacgcatgcatatctctttcttaatacacaatgcgtacggaatcggagggacgattcggaccacgtacaacctggcgaacaccctggccgagcagcacgacgtggagatcgtctcggtcttccgccaccgcgagcagcccgtcttcgcgcccgacccgcgcgtgcgggtgcggcacctcgtcgacctgcgcgagggcgcccctgacgcgggccaccccgacctgggccgtccggccagggtcttcccgcgcgcggagggccgctaccagcagtacagcgccctcagcgaccggcgcatcgccggccacctcgcctccgtcgaggccgatgtcgtggtcggcacccgccccggcctgaacgtgcacctcgcccgcgagacccggcgcggcccgctgcgcgtcggccaggagcacctgacgctcgacagccactccagggccctgcgtgccaccctgcgcggcgcctacccccgcctcgacgcgctgaccacgaccaccgaggccgacgcccacgcctaccgcggcacgatgcggctgcccggcgtccaggtgcacgcggtgcccaacccggtgcccgcgccgggcatcgagcccgcggacggcaccggcaagtgggtcgtcgcggccgggcggctcgcgccggtcaagcgctacgacctcctcatcaaggccttcgcgcgggtgcgcgcccagcggcccgactggcgtctgaggatctacggcggcggcaagcagaaggacacgctgcgcgccctcatcgacgagctcggcctctacaaccacgtgtatctgatgggccccgccaaccccatcgagcccgagtgggccaagggctccatcgccgccgtgacctccagcctggagtccttcggcatgacgatcgtcgaggccatgcgctgtggcctcccggtggtctccaccgactgcccgcacgggccgggcgagatcatcgacaacggcgtcgacggccggctcgtcgaggtcggcaacgtcgaggccatcgccgagggactgctcgaactgatcaacgacgacgcgctgagacagcggatgtccgtcgccgccctcaaggactccgagcgcttcgacccgtcccggatcgccgaacgctacgaaagcctgttcaccggcctggccccgcgcggcggcgccacgctcggcgggaaggtgcgcggctccctgcaccgcacccgcggagcgctgctcggtggggcgtacgcggttcgcgatgtcggacgtaccgcactcaagaaagggcgcgccgcgtgatgacgctggctgagcggaccaccggccggcaccccgacgaggagaccgccccgcccccgcgcgccgactgcatcgccgactccgcgggcggactgaccttcgacatcggcgggagcgacgaagcgggcctcgcccacctggtgctgcgccgccgcgaggacgacgcggaggtccggctcccgctgaccccgagcgccgagggccggctgcgcgccgccctgcccagcagcgtcgaactgcccgagggccgctgggacgcgtacgcccagaccgcggacggcgagccacagcggctggtgcccggcgtcagcgacctgcgctccctcgtggaccgtgggccgggcgcggcgggccacgtcgccgtccgcatcccgtacgccaccaagcacggcaacctcaccgtccgcagctggctgcgcgccccgcacgccgaggcgggcgaactgcgcatcggcgacggcgggctacaggtgagcggccgggtgcacggggccgcgctcgcgccgggcgcgcacgccgagctgtgccgccgcggcgagcccgcgtcggtcctgaccgccgaagtcgccccgcggcagggtgagttccggttcacggtggactacggcgccatggcggaaggtgtctgggacctgtggcttcgcccggcgggggaggacggaccgcgggtgcggatcgcccggctcctcgacgacatcgcggacaagaagccgatcttcacctacccgaagctcacgctggagacgaagcacgggccggtgcaggccgggccgtactacacggcggacaacgagctgtccgtgacggtcacttcagcaccgccaccccagtgaatcgaaggcgctcacttccgcgctcgcggacagccgctgtccgcaagcgctggcagactcggaaccatgttggagacatcggcacgactgctgcgcctgctctcactgctccaggcccaccgtgaatggtccggtgccggcctggccgaacgcctcggtgtcaccccgcgcaccgtccgccgggacgtggaccggctgcgcgagctgggctaccccgtcaacgccagccccggtaccggcggcggctatcagctcggcgcgggggcggagctgccgccgctgctcctggacgacgacgaggcgatcgccgtcgcggtcgggctgcgcacggccgcggggcagggcatcgagggcatcggcgagagctccgtacgcgccctcgcgaagctcgaacaggtgctgccgaaccggctgcgccgccgcgtgagcgccctcaacgccttcaccgtgccgatgctgcgcggcccccagccctccgccgtcgaccccgccgtcctcaccgaactcgcccacctctgccgggacgcggaacgcctgcgcttcaggtatcgcggcaacgacggcgcctccacccgccgcaccgtcgaaccgcaccggctggtgtgctccgagcgccgctggtacctggtcgcctgggacgtcgaccgtgacgactggcgtacgttccgcgtcgaccgcatcacgcccaggccgccgcacggcccgcgcttcgcgccccgcacgccaccggccgacgacctggccgcctacgtctccagaggggtctccacgcgcgcgtacgccgcgcaagccgtcgtccggctgctcgtgccgatcgaggaagcggccgcacgcgtctcgccgtccgccgggacgctggaggccgagacccccggaagctgcgtcctgcgcaccggggccgcgagcctcgacgtgatggtgatccacgtgatgatgatgggcttcgagttcgaggtgctggagcccgccgaactcaccgaggcggtcaggacggctcgcgatcggcttgctcgtgcttcggctcgggctgcggagcctccccggcgtgcgccggatggtgcaggtcgaacgccggggactccgagcggacccggggcagcgtgacgaagttgtgccgcggcggcgggcacgaggtcgtccactccagggagcggccgaagccccacgggtcgtcgacctcgaccttccggccgtacctggcggtcttccagacgttgtagaggaacggcagcgtcgacatgcccagcaggaacgcgccgatcgtcgagagggtgttgagcgcggtgaaaccgtcggcggccagatagtccgcgtaccggcgtggcatgccctcggcgccgagccagtgctgcaccaggaacgtggtgtggaagccgacgaacagcgtccagaaatggatcttgccgagccgttcgtcgagcatcttgccggtgaacttgggccaccagaagtagaagccgccgaaggtcgcgaagacgacggtgccgaagaccacgtagtggaagtgggcgaccacgaagtacgagtcggtgacgtggaagtcgaggggcggcgaggccaggatgacgccggtgaggccgccgaacaggaacgacaccaggaatccggtcgcccacagcatcggtgtctcgaaggacagcgaccccttgagcatcgtgccggtccagttgaagaacttcacgcccgtcggcaccgcgatcaggaacgacatgaacgagaagaacggcagcagcaccgcgccggtcgcgaacatgtggtgcgcccacacgaccaccgacagaccggtgatcgccgccgtggcgccgatcagcgtcagatagccgaagatcggcttccggctgaagaccgggatgatctccgtgatgatcccgaagaacggcagcgcgatgatgtagacctcgggatgcccgaagaaccagaacaggtgctgccacagcagcgccccgccgttggccgcgtcgaacacctgcgagccgaaccgccggtccgcctccaggaccagcagggccgccgcgagcaccgggaacgccatcagcacgagaatcgacgtgaacagggtgttccaggtgaagatcggcatccggaacatcgtcatgccgggcgcgcgcatcccgatgatggtcgtcaggaagttcaccgagccgaggatcgtgccgaagccggccagcgcgaggcccatgatccacatgtcggcgccgatccccggcgagcgctccaggctgttgagcggcgcgtacgcgaaccagccgaaggcggcgggccccgacggcaccgcgagcgagccgaggacgatcaggccgccgaagaggaacagccagtacgacagcatgttcaggcgcgggaaggccacgtccggggagccgatctggagcggcatgatctcgttggcgaagcccgcgaaggtcggagtcgcgaacagcagcagcatgatcgtgccgtgcagggtgaacagctggttgaactggttgttgtccacgatctgcatgccgggccgcgcgagttccgcccgcatcaccagcgccatgacgccgccgatcaggaagaacgcgaacgacgtgatcagatagaggtggccgatcttcttgtggtcggtggtggtcagccagtcgacgatcagccgccccggctgctgtgtccgtacgggtcgcgccgtcgcctgcgcggtgtccgtccccatcgcctgccccttcgccgatcgggtcctgggcttgcagcccgcgccacgggtgtccgcgagctcacgccatgatgctcgcgccgccccgggctccgacagggggcgtgcgggggatctgtgccggaaccgtgcatttcttatgcggtgtctgcttcggcggagcatctcggaatcggaatggaaaacgtcggcagcgcactgcgcgccgtgctttcccgcggttattcacgaccgcttccgacggccgccaaggtagtcccgaatttcgttcgaaggtgggcgcaacgcatacggaaccgctcgtacgtgtgacggcattgggccgaaacgcatgtcgtggtcctgtgacagaagtgtgacgggggaggtacgggtgacgcggggtggcggccccgggcttccccggccccggctcgcggcctaacgtggcggcatggcaccgactcccgctccgcccgcagaacccgaggactccccccaggcatacgtcggcctgccggcccggcgtgccgagcaactggccggtgaacgcggctggagttcggtgcgctcgctgccgccgggcgcgatcatcaccatggagtaccgggtgggacggctgaacttcgaggtcgccgacggcacggtcgtccgctgctggaagggctgacgaagggcccctggatgcccgcgaggtctcgggcacacacgaaggcccccggttccgctggagccgggggccttcgtggtgcggcggggaggggtgtgcgtaccggacccgccgccggtgtctcagccgcccgccaccgggcgggccgaagtggtggtggtgcgcgcgactcggtccgagtgcggcggacgacggctgccgaccggtgtcaccggggtgcgctccgagcgggcggtgtgcggcccgggggccaggtagaggggcggacgggaggtccgggctgggccggccggctcgcggacgggagtctcctcgtccggggccgagcgggcgatcggcacgggcgcgccgaccggggccggagcgggcgccgtgcgtccggggcgggaccgcaaggagtcgcgcagcctgaagatcccggcttcggcgagggcgatcagcggctcgaaccagggcagcgccagcaggatcagcagccccgcggcccagccgagcacgacatcgctcagccagtgcgtgccgaggtagacggtggtgagaccgacgccgagcgaggtcaccgcggacagcgccgacagccagcgcctggccctcggggtcgaggccagataggccaggatgccccaggtcaccaccgcgttcgcggtgtggccggagggaaatatatcgccgccgccccacatctcgttcgacccgatcgtgaccgcgtagtgcggtccgaggcggcccatgccgtacttggcggcaccgaccgtgatgttgagcagcagcagcgcggcgcccagggtcagcagcgggcgcagggtgtgctgccgccaggagcgccagcccagccaggacgcgaccatcacggcggtggggccgcgctggcccagcaccacgtagtagtcgaggaacgcgtggatctcgggccactgctggtacggccggaagaacatgacctgccagtcgagccggaccagccacgaggtgacgaccacggcccacacgatggccaggtagaaggcaagggtcgccgagaagaggaccacccggtgccggctcatcctgggcacgtcgatatgggccggtcgttccggctcacggtccagccgggcgaagacccggtccagacgagtcagctttagttcggtacgcacgtcgatcgacgttacagcgagtgagctgtactcccgcccgaaacactggctttgtgatgacgatgtgatgtgggattcctctcagggcgaggtttatctctgtggattccctaatcacggacgcatccggccttcaattccattgatcgctccgggtgccggttatatggcccttataaattcgttcaccgaatgctggggcggaattgtccggccgctcacccggccccgaagtggatcatggcggacccgagccgttcagccagaacgccccgtacacggccgacgccaccgcgacaccgccgagaaccgccgccgacctgggggtacgcagccgggccagggcccgcgcgaggggcagcagcagggggaacgcgggcagcaggaggcgcggtttcgagccgaagtaactcgacgcgcacagggcgagcgcggtcaccacacccgcgtacaccaggagcggcagcggctgcccctgccgtacgcacaccacgtacagccagacgaccagcgccaccccgacgatcagcccgacgccggccagggccgaggggaacgacgtgaacttgtcgccgacgaagcgcgcgaaggcgtagccgccgtcgaagccgttgcgccagcccgcctggacgtcgagatagcccagcgggcccttcccggtgcggtggccgacccacaggacgtagccggcggcgccgagcggcgcgaggagcatgccgagggcgcgccgccacgccgacgcgccgtccgccgccggcgcgcgtcggtcgtgcacgaacgaggcgatcgccgccacccacacggcagcgaccaccgccgcgcccaccggacgggtcagccccgccagcgaggcgagggcgcccgccgtcacccagcggccggtcaggaccgcgtacagcgaccaggcggcgagcgccgtgaacagggactcgctgtacgccatcgactgcacgatcccgaccggcagcacggcccacacgagtacggcgcacacgcccgcccggcgcccgtggacgtgctccgtgacggcgaagatcccccaggccgcggcgagcgaggcgagcgtggcgacgaccagacccgcatccgcgtacgacagcggcgtcaccgctgcccccagccgctccagccagggcagcagggggaagaacgcgaggttcgagtgcacgtccccgttgggcaggcgcacctcgtagccgtatccgaggccggcgacccgggtgtaccagagcgcgtcccagcgggcggtgagcagggtgtgcgcgctcgagccgcgcgccgcgctccacagtgcgagcgcgacgaggcccagggcgcgtacggccgcgaacccgaggagggcgggcgcggcccggcgcagagcgcccgcgtggggcggcgccgggcgcgtttcaagatcggtcacgcgctcgattatcgacggggcacggaaccgggtgtcccttttgggcgtgatggaccaggaagagcgtggcgtacaccacacgttccctgagagaaaggtgagaggtccgccacgtgccatcgacgggaactcgcgtacgctggccgctcactcgcatcgttgcgtgggtccgggagcaccgctcctcccagggccaccaccgcggggaagtccccaccccgtggatccgccgaagcgagggatcatctgggaggtacatacatgtccggcacgaccacggccgctgcgcgatgccgtcgggagaccgggcccggtgccaaccgctgggtcgtactcgtcgtcctctgcgtcagtctgctgctcgtcgcgctcgacgccaccgtgctgcacgtcgcggtgcccgccgtcaccgaggacctcaagcccggcgcgatagagctgctctggatcgtcgacatctatccgctcgtctgcgcctcactgctcatcctcttcggcacgctgggcgaccgcgtcggccgcagacggatccttcttctcggatacggcctcttcggcgtcgcctcggggatcgccgcccttgccgacagcgcacaggtcctgatcggcgcccgcgccctgctcggcgtcggcggcgcgatgatcatgcccgcgacgctgtccatcctgcggcaggtcttccccgaccggcgcgagcgggcgctcgcgatcggcatctggagcgccgtggccgccgtcggcgcggcggtggggccgctgctgggcgggttcctcctcgagcacttctggtggggttcggtcttcctgatcaacatcccgctgatgctgatcagcctgccggtgggacggctgctgctcccggagtcgaagggggaccgcgacggcccctgggacgtcgtcggagcgctgatggccgccgccggcctcttcggcgccgtcctcggcgtgaagcggctcgggggcggggagccgccgctcagcccgttcaccgtggtgccgttggtggtgggcgcggcgctgctggtcgctttcgtacggcggcagcggcggcgggcccacccgctcgtcgatctccggatgttcgcgcggcccgcgttcagtacgtcggtgggatgcatcgtcctggcgatgctcgcgctggtcggcctcgagctgatcgccgcgcagtacttgcagctggtcctcggtctgtcgccgctggagacgggactgcggctgctgccgctcacgatcgcggcgatggcggcgggactcgtcgggtcgaacatgctgcaccggttcgggccgcggcgcatggtcgtcttcggcttctgtctcaccgcgggctcggtcgtcacgctcaccgcgatgggcgcggaggacaacaccgggctgctgctcttcgggttcctcctgctggggttcggcctggagaccacgctcttcggggcgtacgagtcgatgctgagcgaggcgccgcaggaacaggcgggcggggcggccgcgataggggaaacgtcgtaccagctgggggccggtatcggcatcgccctgctgggcagcgtgatgaacgctgcgtacgcgcccggactgtcgtcggtgccgggggttccggcgtcggcttcgggggcggcggggcattcgctgggggaggcgtacgaggtcgccgcgcgcctcggcggggcgcccggcgctgccctgcggcacgccgcgcgggactccttcgtgcacgggctccatgtgacgctgctggtcagcgcggggttgttgatgctgggggcggtgatggcgctgcgtctgccgcgggtgatggagtgcgaggagcccgcgacgggcttcgcggaggtgccggcgccgcgggaggccgcggagtcgcgcgtctcggcttagccaccgctgtcccgcccactggacgtgcacgactgtccggcccactggacgtgcgcgacactgcgtcgtaacgtcggcgtccccgtcgtaattagcgttgctagttttagcgtgccggaggctgccatgaccgcgttcgatcccgccgacttccttggcatcgacgacctcctggacgccgaggacctcgcgatccgcgacaccgtgcggacctgggcggcgcagcgcgtgctgccgtacgtcgccgagtggtacgagaacggcgagctgcccggaatccgggatctggcgcgggagttgggggccatcggcgccctcgggatgtcgctcaccggctacggctgcgccggcgcctccgccgtgcagtacggactcgcctgcctggaactcgaagccgccgactccggcattcgctccctcgtctccgtccagggctcgctggccatgtacgccctgcaccgcttcgggtccgaggagcagaagcaggagtggctgccccggatggcctccggcgacgtcatcggatgcttcggactcaccgagcccgaccacggctccgacccggcgtcgatgcgcacgtacgccaagcgcgagagcggcggtgactgggtcctcaacgggcgcaagatgtggatcaccaacgggtccgtcgccggtgtggccgtcgtgtgggcgcagtccgacgacgggatccgcggcttcgtcgtgcccacggacgcccccggattctccgcgcccgagatcaagcacaagtggtccctgcgcgcctcggtcaccagcgaactcgttctcgacgacgtacggctgcccgcggccgccgtcctgcccgaggtcaccggactgaagggccccctcagctgtctctcccacgcgcgctacggcatcgtgtggggcgcgatgggggccgcgcgcgccagcttcgaggccgccgtcgagtacgcgaagacgcgggagcagttcggcaggcccatcggcgggttccagctcacccaggccaagctcgccgacatggcggtcgagctgcacaaggggatcctgctcgcccatcacctggggcggcgcatggacgcgggacggctgcgtcccgaacaggtcagcttcggcaagctcaacaacgtacgggaggccatcgagatctgccggaccgctcgcaccatcctcggcgccaacgggatctccctcgagtaccccgtgatgcggcacgcgaccaacctggagtccgtgctcacctacgaaggcaccgtcgagatgcatcaactcgtgctgggcaaggcgctcaccggtctcgacgccttccggtgacccgctcgggcggggccggtgagcggccttgcctcagctctggttgaagaaaccgtccgtcggccggccggccgcctcgccgctgacgatctccgtgttggcgggggtcagcaggaagacccgggtcgcgacccgctcgatcgtgccgcgcagaccgaaggtcaggccggccgcgaagtccaccacgcgcttggcgtcggtgggctccatggccgtgaggttgatgatgaccgggaccccgtcccggaagagctcgccgatgccgcgggcgtcccggaagctgtccggggtgaccgtgccgatccggcggcccttctcctcggccgtctccgaagcgaccttcacgcgcgggtcggtgacccaggcctcgccggattcctgtccttcggcgtagtcgtcgtcgtagtaacgctcgtcatcgttgtcgtcgacgaggccaagccaggcactcgccttgcgcaccgatcccatggacgcctcctctcacagcggtcttgtcttgctttccgcattccccatggtcgtccatgatgcggatgtcgcgccaagtggatagacgccgcgcgggggtttcgtgacggtactggtgcacagcgaatccgtcgagagcccgcgtgccccaagggtcttgctctatgcggctgctgactgagagtgaaatatgatttctcccggcgttcgggtgatgggcggtgcgtacgggtgaacggcgcggtcgatacgatgccgcagctcaacaacgtacgaggcacgggggagtgtcgtgttcgggatggtccggccctgccgtcatcggctcagtgagggactcaaggcccagtggatggcgcatttgtgcgggctgtgcctcgcactgcgcaaagaccacgggcagttcgccagactggtcacgaattatgacggtctgctgatatcggttttgacggaggctcaggcagagcggacgacgggcggacgccggaccgccggtccctgcccgctgcgtggcatgcggaccgcctccgtcgcgcagggcgagggcgcgcgcctcgccgccgccgtctcgctggtgctcgccgccgccaaggtgcgcgaccacatggccgacggtgacgggctgttggcccgcaggccggtggcgctcgcggcgcgcagggtcgccgcgagctggggcagggccggcgcccgtagcggctccggcgtcggcttcgacaccgccgtgctcgtcgacgccgtggaccggcaggtgggcctcgaggcgctcgccggacccggcaccccgatcctgacggtcaccgagccgaccgagaccgccaccgccgcggcgttcgcgcacaccgcgatactcgccgggcggcccggcaacgccgagccgctcgccgaggccggccggctcttcggccggctcgcccacctcctggacgccgtggaggaccgggaaactgacgccgcgtcgggtgcgtggaaccccctgacagccaccggaacacccctggccgaggcccggcgcctcgccgacgacgcgctgcacgggatacggctcgcgctgcgcgaggcggacttcgtggacgccgggctgacgcacgtcctgctcgcccacgagctgcgcaactcggtcgaccgcgccttcggcggcaccgcctgctcgcaccggcccgaactgcacgggccgtcggcctccggtccgtacgcgcccggtccggggccgtacgcacccggtggtccgggtgggcccgggggtccgccgctgccgcccgagccgccgcggggcaaccgccggggtctgctcgcggggtgtgccgtgtgggcggggctggcctgcacctgccagctgtgctgcggcacgtacgacgatccctggacccgggagcgcaaggacgggctctgccacgactgcgactgcggcgactgcggggagtgctgcgactgctgtcagtgctgcgggagttgctgcgacggctgcgacgggtgtgactgcggctgcgactgctgacgcgcgccggccgacgggtcgggtgtggagccgcaggacggcacggccccgcgctccggtcaggggcgcggggaacgcaccggatatctcagtccttcagttccggcggcgagacctgggacttctcgatcgccgagcccgtcgtgccccacttcttcaggatcttctcgtaggtgccgtcggcgatcagctcgttcaccgcggcctggaaggccggtgccagcttcgtgcccttcttgaaggcgaagccgacatcgaggcggtggaactcgttgaggaacttcaggccctgctgctgggccacggcgtagcgcaggccgttgatcgtggacatcacgatgtcgctgcggccctgctggagcgaggaccagatcgcgccggactcgttgtacgtctgcacctcgtacgccttcttgccggcgtccgtgcagaccttcttgttctcctccagcgtcgcctcgaaggtcgtgcccgcgccggtcgccacgttcaggccgcacagctgcttcaggtcggtgatcttctgcagcttgctgtcctcgcgggtggcgaagccctggccgtcgttgatgtaggtgacgaagtcgatggtcttgcgccgctcgtcggtcacgccgaagttgctggccccgaagtcgtacttgccgctgtcgagggccggcaggatcgcctcgaaactggccgactcggtcttgagtttgatgcccagcaccttgccgaccgcgttcgcgaagtcgacgtcctgcccggccagcgtcttgccgtcgtccagatagctggtgccgggcggagtgccgccgacgctgatcgcgaccgtgaggctccgggtgcccgagggcagcagcttggccgcggcctcgttcttccggacggccgagaccacgtccgccgtcgggatgccgccggtcttcgccgcggcctgggcgtcgcttttgcccgcgccctccgagtcgccggagccgcaggccgtcagcagcaccgcggcggacgtgatcagggcaaaggggatgaaaatgcggcgacggggccgcgaggacgtactcatggcgtacgaatctcctgggcaggcggagtgagctgaaaagggtcctgggcaaggcgaatgcgaggggaggggggaacgcggcgtggcgtgtgaaggcctgggtgacggcgggcgaggccggagaacgcaaagaaaggcgccccgaagagggcgcgcagggggtcagctcaacaggacgacgaccacactcgaccgaagtcgatgtgggagcgcgtgaccagccactgctgcgaatgcatgggcacaagtggaacaggcatccgtttccccgtcaactgacttgagacgtacggctcacagtgtggacacccttgacagtgaggggaaacacgaacgtactctcgacgtacggccctgctgaggggctcggccgtacagcgcccgcgcggcgccccgtgtgaaggcacccgtgttcgatccgacgcatcacggagccttcgcatgtcctccgacaccctcgccaaacccgccgcggcagcagaagccgcacccgtgcgcatcgtcgcccagcgccggctcggccagtggaccgcggccgccgtcgttctggtcctgctcgggctcgccgtcaactccgtcgtgcgcaacgacgcgttccagtgggacgtcgtcgccgactacttcacctcggcctccgtgctgcggggcctgtggctcacgctctggctgaccgcggtcgtgatggtgttgggcttcgcgctcggcaccctgctcgccgcgggccggctgtccgccaacccggttctcagatcggtgagttggggatacgtctggctgttcaggtcgatgccgatcctggtgcagctgctgctctggttcaacatcggggcgctgtatccgcagatcctcggcgtgaagacggtgaacctgctcggcccggtcaccgtcgccatcgtcggactgacgctccacgaggccgcgtacgccgccgaggtcgtgcgcgggggcatcctctccgtcgaccgcggccagatcgaggccgctcaggcactcggcctgagccggtggcgccgctggtggaggatcgtgctgccgcaggcgatgcggtccatcgtgccgccggccggcaacatgctgatcggcaccctcaagggcacctccatcgtcagcgtcatcgccgtacaggacctgctctactcggtgcagctcgtctaccaccgcacctaccaggtcatcccgctgctgatggtggccaccgtctggtacgtcgtggtcacctcggtgctcagcgtcggccagtactacgtcgagaagtactacgcgcgtggttcggagcggacccgatgacgcccactctggtgatcgtgggggcggggccgcggggcaccggactcctggaacggatcgccgccaacgcgcccgagctgtacgccggttcggagctggacgtgcacctggtggacccctacccgcccggtggcgggcgcatctggcgtgaggcccagtcgccgctgctgtggatgaactccgaggcacaggacgtcaccatgttcaccgacgagacggtggccatggcggggcccgtacgaaaaggccccaccctgcacgagtgggcggccctcgacggccgcgccttcaccggccggcggcgccagggcgcatatctgcgctgggtgtacgagagcacggtggccgcgctgccgccgggcatccgcgtccaccaccacgcccgccgcgccctgcgcgtcagcggaccgcccgaggggcgccagcaggtgtggctggaagggcggcccgagccgctcctggccgacctcgtcgtcctcacactcggccatctcgacgccgaactcgacgacgagcagcggaggctggccgcccatgcccgcgcgcacggcctcgtccatctgccgccggacttcaccgccgacaccgacctggccgccctcgcccccggtgaaccggtcctcgtgcgcggcttcgggctcgccttcgtcgacctgatggtcctgctgaccgaggggcgcggcgggcgctacgagggagcggagtacgtgccgtccggtcgcgagccggtcctccatgtcggctcccggcgcggcgttccctaccattccaagatcggctacgactggacgggcgaccggccgccgctgccccggttcttcgggcccgccgaggtcgacgaactgctcgcacgccccgaggggatcgacttccgacgggacgtctggccgctggtggagaaggagctggggttcgcgcactaccaccgcctgttcacggcgcaccccgaacgcaccaccgtcgcctgggcggacttcgaggagaagtacgcggcgggagtcggacccgagctccgggcgctggccgcctcggccgtccccgaccccgcggaccggctcgacctcgacgccctcgaccgaccgctggagggggtgagccacacctcgtacgaggaactccaggacggtctgcgcgcgtacatacaggacgacctgacgcgccgtcatgacccctcgttcagcccggactcggcggtgttcttcgggctgctctccgtctacgggcagctcgtgcggctcggggacatcggctcgtggtggcacggcttcttcagctatctggcgtccgggccgccggggccgcggctgcggcagatgctcgcgctgtcccgggcgggcgtactgaagttcctgggcgccgacatgaccgtcagtgccggggacggcgtcttccgggcggcgagcgccaccgttcccggaaccttcgtcgaggcccgtgccctcgtcgaggcgcggttgccgcatcccacggtcgagcgcacccgcgacgcgctgctgcgcgggctgtacgccgacggggccgccgcgacccccgaggggctgctcgccgtggaccccgccgacggccgggtcctggacggctccggcaccccgcatccgcggcgcttcgcgctcggcccgcacaccgacgcccggggctccggcgcgttcacccggccgcgcaccggcgggccggccttccggcagaacgacgcgacggcacgcgccgcgctgacgttcctgcacgcacaccaccacgccgagggagcagtgcgatgagcaccaccacccccgcgacccccgcccccgcgatggtcgacatcaggtccgtccacaagagcttcggcccgctggacgtgctcaagggcatcgacctcgaagtgcgcgccggggaggtcaccgtcgtcctcggcccctccggctccggcaagtcgacgctgctgcgcaccatcaaccacctggagaaggtcgaccagggcacgatcagtgtcgacggccggctggtgggctaccggcgctccggcgacaagctgtacgagctgcccgagcgcgagatcctcaagcagcgcacccgtatcgggttcgtcttccagaacttcaacctcttcccgcacctcaccgtcctcgacaacctcgtcgaggccccggtctccgtgctgaagcggccccgcaaggccgccgtggagagcgcgcgccggctgctcggccgggtcgggctcgccgacaaggcggacgcctacccggggcagctctccggtggccagcagcagcgtgtcgccatcgcccgcgcgctcgccctggagccggcgctgctgctcttcgacgaaccgacgtccgcgctcgaccccgagctggtgggcgaagtcctcgatgtcatcagggatctggcgcaccagggcaccacgatgatcgtcgtcacgcacgagatcggcttcgcccgcgaggtcgccgacacggtcgtgttcatggacgacggccgcatcgtcgagcagggcaccccgggtgaggtactcgaccgtcctcggcatgaacgtacgcgggcgttcctctccaaagtcctctgagaagggttcatccacatgacctcatcgaccggccgggggttgctgcacctggccgccgccgtcgatcagccgacggtgttcgacgccggctcgtacgtcgagctggtgcggctcgcggagcgtggcgtactcgacttcgtcaccctcggcgacaccttcgcgcgtcccggacccgacgcgctcgccgtgctctcgcgggtggcgcccgccacccggcggatcggtctggtgccgaccgtgaccaccacgcacaccgagcccttccatgtgcaggcggccgtcgcgaccctcgactgggtcagccgcggccgcgccggctggcacctcgacgtgtccaccaccgagggcgaggcccgcctcttcggccgccgccatgccgcgcccgccgacaccctgtggcaggaggcgggcgaagtcgccgacgtggccgcccggttgtgggacagctgggaggacggcgccgagatacgcgacgtggcgaccggccgcttcgtcgaccgggacaagctgcaccacaccgatttcgagggggccgccttctccgtgaagggaccctcgatcgtgccgcggcccccgcagggacaccccgtacgggtcgtcgacgccaccgagggacaggcgaggagaacagccgcccggtacgccgacgtggcgctcctccgtgtcacctctcccgcccaggccgccgccgtacggaccgaactgcggggcacggcggaggagttcgggcgcgatcccgacaccctgcggatcctcgcgtgtctggtcgtcgacctcggggacggcgagcacgcggccgagcccggatgggggtccccgctgttcgggcgaagacgagaactcgggggaggcgggggcggacccctggggaccgcgcagggcccgcggtatcgcggcggccccgtcgacctggccgacctgatcgccgtctggcaccaggccggcgccgtcgacggcttccacctcaccccggtcgagccgcgccgtgacctggagcggctcgtcaacggcacagtggcgctgctccagcaccgcggcctgttccgcaccttctatccgggcagcacgctcagggagcacctggggctgggccggcccgccaaccagtacgccgtgaccgggggaacgtcatgaccgtacgcaagcccgccgtcaaacagatccacctggccgccctcccccactcccactcccactcccgatctcgctcgagcggggagagccccgtcccaggggtcgacaacacgaccgtctgggccgacccgcgcgcgaagtcgcagatcgagttcgcctccttcgagcatctggcgcgcaccgccgaacgcggtctgttcgacttcttcctcctcgccggagggctgcggctgcgcgaacacaagggacgcatccatgacctggacgtcgtggggcaccccgaggcgatcaccgtgctcaacgcgctggccgccgtcaccgagcggctcgggctcgccgccacggtcgacgcgaccttcaacgagccgtacgaaaccgcccgcaggctcgccacgctggaccacctcagcgggggccgggccgcctggaacgtggtgacctccgccgacgcgttcaccggggcgaacttccggcgcggcggcttcctcgaccgggccgaccggcatgcccgtaccgccgaattcgtggcggcggcaagggagttgtgggactcctggacgcccgagggggtgtcgcggccgttcgcccaccgtgggcggcacttcgacatcgcgggtgagttcaccgtgccgcgctcgccgcaggggcaccccgtcgtcatccaggccggcgactcggccgaggcccgggagttcgccgcatcctcggcggacgtggtcttcgccaggcacgggacgctggaggcggggcgcgcgttctacgctgatgtgaagagacggctcgcggcgtacggacgcgagcccgaggacctgaagatcatgcccggggtcaccttcgtgctcggcgacaccgccgccgaggcgcaggaacgggccgccgagatccggtggcagcagatctcgccgcagaacgcgatcctcacgctggagcagatctggggcgtcgacctgtccgaccacgaccccgacggtccgctgcccgccttcgacccggacccggacccccacccggacccggagccgggcctgatgcagggcggggtggaggtcgccgatccgcgggcgatcgccgagaaatggcgcgccctgtcccacgagaaggggctgtccatccggcagaccgtgatcgaggcgaccggacggcagtccttcgtcggtacgccggaggcggtcgccgccgaactcgaggagttcgtacggaccgacgccgccgacggcttcatcctcgcaccgcatctcaccccgggcgggctcgacgagttcgtggaccgggtggtgccgctgctccaggagcgcggcgcctaccgcacgcactacccgggaaccacactgcgctcgcatctcgggttggcggatccccctacggaagcgctgatcccatgacgacggacgcatccgaggaccggaagcgccgggacgagcaccgcaccgagacggtgtcggcgccctacgggccgctcgcgctgaccggcacgcaccggctggaggactatccggagggtcgacttccggacatccccgggtgctggacccgggagggggtacgaccgtcctgaccacggtggccgaagacgggctgaccgtcgacggcgagcccttcaccggcgagctcaggctcccgcccgacccgggcccgtgaccgcggccccggtcgcgcacggtgagcgccggctcgtcgttctcgtccgcgaaggggtctggggcgtacgcgacttcgaccccgcctcggccgcccgccgggcgttcaagggcatcgaggcgagctcgtacgatccgcgctggtcggtgccggggcgcttcacctcgtacggcgagaaccgcaccgtacgcgtcgagaacgccgacggccgcgagcgcgggctggtctcggcggcgaactcgtcctcaccctggccggacaggagctgaccctgcgggtgagcgtcgaggggacggctcgctgtgggccgtcttcgccgacgccaccagcggggagagcagccaccgcttccggttcccaggggttcggtcggcgttgttgaggggtccgcaagttgaacgctgcacggccgaaaggcgcccttgcgccttgcggtcgcgcggccgaatactcccccacagcgcttgtcaggggcacggcttgtccggaaaccggacaacgggctcttggctgcgcctcacgggccccatcccccacgtgggccccccgacttcccctgggagggaacgaaaagtgaggatcaagcgcaccaacccccgcagcggtgtggcgagacggacccggctgatcgccgtggccaccggtttcctggccgctgccgcgttcgccgtccccaccgcgaacgcgagcgacgcacagacgttcagcgccacccagctcaccacggtcgccaagtcggtgctcaagtccgatgtagcgggcaccgcctgggccgtcgaccccaagacgaaccgcgtcgtcgtcacggtcgacagtacggtctccaaggccgagatcgcccagatcaagaaggacgcgggcagtaacgccggcgccctcaccgtcaagcacaccccgggcacgttcaagaagctgatcaccggcggcgacgccatctacggcggtggctaccgctgttcgctcggcttcaacgtgcacagtgggagcacctattacttcctgaccgccggccactgcggtgaggtcgcctcgacctggtactccaactccggccagaccacgacgctgggcacgaacgtcagctacagcttcccgaccaacgacttcgccctggtgcgctacacgaacacctcggtcgcccacccgagcgcggtcggcagccagaccatcagcagcgccgccacgccgagcgtgggtacgaccgtctaccgccgtgggtccaccaccggcacgcacagcggccgggtcaccgcgctgaacgccacggtcaactacggcagtggtgacgtcgtctacggcatgatccagaccacggtctgcgccgagggcggcgacagcggtggtccgctgtacggcggatccgtcgcctacggtctgacctccggcggcagcggcaactgcacctccggcggtacgaccttcttccagccggtcaccgaggcgctcagctactacggcgtgagcgtcggctagtcgtccaccccggttcccggtctccggccggcagcgggcgagcccccgtacgcacagggcgtacgggggctcgcccatgttcgcggtaggacacggcaatcggcgcggcaatcgatgcggcaatgggcgcggcaatcggcgtggcaatcgatgcaggagcaactcccgtccctcgcgcctccgtcggatccggacatcagagggtcgaaatcaagacaggactagacctcgcaggctgccgagaactcactcgcactcagtgtttgcaacgggaattcacgtggcaagaccacggagcgtcagggtgcagggggcgcacacctgttgcatatgcgcgtcctgaagtcgaccttgtgtgctccctgtgcccctcggaatagtggacggcgcacagtgggcgcggacgtggcattttgcggtgcgccgcctccgtgcccgtacgccttccggtcgtcgaggtccccacaacctcgttgaccgaccccccacaggaggacgtaagttgaagcaccgacgcatatccaggcggcgcgcagccgtggccggagccggcatcgccgcgctcgtcgccgcgggtgtcaccttccagactgcgaacgcgagcgaggccccgaagaccgaagcgccccacaccctctccctctcggcggccggaaagctcgcctcgaccctgggcaaggacctgggcaccgacgcggcgggaacgtattacgacgcgaaggcgaagcacctcgtcgtcaacgtgctcgacgagacggcggcgaagaccgtcgaggcggccggcgccaaggccagagtcgtgcggaactccctggccgagttgacgagcgcgcgtacgacgctcaagcaggacgcgaccatccccggcacctcgtgggcgaccgacccggagaccaacaaggtcgtcgtcaccgcggaccgcacggtctccaaggccgagtgggccacgctgaccaaggtcgtcgacggcctcggtcagcgagccgaactccagcgcacgaagggggagtacaagcccttcatcgcgggcggcgacgcgatcaccggcggcggcgggcgctgctcgctcggcttcaacgtggtcaagggcggccagccgtacttcatcaccgccgggcactgcaccgagtcgatctcgacctggtcggactccagcggcagccagatcggcacgaacgagcagtccagcttcccgggcaacgacttcggcctggtcaagtacacctcgaacgccgaccacccgagcgaggtcgacctctacaacggctccacgcagcccatcaccaaggcgggcgatgcgaccgtcggccagaaggtcacccgcagcggctccacgacccaggtgcacagcggcacggtcaccggtctggacgccaccgtgaactacggcaacggcgacatcgtcaacggcctcatccagaccgacgtctgcgccgagcccggcgacagcggcggctcgctcttcgcggccgacaccgccatcggcctcacctcgggcggcagcggtgactgcacgtccggcggcgagacgttcttccagccggtgaccgaggcgctgtcgacgttcggcgcgcagatcggctgacgcgacgacgggcctcaccggtccggacgtacgcggtggtcctgccgcgcgagcgggacctggacgggcgtgatcctgaaggacgcaccggcctccaccgcgtacgggcgcgcccctgaggggcacaccgggcccggcaacggcacggcatggcacggcacggcaacaacgcaacaacggcgacagccaaggcggcgcgagcggctcccgtgagacacggcggggcgctcgcgccgtcggcgtcggcccccggccccgcgcgggccggcccggcgcggcgcaggcctcgcacccgatcgggccccgatcgggcggcgcggcctgtctcgccctcctcgcccggaacgccctggtctccggcggtgtctgcgtcacgccggccctcggcaccacccgcaccaccccggtcaccctcacggtcaccgaggagggcggcaccggcgggggtgacgaccccggtccgtccgggccgtcgggcacgaagacggtcaccggccccgagaaccagaagctcaccgtcaccccggtcaacaacctggccaccgaggaccagaccctgaagatcacggggtccggctacaacgaggacaagggcatctatgtcgccctgtgcgtcgacgtcgccctgtgcgtcgacaacggcgacggcgaactgcccaccccgtgcatcggtggcgtcgacatgaccgggacctcgcactcctcggcgtggatctcctccgatccgcccgactacggcgaggagccggcgatcccgtacggcgacggcggcaccttcgagatcgagctcaccgtcgacgcgaaggacgagtacaccgactgcttcaaggcgacctgcgtactggccacccgcgccgaccacaccctctccggcgaccgttcccaggacgtgaaggtcccggtcagctttgtcggccaggacccggtggacacggacgacgggacgggcggtacgggcggcggcaccggcggcaccggcggtaccggcgattcgggctcggcctcggcctccggcggctccggaacctccacgaacacggccggcacgtccgccggcagcctcgcctccacgggcgtcgccgccctgaccctgtcctttctggccgcgctgctcacggcggcgggctggttcgcgtaccgacgcggccaccaggacaacggacacccccgccacttccggaccggcggaccggccgacggaccgaccgactgacgtcgatcactcggccaccggatcactgctcgaacgttcgaccgttcggcttcggccaggaggcgaacggtggcgtttgcgcaggtggggcgggcccgaacagctgtcgtacagcagttcgaaaattggtctatggtggaggcgcgggacttgaacagatgttcgatagcccgggtgagggtgcccgggtgcgacaggtgcgggaggtgtgtgtgccgggattcacgcatctgcacaccgtctccgggttctccccgcgctacggcgcctcgcacccggagcggctcgccgagcgcgcctccgagcggggcatggacgccctcgcgctcaccgaccgggacaccctcgccggcacggtccggttcgccaaggcctgcgccgcggcgggcgtccggccgctgttcggagcggagctcatggtggcttcggcgggggagcgcgagcacggaggcaagcggcgcgccccggtccgcggcggtgccttcatcgacgagtcgacaccccgtgtgaccttcctcgcccgggagggcgcggccggctgggccgacctctgcagaatcgtcaccgcgtcgcatacgggggaggggcagccgctgctcccctggcccgacaaccacgccgagggcctgaccgtactgctcggccccgcctccgacgtcggccgcgcgctcgccgccgggcgccccgaccgggccgcgaggctgctcgcgccctggcgggaggtctacggcgacgcgctgcgcctcgaagccgtgtggcacggccgcaagggcaccggacccggctcgctgcgcctggccgcccgtaccgtcggcttcgccgccgagcagcgcgtccgcccggtgctcagcaacgccgtccggtacgccgaccccggcatgggcccggtcgccgacgtcctggacgccgcccgtcggctcgtccccgtcgaccccaccaaggagctggactccggcgaggcctggctcaaggacgcggacgccatgctgggcgccgccgagcggatcgtcgaggccgcgggctaccgccgggacaccgcgtaccgcctgctcgaacagacccaggccaccgccgccgagtgtctcgtcgaccccgaggacgacctcggcatcgggaccgtccacttccccgagccgcacctcgtcggcgccggccgccgcaccgcgcagcgtgtgctgacctcacgggcggcggcggggatggtgcggcacggctacgcggaccggcgcgactactgggagcggatgcaccgggagctggacatcatcgcccaccacggcttcgcgtcctacttcctgacggtcgctcaagtcgtggacgacgtacgggatatggggattcgggtcgcggcacgcggctccggtgcgggctcgctggtgaaccacctcctcggcatcgcgcacgccgaccccgtcgaacacggcctgctgatggagcgcttcctgtccaagcggcgcgcggtcctgcccgacatcgacatcgacgtggagtccgcgcgccgcatcgaggtctaccgcgcgatcatcggccggttcggcaccgagcgggtcgcgaccgtcgcgatgcccgagacgtatcgcgtacggcatgccatccgcgacgtgggcgccgccctctccatggacccggccgacatcgaccggatcgccaagtccttcccgcacatccgggcgcgtgacgcccgcgcggccctggccgagctgcccgaactgcgggaactggcgggcgagttccggcgggaaggggggcggtacgggaagctgtgggagctggtcgaggccctcgacgccctgccgcgcggagtcgccatgcacccgtgcggggtcctgctctccgacgcctcgctgctcgcccgtacgccggtcgtgccgaccagcggcgaggggctgcccatgtcgcagttcgacaaggaggacgtcgaggacctcgggctgctcaagctcgatgtgctcggcgtgcggatgcagtccgcgatggcgcacgcggtggccgaggtggagcgggcgacggggacttccgtggacctggacgccgtaccgccgggcgacccggcgacgtaccggctcatccggtccgccgagacgctgggctgcttccagatcgagtcgccggggcagcgggacctggtggggcggttgcaacccgccaccttccatgacctggtggtcgacatctccctcttccggcccggaccggtcgccgccgacatggtgcggccgttcatcgaggcgcggcacgggcgggcgccggtccgctgtccgcacccggacctggaggggccgctgaaggagacgtacggggtcgtggtcttccacgagcagatcatcgacatcgtggacatcatgaccggctgcgggcgcgccgaggcggaccgggtgcggcgggggctgtccgatcccgagtcgcaggggcggatccgcttctggttcgcccagcacgcggccgtgcgcgggtacgacgcggagacgatccagcgcacctgggagatcgtcgaggccttcggttcgtacggcttctgcaaggcgcacgcggtcgccttcgccgtaccgacgtaccagtcggcgtggctgaaggcccatcacccggccgcgttctacgccggtctgctcacgcacgaccccgggatgtacccgaaacggctgctgctcgcggacgcgcggcggcgcggggtgccggtcctgccgttggacgtgaaccggtcggcggtcgcccaccgtatcgaactggtgtctgaatccggcgacccttccggtggttcttccggcggtccttccggtggttctcccggccgatggggtgtgcggctggccctctccgacgtgcacggcatcagcgaggccgaggcggcacggatcgcggacgggcagccgtacgcctcgctgctcgacttctgggagcgggcccggccgagccggccgctcgcccagcggctcgcgcaggtcggcgcgctggacgcgttcggcgccaaccgccgtgatctgcaactgcacctgaccgagctgcaccggggcgcgcgaggcgggggcgggggccagctcccgctgaccggagggcgcgggaccgcgtccgcggggctgcccgacctctcgtcggcggagcggctcagcgccgaactgggcgtgctctccatggacgcctcgcgccatctgatggacgaccaccgggagttcctcgacgaactgcgcgtggtgtcggcgcgtcggctgcgcgaggcgaggcacggcgagacggtcctggtcgcgggcgccaaggcggccacccagaccccgcccgtccgctccggcaagcgggtcatcttcaccaccctggacgacggcacgggcctggtcgacctcgccttcttcgacgactcccacgacgcctgcgcgcacaccgtcttccactcctggctgctgctcgtccgtggggtcgtacagcggcgcgggccacgcagcctcagcgtggtgggcgccgccgcctggaacctcgccgagctggtcgagctgcgcgccgagggcggcctcgacgtggtggcggcgcgactggcggagcccgtaccggcggcggagaggtccggtgacgacgatccggccgagggcgggaagatccgcatgcccacggggtacgagatgcacccctgggccgatctgcgtcccgcgggcgaaggcccggcgggtggaaagaagttgtggcaccagagtccggggagtgcgggatgaccatcctctgtatacgtttccagctgccgccgatgtacgaggccgccctgccggggctcctcgggctgctcgaggagttcacgccggtggtggaggcgctgccgcccgacggggcactggtggatctgcggggcgccgagcggtacttcgggcgggggaccgtggagttcgcctcgctgatccgggtgcgggcgctcgcgcactacgggatcgactgcgcgatcggcgccgggccggggcccatgctcgcgcggatggccctgcgggacgccgtacccggggtgacccgcgtggtgcccgaagagccggacgccgtcgcggagttcctggcggagcggcccgtcgtcgcgctgcccggcgtcggccacgccaccgcccgcaccctgtgcgagtacgggctcgacaccctcggcaaggtcgccgccgcgcccctgtccacgctgcaacgcctcaccggtgcccgcaccggccgcgagctgcgcgagaaggcgtccggcatcgaccgcggccgggtcgtgccgaacgccgtatcgcgctccctcaccgccgaacgccccttcccgcgcgacgaggtggacccgtcccggcaccgccgcgccctgctctcggtcaccgaggagctgggcacccggctgcgcaccctggaacaggtctgccgcacgctcaccctcaccgtgcgctacgccgaccggtcctcgacgacccgcagccgtacgctcgccgagccgaccgcgcactccgcggcgctcaccgcgacggcgtaccgcatgtacgaggcgctcggcctccagcgggcccgggtccgcgcgatcgccctgcgtgccgaggggctgagccccgccgaggacgccgcccatcagctcaccttcgacccggtcgacgagaaggtccgccggatcgaagaggtcgcggaccgggcgcgggcgaagttcggcccgcgcgcgatcgtgccgggggcgctggccgcctgagccgtccgccgaggattcagccgagaattcagttggcccacggcggcacgatccggctgccgtcggccagctccgcctcgaggccgatggacgtggtgacccaggagaccgcggtccgatcggtcgggttctcgacgcccagggtcgcgccgggattgatgatcaccgtgtcgccggcggtgatccgctcggtgcgcccgtcgagggtgatcaccagttcgccggacagcagatggaagatctcctcacggttgacggtgtgcacgggggccttcgtccccgcgggaatctcgccccgccaggcgcacagctccttgctgccgctgagcggagtggcgtacgagacgaaacgggcgccgtggatctcgtggaccacggcctcggacgggcggacgacgggcatggagacctccataagtagtcaagcggattgaccatatagtcaagctgcttgaccaatatgtcaagggtgtttcaatgcccccgtgcagaactccgaagccatggccttctccgccgccctgctcgccgccgcgggtgagctgacacaacgcattcacgacggcgtggtcgcccgcggcttcgaggggttgcggcccgcgcacggcttcgccttctcgcggctcgcccccggcggggcgacggtcaccgacctcgccgcccacctgggggtcaccaagcaggcggcgagccagctcgtcgacgagatggtgcgcaaggggtacgtcgagcggcggccgcaccccggtgacgcccgggcccgcctcgtcgtgctgaccgagcgcggctgggcctgtacgcgggccgcggaagaggcggcggcggaggccgtgcggccatgggtcgagctgctcggcgagggggaagtcggccttctgcgggcgcggttgtcgcgcatcgcgccctccggccccatcaggcccacctggtgacgcggtaccggccgcgccggttaccactggaagtttttactgacgcgtaacttcacacttgcactactcgtccgtaacttgacgagtgaacagcatcctcgtgatccggatcacagggcgtaaggccgtcgcaactcccttgagccgcaaggagatcactcgatgctgccctggaaacgagttctcagacctctgaccgcgctgctgctgaccgtcgcggtcgccctcgtccccgccgccaccgcccacgccgactccgccccgagcagcggctggaacgactactcctgcaagccgtccgccgcccatccccgccccgtcgtcctcgtccacggaaccctcgggaactccgtcgacaactggctgggcctcgcgccctacctggagcaccgcggctactgcgtcttctcgctcgactacggccagctgtcgggtgttcccttcttccacggcctcggccccatcgacaagtcggccgaacagctccaggtcttcgtggacaaggtgctcaccgcgaccggcgccaccaaggcggacctcgtcggccactcgcagggcggcatgatgccccgctactacctcaagttcctcggcggagccggcaaggtgaacgccctcgtcggcatcgcacccaacaaccacggcaccaccctgtccggcctcaccaacctgctgccgtacttccccggcgccgaggacctgctctccacggccacacccgggctcgccgaccaggtcgtaggttccgcgttcatggccaaactcaacgcgggcggcgacaccgtggcgggcgtccactacacggtcatcgccacccagtacgacgaggtggtcaccccgtaccggacggcgttcctgagcggttccgacgtccacaacgtcctgttgcaggacctgtgcccactcgacctctcggagcacgtggcgatcggactgatcgaccggatcgcgttccacgaggtgacgaacgcgctcgacccggcgcacgccaccaggaccacctgcgcgtccgtgttcagctgatcccccttccggcccccctccgcggtcgggccggagatcgccgccggggcctgtccggcctgagccgccggacaggccccggagtcctcagcggtggtgccggccgccgctcgtcgcacggcggcggaccgaggcgaacagggcggcggcgccgaacgccagcgccgccgccccgccgatcgcgaggtacggggcgctgccgtcgccaccggtctcggcgaggttctccgcggcaccggcggcggccggttcgtcggcgctcttcgccgggctcttcgccgcgctcccggtcgtccgcgcggcgccgccggcggcggtgggcttcgccgacgtactcgcgtcggagtcgccgtggccgtggtgctcgacggtcgacttgtcggcaccgttctcgatctgccggtcggagggcgcggaggcggtcggcgcgggcgaggagccgctcgccgtaccgccgctgccacggtcgccgccgccgttgctcgcgccgtacgtgacgtccgagcaggagtagaaggcctccgggctgtccgagcgctgccagaccgcgtacaggagctgcttgccggagcgctgcgggagggtgccggagaacgtgtagaagccgcccgacgcggccgggtcggtggccgtcgccaccgggtggccgaggtccaggtcgtcccaggcgagcggcttggacgggtcgtaaccggccttcgtgatgtacaccttgaaggtgcccttgtgcggggcggtcacccggtacttgaaggtgtacgacccgccgctgacgccggtcgcgggccagtcggcgcggggcaggtcgagccccttgaactcgtcgttgtccgcgctgcacagcctgccgtccgggatcagccgctgatgccgcccgttcgcgtcaccgatccggatgccgttccagtcgtacagcgcctgtgtgccgccggccgcgaccgccgccccgcacgccgccgacccggggctctcgggaccctccgcgtagcactgggacacccggctgaccgggtcgcccatcgagccgtgcgcggacgcgggcgcggcggcgagcgcggtcagggcgagcggggcggcaccggcggcggcgacggcggccgccttgcggcgagcagacatggcggagctcctcgaaacggtcccgggggcgtggggcgatcaggtggttgatcagcaagctatccccaagaaaccgtgaaatcgcctgctggaggcgggtgatggagatccttatggccccgttaagggagtgctgaggctccgctcaggtaagtaccgtgtcggccatgacagatgcctggaacgacgccgagacacggcccgccgtcgccgccgacgtggacgccgtgaaggccgtgaccgatgccgcgtaccaccactacgtcgaacgcatcgggcgcgtgccgcagcccatggaggcggaccacgcggcgaacgtggccgcggggcgggtgttcgtcctgggcgagccggtgacgggcctcgtggtgatcgaggcgttcgaggaccatctcttcctcgacagcatcgccgtccgccccgacgcccatgggcagggcgtggggcgacggctgctcgccttcgtggacgcacgcgcgcgtgcgctcgggctcgacgaggtcaggctctacacgaacgccaagatgtgggagaaccagaagatctacccgaagtacggatacgagttcgtggagcgccgggtggacgggccgtacgaccggatccattaccgcaagcggctcgcctgacgttcccccgaccgcaagcggtggccggcggacggcccggctcagccgtccggccaccaggtgcgtgcgatgtcctttcggacctccgggcgctcggcggggcgttcctcggcctcctcccgcacccggcgggagacagacttcctcaggggcttctgcaaggtcacacggcgcatggctgcctccttgtgcctaccgggttccgcgatgttcacggaggtagaccctttccgggagcgttcctcatcggacgcggtctgtcagtggcggttctcacgatcgactgtcagtggcgggtgccactcttggcggcatgaccattaacgggggccccgaaacctcggcgatctcggcggacgtggattgggacgccgagtccgccacgttcgacgacgagccggaccacgggctgcgcgacgcggtggtgcgggaggcctgggcggcccggctgcgggactggctgccgggcaaggcctgcgacgtgctggatctgggctgcggcaccggcagtctgtcgctcctcgcggccgagcgggggcaccgggtgacgggcgtggatctgtccccggccatggtcggcctggcccgcgccaagacggccggacgtgacgcggcgttcctggtcggtgacgcggcggcgccaccggtcggcgagcagcggttcgacgtcgtgctcgtccgccatgtgctgtggacgctgcccgacccgggccgcgccctgcggcggtggtgcggactgctgaggcccggcgggcggctggtgctggtcgagggggtgtgggggacggtgagtccggtcggcctgtccgccgaccggctgaccgggctgctcgctcccctcgcgaagagcgtgcgcgtggagcggctctcggacgattcccggctgtggggcaaagaggtggccgacgagagatacgcggtggtggccaccccttgaccgcccgggctcaggccagcagcgcctcgaagtcgccctcccgggcgaggcgttcgagcgtgtcgagggcgttctcggcggcggccgcggcccgcgggtccgacaccgccagaccgctcgcggcgaactcgtcctcgtcgagacggagcacggccgtgccgtcggcggagcgccacaggtccaggtcgagatcctcgacgacgagttcggtgcccacgagcgtggccgggcgggtgatgtcgcagtaccagcccttcagggtgccccggccgtcacggacctccttcaccgcgtaccagcggtcacgccagtagtactcggtgaagacatcacccggctcgaagcgtacgaagccgaagtcgcggacaccgtcacccgcccagggggcgcgtacggccacccgggtgccgtcgtcatggagcagctcggcggggtaacggatcttcgtccggccggacttgaccagcacgacctccacctggccgactgcctcagccgagttcgcggacatagcgcacctccgtcgcacagatctcgtagccgaaccacttgttgatcgccagcatcggctcgttgccggcgtcgttgcccgtgaacgcctcggtgaagccggcggcgcgggcccggtgcagcgagtcgttcttggcgagcttggcgaggccgcggccgcggaaggcgcgggcggtgcccgtcataccggtgtggtagcgggtggcgccgtcggtacgggccgcgctgaacgccgcggggcggccgtcgacgagggcgaccgaggtcagctcgtggctgaggaggggatgccgccaggtctcctccagccaggcctcgtagtccgtgaactcgtgatcgacgtcgcccggttcgtccccgctcgtctccgcgtcgagttcgaacagcgggcgcgggtcgtcggcgaagtccgcggcggtgcgcagttccacgccggggggcggggactggagcggggggagggtgccgtgcgccaggtcgaggcggaggaagtggccggagcgactggcgcgatagccccgccgctcggcgaacgcccggttcgcgggctcgtccagcacccatgcgaacagcttcgtcgcgcccagggcgcggaggcgttcctcggctgtgcgtaccagcagggagcccgcgccgccgcccagccgctcggggtgcacatagacgttgaggtacgcctgtccgggctcggggctgtcgtgcaccaggccgacctgggccgtgccgacgagctcaccgtccgcctcggccagcaggggctggtagtgggcgtcggggtgcgtgtgccgccggtcgtaggcgatggactcgggggtgacgatgaagaaggggagggccaggcgccggatgtgggcgaagccctcggcgtctggccggctgtcctggcgcagctcgcgaacgatcaaggtcatgggctcgcacgctacgcggggaccacgggcgggggcctccgattttccgggggcgcgggacgagcgctccgcgccgggcggccggtgcgggacaatcactcggtgaccttgaagatcgtcatcgaagcaggcggcgcgccctacgaacaggtacgtgcccagatcgccgagcaggcgcgttcgggggagctgccggtgggataccggctgccgaccgtgcgggggctggccgagtcgctcggcctcgcggccaacacggtcgccaaggcgtaccgggcgctggagtcggacggggtgatcgagacgcgggggcgcaacggaacgttcgtcgccgcagcgggctcggccgcggaacgggaggcggcgtcggcggcgcaggcgtacgccgagcgcgttcggcggctcgggttgagcgagggggacgcgtcggcggccgtacgcgacgccttgcgggcggcctacggagactgacgtccgtggccgggacgggcccgggacgggccgcgctcattcgtcaccgcccggagtacgggtgaccgtcaggcccgtcgccttcgccacccgggcgaacaccgccgcgtcctcgaccgccgccgcatgcgggtcgttgttgaagtacgcgtagacctcgtgatcgtcgggccaggtctcggcgatgcgccgcgcccaggtcaccagggcctggcggccgtagcgcggccacctgcgggcgcggccctcgtggaagcggacgtacccccagtcggcggtgcgccacagcggggtggcgggccgggacaggacatcggcccagcacagggcggcgccccgcgcttcgagcacctcgcgcaccgccggtgcccaccaggagtcgtggcgcggttcgaccgcgatccgggtgccggacgggaaacaggcgagacaggcgtccagcagaccggggtcggcacgcagcgtgggcggaagctggacaagtaccgggcccaggcggtcgccgaggccggcggcgtgggtcatcaggcggtggaccggctcctcggggtcccgcagccgcttgatgtgggtcagataccggctcgccttcacggcgaccacgaagtccggcggggtgcgctcccgccaggtctcgaaggtgccccgcgacggcagccggtagaaggcgttgttgatctcgaccgtggcgaaacgggtcgcgtactcctccagccagagccgcgtgggacacccgggcgggtacaaggcgcccagccagtccttgtactgccaccccgaggtgccgacgaacagggtcatacgtccatcaaagcaccgcccgaggtggccgggcgcctacaggtagagccccgcgtccgccccctcccgcggctccggcagcgaggtcggggacgtgccccggcgcagtgcgtacagctccgccagggtcgcaccctcgcggcccaccccctcctccgtgccgagccagttcaccgcctcgcggcgggtcagcgggcccacctcgatgcgggccaggcagcggccggggcggacgaccgccgggtggaggcgttccaggtcctcgttggtcgtgacgcccaccaggacgttgcgcccctggcccagcaggccgtcggtgaggttcagcagccgcgacagcgcctggcccgccgtgtgtttcgcctcgccccggatcagctcgtcgcagtcctcgaggagcagcagccgccagcggcccttgcccgtcccgtcctcctcgccgatcgcgatgtccatcagatagccgacgtccgagaacagccgctcggggtcgaggacgcagtccacctggcaccagtcccgccaggagcgggcgagggtgcgcagcgccgacgtcttcccggtgcccggcggtccgtggagcagcagcagccggcccgcgatgtcctccggggtggtcttcatcagacggtccatcgcgtccgcgacgggcgtcgtgtagttggggcggacctcctcccacgtgcccgccgagatctggcgcgtcgtacggtgcgggccgcgcctcggggacacgtaccagaaccccatcgtcacgttctccggctgcggctccggctcgtccgccgcgccgtccgtcgcctgcccgagcaccttctccgccagctcggcgctggtcgcggtgaccgtgacgtcggcgccccggttccagcgggacaccaggagcgtccagccgtcaccctccgccagcgtcgcgctgcggtcgtcgtcgcgcgccgaacgcagcacccgggcgcccggcggcagcagcgtcgccccggtgcgcacccggtcgatgttcgccgcgtgcgagtgcggctgctcgcccgtcgcgaagcggccgaggaacagcgcgtcgacgacatcggacggggagtcgctgtcgtcgacgttgagccggatcggcagagcgtcgtgtgggttcgcagacatgtcgccatgatctgtcacgggcgcgccccgtgcacccggtttccgcagcgccccaggtgtgtcgcgggtaccccgtgcccgcggagcgcgtgccgtgctcccggtgcgtctccttcgtcctgttaccgggctgtgcgccgacgagccctgtcccacggccgattcccgccgatactgttgcccatgatgggacgtcatgggtggaattcgggggcacggcggtggcgcctcaccgcactgctcggcgtgggtgtggccgctctggccctggtggtgaccctgatcaacacgctgccctcgggcggcggcagcaccgagggcacctcccgggacggcgacaaggtgcacggcacgcccgccgtcccgcccaagaacaccggaccggaagtgggctggggcttcacccacacccagttcagcgccgacgagggcagcggcgacgccacccagcgcgtcgaggggctgctcgcgcagcgggcggtgccccagatccagcacatcatgggctggggggccggcaaccccgagcccgtcaaggggcgttacgacttcgcggagatggaccgccgcatcgacttcatccgcgagtccggcggcacgccggtggtcaccctgtgctgcgccccggactggatgaagggcggcaagtccggtgcggacaacaccgactggagccggtccgccctggagaccgcaccggatcccgaccactacaaggacttcgcggcgctcgccgtgacggtcgccaagcgctatccggacgtacgccacttcatcgtctggaacgagttcaagggcttctggaacgactccagggcccgctgggactacgagggctacaccgagctgtacaacctggtctacaaggccctgaagaaggtcgacgagaagaacatggtgggcgggccctacctggtcatggacagcgtcgacccgcgccagcaggagaacgcctcgacggccgtgaagggcccgtggggtgccatggaccagcgcgtcctcgacgccttcgactactggaacaggaacaaggccggcgccgacttcgtcgtcgtggacggctccagctacaccaaggacgacgacctcctgccgaacgagttcgcggccacggacaagctcacggccgtcggcgagtgggtgcgtgcgcggacccgcggcctgccgctgtggtgggccgagtactacgtcgagcccgccgacggcaacgacgaccgcacgggctggtccgagacccggcgcgtcgccgtccaggccaccggaatgatcgcgatggccaggggcggtgcctcctccggcttctactggaacccggaggaggagcggggctccgactgcgcgggttgcctgtggaccccgacctccggcggcgacggcggcacgaaactgcccatgtacgacctggtctcgcggttcggcaaggagttcccgccggggacgacgtacgaaacggtgccggtcgccaaggacgacgtgcccaatgtccgcgtcctcgccgacgacaaggccgtcctcgtggtcaacaccctcgaccgggcgatcagcgcgaaggtcgacggaaagcggttcgagttgccggcgtacggggtgaagtggctgcggcgctgagccacttcaccccgtgatccgccgccctgccgcccggtcaggaaccggggcatgaaccgctggacgggctacttcatggtcatgaaccgctgcacgagtgacgccagcagcacggcgagcagcggtagcgagaaccagaagctgctctggagccattgcagctgccgtacgcccggccgcaccgcgacccgtacgacctcgcgcgcggtcagcatcagcaccagcgccacggccgccaggccgccgacgacggaccacggagtccaggtcacctgcggtccgatcggccccggatcgggcttcgggaccttgcccgccggctgcttgcgcagcgtgtacatggtcacgtcgtcgttgacgaggaccttcttcagttcctgccggtcgtccaggttgcggacgagccgggattcccaggtcgtggaatagcccacgtccagctgaaggtaggtgacctggctgcggttgatcatcagatacgagttcgggcccgcgtccttgagcgacttgaccagacccgacacgaggaccggatcgctgggcgcgagcgtcggcacgtactccaccttctccatgtcccgggcgccccacggcatcgcgggcgtcacattgtcgacggtgtcgttgctgagccacagcagccgcacgctcggcttgtcgtgctcgtacacgtagttcatggccgcgacctcgccggggcggatccgctcgaacggctcgttgccccagcgggccaccaggaagccgcccatgagcagcaggcccgccagcagggccgcgaccggagcgaggctcacccggtccttgtcccgttcctcggccgtgacgccggtgcgcgggaacagggcgagcccggcgagcagggccgcgcccggcagggcgaacatgaagacgcgcagcgccatttcgccgccgtacgactgcatgccgaagcccaggaacggcacgaaggtcagcaccagcagcgagcgctcccggtacttgtggtcgcgccgccgccaccagccccagcaggccagggccagcacgccgccggcgagcagcacgcgggtgtagaggacgagtttgtgggtggaactgccgccctggatacgtccggagacggaggtcgacacattgctgccgacgccgccgaccccgccgaagaggtcgtcgaagtgcccggaccagtacggctcggccatgaagcctatccagacggcgacgacgaccgcgaacaggatgggcagaccgcgcagctcggagcggcccaccaggaccagcaccgccagcacgcccagcatcacgaacggtgtgagctggtgggccgggacggtcgcggcgaacaggccgatcaggaccatcagcagaaccgcctgctgacgccggccggcgggttcgacctccgcctcgccgggacgccgtgtgctccacagcacgcgcggcgcccggaaccacaccagcaggatggccacgaaggccaggtagagcagataggtgaagccctgcggcgagaagtagtcctggccgacccagccgctgagcacgaagatccagatgccggtccacttggcgcgccagcccgcccgcagcgagcgtacgagcaggaacagcggtgccagatagaggagttggacggtcatcggccaccagcggatgacctcggtgagatcggtgaccccgcaggccttggcgacgaacgcggccaccgcgaagaagccgggccagctccagcgcgcgtccaggtcgggcacggccgacccggtccggtcgatgtagtcgaggaacccgaggtgctgccaggccgtcgcgaaccgcggctcggtctcgatcaccgcgggcagcgcgtgcagcgacaccacggtggcgagcagggtgaacagcagcagcccctggtgctcgcgggtccgccagagcagcgaggcgaagaccacgaccagcagcgcggcaccgacgagggtcggcatcggcaggaccgagatcagtccgaggccgcccatccggtcgagcgcggcttcgtcgaggcccagcgcgggcacccagtacagcagcagcgccgagaccagcagacagcccaggacgaccccgggacgggacggccgcagccggtcccgcagggacaggggagtgtccggcggcgctcccggagacggagcctccggctcccgtacggcccccgactcccctacggacgcccgcgcctgtacggcctcccccgtgaacggcgcgtccacctcgggcacctcggcgggcccgagcgacgcctcggagcccggctcccgttcctccacgggcaggcccacgtgcggctcgggctccctggccgactgcacccgcagggcccaggtcggccggcggtccggccggaccgcgggcgacccggtgggcggtgtgcccgggcccggacgcacatccggccggcgttccaggtggtcgaagtcgacgtggaggccgagcgccagggtgtcggcgtccagtttcctcgcccaggaaggaccactccccgccccggcggcctcgcgcgcccccagatcggcgaggtcgccgtccggcgccgcgtcctcgggcacggcgggcgacggcgcggtccgcacgatcttgaacagcttgggcgcggcgatcgccacgatcacggcgaggctggagatctccgcgacgcccgcgccggtcaggcccatacgggggagcaggatcagcgtcagcccgagcaccaggacgcacagcaggccctggagataggcgagtccggaggtgcggctctgggcgcgcaggaccgcgaagtacgtctccatgacgacgcgcagcagcgctccgacggcgaaccagcgcagcagcggggtcgccgcgtgtgcgtagccctcaccgaagacgcgcaggatgaacggcgccccgacgaacaggatcccgcacaccggcagcatgaggcgggccatccgcctgagcgccgcccgggtgttcgcggcgagccgcgccgggtcgtgcgagccctcgacggtgagcgaggcgcccatgttgatggccagcaggttgaccgttccgccgatggtcgtggtgatgtagaagtacgcgttgttctcggagctgacctgcgaggcgacgatcacgggtacgaggtagaccaccgcgagcgagaacagcgagccggtgtagtcgccggccaggaaccgtccgacctccttgagtgtcggcggccgcgtgtggtccttggtcgccttcacatgccggggcaccaggcgccggaagaccagccagcccagtggcaccacggacgtggcgatcgccgcgacccaggacacgaagacgccgctggccgggatcgccaccgcgaaggcgacgagcagggccagcttcaccgcggagaacacggtgttgcccacgggcacccacagcgcgctgcgcagcccggtcagcaccccgtcctgaagggtcagcagcgaccaggcgacgaccgcgacgatgaagccgagcccgttgagcggtccgtgcaggaagcggtacgagggcccccatgcgttgagcgtcagcaggaagaccaccgcggcgagtgcgacgacgaccgagctgcccgcgtacgtacggaagatgaggcggccggtggcgcgtccggagaccgggatgaagcgggcgagcgcgcccgtgagtgtcaccgcggtcaggcccgcgaggagcttcatcgcggcgatcgccgcggagccctggcccaccgccgactcgtcgtagtaccgggccgcggccagccagaagcccaggccgagcaccgcggagataccggtgttgagcatcagggcgtaggcgttgcggaacagttggctgccgccgcccgcgcccttgccccggccgggcaggcgaaggcggcggccggactgctgcgcggccgcctcggtggtgggtgtctcggcctgggtggtggtcgtgtcagacacgggaacggatggccttccggcggacctgtcgtgctctgcggaccatggcataccccttggtgagggcgcggtccctggcgaagtcgagggcgatcgcacggccctcgacgagccgcgtgaactcctcgacaccggtactgcggcgcacggtgacgcgccgcagggcgtacgggccctggcggcggcgtgccagcgcgttgccgacggcgagcgactgagcgaaacccgcctcgcgcaccgcctcgcgcacccggcggctggagtagccgtaggggtacgcgaacgacaccgggcgggcgcccagttcgtcggcgacgatctccttgcagcgcagcagctcgaaccggagagcgtcgtcgtcgatctcgtcgagctgcggatgcgtgtggctgtggccgcctatctccacctgcgcgtccgcgagttcgcggacctggtcccagtcgagcatggtgtccaggccgccaccggtgtcgtacgcgccccggatccagcccgtcgagacgaacagggtggacgcgaaaccgtgctcggcgagcaccggcagcgcgtgccggtgcactccctcgtagccgtcgtcgaaggtgatgaggacggggcgctcgggcagcggaccgcccgagcgccagctctcggcgagctgcgcggtgctgaccggagtgatcttcaggtcgccgagcagcgccatctgctcggcgaacgcctcgggggcgacggacagggcgcgggtcgcgtcgttcggcgccgtcgcgatcgagtggtacatgagaatcggcacggccggttccctcatgctgcttccccctcgctgtccgggggctccaccaccgagaaggtggcgccgcccctacgggcccggacactgccgagcacatacccgccggccgccgtgagcaccccggcgacgatggcgcccgcacggcccgcgccgcccgggcgggccagcgccgcgtcgcgcagaccgcgggcgaccccggcgggcaggacccgggtcgtgtaccggcgctcggactcgagtcccttgccggcgccgacacttcgcgccaccagggccttggagagaccctcggcgtaggtacgggtgcggaagtaggcgaagtgctcgcgcggctccggcacccggtgatggatcacggcacggtcgtcgatcagcaggatcgcgtccggtctggcccgggtgaggcggatgcacagctccgtctcctcgcagcccagcggacgcttgtcgccgtcgcgcccgatgcccgtcgcgaaaccgcccgccgcgtcgaacgccgtccggcggaacgaggcgttgcccccgaggacgttgcgcacccgcacgcggccgggcggcaggcccttgtacgtgcagcccaccacccagtcgaactcctcggggaaccaggccgggcggcggcccgacgcccagatgggcatcgtacggccgccgacggccatgacccgcgggtcctcgtacccctcggcgaagtgccgcagccagtcccgttcggcgacggcgtcgtcgtccaggaacgcgatgatctcgccgtgcgaggccgcgatcccggtgttgcggcccgcggacaggccgcgggggcccgcgttggcgagcacccgcacctcgggaacctccttgtactcccgggacaatcgttccagcagtgtctggtggtgatccacgaccagcagcgtctcgcgcgccgggcgggactgcgcccgcaccgaggcgaccgccgcgaggatgtccgcccagcggtcctcggtgtagacgcagatcaccaccgagatgtccggactgctcaagacacctctccctgacccgagttgagctgcatggcgtgcggcctgctgcgcagcgcgcgccggttggagcgctccttgaggatcaccttgagtacccgcaacccgtcccgcacggcccgcagattgctcgcgccgtggatgcggaggtactcgtggctcggtatctcctgcaccttgagaccggccttgaccacccggatgttcatcagggtctcgacctcgaagccggtgcagtcgaggtcgatctggtccaggcagtgccgccagaacgcgttgtagccgtagcagagatcggtgtagcgggcgccgaacttggcgttgacggccgcgcacagcacccggttgccgagcttgcggatcggcgtcatgtcggaggtgccgcccccgttggcgaaccgcgaacccttcgcgaagtcggcccccgacaccagcgccgagacatagctgacgatctcctggccgtcggccgagccgtccgcgtcgaccatcacgatgatgtcgccggtgcaggcctcgaacccggtgatcagcgcatcgcccttgcctttgccccgctgctcgacgaccttgacgtcgggccacagctcgcgggccacctcgacggtgccgtcggtggaattgccgtcgaccagaaccacttcgtgtatccagtcgggaagggacttgaagacgtagggaagattctccgcctcgttcatggcgggaatcacgacactcaccggaggcgtgatcgccaggtgagatgagatggcccggtaattaccggtcgtaaatggatcttggcccgaaaccgccgggcgcaggaatgagctcacgagtctggtccctctcgtccggtggaccgcccgcccctgggcggtccggctctgtgtccggttcgaaaggggggttgtgttcccacttacggcatgacgaaatggatctccgtgcatgccgggtgagctggcaaagccggccgtctgtcgtgagaacggcagtcggtcgcgcggcacgactcggcacagttgcggtcaccgagcacggcacccccctaccgcgccccgcgccgggaccatcgcggtacctgagccctcccctggagccgcgtgatgatggaccgatgcgggtgagatgtacgacggtattgatgattgagcctttatggcaagacctggaacgaggcctcacgtttttgttggtttggccgttacctaacgactcgaacggattttccccatccgtttgagtatcctgtcggccgactcgaaaagctccggccgggacagcaccgcattgcgcagtgcccggaccggggcgcgatgcgccctgtgcccgaacgcgatcgggtgacggcgcgtcacccacccctcggacacggcgatttcccgtgtcttgagggaatccttgtaatccttctgaccccggccgagatccagatgggcgatgccgtccgccgccgcggcctcggccatgcgcagatgcaggatcagcccgggcgagtacttcgcgtacgccgggtcgtacgccgggaaccagcacgccagcacccgctcactgcgcagtccgaagtgagcggcgaccggcctgtcgtccgcgtagagcaccgagaggatgcccgcgaacggctcggagcgggagtggaagagctgctgcaccaggtgggtgatccaggcgtgcgcgaagcggtcgctgcgcccggtcctgcggtactgcgcggacttccaggtcatcagtgtgcgcagcgcggccggatcgcgctcgtcgtggacgtagcgcacgccgccggtgtcccggccgagcttgcgctccttggcgagcgtggtcctggtgaacttcggcgaccgggcgcgcagtccgcgcagatacgcctcgtagccctggtcgacctccatcaccggggacgggaaggtgccggcggctcccgcctcgaacggcgcctggcctgccaccaggtggtcgaactcccacagggcgagcccgcaggcctggagcagctcctgggcgtcccaggtgaagccggccctgtgcacgaggccctggcagtcggagacaccgagaccgacggcccggcccacgccggtggccgtcctctggaacgggaagaacgcggcgggctccccgtcctcgcgggcgaccgcgatacgtacgccgcgtctgcagcggcccaccgcgagtgtgaactcgggggacaggaacgggttcgccagctcgggcgagccgtccagatgggccttcgactgcaaggccgtccaggccgcccggtcggcggcgctcagttcgccggggcggtacacgctgatgtccacgtcgtcaggcccgtcttcttgccgtacggccgcgcagccgccgtacgagtaccagcaggagaacgagggagctgatcgcggtgacggccgcgatgccgccgtggaccgaccagcggtgcacggccagcatgccctgggccaccagcatgtcgacggcgacggctcccgcaaccgagaccaggacgcgaccgaagggttccagcccgcgcagcacggcgccgatggcgacggacggcgccgcgagcaggaagaacagcgtgaacgggccgcgcaggggtgagtccacgtcggcgagcgcgaggaccgcgccgactcctccgatcgcggtcgctgcgcccgcgagcagcggcgacaggtccctccccggaccctgccccgaccgctgtgcgctgtctgttgaaggtgtcttgatgcgtatggtctgcattggcgactttgccccccgaagcgccggatgccgggcttcaatgtcgcgcagcggacggggggccgtcaagatgcggacggcgctcgcgcgggttccggggccgctttaaacatgcgttccccgaaggcgcgggacgcctccggggaacggtggtgcgggtcgacgggaccggtggttacgggacgatcttcaggagcctgttcggcgatccggtgcccgcgctggtgaccttgccggtggtggcgccgccggtcagggccgaggcgacctgtgccggggtggccgaggtgtggccggccagatagacggcggccgcgcccgcgacgtgcggggtcgccatcgacgtaccggagatggtgttcgtggccgtgtcgctggtgttccagcccgccgtgatcgaggagccgggcgcgaagatgtccaggaccgagccgtagttggagtagctggccttggcgtcggtgctggtggtggcgccgaccgtgatcgccgcggcgacccgggcgggggagtacgaggaggcgttggcgctgctgttgcccgccgcgaccgcgtaggtcacaccgctggcgatggagttcgacaccgccgtgtccagcgaggtggaggcgccgccgccgagcgagaggttggcgacggaggggccgctgtggttgttggtcacccagtcgatgcccgcgatcacgcccgcggtggtgccggagccggcgtcgtcgagcacccggaccgccacgatcttcgccttcttggcgacgccgtaggtcgagcccgcgatggtggtggccacatgggtgccgtggccgttgccgtcggaggcggtggtgtcgccgtccacggcgtcatagccgtacgaggcccggccgctgatctgcgcgtgcgtgatgcgtacgccggtgtcgatgacgtacgccgtcacaccgctgcccgccgtgtccgggtaggtgtaggtggtggagagcgggagcgaggtctggtcgacgcggtcgaggccccaaggggcgctggactgcgtggtgtcggtcaggtgcaccgtctggttctgctcgaccgtggccaccgccgggtcggcggcgagtctcctggcctcggtcgcggagaggttggccgtgtagccgttcagcgcggcgccgaacgtcttcttcaccgtgccgccgtactcgttgatcaggcccttgcccttgctcgacgcggccttgaagccggtgcccttcttgagcgtgacgatgtagctgcccttgatcgcggtgggggagccggcggcgagcaccgtgccctcggccggggtggcctgggcgggcagtgcggtgaatccgcccacgagggcgccggtcgccacggcggttatcgcggcgatccggatcttcttgctacgcagctgtgccatacgagggagtcctcctctgggcagcggcgcgcctgggtggggcgcacggctgtggggggtgcgcgcgtcatcacgcacacggccctggagcgtcgtgttccgccctgggttgagtaaagcctcggccatctacgggggtggctcaagggagttgagaccctgtcatgagtctgacatgagcacgcaatcaacggggccgtgagcaccccggggcgaccccggaaagtgccgagaagtcttggcatggacacttcctgtcaacacgcgtagctggtacgacggttacggcagagatcctgctaaagggaggttccatgagacgttcccgaattacggcatacgtgacctcactcctcctcgccgtcggctgcgccctcaccggggcagcgacggcgcaggcgtccccagccgccgcggccacgggctatgtggccctcggcgactcgtactcgtccggtgtcggcgccggcagctacctcagctccagcggcgactgcaagcgcagttcgaaggcctatccgtacctctggcaggccgcgcattcaccctcgtcgttcagtttcatggcttgctcgggcgctcgtacgggtgatgtcctggccaatcagctcggcaccctgaactcgtccaccggcctggtctccctcaccatcggaggcaacgacgcgggcttctccgacgtcatgacgacctgtgtgctccagtccgacagcgcctgcctctcccgcatcaacacggcgaaggcgtacgtcgactccaccctgcccggccaactcgacagcgtgtacacggcgatcagcacgaaggccccgtcggcccatgtggccgtgctgggctacccccgcttctacaaactgggcggctcctgcctcgcgggcctctcggagaccaagcggtccgccatcaacgacgcggccgactatctgaacagcgccatcgccaagcgcgccgccgaccacggcttcaccttcggcgacgtcaagagcaccttcaccggccatgagatctgctccagcagcacctggctgcacagtctcgacctgctgaacatcggccagtcctaccacccgaccgcggccggccagtccggcggctatctgccggtcatgaacagcgtggcctgagctcccacggcctgaatttttaaggcctgaatttttaaggcgaaggtgaaccggaagcggaggccccgtccgtcggggtctccgtcgcacaggtcaccgagaacggcacggagttggacgtcgtgcgcaccgggtcgcgcacctcgacggcgatctcgttcgagatcgttccgctcgtgtcgtacgtggtgacgaacacctgcttctgctgggtctttccgccgctcgccgggaaggacagcgtcttccagcccggatccgggacctcgcccttcttggtcacccagcggtactccacctcgaccggcacccggcccaccgtgaaggtcgccgtgaacgtgggcgcctgggcggtgggcggcgggcaggcaccggagtagtcggtgtgcacgccggtgaccgtcaccttcacggactgggccggcggggtcgtcgtaccgccgccgccaccgccgcctcccggagtggagcccgagctgtggtcgcccccgccgtcggcgttgtcgtcctcgggggttttcgaactcccgcctccggcactcccgttcgagctgctgctcgtcgtgcctgccgtgccgccgccgttgtcacgggtcagcagggcgtacgtcagtcccgccagggcgagggccagcgcggccagtcccgcgatgacggcgacggccgcgcgtcggttgcgggcgggttcgggggaggccgcctccgcgcgcgccgccgagggccgtgtggctgccgaggcggggaccgggcgcggaggagtgtccgacgggcccgggaaggcggtgaccgtgggcgagtaggccgacgtgccggtgcgcggggtgccgcccgcgccgatcagccgcaggtcctgctcggcctgttcggcggggacgcggtccgccgggtccttgcgcagcagcccctcgatgaccggggccagcgggcccgcccggaacggcggcggcaactcctcgtccacgaccgcgcggagcgtgctcagcggggtgtcgtggcggaacggagagttgccctccacggccgcgtagagcaggacgccgagcgaccacaggtcggactcgggtcccggcgtacgccccagtgcccgctcgggggcgaggaactcgggcgagccgatgacctcgccggtcatggtcagcgccgagctgccctcgaccgtggcgatgccgaagtcggtgagcaccacccggccgtcgttcgccatcaggacgttgcccggcttgacgtcgcggtgcagcacccccgccgtgtgcgcggcgcgcagggcggcgagcacctcggcgccgatgtgcgcggcccgctgcggcgagagcgggccctcggcgtccagcaggtcggacagcgcgatcccgcggatcaactccatgacgatccaggggcggccgtcctcgtgggcgacgtcgtagaccgtcacgacgttccggttcgcgacgcgggcggcggcccacgcctcacgctccagccgggtgtacatccgctcgatctcggcggccgggagccccgccggggcgcgcacctccttgaccgcgacctcgcggtgcaggacctcgtcgtgggcgcgccacacggtgcccatgccgccctcgccgaggggggacagcaggcggtagcgtcccgcgatcacacgttcactgcccggttcttcggacacgggcgtccccccatcgcatccgcgcgattgctccactccgcgtgatttctccccaaaagtagctcacccgagtgcggatgccgcccccttgagcaccaatccggccccgagagctacgacgacgaacgcggaccccaggggcacggtcctgcgcaccagcgcggccatcggcccgtcggtccagcggggacgccggttcagcacacgtgtcatcccgctgcccagcttgaccacggcgaacccggccgcggtcagtgtgagggcgagtccgacgccgtatgccacgacgagcagcagcccgaaccacgccttccccagcgccgcggcgcccaccaggacgacgacggccgaggggctgggcaccagcccgccggcgaagccgagcaggatcgtgccgcggagggtgggggcgatctcgtgggtgtgggtgaagccgccgtgggtgtgttcgagggtgggggagtgggggtgcttgtggtcgtggtcgtggtcgtgcttgtggccgtggccgtggccgtggttctcgttgtgcttgtggctgttgctgtggttgtggttctggtcgtgcgggtgggtgtggggtgcgtcgtgcgcgtgggtctcgccgtgcgcgtgtgcgaggaccaggggccgctcgtgcgcgtgttccctgtggtccgcgtgatcgtgatgcacgtgatcgccgtggtcgtggctgtggtcgtggtcgtggctgtggtcgtgcttgtgcccgtggtcgtggccgtgcgcaggcacccggttccgccaagcccgtcgtacgagggtcatgcccgccgtcgtcaccagaaccccgctcgcgatgcccagccaggcgatcaccgagggcgcggccgccgaaccggcggtgaccaggaggccaagggccaccacgcccaaggtgtgggtgaccgtcaccgacgcggccagcggcaggacgtcccgaagcgtggcgcggccgccgcgggccgccgccgtcgcggccatcagcgtcttgccgtgccccggcgcgagcgcgtgcagcgcgccgaggccgaccgcgatgagcagcgccagcgcggcgaagccggccgtcagatcgtggcgggccaccagaccgtccagcgcccgggtccagcggtcggcgccgcgcgggagcacggaggcggcgggtgcgtcccgctgctcctcgacgagcgcggggccgccggggcgtacccgcagggacgcggccgcggtgtcggccggggacgacagcaactgcttggggtagctggtcagttcctgtgacaccgacttcttcggtacgtccgacgcggtgagcgtcatacggtcgccgcgcgcggtgatctcccgccagccggggccggacgtggcgcccgcgctgtggaagccgagggtgaccgagtcgcccttgggcaggggtgccgtcagccggcactccacccgtagggtgttcagccccgcctggccgggccgcacgcgcgcgtggctggtgccggcggagagcgcgacctggcggccgccgacggtcaccttgctgtcgtgcgcggccgtctcgcaccgctgccgcgcccagtcggtcatgccgagcttcttgatctccggcttggcctgggtcgccgggatctccgcgaggtcttcgacgtggtcgacccggagctgtcctggggcggcgacgagaccgtcgtaccggttgacggtgaagttgccgagcggatgcgcgctcgccggcccggacgggacgaggacgagggcgcaggcggccgtgagtacggcggcgcaggaggcgaacgcgcggcgggggttcacttcgccgcccccagtgccgtgcgggcctcgcgggcgccgagcggtgagaagcccgggttcaggtcgagggccgacttcagggaggcgcgggcgtccttcgcgtcgccggcggcgcgctcgatgatgccgcggtggtagaggaaggacgcgttgtggtagcccgtggcggtggcccgacgggcgtacggcagggcgtccttgtcgcggccgttgacgtgcagggcccaggcgagcgcgtccgcggtgtgcacggtgtggcggcgggcccattcggcgcgggccgccttcagcgcggccttggcgtcaccgtggtcggcggcggccagggccgtgtcgaggtcggcgttgacgccgttggcgcgggccagcgcgacccaggcgtcgaccagcgcgtactggtcgcgggccttctgcggattgcccttcttgccgcgcgcctcgtacaactcacccagttccaccagtggttggggcagcgggaagcgctccacgacctgctccataccgcggatcgccgctgcgctgtcgccctgcgcggcctgggcgcgggcccggccctcgagagccgggaggtagctgtcgtcggcggcgagggcgcgcgcgtagtaggtgagggccgccttgtactcaccctggttccaggcgagttggcccagcgccgacgcgacgtacgagatgtcgccgcggctcgtggcggtgctcagcgcctgctccaggacgcggcgggcggttttcacgtccccccgcagttcccggacgtaggcgtaccgcgtgaagaccgggacgccggggcgccgttggtcggccacgtcggcggccttcgacgcgtcgtcgtagcggccgagttcgacgagggcgtcgatacgggaggacagggcgcgctcgctgtacgggttctgcttcagcgcccggtccgcgtaggtcagggcgccgtggaagtcgtgccgggcggcggcgagggcggcgcgtccggcgagcgccgggtcgttgtcgggccgcagtcgcagggagcggtccagtgcgcgctgcgcctgcgggtagcgggaggggtcgcccttggtgcgggcctgctcgatgtacgcgaggccgagcgtcgcccagccgccgaagtccttgggctgggcccggaggtgagcctggagggaggtgatgctcgcgtccaggtcgccactggcgagcagttgcggggacacggcgaccggcgcggcggcggcattggcggttccgccgtcccggacggcgccgagcaccacggccccggcggtgagtgcgaccgccaacgcggccgcacagaagccgagttgggccgcgcgccaacgacgcccggacacggacagccggcggacggcggcgacacgctcgtcgcgcacgccatcggccccggaccccggggcctgcgccagggccttcggcgccacggcctcctgcgccggggcctcctgggccacggcaccggcctggagctccttggccgtagttcccgctgcgggctcttcggccgtggtgtcggccggggacttcttggccgtggcgccggcgggcttctcgggcgcggcgccggtcggcggttccttgaccgcagctcccgctgcgggctcctcggccctggcgtcggccggtgactccttggccgtagccgccgctgcggactcctcggccggggcggcggccgcggattgctgagccacggcgtcggcgggcgattcctcggtcgtagcgcccgccgaggggtcctcggtcgtggcgcccgccgagggcttctcggtcgtggcgcccaccgagggttcctcggtcgtggcgccccccgcggattcctcgggcatggccccggccgtaccggtcgccgaagccggtgtgccggtctcggcggtcccggcctccggcccggcgggcggctgctcgccgccgtcgctctccggcgcgctgtcgttcgtacgcggggacatgccctctcctcgatgtccttgagggaaacggtcgttgtggcggatgagcggcgcggcccgcaccgtgggggatgggttacgtgcgggccgcgccagtcagtgggccgggactagtacgcccggttgcgccgacgccaccacgccagaccggtggcgatcagcaggaacccggccgcgcccgccgccgcggaggccgcgatcagcgtggtgttggaaccgtccgtggcgttcgcgatcagaccgtcgcccagctggttgcgcacgctgttgccggtgccgccggcggtcttcccgcgcgaaccggccgtcggctcggccacgtacgggaaggagtgctcgaacttcttgtcgttcttgttgaccgcgtcacccaagtcgttcttggagccgaccagttcgccctccacgacctggagcgcctcgtcgatcacgtcgtcggtgagccggcgtccgttcgggaagcccgcgttgtcgccgtcgagcacaccgagccgcttgggcttggcggtgggctcgatcgaggtgttgagccgcagttcctcggccggtgtcacgtgcggcggctggttgaggcccttcacgcccttcaggaacacgtcgaccaggtcgttgcgcggctcggcgggcgccttgatcttgtagatcgcctcgatgagcttcggcagctccgggttggtcacgttcttcaggaactgcgcgtcctcccagggcgaggacgcgttgaacttgtccttgtccttctgcgggttgacgacctcgttgaccagcgggttgccgaggcgcgagacctgcgtgtagtgaccgcgggcgtccttgcgctgggtcgtggaccagatgccgacgatcggctggtccttcgactcggtgatcatgtcggtcggcagctgaagggcgatcgagttgacgttgtagcccttgagggtgtcgcgcccgacctccgacaggtctccgccgtacagcaggtcgaagacccgcagatccaggaagaacgggtcgtccgcctggccggcgaacgtcgtggagtcgcccgcgagcttgtacacggcctggttgcgcagcttggtgtagtccggcatcgacgccttgccgacgttcgacggcgccacggggatgtcgtccgcgaccttcgtgcgggagaccagcttctggtcgtgcagcctgagcagatcgatgtcgtacgtctgcgtgatgttcaggtcggggtcgtcgaggctgtccaccggacccgtgttgtacaggaacgtgtcgccgttcttgcggtgcgtcttgaacgtgtagcggtagatcaactcgccctgggcgtcaccgttgttgtcgatgtggatgtcgtactgggcgtcctccgcgaacgtgtagaagttcggaccgcccgccggatcctcgaacgggatccagttcgcgatgaccgtcgtcgtgtccggcttgtccgggctcacgaacgcgtacacgtcggtgttgtcgtactggggagtgcccgagatcagcggggcctcccggtgactggaggcggaggccgcccccggttccagcgcggtgacgccggcggccgcgagccccccggcggccagcgcaccacttatgagggtcgcaaggctcctgcgtcccgcaccgctcctggagataggtgtcatgccgtccgtcctcagtgccaacttgcctgacgaaccgcattcggagcggtcgccggggtggattggtcgaatcccaaacgttcttacggtgactttcgccagttgtttcatcggcgcgggacccgcgttttcgcttcccccatccgtaaccccatccgaagacgtgatcgctgcgaatacttcagtgaggcgggacgggccggagacggccggagaggggggactggtgggggtgctggtgcatgcggacgagctcctggtgctcgtggccgaaggtgaccaacgggcattcgaagagctgtacggactggtgtccgggccggtgttcggtctggtgcgccgggtcgtgcgggatccggcgcagtcggaggaggtggctcaggaggtgctgctcgaactgtggcgctccgccgcccgcttcgaccccggccggggcagcgccctctcctggatcctcaccctcgcgcaccgccgcgcggtcgaccgggtgcgcagcgcccgcgcggccggcgaacgcgagcagcgcgaggcgctccgcgcccaccaccccgccttcgaccaggtcgccgaggaagtcgaggccggcctcgaacgcgagtgggtacgccgctgcctggaccgcctgaccgccctgcaacgccagtccgtcaccctcgcctactacgacggctacacgtaccgtgaagtggccgagcggctctcgctgcccctcggcacggtcaagacgcgaatgcgcgacggactcacgcggctgcgcaactgcctgggaggagccgcatgagcgccctcgaccgtctgctgcgccgcgatctgcactcgcttgccgcgccctacgccctcgacgccctcgagcccgacgaacgccgtcgcttcgagagacacctcaagggctgcgaccgctgtgcggcggaggtgcgggacctgtacgaggacgcggtgcggctcgcctggtccacggcggccccgccgccggcggcgctgcgggaccgggtcctcagcgccgtacgcagcacaccccaggaagctccccagggtgcgtcgcgtgcgcgggagccgcatctgccggcccatgtctggggaaccgcgccgcccccggcacgcgcccgcgcccgccgcacgcgccccctcttcgtcccgctcgccaccgccacggccgccgccgccctcgtcgtggcgtcactgttcgccgtgcaggccggccgaacccaggaccaactcgccgagcagcaggcccaggcacgtgagatcgcccacgttctggccgctcccgacgcccgggcgaccagtgaccgggacgcgaagggccgtggtatcggagtgatcgcctccgcatctgaggggcgcgcggtcgtcaccctgagcgggttccgggcgccgtccggcggccgcgtgcatcagctgtggctcatgcgccccaacggccaaccgcgctccctcgggctcttcgacggcgacgcgcccttggtcgcgagcgggctgaacaccaaggcgacgtcacttgctgtgaccgtcgagcccgacggaggctcagcgcagcccaccagccagccagttgtccaactcgccctggaatcggtcggattcggagagtaaccgtcaacacccttaccggcaaggtgaatcctgcgcccgcgatacccgagtgccacgagggggcgatagggttagcctgcccgggccgggtggactcgtacgggtggggagtgacatggaacagataacagtgcgcagcagggcacgggtccctgcgatcacctgcgggagcagcgcgaccagctcgcgcctcgaccgccatctcgcagtgctgggcggccccgccatcccgcagcgcgagacggccgaggccacgtcgctgatgcgtgagctcaccgcgcgtgacaccgcgcacgaccgcagcggcaggggcgcgcgagtgaggcgagtctcgctcttcgcaccactgcgccgactgcgccgttcgctgttcggcgggcgctgaacaaaccggcgttccacaagggcccgcgctcacgccacaccgacccggcacgcgctgcgatctcgtcgtccatcatccccacggcacgcagcggcgccccggtgtaccgcatgagtgcgggccctttcccttctccccccgacgccccaccacccccggcacccccctcgcgcgtcacccgcgcggtctagatcagcgcgaactggccttccggaccctcttcgtggtggtcgagcaccgaagcgggccgacgtgccgcatccggtaccgggagcacaccggcccggtacagctcggccgcggtgaccggtgcccccgccgccgactcgccgtggcgcgggccgatctcgcccagcagggcgagcacggtgatgagttccagcagttcggacgtccacgcctgcggccaggccgcggggcgcaccgcctccagcgtgcccggctcggcgggctccgtgcggcgggcgaaccacgcctcgaggacccggaccccgccgacgtggaaatcccaggcgccgcccggcaccggtgagatccggccctcgccgatgtgcagggcctcctccgcgcggtcgtagaggagttccagggggcgggcggggagcggagcgcggacgtaggggcggcgcccgcccggcagcttggggcgctcgccggtgcggcacatcagccacagcgtccggtggcccgactccgtgccccgggaccagaggccggggtccgcggtgagcggcacctcgatgccctcggggcccggccgcgcggccgccagaatccaggccagggcgtcgacgggtgacacggggcggcccaggcgtccggcgagatgctccaccaggcccggtgccaggttcggttcgagacgtcccgggcgccggtacagcgggcggacgggacctgagcggacggccggcgacttcaccggcagcagcggcgaagccagcagcagggggccggtggacccgggcgcgaccgtctgctcggccacgaacacctggccctcgtccgccacccgccacagctcgggccgtgccgcgtcgaggagccggtggtccgggatcagccactgttcgtcgaacgggtcgccgagcacacgcacgggctccgggcacgggcccgtcgcacgggcgagccgccccgtcccgctggactggcccggcagctgggccaccgcggagtgcagggtgcgtgcgcgggtcggctcgaacaaggcctcgcggtccggcccctcggccttcagcagggcgtcccagcgcgccttcagcgaggccacgtcgggcgccatcggccagccacggcccagccgcagaggtgcgaccgaccacggcatgaggtccgcgagcagcggagcgtcgtcgtgcgtcacgctgggcatcgtacgacgtggccggccgacctcaagggggtcatgagggaacggggatcagtcggcgtcgagggtgaccgtgaacgagaagcggtcgccgcggtagtggatgaccgccacgtccaggacctgtccgtcctcgtcgtacgtcacgcccgtgtagtgcaggatcgggctgagcagcggcacttggagcagccgcgccgtctccggatccgccagccgcgcctccacggtgtcggtgatacggccgatgcgtacgcccacgacgtcccgcagcaccttggtcatcggccagcgggccaggtcgtccaggccgatgcgctcggccagttcgggccgcacgtagttgcgggcgtggttcgtcggctcgccggtccgctcgtcggcgcgcagccggtggtacgtcgccacctcgtccacatccgggaaatactcggcgagttcccccgaaacgggtgatctgccgtgctccagcagctccgccaccatgcccgactgctgcgccacgatcgcgtccaccgagccgagcagccgcaccggggcgccccgctggacgcccggctcgatgaacgtgccccgtcggcgatggcgggtgatcagcccctcgtcctccagctccttgagcgcctgccgcatggtcagcacgctcactccgtagtgccccgccaactgttcctcggtcggcaggcgcagcgggtcctggggcgaccggccgagtatcgaggcgcgcagggactgcgatacctgataccagagcggcagtttgcggttcagaacgatcgagtccggggcgaaagaggtcacgagggctatccgtaccggtcgcgggcgtgcagtgcaacgggcggtggcgctcagtccgacggacggaagtggcgctggagcccctgccacacgtcgtcgtacgcgggttggaggtgctcggcgcgggccgcctgggccgtcgcggtcaccggccagcgcgtctcgaacatgaacgcgagaccgtcgtcgatcttctgcggccgcagctcggcggcgctcgcccggtcgaaggtctcccggtcgggcccgtgcgccgacatcatgttgtgcagcgaccccccaccgggaacgaaaccggccgccttggcgtcgtaggcgccctcgatgagccccatgtactcgctcatcacgttccggtggaagtacggcggccggaacgtgtcctcacccaccagccagcgcggcgcgaacaccacgaagtcgacgccggcgagccccggggtgtcggacggtgaggtcagcaccgtgaagatcgacgggtccgggtggtcgtagctgatggtgcccagcacattgaaacggcgcaggtcgtaggtgtacggcacgtggttgccgtgccaggcgaccacatccaggggcgagtggtcgtatgtcgccgtccagaggttgccgcagaacttgttcaccacctcgacggggccctcgacgtcctcgtacgcggccacgggagccttgaagtcccgggcggccgcgagtccgttggcgccgatcgggccgaggtcggggagctggaagggggcgccgtagttctcgcagacgtagccccgggcggactcgtcgaggaggtccacgcggaagcggacgccgcgggggaccagcgcgacctggcccggctccgcgtgcagcagcccgaactcggtgcgcaggagcagtccgccgcgctccggcacgatcagcagctccccgtcggcgtcgctgaagacgcggtccatcgaggagttggcgtgatacaggtgcacggccatgccggtgcgctgggtggcgtcgccgttgccgccgagggtccacaggccgccgacgaagtccgtcccggcggggggctcgggcagcgggttccagcgcagccggttcgggtcgggcgccgtctccgtgaagggggcggtgcggatcgcgccgttgtccgcgcgggtgaacggggggtgcgcggccgaggggcggatccggtacagccacgagcgccggttgtgtgccctgggctcggtgaacgccgagccgctgagctgctccgcgtacaggccgagcggggcgcgctgcggggagttgcggccctcggggagggcgccggggaccgcttccgaggcgtgttcgttgccgaacccggtgagatgggccagtccttcggcggtcttccgtgcgtccccgctcatgatcgctccctcgttcctgattcctatgcatcaccgtaggattcgggtgcggtgtgcgcaagggggatggtggggaagcaggccggggcaggacccgccttccggacgcgcaagacccgacttcaggaggatccggctgtcggaggggtgctctactctccccggcatgtcgtggacgcgcggaccgctcgcggcgctcgcggtgtgcgccctgctcggcggcgcggcgggctgtggcgccgacggcgcgcacgggcggcggggcggggcgacggcctcgccggtgggcaagctgctggacgacacggacgagaggggacggcactaccgtgaagtcgacgagaagggcgcacccgaggtctccgtcgaggtccagccggactccgacgacagctgggacgtcctgctgaccgtccacaacttccgcttctcgccgcccggcgcgcgagcggtgccggtggccggacgcggtgtcgccctgctctcgctggacggccgcgccctcgcgcggctgcgcaccccggaccatcacctccccggcaagctggtcccgcgcggcacgcatcacgtcacggtgcgtctgtacgcggacgacggcacggtgtgggccgtggacggccggcccgtccagagcacggcggacatcacggcgtcggggacggggccgacgaggccgcactcgacgccgagcggggccgggggcggggcggagggggcgagcgggacgcccacccagggcaccggcgactccgcggccgggatgagtgtggggcgcacccatctccgtacagacgggcgaggttcaccggactcccgcggaaaggcatcatgaagcccgtgccccaagcgacatcgctgcgccgcgcgcccgtccaacgacggagcgccgaacggctgaccaggatcctcgacgcctgcgccgacctcctcgacgaggtcggctacgacgccctgagcacccgggccgtggccctgcgtgccggcgtgcccatcggctccgtgtaccgcttcttcggcaacaagcgcgcgatggccgacgcgctcgccgaacgcaacttcgagcgctacaccgaccgcgtcacccaccgcctcgagcagtcggacggcgagggtgactggcgcgcggcgatggacgcggtcctcgacgagtacctggacatgaagcgcacggcgcccggcttctccctcgtcgacttcggcaaccagatcccggtcggcgcccgctacgccgaacccaaccaccgcgtcgccgaccgtctgacggaactcctgtcggcgtacctcggccgcacccccgacgacgacctccgccgcacgttcctgatcgcggtcgaaaccgccgacaccctggtccacctggccttccggatgtcccccgagggagacgaggacatcatcgcggagacccgggcactgctgagggcctatctggggcgcgtactggactgagcggagcccgggcggcggcgaaggggccggcggcactcgcgacgggccgctccgcggcgaccggccggcggtcggccgtgcgcgggtttccgacgaggtccccggcagcccctcccctcctgccataccgctcggtatgctcggctcgatccgtgcgtcaccgttgccgccacccctctgggaggacccgtgtcccgcaccgccctgcgtatctgccccttgtgcgaggccacctgcgggctgacgctcaccatcgaggggacccgggtgaccaaggcccgcggcgaccgcgacgacgtgttcagcaaggggttcatctgcccgaagggcgcgtccttcggggcggccgacggagacccggaccggctgcggacgccgctcgtccgcgaggacggggagctgcgcgaggccacctgggaggaggcgttcgacgccgtcgccgccggactgcggcccgtcgtcgaggagcacggaccgcacgccgtcggtgtcgtcctcggcaacccgaacgtccacaccatggccggcgccctctacccgcccgtcctgctcgccggtctgcgcacccacagcctcttcaccgcctccaccgtcgaccagatgcccaagcacgtctccagcggtctgctgtacggcgacgcggtggccatccccgtgcccgacctcgaccgcaccgaccatctgctgctgctcggcgccaaccccctcgaatccaacggaagtctctgcaccgcccccgacttccccggcaagctcaaggccctcaaggcccgcggcggcaccctcaccgtcgtcgacccgcgccgcacccgcaccgccaagctcgccgaccggcacgtcgccatccgccccggcaccgacgcactgctgctcgcggcgatggcgtacgtgctcttcgaggagcggctcgtcgacctcggggagctcgccccgcatgtccagggcgtcgacgaactcgccgacgcgctgagggacttcacccccgaagcggcgagcccgtcgtgcgacgtaccggccgacgtgatccgggagctcgcccgtgaactggccgccgccccgaccgccgccgtctacggccgcatcggcagctgcaccgtcccgcacggcacgctcgccagctggctcgtcgacgtgctcaacatcctcaccggcaacctcgaccggcccggcggcgccctgttcccgctgtccgccaccgacaaggcgccccggcccgccggacccggccgtggcttcgcgctcgggcggtggcacagccgggtgagcggacacccggaggccaagggcgagctgccgctgtccgcgctcgccgaggagatcgacaccgccaccggcgagggcagcccggtccgcgccctcatcgcagtcgccaccaacccggtactctccgcgcccgacggcgaccgcctcgacaaggccctcggctcgctcgacttcatggtcagtgtcgacccgtacctcaacgagacctcgcgccacgcccatgtcgtcctgccgccgcccccgccctcccaggcgccgcacttcgacttcgcgttcaacgccttcgccgtgcacaaccaggtccgctacacccgcgccgccgtccccctggaacccggccggatggcggagaccgagatcctcgcacggctcgtgctcgccgccacgggcatgcacggcgccgcccccgacgccgtggacgccctggtcatcgaccagacactgggcaaggccgtcacggacccgcacgcgcccgtgcacggccgcgacccgggcgaactcgccgccgtgctcaccggggacagcggccccgagcggcggctcgacatgatgctgcgcctcggcccgtacggcgacggattcggcgcccggccggacgggctcaccctggagaaggtgctcgcccacccgcacggcatcgacctcgggccgctcacgccgcgcctgccgcagcccctgaagacacgcagcggcaaggtcgagctgctgcccggacccatcgccggcgacctgccgaggctgcgcgaggcgctgcgggagcggtccgaggggctcgtgctcatcgggcggcggcatctgcggtccaacaacagctggctgcacaacgtgcccgccctcaccggcggcaccaaccgctgcaccctgcacatccaccccgaggacgccgagcgcctcggcctcaccgacggggcgccggtccgggtcaggggcgccgggggagcggtcacggcccccgtcgaggtcaccgacggcatccggcgcggggtcgtcagcctcccgcacggctggggccacgaccggcccggcacccggatgagccatgccgcgctggaccccggcgtcaacgtcaaccagctcctcgatggcagcctgctcgacccgctctcgggcaacgccgtgctcaacggcgtacccgtcgagctgacacgcacatcctgacctggagttttgcgcttattgctcccatgtcaacgtcttgttaacagttctcgacccgacttaacgtcatcgccaccgccggccctggtgggagttcaagggcgaacgttaggtatccattcatgctgaccatcctcggcttcaccatgatcgcgaccttcttggtcctgatcatgctgaagaagatgtcgccgatcgcggcgctcgtgctgatcccggcgctcttctgcgtcttcgtcggaaagggcgccaagctcggtgactacgtcatcgacggcgtcaccagcctcgcgcccaccgcggcgatgctgatgttcgcgatcgtctacttcggtgtgatgatcgacgtcggcctcttcgacccgatcgtgcggggcatcctgcggttctgcaaggcggacccgctgcggatcgtcgtcggcacggccctgctcgccgcgatcgtctcgctcgacggcgacggctcgaccaccttcatgatcacggtctcggcgatgtacccgctgtacaagcgcctgaagatgagcctcgtcgtgatgaccggtgtcgccgcgatggccaacggcgtgatgaacacgctcccctggggcggcccgaccgcccgcgccgcgaccgcgctgaagctggacgccagcgacatcttcgtgccgatgattccggccctcgccgtgggtctcctcggtgtcttcgccctcgcctacgtcctcgggcgccgcgagcgcacgcggctcggcgtgctgacgctggacgaggcactggagccgcaggaggccgagacggtgctggtgggtgcgggcggttccgaggagaagtccccgcgcgccaccggcggttccggctccggcaccgacgcggacgcccccgagtccgccaccgccgacgacggattccagggcctcgacccccaccgcgccaccctgcgccccaagttgtactggttcaacgcgctgctcacggtcacgctactcaccgccatgatcatggagtggctgccgatcccggtcctgttcctgctcggcgccgcgctcgcgctcaccgtcaacttcccgcacatgcccgaccagaaggcccgcctcggcgcccacgccgagaacgtcctcaacgtctccggaatggtcttcgccgccgccgtcttcaccggcgtcctccagggcaccggcatggtcgaccacatggccgagtggctggtctccaacatcccggacggcatgggcccgcacatggccttcgtcaccggtgtcctgagcatcccgctcacgtacttcatgtcgaacgacggcttctacttcggcatcctcccggtcctcgccgaggcgggccaggcgcacggcgtctcgtccctggagatcgcccgcgcttcgctggtcggccagccgctgcacatgtcgagcccgctggtgcccgccgtgtacgtcctcgtcggcatggccaaggtcgagttcggcgaccacacgaggttcgtggtcaagtgggccgcgctcacctcgctggtggtgctcggggccgggatcctcttcggcatcatctgatgcccggcgcctctcccaccgaacggcccggcaggggctggctgctgcgcctcgtcatcgccttctgcttcgcgcagggggcggtgtcgatggcgcggcccgccgtctcctaccgggccctcgcgctgggcgccgacgagcgcgcggtcggtgtgatcgcgggcgtgtacgcgctgcttccgctgttcgccgccgtgccgctcggccgccgtacggaccacggccggtgtgcgcccctgctgccgctgggcgttgtcctgatcgcgggcggctgtgccctgagcggcgcggccgactccctcgccgcgatggccgcctggagcggggtgatgggtctcggccacctctgcttcgtcatcggcgcgcagtcgatcgtcgcccgccagtccgcgccccacgaacaggaccgcaacttcggccacttcacgatcggcgcctcgctcggccagctgatcggcccggtcgtcgcgggtgccctgatcggcggcccggaccgggcgggcagcagcgcgctggcgctgctggtggcgggcgcggtcgccgcggtgtcctgcgcgtcgctgtggcgcatcgaacaccgtacgacggccaactcccgtaccgagcgcggcgatcgcatccccgtccaccgcatcctgcgtacccggggggtgcccgcgggcatcttcgtcagcctcgccgtgctgtcggcgacggacatcctcaccgcgtatcttccggtggtcggtgaacaccggggcatcgctccgtcggtggtcggtctgctgctgagcctgcgcgccgcggcgaccatcgcctgccggctggtgatgacaccgatgctgcggtggctgggccgggccgccctgctcaccgtgacctgtctcgcggcggcgctgctgtgcgcgggcatcgcgctcccggtgccggtgtgggcgctggccgtgatgctcgcggcgctcgggttctgcctcggcgtcgggcagccgctgtccatgacgaccgtggtgcaggcagcgccggacgacgcgcgctccaccgccctcgcgctgcgcctgaccggcaaccggctcggccaggtcgccgcgcccgccgcggccggtctgatcgccggagtcgcgggcgtggcggcgccgttcgtgatgctcggcgcgctgctgctgatctcctcgggaatcgcgctgcgcgcgccggggaagcaggtggtgcgacagcggaccggtggcccgcggcggtccggtgcgccattgggccggacgagggattcctgacagggtgtcgggcgcagctcccgcatccgccgcggcgaatgtgaaagagagtcaggtgaaagagcgatttgtatgaaaatcgtctgactcggaggacatacgcatgaccacctcgccactctcccgccgcgccggagcagcccgcaccggtgccgccgccgccctggcggttctcgccaccgccacgaccgcctcgatcggggcgccggtcgccttcgccgccccgggggacgaaggcgaactcaggatccacagagtgggtgcgcccctgggcgtgcccaaggacgactccaaggtctgccggttctacctcgacgcgaccaacttcgacggggcgacgaccgtcacctacaccatcgaggcgcagccgccgctgcccaacaccgcgacgctcaccggcgccatcatcctcgcggcgggtgtcggccgcacggaacccctcgccctgcccgacgggcagtacaagctgacctggcccgtccccccgagcgccaccgccccccagaaggagaagatcttccgggtcgactgccgcgaagagaacgagcacggcgaaaaggagtacaacggcgcgtcgggcccgcagggcggcggctaccagggcggcgacagccagggcggcgccggccagggcggcgacagctcctcgcagggcggcggacacgagagccagggcggcgggaacagctcctcgcagggcggcgaggacggcccgaagggcggcgtccacgcgggcggcggcgggctcgccgacatgaccgaggcggtctcgccggtcgccgcgacggcggccgtcgggctggtcgtggccggaggcgtcacgtacttccggctgatccgccgtcggccccatggcgccgcgtaggcggctccgcaggccctggtaccggactcgcgcctaccgcctcaccaggacggccgcgctcgtggccgtcctggtgacggtgggcaaccggtgcggacaggacgacgagccgggcgggccggccgtcctcgccgggcccgagcggcccgcggtggcggccgacgccgccggccccggcaccgacgcgcgcggtcccgggaccggagcggagcggaccggccggtcggcccggtccgctccgccgcccaccccgctgccgcgctcccgggccaccgtgctgcgcatcccgcatctgggcatcgaggcgccggtcatcggcctccggctcgaccgtgaccggcagctcgccacgccgccggtggacaaacccaagctcgtaggctggtacgagggcggaccggcgccgggcgagaagggcacggccgtcgtcgtcggccaccgcgacaccaggaccggccccgccgtcttcgccgcgctcggccaactgccgccgggacggctggtcgaggcccggcgcgcggacggacgcaccgccgtctacaccgtggaccgggtgcagacgtacgagaagtcgcactttcccgacaaggaggtgtacggcaccaggaagcgccccgagctgcgtctgatcacctgcggcggcacgtacgaccgcaagaagggctacgccagcaacatcgtggtcttcgcccacctcacggcgacccggaagggctgaaccccggcggaacgcccgcgggggctgaaccccggcggggacgcccgcgaggctcttccggaacgtcgccccaggtcctcgtccccccggtatcgcgctccgccgcggcgcgcgggccccgctccatcgtgacccggaaccctctggcgtcccaaaactaacatcgctagtttggggcgcggacgacgctgcccgactccggaggaagacgatgaaggcacaggacggcatgtacatcgacggcgcctggcggcccgccgcggggccggacatgatcgaggtcgtgaacccggccgacgagcaggtgatcggccgggtgccggcgggcactcccgaggacgtggacgcggccgtacgtgccgcgcgtgccgccctgaccgcctgggccgcgaccccgcccgccgagcgggccgcgcggatctccgccctccgggacgtcctggtggcccgccaggacgagatcgccgagaccgtcacggccgaactcggctcaccgctgtcgttctcgcagagcgtgcaggtgggcctgccgatcctggtcgcgggttcgtacgccgaactcgcggcgacgtacgccttcgaggagagggtgggcaactcgaccgtccaccacgagccggtcggcgtggtcggcgccatcaccccctggaactaccccctgcaccagatcgtcgccaaggtcgccccggcactcgcggcgggctgcacgatcgtactgaagcccgccgaggacaccccgctgaccgcccagctcttcgcggaggcggtccacgaggccggtgtcccggcgggtgtgttcaacctcgtcaccggcctcggcccggtcgcgggacaggcgctcgccgagcacgaggacgtcgacctggtctcgttcaccggctcgacggcggtcggcaggcagatcggtgccacggccggtgcggccgtcaagcgggtcgccctcgaactcggcggcaagtccgccaacgtcatcctgccgagcgccgacctcgccaaggcggtgaacgtgggcgtcgccaacgtgatggccaactccggccagacgtgcagcgcctggacgcgcatgctggtgcacgcggagcggtacgaggaggcggtcgagctggccgcggccgccgcggtgaagtacgcggaccgcatcggcccgctggtgaacgccaagcagcgcgcccgggtgcgcggttacatcgacaagggtgtcgccgagggcgcacggctcgtcgcgggcggccccgaatccaccgagccgcagggctacttcgtcagccccaccgtcttcgccgacgtcacgcccgagatgacgatcgcgaaggaggagatcttcggcccggtcctctcggtcatccggtacgaggacgaggaggaggccctgcggatcgccaacggcacggtgtacggcctcgccggcgccgtctgggcgggcgacgaggcggaggcggtcgccttcgcccgcaggctcgacaccgggcaggtcgacatcaacggcggccgcttcaacccccttgcgcccttcgggggttacaagcagtcgggcgtgggccgtgagctcggcgcgcacggcctcgccgagtacctccagaccaagtccctccagttctaggagcgtcgcccaccatggtccgcgcagctgtactgcccgccgtcggtgctccgctggagatcaccgggatcgaactgcccgagcccggtcccggccaggtccgggtccggctcgccgccgccggggtctgccactccgacctgtccctgtccgacggcaccatgcgggtgccggtcccggccgtcctcggccatgagggcgcgggcaccgtcgtctccgtgggggagggcgtcacccaggtgtcgcccggcgcgggcgtcgtcctcaactgggcgccgtcctgcggaaggtgccacgcctgctcgctgggcgaggtctggctgtgcgccgacgcgctgaccggcgccgggaccgtgtacgcgcggcgcaccgacggctccgacctgtaccccgggctgaacgtcgccgcgttcgccgaggagacggtcgtcccggccgcctgcgtactgcccgtgcccgacggcgtgccgctcaccgacgcggcgctgctcggctgtgccgtgctcaccggctacggagccgtccatcactcggcgaaggtccagccgggcgagacggtcgccgtgttcggggtcggcggggtcggcctcgcgacgctccaggccgcccggatcgcgggcgcgtcgaagatcgtcgcggtggacgtctcgccggagaaggagtcgctcgcccgccgggccggggccaccgactacctcgtcgcctccgagaacacggcccgcgagatccgcgggctcaccgacaagcagggggtggacgtcgccgtcgagtgcgtgggccgcgccgtgaccatccgcaccgcctgggactcgacgcggcgtggcggccgcaccacggtcgtcggcatcggcggcaaggaccagcaggtcgtgttcaacgcgctggagatcttccactggggccgcaccctgtcgggctgcgtgtacggcaactcggacccggcgaaggacctgccggtcctggccgagcacgtacgggcggggcgcctggacctcggcgcgctggtgacggagcggatcgccctcgacggcatcccggcggcgttcgacaacatgctggccggcaagggcggccgggcgctggtggtgttctaggcgcgcctaggcgcgcggctccggggccggtcgaggaactggatccggagccggtcgaggagctggttccggggccggcgccggggccgtgtcctcgggcacaggcgcggtcgtccggccgcgcggccgggaacgcgacaccgccaccccggcgagacacagcaggccaccggccagcgtcagcggtcccggcacttcgtcgagcaccagccaggacatcagtacgacgagggcgggcacggcgtacgtggtcgcgcccatgcggctcgcggtcgtacgggcgagggcgtacgcccaggtcgtgaacgccagcgcggtcgggaagacgcccaggtagagcatgttgagggtcgcggagacgggcgcggcggccgcctcgtggacgagctgcccggcgaagggcagacacccgaccgcgccgaccaggcagccgaaggtcgtcgcctggagcgcactggcactgcccagcgccggcttctgcgcgacgactccgcccgcgtatccggcggcggcgagcagacacagcaccaccccgagaaccgaggatccgccctccccggacagggagagacccacggcgaccgcacccgcgaaggacaccgccatccccgcgagcaaccgcggcgacagggcgtcgccgagcagccgggcaccgagcagggcgatgaggatcgggccgatgttcacgaccagggccgccgtgcccgcgtccacctgctgctcgccccagttgagcacgaccatgtagcagccgaaccagagcagcccggacatgacgatccccggccaggccgcgcgcggcggcagaccctccccgcggacgagacagatgacaccgagcgcgaggacgcccgccagcagccggccgagcgccagcgcgcccggcgagtaggcggcacccgcactgcggatcgacacgaaggcggaggcccacaggacgacggtgacggccgccgcgcccgcggcgagcagctccgcgcggcggcggggtgcgggggtgaacgggggagtgctcatcatgctcccgaggctaggagggggacagacagggggcacgcggatttcggacgtcgtactgcggctgccgctgtgggtgtggctgtgcgtgcgggtccggctgcggccgctcttgaggcagcgccgctcatgtggtcgctgccgctcccgctcagcgcagcgcacccgtcgcgatgcccagcagcgccgcgagcgcccgctccccttggtccgtgaccttcacggcccgctcggagccgatgcgtacgcaccaccccgcgtccagagcgtgccggcacagggccgcgcccgcgacgcccgcgagatggggccggcgttcggtccagtcgaggcaggcccgggccagcgggcgtcggccggtgggttcgagaccgataccggcgtccgcgaaccacttcagcccgtcgtccgtgagcgcgaacccggtgtcctggcgcagcagcccacgtccggtcagcgcgtcggtgagggcgatgccgagccgcccggcgaggtggtcgtagcaggtgcgcccgcgggccatcgcggtgccggcgctggactcccgcagcgtgcgcggttgttcgagggcgccgggcgcgacctgggccgcgagatcctcgacgagctgcgcggtccgcccgtcggccagccgtacgtaccggtgccgcccctgccgctcctcggcgagcagcccgcccgcgaccagcttgcccagatgctcgctggcggtggaggccgcgactcccgcgtgccgcgccagctcgccggccgtccacgcccgcccgtccagcagcgccagcagaaacgcggcccgcgtctcgtcggcgatcagcccggcgagccgggccagccgcggcgcctgggcatcccgggacctgtgtcggctcgtcatgcgttccagcatgcggtacggacacttcggcacccgccgaagtgtccgtggcgggtgccgatcgcgaagaggcgcgcgcccccggtcgccgggcggcgggaactcggcgccagggccaggggcggcctagagggcccgccgtacctgctcgtactgctgcgcgagcccgtccagcaacgccgtgagccccgtctcgaacgcccgctcgtcgatcttctcctgctgctcggcaagcaggtgggcctgcccgaggtggggatagtcggcggggtcgtacgccgtctcgtcgtcgacgaacccgcccgcgaacgagcccagcgcggagcccatgatgaagtaccgcatcagcgcgccgatggacgtggcctgcgcgggcggccagccggcgcggaccatcgccccgaagacggcgtcggcgaggcggaggccggccgggcgtcgcccggggccccgggcgagcaccgggacgatgttcgggtggtcgcgcagcgcggcgcggtaggagaaggcccagtcgtgcagcgccgtccgccagttccggccgtcctcgaacatcgacaggtcgacctgcgcgctcaccgagtccgcgaccgcctcgaggatctggtccttggtgcggaagtggttgtagagcgagggcccgctgaccccgagttcggcggcgagccggcgggtggaaacggccgccaggccctcggcgtccaccagcgcccgtgccgcgtcgacgatgcggtcggtgctgaggaggggcttgcgcggtcgggccatggcgcacatagtagggctgcgcacgtaaactagcagtgctaatttaaatgtacggctttcaaatggggtgacgcgccatgaacctggagctcagcgaggagcagaccgccgtccggcagctcgccaaggacttcgtggaccgcgaggtcgccccgaacgtcatcgcctgggaccgcgcagaggaggtcgaccgctccctcgtcaagaagctgggcgaggtcggcttcctcgggctgaccgtcgacgaggagtacggcggctccggcggcgaccacctcgcgtactgcctggtgacggaggagctgggccggggtgactcctcggtgcggggcatcgtgtcggtctccctcgggctcgtcgccaagacgatcgcgtactgggggagcgaggagcagaagcggcagtggctgccggggctcacctccggcgcgtacgtcggctgcttcggcctcaccgagcccggcaccggctccgacgcgggcaatctgacgacgagggccgtacgcgacggcgacgactacgtcgtcaacggcaccaagatgttcatcaccaacggcacctgggccgacgtcgtgctcctcttcgcccgctccacggacgcacccggacacaagggcgtctccgccttcctcgtccccaccgacacccccggcctgacccgccgccccatccacggcaagctcggcctgcgcggccaggccaccgccgagctggtcctcgaggacgtccgcgtgcccgcctcggcgatgctggcgcccgagggcaagggcttctccgtggccatgtcggcgctggccaaggggcggatgtcggtcgcggcgggctgtgtcggcatagcccaggccgcgctggacgtggcggtgaagtacgccaccgagcgcgaacagttcgggaagacgatcgcccaccaccagctcgtacaggagctgatcagtgacatcgccgtggacgtggacgccgcccggctgctgacctggcgggtcgccgacctcgtcgaccgggggcagccgttcgccaccgcgtcctcccaggccaagctcttcgcctccgaggccgccgtgcgcgccgcgaacaacgccctccaggtcttcggcggctacggctacatcgacgagtacccggcgggcaagctgctgcgcgacgcccgcgtgatgacgctctacgagggcacgagccagatccagaagctgctgatcgggcgggcgctgacgggggtctcggcgttctgaggaacctcgttccgagttccgcgggacctggttccggccggcctcgtctgagtacgtcctgagtacggcggcggatgtggttccggccgtggccgccgacccttgtccgtatgagcgagacaccggtcaagcagcagaacacggcagccttctacggtcaggccgtcgcctctttctccgtcgccatggcggccaccgccatcggcatcttcaaactgcacgccgacgcctgggtgcggggcttcctggccatcgccgtcctgtacctggtgacctcggccttcaccttggccaaggtgatccgggaccggcaggagggcgcgcaccccgcggggcgcgcgtacggccccttcgaaaagctgtgatccgttcgcccacccgtttgccgactcgttcatccacccgttcgcaccgcgctgaacgggcactctaagcgctcgctcaccttcagaggtatggtgttcgtcctgccactggaaggggcgagtgatgagtacggcggaggagacggccggcggcgagatccagccgtgggccgaggtcacccctgacgcggcccggcggttgctggtcgccgccgtggaggccttcgccgagcgcggctaccacgcgacgaccacccgcgacatcgcgggccgggccggcatgagccccgccgcgctctacatccactacaagaccaaggaagagctgctccaccgcatcagcaggatcgggcacgagaaggcgctggagatcctgcggccggcggtggagggcgagggcagcgccgccgagcggctctccgaggccgtacggtcgttcgtgcgctggcacgccgggcagcacaccaccgcacgggtcgtgcagtacgaactggaggcgctcggccccgacgcgcgcgccgagatcatcgcgctgcgccggcagaccgacgcggccgtgcgcgggatcatccaggacggcgtggcggcgggcgacttcgacgtcccggacgtgcccggcaccaccgtggcggtgctctcgctctgcatcgacgtggcccgctggttcaacgtcaacggcccccgtacgcccgacgaggtcggcgcgctctacgccgacctcgtgctgcggatggtgagggcgaaggtctagagggtggatccgaaggacaccccctggcccgctcccgccggcggcctcagaagtagtagcgcgacaccgactccgccacgcagaccggcttgtcgccgccctcacgctcgaccgtcaccgcggccgtgacctggacgccctcgcccgcctccgtgacctcctggaggacggcggtggcgcgcagccgtgagcccaccggcaccggcgcggggaaacgcaccttgttcgagccgtagttgacgcccatcttcatgccctcgacccgcatcacctgcggcaccagcgcgggcagcagcgacagcgtcagatagccgtgcgcgatggtcgtgccgaacggacccgcggcggccttctcggggtccacatggatccactggtggtcgcccgtggcgtcggcgaacagatcgatccgcttctggtcgacctccagccagtcgctgtaccccagctgctcgcccaccgccgccttcagctcgtcggcggatgtgaagatcctcggctctgccatgtccctggcctcctgtgtcgccatgtctaagcaactgcttagcatggtcgggcggggggcccatgtcaacgggccgcgagtgtgacgaggtaggtaggcttcgaggggtgccccagattcccgagaagatccatgagctcacggtcggccagctgtcggcccgcagtggcgccgccgtctccgccctgcatttctacgagtccaagggcctgatcagcagccgccgcaccgcgggcaaccagcgccgctaccaccgcgacgcgctgcgccgggtcgctttcgtccgcgccgcgcagcgcgtcggcatcccgctggccacgatccgcgaggcgctcgccgaactccccgaggagcggaccccgacgcacgaggactgggcgcgcctctccgaggcctggcgcgccgaactcgacgagcgcatcacccagctgggccggctgcgggaccatctgacggactgcatcgggtgcggatgcctgtcgttggagacctgtgtgctctccaacccggacgacgtcttcggcgaacggcggacgggctcgcggctcatggtggaccgcgccgcgagccggccgcggcgcacaccgggtcagcagcagcccgaggactgctgctgaccagtcctgaccagtccccggcctgctgcggccggtccggtcactcgtactccgtgccgcccttgcgggtcagatacgccggactgaccgccttcgcgatcgcccggccgccggtcaccgggctgcgccgctcggtggcggaccggatcacgacgccctcccgcagatgcagcccgtgcccggagaccgtctcccgtccggaggcggtctccaggacccgctcgatgtcgtacgggccctcgtacagcctgggtacgaggggcagttcgccgtccagccgatccgccgcgtccagccagcggacctcgccgtcgatgtccgcggacacgtcgaacacggcgtacccgagggtgtcgcggcggccgtccgcgccgtacgtcaggtcctgtacgccggccccgtacacctcgccgaagatcccgacccggcgtgccccgagccgttcggcgaggcgggccgcggcctgggccacgccgtggccgtgcacggcgcgccagtacagattgcgcggatcctccttcagggcgagggacttggcgccgaagcccttcgaggagacatgcacacggtcctcgtcggcgaggtacgtcaccaggcatgccgtgccgtgcagcttctccgtcaggacgacgggttcgccgggcgtgaagatgtccgggtagcgctggatgttctcgatgtcgacccagcgcagcagatcgggcacggactcgatctcgccgctcatcgtgggcgggatcggcggcacccacttggtgatgccgagcagctccgcgaagtcggttccgtccgccaccgtccgcgcgaggtcgacgtccgccagcgccttcggccggcagacgatcccctgcgacagctcaccgcgcagccgtacggccttgacccggtcggagccgctgcccgcgaggcgtccggtcagccccagctcctcgatcagcccggccggcagcacggactgctccgggatgtagacggcggtctcgccggtgcgatacgcgcccttggcgacgacggcccggtacaggcccacctgggccagttcgagggcgtcggcgttcgggtgggggtggatggtcagcacttcggcggtgacgcgcagcgtcgacatgtcagggctcctcgggttcctcagccgggtttcatcgcccccaactgtccctacgggaaaggggtggagcgagccgatttggtgctggtagcgtcgggctcttcggccggcggcgaggtcgtgcgcggagtcctgaccggaacatctcccacgccctcaccagccctcgacgccgcctccaccgccactttgcgctccaggagcgcccccgcgacgccctccgcgccgggctcgtgccggttgaccgaggcgtgatcgggtaggacggtccattcacggacgcgcgccacccgggccgcgggatccggttccccccatgcgcccgtggtcgccccgatcggaacgcgaacctgtgaacgtatctcttcgagtgccgtcgcaagcgctttcgccgacaatgtgtgctgtccgcaaggggacttgggatgcacgtggacgtccaccggcaccatgcccccgatggtgccccccgccactgacaaccagcctcgacccggggcgaaccggtgttcaggagacggagaaggaggagaaatgagcgtcgtcatcagctcgttgaagtacgaggccgcgcactcgggggcgcagaagatcacatacgacaacgacggctaccacctggtccgcttcccgtacgaggtgagcgaggagtcgtacgacccctggaagatgcacgatccggcccggggcggtggccaggcgtcgacgtacccggacacccgctccgggctgatctggcccagccacgacggctgggccgtgctgtccgcgatggtcttctgggaggccgacgcccgcgcgctggagtaccgggcgcgcttcgtgcgcgacccgctgggtgtctccacggggtacgactcgacggccacgaacgacacgacgctcacccgcggcggccagtaccgcacttatctctggcagatgttcgtgcatccggggacccccgtcggcctgaagatctcggcgcgcggtgtcggtgacgcgaagatcgccgtaccgatcaccctcgccgagttcaagctcgccatccacacggacgtcaagacgccttcgtaggcagcgcctttcgggcgctcgtccgatcaggacaccccgggcacgcgcacgggggcgcggccttctgtgcgcacccccgtcgtgctcacgccgacaccagcagccgtccgcgcctggcctccaccagggcttcgggtgtcagaacgggccgcggcaccactattccgcagcccgtgcagaccgggcccgacgacggttcgtgggccaggtcgtacttccatgtgaggcgctccccggcgcacacggggcaggcctcgcccggctcgcgctccagtgcggcgatgagccggcgcagcacctcggccagtgcttcatggggatggacccgtgggtcgtcgcaccaggcgacgccgaaaccgccccaggtcagccggtgccagtcgtccacgctgcccggcctgcgcagcccgtcgtgcttctccttcttgcggcgctgcgcgaactcgacctcgtaggcgagccagacggagcgggcctcctccagctcgtccagcgcggccacgagccgcgccggatcgggcgaacggtcctcaggaccgaacccggcccgggagcacagatggtcccaggtcgcccgatgcccgtagggggcgaacctctcaaggcacttgcgcagtgagtaccgccgcagtgccagatcgcacctcggatctcgcacctgtctcgccagactccggaaaccggccatcgccttgcacctccgtcacacctgcacctgaacttcggtcacttcggcgtcgtcgaacggacgtcgccgaatagacgtatcgacaagcaattcggctccatccgattttcgatgaccgccataagccacccgccgagtcgtcccggcttacctcccgccgctgtcagccgcctgtcggcggcactgtccgactgcgatgaatcccaaaaactgacgcatgttcatcttcaatctcggggataccggcggtaacgtccggcccacccccgtcggtaggagctgccatgtcacggcgcaccccacgcatcgccctcgacagactgagaactcctcgcagaatccccaagttcctcaaggccgcttcgatatgcgtcctcgtcgccggtcttttgtcccccgtcacccaggtggccgccgccgacacctcggccgcggccgccggtgactactgcggcggccagtgttccgacatcctcccgcccggcgagaacggcaacgccaccctcgcccagatcctcctcaaccaggccttcggcacccagcccgaccacgccgaggaccagctcgcgccgtacggcaatctgccctccggctactccgcgctcaccgacgcgaagatcaacaacttcttcaacgacgcctccttcggggtcgcctccgaccaggtcgcctccaccaccaagcccggcgggcgcagcgacgtgacgatcgtccgcgacaagaagacgggcgtcccgcacatcacgggcacgacccgttacggcactgagtacggagccgggtacgccgctgctcaggaccggctctggctgatggacgtcttccggcacgtcggacggggccagctgacctccttcgcgggtggcgccccctccaaccagggcctggagcaggagttctggcgcaacgccccctacaccgaggccgatctgcaggcccagatcgacagcgccatcgcgaacaacggcgcccgcggccagcaggccctggccgacgccaacgcctacatcgagggcatcaacgcctacatcgacgcctccgacagcggccgctacttccccggcgagtacgtcctgaccggccacaaggactccatcaccaacgccggcaccatcgaccacttcaagctcaccgacctggtcgcgctggcctccgtcatcggcgcgctcttcggctccggaggcggcggcgaggtcaacaacgccctctcgctgatcgccgcccagtccaagtacggcgtgaccgagggcaccaaggtctgggagtccttccgcgagcgcaacgaccccgaggcggtcctcaccgtccacaacggcgagagcttcccgtacgcgtcgaagcccgactccccgcagggcgcggccctgcccgacgcgggctcggtgacccaggagccgctggtctacgaccgcaccggcagcgcggccaccgccggtgccaccggcgcctcggccacggcggccgccaccaccctcacctcagccaagcgcggcatgtccaacgccctcgtggtcagcggcaagcacaccgcgagcggtcacccgatcgccgtgttcggcccgcagaccggctacttcgcaccgcagctgctgatgctccaggagatccagggacccggcctgagcgcccgtggcgcctccttcgcgggcctgagcatgtacgtggaactcggccgcggccaggactactcctggagtgccaccacctccggccaggacatcatcgacacctacgcggtcgagctgtgtcaggacgactaccactacctctaccacggcacctgcacggccatggacaaggtcgagcggaccaactcctggaagccgaccaccgccgactccaccgcggccggctcctaccgcatgcaggtctaccgcaccaagtacggccccgtggaataccgggcgacggccggcggcaagaaggtcgcgtacaccaccctgcgctcctccttcctgcacgaggccgactcgatcatcggcttccagatgctgaacgacccggactacgtcaagagtccgcagacgttccagagcgccgtgcagcacatcaactacaccttcaactggttctacgccgactccacgcacaccgcgtactacaacagtggcgacaacccggtacgcgccacgggcgtcgacgccgagttcccggtctgggcgcaggcggcgtacgagtggcggaactggaacccggcgacgaacaccgccgactacacggcggcgtccgcgcaccccaactccgtcgaccaggactactacatctcctggaacaacaagcaggccaaggactacaccacggcctcctggggtgacggctccgtgcaccgcggcaacctcctggaggaccgggtgaagaagctggtggccgcgggcggggtgaccagggcctcgctcgtgaaggcgatggccgacgccgccctcgccgatctgcgggccgaggacgtgctgccgaagctcctgagggtcatcaacagctcgacggtcacggacaccacggccgcggcggcggtcggcaagctgtccgcgtgggtgacggccggcgccaagcgcacggagacctcggccggctcgaaggcctacgccaacgccgacgcgatccgcatcctggacgcctggtggccgctgctggtgaaggccgagttcgaaccgggtctcggcagcgacctgttcaccgccttcaccagcaacctgccgaccgacgagcccccgtcgtccgcgcacggcccgaccggcgcgcacgccggaagctccttccagtacggatggtggagctacgtcgacaaggacatccgggcggtgctcggcgagccggtgcagggcggactggagaagtcgtactgcggctccggcagcctcagtgcctgccgggacaccctgatcagcaccctcaaggaggcggcaggcaagaccgcggcccaggtctacccgggtgacgaccagtgctcggcgggcgaccagtggtgcgccgactcgatcgtccagcggacgctcggcggcatcaagcacggcaagatcacctggcagaaccggccgacgtaccagcaggtggtggagtacacgtcgcaccggtgacaccgggcgcaccgacaactccccagcggcggcgggtcagcgtatgcggcccgccgccagcaccacctgcgccagctcccggtgcacgatgtcactgtgcgcgccggtcggcgggccgccgcgcttgacgaccgcggcggcgtcgacgttcacacagcccgacgccggcagctcggcccgcagcgcctcggcgagggtgaacgcgcgcgtgccgtccaccgcctgcaccccgtcgtggcccatcgcaccccaccgggggcccagcgtccgcccgatgtcgaagtcggccccgagctccccggcggccgaccgcgcgtcaccggccatgcgcgacgccagcggatacatcgttccgagcgccgagtcgaagtgggagtagcagcacaccagcggaccgtcgatgcggctctggagaccgtgcagcgccccgctcgcgtgcgtgtcgtgcggcagacgcgccgcgaacgcgtagtgcgagaaggccccctggagcagcgtcacggacttcaccgtgcgcacccccgccggcagtccgcgcagcgcgaacgacaccagccgtcccccgaaactgtgcccgaccagatgcacgcgtacgtccggcgccgcctgtgcgagccggccgaggacgcgcccgagtccccgttcgccgaccgtccccgcgcgccgcttcatcgcgtagtacgtggcctgccgcagcagctcgtgcgccccgtcccacagccccgccggcgtgaaggagaagtcgaccgcgccggacgccgcgctcgtaccgtgtaacgacgcgacccggtcgagcgcccgcgcgaagtcgcggcacaccagcgccgtgtcccccgagagcatctcggggccgctcaccggcccgcccgtcgccagggtgtccgcggcgcacgcgtcctgcggatcctgcggccgcgcctcgaccagcagccgtacgagctgtccgaacgtctccagcgaggcctcctcgtccggatgccgctccagcagccgcgcgatctgctcgacgagcgtggcccggtcggggaacacctccaccagcgcctgcctggcccccttggcgagggccgggcgcgcgaccgccgtgacctcggccggcacggacgccgggaagtcggggatcggctcgtccgggaagatcatcgagggccacaccacacccacgtacccgagacgcgcccgcggtgcgagcgccgggaccggctggaagaagcggctgtagagccgggtggcccccgagcgttcgttgttccagccgtgggcgaagacgaccaggtcatggaccttgcgctgcgccacctgcgcgagcagccgatcccgttcccggccgtccacgtccccgtccgcgtcgaacgtcagctcccagtagggagtcacactcattgcccgttccgccatgacaggcccccttggcccctgtggtcccacgatgtgggcgtatcgtcctgccggcgggggaggttggccagatgtcacgtgcggtccggtgcgaccgaaccgaagtgccgggtgcggtcgccgcttcagcggtagacgaggtactccttgcgtacgcggcggaacgcggccagctcgtcctgccaggcggccaccacctcgtcggcggtcgcccccgcgtcgatcatggtgcgcacccgcgcggagcccgtcagcttgtcgatccagttgtcggagcgccaggtgaagccgctccagaccttcttggcggtcaccagcagcgcgactccggtgcgtacggggtcgtaggcggcccggtcgtgcacatggatctgcacacccccgacggtcttgccctggaacttggagaaggtgggcgcgaagtacgcctccctgaagcgcacgccgggcaggccgagccgctcggcctcgcgagcccaccggccgtcgatcccgtccgcgccgagcagctcgaacgggcgtgtcgtcccgcgcccctccgacaggttcgtcccctcgaagagacacgttcccgcgtacacgagagcggtgtcgggggtcggcatgttcgggctcggcggcacccaggggaggccggaggcgtcgtagaactccgaccgtttccagccggacacgaggacggtgtccagcggtaccggcgtcgtcaggaactccccgttgaacagccgtgccagctccgcggccgtcatcccgtgcgcctgcgcgatcggctgccggccgacgaacgtcgcgaactccttgtgcagcaccgggccttgggccgtccgcccggtcaccgggttcggccggtcgagcaccacgaagcgcttgcccgcgagcccggcggcctccatgcagtcgtacagcgtccagatgtacgtgtagaagcgggcgcccacgtcctggatgtcgaacacgacggtgtcgacgccggacgcggtgaagacgtcggcgagcggccggccgctcttcagatacgtgtcgtagacgggcaggccggtcgccgggtcgtcgtagcggccctccgaaccgcccgcctgcgcggtgccgcggaagccgtgctccggaccgaagaccgcggtgaggtgcacccggtcgtccgcgtgcatcacgtcgacgatgtggcgcactcccccactctcggcttcgctcgagcgggaggggcccccactggtgacgccggtggggttcgtgacgatgccgacccgctgcccgtcgagcagcccgtagccgtccgcggcgagccgctcgaagcccgtgcgcagccggccgccgtccgccgcggccgggggcgcggtcagcgacacggccgccgtggtcgcggcgagcagccctcgtctggacagtttcatgcggtgacctccgtgatcgacggaactgtcatggccacgcacgctagtgcgcacaccggccccgaggaacgcaccgcaccggccttgtcaccgggaccccttccctcgctacataccgactggttagtctgatgaggcagcagagccgactgccgcagaaccatgcgcgtcgcgtcgaaggagaccgatggtggaagccgtgcaggatgccggagtggtcgtcaccggagcgggaggcggcatcggtgccgcactggcccgccgcttcgccgccgagggggccagggtcgtcgtcaacgacctggacgccgttcgggcgaaggccgtggccgacgagatcggcggcatcgcggtcccgggcgacgcctccgcgatcgtggccgaggcacgggacgccctcggcggcacggtcgacgtgtactgcgccaacgcgggcctcgcctccggcggcaccgaagccgccgacgagaaggtctgggcgctcgcctgggacgtgaacgtgatggcgcacgtccgggcggcccaggaactgctccccggctggctggagcgcggcagcggccgtttcgtctccaccgtctcggccgccggcctgctcaccatgatcggcgcggcgccctacagcgtcaccaagcacggcgcgtacgccttcgccgagtggctctcgctgacgtaccggcaccggggcgtgcaggtccacgcgatctgtccgcagggcgtgcggaccgacatgctgaccgcgtccggcagcgcgggcgacctggtgctcgcgccgaccgcgatcgagcccgacgacgtcgccgacgccctgttcaaggggatcgaggaggaccgcttcctgatcctgccgcaccccgaggtcgccgagtactaccaggcgcgggccaccacgcccgaccgctggctggcgaacatgaaccacatccagcagaagtgggaggcggcccgatgaccggatccccctacgcggcgaagccctggaccgccctgctcaacgatgcccagggcgcccccgtcgcccccgtcgcctccctggtgcacgccgtacgcagggccgccgccgacaccccggagcgcaccgccctcgcctacttcgacgggcggatcacctatcgcgcgctcgacgagctgagcgactccgtcgccgggcacctcgccgcgcgcggtctggagcgcggcgaccgggtggcgatcctgctccagaactccccgcacttcgtgctcgccctgctcggcgcctggaaggcgggcgcgatcgtcgtgcccgtcaacccgatgtacaagtcgggcgaggtcacccatgtcctgaaggacggcgaagtggccgccctcgtgtgctccgaccgcgcgtgggactcgtacctgcgggagacggccgccggtacgccggtacggatcgtgctcaccgcctgcgagctggacctccagacccgtaacgacgcgcgcgtgctgaacttcgagcgccttccgcaggctgcggacgccgacgacctgatcgcggtcgcccggcgagggcacaaggcgcccgccgaccgcgcggccgtcccctccgacatcgcgctgatcagctacacctcgggcaccagcggtgctcccaagggcgccaccaacacccacggcaacatcatgtacaacgccgagcggcagcgcaccgggctcgccctgcccgggacgcccgtctacttcgcgatggcgccgctgttccacatcaccggcatggtcgcccagctcgccggatgcctcaacagcgcgggcacgcttgtgctcgcgtaccgcttcgaggccggggtcgtgctcgacgcgttcgccgagcaccggccggtctacacggtcggcccctcgaccgccttcatggcgctggccgcgcacccggacgtcacccgcgaccacttctcctcgttccggatgatctcctcgggcggcgcgccgctgccgcccgccctggtggagaagttccgcgccggcttcggcccttacatccacaacggctacgggctcaccgagtgcaccgcgccctgcgcctccgtaccgcccggcctggaagcccccgtggacccggtctcggggacgctggccgtcggcgcacccggtcccgacaccgtcgtacgcatcgtcgacgaccagggcgaggaggtgcccttcggggagcagggcgagatcctcgtccgcggcccgcaggtcgtgcccggctactggcgcctccccgaggccaccgccgagaccttccccgaaggcgagctgcgcaccggcgacatcggcttcatggacccccagggctggctctacgtcgtcgaccgcaagaaggacatgatcaacgcgtccggcttcaaggtgtggccgcgcgaggtcgaggacgtcctgtacacgcatccggcggtgcgcgaggcggccgtcgtcggggtgccggacgggtaccgcggggagaccgtcaaggcgtacatcagcctgcgtccgggggccgacgaggacccggctgcgttcgccgcgtactgcaaggagagactggccgcctacaagtatccgcgtcaggtggagatcctgcccgacctgccgaagacggcgagtgggaagatcctccgtcgggaactgcgttcccggtccggcgaaacccagtagacaacactcggaaggcaggtggcggcagtgcccaggacgacggacggtgacggcacgcccgtcccgcagcggctcctcgccgccgccacccggctcttcgccgaccgtggctacgaccgcacgtcggtccaggagatcgtcgaggcggcgggcgtcaccaagggcgccctgtaccactacttcggctccaaggacgacctcctgcacgaggtgtacgcgcgagtgctgcgcgtccagcaggagcgtctcgacgcgttcgcggacgccgacgcgccgatcgaggagcggctgcgggcggcggcggccgacgtggtcgtcaccaccatcgacaacctcgacgacgcgatgatcttcttccgctccatgcaccatctgagccccgagaagaacaagcaggtacgcgcggagcggcgccgctaccacgagcgcttccgcgcgctgatcgaggagggccagaaggagggcgtcttctccaccaggacgcccgccgacctggtggtcgactaccacttcggctccgtgcaccacctgtcgacctggtaccgcccgggcggcccgctcaccccgcagcaggtcgccgaccaactggcggacctgctgctgcgggcgctgcggccgtagttctcctccggcgcatgggtaaggggcggtcgccatggcgaccgccccttacccatggctcacaggtacttcgcccgtggctcggctcagacgtacttcttcagctcccgccgcgccagcgagcgctggtgcacctcgtcggggccgtccgcgagcttcagcgtgcgggcgctcgcccagagttcggccagcgggaagtcctggctgacgccgcccgcgccgtgcagctggaccgccttgtcgatgatgtcgacaaccgtacggggcgtggcgatcttgatggcctggatctcggcgtgggcccccttgttgccgaccgtgtccatcatccaggccgtcttcagcaccagcagccgcagctgttcgacggccacgcgggcgtcggcgatccagttgtgcaccacgccctgctgggccagcggcttgccgaaggccgtgcgggagacggcccgcctgcacatcagctcgatcgcccgctccgccatgccgatcagccgcatgcagtggtggatgcggcccggacccagccgggcctgggcgatggcgaagccgccgccctcctcgccgatcaggttcgacaccggcacgcgcgcgtggtcgaagatcacctcggcgtggccgccgtgggagtggtcctcgtagccgtacacctgcatcgcccgcttgacctggacacccggggtgtcgcgggggaccaggatcatggactgctgacgccggatgtccgcgccgcccgggtccgtcttgcccatcacgatgaagatcttgcagtccgggttcatcgccccggagatgtaccacttgcggccggtgatgacgtactcgtccgtgccgtcggaggcgcgctcgatcagcgtggtgatgttggtggcgtcggaggaggccacctcgggctcggtcatcgcgaacgccgaacggatctcaccggcgagcagcggctccagccactgcttgcgctggcgctcgtcgccgaactgcgcaagcacctccatgttgccggtgtccggcgccgcgcagttcagcgcggtcggcgccagctgcggggagcggccggtgatctcggcgagcggcgcgtactggaggttggtgagtccggcgccgtactcggagtccggcaggaagaggttccacaggccctggcggcgggcctcggccttcagctcctcgacgatcacgggcgtgtcccacggcgaggcgagccgctcgcgctgctcgtgggcgacggcctccgccggatagacgtgctcgtccatgaaggcgaggagcttctggcgcagttcctcggtgcgcgcgtcgaacgcgaagtccatggcggttcagccttcctgaagagtggtcaggccgtgctcgatgaagacggggaccagttcaccgatgcggtcgaagccgccgccgaccgtctggccgagcgtgtagcggtagtggatgccctcgaggatcacggcgagtttgaaccaggcgaacgccgtgtaccaggagacggcggacacgtcgcgccccgagcgcgcggcgtaccgctcgatcagctcggccgggtccgggtgtccggcggccgcggcggtggtgctgatgggcgagtccggcagcgccagcggcacgctgtacatcgccaccaggcccaggtcggtcagcgggtcgccgagcgtggacatctcccagtcgaggatggcggtgatccggtcgtccgcgccgagcagcacgttgtcgagccggtagtcaccgtgtacgaccgtgggcgcgggggagtggggcagctcgcggccgagtgcggcgtgcagctcgtcgatgccggccagttcccggttgcgggaggcgtccagttgcttgccccagcggcgcagctgccggtccaggaagccctcggggcgcccgaagtccacgaggcccacctcggcggggtccaccgcgtgcagctcgaccagcgtgtcgaccaggccgagcagcgcgccccgggtccgctccgggccgagcggggcgagctgttcggcggtgcggtacggggtgccctccacgaagtccatcacgtagaagggcgagcccagcaccgagtcgtcctcgcacagcagcaccgggcgcggcaccggcacggccgtcgggtgcagcgcgctgatcacccggtgctcgcgcttcatgtcgtgcgcggtggcgagcacatggcccagcggcggccgccgtacgacccacttcccggtgccgtccgtgaccacgtacgtgagattcgaccgtccgccctcgatcagccggccggtcagcgggccggtcaccaggccgggccgctcggcgtcgagcaggccgcgcagccggtcgagatcgagtcctggcgggtggtctgggctcatcattgctcctccgtgcgcggtaacgggacctgacacatgatgccgaccggtcggtatgtcgtccagtgcccggagcaaacgtgatcggcgccacggccgcacggcgccgccgcacgccggtcccgccgtgtcatcgctgccccggtcgccggtcgccggtcgccggtcgccggtcgccgcttcacgcgtggcaggcgaccatccgtccgccgttcatggccgcgatgtcgcggacggcggcgggcacgtccagcggtgcgccttccggcgccccgtccagctcggcgtacgcgcgatgcagattggccacgaaccgctcgctctccggcagcgctgcgaactccccgaggtccgtctcccgggccgcctccaggggagtgcggcccgccgcgtggctcttgtgcgcgatgtcggcgacgaagcgcagatagcgctccgtacggtcgaacgccgacgggtcggtgaccgggccgtgtcccggtacgaccgtctcggcgcccagctggcgcagcacgtccagggcccgcagcgagccactgagcgagcccatcagaatgaacggcgtaccgccctcgaagaccaggtcgccggtgaacagcacccgccggtgcggcaaccacaccaccgagtcgctcacggtgtgcgccaccccggggtggatcacctcggcgtccaccgcgccgacatggaccgtcgtgtggccggtgtacgtcaggtcggcggcctggatccggatgtccccgaagtcgttctccggccagagcagatgcagctgccgcccgttggccagtgtctcccggcggcattcggcgtgcgagacgatcgtcgcggtgggcgcgaagtggctgttgccgtaggtgtggtcgccgtgatggtgcgtgttgacgacgaagcgcggagcggggacgcccgcggcggcgatcgccgcgctcagggcccgggtccgccgctcggtggccgccgtgtccacgagcagggtggtcgtgccgtcgctcacgaacccggcgttgttcaggcaccagccgccgtccggctgcacataggcgtgcacgtcggcggcgagctcgaccgtgtaaggctccgctgcggtcatcagaccccctggatgtcgtcgactgatgtgtcagagcctgtcagtcggcggcgtcggatgggaatccggcgggccgtccggagatcgtccggggagcgcaggctgtgctcggatcaccgtactcttcgcattcggggttgttccggcgcgcgcggtgcttgtgcggggcgggcggccggcgcgcctagagcaccagcgccgccgcgcacagggccagggcgaccgtgcagaaggccgccgcggccgcgtgccgtggggcgagcgcgggcgggcggtgcgctccggccgtcgacaggtcgcggatgcggtggtgggcgacggcgaggaagccgacccagagcgcgcagcacagcgcgcagacgatcagtcccgccgccgtgccactgtgcagcgtcgtcttcacggcgagtacggcggccacggtgcccgacagggtcgtacgccgccacgcgagccgagtgcgctcgggttgcagccccgggtcgcgctcctgggcgggcgcggtcatccttcccagccgacgagtacgacgaggaccatcgcgatcgcgacgacggccacggcgatgctcagcagcgcggggaagcgggacaccggaaggtcctcgccccgccgcatcgcctgctcgcaccgcacccagtggttgacggcgcgcagcgagcacagcacaccggcggcgagcagcgcgagggccagtccgacgcgccagccccacctcagatccggcaggaactggtcgacggcgaatcctccgccgatcagtgccagtgcggtgcgcagccacgccaggaaggtgcgctcgttggccagcgagaaccggtagtcgggcgtgccgccgacctttcgtacctcctggggcgcgaaccacagccggacgttccgtgcgaattcgatcacgcgctggaccctacggtatgaccgcgccgccacgtccggcacggcggtcgtccgtccgggcccgcccccacctggccggacgcgctcgcccgacgacgtcagcccgtggcgcgatgcgccttgagccgctcgtacgccgcgagcccgtccgggacccactcccagtcggccagccggcgctccacctcgtcctggggcaggaagtcgtgccaggcgacctcctccacctgggggctgaccgggaggtcgcagcggacctcgtagaccgacgaccaccaggtctggccggcgccgttgtcgtacaggaacttgaagaggggggccgggcggggcagaccgcagacgccgagttcctcctcggcctcgcgcagggccgcgtcgtcgtacgtctcgcccgcgccgacgactccgccgacgaacatgtcgtacaaggaggggaagaccagcttggtgggcgtccggcggtggacgaagatccgcccctcgccgtcccgggccaggatgaacacgcaccggtggcgcagcccccgcgcgtacgcctccccgcgcgccgactgcccgacgaccctgtcgttctcgtccacgatgtcgaggagttcatcggcggggtcgacggggccacccgtcggtccgctcgtcgctccgctcacggctgcttcggtcacggcttcgctcacgggttcgctcatgggcccatccaagcagggccgggcccgggtcctcgggggcccggctcctcaatgcggctggagatcccgctgccgctccgcctccgcggagccccgcggcatcgccgggtgcagtccgaggaggacgatgcccagcacgaccgccgcgagccccgccgcctcccaggcgagcgccccggtgtccgtgcgcagctggtcgccgaggaagcccaccccgcagacgattccggccagcggctgggccgcggtgagggccggcagggacatccgcagcggcgccgtctcgaacgcgctctgcaccagcaccagcccggtcacaccgagggccagcaccgcgtacggctgccagccggtgaccagctccggccagccgccctcgctgaaccgctgcccgctgacccgggtgagcgcgtcctgcacgccgtacagcaggcccgccgcgagcgacaggagcacgggggcggcgctcagccgcgactgcttcgcgtaggtcgtcagcagcagcgcgaacccgaccatcacgccgatgatcacccagtgccgtaggggattcgtgaccgcgtcgccgccggtcggctggccggcgacgatgaacgccgtgacgccgcccgcgagcagcgcgagccccgcccagccctggcgtcccagcggctgcttggtctgccggcgggagaggcccagcgcgaagagcaggttcgtggcgagcagcggctcgaccagcgacagctcgccatgggccagggcgaccgcaccgagcaccatgccgaccaccatgaacccgatgccgccgagccagcgccgcacatgcatcaggtccaggagcagtctgggcgagaggaagtcgctcagcggagcatgctgggccgcgttctgctggagcacgaacccgatgcccaggcagaaggccgcgctcacggcgagaaccagaaccagtaccgacacgctgcgtacctcgaaactcagcggggccacgggatgcgccgactgtagcgctccccgctgtgagttgccgtgagagtacccacaacccggcagttgactcgctcactcttgtaccgaaggatctgaccgatcagtaacaacgtaccgactggtggtcatgccggaccggctcgcggtcgtggctgctcggtcatgtcgagaggacgggcgaatggcccacgacgcagacgtcatcgtgatcggcgccggcctggcagggctcgcggcgaccgcggagctggtggacgcgggccgcaaggtgatccttctcgaccaggagccggagcagtcgatgggcggccaggccttctggtcgttcggcgggctcttcttcgtcgactcgcccgagcagcgccgtctgcggatcaaggacagccacgcgctcgccctccaggactggatgggaacggccggtttcgaccgtcccgaggaccactggccgcgcaagtgggccgaggcgtacgtcgacttcgcggccggtgagaagcgggcctggctgcaccggcagggggtgcgcttcttcccggtggtcggctgggcggagcgcggcggctacgacgccaacggacacggcaactcggtgccgcgcttccacatcacctgggggaccggacccgggctgatcgagccgttcgtgcggcgggtgcgggcgggggtcgcgcggggactggtcgagctgaggttccgccaccgggtcaccggtctgtcgcgcagcgcgggcgccgtggacaccgtcacgggtgaggtgctggaggcgtcggacatccagcggggccgggccagcagccgcgaggtcaccggagccttcgagctcacggcccaggcggtgatcgtcacctcgggcggcatcggcggcaaccacgacctcgtccgcgcgaactggccggagcggctgggcagggccccggagaagatgatctcgggtgtgcccgcgcacgtcgacggcaggatgctcgccatcgcggagggggcgggtgcgcgtctgatcaaccgcgaccgcatgtggcactacaccgagggcatccagaactggaacccgatctggcacaaccacggcatccgcgtcctgcccggcccgtcctccctgtggttcgacgcccgcggcaaccggctgcccgtgccgctcttccccggcttcgacacgctcggcacgctcgaacacatcatgaagaccgggtacgactacacgtggttcgtgctcgaccagaagatcatcggcaaggagttcgccctctcggggtccgagcagaaccccgatctgacgggcaagtcgatcaaggacgtgatcgggcgggcgcgggccgaggtgccggggccggtgaaggcgttcatggaccacggtgtggacttcgtcgtggagaaggacctgggcgcgctggtgcgcggcatgaacgcgctgaccaaggaaccgctcatcgacgaggccgcgctgcgccgtgagatcgtcgcgcgcgaccgggagatagcgaaccccttcaccaaggacctccaggtgacggcgatgcgcggggcccgcaggttcctcggcgacaagctgatccgcacggccgccccgcaccgcatcctcgaccccaaggcgggtccgctgatcgccgtgcgcctcaacatcctcacccgcaagacgctcggcggcctggagacggacctctcgtcgcgggtgctgaccgagggcggcgccccgctggagggcgtgtacgcggccggcgaggccgccgggttcggcggcggcggcgtccacggctaccggtctctggagggcacgttcctgggcggctggctgttctcgggccgcacggtgggccgggcggcggcacaggccgtgggctgagacgcgggccagggtgcgggcggtggactgaggcgggccggacctgggtcgtgggccgggtccgaggggcttcggcagcacctcccgcgcccgcctgcccgcgaccgccgcgcccgcctgcccgcgaccgacggcacgcggaactcaggcggtggccggtgtccggtgtccggtggcgtgcgccccgcgctcgcggcgtgtggcggcccggtgtccgaaaggagcgccggacgccgccagacgcacggtgtactgacggtggccgtatgccaagcgctctcggcgcacggcgaccgtctaccgcccgactgccgtccgcagcacagtgccccgcacccgtcaagtcgcctgcaccaaaggcacgttgacacgtgtaggcccctgggtgcccttgactggaagcgttggctgagggtttgctgtccgtgatcagttactgacaaaccgcgccctgtgaggaacccccgcggtgcccccacccccacccccactcggccgtggtcgcaagcgtgcggcccatgccttcgacgcggcgctcgacgacgccgaactcgtcgcctcccgcgcctcgttgacccaggggcgatgggcccccgtgcgcgcgctgctcgccgcgacccgcgacgactgggaccgtcggggacaccgcgtcaccgtcctggcgcaggagtccgccgcccttccctgggcgcgcgaatggcagctcgccgaacccgagtccccctgcgccgccgtactgctcgcctgcgccaccgtccaccgcgccctgaacggcaaggagcgcccgcagacggcacgcgaggcctgccacgccgcggccgccctcgcccccgacgaccccacaccgtggctcggcctgctgatactggagcgctcactcggcaccgacgaggacgtggtccgcctcttcgacgaggtccgccaccgctgccccgaccaccaccacgcccaccagctcatcgtcgcccggctcgccgaacgccgcgcggacgccggacgggacccgctgcacgaggtctacgacttcgccaactgggccgccgaacaggcccccgccgactcgccgctcgcgatcctcccggtcgtcgcgcacgccgagcgctaccgcgtcctcgccgccgccggtgccgagcccgccgacccggtcgcctccgggcactgggtggggcggcgggcccgccaggtgatgaaggccgccttcgactggtggctggagtgggagcgcgacgaccatccgcgccgcttcgtcgacctcaacttcctggcccacgccaagttctgcgagggccgtggcgccgaggccgccgccctgttccaccgcatcggagaacacgccaccccggcgccgtggtcgtacccggaccgcgacccgtaccaagccttcagcgccgcacgcgccagcgcgctcggcgccccctgaacggccgccggccgtcggcccccgaccgccggcccccgagacatcacctcgcaccccagccgagacatcagccgagacatcggccgagacaccagtggagaggacaaccccgccatgacgacgggcagttcgagcacgagtgagagcagaccagcgaacaggtccgccgtcgcggacgacatcagcaccttcaagggacaggaacgcgctctgcgcgccgaccggctcggcacggcgggcctgttgctgtccgtgctcgccgcgaccgcccctctcatggtggtcgcgggtgtcatgcccactacattcggggtcatgggcatcgtcggccagcccctgctcttcgtcgtcctcggcgcggtgctggccctcttctccctggggtacgcggagatgagccgccacgtccacaacgcgggcgccttctacgcctacatctcgcgcggcctcggcggcacggcgggcgcgggtgccgcggcggtcgcactcgtcgcctacagcgcgctccagttcgccatctacggcatcttcggcttcgaggtctcgggtctgtgcgccacctacctcgaactccaggtcgcctggtggatcccggcgctggcggccgtcctcgccgtcggcgcgctcggcctgctgaagatcgacgtcaacgcgcgcgtgctcggcgtgctgctgctcatcgaggtcgtcctcgtcgtcgtgttcgacatcgcggcggtcgccgaccccgccaaggaaggcctgtcgctgcacgccttcaacccggacaccctcaccggtgcgggcgtcggcaccgcgctctgcttctgcgtcgccgccttcctcggcttcgaacaggcccccgtctacgccgaggagaccagccgcccggacgtcctcgtgccgcgcgtgatgttcctcgcgatcggcttcgtcgccgtcttcttcgcggtcagctgctgggcgttcacggtcgccgccggtccctccaccatcgtggccgccgcccagaaacagagcgcgggcctgctcttccagctgacggagtcccggctcggcggcaccttcaccgacgtactgcacgtgctcttcgtgaccggcatgttcgcggcgatgctcagcttccacaacgtggtcgcgcggtacgccttcgcgatgggccgcgagggactcctgcccgccgccttcggccgtacgacgggcgcgagcggcgcccccggtacgggctcgctccttcagacggccgtgtcggcggtgatcgtcatcgccttcgcgatggccgacgacaagccggccggcgacccgaccgcgcccgtgctgcacctgttcacctggttcggcagcgtcggggcgctcggcgtcaccctgctgatggtggcggcctccctgtccgtgatcgtcttcttcgcccgccgcggcgccgcccgcgcacaggcctggcggctggccacgtccgcggtgtcgggggccgcgctgctcgtgatcgtgggctacacggtcaaggacttcggcgtactggtcggaacgggaccggactccgcgctcggctgggtgctcccggcgatcatcggggtggccctggtcctcggcctggcgcagggactggtcctgcgctcccgtaagccccaggcgcatgcccgtatcgggctggacaacgaggcgttccagctggacaaggcggcggagtcggcgacctgaaccgcgcccccgcgccgcgatcccgcttcccgcgcacccggcgatccctgaaatcccggtgagaagtggttacggaattctgacgagcacccgtctgccctggcctcaagggggtggcgggtgctcgaatcatggtgtgaaccctgaacatcccgaagagcgggaagcaccggagcccgagaagcgggaggcaccggagcccgaggggcggggcaccccgatcgggcgccgggtcctcctcggcaccctcggcctcggcgcgctcggtgtcgtcgccgcgcccgtgctccagcgaggaatggagtccgtcctcgccggagcggccgagaaggacccgacgggcctgaccggtctgctgcccaacggcgggggctttcgctactactcggtgacgtcgtcggtcccgcacaagggggaggcgaactaccgcctcacgatcgacggcctggtcgaccacccgacgtcgttcaccctggccgatctgcgggccctgccgcagacccggctcgtgcgcgacgtccagtgcgtcaccggctggcgggtgccggggacgccgttcgagggcgtacgtctgtcccggctgctggacgcggcgggcgtccgctcctccgccagggcggtccgcttcacctgcttcgacggggcgtacaccgagagcctgacgctcgcgcaggcccgccgcgcggacgtcctggtcgccctgcgcatgcaggacaagcccctgggccacaaccacggcggccccgtccgcctgtacgtcgcccccatgtacttctacaagtccgccaagtggctctccggcatcaccgtcaccgaggacgtccgtcccgggtactgggaggaccggggatacgacgtggacgcctgggtgggcaagtcgaacgggcgggacgatgaccctacgagctgacgcccccgcccccgccgtgtcctcacgggtacggcgcttcacgcgcgcggagcgctgggtgcaccgggtgacggccgcgctgatgggcgtgtgcgtggtgacggccgcctgcctgtacatccccgttttcgcggaactggtggggcgccgggacctggtcgtacgggtccacgagtgggcggggctgctgctgccggccccggtgctcgcggggctggcgtcgcgcgcgttccggtcggacctgggtcacctcaaccgctggggcccgcacgaccgggtctggctgcgggcggtcctgcgccgcgacgcccggccctcgtcccgtccggcggcgaagttcaatgcgggccagaagacgtatgcggcgtggatcgcgggagcgtccctggtgatggtgggcacggggctgctgatgtggttcacccacctcacgccgctgatgtggcgcacgtcggcgacgttcgtccacgactggctggccctgacgatcggcgtcgtcctcgcgggccacatcggcatggccctggccgacccggaggcccgccgcggcctgcgcacgggctcggtgagccgggagtgggccagccaggaacaccccctgtggcgcgaaggccctccgggcggggaccggcgggggtgacgctgcggcgtcctgttcgtggccgcaccgccgaagaacgcgcggaacgtcccgccgcgaggggtcccgccgcgacaggtatcgccgcgacaggtactgccacggcgggtactgccgcgaggggtatcgccgcgacaggtatcgccacggcgggtaccgcccacggcgggtatcgccgcgacaggtactccacggcgggtaccgccacgctggccgtacccggcggcgccgaacccgccgcgcgccggcggcggggacccggtcccggcccctcagaccccgaagtccagcagcaccttgcacgcctcaccgcggtccgcggccagcgcgaacgccgactccgcctcctcgagcggaaccaccgcgctgatcagggagtcgaacgccggctcacgcgccagcagggtcagcgcctcgtcgaactcgtcggcgaagcggaacgctccccgcagttcgatctcccggctgaccaccaggttcccggcgaacggcgtctgtccgggcggcagcatgcccagctggacgaccaccccaccacgccgcaccaggcgcaggcaggtgtcaagacccgcggcaaccccggacgcctcgacggccacgtcgaccgagtccggccacccggcgtcggccggatcgtcggcgcgtacgacgtcgtccgcgcccaccccggcggcgtacgacagcgcccgcggcagcagatccgtcaccgtcacccgccccgctccggcggccttcgccgcggccaccaccaggcacccgatcggcccggcccccgtcacgagcaccggccggccggccaccggccccgcccgccgtaccgcgtgcaacgccaccgacagcggctccgcgagcgcggcccgccgcagatccagcccctccggcagcgccctcacctgcgcggcgggtaccacgacccgcgcggcgaacccgccctggacgtgcggcatacgggccgcgctgcccagatagcgggtgtcccggcacacgttcgcccggccgtccgcgcactccggacacaccccgcacggcgtcgccgggtgcacggccacggccgtacccggcgcgggaccggcggccccgggcccgtacgagaggaccgtccccaccacctcgtgcccgagcaccatcggctcccgcagccggaagtccccgactccgccgtgccgccagtagtgcaggtcggagccgcatacgccgccgtaacggacggcgaccagcgcctgccccggtccggcggccggctcgggcagttcgtcgacccgcaggtcgccccgaccgtggatcacacaaccgagcatcgtccggcctctctagagcacactcgtcatgccgccgtcgacgtacagcacctgcccgctgacgaagtccgccgcgggagaggcgaggaagagcaccccgccgaccaggtcctccgtacgtccccagcgcccggccggggtgcggtgccgcacccacgcgctgaactcctcgtcctcgacgagcgggcgggtcaactcggtctctatgtagccggggccgagcccgttgacctgcaccccgtacgggccccagtccgcgcacatgcccttggtgagcatcttcagcgcgcccttggtcgccgcgtacggggcgatgccggggcggacgacctcgctctggagggaacagatgttgacgatcttgccgtggccgcgttccgtcatacggcgggccgcctcgcggcccaccaggaacgcgctcgtcagattggtgttcaggatccggtgccagtcggagtccgtgaactccaggagcggggcgcgcagttgtatgcccgcgttgttgaccaggatgtcgagcggacccacccgctcctcgacctccgcgatgccggcggccaccgacggaccgtcggtcacgtcgaacgcggccgtacggacgtcgcccggcagttcggcggccgccgcggtgagccggtcgccgtcccgtccgttcaggacgaccgtgcagcccgcctccaggaggccgcgggcgagcgcgcgcccgatgccgcggctggagccggtgaccagggccgtacggccggcgatgtcgaagagcggatggctcattcccgtactcctagatcacgagggacagcagcaggaccagtccgccggcgaccaccgagatgatggtctccatgatcgaccaggtcttgaccgtctggccgacgctcagaccgaagtactccttgaccagccagaacccggcatcgttcacatggctgaagaagagcgagcccgccccgatcgccagcacgaggagcgaggtgtgcgcggtcgacatgtcggccgcgaggggcgcgacgagaccggccgcggagatggtcgcgaccgtcgccgaaccggtcgcgagccggatcgccaccgcgatcagccaggccagcagcagcgccgggatcgaccagtccttggagatctccaggatcatctggcccacaccggagtcgatcagcgtctgcttgaagccaccgcccgcgccgacgatcagcaggatgcccgcgatcggggcgagggacttctcgacggtcgtcgagaggcgctccttggtgaagccggccgcgcggcccagcgtgaacataccgacgatcacggccgcgagcagcgcgatcagcggtgcgccgatgacgtcgaagacgcgctgcacctggtgcgtggggtcgtcgacgatgatgtcgaccagggcctttgccagcatcagcacgaccggcagcagcatggtggcgagggtggcgccgaagccggggcgcttgtccaggtcctcggaagcgcgggtggggatcatgcggtcgggagccggaacgtccacccagcgggctgcgtatttcgagaacaccgggcccgcgatgatcaccgtcgggatggcgacgaggacaccgagcgccagcgtgaggccgaggttcgccttgaccgcgtcgatcgcgaccagcgggccggggtgcggcgggatcagcccgtgcatcacggacaggcccgcgagcgccgggatgccgatccgcatcagcgagtagttgccgcgcttggcgaccatcagcacgaccgggatgagcagcacgatgcccacctcgaagaacagcggcaggccgatcacggaggcgatcagcaccatcgcccacggcatggcccgcccgcccgccttcgcgaggatcgtgtcgacgatctggtcggcgccgccggagtcggcgagcagcttgccgaggatggcgcccagcgcgatcaggacgcccacaccggcgacggtcgagccgagcccggccgtgaagctgacgatggtcttgtcgagcggcgccccggcgaacgcgccgagcgcgagcgaaccgatggtcagggcgaggaacgcgtgaagcttgaacttggtgatgagcagcacgatgacggcgatgcccgccagtaccgcgatgccgagttgagcgtggcccgccgaggtgatcggttcgacggtgtccgctgccagcttctcgacgctgagtctggtcacgggtgggtcccttgtgtgtgaagagtggggagaagagggggatgagaggaactgcggagagtaagtactgagcggaagtaccgagcggaagcgccgggggcttacttcgccggctgagaggccggttcgagggcccgcagcgccgtcacggcccgctcgctgatctcctcgggaccgccggtgacatccacggcgaccccggcctcgtccgccgccagcggctgaagcgtggcgaactgcgagtccagcagcgccgtcggcatgaagtgcccctgccggtgcgacatccggtcctcgatcagctcgcggtcgccggtgagatgcacgaagacgacgccgggcgccgcggcccgcagccggtcgcggtacgaccgcttcagcgcggagctgctgaccactccgccgagccccgcccggctgtgcgcccaggcgccgatcgcgtccagccagggcaggcggtccacgtcgtccagcggcactccggccgacatcttggcgatgttggccggggggtggaagtcgtcaccctcggcgtagggaacgccgagccgggcggcgagcagcggaccgatcgtggtcttgcccgtccccgcgacgcccatcaccacgactacgtggggggtgtgcacctgttccatcactgctctcgctgtcttcgtcgacatctgatgtcgaccacactgaaaccgattaggtacgacgaattcaagagtctgtgacaaataagtctgactttttgtgccagtgatccacctcgtactctgagtgcatgaccacaccgggccgggggctgcacggccatgtactggagaccctcgggcccgccatcgccgcgggcacctacccaccgggaagcgtgctgcgcacggacgagctcgcccagcgcttcgaggtctcacgctccgtgatgcgcgaggcggtccgcgtactggagtcgatgcacctggtggagtcccgccgccgcgtcggcgtgacggtccgtcccaaggccgagtggaacgtgtacgacccccaggtcatccgctggcgactggccggcgccgaccgcccgcaccagctgcgctcgctgaccgtgctgcgttcggcggtcgaaccggccgccgcgggcctggccgcacggcacgccaccgccgatcagtgcgcggacctcaccgagtgcgcgctgggcatggtcgccacgtcccgcggccatcagctggaggcctatctggtccacgacgtggccttccaccgggtgatcctcaacgcgtcgggcaacgagatgttcgcccgcctgggtgacgtcgtcgcggaggtcctggcgggccgcacccaccacgaggtcatgttcgaggaccccgacccggccgccgtcacgctccacgtccaggtggcggaggcggtacgcgagggcgacgccctccgcgccgagcagctcacccgtgagatcacggtcggcgccctccaggaactggacatcctggcgccgtagccacccggcggttactcgaagaactccccgtcgacgtacacccacgccccgccgatccgctcgaaccggctccgctcctggagcgcaccgccccggtaggacgcccggaacgtgaccgtcccggccgagtggaacgcggacccctccgtcgtccccaggatctccaggccggtccaccgcatccgcgggtcgaagtcgacctcggcgggccgcgtccgcggatgccaggtccgcagcagatacgcctcgtcccgccgcacgaaggcgcagtaccgcgaccgcatcagcaacgcggcggtgggtgcgtcggcggcaccggagtggaaccgcccgcagcacgcctcgtacacctcgggaagcccgcacggacacgaagccggctgcgggcgcgacgtggggcgcgaagtggaacgcgtacgacgggacttgctcatgcggaccccgtaatgtgcggcggatacggcggacgcgccggtaccggcgcggcgaggacgggcagcgacggcagggcggtctcctccagccacgcggtgaacagctcgtccagcggctgggcggagaagcgcgcggcatgcgtggtgaacgcggcggtggtcaccaccccgccccggtgcacacccgcccacccgcgcagcatccggaagaacgcctcgtcgcccagcgcacagcgcaccgcgtgcagcacgagaccgccgcgctcgtagagccggtcgtcgaacatcagcttgcggcccggatcggccagccgcagatcctgcggcagcgaggacagcttccggtgcgcgagcgtggcgagttgctgtgccgtacggccgccggagcgctccgaccacagccactcggcatacttcgcgaacccctcgttgagccagatgtgccgccagtcggcgatggtcacgctgttgccgaaccactggtgcgccagctcgtgcgcgacaagccgctccgaaccccgcttcccgtccacgtggttggcgccgaacaacgacaacccctgtgcctcgacggggacatccagctcctcctccgtcacgaccaccgcgtactcgccgaacggatacggcccgaagagctcctcgaacagctccgtcatcgcgggctggcgcgcgaagtcccgggagaactcggtcagcagatgagccgggatgtgccccgtctgcgggacaccgcccagccccggatcgccgagcagcaccgtctggtacttgccgatcgacagcccgaccagatagctggacgtcggcgccggctgctcgtacacccaggtggtcgtggacgccttcgtcgtacgagtgagcaggcgcccgcccgccaccaccgagtacgccgacggcgtcgtgaccgagagctggtacgcggccttgtcggcggggcggtcgttgcacgggtaccaggacggcgcgcccaccggctggctcgccaccagcgcaccgtcctccagctcctcccagccgagaccgccccaggcgctgttgaccggctggggattgcccgaccagtgcacctccacggtgaacgccgcgccggcccggaccggcttcggcggacggatgcgcagccggccgccgcggtgcgtgtagtgcggcgccttgccgtcgacccggacccggccgatccggaagtcggccaggttcagctggaactcggcgagcggagcccggcccgctatggcgttgagccgcgcggtgccggcgagccggttcgggccgggacggtagtccagcgtgagctcgtagcggtgcacccggtagcgggcatcaccgttcgtggggaagtacggatcggcttccgccttctgccgagggctcactgctgcgtctgctccctgcgctgggctcgtacgtcgtgccggtgcaccgtccttcggcccggagcgagtcacctcggtcacgcccggggacgccacgcctcgatcgggttgcccagccagcgggtgtcgtcggggacggattccgccgccatgacgagcgacgcgggtcccagcgtgctgcgcgccccgactgtgctgccgggaaggacgattccgcccgggcccagagtggcgccctcacggaggacaacagtatccgtccgcaagatccggtcgtggaagaggtgggtctgcaggacacagccccggttgaccgtggtcgcgtcctccagggtcaccaggtccgtctcgggcagccagtaactctcgatccacgcgcccttgccgatacgggcgccgaggccgcgcagccacgccgtcatcagcggcgtcccgggcacggatcccgccagccacggcaccgcgacgacctcgacgaaggtgtcagccagctcattgcgccacacgaaaccgctccacagcgggtgctcgcccgcccggtgccggcccaccagcagccacttcgccacgacggacgtcaggcaggcgagcacgccggcgcccaggaacacgagtccggccagcagcggcgcccagccgcccagcgcgctcagcgcggcgacggtcagcaccaccagcgccgccgagcagaacaccggcacgatccggcacagctccacgagcgcccgtccccacagcagccgcgcgggcgggtcgtaggtacggctctgatcgccgtcccgcgtcgaacgcggcagcttcaccggcggcagccccaggtacgagctgcccttcttcgccttcttcggggtcgccgacagcaccccgaccagcccaccgtccggcacgctgcgccccggcgcggtcatcccggagttcccgaggaacgcccggcgcccgatctgcgcgcgcccgatccgcatccagccgccgcccagctcgtacggagcggtcagggtgtcgtcggcgaggaacgcgccctcgccgaccgtggtgagactcggcagcgcgagcacggtggacacctcggcgccccgcccgatccgcatgccgagcaaccgcagccacaccggcgtgatcagcccggcgtacagcgggaacagcgtctcgcgcgagcggtccatcagctgcgtgaccgtccacgcctgccagccggtccggctgtgcgtggggtgcgtgccctcgcgcagccccaggctgagcagacgtacggcgagcagaagcagcagggcgtacgcgcacccgaaggcgagcgtcgccggcaccagggcgatcgcggcaccccgcagggcggcgccgagcccggcgtccggcgccacgaacaccccggccaccagcagggcggccagccccgcgagcaccggcagcgcactcagcgcgaacccggccgcgccgtacatcgcccgccagtacgtgccacgccgcggccgctcctcgggccacgcgcgcttcgccttgccgagcttgcccgccggcgcccccgcccagcgctgaccggtgggaatctgcccggcgacggcggaaccgggcgccacctcggcccgcttgccgacccgcgcacccggaaagaggatgctgcgcgtaccgaccacggcatgcgcaccgaccctgaccgggccgatctcgaggcggtcgccgtccagccagtggcccgacagatccacctcggactcgacggccgcgccccggcccagcttgagcatcccggtcaccggcggcaacgagtgcagatccacgtccgcgccgaccttggcgcccagggcccgcgcgtaccgctccagccaggacccggtcagcgaggtcgccccgctgaactcggccagccgctccgccgtccacagccgcagatgcacactgccgccgcgcgggtaccggcccggcctgagcccccgcagcagcagccgggccccgcccgccgcgatggcgagccgcccgggtggactgaagaacagcaccgctccggcggtcaccacccaccaggaggcggacggcgcccacggatacgggccgaaccggtgcagtacgttccccagcgcggccagtgccaccgtccagcgcagcccgagcagcgtgaacagcgggatcagcaggagaagctgaagggccttggcacgcggcgggaccggggcgatcacgcgggccgctccgtcgtcccgcgtggacctctccagccggcgggccagcttgcgcagcaccggctgctggtagacgtcgaggacggccgcgcccgggtagcgggtgcgcagcctggtggtgagctgggctgcggccaggctgccgccgccgatcgcgaagaagtcgtcaccggcgccgccgaccgggatgccgagcacttcggtccactgctcggcgagccaggcctcggtgccgtagagctcggcggtgggggcctccaccccttccagcggccagggcagcgcagtgcggtcgaccttgccggacgtgcgcgtcggcaggtcggcgacgggcgcgagcagcggtacgagggcggccggcagctcggcgcgcagcttctcgacggccgctgcctggtcccagccgtcctgggtgacgacatagccgacgagaagctggttgccgctgcgggcggtgcgcacggcggcggccgcgcccgcgacccccggcagcgcctggagcgcggcgtccacctcgcccagctcgatccgacggccgccgagcttgatctgctcatcggcccgcccgaggaagaccagcccctcgggctcggccctgacgaggtcaccgctgcggtacgcgcgcgcccagccgagcgacgccagcggcgcgtacttctccgcgtccttctcggcgtcgagatagcgcgcgaggcccacgccgccgatcaccagctgcccgctgccgcccatcggcaccggctccccggcctcgtcgacgacggccagctcccagccgcccaggggcagcccgatccggatgggctcgttcccggtcaggagagaggcacaggccacgacggtcgcctcggtcgggccataggtgttccagacctcgcgcccctcggtgaccagccgctccgccagctcgggcgggcaggcctcaccgccgaagatcagcagccgtacgtcgctcagggcctcgggctcccagagggcggccagtgtgggcacggtggagacgacggtgatctcctgctcgactagccagggcccgaggtcggcgccaccgcggacctgcgagcgcggcacgggcaccagacaggccccgtaccgccaggccagccacatctcctcgcaggaggcgtcgaaggcgacggacagcccggccatgacccggtcaccggggccgatcggctcctcggtgaggaagaggtcggcctcggcgtccacgaaggcggcggcgctgcggtgactgacggcgacccccttgggcctgccggtggagccggaggtgaagatgatccaggcgtcgtgcccggtaccgggccgcgcggcggggaccccggccgtcccgtcgacggtcaggtggtgcccggccccgacgaccgcccgcacctctgcctccccgaagaccagttcggcgcgctcgtcggggtcctcggcgtccaccggtacgtaggcggcgccggcggccagaacggccaggaccgcgatgtacagatcgttggtcccggacgggacacggacgccgacccggtcgccgaggccgactccggcggccgcgagccgccgccgcagggcctcgatctcgacggcgagcgcacggtaggtgaggcagcgccggccgtcgtcgagggcgggctcgtcggggtacgcccggacggaggcgtcgagaatgtccacaagggtccgaggcgaggcgggggagccggcggagaagcgtgcccggtcaccgaactccgcccgcacctcgtcgtcggacagcgcgagtgcggggccttgctggagggcagccatcgagtcctcacgtgtcgttcccggagcgatcgggagcgctggtgggcccgcagggatgcctggggatgttccggtccagcgccgaacaagctggaaactgtagtccgacgctagccgccgaccagcacgtcagccatgcgaggaggccctcgacggactgcggaggctctgattccggagtcctgccatggtcacgggcgcgtactccgcaaaaaacggtgccgactcgatcagagtcagcaccgttctgggatcctgctgtggtgtccgaggggggacttgaacccccacgcccgataaagggcactagcacctcaagctagcgcgtctgccattccgccacccggacaaggtgtctgtcgcgcggggtttccctcgcggcgacagaggaaacattaccaggctttcgagagcccctgatcaccccccgtccccgcgtgaacggcgtgtgacgggccgggtcccgccttgggcggcgcgggccggcggagggaggatgagggggaccaccagcagcgacagtgggaggaagcagcgtgagcgagtcgaacacggccaggggcatctctggcgaggacgaggtcgtggacctctgtcgcgagctgatccggatcgacaccagcaactacggggaccactcggggccgggcgagcggaaggccgccgagtacgtcgccgagaagctcgccgaggtcgggctcgaaccgcagatcttcgagtcccaccagggacgcgcctccacggtcgcccgcatcgagggcgaggacccgtcccggcccgcgctgctcatccacggccacaccgacgtcgtaccggccaatgcggcggactggacccaccaccccttctccggcgagatcgcggacggctgtgtctggggccgcggtgccgtcgacatgaaggacatggacgcgatgaccctggcggtcgtacgcgaccggctgcgcaccgggcgcaggcccccgcgcgacatcgtgctcgccttcctcgccgacgaggaggcgggcgggacgtacggcgccaagtacctcgtccagaagcaccccgacctcttcgagggcgtgaccgaggcgatcggtgaggtcggcgggttctccttcaccgtcaacgagaagctgcggctctacctcgtcgagacggcccagaagggcatgcactggatgcgcctcaccgtcgacggcacggcaggccacggctcgatgaccaacgacgacaacgcgatcaccgagctgtgcgaggccgtcgggcggctcggccggcacacctggccggtgcgggtcaccaagaccgtgcggtccttcctcgacgagctctccgacgcgctcggcaccgagctcgacccggagaacatggacgagaccctcgccaagctcggcggcatcgccaagatggtgggcgccacgctgcgcaactccgcggcgcccaccatgctgggcgccggctacaaggtcaacgtcatccccggccaggccaccgcgcacgtcgacgggcggttcctgcccggtcacgaggaggagttcctcgccgacctcgaccggattctcggcccccgcgtgaagcgcgaggacgtgcacggggacaaggcgctggagaccgacttcgacggcaggctcgtcgacgcgatgcagagcgccctgagcgccgaggacccgatcgccaaggccgtgccctacatgctctccggcggcaccgacgccaagtctttcgacgacctcggcatccgctgcttcggcttcgcccccctgaaactgccgccggagctggatttcgcgggcatgttccacgggatcgacgagcgtgtgccggtcgacgggctcaagttcggcgttcgcgtactcgaccggttcatcgacgcgtcctgaccattgagcgaggcgccctctgaaacgattactcaataatcggccgcccgtgcggagttgactgagaagagtgaatgcgaccataagctcgtagctccattactccctcctcgttacaggtagtgcgatcagctacttgggatcgcattgccaacaaggaggaataatgatcaagaaggtcgtcgccgctgcggctgccactggtggcctggttctcgcgggtgcgggcctggccgtcgccgactcgggtgcccagggtgccgcggtgcactccccgggtgtcgtttccggcaacgtcatccaggtgccggttcacgtcccggtgaacgtctgcggcaacacggtctccgtgatcgggctgctgaaccccgccttcggcaacacctgcatcaacaagtgacgttgtgagcccgtcggccccggagcgcgcgccatgcgctccggggccgaccggtcttttcggttcgagacaaggtcgaaggcagggattcagcaatgcgacaggtcacccgcaagggcctgatgaccgtggcggcggcgaccggcgtgctcgccgccaccggcggctacgcacacgccgactcgggtgcgtacggctccgcgtcacattcgcccggcgtgctgtcgggcaactcggtccaggtgccggtgcacgtgccggtgaacgtctgcggtaacaccgtgaacgtggtcgggctgttcaatccggcggtgggcaaccaatgcgccaatgggggcggcggcggtcaccacgatggcggcggtcaccacggaggcggcggtcaccacggtggcggctacggcgacagtccgtccggtggtggcggtcatcacggtggcggcggtcaccagggcggcggctacggcgacggcccgtccggcggcggtggcggcggtggtgggtcgcaggccggcgggcacaccggcgactcgccgggcgtgggctccggcaaccacgtccaggtcccggtggacgtgccggtgaacgtctgcgggaacaacgtcaccgtgggcgggctcggcaacgcggcaggcggcgacgcctgcgccgacaccccgggcggcggccacgcgacgaccccgcccggcggcggtggcgggacgacacctccgggcggcggcggcggtggcacgacgcctccgggcggtggcggtggcgggaccacgcctccgggcggtggcggtgggacgacgcctccgggcacacccggacaccccgggcagccgggcggcgacagctcggcgcaccccaaccaccccggtggacagtccgtcacccagcccgagggcaccgcgcagcttgcccacaccggcagcgacatgccgctcggcctgctggtaccggcgggcgcgggcgcactgctcggcggcgcgctgctctaccgcagggcgcgatcggcagcgtaaaaaaacagcaaaggccaccgtatggggccgtggacttccccggtgatgtggagaacggagcgggccccgtgagtgcggggcccgctccgtttcggccgccttttctcaccatgtggcgcgcacctggcggatgatccgtcggcgcaaccgcaccctgcggctgccgtcgcggtgcaggctgaggcggtccaactcccagtggccgtactcggcatggtcggtcagcaggcgtgtggcttccttgcgggacaccccgcgaggcacgtacacgtcgacaaattcgtattccggcatcgcatctattgtgcgggcagaggccgtgtacggatagcgtctgcactatgtctgatgctgcgcagtccaccgctgccgaggtacgtgccgccgcggaggcggtcaagaccgcgctcgaccgccacctggccgcggtcgagcgcaggtcgggcgaggacgacccggccgtctatgaggcgttcaacgagctggccgcggcggccgaggagtacgacgaactgctctacgaccgctatgacgaggtcacgccgttcgagatccccggcacggacgattcgctgcccccgtacacgggacccgaggagcccagcgcggtgagtgtgctgatccgccgggactacgcggtggtggagccgcaacgactgctggcgcaggctcagcgggtcgaggccgcggaggagcccgccgacgaggtggccggcacggtccacggggcgctcggtgtgctgttcgaggagtacgagccggacgagatcgcctcccggcacaaggagttcggcctggaggagggcgactccacactctgggtgacggccgaggaggagcggccggagccgggggagtggctggaggcccccttcgagcagatcgacccgcagcacatcgtgtgccgcttcgatgccagcgccgtctacgacgaggagtcggacggcgaggagtcggacggcgaggttccggaggacgacctcggcccggactccgagctcgacggggagctggacgaagacgacctggaaccgctggacgcggatcgctgagcatctgccgagggcggcggtcaccggaatcccggtgaccgccgccctcgcgttggccccccgccctcgttcgttcgcccgccctcgcgttcgcctgccgtggtccgttcgcccgccggccgcgcggccggctcagtcggcggccggaacctggggcctgagcagggcgggcaggcgcgtggtgcgcggcttggcggtgacctcggccacggcccggggcagtgcctgctccactccgtgcacgacggacagatggcgctcggccaggccgaacgccgtgtacacccaggggcgggtcagggactgcgccgcgtcgccgggcaggaccacgaccgcggcgggccaccggctccccaccgcctggtgcgcggtcagcgcccagccgtgccgcacgcactgctccacccgctccttcggtacgacgacgggggcgcccgggatctccaggtgcagcccgtcggcgtcggccttcacgacgcggcccggcagcgtacggcccggggcgggggagtacgcgatccggtcaccgggatcgaatccgccgaagcgcccggggcccgggttgagccgctccttgagcgcggcgttcaacgcgcgcgtgccggccgcgccaccgtgccccggagtgatcacctgcgtctgctcggccgggacgccgagcgcccgcggcaccgagtccgcgaccagctgcacggtgcggtgcaccgcttcaccggcgtcccgcaccggcacgatcacgacctccttgccgggcgcctcgacctggttcagctcgccgacgccgatgccggagatcagctcgccgatcggtccgggatcgggggtgcgcgaggcgatccccgggcagacgcgtgcggcgagcagatccgcgaacacccgtcccggaccggccgaccacaacacccccgggtcgccgctcagcaccagccgggccccgtcgggcagcgactcggcgagcatggcggcggtctcgacgtcgagctggggagcgtccaggacgaccaggaggtcgaggaccagggcgccgtccgcgtcccggccgggaccctccgcgccggacagcagacccgccacggtggagacaccggtgcccgggccctgctgcggcccgcccggcaggtccgacggggcgagccgagccgtgaagcggtcgcagccgatccggctgtgcgcggcggcccaggtccgcagccccagcccgcgggcggcggacagcagcgccgcggcctccgcaccggaggcgtcgccgccggtgtggaggaccaggccgtggcccgcgaccgcgcggatcagctccgcggcggagccgcccgccgatgcggcggcccgctcccagtcggcggccgagccgtcctccttcggcacggagttcatcacccggccgagcgcgtcggcgaggctctcctccgcgagggcgtaccgctccaggccgatcaggacgcggaccggacgctccgctccctcctcctcggcctccgcctccgcggcgggcgcggccgcgtcgagggcgtcctggaacaccagcacctcgccctcggcgagcgcgctctgcaccgctgtgtccgggtccggcacggcccgctgcgcgagcgccgtggtgagggccgccacctccagcgccgtatgccccgcgagggccgcctgctccagcagccacaccgtgaccgcccggccccgccgctcgtcgtccgggccgcactccgcgccgagcagcgcccgggcgaagccgtcggcctgctcgggacgcactccggagacccgcagcaactgccaggggtcctcgcgcagttgcaggtcggctccgtcgcccaggagggcggcgagctgcggcgcgagcgcctcgggggcgccgccctcggtcagtacggcacgcacaccggcaacggcttgtgccgcggggaccgccggcccggccggggccgccacgggctccgggcgccgctcgggctcgggggccggcctgcgcggcgccggcggctcgctgaaagcgctggccaccggcttcgcaccgctctccacgacccgcaccgccgcgagcagatcggcggccgtgccgctcagcttcgtgccggcctcgatcggcgcctgcttctccgccttccgccgctcgatccgctcccgctcgacccgctgggccgccaactcggcctcggcctcggtgggcttggccgcgtcgcccgagccctcggcagtgcccgccgcctcactcccggctgtgccttcggagctctcggtagcgcccgccgcctcactcccggctgtgccttccgcggagctctcggcgtcgcccgccgccccgctgccgggcgtgccctcggtctccgggacgccgtccaccgcaccggcgccgggctgtcccggttcgacttcgcccgcacccgcgcccggctgccccggctcggcttcgtccgtggtctccggctccgtggtcacagcgtgctccagtcctggtcgggatagtggtgcaccggggccgacacgtcgtccagcgcccggcagatctcgtcaggaagactaagggtctccactgacaacgccgccgtgagctgctgcgcgttgcgcgcgccgacgatcggcgcggccacgccgggccggtcgcggacccacgcgagcgccacctggagcggggtgaccgcgagaccgtcggccgcggtctgtaccgcgtccacgatgccgctcgccgtgtcgtcgagatagggagcgacgaacggagccagatgctccgaggcgccccgggagccggcgggcgtcccgccccggtacttgcccgtcaagacgccccggccgagcggagaggacggcagcagcccgacccccaggtccagggcggccggcagcacctcccgctccacgccgcgctggagcagggagtactccatctgtgtactggcgatccgggtccgcgggcccggcgccgagagctgccaggtggccgccttggcgagctgccagccgcagaagttggacacgcccgcataccgcgcccgtccggtgctgaccgcgaggtcgagcgcctggagggtctcctccagcggggtgtgcgggtcgaaggcgtggacctgccacagatcgacgtagtccgtgccgagccgggcgagcgaggcgtccagcgcggagagcagatgcccgcgcgaaccgtcgaaccgccggtccgggtccgctacgctccccgccttcgtcgagatgaccaggtcccggcgcggcacgagcccttctatgagctgtccgagtacgtactcggcttctccgtcgccgtacacgtccgcggtgtcgacgagggtcccgcccgcctcccagaacaccttcaacagctccgcggcgtcatgctcgtccgtgtcgcgcccccacgtcagggtgccgagcccgatccgggacacacgcaggccggtacggccgagatgcctctgctccatggacgccgagattactggccagaactcgatacgtggtggccctgtggacaaccgggatcaccccagctcgaaccccgtccctgcccctgcgtccgccggcgcgctagtgtctccggaacaagggacgttactgatcggtaaggggaatcggccatgcagctcgggatcaacctcggctactggggcgccggaatggacgcggacaatctcgccgtcgcccaagaggccgaccggctcggatacggcgtctgctgggccgccgaggcctacggctcggacgccgccaccgtactcacctgggtcgccgcccagaccgaacgcatcgacgtcggctcggccatcttccagatcccggcccgccagcccgcgatgaccgcgatgaccgccgccaccctcgactcgctttccggcggccgcttccgcctcggcctcggcgtctccggcccgcaggtctccgagggctggtacggcgtcaagttcgacaagccgctggcccgcacccgtgagtacgtcgagatcgtccgcaaggcgatgacccgcgagcgcctgtcgtaccagggcgagcactggaccctgcccctgcccgacggcccgggcaagccgatcaagctgaccgtccaccccgagcgtgagtacatcccggtctacatcgccgcgatcggcccgaagaacctggagcagaccggcgagatcgccgacggtgcgctgctcatcttcccctcggccgaccacctcgaggacaccgcgatcaagcacctgcgggcaggccgggagaaggccggcaagaccatggacggcttcgacgtctgcccgaccctcccgctcgcgctcggcgacgacaagaacgtgaccgcgctcgccgacacgttccgcccctacaccgcgctgtacgtcggcggcatgggcagccgcaagcagaacttctacaaccagctcgcccagcgcatggggtacgagaaggaggccgccgagatccaggacaagtacctgtccggcgacaaggagggcgccgcggccgccatcccgcacgagctgatcgaccagaccacgctgctcggttccgtggaccgcatcgcggaccggatgaaggcctacgcggccgccggggtcaccacgctcaccctggcgcccgcgggcttcacgctggaggagcggatcgccgcgctgcgggcggggaccgacgccctggagcgggcgggcctcgcataacgcggcggaccacgccgagaagtttccgcggccgtggtgggggctcgggggtcttccccgccacggccgtcttcgggcacaacgcctcggacgccttccgggttacgcgtcgaggtgttccacgccgtccgtcgttcggcggagcggtccgacacatctgttgccgtacttctgacatcccatttgactcggtttctgcggaaactttgcatggaggtggcagtgatgctttcggtcaggagtctgttccaggagatcctcgacaacgacgagtcgttccggctcttctgctccatcgctgccagcggcgagtcccagggcggctgggagaacgggcggatcgccgcgctcgtcccgcacagccagcgtgacctcgcccccaagatcacccggcacggcgccgacgaggacaaacacgggcggatcttccacgccctcatgaagaagcgcggcctggaccccgtagcgatcccgcccgacaccgactacacgatgctcctggaacggcacggcatcggtctcgcccacgagaagctcaagggcgacgagccgctcaccgtgcaggacatcgtcacctacctcgcgcacagcagggtcaccgagcagcgcgccgccgagcagatggagctgctccgcaggcacttcgccgaccatcccgacatcggccgcgcggtcaggatgatctcccacgacgaggacaaccacctcgcgtactgccacgaagagctgttgcgcttcgcgtacaccggacacggccgcgccatccagcggacgctgcggcagtgcgcgctcgccgagatccgcgtctaccgggacgtcagcctcgccgtgatggcccacatgggccgcctcctcggctggccgaaggccagggcggcggcgctcgcggccggtatccacgcggtgtacgcctacgagcgcgccgtcggctggcgccgcatggtctccctgaggatgccggagcgccgcgacgcgctgggcggaccggcgaccaccgccgccgagtacgcgtaggggcgggtccttcggatctcccagggtccgcgacgccgcggtgacatcagccgctccacggcgggcggcacctcgccgtgtggtcgcacgccgttgtcgcacgacccgcgcacgccccgtgggtcgtgccccgccctgtgacgcacgcgccccggaccaccgcgtacgcccgcgtcgccgcccgcgcctacagccacccccgctgcttgaacagccggtacagcagaacctcgagcaccaccatcgccgcgatcaccgccggatacgaccacgtccagtgcagctccggcatgtgctcgaagttcatgccgtagatccccgcgatcatcgtggggatcgccgccatggccgcccacgcggagatcttccgcatgtcgtcgttctgacgcacgctcatctgcgcgagatgcgccgagaggatgtcggagaccagccggtccaggccctccacggattcgttgacgcgcgtcaggtggtcgttgacgtcgcggaagaagggccgcgcctcctccttcacgaacggcaccgccgcgaggttgggccccaggccggcgagccgggtcagcggcggcgtgagcggaaccgtggcccggcggaactcctggatctggcgcttgaacgagtagatccgcgacgccgtgttccgcgccccgccgctgggcgagaagacctccgcctccagctcctccagatcggtccccagctccgtggccacgtccagatagtggtcgacgacggagtccgcgatcgcgtgcagcaccccggtgggaccgtgccggagcatgtccggccggcgctccagttcgtgccggatgctcgacagcggcgcaccctccccgtggcgcacggtcaccacgaaggagtcaccgacgaagaccatgacctcgcccgaggagacggtgtcgctgtacggctcgtacgtcaccggcttgaggaccacgaacagcgagtcgtcgtacacctccagcttgggccgctggtgcgccttcagggcgtcctcgacggccagcggatggagtccgaactcatgggtgaccaggtcgaactccttctccgtcggctcgtggaggccgatccagaggaagctgtcaccctgtgcacgcgcctcgtcaagggcgtcggagaggtcctccgggccctccgtgcggcggccgtcacggtagatggcgcaatcgacgatcactgagcgtattcttccgtcgcgcggacaggtgcgcactccggacgtcgccgggagccggcccggtgaggaccgccgggggcccctttaggctgggccgcatgcccacgttgatcctcgtccggcacggacgttccaccgcgaacaccgcgggactgctcgccgggtggacgcccggcgtcgccctcgacgagcggggcgccgcccaggccgccgccctcccgggccgcctcgccgaggtgccggtctccgagatcgtcaccagcccgctccagcgctgccgggaaacggttcagccgctgctcgacgcccgccccgggctgcgcgcgcacaccgaggaacgcatcggggagtgccactacggcgactggtcgggccgcaagctcgccgagctgaaggacgagccgctgatggaggtcgtccagtcgcacccgtcggcggccgcgttccccggcggcgaatccatgcgcgccatgcagacccgcgccgccgaggcggtgcgggagtggaacgcgcgcgtggagcgcgatcacggctccgatgccgtctacctcatgtgctcgcacggcgacatcatcaagtcgcttgtcgcggacgcccttggactccatctggacctctttcaacgaatctccgtagaaccgtgttccatcaccgcgatccgttacacccgactgcggccttttctcgttcgcctcggggacaccggcgatttcgcgtcccttgccccgcgcgaggaaccctccggtggcgacgctccggtcgggggcggtgcgggcgcaccgtgatcgtcgaccgcagtagggtgaagcggtcgaaacagagcagacgttgtcagcagccgatggggaccgacgcggtcggtcgtcccacatgccgaatccaatggagacaggacgtgtcgcgtcaggtgttcctctacgaccccccggaccgtttcgtggccggtacggtcgggctgcccgggcgccgtaccttcttcctccaggcctcctcgggaccccgtgtgaccagcgtggccctggagaagacccaggtcgccgcgctcgccgagcgcatggacgagcttctcgacgaggtcgtacggcgcagcgggggcagcgccccggtccccgccatggcccccaccgagatctccgacaacgcccccctcgaggctcccgtggaggaggagttccgggtcggcaccatggcgctggcctgggacggtgacgagcagcgcatgatcgtcgaggcgcaggccctcgtggagctcgacgccgaatccgacgaggacctcgccgaggcggaggagcggcttctccaggacgaggagaacggtccgccgatgctccgcgtccggctcaccggcctacaggccagggccttcgccaaacgggccctcgacgtcgtcaacgccggccggccgccctgcccgctgtgcagcctcccgctcgacccggaaggacacgtatgtccgcgccagaacggataccgccgcggagcgtgaccacggccgaactgctcgccgagggtgagctgaaagtacgtggccgcatccgcgaggcgtccaacgcggcgctgtactgcacggtctcgcacgacgggcaggaggcgttctgcatctacaagcccgtcgccggcgagcggcccctgtgggacttccccgacgggacgctcgcccagcgcgaggtcgccgcgtacgaggtctccgaggcgaccggctgggggctcgtgccgaccaccgtgctgcgcgacgggccctacggcgagggcatgtgccagctgtggatcgagggacagccggacgtcgagctgctggccctggtggacggcgaggagcccgaggccggctggaaggcgatcgggttcgcggacgtcggggaggggcgtacggcgcttctcgtgcacgccgacgacgaacgcctgcggcggctggccgtcctcgacgccgtcatcaacaacgccgaccgcaagggcggccatctgctgcccaccgacgagggccgcctgtacggcatcgaccacggggtgactttcaacaccgagaacaagttgcggacgctgctgtgggggtgggcgggggagccgctcacggccgacgctgccgaggccctcggcaccttgaaggacggcctgacggcgggaggcgccctcgccacccgtctggcggagctgatcacaccggccgaactcgacgccacgcgcgcgcgggtcgacgccatgctcacctcgggaaagcacccggagccgagcggtgagtggccggcgattccatggccgccggtctagggcccgatgtcgtggtcgtgagcacgatttcggggccgccggtgtcgcggagcgccgaacgcatgccgggcggcattgcgcaagagggccttctcggtcatcaggcctggtccggttcgtatacggaacatccgtccggttaggctcatgacatgcatgcctggcccgcttctgaggtccccgccctgcctggtgagggccgcgacctccggatccacgacaccgcgaccggcggggtaatacccctgcaccccggtcccgtcgcccgtatctacgtctgcggcatcacgccgtacgacgcgacccacatgggtcacgcggcgacctacaacgcgttcgaccttgtgcagcgcgtgtggctcgacaccaagcggcaggttcactacgtccagaacgtgaccgacgtcgacgatccgctcctggagcgcgcggagcgcgacggcgtcgactgggtcgggctcgccgagaaggagaccgccctcttccgcgaggacatgacggcgctgcggatgctgcccccgcagcactacatcggcgccgtcgaggcgatacccggcatcgtcccgctcgtcgagcggctgcgggacgcgggcgccgcgtacgaactggacggggacgtctacttctccgtcgaggccgacccgcacttcggcaaggtctcgaacctcgacgccgccgccatgcgtctgctctccgccgaacgcggcggcgacccggaccgtcctggcaagaagaaccccctcgacccgatgctctggatggccgcccgggagggcgagccgagctgggacggcgcctcactgggccgcggcaggcccggctggcacatcgagtgcgtggccatcgccctggaccacctcggcatgggcttcgacgtacagggcggtggctccgacctcgccttcccgcaccacgagatgggcgcctcgcacgcccaggcgctgaccggcgagttccccatggccaaggcgtacgtccacgccggcatggtcgcgctcaacggcgagaagatgtcgaagtccaagggcaacctggtcttcgtgtcgaagctgcggcgtgacggcgtggacccggcggccatccgcctggcgctgctcgcccaccactaccggtccgactgggagtggacggacgccgtcctcgaagaggccctcgcgcgcctcggcacctggcgcgcggccgtctcccgccccgacggtccgcccgccgaggcgctcgtcgaggagatccgcgacgccctcgcgaacgacctggacgcgccggccgcgctcgccgcggtcgaccgctgggccgcgctccagcacgagcggggcggtaccgacgagggcgcgcccggcgtggtgtcgcgggccgtcgacgcgctgctgggcgtggcgctgtaaccggccgggtacgcggccgggcgccgggcgggttctcacccgcccggcgccctccgcgccgggagcatgcgctcctacgtcatccaggtgccgccacccgggctacttcgtcacgatgacggactgcaggacgccggtcgcggtgtcgtagatcccgtagaccggctgcccgtaggcgaaggcctcctggaccgcgtcgtgcgtcacctggttcgggttgatgagtcggcgccatccgttgctgatgaacaggtagagcacctggggctggcccgggagcggtgtcacgacgtcctggaagtgctgggccacgccgatggagagcgccgcggtcgagacggcgctcggcagcaccagggcctggccgtgctggacgtcctgttgctgctgttgctgttgctgttgttgctgctggccgccgatgtcctgcggctgagcgagctgctggagcagatgctggaacggctgctgctggccgaggtgctggagctgctgctgaaggtgctgcggaatctgctgctggtgctgcccgaagggctgctgctggccgatgccctgctgcccgatgttctgctggcccatgccctgctgccccatgccctgctggccgaagggctgctgcatctgcggcccgtacggctgctgctgcccgtacggctgctgctggccgaactgcggcggtgccgtgctcgggccctgctggccctgtcggccctgctggtcctgctgctgtcccatggagctgagttgcggggtggtgctcattcgggtgccaccttccctcaatggttggttgcggtccgtcggtccgtgacgaccaggtcctcagcccgtgacgaccaggccgatgatctcgtcgtccgagaaccagacacggatgtcgggccgtccgcccgcgaaggcggtgtgcaccgcctgacggatctcgggggacgggttgttcaggttgcgccaggcgccggccgcgaacagccggagcctgggcgggagttcacgcggatacggcagcagctcgtcccagtaccgctcggcctgggccgagccgaccgcctcgggcagcagatgagtgaccgccgccttgatgtcgggccggttgccgatccgctgcgaggcgggccggcccggcgcgtcctgctgcggggaacccgtggcccgcagcaggacgcgggcacgttccggggacatcggctcctggtcggccgccttcagcatgccttgcagcgcggccagggcgccgaccaccatcggggaggcggaagaggtcccggagaacgtgtccgtgtaccagacgatttcctcggcaccgccctggagatcgccgggccggtcccagaagccgccggtcgtcgtgacctcgcgtccccagccctgcgcgtccacacgggccccgtagttggagaacgcgagccgggagcggtccgggccgtgatcacggccgtgggtgccgggcggaggggcgcccgcgccgaccaggaccgcgccggaggaccggtgggaggggttgaacgggttgcgccaccacgtggggaactcgtcggggcggcgctcgtacgccgcgtcgtcgagggactcgccaccgttgccggcggcctccaccacgatgacgcccttcgcggtcgcgtaccggatggccgcgaagtcgtccggccaccactcgagcgcgaggtagccccgctggtcgtcgcgctgttcgtagtcgaaccgcggtcccgggcgatggagttcgaccaggacgacgtcgccggggccgagccggtcggccgccgcgtggatcgcggcagccgtaccgatgccctggaaggacgcggcggcggtcacggcgtccggcacgatgccggtgacgccccgctcattgcggtcgccgccgatcactccgatgacggccgtgccgtggttgcgccaggcgaggtcggtcagcggggtgccgacgacgacaccggcgagcttggcggccagatcctcgtgccccaactgccaggcgccctcgacgtcgatcaccgtcacgtcctgccccgagccgccgggccgctgccatgcccagtgggcgtcgatcccctcgggcgcgggccgcagatagccctggcggctgccgaagtcgggggtgacgggcgtgccttccttcagccgccggctgtcgtcggcgctctctccggtcggcctgccggagccggtggaggcgggcacggcgcccggtttcacatacgccgtgtcgacctccggaagtgcggcgatgcgtgcgcgcagttcctgggcgcggctccgcacaccgcgcacccggtagaagagtccgaggtcgggcacgttctcgacgcccgtggtcatggactgctggagtcgctcctcgctgccgaacagcggttcgagcgcgagctgttcgtcactgaggaacatgttgagggccgatacgtcggcgcccaccgccgagcggacgccgtcggcccgggcgcgcagccgcgcctccggacgggcgacgacgatcagctcgtgctcggctcctcgataggtgaatcccgctccgtcgggccccggcccggacgctcccgggccctgcgccggctgtccctggtcggtcatcgcgtgtgccgctcccttcggtccgtgctgcgggtgccaagtagcggacggcgcggatgacttgcccccttccggggcgccgcggccggctttcgtggtccggcccggaaccgcgccttcgacgcacaacctggcacgcccgtgccgtccagtccagcccgatttcgccaacttggtttggaaacaagttgaatggggaaacctgtgcaatccgactggaaagaggtgtcacgcagcaatccggccgaatgctgccgagatgcgtgtcatatgacggtgcccgagcggccgttggcgcgacggggcggttgcagccgaagcggcggttgcgggcgaagtggcggatgcgtgcgaaggagcgatcgcatgcgaaggggtgatcgcatgcgaaggggcggtgcgccgtgtgcgcaccgccccctcggtggtcgtggttcagtcctccgacgagtcgtcggacccctcgtcggccgggccgtcgtcctcggcctccggcttcggcggcttcggtggccgcgtacggccgccgggggcgtcccgcagatacgaggtgccgtcgctgccgtccgccgtggcgtgtccgccggccgccggtccgccgccgtccctgcgccgcaggtatcgctcgaactcgcgggcgatcgcctcgcccgacgcctcgggcagctcggcggtgtcccgggcctcctccagcgactgcacgtactcggcgacctcgctgtcctcggcggccagctggtccacgcccacctgccacgcacgcgcgtcctcgggcagctcgcccagcggaatgcgtacgtcgatcaggtcctccaggcggttgaggagggccagtgtcgccttcgggttcggtggctgcgacacgtagtgcggcacggccgcccacagcgacacggccgggacgcccgcgtgggtgcacgcctcctggaggatgccgacgatgcccgtggggccctcgtacttggtctcctccaggtccatcgtgcgggccaggtccgggtcggacgtgacgccgctgaccgggaccgggcgggtgtgcggggtgtcgccgagcagggcgcccaggacgacgaccagctccacgcccagttcgtgggcgaacgccagcagctcgttgcagaacgagcgccagcgcatcgacggctcgatgccccgcaccagcaccaggtcacgcggcttctccccgccgacgcgcaccaccgagaggcgggtcgtcggccaggtgatcttgcgcacgccgccgtccagccacacggtggggcggttgacctggaagtcgtagtagtcctcggcgtcgagcgccgcgaacacctcgcccttccactccctgtccagatgtgcgaccgcggtggaggcggcgtcgccggcgtcgttccagccctcgaacgcggccaccatgaccgggtcgatcagctcgggaaccccctcgagctcgatcacccagtgcctccttccgacgtgccctcgcgtacgtcccaaccttacggcgtgcggcgggggcgtccgcagcccccttgcacgggggagtgaacggatcactgccccgatagccacccaggaacacccctcattcatccgagctgtcagagatcgaattcgctgccggcctgggcgccgttctggggcgacacgggcctcggaagcccgtcggaggtccgatgtccggcccggggcggggctgtgagctggtggtacctccgctgttatgccgcctgccggtgcccgagacctccgatggatccggagggccggtgtgcactcggctcgaggaggccgcctacagggtgctgcgcagccactgctccacgctcgcgatgtgcaccgtcgcccacgaccgcgccgcctccgcgtcccggtcgcgcagggcggtcaggatcgcgcggtgctcgtgcagggtccggctgaccgcgtcctcctgcgtcaggccgcgccagatcctggcccgggtggtgggcccggacagcccgtcgagcagcgagcacagcaccgagttcccggaactctgcacgatgccccggtggaactcgaggtcgcaggcgacgagttcctccacggagggtgccgcgcccagcgcgtccaactgggaggtgagcgcgtccagttgccgctcgctgatgcgcgacgcggccatcgccgtcgccgccggctccaggatgcggcgcacggcgaggaactccaggaccgtgtcgtcgcggtggaagtcgacgacgaaactcagcgcctcgagcaggagttggggatccaggctcgtcacatacgtgccgtcgccctgccgcacgtccaggatgcggatcagcgacagggcgcgcaccgcctcgcgcaaggagttgcgggacagcccgagttcggcggcgagttcgctctccttgggcaaccggtcgccgggacgcagcgcgccggagacgatcattcccttgatcttctcgatcgcctcatcggtgactgccatggcggggcctccctgtcgctcagacatccgatgactcggcccattatgggggttcagcaggctgaacgggacgggaagtcctcagctcaggcaagcgcgccgagttcggccagcgcggccgcctcgtcgagcgaggtgagtgtacggccgcgcatcaggatcctgccgtcgaccacggtgtcccgtacgtccggcgcatgcgcggcgtacgcgagcagggaccacgggtcgtgcggtgggcacagatgcggccggccgaggtcgagcacgatgaggtcggcgcgcttgcccgcctccagcgagcccaggtgatcaccgagccccagcgcgcgggccccctcgatggtggccatccgtacggcctgctcggcgcccaccgcggtggggtcgccgcccgccttgtgcaccagggcggcctgccgcaaagcacccagcacgtccagcgtgttggagctgacggctccgtccgtgcccagcccgacggtgacacccgcgctgagcagccgcggcaccggtgcgatcccgcagcccagcttgaggttcgacaccggacagtgcgcgaccgaggtgccggtgcgggccagcgccgcgatctcgggacccgtcagatcgacggcgtgcgcgagcagcacatcgggcccgagcagcccgagcgagtcgagcagttccaccggacgcttgccgtgacgcacctcgacggtggcgacctcggtcgcgttctcggccgcgtgaaggtgcagcagcgccccgaactcccgggccagcgcggcgatgtcgaggagctgcccgggagagagggtgtaggtcgagtgggcgaagaggaccgggcgcgtgccgggccggtgcgcgcggtcggccaggtcgcgccgcgcccacgccagtcggtcctcgtacgcgatgccgtcggccggatccggtacgtccatgaaggtggggccggtgtgcagccgccagcccgactcccgcgccgcacgctcggccgcctcgtggaaccagtacatgtccagcgcggacgtcaccccggcccgtacgctctcggcgaccgcgacccgtacggccgccgccacgttcttcggcgacagcagctcggcctcccacttcagcatccgctccaggaagcgctggagcgtgacgtcgtccgcgcggccgcgcagcagcgtcatcgccagatgcgtatgggtgttgacgaggccgggcagcacgagacagccctcggcgtcgatgtcctcggccgccgcgtaccgcgtccgcagctcctgggcgggccccaccgcgaggatctccccggcgcggacggcgaccgccccgtcccgtacgagggttccggcctcgtccacggtcagcacgtcaccgccgtgcaccagcagatcgacggtctcgctcatgcggtgtactcctcggtcccctcggtcccggcggcaccctgcgccagcagccgcagcgcctccagcgacacgaccgcgccgcgttccacgcccgccgccaccacgtcccggtgcgggtcgtaggcgcccgtcgtcagcagtgcgtcctcgtcgaccagttcgtcggcgttcgcgccgtccaccacgagcaccccgcccgcgacgagaccgcgcagcgaggccgtcacgagcagcgcggacagctccatctcgatcgcggcgagcccggcccgggcgtagccgtcgagcgggatgaggccgggctggaaggcggcccgggtccacacgatgccccggtggtgcggggcacccgtctcgcgggcggcgcgctggagggcgagtaccgcctccggcgcggacacggccgggtacgcggccggcagcagctgctgtgtcacgccgtcgtcgcgcacggccgcctcggcgatgacgaggtcgccgtcgccgatcccgggcttcatcgcgcccgccgtgccgaaccgcacaaacgtgcggacccccgcgtccgccagctcctggaacagcaggatcgcgccgggaccgcccaccccgtgcgaggcgaccgtgaccggcagacccttccaggccccgcggaacacccggtactcgcggtggtacgagacctcttcggcaccgtcgagcagtgcggcgacggccgcggcgcgcgccgggtcgccgacgaccacggcgtacgggggcagcccggtgcggggtatgcgggtgacgggcagcaggtcctgcgtcatgaggtggctccagtggcacggatacggcgacggcggcgggccgtcgtgaggaagagggcgccgagggtgacgacgtacggcgcggcgtcggtcgcctgctgcggcaggccgaggccctgaaggcggaagccggccgcctcggcgacgccgaacagcagtgcggcgagcaggaccccgagcggcagcgcacggcccagcatgaccgcgacgaccgcgatccagccgcgtcccgccgtcatgttctcggagaacaacgtcacgttgccgagggcgagttgggccccggcgagcccgcacagcacacccgacacgagcacggccgcgtactggtacttcgccgggctcaccccgagtgtggccgccgcgtccggagcctcgccgactccgcgcagccgcagaccccacccatgccgggacagcatcagcgcggccacgccgaccgccgcccaggcgaggtaggcgagcggcgagaagccgccgaccagcggcagcccggccagtgacggatcgtcgaaagtgccctgcacaccgaagaccgtacgcagcaggaagccggtcagacccacggccaggagattcatggcgatgccgaggaccaccgcgtccccgcgcagcgtcaccgcgccgacggcgaggatcagggagtatccggcggcggcgagtgccgcggccaggacgccgagccaggggctgccggtgaaccagctggtggcgacggacgtgaagcagcccatcagcatcatgccctcgaggccgatgttgaagacgcccgcgcgctcgcacagggccccgccgagcgcggccagcaggatgggcgtgagcgcgcgcagcgccgacatgaggaggtcggagtcgaagaacatcaggcgaactccccttgtgcggacggcttctcgcgccctcgccggaaccgcgagaaccgcgggaaccgcagccgggccgccaggaacacgatgacgatggcctggaggacctgggtcagctcgcgcggcacctcggtcgtccgttccatcgagagcccgccgacctggaggacggcgaagaagaacgacgcgaccaccgtgcccagcggggccgcccccgccagcagcgcggcggtcaggcccgtccaggtgtggccgggagcggtgagcgagccgtcgacgaagcggtacgggaagctcagcacgccgatcgagccgacgagtccggccagcgcgcccgagaccgccatcagacggagcgtcagacccttccgctcgatgcccgcatacgcggcgaagcgggagttcaggccggtcatccggacctcgtagccgatcgccgtgcgccggtccgcgaaccagtacgcggccgccgcgagcgccaccaggaccagcccgacggtcacggtcgacccgccgaaggcgggcagcgcgaccccgtcgggcagctgacgggtctgggggaggctggagccgggttccttgagcggataacgggccaggtacgaggcgaacgacgccgccggatagctcagaagcaggctgctgaccaggagcggaaccccgaggtggttctcgcacagggcggccagggccgcgtagccggcgcctgccgccatgccggcgaagagggcgagcacgacggtgagcggggcgggcagcggcgcgtacaggccggtgaccgccgcggcgatcccgccgagcaccagctggccgtccccgcccaggttgatgagcccggcacgcagcgggatcgccagcgcgagcgccatgccgaggacgctggtgccggtgctcagggtcgagccgatgccgtccgcgccgagcgagccgccgatgaccgcgccgtaggcggcgaccgggtcggcgcccgtgcccacgaggaacagcgcgccgatgacgactccggcgagaatcgagaaggcgacgggggagcgcagggccccggtgatgcggttcatgtcagtctccgacctctgccggtgcggcggctcccgccatcgcgagccccagcgtccgctcgtccgcctcgtccttcgggtacgtcgccgtcacccggccctcgtacatgacgagcacccggtcggcgagcccgcggatctcgctcagctcggccgagaccaggagtacggcgtgaccggcgtcgcggtaggcgatcagctggtcgtggatgttctggacggcgccgatgtcgacgccgcgcgtgggctgttcgaccagcagcagcggtgcctcgtgggcgagctcgcggccgatcagcagcttctggagattgccgccggacagggcggacgcgggcacctcgggggtggccgccttgataccgaagcgctcgacgagccccagcgcgtgggcgcggacggccgcggctgacagcagtccccgggacgacagcgacgttcggtggtgccccatcgcgaggttgtccgcgacggacgcggcgggcgcggtgccgaccgcgtgccggtcctcgggcacatacgcgaggcccctggcgcgccgctcggtcgccgaggcgtgcgtgatgtcctcgccccgcagcgtgacctgcccggcggcggtcggccgcagcccggccagtgcctcgaccagctcgctctgcccgttgccggcgacgcccgcgataccgacgatctcgcccgcgcggaccgtcagttcgacctcgcgcacggcgtccgtggtgagcccccgcacgcccaggaccacgtcggccggtgtgcccggcgcgtggacgcggtccagttccaccgcgcggccggtcatcgcggccgcgatctcgtcggccgtggtcccggcggtgcgcagccgggcgacgaccctgccgtcccgcagcaccgtcacacggtcgctgccttcgaggacctcgcgcagcttgtgcgtgaccaggatgaccgtacggccctcggcggccagcgacttgagcaccgcgaacagcgcgtcggcctcggcgggcgtgagcaccgcggtcggctcgtcgaggatgagcgtccgggcgccgcggtgcagcagcttcaggatctccacccgctggcgcagaccgaccggcagctcaccgacgcgggcgtccgggtccacggcgaggccgtgcacctcggcgagttcgcgcacccgccgacgggccgcggaccggtccaccagaccgaagcggcgcggctcggcggcgtacacgacgttctcggcgaccgtcagcgagtcgaacagcttgaagctctggtgcaccatgccgagcccggcggccatcgcggcaccgggatcggcgaaggacacctcgcgcccgtcgatccggatcgaaccggcgtcgggccgctccatgccgtacaggaccgacatcagggtggacttgcccgcgccgttctcgcccatcagggcgtggatctcgccgcggcggaccgtcaggtcgacggcgtcgttggcgagggtgccggggaaacgcttggtgatcccgcggagttcgacggccgccgggggagcgtcactcggcggcggggtcatcgaccttcagctctccggcgacgatccggtcgcgcagcgcggtgaccttcttcaggacgtccttgtgctgggcgatgacgcacttggaggtggccacgccgtcctcgagccccgtgaggctgatgccgccctccttcaggccgtacgagacggtggtccccgccttgccgcccaggacctggtcgatgcccttccgcacggcgacatcggtccgcttgatgacgttgtcgacgaccgtgccgggcgccgcgacgcactggttgacgtcgacgccgtacgcgtacgcgcccttggccttcgccgcctcgaagacgccgtagttgccggccgcggccgccgccatgatctggtcgtagcccttggcgagcagggagttcgcctgctccttcgcgcgggccgagtcgtcgaacggggactggccgccgacgaagcgggtggaggcggacgtcttcgcggccacctccttggcgccggccgcgaacgggtcgctgtagcggcggaactggggggtgtcgagcacgtccaccgcgccgaccttgccgctcctgctcagcagcccggcctcggcgcccgccaggtacacgccctcgtgctcgcggaagaccgcgcagctgacgttccgatacgtcttggtggtgcacgcgtcgacgatcaggaactgctgctcggggtgcgccttcgcctgctgcgcgaccacgtcggcgaactcgaagccgaccagcacgatcacgtccggctcggcgtccacggccgcctgcacgttctgctgctgcgaggaggtgtcggtggactggtagaccttctgcgtcccgtcgtgcgcctcggccgcggccttcaccccgtcgacggcgagcttgaggaactcgttctggccgacgccgtcgggagtgaccagggtgaaggacttgccgccgctcttcgcggtgccggaggcgtcgttcttcgcggcggcgttgcaggcggtgaggccggtcacgaggagcgtggtggcagcggcgagctggagggtacgacgggatctgcggtgcatcggaggaccttccgggggtacggcaaggcgcgctccggtggagcgcggggcgggggagagcgagcaggagggcgaacgtcggcgctgacgggtgcgggtcagccgcgacagaggtcgccggcgcaccggccgtgatcgaggaagcggcgcatcgtgagcagcacacgtcctccttcgcatcggccttcgggctgcgggtgctggactgtaacaccggtttccggacacgcgtgcgactgtctcgaactgtggttcttcgaggtcatgtacggttgcgcgcatcttcggaacatcaggagtgtctgttatgtcccagaaactgcgcgccgtcgactggaccggaaacagcctcgcgctcatcgaccagaccgtgcttccgcaccgtaccgaaaccatccaagtccgtgatgtggacggcctggtggacgcgatccagcgactcgtggtgcgcggcgcgcccgcgatcggggcggcgggcgcgtacggggtcgcgctggccgtgctggagggcgagcgcgagggctgggaccgtacgcaggtccttgcggcggtcgcccggatccgcgcggcacgccccaccgcggtgaacctcatggtgtgcgtggaccgcgtgctgacccgcttcgacgagggcctcgacgcggtgctcgcggaggccgcggcggtgcagcgcgaggacgtcggggcgaaccgggcgatgggggcgtacggggcggactggctgctgaagcgggtggccgccgaccgtccgctccgcgtcctgacgcactgcaacacgggtgcgctggcgacggcgggctggggtacggcgctcggtgtgatccgcgaactgcacgcgcgcggacagctggaagtggtctacgcggacgagacgcgcccgctgctccagggctcccgcctgaccgcctgggaactcgtccaggagggcataccgcactacgtccaggcggacggggcggccgcgggcacgatcctgcggggcgaggtggacgcggcgatcgtcggcgcggaccgcatcgcggccaacggcgacacggcgaacaaggtgggcacggtgggggtcgcgctggcctgcgcgtacgcggggatcccgttcctcgtggccgctcccaccacgacggtggacctgtcgacggcgacgggcgacggcatccacatcgaactgcgcggcgaggccgaggtgttggagtggtcgggcatccggacggctcccgccgggtcgcgcggccacaacccggcgttcgacgtgacgccggggcggctggtgacggggctggtgacggagcggggcgtgctcgaggtctcggcgggagaactgccgggggagcacctgcggtagccggacccccgcccgccgcgacgaggtgtcaccgaggcggtgaggggccggcggaccgcgcacggaccctcgcggccggccgggtcaccgctgcgtgagctccaactcgagcagccattccacgacctcggtgtgatgccgggcctgacgagggttctcgccccacacatacagcccgtgccccgccacgaccaccgccggcatccggggatcgcgcgcctcctcgagacggtcgccgagcaccttcatgtcctggctgttggcgatgacgggcagcgtgacctcgacgtcatgggcgggcaggccgacgcccttcagcatctccaggtcccggaacgcgatgccgcccggctcgcggcggcccatggccacggaggcgaccgtgtgcacatgcacgacggcccccgcaccggtcagcgcggccacgcgcgcgtgcagcgcggcctccgcggagggcctgcccccggcgacggccgcaccgtcgccgtccaccaggaccacgtccgcgggcgtcagttcacccttgtcgtggccgctcgccgtgaccgcgagccgcagcgggtcacgggacaggaccacggacaggttgcccgacgtgccgcgcatccagccgaaggaggcgaagcgggcggactcggcggccaggaccgcgcccgccccctccaggtccggaactgacgtgtcgacggtcatgcggtgctccttgcgatggtgatcccgccgaacgaccccgcctgcgcgtggtccccgacgccctgctcgtagtacggctctccgggccgccggacaccgacggtccgccagcccgcggcgcgggccgcgtccagctcgcccggccggtcggagaggaagaggatccggtcggccccggtgcccagcgccgccgcgatcgtccggtacgactccggctcctgcttcggccccgcgttctcggtgtcgtacaacccctcgaccagcggcagcagatcgccctcggggctcgacctgaaccacgcgcgctgcgcggccaccgaacccgacgagtacacatgcaggcgcactcccgccgcgtgccacgcgcgcagcgccggcaccacgtcgtcgtagaagtgcgacaccagctcgccccgggcgaagccctcggaccagacgaggccctgaagggtcttcagcggcgtggccttgcggtcgtcgtcgagccactcgttcagcgccttctcgacgcgtacggcatcggcgtccggctcgccgagcaactcccgtacctgcgccaccgcccgcgccacctccggatcaccgctccgctcggtgagcagtgctccgaaacgagagcgcgagtacgggtagagcacgtccacgacgaaccccgtggcgctcgtggtgccctcgatgtcgagcaccacggagtcgatgtcgaagaccgaactcatgcggcagaacccacgtgaccggcgtggatcgtgtcgtagtccgggaaccgggacgcgatggtggagccggtgaagctgccgatccagccgtcctcctcgtggaagaagcggatcgcggtgaaggcgggccgcgtccccatgtcgaaccagtgcgtcgtaccgcgcggcacgcccagcaggtcgcccttctcgcagtacacggcgtggacctcgccgttcacatgcagatagaagatcccggagcccgagacgaagaagcggacctcgtcatcgtcgtcgtgcgtgtgctcctggaggaacttcgcgcgcgcggccttcgccttcaccgggtactccgggtcgtcgctcgggtgcagcccgagcacatcgaccgtggtgaagccctcctcggcgttcaaccggtcgatctccgggccgtacgcggcgaacaccgtgtcgctgtccgcgtccgccggcacgtccgcgcggaccggccactgctcgtagcggaccccgagcggcgcgagcgcggcggcgatctcggcggggtcggaggtgcggcgcaccacggtctccggtccggactcgggccaggtcgtcagcagggtcatgggagcaactccagggtgctggaagggatgtccgaatgccgagacgggcatccgggcgcaagcgagggggaagggggcggcgccgcgccccgcgcgggaggcgaaaagccggagatcgggtggccggaaagcctgtgatcagccgcgacacaccgcgccggtacagcgtcgcatcgctgtcgcgcctggtgttgtcgtcatcggagcctcactgtcccgggtcgggtgccggtcccgtgatggtaactcccggcggccggacggccgagtgtgacgaagttgttgtctcaactactgagaaaccgggtctcgatctttgacgcgtggctggaaacgttctcatgatctgggtatgaaggcgctgctgctcgtgcggcggctgtacgtggacttgctccggtcaaccacagcccgctgtcgctgacctgacccggagcgcccgaaagcgcccgcgcccgccgtgagttccccgtgtaccggcgaggccctgccgcgtacgcctcgcacgcggccctggcgtgattcctcccctgccgctccggaccggcactccctcttcatcctcttcgccccgccctggagcgcctcatgtcccgtacccgcctgcccgtcgccgcgctctcactaagcaggccctgccctgggtgcgggtggcgggcccctcctggccgatgagccccgagcgcgccgacgccgaggcccgggcctacgagcaggtcgccggggtcgcaccggacaagatcccggcgatccacggctacgacggcgagaaccacgccctcgtcatggaggacatgtccgacctggaggtcctgcgcacggtcctcaacgagggcgccgcgtacggccccgacacctcgcgccgcatcggcgagttcgtcgcccagctctccttcgcgaccagcggcttcggcatgccgtcagccgagcgcaaggcgctgatcgcggcctgtgtcagccccgagctgtgcaagatcaccgaggacgtggtcctctccgagccgtacatcgaacacgagcacaaccactggcaccccggactcgacgacctggcggccgcgttccgcgccgacccgcgcctgcgcaccgaggtcgccgacctccgccacgtcttcatgacgagcgcgcaggccccgctccacggtgacctccacacgggcagcgtcatggtgggcgagcgcgacggcgccccggtcgtccgggtcttcgaccccgagttctccttcgtcggcccgatcggcttcgacctcgggctgtactgggcgaacaccctggtgtcgcaggagcgggcgcgggccctcggcacgctcaccgatcacggtgagcaactccggctgtcctgggaagcgttcgcggctcagttccgccggctgtggccgacccgcgtcgacaccttcttcgacgacgcctatctcgaccgcttcctcgaccgcgtgtgggccgagtcgctgggcttcgccggtacggagatcgtccgccgcgtcatcggcttcgcccacctcaccgacctgacaacgctcccggacccggtaccggcgtcccgccgggcgctgctcctgggccgggaactgatcgtgcgacgtgccgagttgacgggaccggacgacgtacgggccgtggtggcgtcgctgtcctgaagcagccggcgggctacgcgagtccgagacgtccgcgatacgggcaggggcggccccgtaggagccgcccctgcccgtatcgcgggtggttacttcttgtcgagcaggtcctgcaccttgccccggacctcgtccgtggcgaggccgcggatcgtcagcgtcgtacggcggcgcagcacgtcgtccgccgtctcggcccactcgttgtcccgggcgtagacgacctgcgcccagatctccggggcgtcctggtggacgcgctcgccgagctccgggttgtcgttcgccaggcgcgcgatgtcgaaggcgagcgaaccgtagtgcgtggccaggtgcttggccgtgtcggcggccatgcgcgggccgggcgccgggccgtcgaccagcagccggtgggcgaccgcgcgcgggttggcgacacccggcagcggcagcttcttcggcagctcgttgatcggctcgaagtcctcaccgagcggatggcccggcagcgactccagcttcttcatgaccgtacggccgatgtggcggaaggtggtccacttgccgcccgcgacggacagcatcccgccgcggccctcggtgacgaccgtctcgcgcttggccttcgaggtgtcgccgggaccgccgggcagcacccgcagaccggcgaaggagtacgtgatcaggtcacgggagagctgctggtcgcggatcgagaacgcggcctcgtccagtatctgggcgatgtccttctcgttgaccgcgacgtcgcccggctcgccctcgtactcctcgtcggtcgtgccgagcagcagcatgtcctcccaggggagggcgaaggtgatccggtacttgtcgatcggggtggccagcgccgccttccagggcgaggtgcgcttcagcaccaggtgcgcgcccttggagaggcggatggacggagccgcgtccgggttctccatcctgcgcaggtggtcgacccacgggccggtcgcgttgaggacgaggcgcgcgttgacgccgaactcctcgccgttcgtccggtccttgagctccgcgcccgtgacccggcccctggtgaagcgcaggccggtgacctcggcgtggttgaggacgacggcgcccgactcgacggccgcgcggaccgtcatcagggccatccgcgagtcgttcatctggtcgtcgccgtacacggccacggccttcaggttctcggtgcgtagctccggcacgtcctgcgcggccttcgaggggccgagcaggtgccccacgccgtcgccgaacgccgacagcgcggagtacgcgaagacgcctgccccgagcttcgccgcgccgtgcggcccgcccttgtacacggggaggtagaacgtgagcgggttcgccaggtggggggccacctggcgggagaccgcacggcgctcgaagtggttctccgccaccagcttcaccgcgccggtctgcaggtagcgcagaccgccgtggagaagcttggaggaggcggaggaggtggcgccggcgaagtcgccggcgtcgaccagggccaccctcagcccggactgcgcggcatgccaggcggtggagatgccgaggatgccgccgccgatgacgaggaggtcgtacgtcgccttggaaagctgctcccgggtctcggcgcggctcgggttggagccggaggccgggtgcgtaccgagggcaggcacggactgaagggtgggctgactggtcatgcgggttcttactcctcgtcctcgatccagcccatggtccgctcgacggccttgagccagctcttgtactcacggtcgcgggtctccgcggccatgttcggggtccactccgcggccctgcgccagttggcccgcaggtcctcggtgttggtccagaagccgacggcgagaccggcggcgtaggcggcgccgaggcaggtggtctcggcgaccatcggacgcaccaccggcgcgtccaggaagtccgagagcgtctgcatcagcaggttgttggaggtcatgccgccgtcgaccttgagggccgcgagctcgacgccggagtccttcgtcatggcgtcggtgatctcgcgggtctgccaggccgtggcctccaggacggcgcgcgcgatgtgcgccttggtgacgtaccgggtgagaccggcgatcacaccgcgggcgtcggagcgccagtacggggcgaacagaccggagaaggccggcacgaagtaggcgccgccgttgtcctcgaccgacgacgcgagcgtctcgatctcggcggcggacttgatcaggcccatctggtcgcgcatccactgcacgagcgaaccggtgacggcgatggaaccctcgagggcgtagaccggcttctggtcgccgatctggtagcccacggtggtcagcagcccgctgtacgagttgatgatcttgtcaccggtgttcatcagcatgaacgtgccggtgccgtacgtggacttggcctcgccctcggagaaacaggtctggccgaacagggccgcctgctggtcgccgagcgcggaggcgacggggatgccgccgagcaggtcgccgagcttgccgccggtgatctcgccgtacacctcggcggaggagcggatctcgggcagcatcgccagcgggacaccgatggactcggcgatcttgtcgtcccactgcatggtgtgcaggttcatcagcatggtgcgggaggcgttggtgacgtcggtgacgtgcttgccgccgttgacaccacccgtcaggttccagatgacccaggtgtccatggtgccgaagaggatgtcgccggcttcggcgcgctcgcgcaggccctcgacgttgtccagcagccagcgggccttcgggccggcgaagtacgacgcgagcggcaggccggtctcgcggcggaagcggtcctggccgacgttgcggccgagttccttgcagagcgcgtcggtgcgggtgtcctgccagacgagggcgttgtggacgggctcaccggtgttcttgtcccagagcagcgtggtctcgcgctggttggtgatgccgatggccttgatgtcgtcgcgggtgatgccggccttctcgacggctccggcgacgacctcctggacgttggtccagatctcggcggcgttgtgctcgacccagcccggcttcgggaagatctgctcgtgctccttctggtcgacggagacgatacggccgtcccggtcgaagacgatgcaacggctggacgtggtgccctggtcgatcgcggcgatgaaggggccggcggtgtgtgcgtcggtcacggtgtgctcctgaaaggtccgtatgaaaggggctgtatctacggcgcggtgcttcgagcggtgctgtggtgcgagcggctctcgagcgagtgcttccagcggtgctgttatgcgaaggcgacgttgtatatgcctgcggctatcgcggcgccgatcagcgggccgacaaccgggatccaggcgtagctccagtcggaaccacccttgttgggcagggggagcagggcgtgcacgatacgcggaccgaggtcacgggccgggttgatcgcgtagccggtcgggccaccgagggagaggccgatgctgacgaccacgagcgaggtgatcagggcgccgatggtgccgaggccgttgccgttgtcgttcaggccctgcgtgaggatcgcgagcacgaggacgacggtgccgatgatctcggtggcgaggttctgcaccacgttccggacctcggggccggtggagaagacgccgagcacggggccggctcccgtctcctgggcctctacggccttggtcttggtggcctgtgcgcccggaccgccgacgatctcgtggtcggtgaggtgcgcgtggaactggccgtagtaggcgacccagaccagggcggcaccgatcatggcgcccagcagctgtcccgcccagtaggtggggacgttgctccagtcgttgtccttgatcgcgagcgcgagcgtcacggccggattgaggtgggcaccggaaagcggcgccgagatgtagaccgcggtcagaaccgcgaagccccacccgaaggtgatggcgagccagccggcgttgcgcgccttggaggccttcagcgtgacggcggcgcacacgccaccacccagcaggatgagtacggcggtaccgatggtctcgccgatgaagatgtcggagctggacacccgcgactcctttgtccttcgtccaggggaagccgaaccccgggtccctccggtggttcgtgctctcagggagagagagcgatacggcccttggcgttgccacactctaacgcgtattgccggtaggtgttcgacaatgccgaccgatggacgggagtcttgcttccgcgttaccagcacgtcaagagctctgttatcgaaagcacgatcgttattgatcgccacgagttatcgatcttgaggtggcacgacgaaggccgggacgcccttggcatcccggccttttcctgtacgaacctcagaaccgcgcggggtcccgcacgaaccgcggagccgcgcggcgtacggacctcagaaccgccccgcgcccagatcccgtgacaccgcccgggcgcagtcccggaccgccgcgatcaggtccggacgcagctgcccgtccttgcagacccgctccacggccccggtgatgcccaccgcgccgaccggcatccgccgccggttgtggatcggtgcggagaccgaggcgacccccgtccaggtctcctcgacatcgtccgcgtacccgcgcgcgcgggtcaggtcgagcacgccctcgaactggtccagctcactgatcgtgcgcggcgtgaacaccttgcgctcggcctccaggacctcgctgtgcgccaccgggtcgtaggccgagaggaccttgccgagcgccgtggagtgcagcggctgcatggccccgacctccagcacctgccggctgtcgtcgggccggaagacgtggtgcacgatcagtacgccctgctggtgcagcacgcccagatagacgctctcgccgctggagcgggccaggtcgtccgtccacaccagggcgcgcgcccgcagctcgtgcacatcgagatacgtggtgccgaggcgcagcagctcggcgcccagctggtagcgccccgaggccgcctcctgctcgacgaacccctcctgctgcagcgtgcgcagtatgccgtgggccgtgcccttggcgaggcccagcgacgaggcgatgtccgagaggccgagccgtcgctcgccgcccgcgagcagccgcagcatcgcggccgcccgttcgagcgactggatgttccgtgccatccccgtcctgccctccgtcccctcggccgtcggtcggcgttcgtataccgccccgttcggcaatgtcgaacactaccgtccgctgtcgacctctcgccaatggctcggcgccggctgtttcgcctgaacccccacatggcacacatacggcacacccgtccggcccgtggacgcccctgaccgtacggccctgccccgggctaccctggccgggtgcgccttccatgggaagcgcaaagccgacagccgtcgcactccagggagcatcttccatggcctcgttgccgaatccgtccccttcgtccgcctccgccgcgagccggagccgaaccgacgccctacgcgaagccctcgccacccgtgtggtggtggccgacggcgcgatgggcacgatgctccaggcacaggacccgacgctcgaggacttcgagaatctcgagggctgcaacgagatcctgaacctgacccgccccgacatcgtgcgctccgtccacgaggcctacttcgcggtgggcgtcgactgtgtggagaccaacaccttcggagccaaccactcggcgctcgccgagtacgacatcgccgaccgtgtcttcgagctgtccgaggccggggcccggctggcccgcgaggtggccgacgagttcggcaccggcgacggccgccagcgctgggtcctcggctcgatcggccccggtacgaagctgccgacgctcggccatgtgggatacggcaccctgcgcgacggcttccaggcgaacgccgagggcctgatcgcgggcggcgcggacgccctgatcgtggagaccacgcaggacctgctccagacgaagacctccgtgctgggcgcccggcgggcgatggacgcgaccggcgtggacctgcccctgctggtctcgatggcgttcgagacgaccggcaccatgctgctgggctccgagatcggcgccgcgctcacggcgctcgagccgctcggcatcgacatgatcggcctgaactgctcgaccggccccgcggagatgagcgagcacctgcgctatctcacccgccactcccgcatcccgctgctctgcatgccgaacgccggtctgccggtgctgaccaaggacggcgcgcacttcccgctcggccccgagggactggccgacgcccaggagaacttcgtacgcgactacggcctgtccctggtcggcggctgctgcggtacgacacccgaacacctgcgccagctcgtggagcgggtgcggggggtcgagcccaccgagcggcgcccccagcccgagccgggcgccgcctccctctaccagaccgtcccgttccgccaggacaccgcgtacatggcgatcggtgagcgcaccaacgccaacggctccaagaagttccgcgaggccatgctggacgcccgctgggacgactgcgtggagatggcccgcgaccagatccgcgagggcgcgcacatgctcgacctgtgcgtcgactacgtgggccgcgacggcgtcgccgacatggaggaactggccggccgcttcgccaccgcctccacgctgccgatcgtgctggactccaccgaggtcgacgtcctgcgcgccggactggagaagctcggcggccgggccgtcatcaactccgtcaactacgaggacggggacggccccgagtcgcggttcgcgaaggtcacccggctcgcccaggaacacggcgccgcgctgatcgcgctgaccatcgacgaggagggccaggcccgcaccgtcgagaccaaggtcgccatcgccgagcggctcatcgaggacctgacgacgaactggggcatccacgagtcggacatcctcatggactgtctgaccttcaccatctgcaccggtcaggaggagtcccggggggacggcatcgccacgatcgaggcgatccgcgagctgaagcgccgccgcccggacgtccagaccacgctgggcctgtcgaacatctccttcggcctcaacccggcggcccgcatcctgctcaactcggtcttcctcgacgagtgcgtgaaggcgggcctggactcggcgatcgtgcacgcgagcaagatcctgccgatcgcgcgcttcgacgaggagcaggtcaccaccgcgctcgacctgatctacgaccggcgctccgaggggtacgacccgctccagaagctgatggcgctgttcgagggagccaccaccaagtccctcaaggcgggcaaggccgaggaactggccgccctgcccctggacgagcggctcaagcggcgcatcatcgacggtgagaagaacggcctggaggccgacctcgacgcggcactccaggaccggccggccctcgacatcgtcaacgagacactcctcgacggcatgaaggtcgtcggcgaactgttcgggtccggccagatgcagctgccgttcgtcctccagtccgccgaggtcatgaagacggcggtggcccacctggaaccgcacatggagaagtcggacgccgagggcaagggcaccatcgtcctcgccaccgtccgcggcgacgtgcacgacatcggcaagaacctcgtcgacatcatcctgtccaacaacggctacaacgtcgtcaacctcggcatcaagcagccggtctccgcgatcctggacgccgccgaggagcaccgggccgacgtcatcggcatgtccgggctgctggtcaagtccacggtgatcatgaaggagaacctggaggagctgaaccagcgcgggctgtcggccgactacccggtcatcctcggcggcgcggcgctgacccgcgcgtatgtcgagcaggacctgcacgagatctaccagggcgaagtccgctacgcccgggacgcgttcgagggcctgcgcctgatggacgcgctgatcggcgtgaagcggggcgtgcccggtgcggcgctgcccgagctgaagcagcgccgggtgcgcgcggccgcggtcgaggtcgaggagcggccggaggagggcgcggtccgctccgacgtcgccaccgacaaccccgtccccgcgccgccgttccggggcacccgcgtcatcaagggcatccagctcaaggagtacgcctcctggctggacgagggcgccctgttcaagggccagtggggcctcaagcaggcgcgcacgggcgacgggccgacctacgaggaactggtggagagcgagggccggccccggctgcgcggactgctcgacaagctccagaccgagaacctgctcgaagcggccgtcgtctacggctacttcccgtgtgtgtccaaggacgacgacctgatcatcctggacgagcagggcaacgagcgcacccgcttcacgttcccgcgccagcgccgcggccgcaggctgtgcctggccgacttcttccgcccggaggagtccggcgagagggatgtcgtcgggctccaggtcgtcaccgtcggctcgcggatcggcacggagaccgccaagctcttcgaggcgaactcctaccgcgactacctcgaactgcacggcctgtccgtgcagttggcggaggcgctggccgagtactggcacgcccgggtccgttccgagctgggcttcgccggcgaggacccggaccggatggaggacatgttcgccctccagtaccggggcgcccgcttctccctcggctacggcgcctgccccaacctggaggaccgcgccaagatcgccgctctgctcgagccggagcgcatcggcgtacacctgtccgaggagttccagctgcacccggagcagtccacggacgcgatcgtgatccaccacccggaggcgaagtacttcaacgcgcgatgaaacgcgcgacgagccgggcggcgaggtgccgggctgcgacaagccgtgtggcgccgcgcgccgcgaggctcggtgacgcgcgccgggacgtacgtccacgcatgctgagcatgctgatcggataagtcgtacactggtcggtccactgcaggccggttgcccttttgccaaaaaagggcagccggcctgatcgtccctcaaggaggtgcgcccggatgaccagtacggtccccgcgctcggtacccgttcggccgaaggctccgctctgcaggccgtgctcctcgacatggacggcaccctggtggacaccgagggcttctggtgggacgtcgaggccgaggtcttcgccgccctcgggcacccgctcgacgagtcctggcgccatgtcgtggtcggcggccccatggcgcgcagcgcgggcttcctcatcgaggccaccggtgccgacatcaccctcgccgaactcacggtgctgctcaacgacgggttcgaggcacgtatcggccgtacgctgccgctgatgccgggcgccgcacggctgctggccgaactcgcggcgcacgagatccccaccgccctggtctccgcctcgcaccggcgcatcatcgaccgggtcctgacctccctcggctcccagcacttcgcgctgaccgtggcgggcgacgaggtggcgcgcaccaagccgttccccgacccgtatctgctggcggcctccggactcggcgccgagccggcgagatgcgcggtcatcgaggacacggcgaccggtgtcgcggccgcggaggccgccggctgccgggtggtcgccgtcccgtcggtggcccccatcgcacccgccgcccggcgcactgtcgtgacctctctcgaagaggtcgacctgccatttctccgcggcttgatgacggaaatgcgctaagcgttcaccgagcgtacggagccgaatacggggaatttccaagacgtcgcagggagtaattcaaggtcgccggatggccgaattccggtacccccccaccgagttgcgagtgtgacgttcgccactcaccagggggtcgacagcgggggcgacatgtgcagctctccccttttcggggggcggtgacgtgcccttgtgtcccaattagtggaacactgtactaatccttcccgcagcgggtttcccgtgcgtccgcagccggtctcactgcgtgatgggaactcaactccggttgctgcgagccgtcgtgctggtgcggactaatctcgtcgcgagaacatcgccacaaccccccgtgatccgccgcgccacccctgcatgccgggtacacggactcgacagctctggagaaaatcgagcatgaaccgcaagactttggtgctgccggcggtcgtcggcctgctcgccccggtgctcgccgcctgcggcggatccgacagcgggagcagtggcggcggttcggtcgtcgtcggcaccactgaccggttcaccgcctccagcgacgcccccgcgcccgtcgacccggcgtacgcgtacgacgtgggcacctggaacatcctgcgccagacggtgcagaccctgatggtccagccccgcggcgacggcgagccggagcccgaggccgccgagagctgcggcttcaccgacaccggcaacgagcgctacgcctgcaagctgcgcaaggacctgaagttctccagcggcaaggccgtcacggcggccgatgtgaagttctccatcgaccgcgcccgctcgatcaaggccgacagcggtgtgttcgccctgctgtcgaccgtcgacaccgtcgagacgcagggcgaccgtgaggtgatcttccacctcaagaccgcggacgccaccttcccgttcaagctgtcgaccccggtcgccggcatcgtcaaccctgacgactacgagaaggacaagctgcgcgacggcttcaagatcgacggctccgggccttacacgatggaggccgaggagaaggacaacgagctggtcaaggccgtcttcaccaagaaccccaactacaagggtgcgctgaaggtgaagaacgacgaggtcgagatgaggtcgttcgaggacgcctcggcgatgggcgccgccctcagcaagggcgacatcgacctgatgacccgcacgatgacgccggaccagatccagaagctctccaccgactcgaagggcgacgtcaacctcgtcgagatgcccggcctggagatccgctacctggccttcaacaccgacgccacgaccgtcaagaccaaggcggtccgccaggcggtggcccagctcgtcaaccgcggcgagctggtctccaaggtgtacggctccacggccgagcccctcttctcgctggtcccggccaccatcaccggacactccaactcgttcttcaacaagtacggggacgcgagcgtcgccaaggccaagtcgctgctcgccagggcgagcatcaccaccccggtgaagctgacgctgcactacacgaccgaccactacggctcggccaccaagaccgagttccagcagctgcagcagcagctgaacaacagcggtctgttcgacgtccgcatcaagggcgagccctggtcgaccttccgcccggccgagcagaagggcaagtacgacgtctacggaatgggctggttccccgacttccccgacgccgacaactacatcgcgccgttcctcgacaaggacaacttcctcggctcgccctacgcgaacagcgagatcatcggcaacctgatcccgcagtcccgtcgtgaggccgaccgtctgaccgcgtcgaagtccatcactgacatccaggacatcgttgccaacgacgtaccggtgctgccgctgtggcagggcaagcagtacatcgccgcccaggacgacatcaccggcgccgagtgggcgctcaactcctcgtccacgcttcagctctgggagctcggacgcggtgtgagcgactgacgcggcactgcctagactcaaggggtaccgaccccgggcctcgtggagcccggggctctcgagacctgacgagaaggcacctgtagtgaacatgcgcaaccagtggccggtcctgtctgtcgcgacggggctggccgccggcctgctcaccggatgcgggtcggacacgggcgactccggaggcaccggctccgaggtcgtgatggggatgtccgacgacgtcctggcgaccgaccccgcctccggctacgacccggggtcctggctgctgttcaacaacgtcttccagtcgctgctgagcttccccaagggcggtacggaacccgagcccgaggccgccagggagtgcaagttcacggacacggagacgaaggtctactcgtgcaccctgagggacggactgaagttcagcaacggtgacgcgctcacctcgaaggacgtcaagttctccttcgaccgcatgctgaagatcaacgacgcctccggccccgcgatcatgttccccatgctggacagggtcgagacgcccgacgcgaagaccgtcaccttccgcctcaagacccccgacgccaccttccccagcaagatagcctccggcgccggctcgatcgtggaccacaactcctactccgcgacgggactgcgcaaggacggcggcgcggtcggctccggtccctacaagctggactccttcgacgacgacaaggccgtcttctccgtcaacgacagctacaagggcaccgccaaggtgaacaactccggcgtgaccctcacgttcttccacggcaaccagaccgccctgaagaacgcgctgctgaacaacgagatcgacgccgcctaccggggcctggccgccgccgacgtcgccgacatcgacaacgacacgtccaccggcaagggcatcaacgtcgtcgagggcaccagcgccgaagtccagcacatggtcttcaacatggacgacccggtggcgggcaagctcggagtccgcaaggccatcgcctacctcctcgaccgcgacgccctcgtcaacaaggtctacgacaacacggcgacgccgctctactcgatcatcccggccgggatcgccggccacgacacgtccttcttcgacacctacggcgcccgcccctcgaaggcgaaggcggcggccgcgctgctggccgagggcatcaccggcaaggtgaagctgaccctctggtccacgccgtcgcgctacggcccggccaccgacgaggagttccggaccatcgccggacagctcaacgccagcgggctgttcgacgcgaccgtgaagtccgtcgcctacagccagtacgagaaggacatcgcccagggcaagtacggcgtgtacgtgaagggctgggtgcccgactacccggaccccgacaacttcaccgcgccgttcttcggcaagggcaatgtgctgagcaacaactactccaacagcacgatcaccggtcagctcatcccgaagaccgccgcccagagcgaccgcgcctccaccgacgcggagtacggcaggctccaggacatcgtcgccgaggacctccccgtcatcccggtctggcaggccaagcagtacgcggtcgtccgggacaacgtctacggcctcgagtactgcctcgacgcgtcgacggtgttccggttctgggagatcagcaagggctgatcccgcggtcgtacctacaccgagggcgcccccttctcgcggaagggggcgccctcgacgtacaccccgtacgggcgcgggggacccggctactgcgcgccggggcgcaccaacccgctctcgtacgcgtacaccgcggcctgcacccggtcgcgcagccccagcttggtgaggacgtgaccgacgtgcgtcttgaccgtggtctcgctgacgaacaggtcggcggcgatctccgcgttggacagcccgcgggccaccagcttcagcacctcgacctcgcgttcggtcagtgtgtgcagcgtgtccgggacgggctcgtcaccggacgggaggtgcccggcgtacttgtcgaggagccggcgcgtgatgctcggcgcgagcatcgcctcgccggccgcgaccacccggatcgcctgcaccagctcattggccggggcgtccttgagcagaaacccgctggccccggcccgcagcgcctccaccacgtactcgtcgaggtcgaaggtggtcagcacgagcaccttggccgggccgtcccgcccgggaccggtgatctgccgggtcgcttccactccgtccatccggggcatacggatgtccatcagaaccacatcgggctgcagcgcacgcacctggtcgagcgcctggagtccgtctccggcctcgccgacgaccgcgaggtcctgctccgcctccagaatcatccggaagccggtacgcagcagcggctggtcgtcgaccagtaggacgcggatggccacggtgagtctccttcagctagtccggccccattctgccctgctccctgccgccggactcgggcggcccgatctggagcggatacggcggcggagtaccgccgaactccgggcacacggcctggtggtcgcaccagccgcacagcttggtgggccgcggccgccagttgcccgtctccgtggccaactggatcgcgtcccacagcgcgtgcagtttgcgctcgacgcgctccaggtcggcgacgaccgggtcgtacgtcaggacgtcgccgctgccgagatagacgagctgaagccgccgcggcaccacgttcttcagccgccacaccacgagggcgtagaacttcatctggaacaacgcgccttcggcgtactccggccgcggggccttgccggtcttgtagtcgacgatccgcacctcgccgctcggcgcgacgtcgacgcggtcgatgatcccgcgcagcctgagcccggaatccagctcggcctcgacgaacagctcgcgctcggcgggctcgagccgcgtcgggtcctccagggagaaccaccgctccacgagctgctccgcctcacccagccagcgcgccagccgctcaccctccggatcgtcggcgaacagctcgacgacctcgggcctgctctcgcgcagccggtcccactggccggggacgagggacctggcacgcggcgcggtccgctcggcggcgggcgcgtcgaagagccgctcgagcaccgcgtgcacgagcgtcccccgcgtcgccgcctcactgggcttctcgggcaacttgtcgatcacccggaaccggtagagcaaagggcactgcatgaagtcactggcacgcgagggagacaacgagcggggcggcacggcgacggtcacggcggccgtgccctcggaggccgccggagccgccgacgaggcggcctcggccgacgccggcggcgcgcccgctccgctggacgcccccgccgggcccggcccgagccacgcggccgccggggccgacgcggggggcccgaccgccggggacggcggcgctggcgcggccggcgcgccgtcgcccgcagggtccggtgctgtgccctcggtgctcgtttccatgaccacagaccatacggcccaccactgacagtgacccagccgcgggccccgccgccctcccgcgggcccgccgctgtccgggcgccgcacacgacggcgccgctctcctttccgcgccgcacgcgacggcgcggaaaacagagggggtgccggggcggaacgcgccgcaacggccgcataccatcgaccagagaccctcccgccctgcatgatcgggacagggagacgcttcgatcgaggggacatcgtggacgagagcggcgggagcgggcagccgcgctccggcaacgaccgggcgaccgaccgccacccagggccgtcggccccggccaccgacaccccacaccccgacccggagccccacgagaaccagaccccgccgacgcccccgcaaacaccgcccggcgaaccggccacccccgcctccgacgggccgtcggcatccgaggcagccgtcgtccgagcagccggtcgcccgagaccgacccggcgaacaccggacagggcacaccgtccgacgagaaagcggacccaggcacccaccggtccggcaacccccgcggagccgcacccccaccaccccggcacccccgaagcagaccaggcacccgccgccccccgagccgacgaagccccccacccggccgacgaacacgccacagccccccgcaccctcgcccactccgacacgggcacgggcagcggcagcggcaccggcaagggccgcccgccccggcgacccaaagagcccggcggcggactgctcatgggccgccccttcggcgtccccgtgtacgtcgcccccagctggttcctcgtcgccgccctcatcacctgggtgttcggcggccagctggatcgcgtactgcccgaactcggcgccgcccgctacctcgtctccctcttcttcgcggtcgccttctacgcctccgtcctcatccacgaactcgcccacaccgtcgccgccctgcgcttcaagctgcccgtgcgccggatccagctccagttcttcggcggagtctccgagatcgagaaggagaccgaaacccccggccgcgagttcgtgctggccttcgtcggccccctgctctccctgatcctcgcggggatcttctacctcgccatgcagaccgtggaccggggcaccgtccccggcgtcctgatcgcgggcctgatgatctccaacctcatcgtcgccgcgttcaacctgctgcccggcctgcccctcgacggcggccgcatgctccgcgccgtcgtctggaagatcaccggcaagcccatgagcggcaccatcgccgccgcctgggtcggccgcgccctcgccgtcgccgtcctgatcggcctccccctgctcacccagaccggcgcactcggctcgaacgccgaggacgtcggcggcatggacaccgtcacggacgccctgctcgccgccatcctcgccgcgatcatctggaccggcgccggcaacagcctccgcatggcccgtctgcgcgaacacctccccgagctgcgcgcccgcaacctcacccgccgcgcggtccccgtggagaccgacaccccgctctccgaagccctgcgccgcgccaacgacgccggcgcccgcgccctggtcgtggtcgacgccgacggcgaacccctctcgctcgtacgcgaggccgccatcgtcggcgtaccggaacaccgccgcccctgggtcgacgtcagcggcctcgcccaggacctcaccgacggcatgcgcatctccgccgagctcgccggcgaggacctcctcgacgtcctgcgcgcgacccccgccaccgaatacctggtggtggaggagtccggcgagatctacggcgtcctgtccgccgcggacgtggaacgcgccttcgtgaaggccatggccaggccgaactgagatggtcggcggcccctcgaacgaccggtaggctggtcacatgtccgaaccgaccggtgccgcccgcaggcgcgggcccttcaaggtcggggaccaggttcagctgaccgaccccaagggccgccactacacgttcacgctcgaagcggggaagaacttccacacccacaagggttccttcccgcacgacgagctgatcggctcccccgagggcagcgttgtccgcaccacggggaacgtcgcctatctcgcgctgcgccccctgctccccgactacgtcctgtccatgccccgcggcgccgccgtggtctaccccaaggacgcggggcagatcctcgccttcgccgacatcttccccggcgcgcgcgtcgtggaggcgggcgtgggctccggatcgctcagcagcttcctgctgcgcgccatcggcgaccagggcatgctgcactcgtacgagcgccgcgaggacttcgccgagatcgcccagcagaacgtggagcgctacttcggcggcccgcaccccgcctggcagctcaccgtcggtgacctccaggacaacctgagcgacacggacgtcgaccgcgtcatcctcgacatgctcgccccctgggagtgcctggaggccgtctccaaggcgctcgtccccggcggcatcctgtgctgctacgtcgccaccaccacccagctcgcccggaccgtcgagtccatccgtgagatcggctgcttcaacgagccgacctcctgggagtcgatgatccgcaactggcacgtcgagggcctcgccgtccgccccgaccaccggatgatcggccacaccggcttcctgctcaccgcccgccgcctcgccgacggcgtcgagccgcccatgcgccgccgccgccccgccaagggcgcctacggcgaggactacaccggccccaacgccgacggaggcgccggccgctgaggcggccccgtgccgcgttcaacgtacaagtgccgtggccgagttcccgacaagcgtccgggaactcggccacggctccttttggttgacgcggcaccagaaccttcgaccccgccgttcccccgcactgtgacgtgtggcaccatgcgggacaccccaccggcacagcccacaggagacgcttctctcgtgcagcaatccgccgtcccggaactggcacacaccaccacccgccccatccactgggtcgccacggccaccgccctcgccggggtcgtcgcgctctcctccgtactgcagcccggctccgcgacagcggcccagcccggccccggaacgaaggcggccaaggtcgcgacagcgccccccgatcccgcgaaggccgacttcccgctcgactgcggccccacgaagctcctcgtccagaagaaggcctccggggacctcgacggcgacggacagccggagaccgtggccgtggtccgctgcgacgcgagcatgggcaccccgcccgacggcgtctacgtcctcacccgggccgcggacgccaagaagccccgcgtggtggccacactcgtggacccgaaggaccggctgaccgtcaccgacttcgcggtgcgcgacggagcggtcaccgccacgttcctcggctactcgtcgtccgacgtgccgagttgctgccccgacgtgaaggaccgcgccaagtggcagtggaagggcggagcgttcgtccgctcgacaccgtccgcagcacagagcgtgtgagaaacaccccgcccggcccgacgggtgtgagaaaccagacaggaaagtgacgaggagtggccgtcaggtcacttcttgttcactccgcgtccggcccgtagacctcgacgctgtccgaaacccgacgcacgtggatgcagtcgccaggacactccttcgcggagtcggcgacatcccgcagaagcgtcaggggtacgggcgttgtggcgcccttggcctgcaacagctcgtcgtccgcgctcttgacgtaggccaggccgtcgatgtccagctcaaagacctcgggggcgtactggacacagatgccgtcgcccgtacagagatcctggtcgatccagacctccagcgcctcaccgtcgactgcggcctcctgctgcacggtcatttctcctgccgtttcctgcgtcgagcgacccgattcgtcagcaagtcgggccagctctgacgggtgttgaacacttcgaccctacctccgtccgcttcccaatcatgttgggtgggtattcccctggcgtgagggagagcgcaagggtgaagatcggacacacctcgacagtctttgtgatctaggggtttcaatcgacacccacccaggtagggtctggaagcgtccagctccccttggaggaggtgaggaccgtggcagcccacgacgacgacatgaaccgcggcatccgcccgggaagagggtccgacgaccccgccgggcagattgcctaccttgagcaggagatcgccgtcctgcgacgcaagctcgccgactctccgcgacacacgaggattctcgaagagcggatcgtcgagctgcagaccaatctggccggcgtgtccgcacagaacgagcggctcgccaacacgctccgtgaggcccgcgaccagatcgtggccctcaaggaagaggtcgaccggctcgcacagccaccggccggcttcggtgtcttcctcacggcgaacgaggacggcacggcggacatcttcaccgggggccgcaaactccgggtgaacgtcagccccagcgtggagctcgaagagctcaggcgcggccaggaactgatgctcaacgaagccctcaacgtggtcgaggccatggagtacgagagcgtcggcgacatcgtcaccctcaaggagatcctcgaggacggcgagcgcgccctcgtggtggggcacaccgacgaggaacgggtggtacggctcgccgagccgctgctggacgtcaccatccgccccggcgacgccctgctgctcgaaccccgctccggctacgtctacgaagtcgtaccgaagagcgaggtcgaggaactcgtcctcgaagaggtcccggacatcggctacgagcagatcggcggtctgggcaaccagatcgagatgatccgcgacgcggtcgagctcccctacctctaccccgacctcttcaaggagcacgaactgcggccacccaagggtgtcctgctgtacgggcctccaggatgcggaaagacgctcatcgccaaggccgtcgccaactcgctggccaagaaggtcgccgaggtcaccggacaggccacgggcaagagcttcttcctcaacatcaagggccccgagctcctgaacaagtacgtcggcgagaccgagcggcagatccgcctcgtcttccagcgtgctcgtgagaaggccagcgagggcacaccggtcatcgtcttcttcgacgagatggagtccctcttccgcacccgcggctcgggcgtcagctcggacgtggagaacaccatcgtcccgcagctcctcgccgagatcgacggtgtggaaggcctgcagaacgtggtcgtgatcggcgcctccaaccgagaggacatgatcgaccccgccatcctgcgccccggacgtctcgatgtgaagatcaagatcgagcggccggacgccgaggcggcgaaggacatcttcggcaagtacctcaccgagcgtctccccctgcacaccgaggacgtgggagagcacggcggggaccggtcggccaccgtccacggcatgatccagaccgccgtggaacagatgtacgccgaatccgaggagaaccgcttcctggaggtcacctacgccaacggagacaaggaagtcctctacttcaaggacttcaactccggcgccatgatcgaaaacatcgtcgggcgcgccaagaagatggcgatcaaggacttcctcgagcacagccagaagggcctgagggtctcccacctcctccaagcgtgcgtggacgagttcaaggagaacgaggacctgccaaacaccacgaacccggacgactgggcccgaatctccggaaagaagggcgaacggatcgtatacatccgtaccctcatcaccggaaagcagggcgcggacacagggcgctccatcgacacagtggccaacaccggtcagtacctgtagaaggacagggcggctgcgggtgcccacaccgggtacccgcagccgactgtttttcaggccacggttggagcaaggcaatgacgcaaatgatctccccaccagcgcaaaggcgttctaggctctttcgtaccgccgagtcgcgcagtgcggggacgggcaccgcacacgcaccggagcgccagcggtacttgagcagcgtccccgaccgagggcgccgccgggcaaggagggccgcatgaccgtacggcgagtaatgggcattgagacggagtacgggatctccgtccctggccaccccaacgccaatgccatgctcacctcatcccagatcgtcaacgcatacgcggcggcgatgcaccgggcgcgccgcgcccggtgggacttcgaggaggagaacccgctgcgggacgcgcgaggcttcgacctcgcccgcgaggccgccgactccagccagctcaccgacgaggacatcggcctggccaatgtcatcctcaccaatggggcacggctgtacgtggaccacgcgcaccccgagtacagcgccccggaggtcaccaacccgcgggacgccgtcctgtgggacaaggccggcgagcgcatcatggcggaggccgcggagcgcgcggcccagctccccggcgcccagccgatccacctctacaagaacaacaccgacaacaagggcgcctcctacggcacgcacgagaactacctgatgaagcgggagacccccttctcggacatcgtgcgccacctcacgccgttcttcgtctcccgtcaggtcgtcaccggagcgggccgcgtcggcatcggtcaggacgggcacgagcacggcttccagctcagtcagcgcgccgactacttcgaggtcgaggtgggcctggagaccaccctgaagcgccccatcatcaacacccgggacgagccgcacgcggacgccgagaagtaccgcaggctgcacgtgatcatcggcgacgcgaacctgtcggagatctcgacgtatctcaagctgggcacgacggccctggtgctgtccatgatcgaggacggcttcatcgccgtcgatctggcggtcgaccagcccgtacgcaccctgcaccaggtctcgcacgaccccacgctgaagcggctcgtcacgcttcgtagcgggcgcacgctgaccgccgtgcagctgcagatggagtacttcgagctgtcgcgcaaatacgtggaggaacggttcggggccgacgcggacgagcagaccaaggacgtcctggtccgctgggaggacaccctgaaccgcctggagaacgacccgatgagcctcgccggggagctggactgggtcgccaagcgggagctcatggagggctaccggcgccgggacgacctcgactgggacgcggcccggctgcacctggtcgacctccagtacgccgacgtacgcgccgagaagggcctctacaaccgtctggcggcccgcggccggatgaagcgcctgctggacgagaacgacgtcgagcgggcccgcaccaagccccctgaggacacgcgcgcgtacttccgcggacgctgcctggagcagtacgcggacgacgtggcggcggcctcctgggactcggtgatcttcgacctgccagggcgggactcactgcaacgcgttccaaccctggagccgcttcgcggaacgcgtaatcacgtcaaggagctcctcgaccgctgtcgtacggcggaggacctggtcagggtcctgtcaggcgcctgagcgggccgtcggggcgattcgtcccgacggggtggaaacggtggcgtccgggaatcatcgaggtggctcccggacgttgcagcaactgcagggccgatgtcggacccggccagtagggtctgatcaagaacgtcgaaccgagcggggtgaggtagatggcgaccaaggacaccggcggcggacagcagaaggcgacgcgcaacaccgaggaggtcgaggagcaggcgcaggacgcgcaggcttccgaggacctcaaggagcgccaggagaagctgagcgacgatgtcgactcggttctggacgaaatcgatgatgtcttggaagagaacgccgaggatttcgttcgatcattcgttcagaaaggcggcgagtagccttcgaattgaaggccgatgggggcgtcggggttggtaaacgaagagggcgtgaagcgctgtgtgcggtgtggcgagtgccggccgcgcgcagccttcgctcgcaggcggtcgaacctcgacggcctgcagcgacattgccgagagtgcgcatcggactatcaccgagcgcgtcaggaaagcctgggcaagaaggtccgtcccaaggtcgaggtgcccgaagggcacaagctttgcctgaagtgcggcgaggtcaagccgtggagcgcgtggcaccgtaacgccacggcttcggacgggctgtcgacacgctgcaaggcgtgccgagccgtcgaggggcgtgcgggccacctcaagcgccactacggcctcacggaagccgagcgggacgagatggtcgcgtcccagatggggatctgtgtgatctgcctgaaagccccggcagctcatgtggatcactgccacaggacgggtagtgtccgtggcgtactgtgcttcaactgcaattcggccatcggcaagttgggagacgatcccgacgctgttcgtcgggctgccgcctacctggaaggaaccccgtggaagccaacactcgtagcaccgggcgtctaccggctgccttcctgacacctgggtcgtcgtccttcatggacttcctgtccgagcaccagccggagatcctcccgggcaaccggcagctgccgcccacccagggcgtgatcgaggccccgcacggcacgaccatcgtcgccaccacgttcccgggcggggtggtcctcgccggtgaccggcgggccaccatgggcaatgtcatcgcacagcgcgacatcgagaaggtcttcccggccgacgagtactcggcggtgggcatcgccggtacggcgggtctggccgtcgagatggtgaagctgttccagctggagctggagcacttcgagaaggtcgagggtgccacgctctccctggagggcaaggcgaaccgcctctccacgatgatccgttccaacctcgccatggccatgcagggcctggccgtggtacccctcttcgcgggctacgacgtggaccgcgaaaagggccgcatcttctcctacgacgtcaccggcggccgctccgaggagcacggctacgcctccaccggctccggctcgatcttcgcgcgcggtgccatgaagaagctctaccgcgacgacctgaccgagcagcaggccacgacgctcgtcatccaggccctgtacgacgcggccgacgacgactcggcgacaggcggtcccgatgtcgcccgccggatctacccgatcgtcaccgtgatcaccgaagacggattccgccggctcaccgacgaggagtcctccgagatcgcccgcgcgatcctggagcggcgcctggagcagcccgacggcccgcgggccgcgctgctctgagccgcttctcctgtcaggtgacccagtgaattcgacggaattgcggaaagaaagggacggataaccggtgtcgacgccgttctatgtctccccccagcaggccatggccgaccgggcggagtacgcccgcaagggcatcgcccgtggtcgcagccttgtcgtgctgcagttcgccgacggcatcgtgttcgtcggcgagaacccgtcccgcgcgctgcacaagttcagcgagatctacgaccggatcggcttcgcggccgccggcaagtacaacgagtacgagaacctccggatcggcggcgtccgctacgccgatctgcgcggttacacctacgaccgggacgacgtgaccgctcgcggtctcgccaacgtctacgcccagacgctgggcacgatcttctccagcgcggccgagaagccgtacgaggtggagctggtggtcgccgaggtgggggagaccccggagggtgaccagatctaccggctgccgcacgacggctcgatcgtggacgagcacggctcggtcgcggtcggcggcaacgccgagcagatcagcacctacctggatcagcgccaccaggacggtatgacgctcgccgaggcgctcaagctggccgtccagtccctgtcccgcgacacgaacggcagcgagcgggagatccccgccgagcgcctggaggtcgcggtcctggaccgtacgcgcccgcagcagcgcaagttcaagcggatcgtgggccgtgagctctctcgtctgctggaggcggccggagcgagcaccgcgggcgaggccgggagtgccgaggacgagggctccgacgacgagaagtagcggcttatttcgcccttcgacgccccggccgggtttccggccggggcgtcgggcgttcaggacgtgcgtggcggcgccgtggagccccgtatgacgagttgcacggggatgtcgccctcctcgggggtgcggccctccaggacggccaggagggccgccatgccccgctcgccgaagcgctccgcgtcgaggcggacggtggtcagctccgggtcgatggccgtggcgagggccaggtcgtcgagaccggtgacggagatgtcgtcggggacgcgcagcccgaggcgccgggccgccttgtaggcgccggccgccagcttgtcgtcgtcgcagaccagcgcggtgggccgggggccgggggccgcgagcgcggcctccgcggcggcgacggcgccctcgatggagatgggcgcgcgggtcgtgcgtacctcggtgcccgggatcgtgcccacgcgcgcggcgagttcccgggcgcgcacctcgaacgtccaggacgggatgtccgccgccagatgcaggaagcggcggtgccccagggcgagcagatgttccgccacctgacgcacgccgtccgcgatgtccaggttcacggtcgccgcgcccaggctgccctccgggtcgctgtccagcatcaccagcggcagctggtcgccccggatggccgtgagcgcgtccgcggccatcgaggaggcgatcacgccgtccagggcggcctgcgccgagccgaaggggtcccgggccgggccgatgccttcgggggaggggtagagcaccacgccgaagccgtgttccgcggcgaggcgggcggcgcccgtgtagacgccggcgaagaactccgtggtcagggccggcaccacgaggagcacggtccgggtgcggccgaggcgcagattgcgggcggccaggttcggtcggtagcccagctcccgcgcggcctcccgtacccgttccgccgtcgcctccgagacccgtccgcgccatttctcgccgagtaccagtgacaccgcggcctgggagactccggcggcctgggcgacgtcccggctcgtggggtgcgtgctggctcgtgccaccgtcggacctgctccttcgtctggactcgcggacagcgcacatggtacgtatgaccgacgaagttatacgtaaaacctcaggcgtcgggccgctccgggcgccgcggagagaaggcgggacatggccgcgggatacctggagatcctccgagcgaggcacgccgcgcggctgctcaccggcacgctggtgggccggctgccgaatgccaccgccgcgatcgccgtcgtgctgttcatccgtgccgagggcggcacttacagcctcgccggggcgctcgccgccgtgtacggggtcgccaacgcggtgggccagccgctgctcggccgcctcgtggacctgtacgggcagccgcgcgtgcagctgcccgcggcgctcgtctccgccctcgccatgaccgccttcgccctcagcggcaccaacccgctgccgcccgcgtatgtctccatggccgtcgccggactcttcaccccgccgctggagggcggactgcgggccctgtggccctccgtcctgcgccgggaggaccaggtgcacacggcgtacgcgatggacgcggtggcccaggaagtcatgttcaccgtcggccccttgctggtgaccctgtgcgtggcgttgtggtccgcccaggccgcgctcgtggtgctgaacgtcatcggtgtcctgggcgccctctccgtggtcgtctcgcccccctcgcgcgcgtggcgttcggcgccgcgcgaggcacactggctgggtgctctgcgctcgcccggactgctcgcgctgctcggcgcgttcctgttcgtggggctcgcgctcggctccatcaccgtcgcgggcgtgtcgtacgcggacgacaacggcggcgacgcggtctacggctggctgatggcggcgctcggactcggcgccctcgtcggcggcacggtgtacggggcgcggcagtggggcggtgccccggagcggcgactgcgggggctcgtcgccctgctggcggtctgttacctgccgctggtgctggtgcccggcccggtcgccatgacggccctgacggcgctcgccggggtcttcctcgccccctgtatcgcctgcgccttcatcatcgtcgaccggcacgcgccgagtggaaccgtcaccgaggcgttctcctggcttgtgacgacgttcaccgtgggcgcctcggtcggaacgggcctggcgggcccggtcgtcgagtggggcggaaccctgtgggggttcgccgtaccgggggtcgccggggccgtctccctgctggttctgctggccacggggcgggtcctcgcagctcccgccggggggccggtggttgcggcctcgtcggaaaatgatccaaaccgtgctgtcgaaccccgtttcagctcaggggatcgggcgtaatgttcagtcatggaccgccgcattttcgggctggagaacgagtacggcgtcacgtgtacgttcaggggacagcgccgcctgtctcccgacgaggtggcgcggtacctcttccgccgtgtcgtgtcatggggccgcagcagcaatgtctttctgcggaacggtgcccgcctctatctcgacgtgggatcacatccggaatacgcgacacccgaatgtgacaacgtgaccgaactggtcacccacgacaaggccggcgagcgcattctcgagggactgctcgtagacgccgaacgacgcctgcacgaggagggaatcgcgggcgacgtctacctcttcaagaacaacaccgactcggcgggcaactcgtacgggtgtcacgagaactatctggtggcacggcacggggagttctcccggctcgcggacatcctcattccgttcctggtgaccaggcagcttctgtgcggtgccggcaaggtgctgcagactccgcgaggcgccgtctactgcgtcagccagcgcgccgagcacatctgggagggtgtcagctccgcgacgacccgctcccggccgatcatcaacacccgcgacgagccgcacgcggacgccgagcgctaccgccggctgcacgtcatcgtgggcgactcgaacatgtccgagacgaccatgctcctcaaggtcggcgccaccgacctcgtgctgcgcatgatcgaggcgggcacggtgatgcgcgacctgaccctggagaacccgatccgggcgatccgcgaggtcagccacgacatcacgggccgccgcaaggtgcgcctggccagcggccgcgaggcctccgccctggaggtgcagcgcgagtactacgagaaggccgtggacttctgcgagcgccgcggcatccgtaccggcaccgtcgagcaggtcctcgaactgtggggccgcacgctcgacgcgatcgaggccgaggacctcgaccggatcggcaccgaaatcgactgggtgatgaagtacaagctcatcgagcggtaccgggccaagcacaacatgacgatgtcgcacccgcgcgtcgcccagatagacctcgcctaccacgacatccaccgccgtcgtggtctctactacctgctggagaagcggggacaagccacccggatctgcaatgacttgaagatcttcgagggcaagtccgttcctccgcagaccactcgggcccggctgcgcggcgacttcatccggcgcgcccaggaacagcgccgcgatttcaccgtcgactgggttcatctcaagctcaacgaccaggcgcagcgcaccgtgttgtgcaaggacccgttccgttccgtcgacgaccgggtggagaagctgatcgccggaatgtgagccgctcgtcccggagcgtgtttccggtacgcaacgcggggcgccgtacgtttctcgtacggcgcccttctcacgtcgtagagttgcgcgcactccaccaacaagatcgaccgatacgaggcccccacagtgcgccgacgctcagttcttctcgccgtgccggccggactggtcacgctcgccggatgcggtgacgaaaagtccgacacggccaagaccaagcccagcaccagcccgtctccgtcggcctccgcatcgtcggccccgccccccaagatcgtcgacggcccgctgccggccatcaccgccggtaccaagttcgacgagaagccgaccgtggccaagggcagcggcgacccctcgaaggacgtggcggtcaagacggtcatcgcgggcagcggcaagacggtcgcggagaacgactacatccaggcgaactacctgggccaggtctgggacacggcgaaggtcttcgacaactcctacgaccgcaagacgccgctggtcatccagctcgcccagggaagcatcatcgacggctggcgctatgcgctggcgggcaagaaggccggcagccgggtcctgatgtccgtgccgcccacctggggctacggcaagcagggcaactcgcaggcgggcatcaagggcaccgacaccctggtgttcgtggtcgacatccagaacacgttcaacgcgaagagctccgcccagggcaaggacgtcgcacagggcgacgccaagctgccgaaggtcggcaccaacaccgacggcaaggccccctccatcgacgtaccgaagacggccgccccgacgaagctcgtggcgaactacgtcatcgagggcgacggcgacgtggtcaaggcggacagcagcgtcctcgtgcagtacaagggcgtgctctgggacaccggcaaggagttcgactccacgtacagccgctcggcgctgacgtccttctcgctgcagcaggtcgtcaagggctggtcccagggtctgaccggcaagaaggtgggcagccgcgtactcatcgtggtgccgccgaagctgggttacggcgacagcccgccgagcgggagcggcatcgagaaggactccaccctggtcttctccgtcgacatcctggcgaagatgtaacccctccggggatgtgagagtgtcggtcttgccgtaatggcctttatcgcagacaagcaggagctttagacgtgagcatcgagaagcccgagatcgacttcccgggcggcgagcccccggcggacctcgagatcaaggacatctgggagggcgacggaccggtcgccaaggcgggcaacaccgtctccgtgcactacgtgggtgtggccttctccaccggcgaggagttcgacgcgtcctggaaccgcggcaccccgctgcagttccagctcggtgccggccaggtcatcaagggctgggaccagggcgtgcagggcatgaaggtcggcggccgccgccagctgaccatcccggcgcacctcgcgtacggcgaccgcggcgccggtggcggccgtatcgcccccggcgagacgctgatcttcgtctgcgacctggtcgcggtctgatcctcacggggttttggccgcggtccggtcgtcgtgctgatccgtccgatcagccgtacgctctcgccgcggcccgatcgtcgtacgccgaatgatcgaggtccgaccggacccgatcatctggggcccatgcctgtccgggcgtgggccctcggcttttgccgcgacactccggagcggtacggtcaacggtcggaagcaccatagggaagggcgtcgatggccattgccaaggccgagcggctgatgaacctggcgctgtgtctgctcgggacacgacggccgctcagcaagcgcgagctgcgtgactccatcgaggcatacgtcgaggcttttgggccgggcaagggtgcggcgagttcggacgactccttcaaccggatgttcgagcgcgacaaggacgatctgcgcgagctcggcctggtcatcgagacggtggagaacctcgacggcgaggtcggctacctcgcgcgccgcgacagcaaccgcctgccggccatcaccttggacgccgaggaggccgccgccctcggtctcgccgcgaaggtctggcagcaggcccgtctcgccggtgccgcgagcggcgccctgcagaagctgcgcgccgcggggcttcccgaggatgtcgacccgtacgaggcccacggcgccctggaaccgcgcatccccgtgcacgaggccgctttcgaacctctgatgctcgcctgccgtgaccggcgccccgcttccttcgactaccgcaaggcgaacgcggcccgtcccgagccgcgcaccgtggagccctgggccctcgagtgctggcgcggccactggtatctggccggctgggaccgtgaccgcggcgccgagcgggtctttcggctctcccggatcaccggcaaggtccgtacgcgcagcggaaggtacaccgccgaggtgcccgatgtcgtcaccgtgcgcgagacggtggcgagctgggcgggggagaccgccgaccgttccgctctgatccggctgcgtaccggtgccggctatccgctgcgggccaaggccgtctcggtacgggaactgggcgacggctgggacgagttggagattccgtacgggcacggtctggacgcgtggctcgtcgagttcgggcccgatgtggtggtcctggagccggccgagctgcgggccgacgtggtggaccggctgcgtgccgtggccaagggctgagggggaacacaagaacgtggcaggcaaaccggccaggcccgcgaacgcgatcgaccagacccggcggatgctgtccctggtgacgtatctgcgcgagcgtcccggcgcgcgcgtcgaggacgtcgcccgcgccttcgggatcaccgaggacgagctgatctccgacctcgacgtgctgccgctgtgcgggacgagtttccgcggtggcgacctcctcgacatcgacaccgacggcgaccggatctggtggcacaatccggccgctctcggcgcggacgcggccgagcccctgcggctcgccgccgacgaggcgaccgccctgctggtggccgcccgcgccgtgtccacgctgccgggcctgcgggagggcgaccggcaggcgctgctgcgggccaccgccaaggtggagaccgcggcgggcgaggcggccggggccagctcccggctctcggtgaccttcgagtcggagggcggtgtcttcgcggacgtcgaccgggcgatctcggagcgccgccgactgtggatccgctactactcgcccgcccgcgacgagctcaccgaacgcgagatcgacccgatccggctggtcagcgtcggccacacctatgtggaggcgtggtgccgccgctccgaggcgcggcgcaccttccggctggaccgggtggccgagatccgcattctggacgagccttccgcgccgcccgaggtcgagctgcgggacctctccgaagggctggtacagcccgcggccgaggaccccgaggtggtggtcgaggtcggtcccggcggccgctgggtggccgagtactacccgcacgacagcgcggatgagcttccggacggcgggctgcgtatcactctgcggacccccgagcccgcgtcgttgcggaggctcgcgctgcgcctcggccgcgacgggcggatcgtctcgccgcaggacctggcggacagcgcccgccgcgccgcccaggaggcgctcgccgcgtacgacgacgcaccgcggggtgccgacggagttcaggacgggccgtacgacaggcaggagcaggggctgtgagcacgtcgtcgatgtctggtgcgccggagcagtcggatacggcgcggagggtcgtcgtcccggggccggcgtcgggtacggcggacagggccgtcgtcccggtcgaggcgccggagatgtcggtgggggcggcgttcgcggggatgcggagagtggcccatgtggtcttcagggcgggctgccccgactgccgggcccgcttcgagctgggggcgaacgccctgcgcctggccatcggcgccaccagcaggaccaccttctactccttcacctgccccgagtgcggagtccccgtccgcaagccggccggggagcggatcgtcgcgctcctcaccgggggcggggtgcgcaccctgcgcctgcactcgacggtctaggctcggcgtcatgttctggccgatgctcgcgattgccgtggggttcctgggtcttgccgtgctcggcgtgctcgccgtccgcgtttttctggcggccgagcggctgggcaggcaggtcacggactccgcgcgccggatcaatcgcgccgccgacgacctggagcgggcgaccgtggcggcggcacgatccgcggatccggtatgagccggcttctgcggatccggtacgggccggcttctgcggatccggtacgggccggcttctgcggatccggtacgggccggcttctatggattcggtatgagtcgccttagggatgcgcaatgagtcacttcagcctgtcaccttcgcgctgaggacaggtacgctgctgatcgcggcccggataacgaggcgcgagccgcgaaccgggagtacgcacagggattgccccgcgttcacccctgagcgttacgatcgctgcacgacagccggacatttgtccgaccgatcggacagcacccccgcccatgccgcctcggtgagaaggtaaagacttatgttcggaaggctcggagctcccgagatcattctcatcctcgtcgtcatcatcctgctgttcggcgcgaagaagcttccggacatggcgcgttccctcggtaagtccgcgcgcatcctcaagagcgaggcgaaggcgatgaagtcggagggccaggagtccactcccgcgggcccgccgaacaccgacgagcagcccccggctcagcgcacgatccaggccgcgcccggcgacgtgaccagctcccgtccggtcagcgagcccacggacacgaccaagcgctgacgcagggccggtgacttccggcccgccgcacgagatgggaacgtgggttgctcaagcctgcccgcaacaaggagaaggatcccgaggggcggatgcccctcgcggagcaccttcgtgagctcagaaaccggctcgcgaaggcgatgctggccatcgtcgtggtcacggccgtcgcagccttctactacaacgacatcatcaacttcttcaccaagccggtcctggaatccgtcgggtgcccgaagaccttcgccgaggtggcgaagatgcccgagggcaagcagtgcgcgcagatcacgatcaacggtctgctcgcccccttcaccctggcgctgaaggtctccttgatggcgggcgtcgcgctcgcctcgccggtctggctctaccagctctgggcgttcgtcgcgccgggcctgcacaggagcgagaagaagtacgcgtacgcgttcgtcgggacgggtgttccgctcttcatgggtggcgccttcttcgcctacaaggtgctgccgaccaccgccaaggtactgatggagttcacgccgaacggcgtcagcaatctgctgccgctggacgatctcctcgacctcgtcacgcgcatggtggtcgtcttcggcctctccttcgagcttccgctgctgctggtcatgctcaacctcactgggatcctcaccggcaagcgcatgctcggctggtggcgcggcatgatcatgggcatcacggtcttcgcggccctcgccacgcccagcaccgacccgctgaccatgctggcgctcgccggccccatctggatcctgtacttcggagcggtcgccttctcgctcgtcaacgaccggcgcaagcgccggcgtgaggccgaggggccggacgacgacgaggcctccgagctggacctcacccccgaggacatcggtgagatcgagaccgtgtcggcgaaccgggcgttgccggagcagtcggtcacggaccgggtcaacggttatgacgacgtgacctgacggagcccgtggatctcgtagggtcagggccgtgaccagcgagatcaccctcttcgtcaaccccaccgcgggacgcggccggggcgcccacgcggcgcagccggccgcttcggctttgcgggcggcgggattctccgtccgtacgatcctcggggagaacgccgaggacgctctggcccgcgcgcgcgaagccgtcgcgggtggaacgggcgccttggtggccgtcggcggggacggcatggcgcatctggcccttcaggccgtcggcggcacgcgcaccccgctcggcctggtcgccgtcggcaccgggaacgacttcgcgcgggccctggggctcccggtgcgcgacccggcggccgcggggcgggtgatcgcggaggctctgaagggggcgcggctgcgtgacgtcgatctggggcgtgtcgacggaacctggttcggcaccgtcctcgcctccggcttcgactcccgggtcaacgaccgcggcaaccgtatgcgctggcccaccggccgcttcaagtacgacctggcgatgctcgccgaactggccgccttcacgcccgtcccgtaccggatgacgctcgacgacggagcggtccgggagatcgaggcgaccctcgtggcagtcggcaacgggtcgtcgtacggcggcggcatgaagatctgcgcggacgccgacctcgacgacgggctgttcgacatcacggtcgtcggggactgcagccgtacgacgctgctcaaggtgttccccaaggtgtacaagggcacccacctcgaccatcccaaggtcaccgtgcaccgggccgcgaaggtcgaactcgtcgctcagggcatcacggggtacgcggacggtgagccgctgggcccgctgccgctcacggcggagtgcatacccggggcggcgcgggtcgctgtgccctgagctgcgtgaaccctgggtttcacaggcttggatccggatattgatcgtcctgttgtcagtggctcccggtagtctcgaaagcacgatgacagaggacctctcaccggccgagcggtacgcggcagctcgtcagcgcgctgccgagcaggccaccgcgctcgcccccttccgcgagatgtacgacttcggcctcgaccccttccagatcgaggcctgtcaggcactcgaggcgggcaagggggtgctggtggccgcgcccaccggctcgggcaagacgatcgtcggcgagttcgccgtccacctcgccctccagcagggcaagaaatgcttctacaccacccccatcaaggcgctctccaaccagaagtacgccgatctggcccgccgttacggcgcggacaaggtcggcctcctcaccggcgacaacagcgtcaactccgacgccccggtggtcgtgatgaccaccgaggtcctgcggaacatgctgtacgcgggttcccagaccctcctgggtctcggctatgtggtcatggacgaggtgcactacctctccgaccgtttccgcggcgccgtctgggaggaagtgatcatccatctccccgagtcggtgaccctggtgtcactttcggcgaccgtgtcgaacgcggaggagttcggcgactggctggacacggtgcgcggcgacacccaggtgatcgtgtccgagcaccggcccgtgccgctgttccagcatgtgctggccggacgccggatgtacgacctgttcgaggagggcgagggccacaagaaggccgtcaaccccgacctcacgcggctggcccgcatggaggccagccgcccgtcgtaccaggaccgcaaacgcggccgcgccatgcgcgaggccgaccgcgagcgtgagcgccggcagcggtcgcgggtgtggacgccgggccggcccgaggtgatcgagcggctggacgccgaagggctgctgcccgccatcacgttcatcttcagccgcgccgcctgcgaggccgccgtccagcagtgcctgtacgcgggcctcaggctgaacgacgaggccgcgcgcgacaaggtgcgcgccctcgtggaggagcgcacggcatccatcccgaccgaggatctgcacgtcctcggctactacgagtggctggagggactggagcgcggcatcgcggcccatcacgcgggcatgctgccgacgttcaaggaggtcgtcgaggagctcttcgtacgcggcctggtcaaggccgtgttcgccaccgagaccctggcgctcggcatcaacatgcccgcccgctcggtggtgttggagaagctcgtcaagtggaacggcgagcagcacgccgacatcacccccggcgagtacacccagttgacgggccgggcgggtcgccgtgggatcgatgtcgagggccacgcggtcgtgttgtggcagcgcggcttcagccccgagcacctggcaggcctcgctggcacccgtacgtacccgctgcgctccagcttcaagccgtcgtacaacatggcggtgaacctggtcgaccagttcggccggcaccgctcacgcgagctgctcgagacgtccttcgcgcagttccaggccgacaagtcggtcgtcgggatctcccggcaggtgcagcgcaacgaggaggggctcgagggctacaaggagtccatgacctgccacctcggggacttcgaggagtacgcgcggctgcgccgcgaactcaaggaccgcgagaccgagctggccaagcagggcgcggcgcagcggcgggccgaagcggcggtggcgctggagaagctcaagccgggcgatgtcatccacgtcccgaccggcaagtacgccggactggcgctcgtgctcgacccgggcctgcccgcgggccgctccaacggccatcgtggcttcgagcagcacgacggcccgcggccgctggtgctgaccgccgagcgccaggtgaagcggctcgcctcgatggacttcccggtgccggtcgaggcgctggagcggatgcggatccccaagtccttcaatccgcgctcgccgcagtcccgtcgggatctcgcctccgcgctgcggacgaaggccgggcacatcgtcccggaccggcatcgcaagggccgttccgcggccgccgacgaccgtgagatcgcccggctgcgggcggagttgcgcgcgcacccctgccacgggtgcaacgaccgggaggaccacgcccgttgggccgagcgctactaccggctgatgcgtgacacctcgcagctggagcggcgcatcgagggccgtacgaacacgatcgcccgcaccttcgaccggatcgtcgcgctcctgaccgagctggactatctgcgcggcgacgaggtcaccgcgcacggcaagcggctcgcccgtctctacggcgaactcgacctgctggccagcgagtgcctgcgtgccggggtctgggaaggcctcgatccggccgaactcgccgcgtgcgtctcggcgttggtgtacgagtcgcgggtcggtgacgacgcgatggcgcccaagctgccgtccggcaaggccaaggcggcgctgggcgagatggtccggatctgggggcgcctcgacgccctggaggaagacttccggatcacccagacggagggtgtcggacagcgcgagccggacctcggcttcgcctgggccgcgtacatgtgggcctccggcaagggcctggacgaggtgctgcgcgaggcggagatgccggccggtgacttcgtccgctggtgcaagcaggtcatcgacgtgctgggccagatctccgccgccgcacccgtcaggggcgagggctccacggtcgcgaagaacgcccgcaaggcggtcgacgaactgctgcgcggggtggtcgcctactcgtcggtgggctgagccggcgccgcgcccgcttcgccgccccttacctttccggaggggcggcgattcttcgcggaggggccgacgaagcggggcgcgggtgctaggccgccacccgcgccgcgtcccgcttcgcgacttcttcgcggacgatcgggatcacgtgccggccgaagtcgatcgcgtcgtcgaggaggtcgtagccgcgggccgagaggatgtcgactccgaggtcgtagtagtcgaggagggcctcggccaccgtctcgggggtgccgaccagtgccgtggagttgccggcgccgcccgtctccgccgccgtcggggtccacagggcgcggtcgtggcggtcgccccgggcggccaccgccagcagccgctgggagcccgagttctccggattcttcagcggatggcggcggctgagcggagccccggccgtgcgcgccttgatccgggccagcgtccggtgcgccttctcccaggccagttcctccgtcggcgcgatgatcgggcggaacgcgacctggatccttgggatgtccgtgcggcccgccgccttcgccgcggccttcaccgactcgatctgctcggcggtctgcgccagcggctcgccccacaggcagtagatgtccgcctcggcgcccccggccgcgtacgcggcggccgatgagccgccgaaggagacgggcggatgcggctgctggacgggaaaggtgtcgctgacgaagtcgtggaagcggtagtgcgtgccctcgtggtcgaacggctcgtgcgtcgtccacgccttcttgatgatctggatggcttcccgggtgcgcgcgtaccgttcgtccttggtcaggaagtcgccctcgcgctgctgctcgtggtcgttgccgccggtgatgaagtggacggccagccggccgtcgctgatgcggtcgagggtcgcgaaggtcttggccgcgaacgtcgggtacgagacgttcgggcggtgcgccaccaggatctggatcttctccgtgcgggccgcgatgtaggcggccgcgggcgacggatcgggggagccggacccgtacgcgaacaggatccggtcccagccgtactcctcgtgggcgcgggccagcctgagcgtgtactccttgtcgaaggacggcccggagcgggcggtcacttcggagccttcgttggttgcggcgatgccgaggaactctacgggcatggtggtgcggcctcgattcggtgctgcggtgcgctgacggtggcggagggcgtcgtcaggcgcgacacgccgccgaccacactcgacagaagtcgatgtggtcgcgggtgaccagcagcagccggggtcgcatgggctcagttgaacaggcgggtacgtgtcgcgtcaacggcgcgtgtgaacggcgtgtgtcaacggtccaggtacgcccgccagcccccgtactccgtgatgtccgccgcgtccgtgagcgcgtccggctcgcacaggaagcccgggacgcggctgccgtcggccagttcgacctggccgagcgtcatcgggcgggggagtgaggcgagcagccggccgaggccttcggcgggcagccgccagacctccgtctcgatcgcggcgccgccctgacgcacgtgcacgaggcccggcttgggcggggtggtcggcagggcgtgcagccggtaggcgggtgcggtggtggtcgtacgctcccgtcgcgcgcccagggccaggagctgcgggttgagcggctggcccgacagatgcgcgccgatcaccgccacgctcagctgtggctgaagcagggcggcgatccgggcgagccgcccgtcggtgaacgccgggccgatcagcatcaccccgaagggcagttgggcgggcgtgagaccggcgggggcggcgaccgcggccaggtcgaagaggttcgtggagttggtgaagcgcccgaggcgggcgttggcgcccagcgggtcggcggcgacctcggcgagtgtggggtgaccgggggtggtgggcagcagcagggcgtcggcatcaccgagttcggcgagcgcccgggtgcgcagggtggccagacgttcctggtcggcgaagagccggtgggccgggatgtcccgggcgcgggtgatgatgccggcgacggtggggtcgagccccgcaccgccctcgctgatcaacttgtcgacaaagctccccaccgcggtgtagcgctcggccacgaacgcaccctcgtagagcatcgccgcggcctcggtgaacgggctgagatcgatcgtgcggaccgagacgcccgccgccacgaggtgctccaccgcggcctcgtacgcctcgccccagccctcgtccagctcgccgagctgcggcagcggcgggaccgcgacgcgccacgggccgggggcgcgctgggggagcggagggaggtcccggccgggcggcgacgccaggtgcgcgagggcctgctcggcctccgggagcgtacgggcgaagacggtgacgcagtcgagggaggcgcaggcggggacggtgcccgtcgtggggacgaggccgcgggtgggcttgaggccgacgatgccgttgaaggcggcggggacacggccggagcccgcggtgtccgtaccgagggcgaagtccacgatgcccagggccacggccacggccgagcccgcgctggagccgccgctgatcctcgccgggtcgtacgcgccgcgcaccgccccgtacggggaacgggtgccgaccaggccggtggcgaactggtccaggttcgtcgtgccgagcacgatcgcgccggccgcccggagccgggcgacggccggggcgtcggcctcgggcaggtaggcgtacgcggggcagcccgcggtggtcgccaggccgtggacgtcgatgttgcccttgacggcgaacaggcgtccggcgagcgggagccgctgacccgccgcgacgcgctcgtcggtcaccgccgcctcggcctcgacgtccgcccgggatcggagatcgatccagatctccggacggtcgacggccgccacacgggcgtacgcggcacggacacgggacagagtggacatgcgtgctcctcgaagttcagctcgtggccggtgcgagcacgaccagcgccgtgcccgccgccacctgatcgcccggcctggccaggatctccgtcaccacaccggccatcggcgcgggcaccctggactccatcttcatcgcctccagggtgagcagcggctggccggccgtcaccgcgtcgcccggtcccacgttcagctgccagaccgacgcggcgaactcggcctccaccagagcgccgcccaccggaacggtcacctcggccggcggggcctcgggcgccgtcgccgcctcggcccgcgcgaactcgcccgccgcctcccacgcgtcccgctccgccgcgaaggccgcgccctggcgggcccggaaggcggcgatggagccggcgttcgcggcgaggaaggactcgtacccggccagcgagaactcgccctcctcgacgcgcggcacgaagcggcccgaggcgatgtcggcgcgcaggtcgaggagttcgtcgggcccgacggcgtaccacttgatccggtcgaagaagcgcagcagccacggcgagcccggttcgaacgcgccgcgctgctgccagcccgaccagacctgggtcgtgcggcccacgaactggtagccgccggggccctccatcccgtagacgcacaggtacgcgccgccgatgccgaccgagttctcggcggtccaggtgcgcgccgggttgtacttggtggtgaccaggcggtggcgcgggtcgagcggtgtggccaccggcgctcccaagtacacgtcgcccaggccgagtacgaggtactccgcgtcgaagaccgtgtcgtacacgtccgccaccgactccaggccgttgacgcggcggatgaactcgatgttccacgggcaccagggcgcgtcgtcgcgcacgcccgccatgtagcgctcgatcgcctcgcgggtggccgggtcgtcccaggagagggggaggtggaccgtgcgggacgggacgacgagctggtcggtgggcgggagcgcgctcaccgtctcccgtacgaccgcgaggagttcgcgtagcggcaggcggcgcgggtccgtccggatctggagcgagcgaatgcccggggtgaggtccgtgacgccgtccagcccggcttcggccaccgcttccatcagcgcgtgcacccgcatgcgcagggccaggtcgagctgcatcgggccgaattcgaccagcaggttgtcgtcgccgctgcgccggtaggtcacgtcgccgtcccgtgcgagcaccccgccgtccacgatcgcgggccgcgtcgagccgtcctcggccagcggtgtgaagcggaccgtgtcgccggggcgcagctgcccgagcttccagcgctccgccgtggcgaccgtcgccgggcagacgaaaccgccgagcgagggcccgtccgggccgagcagtaccggcatgtcgcccgtgtagtcgacggcaccgaccgagtacggggtgtcgtggatgttggacgggtgcagccccgcctctccgccgtccgagcgcgcccagcggggcttgggtccgaccagtcgtacgcccgtccgggccgagttgaagtggaccttccagccggccgcgtagaagtcgcggatgtcgtcctcggtgaagaactccggtgcggcgtgcggtccttccagggcgccgacgtgccactccgtagcgaacaccggccggtccccggcgggcacgggagcgccccggtccgtgaccgacccgccgtgcagcacgtcccccgtgcgcagcgcccgcccgccgtgcccgccgaaccggcccagtgtgaaggtggccgcgctgccgaggaacgcggggacgtccaggccgcccgcgaacagcacataggtccgcaggccgggctcggcgggggcgccgacctccaggagggccccggcgggcaccgtcaccggctcccactgggcgaccggcgttccgtccacggtgaccggtgccggggcgcccgtgacgcacaccgtcgtggcgtgggtgaagcgcagcgccggtccccgcagggtgcactccagacccggcgctccctcctcgttcccgagcgcccggttgccgagccggaaggagcggtcgtccatcgggccgcacggcggcacgcccacctgccagtagccggtgcggcccggccagtcctggacggtggtgagcgtgccggccgcgaccacctcgacgcgcggagtggggtcggtgatcttggccagtgtcgccgtcgtgtgggtggcggtgcgcaagccgtggtcggcgagcgccgcccggacgagccccagattcgtctcgatgccgtcgacccgcgtccgggccagcgcctcgtcgaggcgggccagcgcgtgcgcccggtcggacccgtacgccacgaccttggcgagcatggggtcgtacgacgtcgtgacctccgtccccgtctccacccagccgtccacccgtacgccctgcgggaactccacccgcgtcagcaggcccgcgctgggccggtgctcgcgggaggggtcctccgcgtacacccgggcctccacggcgtggccgcggggcggccccggatcgcgtacgacgtcggcgtcgccgcccgcgagccgcagcatccaggcgaccaggtcgaccccgtagatctcctcggtgaccggatgctccacctggagacgggtgttgacctcgaggaagtacgcctcctcgcgggcggcgtcgtacacgaactcgacggttccggcggagcggtagccgaccgcggcgcacaagtcccgtgccgccgaggcgaggtggtcgcgcacgtgtgaggggagtcccggcgcgggggcctcctcgaccaccttctggttgcggcgttggagcgagcagtcccggtcgccgagggtgacgacccggccccggccgtcgccgaagacctgtacctcgacatggcgggcgtgctcgaccaggcgttccaggaagatccccgccgaggagaacgaggccgcggtgacgcgccgcacccgctcccacgactcggccagttcggcggcggaacggcaggccgacatgccgatgccgcccccgccgccggtggccttgagcatgacgggatagccgatgcgggaggccgcgtcgagcgcttcgtcgagcgaggcgagcagccccgtgccgggtgcgagcggcaccccggccgcctcggccgcggcccgcgccgtgtgcttcgcgccgaagagttccagctgctcgggcgtcggtccgacgaacacgatcccggcgtcctcgcagcggcgcgcgaacgccgcgtcctcggagaggaagccgtagccggggtggatcgcgccggcgccggtgtccttggcggccttcagtacgagatccgcgtcgaggtacgactccttcgcgggcgcggggcccaggcgtacggcctcgtcggcgagccggacatggggcgccgagcggtccgggtcggagtacaccgcgacggtgcgcaggccgagttcacgcgccgtgcggatgacgcggacggctatctcgccccggttggcgacgagcagggtgtcgaaggtcatgacgcgtccccctggacctggacggcggccccgatcgtcatccgcaccgccgtcggctcgaagccgttgcaggggttgttgatctgcgggcagttggagaccagcacgagcacgtcgcgctcggcgcgcagggtcagggccagacccggggcggagatgccgtcgacgatgcccagcgtgccgtccttctcgaccggcacgttcatgtaccagttgatgttcgagacgagatcgcgcttgccgaggccgtacttggcgccctccgcgaggaagttgtccacgcacgcgtgctgcgaccaggtgtggtggccgtaccgcagtgtgttcgactctttggagcaggcgccgccgaccgtgtcgtggcgccccacctcgtccgcgacgaccgtcatcagcggggtgtgctcgttggacaggagcacactgccggtggtgaggaagacgctgccctgggcgtggatcgtgtcgggcgcgctgtagcggaccgcggtgtcgtgggcgtcgtacacgaggaagtccacggcctggttgccgtgcaggtcggtgagggtgagcgtctcgcccgcgcggacgacggcggaccaggcggcccgggcgggaacgacggtctccgtgacggctgtccgggtcatgcgagccccctcgcggcaaggaattcggcggtgttcagcaacgcgcggcggccttcgggggtcgcctcccacagcgggtcgccggggcgggtggcgtccgcgcgccaggcgagcacctccagcggggtgctgacgtagtccgtacgcggatcggcggggtgcggcacgttcgcgatcagcaccgtgaggtcctgctcggcgcgcagggtcacgctgccgccggggccggcggagccggtgaagtcgagggtgccgtcgtcacgtacctccacgccctggaagaaggagagcgagggcggcaggtcgcgcggctccagaccgttcttggccgcggccagtttgaacagctcgcgccccgccggggaggcggactgcggggtgccgtccccgtaccgctccgtgttgcgtacgagcgtggaggtgccgcacagcgcgtcgtgccgtcccgaggtgtcggcgaccaccgaggcgaggacccggccctggtcggacaggagcagccggtcctcgccgaggtaggcgttccactgcaccttgaccgtgtcggctacgttcagccgctcccacggacggtcggcgacgtacaggaggagatgcgcacaggcgtcgccccgcaggtcggtcaggcgcagctcggtgccgcgggccagcacccggtgcgtgtagttgccgcccgcgaccgtctccgcccacaccaggtggcccgccgcgcagggcggcgcgggccaggcgctcgccggtacgacgggcatggcctcggtccgggcgccctcctgcgcccgggcgtgggcgcgtgccccgtaggtggtcgctgtcgccatcgcggacctccgctgttcggctcttcgggtgatttctgtcgcccgacagaaattaggggcgggtcgggtcggtgccgttgccctcgcattgccggtcggttaccgatccctcacggaaaccgtccggagagcgtccggcatcgcccgaagatcgcgtggcggtgccgtgtgcgaggatcgaacgcatggggaccagtggacggcgggtgggcagaccgcgcgccgcgcagcggccggacagcggtctgtcgccgcgcgacgaactcctcacggccgccgccgagttgttcacgacccgtggctacgccgccacgaccacccgtgccgtcgccgagcgggccggcatgcggcaggcgtccatgtaccactacgtctccggcaaggaggaattgctcgccgcgctcctggagtccacggtcacgccctcgctcgccctggcccggcacctgctcgccgaggacgccgccccggccgagagccggctgtgggagctgtgccgcacggacgtggaactgctctgcggcggcccgcacaacctcggcggcctgtacctgctgcccgaggtgcacaccgaacgcttcgccggtttccatgccgtacgggccgaactgaaggacacctaccggcagttgctggccgcgacggccgtgggcggcgcactcgccaagagtgagctggatctgcgtacggatctggtcttcgggctgatcgaaggtgtcatcctcgttcaccgctccgatccggagcgcccggtctcggctttcgccgaggcgaccgcggacgccgcgctgcgcatcgtcggcgtctgacggacgtcccgccccggtgccggaagccgggggtcacccccgtgggcgacagttttcgcatgcctgtgcctcgtgacgcagtgtgtgcgaatggaggcgcagcgtgcaaatggggccgagcgtactcctggcgcaggagtcatttcaggtgcttgctgaatatgacatagcgatgatccggtcggactaagctcgcccgcagcgcaccaggttgagatgaattcgtgcgcctgttcccaaaaataccgaagatccagatccgtaccccacgtacctcagcacaacaccccccaaccccagccgatttgtctcagagggcatacatggtgagtgttcaatcgcctcccggtggccgtgaacttccctacgcgcgcgtgctgttgctgccggccatactgatggccgcggcgaccggggccgccgtcgccttggtggcggagccggcccggatcgccgtcggctggtgcggagccgtcgcgacgctcctcgtcatcgccgccgcggccgaagcggtacgccgcggccgcaccgtccgtgagctgcgcgccgaggtcgcgcgccggaccgccgacctggaagaacgcgtcgccgcccacgacgcggagttcgtgcgcctgggtcaggaaatcctgcccgcggcactggagttggtgcgggtcggcgagtccccgtcggaggtgatccgcaaaaccgtcgacgcggagcccgagtggcgcgaccttcccccaccgcagcgcagtctgctgaccaccgtcgtcagggtcgtggaccgccagttcgccctgcgcgactcctcgcagcgcaccttcgtcaacatcgcccgtcgcgtccaggcgatcgtccaccagcagaacaaggaactgcgggagatggaggaggaccacggccgtaaccccgaggtcttcgacgacctgctccgcatcgaccacggcaccgcgctgatcggccgtctcgccgactccatcgccgtcctcggcggcggccggcccggccgccagtggcccctgcccgtaccgctgtacagcgtgctgcgcggcgcgatgtcccgcatcctggagtaccgccgcgtcgaactgcactccatcgccaaggtcaatgtcgccggcgtctccgtggaaccgctcatccacgccgcggccgaactcctcgacaacgccacccgctactcgccgccgcagaccaaggtgcacgtcaccgcgatcgaggtgcagaccggcgtcgccatcgagatcgaggacgccggcgtcagcctcagcgaggaggccctcgcccgcaccgagggcatgatcgagcgcgccaagatgagcatggacctccaggacatcggcgagaccccgcgtctgggcatggccgtcgtcggccgcctctcgacgatgtacaacatgcagatctcgctgcggcagtccgcgtacggcggcgtccgcgccgtcctcgtcgtgccgcgcgacatgctcaccgacgaccccgcccccggcttcgcccacggcatcggcgccgcctccgcaccgatcatggacaccgacgcggtcgaggcacccgaccgcaaggccaagaagcgccgccccaccaccggaccccggatcccgagccagtacgcggacatggaggacgacgtccccgaggtcaccgagtggacggccaacggactgccgcagcggcgccgccgcgtgcagatgtcgctcaccgagcgatacgccgagcaggcgcggatcgaggccgaggcgaaggccaccggggtcaacatctgggaacccgagcccgccccggaggagccgaaggagcccgagcccgaacccggactgtgggtcgaggcgttcatgaacggtctcaagggcgacccggatccgaccgctttcaccaagaacccggcccttgcggaggccgatgacgagggggacctcaagtgatccagcagcgagccaacttcgactggatgctcaaggaactcgccgacggggtacccggcgtccaccagatcgtggtgctctcggccgatggactgcgcatcgcgcgctacggcggtgacccggacgccgccgaccgcgtcgccgcggcctgcgccggactgcagagcctggccggtgccgtcgccaccgagatcccgcacagcgacggcaagatgcgcatggtcatcatcgagatggacggcgcctacttctacatgatggcggcagggcccaacgcctacctcgcggtgctctccgacgtgacggcggaggccgggctgatgagcaaccgcatgcgcgacctcgtcgtgcgcatcggcgcccacctgaccagcccgccgcggcgcaacgggcagaccgtatgactcctccgcaacgccgacggcgctcccccgagccacagcctccgccccggccccctcagccgaacgacgggaacgacgggaaggacggcgacgcgagcaacccggaacggctgttcatcctcaccggcctggccgacgggggcgaacgggcggccctcgacctggtcacgctgatcgtggcgggcgccgacccgccgccgaccgccccgccggagcagtcggcgctcctgcggctctgccaggcccccctgtccgtggccgagatctcggcctatctcaggctgccgttcagcgtggtgaccgtcctgctcaccgagctgctggcggccgaactggtaacggcacgcgcccccatctcgcgagaggcgctgcccgaccgttccctcctcgaagcggtgatgcatggacttcaaaagctctgacgccatcaggggcccccggaccgaggaccatctgccgcacacggcccaggccgccgtgaagatcgtcatcgtcggcggcttcggcgtcggcaagacgaccatggtcggttccgtcagcgagatcaggccgctgaccaccgaggagaccatgacacagatgggcatcggcgtcgacgacaactacggctcggagagcaagacggccaccaccgtcgcgatggacttcggccgtatcagcatcaccgagcaactggtgctgtacctgttcgggacgcccggccaggagcgcttctggttcctgtggaacggcctgttcgaaggcgccctcggcgcggtcgtcctgatcgacacccgccgcctcgaggtcagcttcgacgtcatcggccggctggaggaacgcggggtgcccttcgtcatcgccgtgaacgacttcccggacgcgccccgctaccccgtcgaggatctgcgcggcgcactcgacctgaccgaggacatccccatcgtgaagtgcgacgcgcggcgccgggcctccagccgggaggtcctgatgacgctgatgcacttcctgcactcgctggccgtgtccaagacgtccgtctgaaccggccacgcccccacccgccgactccgcggagtcctcatccacttcagtcttcggagcgaccatcgtgacgcctgaaccccacccctcgaccggcacggacgacccgacgttcggcccgccccccggctgccccgcccacgaccccggcctcggcggggtgcgcaggctgtacgggcccgaggcggaggacctgggagacctgtacgagaaactccgcgccgaacacggtgcggtggcccctgtgctgctccacaacgacgtaccgatgtgggtcgtgctgggccacaccgagaacctgcacatggtgcgcagcccctcgcagtacacccgtgacagccgcgtctggacccccgtcctggacggcaccgcgggccccgaccacccgctgatgccgcacatcgcctggcagcccatctgctcgcacgcggagggcgacgagcatctgcggctgcgcggggcggtcagcggtgccatctcgaccatcgaccaccgaggcatccgccgctacatcaaccggtcgtcgcaggctctcgtcaaccggttctgcgaggagggcagagccgacctggtcggccagttcgccgagcatctgccgatggcggtgatgtgcgagatcctcggcatgcccgacgagtacaacgaccgcatggtgcaggccgcccgcgacatgctcaagggcaccgagaccgcgatcgccagcaacgcgtacgtcatggacgccctgatgcggctcaccgcccgccgccgggcccaccccgagggggacttcaccagccacctcatcaaccacccggcgcagctcagcgacgacgaggtcggccagcatctgcggctcgtactgatcgccgcgtacgaggccaccaccaacctcctcgccaacgtgctgcgcatggtcctcaccgacccgcgcttccgtgcccagctcaacggcggccagatgacggtgcccgaggcggtcgagcagtccctgtgggacgaaccgccgttcagcaccgttctcggctacttcgccaagcaggagaccgagctcggcggccagctcatccgcaagggcgacggtctgctcctcgggatcgcgccgggcaacgtcgacccgcacgtacgcccggacctgtcggccaacatgcagggcaaccggtcccacctcgccttcggcggcggcccgcacgagtgcccgggccaggacgtcgggcgcgccatcgccgacgtcggcgtcgacgccctgctcatgcggctgccggacgtccagctcgactgcgcggaggacgagttgcgctggacggcgtccatctcgtcgcggcacctggtggagctgccggtacggttcgcgccgaaggaaccgcaggacgtgtcgcagcggcccagcctccgtccgctgccgcagccggtcccgagccggccggtccggacgcagcagccgcaggccacgacaccgcccccggcgcccccggccccgcccgccgccgcgccggaacgcggtcctggcgcctggcagcggttcctgcgctggtggcgcggctactgagccttcttcctgtaccgggcgtgcgggtaccgggtgtccggtcgccgatcctcctgtgccggtggcgtggctaccggacccagtcctcgtacgccgaccaggcggtgagtacccgctcgctcaggaaccggtgctcgtgccccgtgaccggatcggtgaactccaggacccgcgcgagcagttggagcgggcgccggaagtcaccggccggcccggggtcggtcaccaccgggtagagggggtcgccgaggatcggcaggcccaacgcgttcatgtgcacccggagttgatgggtctggccggtgcgggggaggagccggtaccgcccccggccgtcccggtgctccgtcagctcgatccggctcaccgcgttgggctccccggcgacctcccgggcggccagtaggccccgctccttcaggatccggctgcgcacggtacgcggaagggcgacctccgggtcgtacgtggcgacggcctcgtactccttgtgcacgagcttgtcgcggaacagcgactggtacgcgccgcgctccccgggccgtacggtgaacagcacaaggccggccgtgagccggtcgagccggtgcgcggccccgagctccgggatgccgaggtcccgccgcagccgtgcgagaacggtctcggcgacatggctgccgcgcggggtggtggcgaggaagtgcggcttgtcggcgacgacgatgtgctcgtcgcggtacaccacgtcgagcgcgaacggcacgcgctcctcgtcgggcagttcgcggtggaaccacacgaacatccccggcacatacgccgtgtcgcgctcgacgggccgcccgtccgccccgacgatcagaccggcgtcgagcatcccgtcgaccactccgtccccggccgcgagccgggccacgagatggtcgcggacggtgccccaggccccgccctgcggcagcttcacccgcaccgggtcgaccccctcgcgctgggggaggggagagggcgggatgcggggtttgcgtctcattgcgatcagcgtacgaggggccaccgacagcggaggtacgggggcgcgggccagggcgccgggtccggacggggcgaggcgcggggtgcggacggggcgaggcgcggggtgcggaaatccactgggaccgcggagcgcaccttggcaggatgcggatcatgccctacctcaccggcccggtgctccccgccggcaccctcgcccgctccgagcagcccacgatccccaccggcgacggcctggtcctgcggccctggacggccgaggacgcgcccgctgtccacgaggccttccaggaccccgtcatgcatcaatggcacatccgcgccgcagactcgacggacgaggtcgccggctggatcgaggagtggcggacggcctgggcgggagaacggaacgtgcagtgggccgtggccgacgcggacaccgaccggctgcgaggacgcgtcgcgctgcgggacgtcctgctcggcgacggggtggccgaggtcgcgtactggaccgtggcgggcgcccgcggacagggcgtcgccgcgcgtgccacctcggccctcgcgtcctgggcgctcgacgaggtcggcttccaccgcctggagctgagccacgccacggccaacgaggcctcctgccgtgtcgccgccaaggccggcttcaccctggagggcaccaggcgcagcgccctcctccaccaggacggctggcacgacatgcatctgcacgcgcgcgtacagggcgatccgagccagggccccacggcctaggcctgccctgggttcctaggcggtcgcctcctggaccgtcgcctccggcgcgggagccggggccgacgtccgcccgcggtacgcccggtaggccgcgcccgccgcgagggtcaccgccaggaacagcacggtgaaccactggaagtaccagtgcccgcccgcggggtcgtacacctccgcccgcggccaggcgaggtcgacggtcatgaggaggccgtagaggagggcgagcgtgttgacgggtacgccccagcggcccagggagaagagcggggcgcccgtctcgtccgtgccctcggtggtgaactcgccgcgcagccgccgtaccagcagcggcccggtcaccatcgcgtacgccaggtacagcatcacgatgcaggtcgtaccgatggccaggaaggcctccggggaggcgaagttgaggagcagcagcgcggccgccaggacgccgaccaccagggcgggggcgctgggcatgccggtgcgcgggttgacccgggccaggcgccgggcgaaggggagccggccgtcgcgggccatggagaagagcatgcggcaggccgccgtctggatggcgagggtcgccacggagatcgccaccaccacgtcggcgagcagaacccggccgacaccgtcgccgaggctgctggtcaggacgtagctcagaccgtcgaccccgaggcggccgtccgtcaggctgggggccgcgagcagtccgccgaggacgatcagcccgcccagcaggccggccgcgccgagcgcggtgaggatcgtgcggggcgcgacgcggcgcgggttgtgggtctcctcgctcatctcgcccgcgctgtcgaagccgatcatcacgtacgccgccgtgaacgaccccaccgccagcgccccgaacaggcccgcttgagccccgccgccggtgtggaaggtgatgccgggcgagcgctcggagtgggtgagcagcagcacgatgatgaggacggccccgatgatctcggcggtcacgccgacgcggttgatcacggacatcacgcggttgtcgatgacgttcacgaacgtggtgagcaccagcaggatgacgcccagcaccgccgcgttcgccgcgccgctcgcgctggtgggcgccggatcgccgcccaccagctggaagcccgaccagatcggcggcatcaccatctggagcgcgagtgccgccgccgcgaccaccacgatctggccgatcaccatgatccagccggcgaaccagccgaaggtgaggttcgacaggcgcgaggaccactggtagatcgcgcccgagatcggatagcgcgcggccagctcggcgaagcacgcggccaccagcagctggcccaccagcacggcaggccaggcccagaagaagacggggcccccgaaggcgtacccgaaggcgaagaactggaagaccgtcgtcaggacggagatgaaggagaacccggcggcgaaggaggcgtaccgtcccaggctgcggtgcagctcctggcggtagccgaactccgcgagatcggcggcactttcgggccgtggcgggtcggggcggacatcggcgggggcggtgctcgtcatggcggcaacctgctttcgcacagcggcgcgagagttcctgtcgggcgacagaaattagggaggccctgtttcatgggcgtcacgcggccgtgtccggggcgggcctaagtcctcacggggttgcggaggtatctcagacgcgatacatcgtgtgtattgaccgggcttttcgaaacgcgatatgttcggtcacgaatattcggtgccgatgcgatgtcgatgcgcacgtcgacgtcgatgaacacgtcgacgcgatgttgacgggatgtcgacgggatgccgaggggatggaaggggggatttcgtgatggggaccaagcgccgcaagctcggcaatccgctggcgctggccgtgatggtgctgctcatggagaagcccatgcatccgtacgagatcgcgcagaccctctgccgccgcggcaaggacaccaccacgaagatcaactacggctcgctctacacggtcgtccagaacctggagaagcacggtttcgtggaggtcgccgaggtgcagcgacagggcaaccgccccgagcgcacgctgtacggcatcacggacgccgggcgcgaagaggcgacggagtggctgtccgatctgctggcggtcccggcccgggagtacccgatcttcgagaccgcgctctccttgctgggtgtgctccaccccgacgaggtgacgcgtctgctcgaggagcggctcacccagctggaagtgcaggtggcgagcgcgcgaggcggcctggagaagctgtacgagacgctgccgcgcctcttcctggtggagaccgagtaccaactgcacatggtcgaggcgcaggccgagtgggtccgcggcttcctgcgggagctgcacgacggctcgctggccggcgtcgaggcatggcggcgtttccacgagacgggggagatcccgcccgagttcaaggacttggaggagcgccacttcgagaagtgaccccacagagaacagaccccggcaggactgttgcagcagtcccgccagggtctcgaaccccgaaccggatccgccgtgaggcagaccgggcgaccgaggtgcggcacacccaggatagcccggcgctcttcacccggatcgatcgtcatccgcttgcacggatcacgtcacgcccgcccatcgcggacctgccgtcgtccaccgcacagcggccccctggtcatccgctcacacaggagagcagtcgtcatgaacacccgtgcgcccgcggtagaggcgcgtcagctgatcaagacctatcccggtgatgtcaccgccctgagcggcatggacatcaccgtcgagccgggcaccgtcttcggcctcctcgggcccaacggcgcgggcaagtccaccaccgtcaagatcctcaccaccctggcccgccccgactcgggcacggccaccgtcgcgggccacgatgtgctgcgccaccccgaccgggtgcgccgcgcgatcggcgtggtcgcccagagctccggcgccgacccggtcgccaccggccgggagaacctccgactccagggcaggctccatgggttgaagggcgccgggctgagccgccgggtggccgagctgctggaccgcttcaagctggccgacgccgccgggcgtcaggtcaagggctactccggcggtatgcggcgtcggctcgatgtcgcgctcgggctggtccaccggcccgaggtgctcttcctcgacgagcccaccaccggcctcgaccccgaggcgcgcaccgccatgtgggacgagatcgcccggctcgccggcgacgagggcctgaccatcctgctcaccacccactacctcgaagaggccgaccggctcgccgaacgtatcgccatcgtcgaccgcggccgtgtggtcgtcgaaggcacaccggacgggctgaagggggaactgcgaggtgacgccatccacttggagctgcgcgaagcggtcggccaggccggtcgtacgctgctgaagggctccctcggcggggtgcccggagtgcacgaggtgctcttcgacgacgcgcagggccgccgcgtcagcgtccgcgcggacgacggagccgccgcgatgcccgccctgctcggcgctctggagcgagccggtgtcggggtggccgcggcgaccgtggcccgtccctcgctcgacgacgtctatctccgtcacgcggggcgccgttactccgaggcggaggcggaaggcgccgacagcctcgccctcgcgggagccacgggaggtacccgatgagcacggccgtctcccagacctggtacatgacacagcgtcaactcatggtgttcgtacggcagcccgcgtatctgctgatcacgttgatccagccggtggtctggctgttcctgttcggcaacctcttcaagaaggtcgtcgaactcggcggcttcggcacgacctcctacctggactacctcgtcccgggcgtggtggtgatgagcgcgctcagctccaacatgtgggcgggcatgagcacgctcgacgagatccagcggggcacgctcgacaggttcctcaccacaccggtcagccgggcggccctgatgaacggcaatgtcgtcaacaacggcctggtcaccgcactccagtcggtgatcatcgtgctgctcggcctgctgggcggcgcggactatccgggcgggttcggcggggtagccgttctgatcgtcgcctcggtgctgctcggcacggtcttcggagcactgtccaacgcgctgggcatgctggtccgggagcgggagtccatcatcggcatcaacacgttcctgctgctgccgctgaccttcctgtccagtgccttcatggccacgtcccagatgcccggctggatgcggcgcacagccgacttcaacccgctcgactgggcgatggtggcgggtcgttcggccatgtccgagcatccggactggggcggcgtgctcggccggggcggggcgctgctggccttggcggtcgcggcggtgtggctctcgatccggacgttcaggtcgtaccagcggtcggtgtgacggacgcgctcaggagtcgctcaggaggcggccggttcggccgtctcctgctccgcctccacctgcgcgttccactcccgcttcgccgcctgccagccgtcctcgttgtggccgaggcgccagtagccggagatggagaggtcctcgcgcgggatctcgcgctcgacgcgcagcagcttgcgcagctccttcacgaagcccgcctcgccgtggacgaacgcgtgcacccgccccgccgggaactccagcgcacggacggcctcgaccagggcctcgccgaccggccggtctccgcggtgcagccagacgacatccacgtcggaggcgatcttctgctcctcttccgggccggagacctcgatgaaggcacgcacgtcggcgccgtcgggcagcgactccaaggccgcggcgatcgcgggcagtgcgctctcatcacccgccagcagatgccagtcggcgctcgtgtccggcgcgtacgcaccgccggggcccatgaaccgcacgagttcgcccgactggacgcgggtggcccacggcccggcgagcccctcgtcgccatgcaccacgaagtcgagggtcagctcgcgcagttcgggatcccaggcgcgcaccgtgtacgtccgcgtcacgggccactggtcgcgcgggaactcctcgcggacgcgctgcatgtcgaagggctcggggtaagtgactccctcggcaccgaacagcagcttcacatagtggtcggtgcgggtgcccacggtgaactcggcgaggccgtcgccgccgagcaccacacgctgcatgtgcggggtgagccgctcggtgcggatgacccgcgccgagtggggcttaggggtcctgcgttccggacgctctgccatgacggcctcccagatctgcatgcttaggcttacctaagttagcaccttctcctgggcaacatctatgcctgcagcgtcgagagcaacctgtgcaacgagccgccgagcccccagcgggcggcgagttcgtccagggccgccggatcgcgcggggcgcccggcagcgtgatgtcgacgtccggcagcggcacgtcaccggccacccgcacgaccttgggcgcgaccgcgaggtacggccgggactcgtcgaggcgcttgcgctgcgacggcgtcagcttcgccttcgggtcgtcgaccgcggccatgatgccggccaggtcgccgaactcggcgagcagcttggcggccgtcttctcgccgatcccgggcacgcccggcagaccgtcgctcgggtcaccgcgcagcagtgccagatccgcgtacccccctccgtcgactccgtacttctcacgcagccacgcctcgtcggtgagctggagcaggccgacgcccttgagcggatagaggacccggatcccgcgctcgtcgtccaccagttggtacaggtcgcggtcgccggtgacgatgtcgacggggcccttcgcgcgggccgtgaacgtgccgatcacgtcgtccgcctcgtacccctcgacgcccacgcgcgcgatgccgagcgcgtcgagcacgttctcgatgacgggcacctgcggagagagggtgtcggggacctcctcctcgtccggccccgactcgcgctcctcggccacgcggtgcgccttgtaggaggggatcaggtcgacccgccactgcggacgccagtccgcgtccatgcaggccaccagttcgtcgggacggtggtccttgaccaggcggtcgatgaattcgagcagtccgcgcacggcgttcaccggggtgccgtccggggccttcacggagtccgggacgccgaaataggcgcggaaatagagcgaggcggtgtcgagaagcatgagtcgtcgagttggctgcgtcacctttcgcatcatgccgtacggcaccgacaggcaccccgccgacgcagacgtggcagttcagagtgcccttacgtaacagaagtaaacggattgtgaactggagcactcctgagtttgaccccttcaagagggggcaggcgccgcgtcggagcagagcccgttgcattttcaatcgtccgagggcctcgcgacgctccaggacgagaggtacacgtgtcatccaggctgcaggccgagagcctgtacaaggtcttcggcagacgacccggcgaggccgtggagcggctccgctcgggagccgaccgcgaggagctgcgcgccgacggcaccaccgccgccgtgatcgacgcctccttcacggtggagccgggtgagatcttcgtcgtcatgggcctgtccggctccggcaagtccacactgctgcgcatgctcaacggactcctcgagccgaccgccgggcacgtccgcttcgacgaccaggacctgaccgcgctcggcgaccgcgcactgcgcgaggtccgctccaagaagatcagcatggtcttccagcacttcgcgctcttcccgcaccgcagcgtccgcgagaacgccgcctacggtctcgaggtgcagggcgtgccccgcgccgagcgcgagcggcgcgccgacgaggcgctcgccctgtgcggcctcggcggctgggagaagtcctggcccgacgagctctccggcggcatgcagcagcgggtgggcctggccagggcgctcgccaccgacgccgaactgctgctgatggacgagtcgttcagcgctctcgacccgctgatccggcgcgatatgcaggaccagctcctggaactccagaagaccctcaagaagaccatcgtcttcatcacccacgacctgaacgaggccatgcgcctgggcgaccggatcgccgtcatgcgcgacggccgcatcgtccaggtcggcaccgccgaggacatcctggtacgtcccgccgacgactacgtcgcctccttcacccaggacgtcgaccgctcccgcgtcctgaccgcgggcgccgtcatggacccggacgtacgcggcgacgaggcggactgcgcctgtgagaccgccacgcccgacacgccgttcaacgaactctgcgccatcagcgcgcgtctctcgcatcccgtcgcggtgctggacaagaaacggaaactcctcggtgtggtgccccggcaacggctcgtcggcttcctcggtgacgagcggggcgaacccgccgcgtgtgcgacgccgcgcgcgaaggcggtgacgaccgatgcctaggatccccttcggcgactgggtcaacgacaccgtcgactggctgctgaaccacatgtcgtggctcttcgacttcttcaagacggtcttcctgggtgccttcgacggcatcgacgcggtcctccaggctccgcagccgctcctcctcgccggaatcctcgcggtgatcgcgttctggctgcgcggcacgtcagcgggtgtcctcaccttcgtgggattcgcgttcatcgactccctcgaactgtgggaggacgcgatggtgaccctgtcgctcgtcctcgtggccacggtcatcgcgctcgtggtctccgtgcccgtgggtatctgggcggcgcgttcggaccgggtcagcagcatcgtgcgccccgtgctcgacttcatgcagacgctgcccgcgatgatctacctcatcccggcgatcctgttcttcggcaccggcgcccccgcgggcatcgtggcgaccctgatcttcgcgctggcacccggcgtccggatgaccgagctgggcatccgtcaggtcgacaaggaactggtcgaggccgccgacgcgttcggcaccaccccccgcaacatcctgctgcgcgtccagctcccgctggcgctgccgacggtcatggccggtgtcaaccaggtcatcatgctgggtctgtccatggccgccatcgcgggcatggtcggcaccggcggcctcggcggcgacgtcaacgaggccatcggccagctcaacgtcggcctcggctcggaggccggtgtcgccatcgtcatcctggccatctacctggaccgcatgaccagtgccctgggcacccaggtctcgccgctcggccgccgcgccgccgccaagctgcgcgccgcgcagggcctgaagatctggtcctaccgcccccgggccgccgtggccgtggtcggtgtggtcgtcctcgcgctggtcgcgggcggcatgggcatcttcggcggtacgacgtcgtcgaccgccgcgtccgacgccgagaacgtcggccagggcaagaaggtcaccatcggctacatcccgtgggacgagggcgtcgcctccaccttcctgtggcaggaggtgctggaacagcgcggcttccaggtcgacaccaagcagttcgacgcgggcccgctctacacctcgctcgggcagggagacatcgacttccagaccgactcctggctgccgaccacgcacgcgcagtactggaagaagtacggcaagcaactcgacgacctgggttcctggtacggcccgacgtcgctggagctgagcgtgccctcgtacatgaagggcgtcgactccctggcggacctcaagggccaggcctcgaagttcggcggcaagatcaccggcatcgagtccagcgccggcatgatgggcctgctcaagaccaaggtcctgaaggagtacgggctcgacaaggagtacaaggtcgtcgacagctccacgcccgccatgctggccgagctgaagcgcgcgtacgccaagaaggaccccgtcgtcgtcacgctctggtcgccgcactgggcgtacagcgactacgacctgaagaagctcaaggaccccaagggcgcctggggcaagggcgacggggtgcacaccctcgcccgcaagggcttcgcccaggacaacccggtcgtcggccggtggctcaagaacttcaagatgaccgagaagcagctcaccggtctcgaggcggagatcaacaaggcgggcaagggcaagcagcaggacgccgtgcgctcctggctgaagcggaacccgggtgtcgtcgacaagctggcgccggtcaagagcgccacgtccggcgccgccggcgagacgaagcgtccgctggacgtagcctggttcccctgggacgaggacgtcgccgtcacctacctgtggaagaacgtcctggcgcggcgcggctacacgctgaatctcaagcagatggacgtcggccccgtctacacgggcctggcctccggagatctcgacctcaacttcgacgcgtggctgccgtacgcccagaagaactactgggaccagcacaagaacgacctgagagacctgggcacctggtacaaacccacgtcactcgaaatcgccgtgccctcctacgtgaaggacgtcaagtccctcgcggacctcaagggcaagggcggcaccttcgacgggaagatcatcggaatcgagccgggcaccggcgagatgaacctgctcaagacgaaggtgcttccggggtacggcctggacaaggagtacaaggtcgtcgacggctccacgcccgcgatgctcgccgagctgaagcgcgcgtacgccaagaaggagccggtcgccgtcgtcctctggtcgccgcactgggcctacagcgagtacaagctcaccaagctggcggacgacaagaagctgttcggcgagggcaacacgatccggaccatctccagcaagcagttcccggagcggtatccgcagctcaccaagtggatcaaggacttccggatgagcgaggccgaactcggcagcctggagagcgagatcaagaagcgtgggcaggggcatgagcaggacgccgtcgccgcgtggctgaaggagcacccggacatggtgggccggatgactccgcagtagtcctgacggctccgtggagtcctgacggctccgtggagtcctgacggctccgtggagtcctgacggcccgaggggtgggcttcgccgatacgccgtccgtgcgtgtggcgtagcccacccctcgcggcatgtccgcggggcgcccgtcggcccgcgctcggcgccgacggcaagtgcggctccgtactggcgtacgagaaggatccggacaaccgcatcgcggtccgcggccgtgccggccccgacgccccgccggccgggcgagtcgaacgcggcttcgaggtaccccgcaccctgtcgcgcggtgccgagggcaccccggaccccgtctccgtgcacgacggcacgcaggtgaggtccggcccctaccggggggcctgcggctccgaccgccggctccggctgtccggcgggacttcaggacctggcggacccgccctgaccagcggctcgaccgtgccctggaggcgtgcgggaccggcggcgacatcggtgaccgctcgccgctccgcctcggcgcggggccgctcgtcccgaaaacgggggcagggccgatgcgacgacttcgggagccggcggacgtacgcccatgatcgggccaccggcggggccgaacggctcgccgtccgcacccacggtggcaacagggccttggcccacccgccggcgaccctcctcgccggccgggacgggcgtcccgcgcttctggtcagccgcttcgtcccgcgcgagggctcggcgcccggcgagacgggcgggccgttccactggcgcgaactgtgagcctcgccctcctcggacatgacagcgatgtgacgggtgcatgaaacggtttgccgaacatgcgtagggtgcagagaactcatcaggactggttcggacgcagtgcagggaacaggcggccacgggtggccggaagccgcggggcagcggaccgacgagcgaaggagggagccggagcgatgggcgaccacaaagaacagccccttcgggtgggcgcggccgtacggcgtcggcgccgggcactggagctcaccctcgccgtcgtggccgagcgcagcggcctgtcggtccccttcctgagccaggtcgagaacgaacgggcccgccccagcaggccctccctggagcgcatcgcggacgccctcggcaccaccgcggtcgaactgctcgccgcggccgacccggcacgcagcgtcgacgtcgtgcgcgcggacgacaccgggctcacgcccacccgggcgcgcgtgcgccccctggtgcgcggtcaccaccagttgcacgccatggagttcaccggcgaccacgacgagggccgcgaattccagcaccgcaacgacgagttgatgtacgtcgccgacggtgccgtcgagatcgaggcggagggccgcgcccaccggctcgggcgcggcgacaccctgtatctgacgggcggggtgcgccaccggtggcgggcgaccgtaccggacacccgggtgatcgtggtcgcggtcgccgaccacatcgaggcggccgaggatccctcgggccggcgctgacccggcctgccgtcagcctgccgtcagtccgccgaccgcacgctgaccggatcgggtgacaccggtcacggagcgtggctggaatactggcggcatgcccgacacctccggatatgccttcgacaacacatccgaaagagcaggcagccgctatgacgtgctggagtccacctacgaccccgtgaccttcgcgcggctcgccgaattgggtgtggcgccgggaatgcgctgcctggaggtcggcgccggtgcgggctcggtcgccgcatggctcgccgagcgcgtcggaccggacggctccgtgctcgccacggacatcgaaccgcgctggctgggcgagctcccggcggccggcaacgtacgcgtcgtacgccatgacatcacccaggaggatctgcccgaggggcggttcgacctgatccacgcccgtctcgtgctgctgcacctgcccgagcggcaggccgcgctcgaccggatggtgcgggcgctgcgccccggcgggcggctggtcctcgacgagttcgactgcggctgggtgccggtgctgtcggcgccctcgcccgaatccgcggagctcttcgagcggatgcacgacgcggtgatgggcgtgctcacccgggccggcgccgacatccgctggggactgcacgcctacggggcgctgcgcgcgaccgggctggccgaggtggcgtccgccacctgggccgaggcgtgggtgggcggttcgcgcggcattcggctgcaccaggtcaacatccgggatgtgggcgggcagttgaccggggacgggctgacggacgacgatctggagcgttgtctgcggctgctcgacgacccgtcgttcgccgtcaactcctatccactgatcaccacttggggcaggcgccggtgaggacttcgtggggcaggcgcactcggggcgggtgtccgtgacgcgtgtggtctcgctcgtgccctcgctcaccgaggccgtggcccggtccgcgcccggtgtcctggtcggcgccaccgactggtgcagtcagccggcggacctcgacgtcgtgcggatcggcgggaccaagaaccccgatgtcgagcggatcgtccggctcggccccgatctggtgatcgccaacgaggaggagaaccgcgcgcccgacctggccgctctgcgcgaggccggggtcgaggccctggtcaccgaggtgcgggaggtgccgcaggccttccgcgagctggagcgggtgctgcacgcgtgcggagtgccgggcggccggccgcgctggctggacgaggcggaggcggcctggtcccggctgccggcgccggggcgtcgtacgaccgccgtcgtgccgatctggcggcggccctggatggtgctcggccgggacacgttcgccggggacctgctggcccggctgggcgtcgacaacgtgtacgcggcgcacgcggagcgctatccgcgcgtgccggtcgaggagctgcgagccgccgctcccgagatcgtggtcctgccggacgagccgtaccgcttcaccgccgacgacggccccgaggccttcgcgggcacggcctgcgcgctggtcagcgggcgccacctcacctggtacgggccgtcgctgcgggaggccccgcaggtcatcgtcgaggcggtgcgagcagctcgccggtgaccagcccgcgggcggtacgggccgcggtgacggcccaggcggcgaccagcccggcgtacagcgcgacggcgagtccgtcgaacgcggcgagcccggtgtgccgggccagggcctccgcgccggtgacacatgtaccgaccgggaaggtgaacgcccaccaggtcagcgcgaagcccatgccccgccgccgggcccgcaccaccagcgcgaccgcaaggcccagccacagcagggcgaagcccatcaccgggacgccgtagaggacggcgaggacgccgaagccctggtcgtacggggcggggacgacccccggggcgaagtccgcgaacttgccgacggcggtggtggactggccgagcgggccgaggaccaggagaagcgtcggggtgaggacgaggggcagggggcccgtggtgatgagccgggcgaaaatcatcggcagcatcatgagcgtgcccagcaggctgaggccgaacatcgcgacgcaggcgagcagcagggtctcccgcggctgaccggccgggagatgcgggacgagcagggggccgagggccgccgagaccatcggggcgaccagggggagcagccagacgggggtggcccggcccggctcgatgcggtggcgggtcaccatcaggtagggcaccgcgacggccgcggcgaggccgacggcggtgccggcggtgaagagtacggcgtccaggacgacggccgcggtggtgccgagccagtcccggccgacggtcagggtggcgccgccgacggccagcagcgccatggcgaggcagccgtagaagggggccgtggtggggcccgtcgtggggtcgaggaggtgggcgcgggcctggtcgcggtggtggatccagtgcagggcgcgggcgccgaggagggtcacgagcatgatcagggagagcgcccagaaggccgtgcaggcggtgcgcaggcccgggaggtcaccggggaggcccgcggcggagcccgagggaaggcccgctcccgctgtggccacgatcgcggtgcccatcaccgaggcgtaccagttggggccgaggtggcggaaggcggcggcccggggacgcgacgtgcggacgctgggcggggcgaggggctgggctgcggtgaccatggctccacggtccctccgtcccggggacctcaccagggagtatgcctctatgggggcataagctggatttatgagcgagggtgttgatggtgggttgtcggccggtcttgcgcatcgggtgccggagttgggtgcgctggagctgctgcttgccgtggcacggctcggaagcctcgggcgggcggcgcgtgagctggggatcacccaaccggcggccagcagccggattcgctcgatggagcggcagctgggcgtggcgctggtggaccggtcaccgcggggctcccggctgaccgaggcgggggcgctggtcacggactgggcgcggcggatcgtggaggcggcggaggcgttcgacgcgggggcccaggcgttgcgggggcggcgggactcgcggctgcgggtcgccgcgagcatgacgatcgcggagtatctgctgccggggtggctgatcgcactgcgggcgcagcggccggacacggcggtgtcgctgctggcggggaactcggcggtggtcgcggagcggttgctggcggacgaggcggacctcgggttcgtggaggggctgtcggtgccggcggggctggactcgacggtcatcgcgcacgaccggctgatcgtggtgacggcgccggggcatccatgggcgcggcgccggcggccgttgtcggcggcggagctggcggcgacgccgttgatcctgcgggaggaggggtcggggacgcggcaggtgctggacgccgcgctgggcggactggcgcggccgctgatcgaactgtcgtccaccaccgcggtgaaggcgtccgcggtgagcggggcggggcccgcggtgctgagcgaactggcgttgggggaggagctgtcggcgcgtcggctggtgagcattccggtggccgaggtgcggttggggcgggcgttgcgggcggtgtggcggtcggggcatcggccgacggggccggcgcgggatctgctggggttgacgcgggggtagcggggggagggagggggcggtgcggcgcggctcaggaagcagctgccaccagggcccgcatgacccgcaggtcctcgcccatctccgggtgccactggacacccagggcccaagcgggtgcggggagttcgatcgcctccacggtgccgtccgccgcgtgggcgcagggcagcagatccgtgcccaggcggtccaccgactggtggtggtaggtggggaccgcggtctcctccggcgccaggtctccgtagcgggtgccgggtaccggcttgaccgggtggtggccgaaggcgcccacctgctcgacgtgcccgtcgatgtgctgcacgagtgtgccgcccagcgcgacgttgagcagctgcatgccccggcagatgcccaggaggggggtgccggacgccagcgcggcccggatcagggccagttcccaggcgtcgcgctcgggagccggcgggcccgtgcgcggggagcgggccgcgccgtagtgggacgggtcgacgtcgggaccgcccgcgatcaccaggccgtccaggcggcccacggccgcggtggcgtgcgccggatcgtccggcgggagcatcgcggcgagtccgcccgcccgctgcacgagccgcggatatccggccgggagcagcgccgcctccagctcccacacgccccagcgcgcgccggactccagatacgtactcacgccgatcagcggtcgtccggtcacgtggccgcctcccttactcccaatggcccttgcccatacctttgcgggtggtccagggcaaagcaagcccccctggctggaggcgcgtggcgcgtggcgcacggccgaccacacgcgacgcccccgctcaggccaggaagccccgcagcagtgccgccgtccccccgcagtgctcccgcatcatctcccgggcgccgtccgcgtccccgtccagcaccgcctccaccagtgcggcgtgctgccgctgcgagtgctccaggttgcgcaccaggagggggatgcagtccagcaggtcgttgaccgtcgcgcgtacggccgcgtactgcgcggtgagggacggggaaccgcccagttcggcgagcgtgaggtggaggagcgtgtccaggcggcggtagtcggcgagcggtgcgtcctgggtgcgggcgagggcctcgcgcagccggtcctcctgctccgccgtgaggccgtgggccgcgcacaggcccgccgcgccgacctccagcacctcacggaagcgcagtacgtcctccatgtccaccttctcgatgcggcggcgcagctcgtcctcgccgcccgcatcggccctcggcaggacgaacgtgccgccgtaccggccgcgccgcgactccaccagaccctggtcctggagcaccttgaggacctcgcgcagcgtcacccggctgataccgagacgttccgccagctcccgctccgagggcagccgttcgccccccggcaccagtccgagccggacgacctggaggatctgctccagcgcctcctcgaagccgttgcccgcccgcaccggacgcagtaccggcgccagccggtccccccggccgccgaggccgccgaggtcatcatcggaatccgcctgtggcatctggccgtgcccccttcccaagcaatggttctcggcaataccttatggctctcggctgaccgaaggagccctcccgtggcagaccgcacaccaccgctcggtgtcgaggagctgcacgccctcgtcgcgggcggcgagatcgacactgtcgtcctcgcgttccccgatatgcaagggcgcctccagggcaagcggttcgccgcgcgcttcttcctcgacgaggtgctggagcacggcacggagggatgcaactacctgctcgccgtcgacaccgacatgaacaccgtcgacggctatgacatgtcctcctgggaccgcgggtacggcgacttcgccatgcatcccgacctgagcacgctgcgccaggtgccgtggaacgcgggcacggcgctgctgatcgccgacctcgcctggaacgacggatcgccggtggtcgccgccccccgccagatcctgcgtcgccagctcgaccggctcgccgccctcggctacaccgcccaggtcggcaccgagctggagttcatcgtcttcaaggacacctacgagcaggcctgggacgccggatacaaggggctcacaccggccaaccagtacaacatcgactactcggtgctcgggacgggacggatcgaacccctgctgcgccgcatccgcaacgagatgcaggccgcgggcctcaccgtcgagtcggccaagggcgagtgcaaccccggccagcacgagatcgtgttccggtacgacgaggccctggtcacctgcgaccagcacgccgtctacaagaccggcgccaaggagatcgccgcccaggagggcgtgtcgatcaccttcatggccaagtacaacgagcgcgagggcaactcctgccacatccacctgtcgctggcggacgcggacggcaccaacgccatggccggcgacggacccggcggcatgtcggacgtcatgcgccacttcctcgccgggcagctcgccgcgctgcgcgacttctcacttctgtacgcgcccaacatcaactcgtacaagcggttccagccgggctccttcgcgccgaccgccgtggcctggggctacgacaaccgcacctgcgcgctgcgggtggtcggccacggccgctcgatgcgcttcgagaaccggctccccggcggtgacgtcaacccgcacctcgccgtcgccggactcgtcgcggccggcctgtacggcatcgagcacaagctggagctgcccgaggcctgcgcgggcaacgcctacgccgccgagtacgagcacgtccccaccaccctgcgcgaggcggccgaactctgggagaacagccccatcgccaaggccgccttcggcgacgacgtggtcgcccactaccgcaacatggcgcgcgtcgaactgaaggccttcgacgccgcggtgaccgactgggagctgcgccgctccttcgaacgcctgtgaggccccacgtgtcgcacccgcacgaactcgtcgtcctcgacccggcgaccgaggaggtcgtcgccaccgtcccggccgcgacgccgcaggacgtcgacgcggccgtcgtacgcgcctcgaaggcgcaggtacggtgggccgccctcgctccgggcgagcgcgcccggctgctgcgccgcttcgccgtcgtcgtcgacgaacacctggaggagctcgcccggctggaggtccgcgaggccggtcacgtcatcggcaacgcccgctgggaggcgggcaacgtccgggatctgctcgactacgcggccgggggagtggagcggctgaccggccgtcagatcccggtgccgggcggcctcgacatcacgatcctcgaaccgctcggcgtggtgggtgtcatcgcgccctggaacttcccgatgccgatcgcggcctggggcaccgccccggcgctcgccgccggcaacgccgtcatcctcaagcccgccgagaccacaccgctgaccgccctgcggctcgccgaactcgccctggaggcggggcttcccgagcacctcttccaggtcctgccgggtgcggggcccgtcgcgggcaacgcgctggtcgagcacccgggggtcgcgaagatcgtcttcaccgggtcgacggccgtgggcaaacaggtgtgggcgaagggttcggcccttctcaagcgcgtcaccctcgaactcggcggcaagagcccgaacatcgtcttcgccgacgcggatgtcgaggccgcggccgccgcggctcccatggccttcctcgacaactccggccaggactgctgcgcccgcacccgcatcctcgtccagcgttccgtgtacgaccgcttcctcgcactgctcgccccggccgtcgagtccgtcgccgtcggcgaccccttggacgagcggaccgcgatgggcccgctgatctccaaggtccagctggagcgcgtacggtcgtacgtcccggccggcgcccccgccctgcgcggcaaggcgcccgaaggccccggcttctggttcccgcccaccgtcctgaccgacgtcgacccccacgcgcccgtagccgtcgaggaggtcttcggacccgtcgccgtcgtgctgccgttcgaggacgaggcggacgccgtccggctcgccaacgccaccgagtacggcctcgccggttcgatctggacccgggacgtcggccgcgccctgcgcgtctcgggggccgtccgggccggcaacctgtccgtcaactcccactccagcgtccgctactggacaccgttcggcggcttcaagcagtcgggcatcggccgcgaactcggcccggacgccctcaccgccttcaccgaaaccaagaacgtcttcatcagtacggagggccccgcacagtgaccgaagcgaccgaacagaccagctgccgccgcctcgtcggacggaccgccgtcatcaccggggccggcagcggcatcggcctcgccaccgcgcgccggctcgcctccgagggcgcccatgtcgtctgcggcgacatcgacgaggtcagcggcaaggcggccgccgacgaggtcggcggcaccttcgtgcaggtcgacgtgaccgacgccgaacaggtcgaggcgctcttcaggaccgcgtacgacacctacggctccgtcgacatcgccttcaacaacgcgggcatctcacctcccgacgacgactccatcctggagaccggcctggaggcctggaagcgggtccaggaggtcaacctcacctccgtctacctgtgctgcaaggccgccatcccctacatgcgacgccagggccggggctccatcatcaacaccgcgtcgttcgtggcccggatgggcgcggcgacctcgcagatctcgtacacggcctccaagggcggtgtgctcgccatgtcccgcgaactgggtgtgcagttcgcccgcgagggcatccgggtcaacgccctgtgccccggcccggtgaacacccccctcctccaggaactcttcgccaaggacccggaacgggccgcgcgccggctcgtgcacatcccggtcgggcggttcgccgaggccgacgagatcgccgccgccgtggccttcctcgccagcgatgactcgtcgttcgtgaacgcgaccgatttcctggtggacggcgggatctccggcgcgtacgtcacacccctgtaggccagttcggtgtatgcaccttccatgcgataccgagagatcttcgcgtggatcctggtcgcggccgccacggtggtggccgcaccagccgcctcggccaccaccaccggccctcgcaactgccctcgcctgtcaggaagttggtacggcgacaaccgcgcccgcctccagcaggtcatcgacgagcgcggcacctgtgccggccaccccggcagccacccggtcgccgcgttcgactgggacaacacggtcaccaagaacgacgtcaccgacgccaccctcgcctgggccctccagcacgacaggatccggcgcccggcgcgctggaaggacaccagtaagtggctcacggacgcggcggacgcggccctgaccgaggcctgcggcaccgccgtccccgcgggcgcgcccctgccgacctcgacgaacacccgctgcaccgacgagatcctcgagatccgcgagaacgcgaagaccatgagcggggccgccgccttcaccggtgacttcgatcaccggcgcacggtcccgcagtacgcctgggtgccccagctgttcgccgggcacacggtcgcggaactctcgtcgtacgcgagcagggcgcgtgaggaggcactcgcggcccccgtcggcgccacccggaccctcggcacccacacgatcgcggcctacgtgcgctactacgaccagcagcgcgacctggtccatgccctccagaaggccggattcgacgtctacatcgtctccgcgggctccgagcccgtcaccgaggtctggtcgcggggcatcggcatcgacgcgcggcacacgatcgcgatccggtcggtcctcgaccggcacgggcggatcaccacctggaaccagggctgcggcgacgtacccgtcagccagggcgaggcgatcccgtacatcgacggcaagcggtgctggatcaaccaggagatctacggcgtacgcggcaaggcggcctggcagcgccagaaccggccgcaccggcccgccatcgccggcggtgacgcggacaccgacgtcaccttcgtcggggacgccaccggcgcccacctcgtgctcaaccggaacaagagcgagctgatgtgccgggcgtacgacgacgccgacgggcactggctgatcaaccccatgttcatcgagccactgccgcgcaggcccgccccctacccgtgctcgaccgccgcctacaacgaacccgacggcggcaaggggccggtccggcgggaggacggttcggtggtgccggaccaggaggacaccgtgttccgcatcccgtaaggggcgcggggcggcggcatcgtaaggtgcggggatgagcagtacgcctccgcccggctggtaccgagacccgtcgtacccgctcgtcgagcgctggtgggacgggtccgcgtggaccgaccaccggcgtcagcccgagacaccccaggagcccctggtgggcccgcggccggccggccgcgggcccggccgcgccaaggtgatcgcgctcaccgcggccggggccgtcctggtcgccgccgtcgtcacgggggtggtggtcctggcccgcgacgccggcggcagcgggagcggcgccgaggcgaagaccaccgccggctcctcggtgaccaccacgccctccgcgtccgcgtccgcgacctggccctccgcctccgcctccgaaccgtcggccgacgacccgtccgtcgtcgaggacgaactcaacggcatcacaatgccgttgcccgacggctgggtcagggccgagaacgtggcggaggacgacgtcgtcatgaccacgccgggtacgtacgactgccccggcgaccccggcctgtgccgtcacggccaggtcctgtcacgtaccgccacggcgagcgacgcatcgccgaaggcgctcgcccggggcgacatcgcggatgccatggacacggcgttcgaccgcgacggcctcggcagccggcccttcggcggcgtgacgtcgcaccgtgaggtcaaggccggcacggtcgccgtcggcggccgcgcggggtacttcgtgcgctggcgcgtcaccaccgcgaaggggcccggcggttacgtccagtcgctggccttcccgtccagcgtgggctccgaggcgccggtcatcgtccgcttcgccttcgacgcgggcgccgacgggccgccgctcaccgacatggacaagatcaccaaggggatcaggccgatcggcgacccggcgaccggcgggggcgtgggcagcagcatcggcgcgtcgaggtagccgcgcgcagacacgtcgaggcggcgggacatggacgcgtcgaggcagccggcacggacgcgtcgaggcagcccgctacggaaacgtgtgccccgctacagaaacgtgtgcccttctacagaaacgtgtgcccctcgccccggtacgtcggcacggtcgccgtcacctcgtcgccctcgacgagatggagcacgtcgaaccgctcgcacagctcgcccgccttggcgtgccggaaccacaccttgtcgccgatgagcagatcgtcggcgggggagcccagcagaggcgtctgcacctcgccgggtccctcctgggggtcgtacttcagtccctccgggaggcaggggaccggcagccggtcggcgccagccgcgccggacgcggggtagccgccgcccagcacggtcaccaccccgaccccgggcctgcgcacgacgggctgcgcgaagagggcggccggacgcccgctgaacgaggtgtagttgtcgaacagccgcggcacgtacagcccggagccggccgcgatctcggtcaccgcgtcctcggcggccgtgtgctgcacgctgccggtgccgccgccgttgacgaactccaggtcgggcgccacggcgcggaccgcacgcacgacgtcggcacgccgctgggccagctccttgcgcgccgcggcctgcatcagccggacggcacgcgagcgcaccggccggccggccaccgcgtcgccgacgccggcgatgtgtccctcgtacgccatgatcccgacgagccggaagccgggcgtccgcgccaccgcgcgggccaggtcggcgacttgggcggcggagtgcaggggggagcggcgggcgccgacgcggacgcggcccccgaggagtttgagcgaggtgtccaactccaggcagacacgcacgacttcggtgccgccctggcgtgcctcgtcgatcagacgcagctgcgcggggtcgtccaccatgacggtgacggcggcggcgagcttggggtcgcccgccagctcggagaaggccttgcggtccgccgacgggtaggcgagcaggacgtcgtcgaacccggagcgggcgagccacagggactcggcgagcgtgaacgacatgatgcccgcgaagccgtcccgggccagcacgcgttcgagcagggcacggcagcgtacggacttgctggcgacgcggaccggcttgccgccggcccggcggaccaggtcgtcggcgttggcgtcgaaagcctccaggtccacgatcgcgacaggggcgtcgagctgagcggtggcccgatcgtagcgggcccggtctgcggcgcgggcagtcatgaccgaagcctgccagatgcgattaccgcagggtagggggacgttccgggcagatgccccgggggtgcggactggttcccgttacgggcgtgtcaacccgtagagtgacgcgcacgcggcgaggggaacgaccttgcccgggcgggtgcgcccgggatggcggaccggccgggcgggtatgtctgcccgtggcgggcgatcctgcgaggtgtttcccgtaccccgcgtgcagaccgctccgcacaggcggtcgaacgcccccggcaggccccggggcggcccggccacaacgaaacggggggtgcatgagcaccgaagcgcgccgcgcctccattcccccgcgccctgcggtcccgccccgcccgacgacaccgccgcccaccgggccggcctcgcgggacgggcaggcgacttcgcgggacacggacggggcggtgcctccggtaccgcaggatccgccctccgcggtcccgcgtctcgcggtaccgcgtccggccgcgcggaacccgcggcccggaatgcctccgtcgtacgaacgccctttcgcgagccgcataccgaacgtgcctccgtccacgcccgggggacgccccaccacgggcggcgcaccgaccgcaccgccgcccgcaccgcaacggcccccggccgtcggggccgggcccacggtgccgccgaccgcagggcgacaggccgcctccgccgcgtccccaccgacggcgcccccgccccggcccacccgcccgccggcgcaggacagcgcgcccgtaccgtccggctccgcgtccgtaccggcgcagggcagcgcgcccgtaccgtccggctccgcggccgatccgaccgtccgcaacggcaactccggtgtgctcccgcgttccgtcaccccggacgcgccctcgtccgccgtgtcgtcccggcgggccgccgagtccccacggttccccaacctccgtctcgaccggaactccgcacccgactccccgcccccgcccgtggcttcggcgcggttcccggacgcgccgcccgtgtcgcccgccgaccccgcacgggacgccaggtcctcggcggcccccgccgacctcggcccgaccgccgcgccgccgaggcccgccgttccgccgagcacggacggcatcgtggagacaaccgcgcgcctgaggcccgcacgggaggagaaggcggccgccccggccccaccagtctctccagcaccagccccagcccctgcgtcaccggccggctccgtcccaccccccgccacggaccgtcccttcgtctccttcggccggcccgagacgtacgacgaccacaccgcccggccacgcttcctcggcgcgcgcgtgcggccccgcgtcgccgcggccgccgcctgcgtcgtactcggcctcgggctcatcggcggtgcggtgaccgggagttggctcaccggggacgactcggcgccgtccggttcgcccagcgccttcgtcgcggccggcggcctgtggcacagcgtccccgtggacaagctgttcccggccaccgtcgacgggacgggcgcgggccccggcggcgccgaccggacctggacacgtatagccgtcgcccccgacagcggctgcaaggacgccttcgacccgctgctgcgcaaagccctcgcgcccgtcggctgcctgcgcctgctgcgcgccacctacatggacgcgacccgcagccatgtcaccaccgtcggcctgctgttcaccaaggcggacaccaccgccatgagcgctctgaaaacccgcttcaagacggaggacctcggccggcgcacggacctgatgccccggccgtacgccgccaagggcaccgtcgcggccggtttcggcgacgaccagcgcgcctcctggacgctgtcggtcctcacggacgctcccgtcgtcgtctacgccgtctccggcttcgccgacggccgcagcgtcaccgacccgcagcccgccgcggaggccatacaggccggcgccaccaccgcccccgcccaggccggcctcggccacgaggcgcagggcctcgccgaccgcatcgagcgcggcctccgcaagaccgtcacctcggccacggagaagccttcatgacgcgccggcccacagatgtccgcaagccgtccaaagaccgcgccccgcgccggaccggtgcgcgcctgctcacgctcctcctcgccggctccctggcgctgctgcccgccaccacggcccacgccgacggcatacgcgccaagcagtgggccctggacgccatgcacacccagcaggcctggagcacgaccaagggcaagggcatcaccgtcgccgtcctcgacacgggcgtcgacgacgaacaccccgacctcgcgggcaacgtcctcaccggcacggacatggtcggcttcggcgcccggcgcggcgaccgtgcctgggcccggcacggcacggccatggccggcatcatcgccggccacgggcacggcgtcggcgacgccgacggtgtcatgggcatcgcccccgaggccaggatcctgcccgtccgcgtgatcctcgaagacggcgacaacgcccgtgcgaaggcccgcaacacccgtggcaacgcgctggccgaaggcatccgctgggccgccgaccacggcgccgacgtcatcaacctctccctcggcgacgactccaagtccgcccaccccgaacccgccgaggacgaggccgtccagtacgccctgaagaagggcgcggtcgtcgtcgcgtcggccggcaacggcggcgagaagggcgaccacatctcgtacccggccgcgtacccgggagtgatcgccgcgaccgccgtcgaccgctacggcacccgagcctccttctccacccgccgctggtacgccaccgtcagcgcacccggcgtcgacgtcgtcatcgccgacccggaccacaagtactacgaagggtggggcacgagcgccgcgtccgccttcgtctccggcgcggtggcgctcatcagggccgccgatccgggcctgaccccggcacagatcaagcagctcctggaggacacggcccgcaacgcccccaccggcggccgtgacgactcccgcggcttcggtttcatcgaccccgccgccgccatcgaggccggcgcccggctcaagaccgaggggctgcactcgacggcatacggcaagcggtacttcggttccggtcccgacaccgcggaggactccggcgattcccccggctgggcgggtccgctggcgggcggcctgggcgcggcactgctgatcgcggcggtggccctgtggcgcggccgcaacaggcgccgcccccacggtttctgacggtttccggacgcggccggtttccggacacggcccgggtacgggctacccggcgctgtcctcgaacgccgacagggccgcctgcgccgccgcctccaccagcgaaatccccttcgccttcgtggtgttgccgttcgacagcaccgccatcaggtacgcgtgtccgttcaccgtgacccggccgatgctgttgatgtcccacaggccggtcgtgctccgcgccagccacccgttcttcagggcccacttggtgccgtccgccgcagccgacacaccccagtgctggtccgtcgctatctcgcccatgagcccctgaagatacgtccgcgaggcctcgctcagctcggagtcgtccccgaacacctgctggagcagggcgagttgatcggccgccgtggtctgcgtcagcccccacagctcgccgtccccgccctcggtcccctcgagcccgaagcgctggttcgcggatcccagcccgtccgcccggccgatcgcggcccacagcgccgacgcggacgtgttgtcgctgttctcgatcatctcggtggcgtacgtcttctcccgcgccgtcagctgccggttcgcgtcctgcgcctggagcaacagcgtcgccaggatgtcgaccttgacgatgctcgccgtgtcgaaggtgccgtcgccgtacgaggcgctgtcgccggagtccgggtcgagcacggccacggacacgtccgcgccgtcctccacggtcaccgacttcatggccttggccagcagcgcgttccggtccacggacgggtcagccgcgggttccaccgatgcctcctcgctcgccggggccgaagccgagggtgtcgccgacgacgatacggtgcccgcgtcggcgtgcgcctgtgccttcacgtacgcggtccccgcggccgtaccgcccacgatgacggcggtggcgagaacggtgtagagcagcggacggcgacggggcggacgagcgcggcggtgagctctgtgagactccatgcccgcgagcctggagcccggtcctgtgcgcgccgttagacgaaagttagaggcgtgtcagggaaatctgagaaacccgtgaaaggcgtgaaccccgcgtttcagggtcggcacaagcgcagcagagaccccccgatagggtcggtgaccgtggcgaacaagaacattcccgactccggcttctccgacgacgacggctccgccgacccccggctgagcgcggcgctcgccgcctgggccgaggaccgcacggccgtcggcccggtcctggacgcgctcaagggcgcccgcctgctcgtgcccgtggtggccgtgctcggcgaggtcgaggaggacgagaacgggctgcgccgcgagaagaccagcgacatggcggtgccgaccctgaaggccgggaaccgcaccgcactgccggccttcacctccaccgagtcgctggcccgctgggacccgcaggcccgccccgtcgccgtccccctgcaccaggcgctgcaggccgccgtgcacgagaaggcggacacgatcgtgctcgacctggccggccccgtcgcgtacgagctgacgggccccgcactgctcgccctcgccgagggacggacgacgacggacccgctcgcggaccccgccgtggtcgacgccgtacgcaccgccgtcgccgccgtgcccgcggtccggcgtgcccacctcggtcccgggcaggcggacggcaccctggctctcgtactggatccggccgcggcgccggccgaggcagcccgcgcggtcgccgagcggctggcggccgacacaacgctgagggcccgcctggtgcgcgggctcgacctggcacttctgccggccgaggccacgccgccgggcgagcccctcttcgtgcggagctaacgaacgttcgttagccaaaagactgtggaagcggcggaggctgcgacgaacgttcgttagctaaacggcgcagccgcaaccgcaagccgtcgcaacgaacgttcgtaaggcaaaagctccgtcagccaaaagcgccgtcagtcgaagcgcagtcagccgtagaccgcgcccgtgtacttctcgcccggcccctggcccggctcgtccgggacgagcgacgcctcgcggaacgccagctgcagcgacttcaggccgtcccgcagcggcgccgcgtggaaggagctgatctccgtcgtgctcgcgtcgagcagaccggccagggcgtgcaccagcttgcgggcctcgtccaggtccttgtgctcgtcgccctcctcggtcagaccgagcttcacggcggcggcgctcatcaggttcactgcgaccgtcacgatcacctcgaccgcggggacctcggcgatgtcgcgggtcatggtgtcgaagtcgggagtctggggaggggtgtcactcatgtcccacacgataggccccggcgcgcccgcccccgactgcgggacccggccccgaccgcgggagccgggcgacacctggttagcgcacgcatcgcggaactgctaaccttgtgtaacgaccggtcggacacgcatgtgcccgacccacaagtggaggctccgatctcccacctgactgtcctccgggacggcgggtcacccggtcaggcggtcaccatcgttccgtacggacgatggaatcgcccgaaagcgcgccccgcggttgaccgcggcggtgctccggtagttcttggagccccgcctgtgtcccgtccggggcatttttcatgcccctcgacagttggtccaaatgtcgtcaggacatacgcggctgtccgccagaccgccgtgtggtgctaccgaggaggatccatcagcacagagccccgcatcaacgaccggattcgcgttcccgaggtgcgacttgtcggtcccagcggtgagcaggtcgggattgttccgcttgccaaggccctggagcttgcgcaggagtacgaccttgacctggtcgaggtggccgcgagcgcgcgcccgccggtctgcaagctcatggactacgggaagttcaagtacgagtcggccatgaaggcccgtgaggcgcgcaagaaccaggcgcacacggtcatcaaggagatgaagctccggccgaagatcgacccgcacgactatgacaccaagaagggtcacgtcgtccggttcctcaagcagggcgacaaggtcaagatcacgatcatgttccgtggtcgcgagcagtcccggccggaactcggctaccgactgctgcagcgtctcgccacggacgtcgaggacctcggattcgtcgagtcgagtccgaagcaggacggccgaaacatgatcatggttctcggtccgcacaagaagaagaccgaggcgatggccgaggcccgtgaggcccaggcggctcgcaaggccgaagcgaaggccaaccccggccgctcgcagaacgccgccgacgaagacatccccgagggcgagcttcccgagggcgaggtccccgaggccgagaccaccgaggccgccgaggccccggccgaggcttccaccgaggcctgatcccagggcgaaggccccgggatgccaaccgatacacatgacgttccactgtgcccggtttcacgaccgggcatcggaacgccactgacgaggagagaacggcgctatgccgaagaacaagtcgcacagcggtgccagcaagcgcttcaaggtcaccggctccggcaaggtgctccgtgagcgcgccggcaagcgccacctgctcgagcacaagtcgtcgcgcctgacgcgccgcctcaccggcaacgccgagatggccccgggcgacgccaagaagatcaagaagcttctcggcaagtgacgcatcggcgcctaggcgccgtacgtcaggaccgggacccaatcgatttcgggccgtgtgaccacacccacggccccgctacaaggagttaacaagtggcacgcgtcaagcgggcagtcaacgcccacaagaagcgccgggcgatcctcgaggcggcctccggctaccgcggtcagcgttcgcgcctgtaccgcaaggccaaggagcaggtcacccactcgctggtctacaactacaacgaccgcaagaagcgcaagggcgacttccgtcagctgtggatccagcgcatcaacgccgctgcccgcgccaacggcatgacgtacaaccgcctcatccagggtctgaaggccgccaacatcgaggtggaccgcaagatcctcgcggagctggctgtcaacgacgcgggcgcgttcgccgcgctcgtcgaggtcgcgcagaaggccctgccgtcggacgtgaacgcgccgaaggctgcgtgacgccggcgtcggctcgagcctgaatcggacccgcaggccttcgaggcctgcgggtccgtgtgcgttcccccgccgccgcggacagcagacccccacccccataaacccgaaggtgacgtaacccccatgtcggccgcccccgagctgatctccccgcgctctcctcgtgtctccgccgcgcggcggctcgccaagcggaacttccgggggaaggaacagctgtttctcgccgagggcccgcaggccgtgcgggaggcggcggcgcaccgcgccgcggacgccgccacgctcgtcgagctcttcgcgaccgccgaggcggcggagcggtacgccgacatcatcggggaggcccgggacgccggggcgcgcgtgcacctcgcggacgaggcggtgatcgccgacatctcgaccaccgtgaccccccaggggctcgtcgggatctgccgcttcctggacacccccttcgaggagatcctcgcggcccggccgaggctcgtcgccgtactcgcccatgtgcgcgacccggggaacgccggcaccgtgctgcgctgcgccgacgccgccggcgccgaggccgtcgtactgaccgacgcctccgtggacctctacaaccccaagtcggtgcgcgcctccgtcggctcgctgttccacctgcccgtcgccgtcggcgtgcccgtcgaccaggccgtcgccggactcaaggacgcaggcgtgcggatcctggccgcggacggcgcgggcgacgacgacctcgacgacgaactcgacaagggcaccatgggcgggcccaccgcctgggtgttcgggaacgaggcctgggggctcccggaggagacgcgtgcgctggccgacgccgtcgtgcgcgttcccatccacggaaaagccgagagcctgaacctcgccacggccgccgccgtatgtctctacgcgtccgcccgtgcacagcgcgcctccggagggtgccgctccgtcacggacagctagtagggtgacgggctcgggagccctcccccaagctctcggctgcgctggagcagggaggtacccccaacgccggacgagaggtggggtaaggggatgagtgtcggcacgagcggtgcacagaaggcgccgcgagcacaggacgtgcgcggcacacccgcgtcccggcgcggtgatctggccgaactcggcatcgaccccgacgaactgcccgacggactggtcgtggcggacgaacacgggcgggtgatctgcttcaacgccgcggcggcccgtatcaccgccgtgtccgccgccgacgccctcgggcagcggctggagcgcgccctgccgttggaggacctcgaaggccgccgctggtggcagctgaccgacccctacggcggcctcgcgatccgcgtcgcacagcccgagcgcaacctgctgctccccggcggccgggaagtcctcgtgtcggtgcgctacgtgcggacgaggcccaccgggccggtccgccgcctcgtcgtctccctgcgggacaccgaagcccgtcgtcgcaccgagcgcagccacgccgagctgatcgccaccgtcgcccacgaactgcgctccccgctcacctcggtcaagggcttcaccgccacgctgctcgccaagtgggagcgcttcaccgacgaccagaagaaactcatgctggagaccgtcgacgccgacgcgaaccgtgtgacgcggctcatcgccgagctgctcgacatctcccgcatcgactccggacgcctcgaggtgcgccgtcagcccgtcgacatcggcgcggccgtcgggcggcacatccaggcgtacgtcgccgcggggcagcccgccgaccggttcctgctccgcatagagcagcccctgcccgccctgtgggccgaccccgacaagatcgaccaggtgctcagcaacctcctcgaaaatgcggtgcggcacggcgagggaaccgtcacgatcgacgtaacgccctcggcgtccccgcgcgagcggacggacgacgagggcactgcgcacgctgccacgtcggtcacggtgagcgacgagggtcccggcatcccggaggagtccatgaaccgcgtcttcacccgcttctggcggggcagcaagcgcggcggcacgggcctcgggctctacatcgtcaagggcatcgtcgaggcccacggcggcggcatcacggtcggccgcgcccccggcggcggcgccgaattccgatttacgttgcccgtggccaccccggcgtatctgctgtagcgccgcagaggcccacgggcgcacgtcgtaccggagccacccctcggactgcgcgtccgaggcaggctcccaccccgttagactcggcctttggcacctttgcgtcctctcatctgtggacgattcgtctccgagtcgtggacggggaccatccgccagccaaccggaagcacgggaagagatgtcggcaccgaataagtcgtacgaccctgtagaggtcgaggccttgaaaccggaagagatcgagcgcatgcgggacgaggcgctcgccgccttcgcggccgccggcgacctcgacgcgctccaggaggccaaggtcgcccacaccggcggcacctcgccgctggccctcgccaaccgcgagatcggcgccctgcccccgcatgccaaggccgcggccggcaagctggtcggccaggcccgtggcgccgtgaacaaggccctcggcgcccgccaggccgagctggaggccgagcgcgacgcccgcgtgctggtcgaggaggcggtggacgtcacactgccgtacgaccgcgtaccggccggcgcccgccacccgctgaccacgttcatggagcgcgtcgcggatgtcttcgtggccatgggctacgagatcgcggaaggccccgaggtcgaggcggagtggttcaacttcgacgccctcaacttcaccccggaccacccggcccggcagatgcaggacaccttcttcgtcgagggcccgaagggcaccgaaggagacgagtccggtgtcgtgctgcgcacccacacctcgcccgtgcaggcccgcgccatgctcgaccgcgagccgcccgtctacatcgtctgccccggccgcgtctaccgcaccgacgagctggacgccacgcacaccccggtcttccaccagatcgagctgctcgccatcgacgagggcctgaccatggccgacctcaagggcaccctggaccacatggtccagacgctcttcggcgcggacatgaagacgcggctgcggccgaactacttcccgttcaccgagccgtccgccgagatggacatgctctgctacgtctgcaagggcgagtccgtcggcaaccccgaccgtccctgccgcacctgctccagcgagggctggatcgagctcggcggctgcggcatggtcaacccccgtgtcctcaccgcctgcggggtggacccggagaagtacagcggattcgccttcgggttcggcatcgagcggatgctgatgttccgccacaacgtcgaagacatgcgagacatggtcgagggtgacgtccggttcacccggccgttcgggatggagatctgatgcgggtcccgctttcctggctgcgggagtacgtcgacctccccgccaccgagaccggccgcgatgtgcaggccaagctcgtttccgccggcctcgaggtcgagagggtcgagcagctcggcgccgacctcaagggccccctggccgtcggccaggtgctgaccatcgaggagctggagggcttcaagaagccgatccgcttctgcaccgtcgacgtcggccaggccaacggcaccggtgagccccaggagatcgtctgcggcgcccgcaacttctccgtcggcgacaaggtcgtcgtggtcctgcccggcgccgtcctgcccggcaacttcgcgatcgccgcgcgcaagacgtacggcaggacctcgcacggcatgatctgctccggcgacgagctgggcatgggcgacgacggctccggcggcatcatcgtgctcccgccggagtacgaggtcggcaccgacgccatcgagctgctcgagctggtcgacgaggtcctcgacatcgccgtcacgcccgaccgcggctactgcctgtcgctgcgcggcatcgcccgcgagaccgccatcgcgtacggcctgccgctgcgcgacccggcgctgctcgacgtgccggccccgaacgcgttcggccacccggtgaagatctccgagccgctgggctgcgaccgcttcaccgcgcgcacggtgaccggcctcgaccccgaggcgcgctccccgatctggctccagcgtcggctccagaaggccggcatgcgctcgatctcgctggccgtcgacatcaccaactacgtgatgctggagctgggccagcccctgcacgcctacgaccgctcccgcatccagggcgcgatcggcgtgcgccgggcggagcagggcgagaagctcaccaccctcgacggcacccagcgcacgctggacgccgaggacctggtcatcaccgacgaccgcgggcccatcgggctcgcgggcgtcatgggcggcgcccacaccgagatcgacgacaccgagggcacgaccaccgaggtcgtcatcgaggccgcgcacttcgacccgatctccgtcgcccgcacggcccgccgccacaagctggcctccgaggcgtccaagcgcttcgagcgcggcgtcgacccgctggccgcctccgccgccgcccagcgcacggtcgacctgctggtgctcctcgccggcggcagcgccgacgcgggcgtcacggaggtcatcacgccctccgcgccgcacaccatcaccatcccggcgaaccacccggaccgggtggcaggagtcgagtacggccgcgagaccgtcgtacgccgtctccaggaggtcggctgcgacgtctacgggcaggacgagctgctcgtcaccgtgccgtcctggcggcccgacctgaccgacccgaacgacctggccgaggaggtcatccggctcgagggctacgagaacctgccctcgaccctgcccaagccccccgcgggccggggcctgaccgagcggcagcggctgcaccgccgcgtcggccgcgcgctggccggcgccggatacgtcgaggcgccgaactaccccttcatcggggagcacgtcttcgaccagttcggcctcgccgccgacgacccgaagcgccgggtcgtcaagctggtcaacccgctctccgaggaggagcccgcgctccgcacgacgctgctgccgggcctgctcggcgcgctgcgccgcaacgacgggcgcggttcgcacgacctggcgctcttcgagaccgggctggtcttccacccgcgcgcggagcagcgcatcgcggtccggctgcccgtcgaccgccgtcccacggacgaggagatcgcctccctcaccgccgcgctgcccgagcagccccggcacgccgccgtcgtcctcgcgggcgcccgcgagcaggccggctggtggggcaagggccgcccggccgactgggccgacgcggtcgaggccgcacgcaccctggcccgcgaggcggggaccgaactcctcgtgcgcgccggccagtacgggccgtggcacccgggccgctgcgccgagctcgccgtcgtcctcgacggcgaggagaaggtcatcgggtacgccggcgagctgcaccccggtgtcctgaagacgctgggtctgcccgcgcgcaccagcgcgatggagctgaacctggacgcgctggagcaggcgagcgcgggcgtcgtgaaggggccccggatctccacgttcccggtcgccacccaggacgtcgcgctggtcgtcgacaagacggttccgcacgcggacgtcgaggcggcactgcgcgagggtgcgggtgaactcctggagtccatccggctgttcgacgtgtacgagagcgagcagctcggcgcgggcaagaagtccctcgcctacgcgctgcgcttccgtgccgccgaccgcaccctgaccgtcgaggaggcctccacggcccgcgacgcggcggtggcgctggccgccgagcgcacaggggcggcactgcggagctagcttcgccggaagtgccggggaactgctgggcgtcggccggctgcgggttgtccgtggccggccgcgcccatgcggcggagtcgcacgatgtcgtggctcagtggctcagtggctcagtggctcagcggctcggtggccccgcggcccccgacgggcccctcggccacctcactcattcgagtgacgattccgggcgatctggcccgatcggggcatgcggtcgaaagaatcggaccggccccgggggacgaggtggagctccgcgggccgcttctgcgcagctcagggcctgatggggggccatcggcatgatccgtatcaaggctggggttccctgcggaccacggccccgcgctcgtcccggcgaaggattcagggcggtcgtcgcccgcgggatcccgcgtgaccgcatgctccggcgccgctcgcgccgggagtcccggcgtttccggcgggcgctgtcgatagcgctgcccaccgtctggggcacgacggcgatcacctacaaactggcctgcccgctcgcgcagcagaacgggctcggcgcgcggatcgtcaccagcgccgtgttcttcgccgtcggcaccgggctgatccttcaggtccgacacacactgctgcgggagttgcgacaggcccgcaaggtcgcgggcgccgcccagagcgtgctgctgcggccgctgccgtcgcggatcggcgggctgaacatcgcggcggcccagctctccgccgaccgcggcgccaccgtcggcggcgatctgtacgaggtgatcgccaccgagcacggcgtacgcgtggtgataggcgatgtacgggggcacgggctggcggccatcgggacggtcgccgccgtcctcggcagcttccgcgaggcggtgcacgacgaggccgaactcgccggtgtcctccaacggctcgaacgggccatggtccggcatctgcgggagcgggccagagccgagcccccctcggcgggcccggatccggacagcctggtcgccgaggagttcgtcaccgtgctgctgctggagatccgccacgacggggaggtgtacgccctcaactgcgggcacccctggccgtatctcctcagcggcagccgggtggaactgctcgcgcgcgccgaacccctgcccccgctcggaccgttcccgctgcccgccgagctgccgtccaccagctgtggcccgcttcagcccggggaggcgctgttcctgcacaccgacggcgccgaggacgcgcgcgatgcccgtggccggttctttccgctggccgccgtcctcggcgaggtcgtgcggatcccggcggtgtcgccgcaggccgtcctgaaggccgtcttcgccgggcttctgcgccacaccggcggcagaccgtcggacgacgtggccctgctggtcctgcacaacgacccgcaccgcacctccacgacggcgaaccacccgatggctcaccacgtgcagtaggaacgcgacgtacccgcacccgcagccgacccgcccgaccgacgccccagccgacgacccgcagttccccggctcccccggcggagcccgccgggggagccgtccgccccgccacggagtgtcgggcaggcagccgggcggacggcgcggtatcgggccgccgcactgtacgagggggagccggcggcccggccggcctcttacgaggcatttcagtcaagcggtcggaaactctccgcaacagcgcgcgcacagcccggattcgagcactccgttcacaccccgtgcgaaggcggacgcactactctgtcggcaccgagccaccggagggcattcatgcagcccaacactctgctcgacgcgatcctcgacgaggccgggatctcccacgcgggactcgccgcgcacgtcaaccaggtggggagggcgcgtggtgttgccctcaggtacgaacacaccgccgtggcacggtggttgaagggccagcggccgcgcggccaggtgcccgacctgatctgcgaagtgctcgcggccaggctgcaccgcccggtgacgctcgacgacatcggcctcggcgttcccggtgaaccgtccgccccccacgcttccacgctctccggcttcgtcgagcgggccaccgccctgtggcgctccgacgaacagcagcgcccgcacatcctcggcgcccccgccgtcaccggaacgcctgccgtgatgccggtctgggagtgggagaacccgcccgaggacgtggacgtctcgcgcggcggccggcaccgggtcaggatggccgacatcgagatgctgcgcgcggcccgcgcccactacgagcagatgtaccgcaaggcgggcggcatagcgacccgcacccgcatcgtcggcttcctcaactccgagacggcacccttactgcgcggcagttacaccgacgccaccggccgtcaactgcaccgggccaccggcggcctggtggccatcgcgggcatctgcgcgtacgactccgacgcccacggcctcgcccagcgctacttccaccaggcactccggctggcgaaggccagcggggaccggggactcggcgcctatgtcatagccctgctggtcaaccagtcgctgttcatgcgcgaacaccggcaggccgtcgccttcgccgaggccgcgctgcgcgccgcgggcaagcacatcactcccgcgctcgcctccgacctctacgcgatgcaggccaaggcgtacgcgcacctcggcgacggtacgagcgcgctgtcctgcatccggcgggccgagcaggcggccgagcgcatccggcgcggctacgagcccgacgagaccggttatgtccagcccggcctggtcaacgtccaggtggcggaggcgctgctcagcctcggcgacctggtggcggcgggcgagcacgcggcggccgccgtcgacacccccgcccatgaccgggggcgggtgcaccggctcgcgatgctcagtcagatcgagctccgccagggcaacgccgacaaggcggtcgccacggcggtcgaaatggcggaacaggcgcgcgggatggagtcccagcgcctgcgcgacagactgcgggcggtacgcgaacatctggcgcgcagcggctgcgcgggcacggccgaggccgccgaactgatcgacggggcactgcgcgtaccgctgtagacgaaccggccccaccccctgcgggggaaccccgcccccctcggggcgcgggcgactgcgcctgccgctgcgctgcgagcgcgccgctgtgagcctgctgagtggacgctcctgctgcgatattgccacttactcggcggaaggtggcagaaccgtgcagtggacgaaacagaacgaacaaactgtgtatgaaaaccgctggttcagcgtcaatctcgcggatgtcgagctgccggacggccggcacctcgatcacttcttgatacggctgcggcccgtcgccgtggccaccgtcgtgaatgaggccaacgaagtgctgctcctgtggcggcaccgcttcatcaccgacagctgggggtgggagctcgcggcgggcgtcgtcgaggacggcgaggacatcgccgtggcggcggcccgtgaactcgaggaggagaccggctggcgaccgggacccctgcgccatctgatgagcgtcgagccctccaacgggctcaccgacgcccggcaccacatcttctgggccgacgaaggcgtgtacaccgggcaccctgtggacgacttcgagtcggaccgtcgggagtgggttcccctcaagctcgtacccgacatggtcgcccggggcgaggtcccggccgccaatatggcggccgcgctgctcctcctgcatcatctgaggctcgggcaggacgctttgccctgatatcaccgcgtcctcgggcctcagtggcccagagcctgccagaccgccacggcgagcgcgcccacggccgtgatggccgcgaccgcgggcagtggccagcgggtgtgttccagtgtgacgacccgtgtgctcaggtcgtcgacatccttggcggtctgttccgcgcgatggctgagcagagccagccctccctcgacgcgggcatgtgccacatcgaggcgacggcgtaactctgcgacttctccgtggaccacgggatgctcggggtcggcggtcacgtgtccgctcctttccgtagtcgtcacatcccttgtgtacgcacggaaagtcaactcgcctggtggacgtgtggggagcgtgtgcgagcggcatatgcgggcccggcgcgcacacggtgtgtgaatggcgcgggcccggcaccacttttcggtgccgggcccgtggcggcctgggcctcacgctgcgcagtcgggcgcgggtcgtcccggcgcgtacggggtcaggcgtaggagtagaagcccgagcccgacttccggcccagccggcccgcgtccaccatgcgctggagcagcgggggagcggcgtacagcggttccttgtactcctcgtacatcgacgacgcgaccgaggccaccgtgtccaggccgatcaggtcggacagcttgagcgggcccatcggatgggcgcagcccagctccatgccgttgtcgatgtcctcacggctggcgatgcccgactcgaacatccggatcgcggagagcagatacgggatgaggagggcgttgaccacgaagccggagcggtcctgggcgcggatcgcgtgcttgccgaggatcttctcgacgagcccctgcgcgcggctgagggtgccctcggaggtggtgagggccgggatcagctcgacgagcttctgcaccggggccgggttgaagaagtggatgccgatgacctggtcggggcgcgaggtggcgacggcgagcttcaccagcgggatcgaggaggtgttggaggcgaggatcgcgtctggccgggtcaccacctggtcgagcacctggaagatctccgtcttcacctgctcgttctcgacgacggcctcgatcaccagatcgcggtccgcgaactcgccgaggtcggtggtgaagctgagccgggcctgcgtcgcgtcccgctcctcctcggagatcttgccgcgctcggccgccttggacagcgagttgaacagacgggtccggccgatctccagggcctcgccggtggtctcggcgaccttgacgtcaagaccggcgcgggcgcacacctcggcgatgcccgctcccatctggccgcagccgaccactccgacgcgttcgatgtcggtcacatcgtccctttcgctgatcatcgggctggcagggcccccgttgttcggtgcctgccccgatcgtgcacgttacccccgaagggacggtgatcgatcacccggggcgggcatgctggacagggagacgatccgtgaccgcgcggatccgcacggtggcgcggggccgcggcggggaggggtgtgcagatggggcgactgtcacgtcgggcgttcgcgatggccgcgctgacgactctcgggacggcgggcgacctggcggccgcgccacggggcggcccggcggccccgccgggccggcggcgcgcggccggcgagctgcggggcatgtggctggcgaccgtcgcgaaccgcgactggccctcccgcaccgggctcaccccggccgagcagcgcgccgaactgctggcccacctcgacaccgcggtccgtcgccggctgaacgcggtgttcttccaggtccgccccaccgccgacgcgctgtggccctcgccgtacgagccctggtcccagtacctgaccggcacccagggaaaggaccccggctgggacccgctcggcacggccgtcgcggaggcccatgcgcggggcctggagctgcacgcctggttcaacccgtaccggatcgccaaccacacggacccggccaggctggtcgcctcgcaccccgcccggctgcaccccgactgggccgtgccgtacggcgggaagctctactacaaccccgggctgcccgaggtccgcgccttcgtccaggacgcgatgctcgacgcggtgcgtcgataccgggtcgacggcgtgcacttcgacgactacttctacccgtatccggtcgcgggccagaccttcgacgacgacgcggcgtacgcggcccacggcgcggacttcccggaccgggcctcctggcggcgccacaacatcgaccggctcgtgagcgagaccgcggccctgatccggaaggtgcggcccgccgcacggttcgggatcagccccttcggggtgtggcgcaacgccgcgacggaccccctgggctcggacacacgggcgggcgtgcagacgtacgacgatctgtacgccgacacccgcacctgggtacgggagtgctggatcgactacatctgcccgcaggtctactggaacatcggcttcgccgcggccgactacgcgaagctcgtgccctggtgggcggcggtcgccaagggcaccggcgtacggctgtacgtcggcgaggccctgtacaaggccggggacccggcgcagcccgccgcctggcaggacccggtcgaactctcccggcacctcaccctcgccaagggttacccgcaggtgcgcgggcatgtcttcttctcggccaaggaggtcgcggcggaccggatcggcgcgctggcacgcgtggtcgccgaccactatcagcagccggcgaaacctccacgctgaactagagcgacccgaggggcttggggtgacggatttcggagtccgggcccggtgaacacactgcctcgtgcccgtcctggaagcggacgcggtacgggggagtgccctcggcgcccattacttcgacgatctctgcgatcttgtcgtgctgcccgacgaccctgccgtgctgcacgagctggtcgccctcagtcgcatgcatctgaagggcctcctcgtcatgtgcctcgtcatgtgcgggagtagcggtcagtcaccgccagtctacggctgcccgcctcggttgccccgggccgtgcatgccgctcagcctcgcgctcgctgggtgaccgcgatgcagaccagtacggccgcggccgtcagcggggcggccggtgtgaggtgctcgccgaggagcagtaccgaccacaccagtgtgagcagcggctgggccaactgcaactggctggccttcggaatgccgatcgcggccataccgcggtaccagacgaccagccccaaaaactgcgaacccgccgccacccacagcagcccggcgacactgtgtgccgccagctgtaccggctcgtacgccagggcgaccagcgcgcccggcaccgagagcggcaggcacagcaccagggcccagccgatgacctgccagccgggcatcacccgggcgagccggccgccctcggtgtagcccgccgcgcagaccagcagcgccccgaagaggtaggcgtccgcgctggtcagggcgccgccgctctgctgcacggtgaacgcgatgacggcggcggcgccggagagggccgcgatccagaaggtgcgggaagggcgtgcgccggtgcgcagcgccgagaacaaggcagtcgtcaaaggcagcagcccgacgaccacggccgcgtgcgaggtggtggccgtctccaacgcgagcgtcgtcagcagcgggaagccgagcacgacgcccgcggcgacgacggcgaggcccgcccagtgccgccgggcgggcagcggtacgcgcagcgccagcagacagccacccgcgatgaccgcggccagcaggctgcgcacggtgacgagcgaccaggggccgaagccctccaggccccaggcggtggcgggaaaggtgagggagaaggcggtgactccgagagcggcctggagcgtgccggagcggtgggggagggaagcggggcccgcgccggtggtgtcccgtgggagggaagcgggatccacgccggtggtgtcccgcggaagggccgcggggtgcgtgtgcgccgtgctcctgggctgggtgggcaccgctatcggggtatcggcagtagcgctatcctgtgctctcatgcaagagcgtagcagcgtcggtgatctggcaaatcgtctgcggacggacctgaaccgctactctcccggtgagaagctgccgtcgagccgggcgctcgtcgagcgattccgggtgagtcccgtgaccgtctcgcgggccctggcgcaactggtcgccgagggcttggtgatcacgcggccgggcgccggggccttccgggccgagccgcggcgggcccccgccaccgtgggggacaccgcctggcaggaggtcgccctcagcgccgacgccgccgccgaactcgtgccgcgcaccgtcgacgcctccggcgtgctcgtctcgctcgccgcaccaccggccggggtcgtcgagttcaacggcggctatctgcacccctccctccagcccgagcgggcgatgggcgcggcgctgtcccgggccgggcggcgccccggggtgtgggcgcggccgcccgtggaggggctcggggacctgcgcgagtggttcgcgcggggcatcggcggcgcgatcaccgcggccgaggtactgatcgcggcgggcggtcagtcggcgctgaccaccgccctgcgcgcactggccccgcccggcgccccggtcctggtcgaatcacccacgtaccccggcatgctggcgatcgcccgcgcggccgggcagcggccggtgcccgtccccgtggacgccgacggggtgaaacccgccctgctcgccgacgcgttccgggcgacgggtgcgcgcgtcttcgtctgccagccgctgttccagaatccgacgggcgccgtcctcgcacccgagcgccgtggtgaggtgctgcggatcgcgcgcgacgccggggcgttcgtggtcgaggacgacttcgtacgacacctggtgcacgaggacgccgggccgctgccgccgccgctggccgcggaggaccccgacggggttgtcgtacacgtccgttcgctgaccaaggtgacctcgcccagcttccgggtgagcgcgctggccgcgcgcggaccggtcctcgagcggctgcgcgccatccaggtcgtcgacaccttcttcgtgccgcgcccgctccaggaggccgcgctcgaactcgtcggatccccggcctggccccgccatctgcgctccgtcggcgtcgagttgaggaaccgtcgggacacgatgaccgccgcactgcgcctgcacctgcccgaactcgccctgccgcacatcccgtccggcggctaccacctgtggctgcggctgcccgacggcgcggacgagccctccgtggtcgcgggggccctgcgcgcgggcgtggcggtcacgcccggccgcccctacttcagcgccgaaccccccgccgcccacctgcggttgagcttcgcgggggtcgcgggaacgggagagatcacggagggggtgcgcaggctgcgtaccgcgtgtgacgcggtcctctgaggcagcggcaccagccgcggcatcgcacccgcccccgacgacggccccgtccaccaggcgaaaaccgatcgacgcaccgcacgtccgcctgcgaacctcccggcatgactgacgcacaacgcctgcccggcggctacgaactctccaccgaccccgcccggatcgacctcgaccgtgtccacggctggctgtcggccgacgcgtactgggcgatcgggcggccccgcgagaagcaggagcgcgcggtggccggctcgctcaacttcggggtgtacgcggcggcttcgggcgaacaggtggcgtacgcgcgcgtggtgaccgaccgggcgacgttcgcgtggctctgcgacgtctacgtcgacccctcggtacgcggcaaggggatcggcaccgcgctggtcggcggcgtacgcgcacacctcgaacccctcgggctgcggcgcgtcctgctcgccaccgaggacgcgcacggcgtctacgcgaagctcggcttcaagccgctcgacacgccgggccactggatggcgctcgcgttcgaacagtagaccgggcgagccgtgtgacctcgtggatacccttggtaactcctgagtaacacctcttgacctgcgcacttgtgagcatcacgatcgccgcatgcatcttcgggtcacattcgtcgccaccgcgcgcagctcctcgctgctcgcggagcgcttcgaggaggaccggccgctggaccaggccggctgggacgcggtgcagcgggccgccgctgagctggtgccgctggcggccgccgagctgcgctactgctcgccgtccccgggcagccgggcgaccggtgacgcgctcggctatgccccgctcgcccagctcgcgctgcgcgactgcgacatgggccggtggcgcggtctgacgctgggcgaggcgatggcccgtgagccgtcggcggtcgacgcctggctcgcggatccgcgctccgctccgcacggcggtgagccgctgatgtccttcgtctcccgggtggggcagtggctcgacacccggcccgcggacgacggcagccagatcgtcgccgtggcggagccgtcggtggtgcgggcggccctggtccacgcgctgcgggcccatccgtcgacgtactggaacatcgacgtccgcccgttgtcgacggtcacgctcatcggcgccaacgggcgctggaacctccggctggaggccggactccagcgcgtctagacggtcgcgcgcccagtcggttcttcgcgcgcgtagtcggtcgtgaggatcaggtccttggccggtccgccgacccgccacaccgtccgccagcggtcctcggcgtacacggtgaactcgccgcggtagaggtccgcggcgcacgggtggtcggcgacatggtgcccggtggtcaggtcgaggacgtggaaggggcgcccgtcaccgaaccgtacgtccgacatgccgagggtctccccgggcaggaaccacagcgttcgctcggccggtctcgcggcgccctgccacacgaacgtcccggactcctgatgcagcagcccgccgccgccgtcctccaggggtgagaagacggtcgtcccggtgaagtgcccttcggccccgcccgcgagatcccgcacggtgcgctccacgcgccagcttcccgtcagataccccagggcatcggccaccggccagaactcacccatcggctcccttccttcgtacggcggtttgaccctaccgggccgggtgcgagcgccgacggcgcaggcggcgccggggccttgggcccggccgggcgctgtgcccgtggctcggccgccacatgccgtccggcgactcgacgggggccgaccacggccagacagccggcgaaggccaggtacggcggcagcgcatccacggggagggccctgtgtccgacccattgacgcactccagccccctgcctatcttgccgttcgatgtactgatcgcagttcgaaatatcgaacctcagaccctacagagccgcggagtatccatgtcacccacccgcacccgctggagactcggactcacagccgccgcgttactggtggcctcggtcggcgttcccgcgcccgcccacgccgaagacatcaccgactacgcgatcgccgtcgatcccaagggatcgggggcgaagatcgacgacaccatgtacggggtgttcttcgaggacatcaacagggccgccgacggcgggctctacgcggaactcgtgcagaacaggtcgttcgagtacgcgaccgccgacaacacgtcgtacaccccgctcacctcctggaacacctccggtaccgcggacgtcgtcagcgacgacggacggctcaatgcccgcaaccgcagctatctggccctcggcggcgactcctcggtcaccaactccggctacaacaccggcatcgcggtcgagagcggcaaggtctacgacttctccgtctgggcccgcgccgaccaggccgaccccctcagcgtgaccctgcacgacacggacggtgacttggcccgggcccgccgcgtcaccgtgcgcggcggctgggccaagtacacggccaggttcaccgccggccgcaccagcaccaccggccggctcaccgtcgccgccgccggcgccgtcgcgctcgacatggtctcgctcatccctcatgacacctacatggggcacgggctgcgcaaggacctcgccgagaagatcgccgccctgcaccccggcttcgtccgcttccccggcggctgtctcgtcaacaccggttcgatgaggggatacgacgaggcgtcggggtacgagcgcaagcggtcgtaccagtggaaggacaccatcggacccgtcgagcagcgcgccaccaacgccaacttctggggctacaaccagagttacgggctcggctactacgagtacttccagttcgccgaggacacgggcgcgatgccgctgcccgtggtgcccgccctcgtcaccggctgcggccagaacaaggccgtcgacgacgacgctctcctcgagcgccacatccaggacacgctggacctcatcgagttcgccaacggcccggtgaccagcgaatggggcaggaagcgcgccaggatgggccatcccgagcccttccacctcacccacctcgaggtgggcaacgaggagaacctccccgacgagttcttcgcccgcttcacgcggttccgggccgccatcgaggcgaagtaccccgacgtcacggtcatctccaacgccggcccggacgacagcggtccgaccttcgacaccgcctggaagctcaaccgtgacgcggacgtcgacatggtcgacgagcactactacaacagcccccagtggttcctccagaacaacgaccgctacgacgcgtacgacaggaacggccccaaggtgtttctcggcgagtacgcgtcgggcggcaacaccttcaagaacgccctggccgaagccgcgtacatgaccggtctggagcgcaacgcggacgtcgtcaagctggcctcgtacgcaccgctgctcgccaacgaggactatgtgcagtggcgccccgacatgatctggttcgacaaccacgcctcctggggctccgccgactacgaggtccagaagctcttcatgacgaataccggcgaccgggtcgtgcccagcaccgcgagcggcacgcccgccctgagcgggccgatctccggtgcggtcggcctgtcgacgtgggcgaccaccgccgcgtacgacgatgtgcgggtcaccggcgaggacgggaccacgctgctcggcgacgacttcagcggtgacgcctcgcggtggacgcacacgggcggcggaagctggagcgtcgaggacgggcagtacgtgcagagcgacgtggccgccgagaacaccatggtctcggcgggcgacccggcctggcacgactacgacctgcgggtgaaggccaccaagaagtccggcaaggagggcttcctcgtcgcgttcggcgtcaaggacaccggcacctacacgctcgtcgccgcgcccgacgcggtgaactcgcggacggcgacgcctgtcgcaccggtgacgtccgtcttggagggggtggccgacaggttcacgtataccttcccggccaactccgtgacgttcctgcggatcaggcagaggtagccgcggcggccgtgggctgctgtccggcgggcggcagcccacgctcggcgaagaccttcttcgcgacgagggaggcgttcatcgccttgggtatgccgcagtacaccgccgagtgcagcagcgcctcgacgatctcgtccggcgaaaggcccacgttcagcgccgcgttgacgtgcacctccagctgaacctcacagccgccgagcgcggtgagcatgccgagcgtcaccaactggcggtcgcgcggggcgagtccggggcggtcgtagatgtcgccgaaggcccaggagacgatctggtggcccagttcgggattgatgtcgcccaaggcggcgacgacgcgctccccggcctcgccgtcgacctgcttcaggacccgcaggccgtgctcgaagcgctcttcgcgggtggtggcgtcgctcatgtcggttctcctggttccggctggccgagcagccgttcatagtggtcgatcttgtcgtcgagggcggccgcgttgcggcgcagggcgcggatgcgctccgccagctcggcgcggtgctcgcggagcatcacgagccggtccgggaccgtggcgtcgccccgcgagcgcagcagcgcgaaccgctgcatgtccgcgatcgacatgcccgtctcgcgcagccggagcagaaactccagccaggccaggtccgccgcctcgtaacggcgttggttgccggtggtccggccgacccgttcgatcagaccggccttctcgtagtagcgcagtgtgtcgtgcgacaggccggtgcgctcgacgacctgagcgatcgtgagggtcggttcccggtggagcgggaggggctgtccgctggtcatgacaacaacggtagaacctggagcgcactccaggtcaagcgcggacggcgaccacttccgaagtggccctgagctgcgcggaccgcaccgccgcggcgaaccggcgtgccggtgggcgcgggtgccgtggcggaggccgccctgtgatcgacgaccggtccactgatcgccgactgacgccggacaggccctagagcgccggcggtgccggcggcatcggcggtgcccaggccggctgcgccccgaagggcggcagggacgtgaaccgcgggtcgaacgtcacggtgggcgtgatccggcgcagcgcgtcgcgcaccagtgtgagcggatggtccgggaagtgcgcgtcccactcctcgtggtcggcgacgtggtacggcagggcgccctggaggtcgtacgcgtacggatggggcctgaagtaggcggccgggccgacctggttcagcacgacggcctcgcgcatcccggtcgtggccccctccccggcctgcaccttgacgaccgtgctgcaaccagccttcggtatcgtccaggagccgaggaagacctggccgtgaccgtccggccggcgcaccttgatcagctgccggacggccggcacaccggccacgtcgccggtcaccgcttcgatcagaccggcaccggcccgtgcggcgccctccgcgaggccgcgccgcagccggtccggttcgtggagcggggccggcaggtccgggacgagggggaagaagtgcagcgacaggacgagtccccgctcgtcggtccagagatccgcctcccgctgggtgaagcccgccgtattgatgcctgtgatcggtgtgcccatgggctcatcatcgcgtccggccaacggagttcggcacgcgggggagcgctgcacggggctcctcaccagtaggcccggtcgtcccaggactcgaagcgggcgaactcgaccgggtcgtcgtcctcgtccagaccggccaggcccggcgcggtgagcagaccgcgctgccaggcgaccagggtgtcgaccaggccgctctccaggcgcggcccctgcggcgcgtggcgcggccagacgatcaggggccaggtgtccgggtccgggccctcggccagccagccgaggtagtcgccgtcgatggaacaggcgaacgggaggaaaccgcccggctcgggccaagcgggcagcggatactgctccgggtagctctccctgtgcttccgatacccgcccgtggtctgctcgatgtgcgtgcgaaagcgccgctcgccggtccgcagcggggtgaggaagcgcagccactcgctccagcagcccgcgccgtactcgtccatcagcgtcacgtactcccgcggcagccgtgtgcccagctccgcgaagagggacgcccaccgaccgccgccgagatacggcgtcgcgggcggcgggcagagcagccgcagcgcagcgaggccggcgccggtctccagcgcgacacggcgctgcgtctcggtgaggcggggcgcggtccgcgcgggcggggtccaaggcgcggccgtcggcaggaacgcggtgcgggcgacggatccgggcagagggccgatcaaggggcccggcggcgaagggagttcccaggtgtcgcggaccgtgtgccgcagataggcgccgagggtgaggtcgtacgggtgccagttccgcagtccgctgcccggcacggacccggagtgccggacgaccacggtccaccggtcggggtcgtcggaactcgacgtgtcccagaagaagacgtcgctgccccggctgcacccccaggcgagcagcccgccgggcgcgggatggacggcgtaccgctcgtcttccgggaggtcgcgcaactcgatgcgcgccgcgcggtgcttctcgcgcagccagtccccgtagtcgaaccgtccttcctcggcacagggaccgtggatccacacgtactcaccgaagtccatgggcccgtggcggtcgatcagccgcttgtactcgcccggcaggcgcagcccgagccacttctcgaccgccgcccagtcgacggcgaggggcaccggcggccgctcggcgtgcggtgcggtgaagtcggccaggtcctgggtcacgggtggtcctccgggggtgagcgggcggggcgcacgacgattgtcccgccggcccgcgtccggagcgtgcggccgtcgttgccgcatcccgctaccagctccgccgccgaatcccgttgagatgccgccgtacgtcggggagagtctgtgggcatggagtgtcggtggcgatcaccgtccgaggggccgaaccgctcggccggcccgaggggtacggacggaccaccggcgccgatcttccggcaccgcatgccggcaccgatcccgagctggtcgacgtgccggaaagtcaccggatcgaacaactcgctgagggcgtcgaaccggatccccgcctccgcgtgccggttgtccagcaggcagccctgatccgcgccgtgctcgggcatctggcgattctgcttggccaagggcttgccgggtgccctccgcgacgacatccgcctgcaatggtcaggccacggcgcaggacacgctggacagcgctcggagagggaagggcttcaggggctgaagaggctgaggttgtcccggacgtaatcggccacccctgaaggaggccgcccggtgacctgctcgaccccttccgccttgcggtcgtatcgattctccgcatgaaggcgagccatggtggagatgtgctggaagacgtgatcgggcagccccagcggcctgagatcgtcgtcgatccattcctgcaaggggatgtcggcgtacctgaccggtcggcccagaactgtggagacctccgccgccatggcggcgatgtcctccgagcgcgggccggtcagctcatagatcctgccgatgtgcggggccgggtcggccaggatctcctccacgaccgcggcgacgtcgccggccgccacaggggaggacttcgcccggccgaagggcaatctgatggttccgtacttcgcgatcgaggagaagccgacacggaacagcgggttttccatgaacacggtgggcctgacctggacaacgggcaggcccgaccagtcgaggacctgctccgccagccactgctgccgttgctgcacggactcggaggtgctggtgaggtccatctcggagacagtcagctgcgacatgttcacgaacacttccaggcgcccgtacgcacgcgcgacggccgccgccgtcacggcagcctccagatactgcgccgagacactcatgccgaagtacatgcgtgcgcagccggccagggcgtcggcgacatcgcctgcgcgcgtcaggtctccgatgacgacctcggcgccggtcgcgcgcagcgcctgtgcccgctcgtcgtcgcgacgcaccatggcccggacgggcaggtcccgttgtcgaaggccttcgacaacggatcgtccgacggcaccgacgctgcccgccgcgcccgtcaccagaacgggcggcacaccggctccgggatgtggttcacatgggcagcctgcggtgcgcacagccagggcgcaaccggaaccagacgagcgccggcgcagcgccacccccgcgcccgccgcgagcgcgggggtggcgctgcgccggcactcggtcgttccgcataccgatccatgggattgcataaacgtgcagcgaaacgtatagtcatgccatccaagaggagggttccatggcggtacgagtggcagtggccggagcaagtgggtacgcgggcggagaagcgctgcggctgctcctcgcgcaccccgaggtcgagatcggcgccctgaccggaaactccaacgccggccagaagctcggcgcgctgcagccgcacctgctgccgctcgccgaccgggtgctccaggagacctcccccgacgtgctcgccgggcacgacgtcgtcttcctcgcgctgccgcacggccagtccgccgccgtcgccgaacagctcggcccggacgtcctcgtcgtggacatgggtgccgacttccggctcaggaaccccgccgactgggagaagttctacggctccccgcacgccgggacctggccctacgggctcccggagctgccgggcggccgcgccgcgctggaggggtccaagcgcatcgcggtgcccggctgctacccgacggccgtctcgctcgcgctcttccccgcgtacgcggccgcactcgccgaaccggaggccgtgatcgtcgccgcctccggcacctccggcgcgggcaaggcggccaagccgcacctgctgggcagcgaggtcatgggctccatgtccccgtacggcgtcggcggcgtccaccgccacacccccgagatgatccagaacctcggcgcggccgccggcgagcccgtctccgtctccttcacgccgaccctcgcgccgatgccccgcggcatcctcgccacctgcaccgcgaaggccagggccggcgtcaccgccgagtccgtacgggccgcgtacgagaaggccttcgccgacgaaccgtttgtgcacctgctccccgaggggcagtggcccgccacggcgtccgtctacggttccaacgccgttcaggtccaggtcgcgtacgacgcggccgcacagcggatcatcgcgatcagcgccatcgacaacctcaccaagggcaccgcgggcggcgccctccagagcatgaacatagccctcgggctccccgaggagctgggcctttccacgatcggagtcgcaccgtgagcgtcaccgctgcccagggcttcaccgcctccggcatcgcagcaggcatcaaggagaacggcaatcccgacctggccctcgtggtcaacaacgggccccgtctcgccgccgcgggcgtcttcacctccaaccgtgtgaaggccgcgccggtcctgtggtccgagcaggtgctgaagggcggcgtcgtctccgccgtcgtcctcaactccggtggcgccaacgcctgtacgggccccaagggcttccaggacacgcacgccaccgccgagaaggtcgccgagacgctggacctgaacgccggtgaggtcgccgtcgcttccaccgggctcatcggcgtactcctgccgatggacaagctcctgccgggagtcgagcgggccgtcgccgggctgtccgagcacggtggcgagaaggcggccatcgccatcaagaccaccgacaccgtgcacaagacgtccgtcgtgacgaaggacggctggaccgtcggcggcatggccaagggcgccggcatgctcgcccccggcctcgccaccatgctcgtcgtcctcaccacggacgccgacctcgaccgcgacgcactcgaccgggccctgcgcgccgccacccgcaccaccttcgaccgcgtcgactccgacggctgcatgtccaccaacgacaccgttctgctgctcgcctccggggcctccgaagtcaccccgaagcaggaggagttcgcggaggccgtccgtgcggtctgcgacgacctcggccagcagctcatccaggacgccgagggcgccagcaaggacatcaaggtcgaggtcgtgggcgccgcgacggaggacgacgccgtcgaggtgggccgctccatcgcccgcaacaacctcctgaagtgcgccatccacggcgaggaccccaactggggacgcgtcctctctgcgatcggcacgacccgggccgccttcgagcccgaccagctgaacgtcgccatcaacggcgtctgggtctgcaagaagggcggcgtcggcgaggaccgcgacctcgtcgacatgcgctaccgcgaggtccacatcgtcgccgacctcgccgccggcaccgagaccgccaccatctggaccaacgacctcaccgcggactacgtccacgagaacagcgcctactcctcatgagccacggacccacgcggaaacacaccgcccttcccaaagcccagatcctcatcgaagcgctgccctggctgacccggcacaacggcaagaccgtcgtcgtcaagttcggcggcaacgcgatgatcgacgaggagctgaaggcggcgttcgcgcaggacatcgtgttcctgcaccacgccggtctgaagcccgtcgtcgtgcacggcgggggcccgcagatcagcgcggccctggaccggcacggcatcgtcagcgagttcaaggcgggcctcagggtgaccaccgaggacgccatggacgtcgtacgcatggtgctcgccgggcaggtgcagcgcgagctggtcgggctgctcaaccagcacggaccgctcgccgtcggactcaccggcgaggacgcgcacaccatcaccgccaccaagcaccagcccgagatcgacggggaactcgtcgacatcgggcgggtgggcgagatcaccgagatcgacacgggcgcgatcgaggcactgctcgccgacggccggatcccggtcgtctcctcgatcgcccgctcccaggacgacggacatgtctacaacgtcaatgctgatacggcggctgcggcactcgctgcggcattgggcgccgaaaccctcatggtcctcacggacgtcgagggcctctacgaggactggcccgacagcgacgaggtgatcagtcgcctcaccgcctccgaactggagaagctgctgcccgagctggccagcggcatggtgccgaagatggagggctgtctgcacgccgtacgcaacggcgtcaccacggcccgcgtcatcgacggccgggtccagcactcgatcctgctggagatcttcaccgacgaaggcatcggcacgatggtcgtgccggacgaggaagagggggatgccgtatgaccggcaccgcgaccaacgccgagctgaccgagcggtggcagggcgccctcatgaacaactacggcaccccgcgcctgcccctcgtccgcggcgcgggcaccaggctgtgggacgccgacggcaaggagtacctggacttcgtcggcggcatcgcggtcaacgccctcggccacgcccaccccgcgatcgtcgaagcggtcagcacgcagatcgcctcgctcggccatgtctccaacctcttcgtcgccgagccgcccgtcgcgctcgccgaacggctgctccagctcttcgggcgcgacggccgggtctacttctgcaactccggggccgaggccaacgaggccgccttcaagatcgggcggctgaccgggcggtcccacatggtcgccacccagggcggcttccacggccgcaccatgggcgcgctcgccctcacgggccagcccggcaagcaggagccgttcctgccgttgcccggcgacgtcacgcacgtcccgtacggcgacgcgcaggccctggccgccgcggtcaccgaggagacggccctggtcgtcatcgaaccgatccagggcgagaacggggtcgtggtcccgcccgccggctatctgaaggccgcccgggcgatcaccgccgccaccgggtccctcctcgtcctcgacgaggtgcagaccggcatcggccgtaccgggcactggttcgagtaccaggcccacgagggcgtcctgcccgacgtcgtcacgctcgcgaagggactcggcggcgggctgccgctcggcgcgaccgtcgccttcggacgcgccgccgagctgcttcagccgggccaccacggcaccaccttcggcggcaacccgatcgcctgcgcggccggactcgccgtcctcgagaccatccaggccgagggcctgctggagaacgtgaagtccgcgagcgagaagctgcgcgacggaatcgagtcgctgggccacccgttgatcgcccacgtccggggctcgggcctcctcctgggtatcgtgctcaccgagccgctcgcgccccaggcgcagcaggcggctcaggacgccggtttcctggtgaacgcgcccgcccccgatgtcgtacggctgatgccgccgctgaacctcggcgacgacgaggtggacgctttcctccgggcgcttcccggcgtcctcgacgcggtcaccaacggggacggacgagccaaagaatgagacgacgatgagtcaggcgcaggagaacgagcacgcagggcctgccgtgccgcagacccgcaccgcacgccaccgccggatcgtggacatcctcaaccggcaaccggtgcgttcccagagccagttggcgaagctcctcgccgacgacgggctgagcgtcacccaggcgacgctctcccgggacctggacgagctgaacgcggtgaagatccgcaacaacgacggcgacctcatctacgcggtaccgagcgagggcggcttccgcaccccgcgggtgccgctgggggagtcggcgaaggaagagcggatgcggaggctctccgcggagctgctgatctccgcggaggcctcggccaacctcgtcgttctgcgtactccgccgggggccgcgcagttcctcgcctcggcgatcgaccaggccgagctgcacgacatcctcgggacgatcgccggggacgacacgttgctgctgatcagccgtgaaccgacgggtgggcaggcgttggccgatcacctgttgcggttggctcagaaccatcattgaggtggacgacggtggaggcgcgaccccggtcggggtcgcgcctccaccgatgtacgtcgcgttctggccgcgggccggatgtggccggtcgcgtggttccccgcgcccccggaagggacgctccggtcagccgagccgttgagcgaggcccccggtgcaccgcacctcgtcgcccgccgtgatgagcagtgcctccacgtccggcagcgactccagccaggccagcgcctcccgcgagcccatcgcgaaggcagccgtcgcccaggagtccgcccaggtcagccggggtcccaccacggtcacggcgaccaggtcggtgaccgcggaccgcccggtgcgcggatccacgatgtgcgcaccgcgctcggcggtcccggaggtggccacggccagctccgggaccccggcggcggagaccacggcggccagtgctcccgggcgcagcgggtccgacacgccgacccgccacggccggtgcggcccggggacgccgtacagctggacgtcaccgccgccgttgacgctcactccgctcgccccggccgccacgaggtgccgggccgcccgctcgaccgcccagcccttcacgatcccggtcggatcgagacgtccttcgtacctcgtactgaaccagccctcgctgacccgctccgcctcggcgcccagaccgagcacctcggcgacctccggatcgcactcctcgacggtcagctcaccgcgggcgagccgggagatctggctctgctcgcgataggtgctgaacacctcgtccacccggtggagcccggcgaccgcctcctccagcgcggtccccacggcctgggggtcgccgccgcgcacgtcgaaggagacgacggtgcccatgacctcctcggcgtgacgcagggcgggcgggccctgagccggcccgtcggccggctcagccaccggccttgtccagggccgactgcagggactgcttgtagccgtcgctggtgtaggtggcgcccgagacggtgtcgatgtcggcgctgccggccgcgaccgcttcctggttgagcctgggcacggccagctcggtcttctggctgctggtcccgccgctgggcgcctgcacggcctcggccttgctgatcttcccgccgctcacggtgacacgcacctggacgggcccgtactgggtcttgaccacactcccggtgaccgtcttggcctgggtggacgatccgccgcccgtcggggagggcgacgcggacgacgccccgccgccggtggccttggccttgtccagcgcggactgcagggactgcttgtagccgtcgctggtgtaggtggcgcccgagacggcgtcgatgtcggcgctgccggccgcgaccgcttcctggttgagcctgggcacggccagctcggtcttctggctgctggtcccgccgctgggcgcctgcacggcctcggccttgctgatcttcccgccgctcatggtcaggcgcacctggacgggcccgtactgggtcttgaccacgtctccggtgaccgtgccggactgagcggccgcggcaccgccctgggccgattcctgggccgcggccgtctgctgcggtgccgcgccgcccgccgccgacgcggacgccggatcggacgccggcttcagcgacagcagcagcacgatcccggacacggtggcggcggtggcgagcatgacacgccgaatggggtggctcttcttcatcgctcctgactcccgtcgctcacatctcgaacgactcgtgatggatgcggcgggcggggacccccgcgccgcgcagtgcttcgaacacctgctgcgcgaagccgggcggcccgcacatgaagacgtcgtgatcgtcgatgtccggcagcttccgggtcagggtctccgccgagatgtccgggcgctccccttccgggctgttgaccgcgtacatcagccgggcgccgcgctcctcggcgatcgtcgccagctcgtcccacagggccaggtcctgggtggtgttggcccggtagagcagcgtgaggtcgccggccgcgccgggcagtgtctcgaacagcgcccgcatcggcgtgatgccgacgccgccggccaccagcagcaccttgccgcggctgcgcttgtccgcggtcaacgcgccgtaggggccctcggcccacacgcgggtgccgggctccagttcgcgcagcgcggagctgtggtcgccgatcgccttcaccgtgatgcgcagcatgttggggcggggcgccgccgacagcgagtacgggtgcgagctgaaccgcatgcccggcgcgaggaagcgccagcggaagaactgcccggcctccgcgcccatgcggtgcagcttccgcccgctgatcagcaccgacacgacgccgggcgtctcctcgatcacggcctcgacccgcatgcggtgacgcaggttcagccggatcggcgcgaggatgcggtaccagatcaccagcgcggtcaccgacccgtacagcgcgtaccaggcggtcttcgcggccggctggacggcgaagtcgttgccggtggacagctggtgccagaacgtcaggaacacggccgcgtaggtgagcaggtggatgtggtaccaggcgtcgtacggcatcctgcggcggatcccgccgatcgagatcagcccgatgaacaccagcagaccggtgccgatcgcggcctggcccatgtccggcagttggttgatggagtcgatggtctgctggacgatgtcgttgaacgtcttgccggcctggagcgcgtacccccacatcgtcaggacgaggtgggcgaggaccaggcagagcgtgtaccggccgctcatggcgtgccagcgcgcgacccggtcggagccgacccggcgctccagcgcgggcacccgcgccatctggagcacgacgagggccatcagatagccggcgagcagaccggtgatccgtcccgcgttgaggatcttgctgttgtcgtccgcgatggacggggtgttgctccaccacagccagatgaccccggccgcgcccgcccagacggcgagcagcagcgggacggcgggtgagcggcgcgggcggatgcggcgcatggtctggcgccgcgcggcgcgaccaccggcgatcgtggacacggtttcctccgtggtcgtccgtggggacggggcgaggggagtggccccctggcccagagatacggtccacgacgcccgtgcgttcagaggcccgccgagtccagtgccgactggagtgattgcctgtatccgtcgctcgtgtacgtggcaccggagacggagtcgatctgcgcgctctgcgcggccagcgcctcacgcctgagctgggggatcgcgtagctgttgatctcccggtccttcgggttctcctggggacaggcgaccgcggtcacctcggtgatcacgccgttccgcaccgtgacacgcacctggacggggccccagcgggtctggaccgtgtcaccggtcacggtcctggtgcccgtgctcttcgtgccgccggaggagcctccggaggaaccgccgggagagctgccggaggactgggactgggactgggactggccggacggcgaggacgcctgggccacggccggtggcgtgtgcggcttcagcgagagcagcaggacgacaccggtgaccgtaccggcggccgccagcgtcacccggcgcagcggacggttcttcttcagggcgtgcacgacggcctcacagttcgaacgactcgtggtggatacggcggtccgggacccccgccgcgctcagcgccgcgtagaggtcccgcgccatcgcgggcggcccgcacaggtagacgtcgtgctcggcgaggtccggcacggtctcccgcagggactcggcggtgaaccgcggacgcgttccgtcggcgccgttgaccgcgtacaggaggcgcgccccacgccacttcgcgatggcctccagctcaccgccgagtgccaggtcctcggccgtgcgcgcccggtagaccagggtgacctggccgggcagggtctcgaacagggcgcgcagcggggtgatgccgacgccccccgcgatcagcagcgccttggacgccgtgctccggtcggcggtcagcgagccgtacgggccctcggcccacacccgggtgccgggccgcagcagccccacggcggcactgtggtcgccgagcgccttcacggtgatccgcatcaggccggcccggggcggcgccgacagtgagtacggcgtggaggtccaccgcatcccgtccgcgaggaaccgccagcggaagaactgcccgggccgggcgtccagttcgtccagccgttccccgcgcacgacgatggagaagacgccgggcgcctcccggtgcacggactccacgcgcagcctgtgacgcaggttgagccgcaccggcgcgagcagccggaaccacccgaccagcgcggccgtacccaggtagagcacgtaccaggcggcccgggccgcggagttcccgacgaggtcggagcccagcgcgagctggtggaagaaggcgaggaacacggccacgtacgtgagcaggtgcacgtagtaccagaactcgtggctgatccggcggcgcgccgcacgcgccgaggtgatcccgacggcgacgaggacgatcgtgccgatcgtggcctcgagcatgtccggatagtcgaacaccacgctcagcgtctcgcgcacgatgcccgccccgtcctgggcggcgtacccgaagaggatcagcgtgacgtgcgcggccagcagacagaccgtgtaccggccggccatcgcgtgccagcgggccacccggtcggagcctgtgcgccgctccagaaacgggacccgcgccatcagcgccaccagcaccgcgcagctgtagccgcacagcagcccggtgatccgcccggcgtccgtgagccatccggagaggcccaccaccgaccgcgtgtcgtaccaccacagggcgacgaccgcggcggctcccgcccagagcagggcgagcggcggccccgcgggcgagggccgggggcgctttcgcccttgtgtcgggcgcgggagagcggcccgctcgtacaccgtggtcatctgtccgtccttccggctgtccgggctgaaactgtgcgtccaaaacttctgaggaagctctgaacaggcgcgttcagcggggactcagaggaaaccgagagggacgaggagggcggactcagaggaaactcagaggccgcgggcgggggtgcgggctccgcgaggggtgatgctggaggacgacatgaacattccccgctcccgaggcaacggccggcccgcgctcacccggcccgacggcacccctgtacgcgtcctcgtcgtcgacgacgacccggacctggccgaggtcctctccggggccctgcgctacgaaggctgggaggtccgcgcggcgggcgacggcgcccgcgcggtcgacgaggcgcgggacctgctgcccgacgccgtcgtcctcgacgtgatgctcccggacaccgacggcttcgccgtgctgcgcgagctgcgcaccgtgaggccggacgtctgcgtcctcttcctcaccgcgcgcgacgccgtcgaggaccgcatcgcgggcatcaccgcgggcggcgacgactatgtcaccaagccgttcagcctggaggaggtcgtcgcccggctgcgcggactgctgcgccgcgccggcatggcccggcagctggacgaagggccgcggctgatcgtcggcgacctcgtcatggacgaggaggcccgcgaggtgacccgcggcggcgagctgatcgagctgtcgccgaccgagttcgaactcctgcggttcctgctgcgcaacccgcgccgcgtgctcagcaaggcgcagatcctcgaccgcgtctggtcgtacgacttcggcgggcaggcccatgtcgtggagctctacatctcctacctgcgcaagaaggtggacgcgggccgcgaacccatgatccacacggtgcggggcgccgggtacgtgatcaagccggtggcggggcgatgaggtcacggtggcggtcctgggcggggcgatggccacgggtgcgggcagtcgtgcgcgggctgccgcgtccgcgcacgatgcgggcgcggctcaccgccggactggtggtgctgctcgccgtcagctgcgccgccgtcggcgtcgccgccgtgtacgagctgaacggcttcctcaccggccgcctcgaccagcagctccacgacgtgggagtgcggttccccgcgagcctggagcacgggggcgacgcacccaggtcggaccacgacggagacgaacacggcgacacacgccggcagagcaccggcaccttcggcgcgcggctggtcggccgggacgtcaccaacgcggcggtcgtcccctccggcgcggacaccaccgacctcaacgtgaccctgaccaccgccgacgcgaaagccctggcccatgtcccggccgacggccggggacactccgtctgcctgtcggccctcggcgactaccgggtgatggcggcgcgcggactggaccgggacgtcctgatcaccgggctgcccatggagccggtcgacgccgccgtgcaccgcctggaactggtcgcctccggcgtgctcgccgtggccctcgcggtcgccggggtcgccggggccctgtgggtgcgctggtcgctgcgcccgctgaacagggtcgccgcgaccgccacgacggtcagcgaactcccgctcgccagcggcgaggtcgccctgccgccgcgcgctcccgaatccgacccgcgcagcgaggtgggccgcgtcgcgtccgccttcaaccgcatgctcggccatgtcgaggacgcgctgaccaaacggcacgcgagcgaggagcggctgcgcaccttcgccgccgacgccagccatgagctgcgcactccagtggcctcggtgcgcggtcacgcggaactggcgctgctgcatcccggcccggtcccgccgaaggtgacccgcgccctcgaacgcatcgccgccgagtccgcccgcatgggcgagatggtcgacgacctgctgctcctcgcccggctggacgcgggccgcccgctggagcggcttcccgtcgacctcacccgtctggtcctcgactcggtcacggacgcccgggccgcgggccccggccaccgctgggcgctgcgactgcccgaggaaccggtgacggtgccgggcgacgcccaccgcctccaccaggtgggggccaacctgttggccaacgcgcgtctgcacacgcctgtcggcaccaaggtgacggtggcgctggagtccgacggccggacggcggtcctgacggtgcacgacgacggccccggcgtccccgaggacatccagccgggcgtcttcgaacgcttcacccgcgcggaccgccgccgcacggacggcacgggcggcggcgccgggctgggcctgtcgatcgtggcggcggtggtggaggcccacggcggaagcgtcgcactggagagccgccccggcaccacgaccttcacggtccggctgcccgcccggtactaggccggcccgccggacaggctctggtccggacaggctctggtccggaccggacctagtaccgggtgagcgcggtcgtcccgctcgccgtcccgatggcgatgtgcggcagcctcgggggttcggcccaggtgaggatctgccgcatcgcctccgcgggcaccgacacacaaccggccgtggctccgctcccgttgacgtgcaggaagatccccgcgccgcgcccccgcaccggccgcgcgtagttgaagccgatgacgaaggcgtgcgcgtactgcgcctcgtaggagacgaggtgctcggactcggcggggcggcagtcggcggggcgcggctcggtccagcggttgtacgacagggagtcgttgtcctggcaccaccaggagtcctggtgcacccggcggtacgtggccgtcgtaccgctcggcgccgccttgatgccgaaggcgtacggcaggtcgtacaggccggtcggtgtggtgttcgtgccctgcttgcgggcggtgccctcgacgaggcccttcgcgccgaagcgggcggccgccgagccgcgcttcacccagtgtccgtcctgccggtcccaccaggtgaccgtgccggtggtcgcgtccgcgcggagcgcctgcgcggtgatcagctgggtgccgccgccggtgtcggccatcagctcgggcagggtggcccgggcggtgcccggcgcgccaccgagggtgaggagggagacggacgcgagggcggcgacgacaccagggcgcatggctcagaccgtagtgggcggcagcggcaacggcagcccgggtaggccatccaggctggtcgccacgtgctccttcttccggaagtaggcgctcagcgagtcgtcgtcctcgcgcgcgaagcgctttccgtgcagatcgcggtcctcgtcgtacgacatgaagggcaccgcgtagccgcaggtgtcccggacgagttccgccgtcaccacgatgatcgcgcgcaggccgtgcggggcggggtcgatgcgggggaagtgggtgagcagctgcccgaagcgcgggtcgtcgcggaagacgggctcgccgcggccgtgcacccggacgatgttcggcgggccctggaaggcgcaccacatgagggtgatccggccgttctcgcgcaggtgcgcgatggtctcggcgttgctgccggcgaagtccagataggccacggtcagttcgtcgatgacggcgaaggagcccgtgagccccttgggggagaggttgaccgtgccgtcgccggacaggggcgcggtcgcggtgaagaagaggtgctgcgcctcgatgaacgtacgcagccggccgtctatgcgctcataagtctttcccatgtctaacgattatcggggaagatctttcgcctgtctaaggaatggcgggatcgggtcgtgcgggtcgtacgggtcgtacgggtaccggcggtaccggcggtaccggaatccgtgcgggtaccggcagtaccggaatccgtgcgggtgcttgcagtaccggcagtaccggcagtactgcccgtaccgaaaccgtggccgccccggccggcgcttcgcggggcggccacagcgccgtgcactactcgttgagcgtgcaggcggccagggagtcgaggccctgcggcttctccgcggtgcggccgatggccgtggcgatgcggttgacggtggcgatccgcttgtcctccagcgggcccaggatggcgttctggacgaagttggcgccgccctggccgacggtgtcgacgagccgcttgttggcctcggcgatctgggtgtccaggagcgccaggttgcggtcgacctcggcctgcgcggtggcggggatcgcggggagctgcgaggccacgtcggggcagctgatggtcccgacgccggtcgcgtcgtcgccggtgtcgcccgcctcgcccgcgccgtcgtccgccgcgtccgtggccgtcgcgctcggcgccgccgtggcctcttcgccggccccggcctcctcgcccgcgcccgcctcgtcgccggcacccgcctcgtcgcccgtaccggccgcgccgtccgtgctcagcgcgcactcggcgagcgcgtcgaggccctggggcttctcggcggtgcggccgatggagatggcgatgcggtcgatcgtggacttccgcttgtcggcgagcgggccgaggatggcgttctggacgaagttggcgccgccctggccgacggtgtcgacgagccgcttgttggcctcggcgagctgggtgtccaggagcgccaggttgcggtcgacctcggcctgcgcggaggccgggacgctgggcagctgcgacttgacgtccgggcacgcgatcgtgccggtgtcggccagcgtcctggcgctcgtgccgttgctcttggatgtttccccggcgagggcggagccggcgatcaccgcaccggacagcaccacggcggcggcgccgccgatgagcgcgacgcgacgcttgttgtacttcggaagagccctggacatgcggatgcctcactcggatcgggggtgacttgactgacgaacgcggcgcctgcgttcggcgagaagtacgggaaagcggtttcttgcgttcaaggcttcctgagatttcgatcggacggcccgagattgacgaatcatgcagagccctgcatactcatgcatgtcagtgattgcagtgtgaggagaagcccgtgaccgagcgcgtcgtactcgcctactcgggtggtctggacacctccgtcgccatcggctggatcgccgaggagacgggcgccgaggtcatcgccgtcgcggtcgacgtcggccagggcggcgaggacctggacgtcatccgcaagcgcgcgctcgcctgcggtgccgtcgaggccgaggtcgcggacgccaaggacgagttcgccgacgagtactgcctcccggcggtcaaggccaacgccctctacatggaccgctacccgctggtctccgccctctcccggccgaccatcgtcaagcacctcgtcgccgccgcccagaagcacggcgccaccacggtcgcccacggctgcaccggcaagggcaacgaccaggtgcggttcgaggccggcatcgtcgccctcgcccccggcctcaagtgcatcgccccggtccgtgactacgcgatgacccgggacaaggcgatcgccttctgcgaggagaagcggctcccgatcgccaccaccaagaagtccccgtactccatcgaccagaacgtcttcgggcgcgcggtcgagacgggcttcctggaggacatctggaacgcgccgatcgaggacatctacgagtacacctcgaacccggccgagccccgcgaggccgacgaggtcgtcatctccttcaaggagggcgtcccggtcgccatcgacggccggcccgtcaccgtgctccaggcgatccagcagctcaacgagcgcgccggcgcccagggcgtcggccggatcgacatggtcgaggaccggctcgtgggcatcaagtcccgcgaggtgtacgaggctccgggcgcgatcgctctcatcacggcccaccaggagctggagaacgtcaccgtcgagcgtgaactcgcccgctacaagcggcaggtcgagcagcgctggggcgagctggtctacgacggccagtggttctccccgctcaagcgcgccctggagggcttcatcgacgaggccaaccagcacgtcaacggcgacatccggatgaccctgcacggcggccgcgccgtcgtcaccggccggcgctccgagacgtcgctctacgacttcaacctcgccacgtacgacacgggcgacagcttcgaccaggccgcggccaagggcttcatcgacatctacagcctgtcgtcgaagatcgccgccaagcgcgacctggcgtaagcggtagcgatcttcccgaagcagtagcgtgatggccgcctcctcactcgacaagtggggaggcggccgcacaaccaccaccctccgaggagcacagcaagtgagcagcaacagcggtgacgtacggctctggggcggccgtttcgccgacggtcccgccgaggccctggcgaagctgtccgcgtccgtccacttcgactggcggctcgcgccctacgacatcgcaggttcgcgtgcccacgcgcgcgtgctgcacaaggcgaacctcctcacggacgacgagctggaccgtatgctcgcgggcctcgaccggctcgaagccgatgtcgcggacggcaccttcgtgggcaccatcgccgacgaggacgtccacaccgccctggagcgcggcctgctggagcgcctcggccccgacctcggcggcaagctccgcgccggccgctcccggaacgaccaggtcgcgaccctcttccgcatgtacctgcgcgaccacgcccgcgtcatcggcggcctcctcgccgacctccaggacgcgctgatcggactggcggaggcccacccggacgtggcgatgcccggccgcacgcacctccagcacgcccagccggtgctcttcgcccaccacgtcctcgcgcacgtccaggcgctgtcccgggacgccgagcggctgcgccagtgggacgagcgcacggccgtgtcgccgtacggctcgggtgccctcgccggttcctccctcggcctcgacccggagtcggtcgcgaaggacctcggcttcgagcacggctcggtcgccaactccatcgacggcacggcctcccgtgacttcgtcgccgagttcgccttcatcaccgcgatgattggggtgaacctctcccggatcgccgaggaggtcatcatctggaacacgaaggagttctccttcgtcaccctccacgacgccttctccaccggctcgtcgatcatgccgcagaagaagaacccggacatcgccgagctggcgcgcggcaagtcgggccgcctgatcggcaatctgaccggcctgatggcgacgctcaaggccctcccgctcgcgtacaaccgcgacctccaggaggacaaggagccggtcttcgactcctgcgaccagctcgaagtcctgctccccgccttcaccggcatgatggcgacgctgaccgtccaccgtgagcgcatggaggagctggccccggccgggttctcgctcgccaccgacatcgccgagtggctggtcaagcagggcgtgccgttccgggtcgcgcacgaggtcgcgggcgagtgcgtgaaggtcgccgagggcgagggcatcgagctggacggcctcaccgacgagcagttcgcgaagatctcgtcccacctcacccccgaggtgcgcggcgtcctcaacgtcccgggcgccctggcctcccgcgacggccgcggcggtacggcacccagcgcggtcgccgtccagctcgccgaggtcaggacggacgtggcggcacagcacgcctgggccaccgcgaagcagaagaactagcaggtcgggtgtagcgagggaatcgcgggataggttggtccggagccgtagaggagccgaccgaacggagcccgcgatgcccttcgcccgcctgagcgcagcgacgactcccaccgcccacatcggcctcggcctggccgccgtcggccgccccggctacatcaacctcggccgcgaggacgaccttcccgccgtacgcagcgtcgaggccctgcgcgcccgcacccacgaactgctcgacgccgcctatgcccagggcgtccgttacttcgacgtggcgcgctcctacggccgctcggaggagttcctcgcggactggctgaacgcccggccgggcatcgacgacatcgtcgtcggcagcaaatggggctacacctacacggcggactggaccacggacgccgagcagcacgaggtcaaggaccacagtgccgccacctatgaacggcagcgcgccgagaccgccgggctgctcggcgagcggctcgacctctaccagatccactcggtgaccccggacagtccggccctcaccgacaaggaactccacgccgagctggccgaggccgcggccgagggactcaccgtcgggttctccaccagcggccccgcccaggccgacgccatccgtgccgcgctcgccgtgacggtcgacggcgcacccctcttccgcaccgtccagtccacgtacaacgtcctcgagacctcggccggacccgcgctcgccgaagcccaggacgccgggctcacggtgatcgtgaaggagggcatggccaacggccgtctggcgggcgggcacgcgcccggcccggtgcgggagatcgccgagcaggcgggcctcggcgccgacgccgtcgccctcgcgttcgtcctgcggcagccctgggccggagtcgtcctctccggtgcggccaccaccaaccagctcgcctcgaacctgcacgcggccgtcgtcgacctcgacgacgagcaggtcgcccgcctcgacgccctcgccgaggacccgcgcacgtactgggagcggcgcgggcagctgccctggcactgagcactcacccccgtgaacgacacgaaggtgagacgcatacgctcctcatgagacaaagatgtctcacttggtctatgcttgtctcatggctgtcgatcgcgaacacgtgctgcgcagcgcagcggacctgctcacccggaagtccaccgccaccatggacgaggtcgccaaggcggccgggatcagccgggccacgctgcaccgccagttcgcggggcgggacgccctcgtccgggcgctcgaagagctgggcatccgggagtgcgaggcggcgctggacgcggcccggctggaagcgggcaccgcgaacgaggccgtacgccggctggtgagcgagatcgagcccgccgcccggctgctcgccttcctctacaccgagaaccagcttttcgagggcgacgcccagcacgagggctgggcccggctggacgcgcgcatcgccgcgctgttccggcgcggccaggagagcggcgagttccgcatcgacctcagcccggcctggctcaccgaggcgctctacggcctgatggcctcgggcgcctgggccgtgctggacggccgcgtggccgccaaggacttttcctatatgaccgtcgaactgctgctcggcggtgcgctacggagagaggaatcatgaccagcaccctgcggccggcgtccgtggcggaggtggagcagcgcccgggccggtggctcgcgctctccgtcctcgtcctcgccgtgctgctcgtggccgtcgacgcgaccgtcctcggcctcgcgaccccgtacatcagcgaggacctgaagccctccggcacccagctcctgtggatcggtgacgtctactccttcgtcatcgccggcctgctcgtctccatgggcagcctcggcgaccgcatcggccgcaagaagctgctgctcatcggctccacggcgttcggcgcgatatccgtgctcaacgcctatgccaccacaccggagctgatgatcctggcgcgggcgctgctcggcgtcgcgggcgcgaccctgatgcccgccaccctcgccctcatccgcaacctcttccacgacccgcgcgaacgcagcttcgccatcggcgtctggggcgcgaccgcctccgccggcaccgcggtcggtccggtcgtcggcggtttcctgctcgggcacttctggtggggctcggtcttcctgatcaacctccccgtgatgatcgtcctcgtcctcgtcggcatcagactcctgcccgagtcgcggaatccggatcccggaccctgggacctgagcagtgtcgtcctctcgctcgtcggcatgatcggcatcgtgtacgcggtgaaggaggccgcttcgcacgggccttccctggacgcgctggccgccggagcgctcggcgccgccgccctcttcggcttcgtacgacgccaactcgtcatgcccaagcccctgctggacatgcggctgttccgcaaccgcggtttctccgcggccgtgctcgccgatctgctgaccgtgctcggcatgtccggactcatcttcttcctgtctcagtacctgcaactcgtccagggcaggcccccgttcgaggccggcctcgccgaagtccccgccgccgtcggcgcggtggcggccggcctggccgcggggcgggccgcccgccggtactcggtgcgggccgtggtctcgggcggtctcgccgccgtcggcctggcactcgccgcgctcaccctgctgagcgagtcgaccggctacccgctgctcgggaccgcgctgctcgtggtcggcgtgggcgccggcttctcgttcaccgtgaccgccgacgtgatcctctccagcgtgcccaaggaccaggcgggcgccgccgccgcggtctccgagacggcgtacgaactcggcgccgccctcggcatcgcactgctcggctcgatcgtcaccggcgtctaccgggacttccacggcccggcgggcaccccggcacaggcccacgaatccctcggtggtgccgtcgagtcgacggcggggctgcccgcgcacaccgcggaggccgtgctgtcctcggcccgcgccgccttcgtcgacgggctggcgctcgcggcgggcgccggcgcggcggtactgctcgcgacggcggtcgcggcctggttcctgctgcgcggccagaaactcgaggcgtaggggtacgaacgggtgaggcccgccccggcgacagccgggacgggcctttcacggtgtgggcggagccgctacgccgccttcgccttggtggcgtacatgtccacgtactcctgacccgaaaggcgcatgacctcggccatcacggagtcggtcacggcgcgcagcacatagcggtcgcggtccatgccctcgtagcgggagaactccatcgcctcgccgaagcggaccgtcacccggccggggcgcgggaaaccggcgccgcccggctggagcttgtcggtgccgatcatcgcgaacgggacgaccggggcgccggtcatcagggtgaggcgggcgataccggtacgaccgcggtagagccggccgtcgggggagcgggtgccctccgggtagatgctgaagaccttgccctcctccagcacccggcggccggtcatcagcgccgcgacaccgccgcggccgccgtcacggtcgacggggatcatcccggtgccggtgaagaaccaggccatcagccgacccttgatgcccttgccggtgacgtactcgtccttgccgatgaagaagacctggcggtcgcagaagagcggcatgatcatcgagtcgatgaacgtgaggtggttgccggccaggatgaccggaccttcgcccgggatgtgctccgcaccttccacccgtgggcggaacatcaggcgcatgatcggtccgagcactgccttgatgagcacgaagcgggacaacgggccctccggtgtcaacgaacggtatgagtatgtgcaggtgaggacgatactcgcgccccccgggtgattgcacatcgggttcaccgactggatacgcactgttgacgcacgtttacctgcggtggcgccccgctgcggggtcctcacgcggacgacacggtgtgacggagatcgcgccgtcgggcgcggcccgtccctcccgcgggtgccccctgccgcgcccccgaacccggcgagccgtcaactgtccgaacccgtacggcatctcgtgcgacatccagcgtcacccgtgtgttctgccgcaggtctcccctccgtcactcgagcacacctacgatcgaccagatttgacaggtgcagggcggtgtggcggaggagcgctcatggggacgcaggaaacacgacggacacagcggtcggacgagccggggcgggggaccgggcggcgggcgctgctgggggccgcggtgctcggcgcgggcggagcggtcctcggactgcccgccgcggcgagagcggacgagcggcacgggggcggcggctaccggagtctgccgaagccgaccgtcatcggtcaccgcggggccagcggctaccggccggaacacaccttcggctcctacgagctggccctcgacctgggtgcgcacgtcgtcgaggccggcgatctggtgcccaccaaggacggccatctcgtatgccgtcacgagccggaaatcggcgggaccaccgatgtctcggcgcaccccgagttcgccgaccgcaggaccaccaagaccctcgacggggtcgccaccaccggctggttcaccgaggacttcacgctcgccgagctgaagaccctgcgcgccgtcgagcgcatccccgccacccgccagcgcaacacgatctacaacggccgctgggagatccccaccttcgaagaggtgctccggtggcaggacgagcagacccgcaagcgcggcaggcaggtgtggatctaccccgagaccaagcaccccacctacttccgcaagctgggcctcggcctggaggagcgggtcgccaagctgctgcgcaagtacggcaaggacaagaagaactcgcccgtcatcatccagtccttcgagccgagcagcatccagcgtctgaacaaactggtcggcaacccgctcgtcgtgctgctgtccgccgcgaacacccgcccctgggacttcgtcgaggcgggcgacccgcgcaccgtcgccgacctcgtcaagcccgagggcctggcgtggatcgcctcgtacgcgcagggcatcgggccgacgctcgacctggtcatcccgaaggacgcgagcggcaacctcaccacgccgaccacgctcgtcgccgacgcgcacgacgcgggcctgatcctgcacccgtacaccatgcgcaacgagaacaccttcctgccgaccaacttcaagaagggcaccgacgcgaacgcctacggcgatgtcttcggcgccttcaagacgtacttcgggacgggcatcgacggggtcttctcggacaacgcggacaccgcgctcctggcccgcgcggacttcctgaacggctgagcgggggcctttcccgagggctgaggtcccgcggtcaacccatcgctccgcgcccccggttggagtgacagtcggccgccccggcaacctcccgccggggcggcggcgtcccgccgcatatgacccacgacatggttgccaccctgcgcccgctgctcgccgccgaggcctcggcggaggcatatgcggccggtaccgaccagagcgacctggaacaagccgtctggctgcgtctcctcgagcgcctcgaatccgacggccccctcgtcgatccgcaaggctgggtacgccgcgccgtccgctcggaggtgcgccgcagccgccgcaccgcccgtctcgagctgccgtacggctccgaacccgccgacgacggcgcggccggccccgaacagcaggcgctgaccgccgctcgccatcgtgccctgcacgccgccgtgcgtcggctgcccggccgctgcccacgcctcatggccgcactgctgtctccccaggacctcacgtatcgcgaaatcgcaggcgagttgggtatctcacagggcagtctgggcccggaacgttccagatgcctgggatgtctgcgcagattgctgtccgcggaggttgcggcccgtgaaccgcggggataggagtgagggacaactggcgagcaggtgagcgggaggcgtgcacacatgggcatgagcgtgaccatctctgtggcgaccgagcgggacgccgagcagatcttccggctgcagtacctctgcttccagagcgaggccgccctgtacggcaactaccgcatcgacccgctcgtccagtccctcgaatcggtccgcgcggaggtcgcgggcgactgcgtgttcgtggcgcggctgggcgacgaggtggtcggttcggtgcgcggcaccgtgaccgaggacggcgcggcgtccatcggcaaactctgtgtgcacccccgtctccaggggcacggcatcggcgcccggctgctgcgcgcggccgaggcggccctggccggggagcgcggcgccacccgcttccgcctccacacgggccaccgcagtgagggcaacctccgcctctaccggcgcgtgggctacgagacggtgggcacgtcgaagggcgccgacggagtcccgatgatcgtcctggagaagccggcgggcacctacgcgacaacggcgtagacatgtcgccgctcccgaaggggcgcggcgactacgtattcaggggcgcggcgacgcgaacccgacacgccgcctcccgagggccggccgtgtcccagcgggcgcttccacgtccgcgcccccgaaggggcgcggggaactgcgcgaccagccacagacgtcccgcagcttcgcaacggacggaccgcggtctccttccggctcccggggacggaccgccgtctcctaccggctcccggcggagcgctcccgcttccggagccagtacatggccgacaacggcagcagcacgggaatgaacagataccccatgccgtagtcggaccacacggtcgcgtccgggaacgcggacggctcgaccagcgtccacgtcccgaccgtcagtacgcccacgagctcggcggcgcagcacaccagcgccgcccggcgggccgtctcgccgccgcgcaccagcgagtacgtgatgaagccgtagacgacgcccgccaccgcggagagcgagtaggcgagcggcgccttgtcgaactccgtcgagatctgcaccgcggagcgcgagacggcgccgaccaccatgacgccgtacagccacacgagcagcatgcccgggccgccgatcagccgggtcctggccggcttcgtctcttgcgtggccgtcatctcagcttccccagatgtcatagagccgcacctccagcacggcgaggaccacgccaccggcggcgacggtgatcgaaccccaccgcgtgcgctccgccagcgacatgaagcccgccgccggaacgcaggcgaaggcgcccagcagatacgccacgaagatcgtcgtgccctgctccggctgctggccgcgcgccagctggacgacgccgacgaccagctggaccacggcgagcagcgacaccacggccatgccgatgaagtgccagtccttggtcggctgatcgcggtaggcggcccagccgcaccaggcggtgagcagcagcgcggcgacggcggtcaccacggtcagggcatcaagcatgccgtgaccctattacgggccaaaaggccccacgcgcgcgggcccgaccgccgagccgtcccggcctcgggggcaggtccgccgcacccggtccgccgccggcctgcgccggccgcaccgccggggcggccaccgtggccttggccacaacccatgaggcggccgagccggacgccgacccgtagggagggaccccatgccctgtccgcactggtcaccagcggcgggtgaggatctccggccgaggccgaaagctgtccacggctgtccgctattcggacagcactggcgggcctccgctgtgcgtctgctttacttgatcccatgaccacgacgagcagccgcacccttgcgaccgaggcgaccatgacgcccggtgctcgctgtatgtgtcgaatgtgcgccttctagagggcccccgcaccaccgcctggtctcgcgccccgaagcgagaccgccgccccatgtccgtaccccgtacgtgacccgggctgcccgcgcacacgttctcccccccggttccatcgccatcgcgagaaccgtgccgcgttcccgaccgaatgcatccgtgcccggcgcacacccacgccctgcactcgacagtgacggaaaccccagtgatcacgacaacgggcctcaccaaggtctaccgctcgcgcggccgcgaggtcaccgccctcgacggcgtcgatctgcacgtccgcgaaggcgaggtctacggcgtcatcggccagtccggcgccggcaagtcctcgctcatccgctgcgtcaacctcctggagcgtcccacctccggcacggtcaccgtcgccggacaggacctcaccgccctcgccggccgcggcccgcgcgcgggcaaggagctccgcacggcgcgcagccacatcgggatggtcttccagcacttcaacctgctgtcctcgcgcaccgtccaggacaacgtcgagctgccgctcgaaatcctcggcgtctccggccgggagcgcggccgcaaggccctcgaactcctcgacctggtcggcctcaccgacaaggccaaggcctaccccgcccagctctccggcggccagaagcagcgcgtcggcatcgcccgcgccctggccggcgacccgaaggtgctgctctccgacgaggccaccagcgccctcgaccccgagaccacccgctccatcctccagctgctgcgcgacctgaaccggcagctgggcctgaccgtcctgctcatcacccatgagatgaacgtcgtcaagagcatctgcgactcggccgccctgatggagaagggccgcatcgtcgagtccggcaccgtcagcgaactcctcggtacccccggttccgaactggcgtcggcgctcttcccggtgaccggcgacgcctccggcgacgaccgcaccgtcgtcgacgtcaccttccacggcgaggccgcgacccagcccgtcatctcgcagctctcgcgcacgtacaacatcgacatctcgatcctcggcgccgcgatcgacaccgtcggcggcctccaggtcggccggatgcgcatcgaactgcccggccgttacgaggacaacgtggtgccgatcggcttcctgcgcgaacagggtctgcagatcgacgtcgtcgacaagtcggaccaggagtccgtactggtgaaggaaggtgccaagtgacctggtccgagatgcagccgctgctgtcccaggcgtgttgggacacgctctacatggtcggctggtccacgctcatagcgatcgtcggcggactcccgctcggcctcctgctcgtcctgaccgaccgcggcggactcctccagaacgtcgtggcgaacaaggtcgtcgggcagatcgtgaacgtcgcccgctcactgccgttcatcatcctgatggtggcgttgatgaacttcacccgcaccatcacggggacgaccatcggccgtgaggcggcgatcgtgccgctcgcgatcggcgcgatcccgttcttcgcgcgtctggtcgagacggctgtccgcgaagtggacggcggactcgtcgaggccgtgcagtccatgggcggcaacacctggaccgtcgtccgcagggtcctcgtgccggagtccctgccctcgctgatctcgtcggcgaccaccaccatcgtcgcgctcatcggctactccgcgatggccggcaccgtcggcgccggcggcctcggcgacatcgccatccgctacggctaccagcgcttcgagaccggcctgatgtggatcaccgtggcgatcctcgccgtcgtcatctccctcatccagttcgccggcgactacgcggcccgcggactgcaccgacgcggcggccggtccggtgtcgcgccgaagctcaggctgctgaaggacaaggcgcccgcggacaggacgcccgcggccgacgcccccaccggcgaggcggccacggccgacgtcggcaaggtcgcctgagtcaccccctccccgaactccccgtaccacccaagacggggtcgctccacccatcaggaaaggcacttttcgtgcgtaacaccgccaagatcaccaccgctgtcctcgccgccggagccctcaccctcgggctctcggcctgcggctcggacaaggactccgcctccgacaccagtggcccgctgatcgtcgccgcgagtcccaccccgcacgccgagatactcgacttcgtcaagaagaacctggcgaagaaggcgggcctggacctggaggtcaaggaggtcaccgactacgtcacgccgaacacggcgaccgaggacggctccgtcggcgccaactacttccagaaccagccctacctcgacgacttcaacaagaagaagggcacccacatcgtgcccgtcgtcacggtgcacctggaaccgctcggcctctactcccacaaggtcaagaaggccgacgacctcaagagcggtgcgaccgtcgccatcccgaacgacacggtcaacgaggcgcgggcgctcaagctgctcgacgccaacgggatcatcacgctgaagagcggcgtgggcaacgaagcgaccccgggggacatcaccaagaaccccaagaacctcaagttcaaggagctggaggcggcccagaccccgcgctccctggacgacgtggacgccgcggtggtcaacggcaactacgccatctcctcgggcctcaagccggccaaggacgccgtcgtcctggagtccccgaaggacaacccctacggcaacttcctcgcggtcaagaagggcaacgagaaggacccgcgcgtcaagaagctcgcgaagctcctcacctcgcccgaggtgaagaagttcatcgaggacaagtacgccggctccgtcatcccgtccttctgaggagctctcagcaatgcgtaagcccgtcatttccgcggcggcggccgcactcgccctcggactcggcctgaccgcctgcggctcgggctccgactccgactccgcgaagagcggtggcgacggcgacgcactcgtcgtcggcgccaccgccgtccccgccggcgaggtcctcgcgtacatcaagaaggacctcgccgagaaggcgggcctcgacctggagatcaaggagttcacggactacgtcctgccgaacaccgccctccaggaaggcgaactggacgcgaacctctaccagaaccagccctacctcgacgacttcaacaaggccaagggcaccgacctggtccccgtcgtcaaggcgtacctgccgcccatgggcgtgtactcgaagaaggtcaccgacgtcacgaagctcgccgacggagccaccgtcgccgtacccaacgacacgaccaacgagggccgcgccctcaagctcctcgcgtccaagggcgtcatcgcgctcaaggcgggcgccggcacggacgcgtcccccgcggacatcacgtccaaccccaagcacctgacgttcaaggagctggaacccgcccagctgccgcgctcgctcgacgacctggccgccgcggtgatcaacaacaactacgcccaggacgcgggtctcagcccgacgaaggacgccatccttctggagtcggcggagaacaacccgtacgccaacctcctggccgtgaagaagggcaacgaggacgacccgcgggtcgagaaactcgccaagctcctcacctcgcccgaggtgaagaagttcatcgaggacaagtaccgcggctcggtcctgccggtcgtctccggctgacgccggacaccgcaacgcacggggtccactccttcaccgggagtggaccccgtggtgcgattcggtacctcgatactgcatgctgggcagttcagcaggccctgaaggtttccgaaggttacggagcggcgcatgactagcaccttccccaacatctccatcagcacggagcggttggtactgcgccccctcgacgaggacgacgtccccgccctggccgagatgatgaacgacgagcaggtaggggcctggaccgacgtgccccagccctacaccgaggaccgggcccgccgctggatcaccgagtacgcgcccgcccaacgcaccgcgggccgcggcctcgacctcgccgtcaccgagttcctcacccagcgactggtcggcatcgtccagctcgacaagacgaactggcacatccggtccaccgaaatctcgtacgtcatcgccccctgggcccgcggcgagggctatgcctccgaggcggcgctcgccaccgcccaatggctcttcggggaccagaagttcgagcggatcgagctgcgcacggcggccgacaacaccgcctcccagcaggtcgcccagaagatcggctgcatcagcgagggcgtcctgcgcaacgcctgcatagcccacgtccggaccgaggacggcacgtggaccgacgtgcgcaccgacttcatcgtctggagcctcctcccggaggacctcgacggagtcggcgaggaactcgcggacaccggcggtttcacgtcgttctccgactggaactgagaccacggggccgccggaacccggcccggcccccgtacgccgcaccattcagctccaccaggtacgctcacggagcgccatgcacgggctgccctgacgacctgcgaagaccccctggagactgacgacgatggccgaccgggtcacggtgatcggctgggacggctcgcccctgaccgcggccgcgcgttccgccctcggcgccgccaccctcgtcgccggcgcggcccaccacctgacactggcggaggtccccccggccgccgagcgcatccgcctgggcagcgtcgccctcgccgcccgccgtatcgccgcccaccgcggcaccgccgtcgtcctcgccgacggcgacccgggcttcttcggtgtcgtacgcacgctgcgcgcccccgagttcggcctggaggtcgaggtcgtgcccgcggtctcgtccgtcgccaccgccttcgcccgcgccggaatgccctgggacgacgcccaagtggtcgtcgcacaccgccgcaccctgcgacgggcggtgaatgtatgccgcgcccacaccaaagtcgccgtcctcacctcacccggcgccggacccgccgaactcggcctgctgctcgaaggagtccaccgcaccttcgtcatctgcgaggaactcggcaccgaacgcgaacaggtcaccgtcctgacctccgacaaggcggccgaccacacctggcgcgacccgaacgtcgtcatcgtcatcggcggtcccgtgaccgcggtcgagggcggcggctggatcgccggacgcgaaccgggcgcggaaccgcgcggctgggcgctgcccgccgaggcgtacggcggcgcactcggcgaaggcgaaacggatctgctgcgcgccgcccagctcgcccgcctggggccgcgcgcgggcgacctcgtctgggacatcggttccggcagcggggcgttcgccgcagaggcggcgcgctgcggcgccgccgtcatcgccgtcgaccgggaccaggacgcctgcggccgtacgacggtctccgcgcgccgcttcggcgtccagctccaggtcgtgcacggcgccgcgccgcacatactggagaacctccccgaacccgatgtcgtacgggtcgggggcgggggagccgcggtggtctcggccgtcgccgaccgccgcccgcagggcatcgtcacgcatgccgcgacccgcgacgcggcggaactcatcggcaggggtctgacggagcacggctacctggtcgagtgcgccctcctgcagtccgtcgagctggacacgagggcctggacggagaaggagcggagcgtcgcgttcctgctcagcggccgattgcccgaccgctccccgtgatcctgttgtcgtaccggcgcggtaggctggccgatcgttgtaccgcactccggtcacccggcacctcgtcggtcaatgtccggaaaacgcgcctcttttgggatgtgtgtggtacggcggagccggagggcgcgcaacgtggcgcagtccacagcgggctgtcgcggatcaagctgtcgcgacggcgggacgaccgggacaatgccagttaatggctttgtcgcctttgctggcgggtcgttcgtgccgctgggcacgcacgctcgttcttcactgcggggcggtcggtgcgccgttccgggccagctggcgaagaagcactaaaccgatgggcgaggggtacgcatgaccgacaccggccaggtcccgggcgagggactgccggagaacgcaggcatggtggagcagccgggcgtccccgcgccgggcgcgtacacctacctcgacccctccgacaccgccgccgatgacgacgacctgctcctgatgcccggccagcagggtgcctggggcaatgagatgccgcaggcgatgccggccccggcgcccgtcgtccacgagccaggaccgcacgagacggacggacgcgacagcggctccgtggacctgagcgccgtccgtacgctgtcccaggcagccgcgccgcaggcgaccccgccgcgccgcccgctgcacctcggcccgccgaccccggacatctcgtcgagcccggtgcgttcgctggcggaccgcggcccggcggacgccccgctgcgccaggtgggaccgcccacgaccggacccgagtacctcgacgcgccgccgcagctcgcggagacccctccccagggcgcggtgccctggggcgctccgccgcagacacaggcggtgccaccggtgagccccgaggggccccccgcagaaacggtcgtcccggaggccgccccggccgccccggtcgtcccggaggccgcgccgggtctcgggaccgtgccggccgacgagccggcgccgttcgtcgagcccgagcaggcgtccgagatgccgcccttcgccgaggccgagacgccggacgcaccggccttcgtggaggcgccgcagcccccgcagacgccggacgcacccgcgttcaccgaggtgccgcacgcctcggacgagccgccggccgcggacgcgcagcacgccggggccgccgcacccacggacgttcctccggccgcggagacgccgttcgccgctcccgaggccgaggcgctctacgcggtggacggctcaccggacggtgtcacccacccgcaggtgcagtacgccgacgggaccggccccgtcccggacggctcgcccgaaccgcaggccccggacaccacgcccttccccgcggctcccgaccccgcgcagccgacgggcgacaccggacacatcgccgtgccgccggccgctccggacaccgcagtgcccgcgccggccgccgacttccccgtacccccgtatgacgccgccccggatccggcccaggccgccgccgcggaggcggtgccgcaggccgggaccgagcagcccgggcccgcgcaggacccgcaccaggcgccggaaatctccctcgacctgcatgcggcgccggacccggccctcgacccccagcaggcgccggacccggccctcgacccccaggccgcgcacgtgcccgagccgcagctcgccgccccggccgtccacatcacggacaccgcggtccagttcgcggacacggcactccccgacgaggacgcgcggcctgtcgccgacgaggtccagccgcaactcgtcgccgaagcaggggcccagggccacgcggaggccgagccggagccgcagtacgcggagcacgccgccgcggccctgcacggtgtgcccgtcggagtcggcgctcacgccgtggcgccccaggcgtccgcggggcaggcgcagcacggcgagcagcccgcgcacggtgacccggcaggcccgccgggcttctccccggagccccacgccgaccagtccctcgggcagttcgtgccggtggagggcgcggtgcccaccaccccgcacctggccccgaccccgtcgcacgccatgacggtgccgcccctccccgcggaggagcagccggtcgccgaggaggccgccccggccgtcgtggagccgtccgaggcgccgcacgagctgtcggaagaggcgccgcacgagctgtcggaagaggcgccgcacgagctgccggccgaggtgccgaccgaggcggaagccccggctccggtgatggccgcgcaggagacgcccgccgtgacggtgcccgccccccgcgaggccgaggcacccgtcgcggcgcagccccccgtatcgcaactccccaccccggagccgcccttggcggaccccgagcccgtagtcgcacagcacgcggatgacctggacacccaggtcgccgaccaggaagagagcacggccgcagtggaagacgtacgagagtccaccggcccggcggcccccggctacgacgaggccgagcgcgaggccgtactgcgtgtgatgcgcgagcgccgggacatccgcaacggcttccgcagcgacccgatcccgcacgaggtactgctgcgcgtcctcgaagcggcccacacggcgccgtccgtcggccactcccagccctgggacttcgtcgtcatccgctccgccgacacccggcgctcgatgcacgaactggccatgcgtcagcgcgacgcctacgcgaagtcgctgcccaagggccgggccaagcagttcaaggaactcaagatcgaggccatcctcgacaccccggtgaacatcgtcgtcaccgccgacccgacccgcggcggccgccacaccctcggccggcacacccagccgcagatggccccgtactcctccgcgctcgcggtcgagaacctgtggctcgcggcccgcgcggaaggcctcggcgtcggctgggtcagcttcttcgacgagcgcgagatggtgcgcgagctgggcctgcccgagcacctcgaagtcgtcgcctacctctgcgtgggctacgtcgacgagttcccggacgagcccgagctgatgcaggcgggctggtccaagcgccgcccgctgtcgtgggtcgtccacgaggagacgtacggccgccgcgccctgcccggcgaggagccgcacgacctgctcgccgagaccgtctccaacatccgcccgctcgacgccaaggcgctcggcgaggcgtgggagcggcagaagcggatgaccaagcccgccggcgcgctcggcatgctggagatcatctccgcgcagctgtccggcctgtcccgccagtgcccgccgccgatcccggagcccgcggccgtcgcgatcttcgcgggcgaccacggcgtgcacgcccagggcgtcaccccgtggccgcaggaggtcacggcccagatggtggccaacttcctcggcggcggcgcggtctgcaacgcgttcgccaaccaggtcggcgccgaggtctgcgtcatcgacgtcggcgtcgcctccgacctcccggcgacccccggcctgctgccccgcaaggtccgcgccggtacggccgacatgacgaccggtcccgcgctgacccgcgaggaggtcaaggcggccatcgaggtgggcatcgagaccgcccgcgacctcgtctcggcaggcaacaaggccctgctcaccggtgagatgggcatcgccaacaccacggcctctgcggccctgatctcggtctacaccggggcggacccggccgaggtgacgggccggggcaccggcatcaacgacgagaccctcgcccgcaagaccgaggtcgtccgccgagccctcgaactccaccagccggacccggccgacccgatcggcgtcctcgccgcgatcggcggcctcgaacacgcggcgatggtcggcctgctgctcggcggcgcgtccctgcggacgccggtgatcctggacggcgtgagcgccggcgccgcggccctggtggcccgcgccatcgcccccgaggtcctggccgcctgcatcgcgggccaccgcagcgcggaaccgggccacgtggccgcgctgaacaagctcggactgcgccccctggtcgacctggaccttcgcctgggcgagggcacgggcgcgctgctggcgctgcccgtggtccagagcgccgcgcgagcgatgcacgaggtggcgacgttcgactcggcgggagtcaccgagaagtagtacgccggggcggtgggcgggcgatcgcgcctgcccaccccccaccccgccgtactctggacgcgcatcttaaaatccgcacgtcaagggcttctccaccgccgcaggggcccctctcgcaccgcccgtacgaggagccgcacctccatggccgaacaccccgcctaccccgtgggcctgcgcctcaccggccgccgcgtagtcgtcctcggcggcggccaggtcgcccagcgccgcctccccgcgctcatcgcggcgggcgcgaaggtccacctcgtgtctcccgaggcgaccccgtcggtcgaagccatggccgacacgggcgagatcacctggtcgaggcgccggtacgaggacggtgacctcgcggaggcctggtacgccctgatcgccaccagcgacgcggcggcgaacgtcgcggcctccgccgaagcggagcgcctccgtgtctggtgcgtccgctccgacgacgccgacgcggccaccgcctggaccccggccaccgggcacagcgagggcgtcacggtcgccgtcctcaccacgaacgccaagggccgcgacccgcgccacacggcggcgatccgggatgccgtggtcgagggcctgcgcgacggcaccctcgtcgccccccaccatcgcgtccgcacccccggcgtcgccctggtcggcggcggccccggcgaccccgacctcatcacggtgcgcggccgccgcctgctcgccgaggccgacgtggtcatcgcggaccgcctcggcccgcgcgatctgctcgccgaactcccgccgcacgtcgaggtgatcgacgcggcgaagatcccgtacggccgtttcatggcccaggaggccatcaacaacgcgctgatcgagcacgcccggcagggcaagtcggtcgtacggctgaagggcggcgaccccttcgtcttcggccgtggcatggaggaggcccaggcgctcgccgaggtgggcatcccctgcacggtcgtccccggtatctccagctcgatctcggttcccggcgcggccggcatcccggtcacccaccggggtgtcgcacacgagttcacggtggtcagcggccatgtggcccctgacgacgagcgctcgctggtcgactggccggccctcgcgaagctgcgcggcacgctcgtgatcctgatgggcgtcgacaagatcggaaagatcgccgacacgctcgtggcccacggcaagccggccggcacacccgtcgccctcgtccaggaaggcacgacggccgcccagcgccgtgtcgacgccacgctcgcgacggtcgcggagaccgtacgcgcccaggacgtgaagcccccggccgtcatcgtcatcggcgcggtcgtggacgtgggcccgcagactttcgagtaaccccgggtaacccaacccgttcccagccgttggcaccgcacccaggacaaggcagtatcaccctgtggccgatctcatcaccgttgaggaccccgccgacccgcgtctgcgcgactacacgggcctgaccgacgtggagctgcgccgtaagcgcgaacccgccgagggcctgttcatcgccgagggcgagaaggtcatcagacgggccaaggacgcaggctacgagatgcgctccatgctgctgtccgccaagtgggtcgacgtcatgcgcgacgtcatcgacgaacttccggccccggtgtacgcggtcagcccggagctcgccgagcaggtcaccggctatcacgtgcaccgcggcgcgctcgcctcgatgcagcgcaagccgctgccgacggcggacgaactcctggcgaccgcccgccgggtcgtgatcatggaatccgtgaacgaccacaccaacatcggcgccatattccgttccgccgccgccctcggcatggacgccgtactgctctccccggactgtgccgacccgctctaccgacgcagcgtcaaggtctccatgggcgcggtcttctcggtgccgtacgcacgtctggacacctggcccaaggggctggagtcggtccgcgaggccggcttcaacctgctcgcgctcacccccgacgagaaggcgaagaccctcgacgagacggcaccgcacaagatggaccgggtcgcgctgatgctcggcgcggagggcgacggcctgtccacgcaggcactggtcgcggcggacgaatgggtccgcatccccatggcccacggcgtcgactccctcaacgtgggcgccgcggccgcggtcgccttctacgcggtggccaccggccggccccagtcatagacagggcccgggagagtgagggaccagcgtgaggcgatcgtcgcggtgctgcgccgcggcgagcgggtgctcgtcatcaagcgcggtccgcaggcggcccgcccgggctactgggcacccctcagcggcaagctcgaaccaggcgagacccaggaggaagcgctggtcagagaggtgcgcgaggaggtcggcctggacgtctcgccgctgcggaaggtctgggagtgcccgaccgacgacggacacttccgcctccactggtggacggcggagtccggcacgggtgaggtggtccccgacccgggcgaggtggccgaggcgcgctgggtcaccccgggcgaattcctggcgatggaacccgtcttcgacggcgaccgggagttcttcgagcgcgtactgccggaactctgacctgccggctccggccgcccgggggcccgtccgcccggcgcgccatcggaccgggctgatcccgctccggtaccgctgatccgtcagatcccccgccacggctcgtacgactgctcctgtcgtacgtccttgcgtacgccgccgtcgtcgagcccgcgcgccggcccctggcagccctgggccgccgcgatgcccagcgccaccagcagggtcacgacgacgaacacgaagagccgctggcgcagcagccgcggattggccggccgccgtccggtcccggtggtccgcggcgaggagcgcccggcgccgctgcgcggtgcgggccggctgccggagcgggtggagttgcgcggggccggcgtcggccgcgagccggagcgcggcccgcccccggtccggggcgggggagtcccgggcgcaccctgcggccggcgctgggtccgctgctcggcgtactgctccgcgagccgccccgagggccggtccggttcaccgcgctgggccggcggccgtacgtccgcgatgccctgagcctcacgggccgcgatctccttgagccgcagcgagagttggagcgtgctgggccgctcctccgggtccttggcgaggcacgcgcgcaccagtggcgccagcgcgtccggcacaccgttcagatgcgcctcctcgtgcaccacccggtagagcatcacttcggaactgccgtgcccgaacggggagtcggcggtcgccgcgtacgcgagcgtggcgccgagggagaacacgtccgtggccggcgtgacggcggcgccgcgcacctgctcgggcgcgaggaagccgggcgacccgacggccgtaccgacgtgcgtgagcgtcgaggcccccgtcgcccaggcgatgccgaagtcgatgatccgcggccccttcggggacaacaggatgttggacggcttcagatcgcggtgtacgacaccggcctcgtgcacggcgacgagcccctcggagagggcggcgcccacggcggccacgtcggcggccgacagcggcccctcctcggcgaccttgtcgtgcagggagggcccgggcacgtactgcgtggcgaaccacggccggtccgcgtccaggtcggcggccaccagccgggccgtgcacccgcccctgatccgccgtgccgccgagacctcgcgggcgaaccggaaccggaactcctgatcctccgccaggtccggccggatcaccttcagcgcgacccgctggccacgccggtcggagcccaggtagacaacgcccatcccgcccgcgccgagccgtcggtgaagcctgaacgagccgacgacacgcgggtcctcgcgcctcaggcgcatcatcgccatgtccatccccgctgcccggtccgtttgacgagccacagcttacgtttccccggccgggtgcgcgcagaggccgcgccctctggtccccatcgattgtcagtgcctggtgggaaacttgaaaggtggtcagggagcctgtgaacaggctggttttgagctgcctgtgctcccaaccacccgtcacagaagggggattgaacccgtgaagggtgatcgcgtggagatagtcgtggatgccggggacacgacgcgtacctacgaggtggtggcgagcagggcgggccgccgggtggagacggcggtgcgcaggggggtcgtggaagtgagcgaagtcacccgaagcggatcagtggtgcgcacggcgcgcttcatggcgaaccgggtgctggcgctggtcgagcagcccgtgcccagggaggacgcctcggaacagtaggggcactccgggcgtcccctccgggaagaccctgagacctaggacctcgtctccacccaggggagtacgccgcaggtcatcgctcatcctcggggaggcccgtcaagcggtacgagggcatgacgaccggcagccgccgggcgcctagatttgaggtcaagcggcgggtgcagcactcgtcccccgaggtcagacactcgccgctgccaaccacaacagaagctcggtcaggagagggaccatggcccacacggcaccgcggacggcgatccgcacgcagggacgcagggcgtacaccgccgcgttcggcacccgccgcacgggccgtcgccaccccttggtggcgaccgcgatggcccttcccctggcggccctgctcctgctcgtcttcgacggctgggaaacagtggtcacacaagcgtcgtccgtgggtgtgatgttggggcgctgagcggcgccccaagcccggaagagcggtccgggcggggacatccggccatgaaaccccgtggggacgggggtgcggcggacggcacaaatgcccgcgcagctggggagctgcgcgggcattgttttttccgggccggccgggtccgtacgctcacgggtgaaccgaccaccctgggggactcatgaccgcagacctgctgcccgggctgaccgcgcgggtgagagccatggcccacccggaagcggggccctgcggctgcgacgccgccggcacgctggcggaccgcgcggacggcaccgtcgtccggcatgccgacacggtggcgaaggcgcacgccccggacaccgatcccgccgagctggccctgcgcctggagatcgcctcgcggctcgccggcatcctgctgcccccgttgagtccgaccccggccgacctgcacggccgcccggtgaccttctggccgtacggcagccccgtgaaccccgactgtccgcgggccgccccctgggaggcggccgccaccctcctcgcccggctgcacaaggcgcccgcgccaaagggtctgccgccgatgcgcggtcccgccaaggcggcccgcgcgctcgcccgcctccacgcggccggcccgcaccccgccgccgccccgatcctgcgggcctgggccggtctgcccgcctgggcccgcgccgaagcgcccatgccgtcctcgaagaccctgtgccacggcgacctccacctcggccagctcgtccgccatcccgcgacgaccggtccctggctcctcatcgacgtggacgacctcggcgtgggcgagccggcctgggacctggcccgcccggccgcctggtacgcctgcgggctgctcccgccggacgagtggacccgattcctcgccgcgtaccgcgccgagggcggcccggcggttcccgccgacggcgacccctggcccgtgctggatgtcgccgcccgcgccctcaccgtgcagacggcggctgtggccgtcgccaaggccgtgaccgccgaccgtcccttggacgaggtggagcaggcggtgatcgacgcctgcgaccgaatgggcggagtcccgccggagttcatccacggaagtgccacgtaaggtgcaaccgaccaccgccgggcagtgtctctacctggcgaagcaccaccgaccggcgaggagttgagccgaccatgcagtgtccgaagtgccatgcgccgatgcacacatacaaccgcaatggcgtccagatcgagcagtgcagcggctgccgcgggatattcctggactacggcgagctggagtcgctgacccagctggagtcccagtggtcgcagcccgcaccgccgcccccggccgccccgcaggcctacccggccgctcccgcctggggtgccccgcacggtgggcacggcggcggtcactacggcggccacggcggccaccagcggcacaagagcttcggtcacatgctcttctcgtcctgactgaaaaagggctcctcccgagtggaggagcccttttccgtgccgccgggacggcgtgcatccatgccgctgcggacggcgggaacgacgaagcccccgaccgtacgagacggccgggggcttcggctggtgcgcgatactgggattgaaccagtgacctcttccgtgtcagggaagcgctctcccgctgagctaatcgcgcgggacgggccctcgagctacagggaccaggtggtgctgcgtgcgcgatactgggattgaaccagtgacctcttccgtgtcagggaagcgctctcccgctgagctaatcgcgcggggatccttgcggaccagtggacgatactgggattgaaccagtgacctcttccgtgtcagggaagcgctctcccgctgagctaatcgtccatggaggtggagacgggatttgaacccgtgtagacggctttgcaggccgttgcctcgcctctcggccactccaccaggagtgcagggattcgggaagatcccctgttcttccgagcggacgacgaggctcgaactcgcgacctcaaccttggcaaggttgcgctctaccaactgagctacgtccgcttgtcgtttcggtccgctctcgcgtcccggcgacgtgttgaactctagcggattcccgggccagcacaaaaacgcgtttgtgcagcgtgctgcggtgcgcctgctcgaagacatggtcagggcatcctcaggtcacccgccatagactcgacggcgtgctcgacctccctcctctcgcccgcttcggcggcctcgtcgcgaccggtctcctcgacgtcaccagcgaccccgcggccctcgactccaccggtttctgggccgtttgcgccgacttcgagggccgtctgacctgcgcccgcttccggaacgtacaagaggaagcggtgcgagcgcccgagccggggcggtggcgaggccccgcggccggtgactggacgtcgtccctcgaccgcaccgcgtacacggcgggggtacgccgcatccgcgagcacatcgcggccggcgaggtctaccaggcgaacctctgccgggtgctctccgcgcccatcgcccccgacgccgacgtggacgcgctcaccgccctgctggcccgcggcaacccggcgccgtatgccggaacgattcgcctgccggggcacggcgtcgagatcgcgaccgcgtctcccgaactcttcctgcgccgcaccggcgccgccgtcgagtcgggaccgatcaagggcaccgggcgcaccgaggcggacctcctgacgaaggactacgccgagaacgtgatgatcgtggacctcgtccgcaacgacataggacgcgtctgcgccacggggacggtgaccgtcccggacctctgcgtcgtcgagaagcatccgggcctggtccacctcgtctccaccgtccacggcgaactgcgcgcggacgtcggctggccggaactcctcgccgcctccttcccgcccggctccgtgaccggcgcacccaagtcgagtgcgctgcggatcatcgaggccctggagacggcgccccgcggtccgtactgcggcggcatcggctgggtcgacgcggaccggcggaccgcggagctcgccgtcggcatccgcaccttctggatcgaccgccccgccggcctgctgcgcttcggcacgggcgcgggcatcacctggggctccgaccccgagggtgagtggcgggagaccgagctgaaggccgcccggctgctcgcggtagcgtcgggggagtacgaggaaagtggaaggaccctgacgtgaagatctggctcgacggcgggctgcaggactccgagaccgcccgcgtctccgtcttcgaccacgggctgaccgtgggtgacggcatcttcgagaccgtcaaggcggccgaggggcggccgttcgcgctgacccgccacctcgaccggctggcgcgttcggcgcggggcctcgggctgcccgagcccgacctggacgaggtacgccgcgcctgcgccgccgtcctggacgccaatccgatgccgctcggccggctgcgcatcacgtacaccggcggctacggtccgctcggctccgaccgcggcgagaaggggccgaccctggtcgtcgccgtcggcgagtccgcccgccgccccgattccaccgccgtgatcaccgtgccgtggacgcgcaacgagcgcggcgcgctcaccggtctcaagaccacctcgtacgccgagaacgtcgtcgccctcgcccgcgcgcgcgaacagggcgcgtccgaggcgctgttcgccaacacggtcggccggctgtgcgagggcaccgggtcgaacgtcttcgtcgtgctcgacggcgagatccacaccccgccggtcgactccggctgcctcgcgggcatcacccgcgcgctcaccgtcgagtggaccggcgccaaggagaccgacctgcccctcgacgtcctggacagcgccgaggaggtgttcctcacgtccacgctgcgcgatgtgcagggcgtgcaccgggtcgactcccgcgaactcccgggcgcgccgggcccggtgaccgccaaggccatgcggctcttcgacgagcaggccggggacgacctcgacccgtaggacggccagggcactcggatatccggatgacggagggccgcagggcgggtagaactcccgtgatgaccaccaccctgcggccggtcgagccgcttcagcatgccgccgacgggacgcgttcgcgccgctaccacgtgtgcgtgaacagccgccccgtaggcgtgatccacctcgcgacgcaccctgttttcgggccgtccgtcgcccggatcgacgagctgcgcatcgaggagccggaccggcggcgcggccgcggcacggtcgccgcgctcgccgcggaggaggtggtgcgcggctggggctgcaagcggatcgaggtccaggtgcccggcgaggccggcctgcggctggccggcgcgctcggctacgtcctgcgcaaccgcggcatggagaagcggctcggcaccaccgccccgggacttcccgagggcagccgggggcggcccatgacggctgccgagttcggtccgtgggaggagcgtggcagggcgcactacgcgcagagctggatcgaccggggcgttcccgaggccgaggcacgggagaaggcggagaaggaccacgccaggcatctccccgacggcgtggacagtcccggaacactgctcaccgtcctggagcacgaaggggtgcccgtcggaacgctgtggctggcgctgtccgagggcagcacgttcgtcttcgacgtcgaggccgacgcacgccaccgcggccagggccacggacgttcgctgatgctgctggccgaggcccagtcggtggccgccggaaagagccggatcggcctcaacgtcttcgccggcaacacccccgcggagcgcctctacgagtcactgggctacgagccgacgcagtacgtcctgtacaaggagctgctctgaacctgggccgacgtgtacgacgagccccctccggcctccacgggcaggctccctccgccggacctcaggcttcccctcagccttcccgttctcagccttcctggtctcagccttcctgttcacgctccgccaggaggcggtccgcgatttcctcgacgcgctcgcgcagccccttctggctcttgttgccgtcgaggcgctcgccgccgatgacataggtgggggtgccggtcacgccgatcgccttgccctcggcctggtccgcgtcgacgatcaggatgtgccggccgtcgatcagcgccgtgtcgaactcctctgcgtccagaccgagttcgcgggccacctcgaccaggaagggttctcccttacggtccagctcctcgacccggccgagcaccgcctcgacgtacggccagccctgcccctgctccgcggcctcctcggcggcctgggccgcggcgaaggcgtgcttgtgcttctccagcgggaagtgccgcagccgcagctcgagacgatcgccgtagcgggcgcgcagcgcgcgcaggtcgtcgagggcgctgcggcagtcggggcactggagttcgcaccagacgtccagcacggggacggcgagaggcgcgggggaggagtcgttcatggtccacagtcttccaggagcagaggtgacgacccaaccgggacctcccgagcggtcccggggcggagcctggaacgggccctggggaggagacgacccggagatgtccctgaggtccggtcggaccatggcataccgggcgcggggcggtgcaggatgggagggagagcctcccctgcccgatcgagcccgcctggaggaccggatgattgccgagaccgtctgttccgccgtctccgcggccggcctgggcatagccgtggtcacggcctaccgcaagcgcttcctcgcggccgcccgcatcgccgcgtactcgctggtgcccgtaggcctggtgatgacgggggtcgtcggctgggcggccgacaccactttcagcccgacggcatgggcgggcttcgccttgctcggcggtgcctggctgctgttcgcgaccacgcgtgccgtggagcgccgcagcggcggtacacgcaaggaacgcaaggcggccaaggccgcccagcgtgaagcagtggcccccgcggcctccgcgccctcactgggggagggcgcccgcccggcggcccggcccgcgaccaccccccgggcgaccggcgcctcggacgacttcagcgacatcgaggccatcctcaagaagcacggcatatgaggaagcccggcaggcagatgaagcgggcggcctgacgggctgaaacgacacagaagatcacccgacccgcgcccaagtgatcacgttcgctccgcgccctcacggatattggcgaactcccggtcatcccgggcgtgttgatcccggggcgggtgtcggctgcgccatcatcgcgacgagatgctggacacaacccagagcgacaccgcggctcctcccgaggagcggcgaggttgtctcttcgcgctttcccagccaccgctgatgatcttccttgcggtgatcggctgccttctgctcatggcatcgctgcacgacctgctgctgctctgagccgtacgcggagcccctggcgccacccgccgagggctccgtcagcccggcgcgttcctggtgcccagctccgccgtcctccctgcccccggtatggctccaccccccgtcacggctcctttgccgttacggctccggtgctgtcgccgctcccggccgggtcggattctgcctcgccgcccgtggccgacgcgggaacgggcggacgctgccggtcagcccgccgcttccttgcggcgcgcccggtaggcggccacgtggaggcggttgccgcaggtgcgactgtcgcagtagcggcgggagcggttgcgggagaggtcgacgaaggcgcgtcggcagtccggcgcctcgcaccggcgcagccgctcctgctccccggccaccacgaagaaggccagtgccatcccgcagtcggccgcgaggtggtcggcgacggaggcgcccggcgcgaagtagtggacatgccagtcgtagccgtcgtgatcggtgagccggggggtggttccggcggcggcgaccagttcgttgatcaggccggccgcgatccgggcgtccgcggcggcgaaaaccccggcgaaccggtcgcggatcttgcgcaccgccgagagatcgaactccgacaggacgccgacatcgctgatctcgtgctttcctacgaaatctgcgagcgacgcgacatccgagagaccgtccctcgcgtcgtcgtcctccggtgcggtgttcaccagatcgaccacggcgtcgagcgcgcaccgggtgtcgtgggtgatcagcacgtttcgctccctggcctgggggtcgggcgggcgcccgccgatgctggccgagcctagcggctcgacgcggccggggaaccgtcgcgggccatgcctgaggcgccggcgttacggccgacacgtttccggtacacgcggcgccttcggcggccgggcgtcggccgtgcggccgacgagtcggctcctgcggacatgccgacgccgcccccgcgtgtatacgcggtggcggcgccggtgtgtacccgatcgggacgttttggcccgagccgtctccccgagtggacggcgccgggcggctttgtgggttctctctagctctcggccaggatgtgtgagagctccgtgtcgagatcgaaatggcgatgctccgtgccggggggcacggcggcgtccgttcgcttcaggaacgactccagggcccgcgccggggcctcgagcagagcttcgccctccggagagctcagggcgatgcagacgacgccctgaccatggctgcgggacggccagacgcggacgtcgccggtgccggtgggccggtgcaggccctcggcgaggaggtcgcgggcgaagacccactcgacggtttcctcggctccggtgtggaaggtggcgtgcacggcgtagggatcggccgtgtcataccgcagtcctgcgggtacaggcagtgaggactcgctcgacacaacgaggcgcaggtgcagctcgcagctgaccgtggtgttcataagcgccagggcctttcgctcagtgtgcgctcggggattcgcacgtcggcgaaatcgacatgccacctacggtgccgttgtaaacccctctgagtgttttgcgtgtctttaggtacctcatccggccgagagatcgttcgcgaggtacgaccattccggtgactggtttccctccggtagggtttgttgtatgaatacggggagtgacgagccgggcgaggtcgccgtggccgctgacgaaacgaacgccgagcgggggctcggctcgagggcgccgaaattcatcaaggcgcgtcgcgcgctgcacctgagctggcaggtgggcgttttcatcgtggggctcgcggtcgtcgtcgcgggcgtgatcatgcttccgctgcccggtccgggctggctggtgatcttcggaggcatggcgatctgggcgacggagttcgtctgggcccagctggtgctccgctggacgaagcgcaaggtcaccgaggcgacccagcgtgcgctcgaccccagggtgcggcgccgcaacatcatcctcaccaccgtcgggctcgtgatcatcgccgctcttatggccgtctacgtctggaagttcggcttcgcgatgccctggaacatcaaggagtagcgggtcggcgcggtggcggtccaagggtgaccgccggacctccccgcacgctcgccggacggtcgggggcaccccctgacatggggtaatgttcttcctgcgcccgggcgattagctcagcgggagagcgcttcgttcacaccgaagaggtcactggttcgaacccagtatcgcccacgtatgcgagaggcggccttgtccacggattccgtggcgggccgccttcgtcgtgtctgcgctgtggttgtggctcggtggtcgtggttgtggcctgggcagttggaagcggcagtggagagcaggggtgcaatcgggggctgcgcgtctgcgcggctacacggctgcacggctggagttggcgtcgctctccgtatccggcgcaacggatccttgccgtagcgccgtagcgccgtagcgccgtagcgccgtagcgccgtagcgccgtaggccgcgcgtcgcgagtcccgtttcggtcctggtgcgttcgctctcaactcccctcccggcgttcggcatttcggccgtgcgcctcccacctgcgtactcgccggccctccgtcgccccgccccgccgccgctcccgccgcgtcctccaaccgcgtcccagcaattcctgtccgaatcattgacgtgcccggagggcctccgtaccttgtgccagcaagcgcttacttgaaacgattcatgacagtggacgcaatgtcgcggggagggcccgaccatgcagaaaaacgggaatgttgagaggcggacgatcctcaaggcggccggtgcgtcggcggccgtgctggggctggccgcgacgaccggctgtgggggcgacagtgactcgggggacgggacggtcacgatccgctacgcctggtggggtgccgaagagcgcgccaagcgtatcaaccagaccatcgcgctcttcgagaagaagtacccgaagatcaaggtgaagaccgacttccaggactacgtggccttttgggagaaattccagacgcaggccgcaggtggaaatcccccggacgttttccagaatgcggtggcctatctgcgcaagtatgacaagcggggcatcctgctcgatctcaagtcgcagatagacgccgggaatctgagcctggacggattccgggcgggggtcgagaaggtcgggcaggtcgacggaaagcagctcggaattccggtcggctccaacaccatgtccctcgtcatcgaccagaaggtcttcgacaaggccggcatcaagccggagcagggctggacctgggacgagtacttcaaggccctgaagaagatccacgacaccgagaagatctcgggggacaccggctacttcggtgtgatgtacctctacgacctctacctccgccagaacggcaaggccttcttcaccgaggacggactcggcttcgacgaggccgacctgacggagtggtgggccgacggctacaaccgcctcaaggccggcatcatcaccgaccccaagaagatccaacagctcaggcccaagtcggcgctcgcgtccggcgacgccgcctcggagttcacctgggacaacttcgcggtccggtacagcaccgagggcgacagcacgtacgcactcgccccgatccccaccaccgacggcaagcagaccggccagtacctcgcctcactcatgctgagtgcctccgcccgcaccgaacatccgaaggaagtggcccagttcatcgacttcatggtccatgacccggaggccgccaagatcatgggctacgaccgcggcatcctcgcgaccaccgagcagttcgacgccttcaagccgaccgacccggtcagcaaggagatcgcccagtacgaggaggacacctccgcggcaggcgtccttggtgccatcactccgcacccgtccggcgccgacaccgtcgaggccaccttcctgcgcatcgccgacgacatgtcccagggcaagacgaaggtcgccgacgcggtcaaacaattcttctccgaagcgaaggccgccctcgccgcttgatgggaacagcagtgacgctcgtcaaggactcaccgccccaggtacctgccgaacgccccgcccgccccgccgtcgtcaagcgtcggggccgccgggagaatctggccggctacctcttcatgtcgccgtggatcgccggtttcctgctgctgacggcaggcccgatggtcgcctcgctctatttcgcgttcaccgactacaacctcttcaattcaccgaagtggatcggtctcgacaacttcaccaagatgttcgacgacccccgctggcagaagtcggtggaggtgacggccaagtacgtgatcatcggcaccccgctgaagctgctgctcgccctcggcgtcgccctgctgctcgcgcagagccgccgcggccaggccttctaccgggccgcgttctacgcaccctcgctgatcggcgccagcgtctccgtgggcttcgtctggcgggcgctcttctccgacgacgccgtcgtggacaaagcgcagaccttcctcggcttccacaccggcggctgggtcggcgacgccgactgggttctctacagcctggtcgcgctcaccgtctggcagttcggcgcccccatggtcatcttcctggccggactaaagcaggtgccgcgtgagctgtacgaagcggcggaggtcgatggcgccggaccgttccggcggttctggaacatcacgctgccggtgatttctccggtgctgttcttcaacgtcctgctggagaccatccactccttccagatcttcggctcggcgtatgtcgtctccaacgggtactgcggtcccgccgacgccacgctggtctacacctgctacctgtaccagaagggcttcaaggaggcccaaatgggctttgcctccgcgatggcctggatgctgctgctcgccgtggcgctggtgacggccgtcctcttctggtcccagaaacggtgggtgcactacgaggaggacgctcgatgagcgctaccgcaaccaccgctcgcaagccgcgcgcgctcgggcggcgccggaagggttcgctcgcctggcacctcggcgccctgctggtcctcgcggtcgtgctctacccggtcgtctgggtcatcggcgcgtccttcaagcccagcaaagagatcatcggcagcctggagctgttcccgacggaaccgatcatctccaatttcaaggggctggcggacggtatcgccgacgtctcgatcgccacgttcttccagaactccctcgtctacgcgctcggttccgtcgtcggcatcctggtctcctgctcactgaccgcgtacgccttcgcccggatccggttcgccggccggaacctgatgttctcgctgatgatcggcacgctgctgctgccgtatcacgtgctgctgatcccgcagtacgtgatgttccagaagctggagctgatcaacacctacgtaccgttgctgatcggcaaatacctggccaccgaggcgttcttcgtcttcctgatggtgcagttcatgcggaacctgcccagggaactggacgaggcggcccgtctcgacggctgcgggcatctgcggatctactggtcgatcgtgctgccgctgtgccggtccgcgctcatcaccagcgcgatcttcaccttcatcaacgcctggaacgacttcatggggccgctgatctacctgaacgagcccggcaattacaccgtctcgctcggcctgatgctcttccgcgactcggacggcgtcacctccaactacggcggcatgatcgcgatgtcgctggtggcgctgctgcccgtcctgctcttcttcctcgccttccagcggcacttgatcgacggtatggcgacctccgggctgaagggctgacgtgccgatgactcgtacggccgaagcccgtcgtgcccggccgtgggcgaaagcccgcaagccgccccgcaagccgccccgcgaatcggccctcgccgagcgcttcggtctcttcgccgagtgtctgctcacgggggtgtggatcgcggtggcctcgctgccgctgctcacctaccccgcggccttcgccgccggggcacggcatctgcgccggcgcacggctcacgagggcggcggcggacgggagttcgtcgccgacttccgtgcggccgtgcgcggcgggtggatcgcggggctcgccggctgggccgcggcggccgcggtctgggtggatgtgcaggccgcgcgtgcgggaatgccgggcggccccctcgtgggtgccgtcggcctcttcgcgctcatcggactggtcgtcgccgggctgcgggcggcggcggtctgggagccgggcgtgccatggcgggtgctgctcgcgggcgccggacgccgtacggtcctggatcccgccgggtccttcctgctcatcggcggactggcggtggtggtctgctcgggcctgttcatcgcaccgctcgcggttcccgtgctcggagccgtcgcggcggcggccgtcgccgtggaggagaggtatcggcggcgcgctcgctaatagcttacgaacgttcgtatgcgtcgcggatagctcacgaacgttcgtacgcgctgcgggatggctcacgaacgttcgtacgccaattccggcgccctgcctggctgccctgcccgcacccccgccacccccaccagcgccccccacccacaccacccccatccccacccacacacccaaccctccccctgtcatgcccctgacttccccgcacggaaaggaaaggccatgtctcccatcccccgtaggtccctcctcaaggcagccgccgtcgccggagccgccgcccagttcagctgggccctgggtgccaggaacgcgcaggccgcgccgagagccgaggccgccgacgcggacccggtgaccctggactggctggaggacggcggcctcggtgccgcgcccggctccaccgtcggtgtgccctggccgaagggcgcgtacgaggaggaccaggcgttcgcgctcacggacgcggacggcaaggccgtacccgtgcagtcctggccgatcgcctactggccggacggctccctgaagtggaccgcgcacgccgtcggcacgggagccggcgccgggaagctcacgctcgccgccggttcgcccgccgcgcccgacaagaaggtgaccgtcgacaagcgcggcggcacgatcgacgtgtcgaccggcgtcatcacggcgaagctcggcaagtccggctccacgctggtcaagtcggtcacacgcggttccaccgagatcgccaagaacggccggctcgtgctgatccgccagcccgagctcgaggacggcgaccagggcacggaaaagtacgaacgcttcgagagcgccatctccgacgtcaccgtcgaacaggacggcccggtccgtgccgtcgtccgcatcgacggcaagcaccgcaagggcgaccgcagttggctgcccttctccgtccggctctatttctacgcgggcgccgagtccttccgcatggtgcacacgatcacgttcgacgggaagcaggagcccggcaaggcgagcggcgacttcatccgcgggctcggtgtgcgcttcaccgtgccgatgcgcgatgccgcgtacgaccggcacatccgcatcggcggtgacgacaccggtctgctgcgcgaggccgtcaagggcatcaccggactgcgccgcgacccgggcgcggccgtgcaggcggcccagttcgcgggcgagaggctgcccgacccggccacctgggaccagcgggtcaccacccgtctccagtacatccccgagtggggcgactacaccctcgcccagctctccgccgacggcttcaccctgcgcaagcgcaccaggaaggggtacggctggatcgccgcgggcggcggccgcagggcgagcggcttcggatacgtcggcggacccagcggcggattctccttcggcctgcgggacttctgggagaaacaccccgcccagctcgacatccgcgacgcccacaccgacgaggccgaggtcaccctctggctctggtcgcccgaggcgcagcccatggacctgcgcttctaccacgacggcatggaccaggacacctacgccgaacagctcgaaggcctcaacatcacctacgaggactacgaaccggagttcggcaccccctacggcatcgcccgcacctccgaactcctcttctgggccaacgagtcgacgcccacccccgagaagctcgccgaacaggtcgaggccgtccgggtgctcccgcagctcgccgccccgcccaagcacctcatcaaggccaaggtcttcggcggcctgttctccgagcccgaccgctccaccaccgcgaaggccaagatcgaggaccatctcgacttcctcttcacgtactacaaggaccaggtggagatgcggcgttggtacggcttctgggactacggcgacttcatgcactcgtacgacaccgtgcgccaccagtggcggtacgacgtcggcggctacgcctgggacaactccgagctgtcgccggacctgtggctgtggttcgcctatctgcgctcaggacgctcggacatcttccgcttcgccgaggcgctcacccggcacaccggcgaggtcgacgtctaccacctcggccagtgggcgggtctcggcacccggcacggcgtgcagcacttcgccgacagcgccaagcagcagcgcatcgccaacaccaactaccggcggtactactactacctcaccgcggacgagcgcgtcggtgacctcatgcacgccaacgtcgactccgacgagacgttcctcgtcctcgacccgatccgcaagatccgcaccgagccgtacacgcccgaccggcacgccctgtccatcggcttcggcacggactggagcgggctcgtctccgcgtggctgaccgagtgggagcgcaagggccccaagtgggcgaaggccaaggcccgcgtgctgtcgacgatggagaccatcgccgcccagcccaacggcttcgtccagggcaatggcctctacgacctcgacacgggcaagttcgccatcgcccccgcgcccgtcgtgtccgtctcgcacctctccgcggtgttcggcctcaacgagctgtgcgccgagctgatcgacctggtcgacatgccgaagttcaaggaggtctacctcgactactgccgctacttcaacgccagcaagaccgaacaggcggcacggtacggttccaacttcggctccctgctgctgttccagggccactcgcgcctcgacgcgtacgccgccgtacagaccggcgacgcgacactcgccaagcgcgcctggacgaagttctacagctccgacggctacatggagtcctcgccctggaagacggagaagctgagcggccccgtcaccctggtggcgggcagcgaggccaactgggtcagctcgaacgacaccgcgctgtacggcctcgccgccatcgagaacctggcgctgctgggcgacaagatgccctgagcggccggtcgaccgcgctcagtacatcctccccagcacctcccgcacccgtcgggcgtcccggatccgctgctcgtacgtcgccccgaccgcgagcagcaccagcccggcgagggcgggaggcagccagcgcgggagcacaccggccaactgcaccagatacggggcgagttcgtgcagcgcgtccagcgccagcacggccccgccgagcagcaggggcgcccggaggcggtggcgggcgcccagcagggtgacgaggagcgccgccgccccgagcagcagcgggcgtagccagtgcgcgtcgccccatgccgtcagcagactcggcacgagcgtcgccgcgaggccggggccgtacgccgtccaggacgaggcgagcggatcccggcgccgccggacgacccccacgagcagcgcggggacggtcaccggcaaggtgtacgcctccggggcgccgacgccccaggaccccaggcgcacccacgtcgccagcacgaacagggccgtggccgcgtagccgacgctcctgcggtccgcccggacggcggtgccggcggcgatcaccccgcacagggcgaggacgagcgccagcagcgggggatcggtgacggcgagaccgaccgccaccaggcccgcgacggagccggtgacttccacggcggtggtggtcccgggctcgtcgagccgcgccgcaagcagggccgccccgcacgggacgaccaggacgagcagcgcggtgtgcgccggcgcccacccggcggcggctcccgcggcacaggccagcgcggtggcaccggcgagggacgtgctcgcccagacggaggccggccgcaccttcacggcggcgaccgcgaacagggcggtcagggcggccagtacgccgagggtcgcgggccgggaggtcagcgagaggaaggagaggctgacggacgtgatcagggcgagcgcggtggccgtgtaagccgtcggcgcccgacgtgcgtacgccgccacggccaccgccgtcgccgcggtcagccccagcgcgaacagccccacgacgtaggggagttccagcgtcgcggggaggacgagcgccgtcgcccatcccagcaccagggcgccggtcatggcctgcggccgccactgtgtggtgcgcagcgcccagaccgagacaccggcgacgacggccagtacgagcggtgccgtcgccgcgtccggcggccagggcgtgccggcggtcaccgcggcccggatgtccgacggggcgcccgaccagatccgccccgcccagcccgccggacccagcagcgcgacggcgaccgggggcagcgccgagaccacggcgagcgcctggacggagccggaggcccaggcgagaccgaggcgtacgggctcgggaagcgggccgcgtacgaccgtcagcagggcgacggcgcacaccagatacccgaccaccgtccagtcggccggcagcgacacacgcaggatgccgccgaggcccgcgaccagcaggaggccgccggtcaccgcggtgccgacggcgaggtccaccctcggtgcccgccaggccgtgcccagtgcgatcaccgccgcgaaggcgaggagcgccgccgcacgggcggcggcgctcggaccggtggcctcgaaggagagccggccggccgccagcacgccccagccgcccatgccgtacgcgccgacggcggcgacgagacgtacggatctcacggacacccggagcgcgacaaccgtgtcgaacgcggccgtcgtcaacagcgcgcccgtgagcgtgtgcggacccgcacccgctgcgatcgcccagagcaggagcgggaattggacggcgaccagcgcggccggaagaggcagccgcagcgggagacgagcggcggcccgctcgggccggccgagcagcgcgccgaggccctggccgtacgcagcccagacccccgccaggacggccgaggcgagcgccgcgtaagccgtgccgttcgccccggggagcgccgcctcgtgcagggcgtaggcgtcgagcaccgtcagcgcgaggccgaggcccgccaccgactcggcggtcgagcgcagcccgcgcctgagcagcgcgacgggagtggcgagtgccgccagcgtcaccgccgcgagcaccacggcccgcccggtgatccccagatgcccccagctgaccagcgtgaacgcgatcgcggcgacggtcagcaggatgccgccgagcaccaggagcacgttctgcacgctcggggcggtcgtctcgggccgccgcgggggaggcgggggcggtacgggggccgagtggagaacgccgatcagccaggcgcggcgggtcagcagcagggcgcggcgggcgtcgagttgccgcagctccccgtcgaggatccgcaactcctcggccgggggcgggatatgggtcatgccttggagtgtggtccgcgtcacggcgcacggcatgagcgcacatactcagtccgtactcagatctcccacggcaggcctccccaccggcagactcggggcatggactggagtcactaccgcttccgcagcctgtgggcgctgccggcaccgcccgcccgcgtgtatgccgcgctcgagcgggtcgaggactacccgcgctggtggccgcaggtgcgcgaggtgacgcggctcgacgaggactgcggagtgatcaggatccgctccctgcttccgtacgacatgacgttcaccgcgcgggacgtgcggcacgacacggcggccgggatcctggagatcaccatgaccggtgacatcgacggctgggcacgctggaccgtcaccgccggcggaccgggcaccctcgcccgctacgaccaggaagtcgacgtgcgcaagccgctgctgaggcggttcgccgtgccgggacggcccgtcttccgcgccaaccacgccctgatgatgcgggccggacaacgcggactcctcgcccacctggacggcggccggcaagcggtttgaacgaaacccgaggggacctgtattgttcagtgcgttcccgggcgattagctcagtgggagagcgcttcgttcacaccgaagaggtcactggttcgaacccagtatcgcccaccgggagaaaccggtccgtcgcagacggaccggtttttttgtgctcacaccgtgttttgtgctcacgcttttgtgctcacgccgccgccggcagctccggacgcagcggccacgccgggtccaccgcctccggcgtaccgctgcgcgcgaaccacgcctgaagcccgcgcgcctgtgccgcgtgccacaccgcctgcaaggtgtgcagctcggccggcgagagccgctccagccgggtagcgaaacggcgccccaccgcccgtacgacctccatcgcggccagcgcgtcggccgccgcgtcgtgcgcgccctcaagggcgacgtcgtagtgggcgcacagatcggtgagcgtgcggcggcccttgcggtagcggtccagatgcttgtcgagtacccggggatcgagcacgcgcagcggcgccgactcgaaccagtggtcgaggcaggaggcgcgatgacggcgcaactcccggtccaggagcgtgagatcgaacggcgcgttcatcaccacgagcggccggcccgcggtggcctgttctcccagctccctggctatctcgtccatcaccggcgacggccagcggccgttgcgctgaagatgctcgtcggtcagtccgtgcaccgccgtcgcaccggccggcaccggcactccggggttcaccagccaccgggacacccgcggacgggcccccggggcgtcctggacgacgacggcggccgacacgatccggtcggtctcgacgtccacgcccgtggtctccgtgtcgaacgcggccaaggggccttcgtaccagcacgtcatacgaacacaactcctcgttcacccgcggtggctgacgctccgtcttctgcctgtttggtgatacccgggctgtttgcgccgtacgccggaaggagacaacaggggtacgggtctttgcagttcagcgacccggcacggggattcacttggtctggaaggctgttggtcatggcgatagcgcagcccgaacggggcgggctgctgccccagcgcacggcaccccctcgcggcaccctcgccaccaccgcctgcatggagacactgcaggtgggctacctgcacgcggtcgcggcggccgcgggctgctcgctgtcccagccctttccggacaacggcatcgactggcacgtcagccacagcgcccccgggcacacggtcgacgacgaagtcaccatcaaggtgcagctcaagtgcacgtaccagatcccgccgaatccgccgggccccgccttctccttcacgctcgacaacgcgcacctggcgaagctcgcccgcaccccggtctcggtgcacaagatcctggtcgtgatgctcgtgccccgggcccaggacgactggctgcgcgccagccacgaccgcctcgacctgcggcactgctgctactggatcaacctcgccggacatgccgtcaccggccggcgcaggaccaccgtgcgcataccgacctcgcgcatcttcgacgaccgagcgctctgcgagatcatgacgcgggtcggaacgggaggcagaccgtgacgcaccgcccgacccacgaacccctacgccccgtgcggccccacccggtcgaggccctcccggagaaccagccgcccgacccgggccaggtcgaccccgccgtcctcagcgccctcctgcaccgccacggctggcagcggcgcggcggacccgccggacgctacggccgctggaccccaccgggacccggcagcggcggcacaagcctgctggtgcccgagagccgggccttccccgacagcgacgacctgctcggcgaagccctcgtcgcgctctcccgcagcggatccccctcagcccgggacgtcctgatcgcgctcgccgtgcccagcgacgagatccactggtggcgggacgtcccggccgggcccgcgggcgccgcgccctggcccgtcgaggaccagctgcgcaccgccgcccggcagatgctgctcgcgggcgcactcgccacgcgcgggcgggccggctaccacggcgcccggcaccggcggcccgccgccgcgtccctggagagcgtcctggtcggcgccgcccccgggggacaccggctcaccgcgttcgtgcccgtcgagacggagcgccccctcgccgtacgactgcaccaggccctgtactcggtccgcgaggccgtcgactaccggcgggccaccggcggcatggaagccttcgacgcggccgtccaggccggcgtcagccatgagctcaccgaggcgctggtcgccctcgtccgcggcacggagggcgcccggatcgccgtcgagtgggcgcccgccgccggtgtccccgaaggctgcgcggcgcccgccgaagccgtcgagttctcgcccggcgacctgcccttcctgcgcgaggcgggcgcccgctatctgcgcgaggagccctccgtgccggtgcggatcaccggcacggtcgtacggatgcgcaggtcggggccgcgcggcgcgggcgccgtacggctgcgggtcctggcgggggccgaggtgccgcacgtacggatgacgctggacgaggagtcgtaccggacagcgggccacgcccacctcgtcgggctgcccgtgctggtgcacgggcggctggagagccggggcggtttccggcggctcacggacgtgtccgaggtggcgccggtgcaggtcgacgaggcggagcgggaccggctgatgaagtcgctccaggagaacctggacttcttcgaggaggcgtgcagcggggactgacataaccgtttcgcgaggggcaccccggtctcggtacgatcgcctttgtattgcgcgcgcaatagaagatgcgagcgtgccccgtaggtaggagagaccggtgtcagacgtccgtgtgatcatccaacgcgattccgagcgggaagagcgcgtggtgacgacgggcactacggccgccgacctcttccccggcgagcgcaccgtcgtcgcggcccgtgtgggcggcgagctgaaggacctggcctacgaggtgaaggacggcgaggaggtcgagcccgtccagatctcctccgaggacggcctcaacatcctgcgccactccaccgcgcacgtcatggcccaggccgtgcaggagctgttccccgaggccaagctgggcatcggcccgccggtcaaggacggcttctactacgacttcgacgtcgcgaagccgttcacgcccgaggatctcaaggccatcgagaagaagatgcaggagatccagaagcgcggccagcgcttctcgcgccgcgtcgtcaccgatgaggcggcccgtgaggagctggcggacgagccgtacaagctggaactgatcggcatcaagggctccgcctccaacgacgacggggcgaatgtcgaggtcggctccggcgagctgaccatctacgacaacctcgacgccaagaccggtgacctgtgttggaaggacctctgccgcggtccccacctgcccaccacccggaacatcccggcgttcaagctgatgcgcaacgccgccgcgtactggcgcggcagcgagaagaacccgatgctccagcgcatctacggcaccgcctggccgtcgaaggacgagctgaaggcgcacctcgacttcctcgccgaggcggagaagcgcgaccaccgcaagctgggcaacgagctggacctgttctccatcccggaccagatcggctccggcctcgccgtcttccaccccaagggcggcatcgtccgccgggtgatggaggactactcgcggcgccgccacgaggaagagggctacgagttcgtctacaccccgcacgccaccaaggggaagctcttcgagacctcgggccacctggactggtacgccgacggcatgtacccgcccatgcagctcgacgagggcgtggactactacctcaagcccatgaactgcccgatgcacaacctgatcttcgacgcgcgcggccgctcgtaccgtgaactgccgctgcgcctcttcgagttcgggaccgtgtaccggtacgagaagtcgggcgtcgtgcacggcctcacccgggcccgcggcttcacccaggacgacgcgcacatctactgcacgcgcgagaagatggccgacgagcttgacaagacgctcaccttcgtgctgaacctgctgcgcgactacggcctgaccgacttctacctggagctgtccaccaaggacccggagaagttcgtcggctcggacgaggtctgggaggaggccaccgagacgctgcggcaggtggccgagaagcagggcctgccgctggtcccggacccgggcggcgccgcgttctacggcccgaagatctccgtccaggccaaggacgccatcggccgcacctggcagatgtcgaccgtgcagctcgacttcaacctgccggagcgcttcgacctggagtacacgggccccgacggctccaagcagcgtccggtcatgatccaccgcgccctgttcggctccatcgagcggttcttcgcggtgctcctcgagcactacgcgggcgcgttcccggcgtggctggcgcccgtccaggcggtcggcatcccgatcggcgacgcgcacgtcgagtacctgcagaagtttgccgccgaggcgaagaagaagggcctgcgggtcgaggtcgactcgtcctcggaccgtatgcagaagaagatccgcaacgcgcagaagcagaaggtgcccttcatggtcatcgcgggcgacgaggacatgacggccggcgccgtctccttccgctaccgcgacggctcgcaggagaacggcatcccgctcgacgaggccatcgccaagatcgcgaaggtcgtcgaggagcggacacaggtctgacgcgtacgtcgcacgtgagggggaggcccccggggagccgtcagctccccgggggcctcctctcgtcctcctcctcgtcgtggctgccgcagaggttcgcctacggggatcgtgcggggccgtgtgccctttccggcgcacgtcaccgggaaagcagaggtcgcgcccggcctcgggcagaccgtgccccaggacctgcaccgcgtacgagctcggacagaggagcgacgccacccccagcgggatctcggcgcaccgctcccagcggtcgtagcggctctggtcgtccatcggcccagcttggtcccggacgattctgccggagccccgccgacacgccgcgaacgggcgaagcaatatgctgcacctcatgacgagtgagccggagcagcagatcggagtgggaacgcaggacgcgttccagcgcctgtggacgcctcatcggatggcgtacatccagggcgagaacaagcccaccggtccgggggccgacgacggctgtcccttctgctcgatcccggccaagtccgacgaggacgggctcatcgtccggcgcggcgagcaggtgtacgcggtgctcaacctgtacccgtacaacggcggccatctgatggtcgtgccctaccgccatgtcgccgactacacggacctcaccgagtcggagaccgccgaactcgccgagctgaccaagcaggcgatgaccgcgctgcgtacggcgtcgggagcgcacggcttcaacatcggcatgaaccagggcacggtggcgggtgcgggcatcgccgcccacctccaccagcacatcgtgccgcgctggggcggcgacaccaacttcatgccggtcgtcggccacaccaaggtgctgccgcagctcctcgcggacacccggaagatgctggcggaggcctggcccacggctgcctagccagggcgtgtccggcggatcacgccggatacccggggcctggcacgacctgatcagccggacgggccctggggcggtgccgcgcgggcccgcccgagtgggcccgcgcgccggaggcgctacgcgtcgtacacgtccgccttcctcggtgtcgggtcctggaccgcggtgctgaggaaggacgagcggttgccgaacttctccgtgtccacgccgttctcctccagcaccctgatcgccgccgcgtgcaccacgcgcagcacgggcgtcgcggcccgcagcgcgtcgtcggccatgaagcggtgccgccacggctggtccgcccaggcgtgccgcagcccgaagggctcggggagcgtcagcgagccgccgagccagttgagcagcggcggataccaggtgaggggcgcgcggaccgcgaggcgtaccacctcgtcggcgtcgaccagcgggagcttgaccgtgcgggtctcccagaacctgaccgacttggcgacctgcttcgagggggcctccggcttcgtggtgaacagggagttcaccgggcccagggcgtggccggtgacctcgatgcgcagtgtctcgtgcagcacggtcacggtgatcagcatggtgatgatcagctggccgtcccagagcgtccactggaccccgaggtagtgccggtcgccgctgccgaactgctgcttgttgcagatgtcctgtatcgcgtggttcttgacctggtacgcgtcgacgtccgtgccgcccggacgggagaccgccttggcgttctcaccgatcggtgtgacgacccagtgcttgatcgacggcttggggaaaccgccggtgttgagggggccgcgctccagcatgcgcagctggtcgtggatggaccgtatgacgtcccagctgcggaaggggtggatctccttgcccgcctcgcgcggcaccaggtcctcggcgagctgccagctgccccagcgcgtgcccatgccgagtatgcccttggggcccgcgtagaagacggagttggactgctgctcggcgctgagccgggcgagggactggcgcagctgctcggccgcggtctcgccggggctgccgggcacggcctccgggaccttggcgccgatggcgccgccggccagcaggctgtcccagcgctcccgcagatccttggccgtgcgttcgcagatctgcttggcccacagccagccgacgaccgggacgacgaccgccgcgcgcgcgtaccagccccagaagcccgtgaagggcatacggatcaggaagatcacggcgagggcgcccacggcgaccagcagggtggtgccgagggcggaggcgcgcttgtcctcgcgccgggcgatggccgtccggatctggaagaccagcagccagacgatgaggcccggcaggaagatcaggccgcacagcactatcaccgccgtgagccagttgtcccgctcccggcggatgttgtgcgccgccaggcagtgctcgacgatgacctgcggctccgtgccgaaggactggatgagcgggttgcggccgactccgagcatgcggtcgatcaccgctcgggagaaggcctcgccgaggttgggccgcaggatcttcgcacctctgcgggggcccttgaccgtcgactggtgccactcgttgtcggccttgaggatctcctcgaccgggttgtcccggtaggccgccgaagccagggcgaaggtcgccgccgtctggcccgcggagcccgacaggggcacctgcgcccccgggctgaaatcgaatccgtcgtccgccactgccgcccccatcgccgccgatcccgcttctgcggccttcccgacttccttgccccgcacacctgttgaacaggtcatcgtgctgatgcagtcacaacttgatcaggtcatcagcgtatccgccgccaccgacattcgtcggcggacggccgagaagccgtccgccgacgggagacgggcgtcaccggttcggtcctcagtccggtcctgcgcggtgacgcgttccaactacgaggcctgccgcgtctgttcgcggagccgctccgcaacctgagggggcatcggttcgtgccgtgcgtaggcgcggctgaaacgggcggtgccgtgcgagagggagcgcagatcgacggcgtaccggccgatctcgatctccggcacctcggcccgtacgagcgtgcgcccgccgcccgcctgctcggtgccgaccacgcgcccgcgccgcccggacagatcgctcatcacggtgcccacgtagtcgtcgccgaccaggacggtcacctcggccaccggctccaggagatggatcctggcgtcggccgccgcctcgcgcagggccagcgcgcccgccgtctggaaggccgcgtcggaggagtccacggagtgcgccttgccgtcgagcagcgtgacccgtacgtcgatgagcggatagccggccgcgacacccctggccgcctgggcccgtacacccttctccacggacgggatgaactgccggggcacggcaccgccgacgaccttgtccacgaactcgatgccggcgccgcctggcagcggctcgacctcgatctcgcagatcgcgtactgcccgtggccgccggactgtttcacatggcggccgcgcccggcggccctgcccgcgaacgtctcccgcagggcgaccttgtgcgggatcacgtcgacctggacgccgtaccggttgcgcagccgctccagtgcgacgtccgcgtgtgcctcgcccaggcaccagagcaccacctggtgggtgtgctggttctgttccaggcgcatggtcggatcctcggccaccagcctgcccagaccctggctgagtttgtcctcgtccgccttgctgtgcgcctggatggccagcggcagcagcggatcgggcatctcccacggcgccatcagcagcgggtcgtccttggcggagagggtgtcgccggtctccgcgcgattcagcttcgccacgcaggccagatcgcccgcgatgcagtgcgtgagggagcgctgctgctttccgaacggcgtggacagggcgccgatgcgctcgtcgacatcgtggtcctcgtgcccgcggtcggccaggccgtgcccggagacgtgcaccgtgtcgtcggcgcgcagggttccggagaagacgcggacgagggagacccggcccacatagggatcgctggcggtcttcacgacctccgccaccagcggtccgcccgggtcgcaggccgtgacctcgcgcgccgtgccgtcgggcgtggtgaccttgggcgcggcgcgctccagcggggtcgggaagccgcccgtgatcagctcgaggagctcgaccgtgccgaggccctgacgggcgccctcggcggcgggcgcggcggccagcaccgggaagaaggtcccgcgcgccacggcccgctccaggtcctgcacgagcgtcttgacgtcgatctcctcgccgccgagatagcggtccatgagggtctcgtcctcgctctcggcgatgattccctcgatcagccggttgcgggcctgcgccaggagcggcagctggtccgggccgggctccgactccttgcgctccccggtggagtagtcgaacagccgctgggagagcagtccggtcaggccggtcacgggcgcgtgcccgtcgggcccctgctcgccgtggagcggcagatacagcggcagtacggcgtcggggtcgtcggcgccgaaggcctccgcgcaggtccgggtcatctcgtcgaagtccgcccgggccgcctccagatgcgtgacgacgatggcgcgcggcatgccgaccgccgcgcactcctcccacaccatgcgggtcgagccgtccacgccgtccgaggcggagaccacgaaaagggccgcgtccgcagctcgcagaccggccctgagttcaccgacgaagtcggcgtatccgggggtgtccaagatgttgatcttgtacccgtcccagtcgacggggacgagcgagagctgcaccgagcgcttctggcggtgctcgatgtcgtcgtagtcggagacggtgccgccgtcctcgacgcggcccgcccggttcactgctcccgccgtcagcgcgagagcttccaccaaagtcgtcttgcccgatccgctgtggccgaccagcaccacattccgtacggacgcggggtggtcggccgccgtagccctgccggcggctccggggtgtgcgttcgccttgtcgcccatggccttgcctcccgtgcacggtgaggtcactgtgggcgcggacgtgcggatccgcgtgcggtggcggctccgatgacgcccgcggtgtcttcgagctttgcactcccgtcacggtgcgtccatacgacggacgcgatcgcggcgtgacacggacgcatcaggccatgacacggagggtgcgggtgcccgaccgtcgcacaagcgcgcgcgtggctacgatgggccagccggtggccagcaggggccgcgcggcgacaccgaccatcgggaaggccatgctgaacaagtacgcgcgtgcattcttcacgcgtgtcctcacaccgttcgccgcgtttctcatccgccggggcgtgagccccgacacggtcacgctcctcggcaccgccggagtgatcgcgggcgcgctggtcttctacccccggggggagttcttctggggcacgatcgtcatcacgctgttcgtcttctcggacctcgtcgacggcaacatggcccgccagctcggccgcaccagccgctggggcgcgttcctggactccaccctggaccgggtcgccgacggcgcgatcttcggcggcttcgccctctggtacgcgggcggcggtgacaacaacgtgctgtgcgccgtctcgatcttctgtctggccagtggccaggtggtctcgtacaccaaggcgcgtggcgagtcgatcggtctgccggtcgccgtcaacggtctggtcgagcgcgccgaacgcctggtgatctcgctggtcgcggccggtttcgccgggctgcacaagttcggcgtgcccggcatccaggtgctgctgccgatcgctctgtggatcgtcgccgtcggcagcctggtcacgctgatccagcgtgtcgtcacggtccgccgcgagtccgcggaggcggacgccgcgaccgccgccgagaacgcctcgcaggggagcggagccgcgtcgtgagcagtctgcaggagcggctgacggacggggcctacgcgctcggctggagcaccgtcaggaagctccccgagccggtcgccgcgcggctcggacaaaccgtcgcggacctcacctggaagcggcgcggcaagggcgtacgacgtctggagagcaactacgcgcgcgtggtgcccgacgcgacccccgagcggctcgccgagctgtccagggcggggatgcgttcctatctgcgttactggatggagtccttccggctgcccgcgtggagcgcggagcgggtgaagaacggcttcgacccgaaggacctgcaccacctcaccgacgggctggcctccggccggggcgtcgtcctcgcgctgccgcacctgggcaactgggacctggccggcgcctgggtcaccaccaagctggagacgccgttcacgacggtcgcggagcgcctcaggcccgagtccctgtacgaccggttcgtcgcctaccgcgagggcctcggcatggaggtgctgccgcacagcgggggctccgctttcggcacgctggcgcgccggctgcgcgacggcggcctcgtctgtctggtcgcggaccgtgacctgtccgcgtcgggcgtcgaggtcgacttcttcggcgcgaccacccggatgccggccggaccggcgctgctcgcccagcagaccggcgccgtcctgctggcggcgacgctctggtacgacgagtcacccgtgatgaagggccggcttcatccgccggtcgaggtgcccgagacaggtacgcgggccgagaagacgtctgtcatgacacaggcgctggccgatgccttcgccacggggatcgccgaccatccggaggactggcacatgctgcaacggctgtggctcgccgacctggaacctcgcacggagtccaccgacgggggacggctgtgaggatcggcatcgtctgcccgtactcctgggacgtgccgggcggcgtccagttccacatccgggatctggccgagcacctcatccgtctcgggcacgaggtgtccgtcctcgctccggcggacgacgacacccccctgccgccgtacgtcgtctcggcgggccgcgcggttccggtgccctacaacggctcggtggcccgcctgaacttcgggttcctgtccgcggcccgggtgcggcgctggctgcacgacggcgagttcgacgtgatccacatccacgagccgacctcgccgtcgctcggcctgctgacgtgctgggcggcgcagggcccgatcgtggccaccttccacacgtccaacccgcgctcccgggcgatgatcgccgcgtacccgatcctgcagcccgcgctggagaagatcagcgcgcgcatcgcggtgagcgagtacgcgcgtcgcaccctggtcgaacacctgggcggggacgccgtcgtcatcccgaacggcgtggacgtggacttcttcgcgcgggccaagcccgaccccgagtggcagggggacacgctcggcttcatcggccgtatcgacgagccccgcaagggcctgccggtgctcatgaaggccctgccgaagatcctcgccgagcgcccgggaacccggctcctggtcgccgggcgcggcgacgaggaggaggccgtggagacgctgcccaaggagatgcgcgagcacgtccggttcctcggcatggtcagcgacgaggacaaggcgcgcttcctgcgcagcgtcgacgtgtacgtggcccccaacaccggcggcgagagcttcgggatcatcctggtcgaggcgatgtcggcgggcgctccggtgctcgcgtcggacctggacgccttcgcccaggtgctcgaccagggggcggcgggggaactgttcgccaacgaggacgccgacgcgctggccgagtcggcgctgcgactgctcggcgacccagggcgccgggccgagctgcgcgagcgggggagcgcccatgtgcggcgcttcgactggtcgaccgtgggcgccgacatcctgtccgtgtacgagacggtgacggacggagcggccgccgtggccgccgacgaacggaccgggctgcgggcgcggttcggactggcacgggactgagacgacctctccggcgcgcggggcgccgtgctgtgcaccgcgcgcggggaggacagtccgcttttccaaccttcggtacccgctccgcgaagcggcgaccgagcggccctcgacgcctgcgcggtcaccctccccggcggtgagttccgcatgtggtgacgccttcggcgaggggtatccggacgacgccgagggatgcgtccgtacggtgaccgtggagccgttccggatctcctgcctgtgccacgcctcgtaccgcgaccggtaccgcgtcgccgcccgctccaggaacacccccgactcgtcgaccgggcgccgcgtccggtgcctcgcggaccggtgaccgcgtgctccgtccggcgccgcgcggagccgcggccgggccccggtagccttgccgcccgtgaccgcaaccctcatctggatcctcgtcggcctcttcgcgatcggcctctacctcagctggaccgcggggcggctcgaccggctgcacgcccggatcgacgccgcccgcgccgcgttggacgcccaactgttgcgccgtgcctccgtcgcccaggaactggcgactgccggggtgctcgatccggccgcctcgatcgtgctgtacgaggcggcccacgcggcccggcaggccgaggaggagcagcgcgaggtcgccgagagcgagctgagccaggcgttgcgggccgtcttcggggagcagcagcaggtggaggtggtccgggaggccccggggggcgaggaggcggcgaacgagctggcgcaggcggtgcggcgggtgccgatggcccggcgcttccacaacgactccgtacgcgccgctcgtgcgctgcgccgccatcgcaaggtgcggtggttccggctggccgggcacgcgccgttcccgatggccttcgaaatggacgacgagccgccggtggccctggccgaccgcccgacgacatagcgcctgaccagcatcttcaccaggtgtgccgggaaaatgagccaccgcctcctcattggcccttgctgtggcctggtccactcgcgtttcctcggggctgcagaaccccccctttcaccgagtgaggtcaacccgtgtccagcacgctctccgtccccgcacaggcccccgagaccggcaccgcccgagtgaagcgcggcatggccgagcagctcaagggcggcgtgatcatggacgttgtcacgcccgagcaggcgaagatcgccgaggatgcgggcgccgtcgccgtcatggccctggagcgggtcccggccgacatccgcaaggacggcggcgtggcccgcatgtccgaccccgacatgatcgagggcatcatcagcgcggtgtccatcccggtcatggccaagtcccgcatcggccacttcgtcgaggcccaggtgctccagtccctcggcgtcgactacatcgacgagtccgaggtcctcaccccggccgacgaggtcaaccactccgacaagtgggcgttcaccacgccgttcgtgtgtggtgccaccaacctcggtgaggccctgcgccgcatcgccgagggtgccgccatgatccgctccaagggcgaggccggcaccggcaacgtcgtcgaggccgtgcgccacctgcgccagatcaagaacgagatcgccaggctgcgcggctacgacaacaacgagctgtacgccgccgccaaggagctgcgcgccccgtacgagatcgtcaaggaggtcgccgagctcggcaagctgccggtcgtgctgttctccgccggtggcgtcgccaccccggccgacgccgcgctgatgcgccagctcggtgccgagggcgtcttcgtcggctccggcatcttcaagtccggcgacccggccaagcgcgccgccgccatcgtgaaggccaccaccttctacgacgaccccaagatcatcgcggacgcgtcgcgcaacctgggcgaggccatggtcggcatcaactgcgacaccctccccgaggccgagcgctacgccaaccgcggctggtaaggcacccacaccgatgaacacccccgtgataggcgtcctggctctgcagggcgacgtacgggagcacctgatcgccctggccgcggccgacgccgtggccagggaggtgaggcgccccgaggaactcgccgaggtcgacggcctcgtcatacccggcggcgagtccaccaccatctccaagctggcccatctcttcggcatgatggaacccctccgcgcgcgcgtgcgcggcggcatgcccgtctacggcacctgcgccggcatgatcatgctcgccgacaagatcctcgacccgcgctcgggtcaggagaccatcggcggcatcgacatgatcgtgcgccgcaacgccttcggacgtcagaacgagtccttcgaggcgacggtcgacgtcaagggcgtcgggggcgatcctgtcgagggcgtcttcatccgcgccccctgggtcgagtccgtgggtgccgaggccgaggtgctcgccgagcacggcggccacatcgtcgccgtacgccagggcaacgcgctcgccacgtcgttccacccggaactgaccggcgaccaccgcgtgcacggcctcttcgtcgacatggtgcgcgcgaaccggacaccggagtccttgtaggatctccgggggtcctcccgggcgtttaaggtctgggggagttcgtacaggatgggttacgcgaaggagacaggcagatgtccggccactctaaatgggctacgacgaagcacaagaaggccgtgatcgacgccaagcgcggcaagctcttcgcgaagatgatcaagaacatcgaggtcgcggcccgtacgggcggcgccgacccggccggcaatccgacgctgttcgacgccattcagaaggccaagaagagctcggtcccgaacaagaacatcgactccgcggtcaagcgtggtgccggtctcgaggccggcggcgccgactacgagacgatcatgtacgagggttacggcccgaacggtgtcgcggtgctcatcgagtgtctcaccgacaaccgcaaccgcgccgcctcggacgtccgcgtcgccatgacccgcaacggcggcaacatggccgacccgggctccgtctcgtacctcttcaaccgcaagggcgtcgtgatcgtccccaagggcgagctgagcgaggacgacgtcctgggtgccgtgctcgacgcgggcgccgaggaggtcaacgacctcggtgagtccttcgaggtcgtctccgaggccaccgacctggtcgcggtccgcaccgccctccaggacgccgggatcgactacgactcggcggacgccaacttcgtcccgaccatgcaggtcgagctcgacgaggagggcgcccggaagatcttcaagctgatcgacgcgctcgaggacagcgacgacgtgcagaacgtcttcgccaacttcgatgtcagcgacgaggtcatggagaaggtcgacgcctgagcggcgggagtttcctttcggtgggccggcaggacatgtcctgccggcccaccgtcgttgtcggtggcaacggatagcctggcgaggacagatgatgatcgctgtccgtggatcgccgtcatcgatcgacgaacgacggcgatcagccacctccgcgcgagcggcggcggctcaggcgcaggaaaagggggggctggggtgcgggtactgggcgttgaccccgggttgacccggtgcggtgtcggcgtggtcgaaggagtcgccggccggcccctgaccatgcgcggtgtcggcgtcgtacggaccccggcggacgccgagttgggcctgcggctcgtggccatcgagcagggcatcgagcagtggctcgacgagtaccggcccgaatgcgtcgccgtggagcgggtgttcagccagcacaacgtgcgtacggtgatgggcacggcccaggccagcgcggtcgccatgctctgcgcggcccgccgcggcatccccgtcgccctgcacacccccagcgaggtcaaggccgccgtcaccggcagcggacgcgccgacaaggcccaggtcggcgcgatggtgacccgcctgctgcggctcgacgcgccgcccaagcccgccgacgccgccgacgccctcgcgctcgccatctgccacatctggcgagcccccgcccagaacagacttcagcaggccgtcgccctgcacgcatcgaaagggcgtaccgcatgatcgccttcgtcagcggcccggtcgccgccctcgcccccgactccgccgtggtcgaggtcggcggcatcggcatcgccgtccagtgcacccccaacacgctctccgggctgcgcatgggccgggaggccaagctcgccacctccctcgtcgtacgcgaggactcactgaccctgtacggcttcgtggacgacgacgagcgccaggtcttcgaactgctgcagaccgcgagcggtgtcggaccgcgtctcgcccaggcgatgctcgccgtgcacacgcctgacgcgctgcgccgagccgtctccaccggcgacgagaaggccctcgtcgccgttcccggcatcggcaagaagggcgcccagaagctgctgctggagctgaaggaccggctcggcgagcccctcggcaccggtggcccggcgatcggcagggccgtcaccaccggctggcgcgagcagctgcacgccgcgctgatcggcctcgggtacgcgacccgggaggccgacgaggcggtcgccgcggtcgccccccaggccgaggccgccgggggcacaccccaggtgggacagctgctgaaggccgccctgcagaccctgaaccggacccgctgaccgtcggtcggaccacggggccgcggaccacgggaccgcaaggcaccggcacgcgaggcacaagcaatgcggtgtcctaccggggggcgcggcatcccatcagcggctccgccgcgggccggacccccggccggcagaatcacccggcacgccacggcgaggagaacttcagtgaactgggacgacacgaccgacgcgaccgccgacgagcggctcgtcggcgcgtccgccgaccgtgaggaccaggccgtcgaggccgccctgcggcccaaggacctggacgagttcatcggccaggagaaggtccgcgagcaactcgacctcgtcctgcgggccgcacgcgcgcgtggcgcgacctccgaccacgtactgctctccggcgctcccggcctcggcaagaccaccctctccatgatcatcgcggccgagatgggcgccccgatccgcatcaccagcggccccgccatccagcacgccggcgacctcgcggcgatcctctcctccctccaggagggcgaggtcctcttcctcgacgagatccaccgcatgtcccggcccgccgaggagatgctgtacatggccatggaggacttccgcgtcgacgtcatcgtcggcaagggccccggcgccaccgccatccccctcgaactgcccccgttcaccctggtcggcgccaccacgcgcgcgggtctgctgccgcccccgctgcgtgaccgcttcggcttcacggcacacatggagttctacgagccccacgagctggagcgcgtgatccaccgctcggccggcctgctcgacgtcgagatcgactctcgtggcgcggccgagatcgcgggccgctcccggggcacgccccgtatcgccaaccgtctgctgcgccgcgtacgggactacgcccaggtcaaggcggacggcgtcatcacccgtgagatcgcggcggccgcgctgaaggtctacgaggtggacgcccgcggcctcgaccgcctggaccgcggcgtcctcgaagccctgctgaagctgttcggcggcggcccggtcggcctgtccacgctcgccgtcgcggtgggggaggagcgcgagaccgtcgaggaggtcgccgagcccttcctggtacgggagggactgctcgcccgcacaccccgtggccgggtcgcgacaccggccgcctgggcccacctcggcctcaccccgccccctcgggctaccgggggaaacggacaaggggacctgttcggggcgtgacggcgcgggactcgcaccggcaggaaccccggtgccatgctgagcgttgttccttgcgtgcggactcgcttagactccgccgatgccgccgttgtgggcggcgctgacaacccccatccaccaggccgcccatcgcgcggtcgtgcgaaggaaactccgtcccgtgaataccttgaccctcctcccgttcatcgtgcttatcggggccatgttcctgatgacccgctcggccaagcgcaagcagcagcaggccgcgtcgatgcgtaatgagatgcagcccggcgccggcgtccgcacgatcgggggcctgtacgcgacggtgaaggaggtcaacgaggacacggtcctccttgacgccgccccgggcgtcgacctgctcttcgcgaagaactccatcggcgccgtcctgaccgacgacgagtacaaccgcatcgtccacggcatcgagcacgacctgaagaccgacggcacggtcgtgccggacgacgcctcctccctcaccgagaccgacgagcccgccgccgacgcctcttccgacgcctccgacgacaagcccatcgacctcggcaagaaggacgcggcggacgacaccgccgacgagccgggcaaggcgaagtccgacgaagcagagccgaagaagaccgacggcgagaccgacgcgaagtagtcacgccccgggaccgcgacgcgagccactcgcgcaccgtgcggcccgggatgcgcggtctctcgcacggaatcccgacaccatggcatggccgcccccgcgctgaccccgcgcgcggcggcccgagagggagtacgagaaggtggcagcaccgaagaagggccggagcgcgagcgcccagagcaggccggggcgctcgctggccctcatcctgatcgccatcgcggcgctcaccgggggaatgttcgcctccggaaacaccactccgcgtctcggcatcgacctcgccggcggaacgagcatcacgctcgaggcgaagagcggccaggaatccgcgatcaacaagaccaacatgaacaccgcggtcgacatcatgaaccgccgtgtcaacggtcttggcgtttcggaggcggaggtccagacccagggcgatcgcaacatcatcgtcaacatccccaagggcacgaactccgagcaggcccggaagcaggtcggcaccaccgccaagctctacttccgccccgtcctcgcgaccgaggtctccggtgcggccgcggccagcccgacgcccagcgcctccaacagctcctccaagaaggccaccgacaaggccaccgagaaggcgacgtcctccggcaccccgtcggccaccgccacctcgcagggccgcgcggtcaccgacgcgctgaaggacgaccccacgccgtccgcgagcaactcggcgtccgcctccgccaaggcatcctccagcccctccccgtccgcgagcagtggcgccgaggccgaggccgccaagctccaggccgcgtacaccgcgctcgactgccgcaaggaggggcagcgcgccaaggccggtgagggcgccaagcccaccgacaccaccctggcctgcggcacgaactcggggggccagtggcagaagtacgtgctcggcccggccgaggtcgccggcaccgacgtgaagaaggcctcggcggtctacgacacccaaagtggcgcgggctggaaggtcaccatggacttcacgtccggggggtccaagaagttcgcgagcatcacgggcaagctggcgaagaaccaggaaccgcagaaccagttcgccatcgtcctcgacggctcggtcgtctccgacccgcgtgtcagcgaggcgctgaccggcggtaacgcggagatctccggcagcttcgaccagacggaggccaaggacctggccaacgtgctgtcctacggcgcgctcccgctctcgttccgggagcagagcgtcaccaccgtcaccgccgcgctcggcggcgagcagctgcacgccggcctgatcgcgggcgcgatcggcctggccctggtcgtcatctacctggtgctctactaccggggcctgtcgctcatcgccatcgcctcgctgctggtctccgcggccctgacctacgcgatcatgaccctgctcggcccgacgatccacttcgcgctgaacctgccggcggtctgcggtgcgatcgtcgccatcggtatcacagcggactcgttcatcgtgttcttcgaacgcatcagggacgagatccgtgagggccgtacgctgcggcccgccgtcgagcgagcctggccgcgtgcccggcgcaccatcctggtctccgacttcgtgtcgttcctcgccgccgcggtgctgttcatcgtgaccgtcggcaaggtccagggcttcgcgttcacgctgggtctgaccaccgtgctcgacgtggtcgtcgtcttcctcttcaccaagccgctgatgacgatcctcgcccgcaagcagttcttcgcgaacggtcacagctggtccggcctcgacccgaagcgcctcggtgcccagccgccattgcggcgcacccgacgtccttccgcccccgccgacccgaaggaggcgtgagatgtcgaagctcggcaacctcggcgcccggctccaccgaggcgaggtcggctacgacttcgtcggcaaccgcaagatctggtacggcatctcgatcctgatcaccatcacggccatcctcggcctgacggtgcgcggcctgaacatgggcatcgagttccagggcggagcggtcttcaccacccccaagaccagcgtctccgtgtcgcaggccgagaggtacgcggaggaggcgtccggccacgacgcgatcgtgcagaagctcggctcgggcggtctgcgcgtgcagatcgccggtgtggacaccggcaagtccgaccagatcaaggccgagctctcccagaacctgaaggtcgactcggagaagatcaacgccgacctggtcggccccagctggggtgagcagatcgccaacaaggcctggcaaggcctggtgatcttcatgatcctggtcgtgatctacctggcgatcgccttcgagtggcggatggcggtcgcggccctggtcgcgctgatccacgacatcaccatcacggtcggcatctacgccctcgtcggcttcgaggtgacgcccggtacggtcatcggtctgctcacgatcctcggttactcgctctatgacacggtcgtcgtcttcgacagcctcaaggagcagacgaaggacctcaccaagcagactcgctggacctacagcgatgtcgccaaccgctcgatcaacagcactctggtccgctccatcaacaccacggtggtcgcgcttctgccggtcgcgggcctgctgttcatcggcggtggcgtgctcggcgcgggcacgctcaacgacatctcgctgtcgctgttcgtcggtctcgcggccggcgcgtactcctcgatcttcatcgccacgccgctcgtcgccgacctcaaggagcgcgagccgcagatgaaggccctcaggaagcgcgtcctggccaagcgggcccaggccgccgccaagggcgaggacgccgaggtcgtcggtcagtcctgcgacgagccggacgacgccgcccccgcggtcgtgggtccgcgcaaccagcccgcgtcccgcaaccggggccgcggccgaccctcggggaagcgccgatgaccgagctcgtcaacatcacggagctgctgctcagccgtatccgtgacgttcgtgactacccggagccgggcgtggtgttcaaggacatcacgccgctgctggccgacccggcggcgttcaccgcgctgaccggtgcgctggccgagctcaccgtgcggcacggcgccacgaagatcgtcggcctggaggcccgcggcttcattctgggcgccccggccgccgttcaggcgggtgtcggcttcatccccgtacgcaaggcgggcaagctccccggagcgaccctcagccagtcgtacgacctggagtacggctccgccgagatcgaggtgcacgccgaggacctggtcgcgggcgaccgcgtcatggtcgtcgacgacgtcctcgccaccggcggcaccgccgaggcctcgctccagctcatccgccgggcgggcgccgaggtcgcgggcgtctccgtgctcatggagctgggcttcctgggcggccgggcacggctggagccggccctggccggcgccccgctggaagcactgctccagatctgaggcagcacgcggaaaaccgcacgcaggaccttgcccggccgcagaacaccgccgggcaaggcctgggacggccccaggacaccaccgggcagagcctggaggtatggctcagacgacacactgctggtcaggcctgggagggccgcggtagccccgggacaggccgcgggggccgtagggcgccagcgggcgtctgtgatggccggcaggaggccgtggggcatggctcggggcgcctgtgtaggacgtgccgggggagggccgcagttggccctcccggacaagccactgggggccgtagggcgccggtgggcgtctgtgatggccggcaggaggccgccgggcatggcccaggacacctggtaggaggcgcctgggcaaggcatgggagggccgcagtggccctcccggacaggccaccggggtcgcagggcgccagcgggcagctgtggacggccggcagaaggccgccgggcatggcccagggcacccgtaggacgcccctgggcgaggcctgggacggttcgtaggacgctccgggcaagggcctggggcagtccgtggagcgccgccgggcacggcctgggacggccgcagcgcaccgcgaggcgggcccggaggaatccggcgcccgcctcttgcgtttcttctgttgacggccgtcccagcggcctgaaggcgagcccggagcccgggatcgctaccatgggatctccggagcctgaccgggggacccggaacgcgcacgaggagccctcttgccagacgaggcccagccactcaccgccgccaagcccgaccagacttcgggccccgcggccacgcccgcgaagaacgccgcgcaggggccggtcgagcgtgccccgtccgcgcccggcgacaaggcggcagagcagccccgccccaagtccgccacccccgctcctcccgagcgccccgcagccacgcccgcggcgcgtgccaccacaggccagccggcccgctccggcggctcctccaaccgcgtacgcgcccgcctcgcccgtctcggcgtccagcgctccaacccgtacaacccggttctggagccgttgctgcggatagtgcgcagcaacgacccgaagatcgagacgtcgacgctgcgccagatcgagcgcgcctaccaggtcgccgagcgctggcaccgcggccagaagcgcaagagcggcgacccgtacatcacgcacccgctcgccgtcaccaccatcctcgccgagctgggcatggacccggcgaccctcatggcgggcctgctgcacgacaccgtcgaggacaccgagtacggcctcgacaccctccgccgtgacttcggcgaccaggtcgccctcctggtcgacggcgtcaccaagctggacaaggtcaagttcggcgaggccgcgcaggccgagaccgtgcgcaagatggtcgtcgccatggccaaggacccgcgcgtcctggtcatcaagctcgccgaccgcctgcacaacatgcgcaccatgcgctacctcaagcgcgagaagcaggagaagaaggcgcgcgagaccctcgagatctacgcgccgctcgcccaccgcctgggcatgaacaccatcaagtgggagctggaggacctcgccttcgcgatcctctaccccaagatgtacgacgagatcgtccgcctggtcgccgagcgcgcccccaagcgcgacgagtacctcgccatagtgaccgacgaggtccagtccgacctgcgcgcggcccgcatcaaggcgacggtcaccggccgcccgaagcactactacagcgtctaccagaagatgatcgtccgcggccgtgacttcgcggagatctacgacctggtgggcatccgcgtcctcgtggacaccgtccgcgactgctacgcggcgctcggcacggtgcacgcgcgatggaacccggtccccggccggttcaaggactacatcgcgatgcccaagttcaacatgtaccagtcgctgcacacgacggtcatcgggcccaacggcaagcccgtcgaactccagatccgtacgttcgacatgcaccgccgcgccgagtacggcatcgccgcgcactggaagtacaagcaggagccctccgccggcgcctccaaggtgcgcacggacgccccgaagagcgtgggcaaggacaaggacgccgtcaacgacatggcgtggctgcgccagttgctcgactggcagaaggagaccgaggacccgagcgagttcctggagtccctgcgcttcgacctgtcgcgcaacgaggtcttcgtcttcaccccgaagggcgacgtcatagcgctgccggccggagcgacgccggttgacttcgcgtacgccgtccatacggaggtcggccaccggaccataggagcgagggtcaacggacgcctcgtacccctcgagtccaccctggacaacggcgacctggtggaggtcttcacctcgaaggcggccggagcgggcccgtcccgcgactggctgggcttcgtgaagtcgccgcgcgcccgcaacaagatccgcgcctggttctccaaggagcggcgcgacgaggcgatcgagcagggcaaggacgcgatcgcgcgggcgatgcgcaagcagaacctgccgatccagcgcatcctcaccggggactcgctggtgacgctcgcgcacgagatgcgctaccccgacatctcgtccctctacgcggccatcggcgagggccacgtcgccgcgcagagcgtcgtgcagaagctggtgcaggcgctcggcggcgaggaagcggccaccgaggagatcgacgagagcgtcccgccggcccgtggccgcggccgcaagcgccgctccaacgccgacccgggtgtcgtcgtcaagggcgtcgacgacgtgtgggtcaagctggcccgctgttgcacgcccgtccccggcgaccccatcatcggcttcgtcacccgcggtagcggcgtatcggttcaccgcaacgactgcgtgaacattgagtcactgtcccgcgagcccgagcgcatcctcgaggtcgagtgggcgccgacccagtcctcggtcttcctggtcgccatccaggtggaggcgctggaccgctcccggctcctgtcggacgtcacccgcgtcctgtccgaccagcacgtcaacatcctgtcggcggccgttcagacgtcccgcgaccgggtcgccacgtcccgcttcaccttcgagatgggcgacccgaagcacctgggacacgtcctgaaggcggtcaggggcgtggagggcgtgtacgacgtgtaccgggtgacctcggcccggaggccctccgacgcctgagtcgcgccatcggcgcgccgccgtcggccagccactgccgaccagtcactgccgaccggcaccgatcggccactacgtagaggggctcccgtacacgccgtacgggagcccctctacgtagcagcgtcagaaactcagccgccgaactcgtgcagacccttcagcgcctggtccagcagcgcctggcggccgtccagctccttctggagcttgtcggccttggcgttgttgcccgcggagcgcgccgcctcgatctggccctggagcttgtccacggcggcctggagctgaccggtcagaccctcggcacgcgcgcgtgcctccgggttcgtccggcgccactccacctcctcggactcctggagggcacgctccaccgcatgcatccggccctccaccttcgggcgggcgtcccgcggcacatggccgatggcctcccaccgctcgttgagggagcggaaggccgcgcgggccgccttcaggtccgagatcggcagcaacttctccgcctcctcggccagctcctccttgagcttcaggttctcggactgctcggcgtcccgctccgcgaagaccgagctacgagccgcgaagaacacgtcctgggcaccgcggaagcggttccacaggtcgtcctcgtgctcgcgctgggcccggcccgcggccttccagtcgcccatcagctcgcggtagcgtgccgccgtcggaccccagtccgtcgagccggacagcgcctcggcctccgcgaccagcttctccttggccttgcgggcgtcctcccgctgcgcgtccagcgaggcgaagtgcgccttgcggcgcttggagaacgccgagcgggcgtgcgagaagcggtgccacaactcgtcgtccgacttgcgatcgagccgcggcagccccttccaggtgtccaccagcgaacgcagccgctcaccggcggcccgccactggtcggactgggccagctcctccgcctcgacgaccagcgactccttggcgtgccgcgcctcgtcggactgcttcgcccgctgcgccttgcgctcctcacggcgtgccgcgacggtctcgacgagcttgtccagccgcttgcgcagtacgtccagatcgccgaccgcgtggtgggcgtccacctgttcgcgaatatggtcgatggcggtctgggcgtccttcgccgacaggtcggtggtcttcactcgcttttcgaggaggccgatctcgacaaccaagccctcgtacttgcgctcgaagtaggccagtgcctcatcaggggagccggcctgccaggaaccgacgacctgctcgccgtcggccgtacgcacgtacacggtccccgtctcgtcgacgcggccccacgggtcgctgctcacagcgcctcctccacatgatgcctgcggggggcctcagcacccccgggcatcgtccacagtttcgtcacggccaacataggcgaccagcacggcggctgtccgcatccagcgcgaccgaagtttcgcagttgacggtcaggatttcgtcacggtcgccctgttgaccacgaccgtcgcgttgggcgccccgtcgccctggccagtgctctcaccggccgcggcgatcttcttcagcaccttcatgcccgacgtggagatcgtcccgaagggggtgtagctggccggcagctgactgtcctggtagacgaggaagaactggctgccgcccgtgtgcttctggccggtgttggccatggccaccgtgcccgccgggtacatgccgcccttcagggttttgtccttgaggttctcgtccgggatcgtgtagccggggccgccgcttccggtgcccttcgggtcaccgcactgcagcacgtagatgccgttcgtggtgagccggtggcacttggtgtggtcgaagaaccccttgcccgcgaggaagctgaaggagttcaccgtgtgcggggcctgcgccgtcttcagggcgatgtctatgtcgccgcaggtcgtcgccatcttcatcgtgtagtcggcggacttgtcgatggtgaccgccggctccttcttccagctcagcgacttcaccttgcccgcggcggccttctcgcacgggtccggcgccttgctcggcgaggggctcggggacacctccgcgcccgcgttggcctttttgccgtcgtccttgaagaccccggtcgcgtacgacaccacgctgcccaccacgacgacgcccaggaccgaggcgaccaccgtgttgcgcatccgtgtcttgcgccgcgcggccgtacgccgctgctgctgccgcaagaacttctcccgggcgagctgacgtcgccgctgttcctgggtgaccaccgggtttctcctcatgcgtctcgtacgtcaagtgggacgcgtgcgtcttgtgagccgaccgcctgcgtgtgccccgtaccgtatatgggttcgctgaggaatcggcagcgccggtaggctctgagccacagccacccaccgctgtacgacacaacctcgtacgacaccacgaaggacgatcgtgctcattgccgggttccccgccggggcctgggggaccaactgttatctggtcgcccccgccgcgggtgaggagtgcgtgatcatcgacccgggccatcaggccgcccagggagtcgaggacgcgctcaagaagcatcggctcaagcccgtcgccgtcgtcctcacccatggccacatcgaccatgtggcctcggtcgtcccggtgtgcggcgcgcacgacgtaccggcctggatccatcccgcggaccggtacatgatgagcgaccccgagaaggcgctcggccgttccatcggcatgccgctcatgggcgaactgaccgtgggggagccggacgacgtgcgggaactggccgacggcgccgggctgaagctcgcgggcctcgacctctccgtcgcgcacgcgcccggccataccaaggggtcggtgaccttcacgatgcccgagagcgcggacattccgtccgtgttcttctccggggatctgctgttcgccggctccatcggacgcaccgacctgcccggcggcgacatggacgacatgctcggctcgctgacccgcgtgtgcctgccgctcgacgactcgaccgtggtgctgtccggccacggcccccagacgaccatcggccaggagcgcgccaccaacccctatctgcggcaggtggccgccggcctcgggagcgtggacgctccccgacgaggaatgtgacgagagactttccgtgagcaccttcaaggcccccaagggcacgtacgacctgattcctccggacagcgcgaagtacctcgccgtgcgcgaggccatcgccgccccgctgcgcaactccggttacggctacatcgagacgcccggcttcgagaacgtcgagctgttcgcgcgcggtgtcggtgagtccaccgacatcgtgaccaaggagatgtacgccttcgagaccaagggcggcgacaggctggccctgcgccccgagggcaccgcctccgtgctgcgcgcggccctggaggccaacctgcacaaggcgggcaacctgccggtcaagctctggtactcgggttcgtactaccgctacgagcgcccccagaagggccgctacaggcacttctcgcaggtcggcgccgaggcgatcggcgccgaggacccggcgctcgacgccgaactgatcatcctggcggaccagtcgtaccgctcgctgggtctgcgcaacttccggatcctcctcaactccctgggcgacaaggagtgccgcccggtctaccgggccgcgctgcaggacttcctgcgcggcctcgacctggacgaggacaccctccgccgcgccgagatcaacccgctgcgggtcctcgacgacaagcgggaggacgtccagaagcagctcgggggcgctccgctgctgcgggactacctgtgcgacgcgtgcaaggcgtaccacgaggaggtgcgcgagctgatcactgcggcgggtgtctccttcgaggacgacgcgaagctggtgcgcggtctggactactacacgcgtacgaccttcgagttcgtccacgacggtctgggctcccagtccgcggtgggcggcggcggccgctacgacggactgtcggagatgatcggcggccccgcgctgccgtccgtcggctgggcgctgggcgtcgaccgcacggtcctcgccctggaggcggagggcgtcgagctcgaactcccctcgtccaccagcgtgttcgcggtgccgctcggggaggaggcccggcggatcctgttcgccaaggtcaccgagctgcggaaggtgggcatcgcggcggacttcgcgtacggcgggaagggcctgaagggcgcgatgaagaacgcgaaccggagcggggcgcggtacacggtcgtggcgggggagcgggatctcgccgagggtgtcgtgcagctcaaggacatggagtccggcgagcagacggcggtcggggtgaacgagatcgtggcggagctcgaggcacggctcggctgaccaccggctgcacgggccccaggtgccaacggcgcctggggccttcgtcatcggcgacctgcccgaacgaccgcagcggagggttccccacggtcggctgtccgacgcacagccaccgggctcctcgtcgaccgggtcccgtggcctcgggcaggagggggcgaaaggccgtacggtctcgcgggccgtcaaccccgcgggcgcggattcgtcctgccggacgatttcgacgcctgagagccaccccgcacatcccctgccgcgggccggtgccgggcacggacacctcgcccgcgtcccggccgcggctgccccggacggttcccaccgtgccgctccggcccacgccaccgggtccgagcaggccgaatgcctcgcccggccggatcccgaggtcgatgccgtccaccgcggccacgtcgccgcaccgcttgctaagcctccgtggaaccgaacgctccgggccgatcgcgcgtacctccttatgtccatcgaacggtggacacgcgtgcgcgtgcggcacaatgaccatgcccgcaggcccaactctcaagtgacggaatcggcgtgatgagcaagacgcgagtcaagaacgtctccaccgagccggaagctgccgacacaccacggacggtgggcggcagtcgcgcgttcggtctgctgctggtgatcaccggtgcggccgggctgctcgccgcatgggtcatcacgatcgacaagttcaagctgctggagaacccgaacttcgttcccggctgcagcctgaacccggtcgtctcctgcggcaacatcatgaagagcgagcaggcctccgccttcgggttccccaacccgatgctggggctcgtcgcctacggcatggtgatctgcgtcggtgtgagcctgctcgcgcgggccaccttcccgcgctggtactggctgaccttcaacgccggcacgctgttcggcgtcggcttctgcacctggctgcagttccagtcgctgtaccggatcaactcgctgtgcctgtggtgctcgctggcgtgggtcgccacgatcctcatgttctggtacgtgacctcgttcaacgtccgcaacgacttcctgcccgcgccccgctggctgaagagcttcttcggcgagttcacctgggtgctgccggtcatgcacatcgggatcatcggcatgctgatcctgacgcgctggtgggacttctggaccggctgacccccgccggatccccggggcttcccggccccggcgggattgtcagtggcgtgacatagggttttgcgagtggagcccgacctgtttaccgccgcagcagaagaacgccaggagaaggacccgtccagcagccccctggcggtgcggatgcgcccgcgcaccctcgacgaggtcgtgggtcagcagcatctgctgaagccgggctcacccctgcgcagactggtcggggaaggcagtggaggcccggccggaccgtcctcggtgatcctctggggcccgcccggcaccggcaagacgaccttggcgtacgtggtctccaaggccaccaacaagcgcttcgtggagctgtcggcgatcaccgcgggcgtgaaggaggtgcgcgcggtcatcgacggcgcccgccgcgccaccggcggcttcggcaaggagaccgtcctcttcctcgacgagatccaccgcttcagcaaggcccagcaggactccctgctcccggccgtcgagaaccgctgggtgacgctgatcgccgcgaccacggagaacccgtacttctcggtgatctccccgctcctgtcccgctccctgctcctcaccctcgaaccgctcaccgacgacgacctgcgcggactgctgcgccgggcgctcaccgacgagcgcggtctcaaggaggccgtcaccctccccgccgacaccgaggaacacctgctccggatcgccggcggagacgcccgccgcgcgttgaccgccctggaggccgcggccggcgcggcactcgacaagggcgagccggagatcggcctccagaccctggaggagaccgtcgaccgcgccgccgtgaagtacgaccgcgacggcgaccagcactacgacgtggcgagcgcgctgatcaagtccatccgcggctcggacgtggacgccgcgctgcattatctggcccggatgatcgaggccggcgaggacccccgcttcatcgcccggcgcctgatgatctccgccagtgaggacatcggcctgaccgatccccacgcgctgccgacggcggtcgccgccgcccaggccgtcgccatgatcggcttcccggaggccgccctcaccctcagccacgcgacgatcgccctcgccctggcgccgaagtccaacgccgcgaccatggcgatcggcgccgccatggaggacgtacgcaagggccatgcgggacccgtgccgctccacctgcgggacgggcactacaagggcgcggccaagctcgggcacgcccaggggtacgtgtacccgcacgacctgcccgagggcatcgccgcccagcagtacgccccggaggagctcaaggaccgggagtactacacacccacccggcacggcgccgaggcgcgctacgcggacgcggtggagtggaccaggaagcacctcggtcgaggacggccctgatcgccctgtacgatggctcgcagcgctgagtcccgtgtccgactccggtcgacatcaccaaacgggacatccagccggagcccccgcctcaccgcggggattccaggagcgtcgcgcaccgtcgaaggtgtcgcgggcagcccaccaccacccggtaccgggatcggtcggtgggccactcgcgtgctgcacgtatgtgcccagaccagggagcggctgcccggcaggtccgcaaggacccgcggggtttcccaggctgcggatgcgacctcctttaactctggtgagccgaatccaggaaagagaaaaagacagtggcgaatcagtcccgccccaaggtcaagaagtcgcgtgccctcggcatcgcgctgaccccgaaggccgtcaagtacttcgaggcccgcccctacccgccgggcgagcacggccgcggccgcaagcagaactcggactacaaggtccgtctgctcgagaagcagcgtctgcgcgcgcagtacgacgtgtccgagcgccagctcgtccgcgcctacgagcgtgccgccaagacgcagggcaagaccggtgaggccctggtcatcgagctcgagcgccgtctcgacgcgctggtcctgcgttcgggcatcgcccgcacgatctaccaggcccgccagatggtcgtccacggccacatcgaggtcaacggccagaaggtcgacaagccgtccttccgcgtcaagccggacgacgtcgtcatggtgcgtgagcgcagccgtcagaagccgctgttcgaggttgcccgtgagggtggcttcgcccccgacggcgagaccccgcgctacctccaggtgaacctccgcgccctggccttccgcctggaccgcgagccgaaccgcaaggagatcccggtgatctgcgacgagcagctcgtcgtcgagtactacgcccgctgattcttcggcggacgcagcaccaccttcgcgtcagcccgtcgtctccccgcccttcgtggtgggcgagccggcgggctgacgcatgtccgggaccgtaatgcggtacggagcggccgccccggcgcgataggctcgggcaacgactttcgatgttcaggcatgatccagggagcgggtgcacacagtgtccggtggagaggtggccgggatcctggtggccgtcttctgggcgatcctggtctccttcctcgccgtcgcgctggcgaggctggcccagacgctcaaggcgaccaccaaactcgtcgcggacgtgaccgaccaggcggtgccgctcctcgcggacgcctcgacggccgtgcgctccgcccagacccagatcgagcgggtcgacgccatcgcctcggacgtccaggaggtcacgtcgaacgcgtcggcgctgtcgaccaccgtcgcctccaccttcggcggccccctggtcaaggtcgcggcgttcggctacggcgtgcgccgggcgctcggcagccgccgcgagaacgtgccccccaagacgccccggcgtaccgtgatcgtgggccgccccgtcccgtccgcgcgacgcgagaagcgggacaaccggaataagagggactgacgcagcgatgttccgccgtacgttctggttcaccgcgggcgctgccgccggtgtgtgggccaccaccaaggtcaaccgcaagctcaagcagctgacgcccgagagcctcgccgcgcaggccgcgaacaaggcgatcgaggcgggccacaaactcagggacttcgcactcgacgtccgcgacggcatggcccagcgggaggccgagctcggcgaggtgctcgggatcgacgcggaccccgaactcccgggcccgcggcgcatcgccgccatcgagaacagcaacaacccgaagtacagcaaggacccgaggtacgtcgagaggtcgacgtactcgcacaaccggaatgaggaccactgatggagtcggccgagattcgccgccgctggttgagcttctacgaggagcgcggtcacaccgtcgtcccctcggcgtcgctcatcgcggacgacccgactctgctcctggttcccgcgggcatggtccccttcaagccgtatttcctcggtgaggtcaagccgccgtggccgcgcgccaccagcgtgcagaagtgcgtgcgcacgcccgacatcgaagaggtcggcaagaccacgcgccacggcacgttcttccagatgtgcggcaacttctccttcggcgactacttcaaggaaggcgccatcacctacgcctgggagctgctcaccacgccccaggacaagggtggttacgggctcgacccggagcgcctgtggatcacggtctacctcgacgacgacgaggccgagaccatctggcgcgacaagatcggcgtcccggccgagcgcatccagcgcctcggcaagaaggacaactactggtccatgggcgtccccggcccctgcggcccgtgctccgagatcaactacgaccgcggccccgagttcggcgtcgagggcggcccggccgtcaacgacgagcggtacgtggagatctggaacctggtcttcatgcagtacgagcgcggcgagggcacctcgaaggacgacttcgagatcctcggcgacctgccgcagaagaacatcgacaccggcctcggcatggaacgcctcgccatgattctgcagggtgtgcagaacatgtacgagatcgacacctccatggccgtcatccagaaggccaccgagctgaccggcgtcgagtacggtgccgcccacggctccgacgtctcgctgcgcgtggtcaccgaccacatgcgtacgtccgtgatgctcatcggtgacggcgtcacgccgggcaacgagggccgtggttacgtgctgcgccgcatcatgcgccgcgccatccgcaacatgcgtctgctcggcgccaccggtccggtcgtcaaggacctcgtcgacgtcgtgatcgcgatgatgggccagcagtacccggagctcatctccgaccgtcagcgcatcgagacggtggccctcgccgaggaggccgccttcctcaagacgctgaaggccggcacgaacatcctcgacaccgccgtcacggagaccaaggcctccggcggccaggtcctgcccggcgacaaggccttcctgctccacgacacctggggcttcccgatcgacctcaccctcgaaatggccgccgaacagggcctttccgtggacgaggacggcttccgccgcctgatgaaggagcagcgggagcgcgccaaggccgacgcccagtccaagaagaccggccacgccgacctcggtgcctaccgcgagatcgccgacgccgccggcgagaccgacttcatcggctacacgcagaccgagggcgagtccacgatcgtcggcatcctcgtcgacggtgtctcctcgcccgccgccaccgagggcgacgaggtcgagatcgtcctggaccgcaccccgttctacgccgagggcggtggccagatcggcgacaccggccgcatcaaggtggagagcggcgcgatcatcgaggtccgcgactgccagaagccggtcccgggcgtgtacgtccacaagggcgtcgtccaggtcggcgaagtcaccgtcggagccaaggcccaggtctccatcgacgtccgccgtcgcaaggccatcgcccgcgcccactcggccacgcacctcacgcaccaggccctgcgcgacgccctcggcccgacggccgcccaggccggttccgagaaccagcccggccgcttccgcttcgacttcggctccccgtcggcggtacccacgaccgtgatgaccgacgtcgagcagcagatcaacgaggtgctcgcccgcgacctggacgtccaggccgaggtcatgagcatcgacgaggccaagaagcagggcgccatcgccgagttcggcgagaagtacggcgagcgcgtgcgggtcgtcaccatcggcgacttctccaaggagctgtgcggcggtacgcacgtccacaacaccgctcagctgggcctggtgaagctgctcggcgaatcctccatcggctccggtgtgcgccgtatcgaagccctggtcggcgtcgacgcgtacaacttcctcgcccgggagcacacggtcgtcgcccagatccaggagctggtcaagggccgtccggaggagctgccggagaaggtctccgccatgctcggcaagctgaaggacgccgagaaggagatcgagaggttccgcgcggagaaggtgctccaggccgccgccggtctcgtcgactccgccaaggacgtccgcggaatcgcgctggtcaccggccaggtcccggacggcacgaccgccgacgacctgcgcaggctggtcctcgacgtgcgcggccgcatccagggcggacggcccgccgtggtcgccctgttcaccacggtgggcgggaagccgctgacggtcatcgccaccaacgaggccgcccgtgagcgcggtctcaaggccggcgacctggtccgtgcggccgccaagacccttggcggcggcggtggcggcaagccggacgtagcccagggcggcggccagaaccccgccgccatcggggaggccatcgacgccgtcgagcgcctggtcaccgagaccgccaagtaagagacggtagtgggtatgcgcagaggacgtcggctcgcggtcgacgtcggggacgcccgcatcggggtcgcctcgtgcgaccccgacgggatcctcgcgacgccggtggagacggtcccggggcgtgacgttccggccgctcatcgccggttgaagcaactcgtcgaggagtacgaaccgatcgaggtcgtcctcgggctccctcgctccctcaaggggggcgagggcccggccgcggtcaaggtccgcgccttcgcccaggagctcgcccgcgtgatcgcaccggtcccggtgcggctcatggacgagaggatgaccacagtgacggccagtcagggactgcgcgcctcgggcgtgaagtccaagaagggcaggtccgtcatcgatcaggcggccgctgtgatcattcttcagcaggcgttggaatccgaacgggtgtcaggtaaagctcccggtgagggcgtcgaagtggtcatctgatcgcgatacggtaacgttccgcgcgatgcggcggtgttcgaacagtcgccgcacagcagaagaggcggaacggaggcggtgccacaagcgccgtacgaccgccgcctcgcggctctaggggatcgatgactgagtatggccggggcccaggctccgaaccgtggcatccggaggacccgttgtacggggacggcggatggggaggacaggagccccacgcggcccagtccgcctacggcggccagccgcagcactatccgcagcagccgcagcagcagtacggcgactggggcaacggccagcaggccgggtacgaccagggcgggcagcagtacgagcagcagtacgcggaccaggggcagcagtacccccagcagaacgcggcccagcagcagtaccagcagcacgccgcccaggggcagcagcacaacccccagaatcaccagcagcacgaccctcaaggtcagcagcagcacaacccccaaggtcagcagcagtatgccgaccagactcatcagcagtacggcaacggcggctgggagaccggggcgcacccccaggtcccgtatgccgccgatccggccgacccgtacggggggcagcccgccgcgtacagcggtgagcagcccgacttctacggcacgcccgacgcctacccgcccccggagccgcccggtcggcgccgcgccgagcccaagcccgagcccgagccggagaccgactgggacccgggccccgatgagggagaacacgccttcttcgcgggcggcggcgacgatgacgacgacctcgacgacgaggccaagggccgcggcggacgaggtgaccgccgtggccgtggcgatggcaaggcaaagaagcgccgcaacggatgcgcctgcctggtggtcgtgctggtgttcggcggtggcctcggcggtgtcgggtactacggctggcagttctaccaaaatcgtttcggcgcggcacccgactacgcgggggacgggacgggcgagcaggtgaccgtcgtcatcccgaagggtgccttcgggtcggtgatcggccagaagctggaggaggccggggtcgtcaagagcgccggggccttcgtctccgctcaggcgacgaatcccgacggggacaagatccagccgggcgcgtacacgctcaagaaggaaatgtccgcgaagagcgccgtcgagctcatgctcagccccaagagcaagaacaacctgacggtctacgagggccagcgcaacgcgcgggtctacaccgcgatcgacacgcgtctcggagtcaaaaagggaaccaccaagggcgtcgccgagaaggaatggtcgaccctcgggctcccggactgggcgaacaccgacaaggacatcaaggacccgctggagggattcctctacccgtccacctatccggtctccaagggcatgaagcccaaggacgtcctgaaggaaatggtcaacctggccaaggacaagtacgccgcactgggcatccaggcgaaggccaaggacctgaacctgaagaatccgctccaggtcctgacggtcgcgagcctcgtccagtccgaaggaaactccaagaacgacttcgaaaaggtcgcgcgggtcgtctacaaccgtctgaagccggacaacaccgagacctacggcctcctcgacttcgactccacggtgaattacctgcgcggcgaatccaagctcgccaccggttcggtcaacgacctgcggaagatcaacgacccgtacaacacctacaagatcaagggtctgccgcccggaccgatcagcaaccccggtgatgtggcgatcaacgcggccctcaatccggccaagggcaactggtactacttcgtttcgatcagcgcggacaagacgcttttcgccgagaccaacgaagagcagaaccgcaatcgcgagaagtacctcgaagagcagaagaacggacaatgacgggcaccgacagcaagcgccgagccgccgtactcgggtcccccatcgcccactccctctccccggtgctgcaccgcgccgcgtacgccgagttgaggctgagcgactggtcgtacgaccggttcgacgtggacgaggaggcgctgcccgccttcttcgggaagctcgggcccgagtgggcggggctgtcgctgaccatgccgctgaagcgggccgtcatcccgctgctcgacgagatcaccgagaccgccgcgtcggtggaggccgtgaacaccgtggtgtgcacgcgggacgggcggcgcgtcggcgacaacaccgacatcccggggatggttgcggccctgcgtgagcggggcatcgagcaggtcgactccgccgcgatcctcggcgcgggcgccaccgcctcgtccgcgctggccgcgctcgcccggatctgcaccggtgaggtcgtcgcgtacgtccgcagcgaggcgcgcgccgccgagatgcggcagtggggcgaacggctcgacgtcgaggtgcgtaccgaggactgggcgcaggcggccgaggcactgcgggccccgctggtcgtcgccaccaccccggccggtgcgacggacgcgctggccgccgccgttccggagcggcccgccacgctgttcgacgtgctgtacgacccctggcccaccgacctggccgcgcgctggtccgcgtacggcggcgccgtcgtcagcgggctggacctcctggtccaccaggcggtgctccaggtcgagcagatgacggggcgctcgccggctccgctggacgccatgcggcgggcgggggagcacgcgctggcggcccggtagccggtccgtcagcctgcgcggcggctgcggcggcttgggcaggtatttggccaccgcgccttctcgaacgacagcgtccgcgcgaagctgaagacggcgactccctcgctcgacgtgctcggcgcgatgggacagaagtccggggcagaagaccgggccgctgcggcacgtacgtccgtatccgggaggcgatggggcgcggcggcccggacggagtgagccggccgtccgtcgcagcgtccgccagatggacctggggccggttctcgccaccggacgtgggaggatcggacctggcgggccagggccgcgcacccggtcgcgccgtcgccgtacgcgaggacgcgcgtacgcagggcagtaccagggcgcgagtatgaggagcaccgttgagcaggttgcgctggctgaccgcgggggagtcccacggtcccgcacttgtcgcgacgctggagggccttcccgccggcgtgcctatcaccacggacatggtggcggaccacctggcccggcggcgcctgggctacgggcgcggtgcccgcatgaagttcgagcgcgacgaggtcaccttcctgggcggcgtccgtcacggtctcaccctcggctcgccggtcgcgatcatggtcggcaacaccgagtggcccaagtgggaacaggtcatggcggccgacccggtggatccggccatcctcgccgacctcgcgcgcaacgcgccgctgacccggccccggcccggtcacgccgacctcgccggcatgcagaagtacggcttcgacgaggcccgcccgatcctggagcgcgcctccgcccgcgagaccgcggcccgtgtcgcgctcggcgcggtggcccggtcgtacctgaaggagacggccgggatcgagatcgtctcgcacgtggtcgagctggccgccgccaaggccccgtacggcgtctacccgacccccgccgacgtcgagaagctcgacgccgacccggtgcgctgcctcgacgccgacgcgtcgaaggcgatggtcgcggagatcgaccaggcccacaaggacggcgacaccctcggcggtgtggtcgaggtcctcgcgtacgacgtaccggtgggcctcggctcgcacgtgcactgggaccggcgtctggacgcccggctcgcggccgcgctcatgggcatccaggcgatcaagggcgtcgaggtcggcgacggcttcgagctggcccgggtgccgggctccaaggcgcacgacgagatcgtgcagaccgccgacggcgtcaggcgtaccaccggccgctccggcggcaccgagggcgggctgaccaccggtgagctgctgcgggtgcgcgccgcgatgaagccgatcgcgaccgtgccgcgcgcgctggccaccatcgacgtggccaccggcgaggccaccaaggcccaccaccagcgctccgacgtgtgcgcggtcccggccgccggcatcgtcgccgaagccatggtggcgctggtcctggccgacgcggtggccgagaagttcggcggcgacagcgtcccggagacccggcgcaacgtccgctcgtacctcgacaacctggtcgtgcggtgaccgttccgcgcgtcgtcctcgtcggccccatgggcgtcggcaagtccacggtgggcgcgctcgtcgccgagcggctcggctgcgcctaccgggacacggacgacgacatcgtgaccgccgagggccgcaccatcgccgacatcttcgtcgacgagggcgagccggtcttccgtgccatcgagaagcgggcggtgcacacggcgctcgccgagcacgacggcgtactggcgctcggcggcggcgcgatcctcgacgcggacacccgcgcgctgctcgccgggcaccgtgtcgtctacctctcgatggaggtcgacgaggccgtcaagcgcaccggcctcaacgcggcccggccgctgctcgccgtcaacccgcgccggcagtggcgggagctgatggaggcgcgccgccacctgtacaccgaagtcgcccgcgcggtggtcgccaccgacggccgcggccccgaagaggtcgcccaagccgtcctcgacgcactggagttgaaggaagcatgagcgaggcagtcacccggatccacgtcggcggtaccgcggggacggacccgtacgaggtgctggtcggccgacagctcctgggcgaactcgccggtctgatcggggacagggtcaagcgcgtcgccgtcgtccaccccgaggcgctcgccgagaccggtgaggcgctgcgggccgacctggccgagcaggggtacgaggccgtcgccatccaggtgccgaacgcggaggaggccaagaccgtcgaggtcgccgcctactgctggaaggcgctcggccagtccgggttcacgcgcaccgacgtgatcgtcggcgtgggcggcggcgccaccaccgacctcgccggattcgtcgccgccacctggctgcgcggcgtgcgctggatcgccgtccccaccaccgtcctcggcatggtcgacgcggccgtcggcggcaagaccggtatcaacaccgccgagggcaagaacctcgtcggcgcgttccacccgcccgcgggcgtcctgtgcgacctcgcggcgctggactcgctgccggtcaacgactacgtctccgggctcgccgagatcatcaaggccggcttcatcgccgacccggcgatcctggagctcatcgaggccgacccgcaagcggcccgcactcccgcgggaccgcacaccgccgagctgatcgagcgctccatcaaggtcaaggccgaggtcgtctccggcgacctcaaggagtcgggcctgcgcgagatcctcaactacggccacaccctcgcgcacgccatcgagaagaacgagcgctacaagtggcggcacggcgcggccgtctccgtaggcatgcacttcgccgccgaactcggccgtctggcaggccggttggacgacgcgacggcggaccggcaccgcacggtcctggaatcggtcgggctgccgctgcactaccgctacgaccagtggcccaagctgctcgagaccatgaaggtcgacaagaagtcacgcggcgacctgctccgcttcatcgtcctcgacgggctcgccaagcccaccgtcctcgagggcccggacccggccgtcctgctcgccgcgtacggcgaagtgggggagtaactcccgctcgggcccggcccgcccgatgtgcctctgccgacgggcacttcggcccttccccggccgttcacacaacggcggtcggggacggtaccgttcggtggcgagcgggggttcgagccccgctgccagcgtcaattgcctgtacgagacggagtggcaccggatgcagcacgcagtgggaggtccgctgccgccgccccaccacgcggggcaccaaccggcgaccggttggttgtcggccgcacatcacccgggcgcgcacccgggtcccgcgccggcgcccccgccaggtccggcaccggcgcccccgcccggtttcgcgggcgcgccggtgcctccggggccgccgcacacgcaggtcccgcagcatcacgcgcccccgcagcacgtccccgtgccgcccgcgccggacaccacgggccatgtgcagctaccgcccggcggcccggtccccatgccgagcaccccgcccgccgtgggtccggccgacgccacgtccaccacactcgccgtgctgctcatcggccccgcgggcgccggaaagacgagcgtcgccaagtactgggcggaccaccgccgggtccccaccgcgcacatcagcctcgacgacgtacgcgaatgggtgcgctcgggcttcgccgacccgcagtccgggtggaacgaccattcggaggcgcagtatcgtctcgcccgccgcacctgcggcttcgcggcccgcaacttcctggccaacggcatctcgtgcatcctcgacgacgcggtgttcccggaccgcccggtcgtcggcctcggtggctggaagcgacatgtcggtccggggctgctgcccgtggtgctcctcccgggcctcgagatagtcctggagcgcaacgccgagcgctccggaaaccgccgtctcaccgacgaagaggtcgcccgtatccacggccggatggccggctggtacggatccgggctgccgatcatcgacaattcccagctcgacgtaccggcgacggcccgtgtcctcgacgaggtgctggcccgctccatcgcgagcccgccgcagtggtgaggcaccgctgagcgggcgtcggtgacgacgcccgcaggcggccggccccggccgccgcacccggacggaggtccccgccgcccgtccggacccgttggaccggcggtatccggtcggcgctcgtaggctcgggtcatgtcagaggtgtacgcggcccgccgggagcggctacgggaacggtgtacggcgggtggcagcgcggcggcgttgatctcccgtcccgccaatgtccgctatctcgcgggcgccgcgccgcagggcgccgtactgctgctgggcaagggcgaggacctgctgctgtgcacgggtccgcccggcgaccagcccgcccagggccggctcgacgaggcgctgcgggtgcagctgctggagcggcccggcggtgatccggcggtcgcggcggcggactgcgccggtgcgcagggcgccgagtcgctggcggtcgaggagcaccacctcaccgtcgcccggcaccgggccatcagatcggtggcgccccggctgcgccttgccgatgtcgggggcgcggtcgagcagctgcgcgtggtgaaggacgaggaggagatctccttcctgcggatcggcgcggagatcgccgaccaggccctcggtgaactgctcgaatcgatcctcgtcggccgcaccgagcgccatctcgctctcgaactggaacgccggctcgtggaccacggggccgacgggcccgccttcccgacctccgtcgccaccggcccgaactccggccggcgcggtcaccggcccaccgaccggcgggtggaggagggcgacttcctctccgtctgcctcggcgcgacgtaccacggctaccgctgtgagatcggccggaccttcgtcatcggcacctcgcccgccgaatggcagatcgagctgtacgacctggtcttcgccgcccagcgggccggacgtgaggcgctggcacccggcgccgcctaccgtgatgtggaccgcgcggcccgccaggcgctggagtccacgggccatgcggaaggccttccgccgctgaccggacacggtgtggggctcgaaatcgacgaggacccgcagctggcccccgcggccatgggtaaactggacgcttgcgtgccggtcaccgtcgaaccgggggtccacctcccgggccggggcggtgtcaggatcgatgacacgctcgtcgtacgccccgaggcggacggcggacccgagctactcaccatcacgaccaaggaactgctcgcgctctagccctcgagctacgcgcgtgtcccggggtcgtccacgtcagtccaggagattccgcaaccgtggcttccacgaacgacctcaagaacggcctggtgctcaagctcgacggaggccagctctggtccgtcgtcgagttccagcacgtcaagcccggcaagggcccggccttcgtgcgcaccaagctgaagaacgtgctctccggcaaggtcgtcgacaagacgttcaacgccggcgtcaaggtcgagacggccacgatcgacaagcgcgacatgcagttctcgtacatggacggcgagtacttcgtcttcatggacatggacacgtacgaccagctgatggtcgaccgcaagtccgtcggcgacgccgccaacttcctgatcgagggcttcacggccaccgtcgcgcagcacgagggcgaggtgctcttcgtcgagctgccggccgccgtcgagctcgtcatccaggagaccgagccgggcgtccagggcgaccgctccaccggcggcaccaagcccgccacgctggagaccggtcaccagatccaggtcccgctcttcatcaccaccggtgagaagatcaaggtcgacacccgcacgagcgactacctcggccgggtgaacagctaaccgtggctgcccgcaacacggcccgcaagcgcgccttccagatcctcttcgagggcgaccagcgcggcgtggacgtcctgacggtcctggcggactggatccggcactcccggaccgacaccaggcagccgccggtgagcgagtacacgatgcagctggtcgagggttacgccaaaaaggtgaaccggatcgacgagctcatctcgcagtacgccgtcggctggacgctcgaccgcatgccggtcgtcgaccgcaacattctgcgtctcggcacctacgagctgctctgggtcgacgagacgccggacgccgtggtgctcgacgaggcggtccagctcgccaaggagttctccacggacgactccccggccttcgtgaacggcctgctgggccgtctgaaggagctgaagccgtcgcttcgccgcgaggaggcgtagcgcatcaccgcgcaggacggcaggaccgggtcggacccgggaacggtcgccgtccgttcaagccgcacggaggggcccgcagcagacgctgcgggcccctccggcggttacggcgccgccgacgggccttggcggcctgtcgttggcgtgccgtgccgctgtcgcgggaggagccgtgcatgacgcgctgcagggcgtagatgcccaccgagcacgacctgcgcgagttcctggacgcgatcctggacgggccctcactgccgctgctgctgccggtgagggcctgctcctgcgggctgcggctggcccccccgggggacttgaggggcgtcgttttggcctttccgagctccgggacttgtaggggcgcagtgcgctgccgagagcccggggagctatgagcgggccgacggctgccacgggtttccggaggccgggagtgagccgtcggccgttgtcgggaccctgggggcgggagtggtcccctcggccgttccgggtcccgggggccgggggatcccttcggccgcttcagtctccgggggcgggagtaggccccctcggccgcatcgggtccccggcggcatgagagtgacccctcgaccgctacgggcccccggcggcgagagtggcccctcggcaggccacaggtgcccgcggctcggagagcgcgccgtacgccccgcagccgtacgaaaaaccgccggggtggccggaaacctctcggttccggccaccccggcggcacgtttctgcagcgtcctgcccgtcagccctcttcgtgggagacggcgcggcgcgcgtccgcgtccaggacgccccagctgatcagctgctcggtgaggaccgagggcgactggtcgtaaatgacggcgagtgtgcgcaggtcgtcctggcggatcgacagcaccttgccgttgtagtcgccgcgctgggactggatcgtcgcggcgtaccgctggagggggcccgccttctcggccgggacgtgggccaggcgctccaagtccaggaccagcttcggcggcggctcggcggccccgcccggtgtggtgcccggcagcagctcctgcaccggaaccccgtagaaatccgccagctcggcaagacgctgtacggtgacggcgcggtcgccgcgctcgtacgaaccgaccacgaccgccttccagcgtccctgggacttctcctcgacaccgtggagggaaaggccctgctgggtgcggatcgcccggagcttggccccgagctgtttggcgtattcgctggacatatagctccccggacgctggaacatgtgcggctccgccgcgtggctggtaactcactgtgaggttacgcagcgttactcttccccgtcaagccgaatggtccggaccgacccctccgtggtagacgacgtgcagtgacgccattggagtgacccgcggcgccaggggggtgatcaggccccttgcgggggctggtagcgttggtggcgcaattccgacgtcctttaatgatccgtcccgtgaggcggagaaggaggtccgtttcatatggacacccagcagtacgagtccgatgcgcggcccgttctcgaaggctccgacatcgcgcgggtactgacccgcatcgcccacgagatcgtcgagcgcgccaagggcgccgacgacgtggtgctcctcggcattccgacccgaggcgtcttcctcgcccagcggctcgccgccaagctcgaggagatcaccgaccgcaaagtgccggtcggctcgctcgacatcaccatgtaccgcgacgacctgcgcatgcatccgccgcgtgcgctggcccgcacggacatccccggtgacggcatcgacggccgcctggtcgtcctcgtcgacgacgtcctcttctccggccgcaccatccgcgccgccctcgacgcgctgaacgacatcggccgcccgcgcgccgtacagctcgcggtcctcgtcgaccgcggtcaccgcgaactgcccatccgcgccgactacgtcggcaagaacctccccacgtcgttgcgggagacggtcaaggtcctgctcgccgaggaggacggtcgcgacaccgtgctgctcggtgcgaagcggacctcctcgggcgcgcagcagtagcactcggccgtacgcccctgagtgcgcccctgcgcgcacgcatgcccgaatcctcccgaactgaactgccttacggagcctgacagatgcagcgtcatctcatctcggccgccgacctcacccgcgacgacgccgtccatctcctcgacaccgccgaggagatggcccgggtggcggaccggccgatcaagaaactgccgaccctgcgcggccgcaccgtcgtcaacctcttcttcgaggactccacccgcacccggatctccttcgaggccgccgagaagcgcctctccgcggacgtcatcaacttcaccgccaagggatccagcgtctccaagggcgagtcgctcaaggacaccgcccagaccctggaggcgatgggcgtcgacgccgtcgtcatccggcacggcgcttccggagccccgtaccggctcgccacctccggctggatcgacgcggtcgtcatcaacgccggcgacggcacccatcagcaccccacgcaggccctgctcgacgccttcaccatgcgccgccggctcgtcggccgggacgccgggctcggccgggacctggccggcaagcgcatcacgctcgtcggtgacatcctgcacagccgcgtcgcccgctcgaacgtggacctgctgcacaccctcggcgccgaggtcaccctggtcgccccgcccaccctgctgccggtcggcatcgagtcctggccctgcgaggtcgcgtacgacctcgacagcacgctgcccaagtccgacgcggtgatgatgctccgcgtccagcgcgagcggatgaacgccgcgttcttcccgaccgagcgcgagtactcccggcgctacggcctcaacggcgaccgcatggcgaagatgcccgagcacgccatcgtgatgcaccccggtcccatggtccgcggcatggagatcaccgccgaggtcgccgactccgaccgctgcaccgcgatcgaacaggtcaccaacggcgtctcgatccggatggccgttctgtatctgctccttggcggcaacgaacccgccgtcagccacacccgtatcgaggagaagtaagacagatgagcaagatcctgatccgtggtgcgaaggtactcggcggcgagccgcaggacgtcctgatcgacggcgacacgatcgccgaggtgggcacggggctcagcgcggaaggcgccgaggtcgtcgacgccgccggcaaggtgctcctgccggggctcgtcgacctgcacacccatctgcgcgagcccggccgcgaggactccgagaccgtgctgaccggtacgcgggccgccgcgagcggcggctacacggccgtgttcgccatggccaacaccttcccggtcgccgacaccgccggtgtcgtcgagcaggtctaccggctcggccaggagcacggctactgcgacgtgcagcccatcggcgccgtcaccgtcggcctcgagggcaagaagctcgccgagctcggcgccatgcacgagtccgcggccggcgtcaccgtcttctcggacgacggcaagtgcgtcgacgacgccgtgatcatgcgccgcgcgctggagtacgtgaaggccttcggcggagtcgtcgcccagcacgcgcaggagccccggctgaccgagggcgcccagatgaacgagggcgtcgtctccgcagagcttggactcggcggctggcccgcggtggccgaggaatcgatcatcgcccgggacgtcctgctcgccgagcacgtcggctcccgcgtccacatctgccacctgtcgaccgccggctcggtcgagatcgtgcgctgggccaagtcccgcggcatcgacgtcaccgccgaggtcaccccgcaccacctgctcctcaccgacgagctggtgcggtcgtacaacccggtctacaaggtcaacccgccgctgcgcaccgagcgcgacgtcatggccctgcgcgaggcgctcgccgacggcacgatcgacatcgtcgccaccgaccatgccccgcacccgcacgaggacaaggactgcgagtgggccgccgccgccatgggcatggtgggcctggagaccgcgctgtccgtcgtgcagcagaccatggtcgagaccgggctgctcgactgggccggcgtcgccgaccgcatgtccgtgaagcccgcgcggatcggccgcgccaccggccacggccgccccgtctcggcaggtgagcccgccaacctcacgctcgtcgacacggcataccgtggggcggtggaccccgcgggcttcgcctcgcgcagccgcaacaccccgtacgagggccgtgagctgccgggccgtgtcacgcacacctggctgcggggcaaggccacgctcgtcgacgggaagctcgcgtgacatcactgcatcagacgtaccttgccgccggacagaagtcggcggaggtgaccgactggtccgcccgcatcggctggctcgtgggcctcgccctgttcatcgcgctcgtctactggctgatgcgcgagggctggaagtggcgcggcacccttcagagcgacctgcccgagctgcccgcccgcccgtctcccaccaccaccctcaacggaggcggcaagccgccgccggctggaatgccggacgagccggaccgggtgaaactgacgatgagcggccgctaccacggctccaccaccgccgggcagtggctggaccgcatcgtcgcgcacggcctgggcacccgtagccgggtcgagctcacgctgacggacgcgggactggacgtcgtacgccccggtgcggccgacttcttcgtcccggccgcacagctgcgtgaggcccggctcgacaagggcatcgcgggcaaggtcctcaccgagggcggtctgctcgtcgtcacctgggcacacggcgacaagctgatcgactccggcttccgctccgacgtctcggccgagcacaacgagtgggcctacaccctgaacaacatgatcaacaacacggaaggcgcacgatgacgacctccaccaggggagctgccaaggttcccgccgtactcgtcctggaggacggccggacgttccgcggccgcgcctacggggccgtgggggtgaccttcggcgaggccgtgttctccaccgggatgaccggctaccaggagaccctcaccgacccgtcgtaccaccgccaggtcgtcgtgatgaccgccccgcacgtcggcaacaccggcgtcaacgacgaggaccccgagtcgaagcggatctgggtctccggctacgtcgtacgcgaccccgcgcgcgtgccctccaactggcgctcccggcgctcgctggacgaggagctgcgccaccagggtgtcgtcggcatcagcggcatcgacacccgtgcgctcacccgccacctgcgcgagagcggcgccatgcgcgtcggcatcttctccggcagcgcgctgccggacgagggcacgatgctcgccgaggtgcgccaggcgcccgagatgaagggcgcgaacctcgccgccgaggtcgccaccaaggagacgtacgtcgtccccgcgatcggcgcgaagcgcttcaccgtcgccgccgtcgacctgggcatcaagggcatgaccccgcaccgcatggccgagcgcggcatcgaggtgcacgtcctgcccgcgacggccacggccgaggacgtgtacgccgtgaaccccgacggcgtgttcttctccaacggccccggcgacccggcgaccgcagacggcccggtggccgtcatgcgggaagtgctcgcccgtaagacccccctcttcggcatctgcttcggcaaccagatcctgggccgcgcgctcggcttcggcacctacaagctgaagtacggccaccgcgggatcaaccagccggtgcaggaccgtacgaccggcaaggtcgaggtcaccgcgcacaaccacggcttcgccgtcgacgccccgctcgaccaggtgtccgacaccccctacggccgcgccgaggtctcccacgtctgcctcaatgacaacgtggtggagggcctccagctgctcgaccagccggccttcagcgtccagtaccaccccgaagcggcagcgggcccgcacgacgccgcctacctgttcgaccgcttcgtatccctgatggagggccagcgtgcctaagcgcaccgatatccagtccgtcctggtcatcggctccggcccgatcgtcatcggccaggccgccgagttcgactactccggcacccaggcgtgccgcatcctgcgcgccgagggcctcagggtcatcctggtcaactccaacccggcgacgatcatgaccgacccggagatcgccgacgccacctacgtcgagccgatcaccccggagttcgtcgagaagatcatcgccaaggagcggccggacgcgctgctgcccaccctcggtggtcagacggccctgaacaccgccatctccatgcacgagcagggtgtgctggagaagtacggtgtcgagctgatcggcgccaacgtcgaggcgatcaacaagggcgaggaccgcgacctgttcaagggcgtcgtcgaggccgtccgcgcgaagatcgggcacggcgaatccgcccgctcggtcatctgccactccatggacgacgtgctcgagggcgtcgagaccctcggcggttaccccgtcgtcgtccgtccctccttcaccatgggcggcgccggctccggcttcgcgcacgacgaggaggagctgcgccgcatcgcgggtcagggcctgacgctctccccgaccaccgaggtgctcctggaggagtccatcctcggctggaaggagtacgagctggagctgatgcgcgacaagaacgacaacgtcgtggtcgtctgctccatcgagaacttcgacccgatgggcgtgcacaccggtgactcgatcaccgtcgcgccctcgatgacgctgaccgaccgcgagtaccagcgcctgcgcgacatcggtatcgcgatcatccgtgaggtcggtgtcgacaccggcggctgcaacatccagttcgcggtgaaccccgacgacggccggatcatcgtcatcgagatgaacccgcgcgtgtcccggtcgtccgcgctcgcctccaaggcgaccggcttcccgatcgcgaagatcgccgcgaagctcgccgtcggctacacgctcgacgagatccccaacgacatcaccgagaagaccccggcctccttcgagccgacgctcgactacgtggtcgtgaaggccccgcgcttcgccttcgagaagttcccgagcgccgactcgaccctcaccaccaccatgaagtcggtcggcgaggccatggcgatcggccggaacttcaccgaggcgctgcagaaggcgctgcggtccctggagaagaagggctcgcagttcacgttcgtcggcgagccgggcgacaaggccctcctcctggaggaggccgtccgtcccaccgacgggcgcatcaactcggtcatgcaggccatccgcgcgggcgcgacgcccgaggaggtcttcgaggcgacgaagatcgacccctggttcgtcgaccagctcttcctgatcaaggaactcgcggacgagctggccgccgccgacaagctggacccggagctgctcgccgaggccaagcggcacggcttctccgacgtccagatcgccgagatccgcgggctgcgcgaggacgtcgtgcgcgaggtgcggcacgcgctgggcgtgcgcccggtgtacaagacggtcgacacctgcgccgccgagttcgcggcgaagacgccgtacttctactcctcctacgacgaggagagcgaggtcgcgccccgcgagaagcccgcggtcatcatcctgggctccggtcccaaccgcatcggccagggcatcgagttcgactactcctgcgtccacgcctccttcgcgctgagcgaggcgggctacgagaccgtgatggtcaactgcaacccggagaccgtctccacggactacgacacctccgaccgcctgtacttcgagccgctgacgctcgaggacgtgctggagatcgtccacgcggagacgctggcgggcccggtcgcgggcgtgatcgtgcagctcggcggacagacgccgctgggtctgtcgcaggcgctcaaggacaacggcgtaccggtcgtgggcacgcccccggaggcgatccacgccgccgaggaccgcggcgccttcggccaggtcctcgcggaagcgggcctgcccgccccgaagcacggcaccgcgaccaccttcgcgggcgccaaggccatcgccgacgagatcggctacccggtcctcgtccggccgtcgtacgtcctcggcggccgcggcatggagatcgtgtacgacgagacgcgcctggagtcgtacatcgccgagtccaccgagatcagcccctcccggccggtcctggtcgaccgtttcctcgacgacgcgatcgagatcgacgtcgacgccctctacgacggcgaggagctgtacctcggcggcgtcatggagcacatcgaggaggccggcatccactccggcgactcggcgtgcgccctgccgccgatcacgctcggcggcttcgacatcaagcgcctgcgcgcctcgaccgaggccatcgccaagggcgtcggcgtccgcggactgatcaacatccagttcgccatggccggggacatcctgtacgtcctcgaagccaacccgcgcgcctcccgcaccgtccccttcacctcgaaggcgaccgcggtgccgctcgccaaggccgccgcccggatctcgctcggcgcgaccatcgccgaactgcgggccgagaggctgctgcccgcgaacggcgacgggggcacgctcccgctcgacgcgccgatctccgtgaaggaggcggtcatgccgtggtcgcggttccgcgacatccacggacgcggcgtcgacacggtcctcggcccggagatgcgctccaccggcgaggtcatgggcatcgactccgtcttcggcacggcgtacgccaagtcgcaggcgggcgcgtacggaccgctgcccaccaagggccgcgccttcatctccgtcgccaaccgcgacaagcgctcgatgatcttcccggcgcgcgagctggtggcccacggcttcgagctgctcgccacgtccggcacggccgaggtgctcaagcgcaacggcatcaacgccaccgtcgtccgcaagcagagcgagggcgagggcccgggcggcgagaagaccatcgtccagctcatccacgacggccaggtcgacctcatcgtcaacacgccctacggcaccggaggccgcctcgacggctacgagatccgtacggcggcggtggcccggtccgttccctgcctgacgacggtccaggcgctcgccgccgccgtccagggcatcgacgcgctcacccacggagacgtgggcgtgcgctcgctccaggaacacgccgagcatctgaccgcggcccgcgactagcagccctgagggggacatcggaaacggtgtccccctcttcgtgaggctcaacaggcttcaagaggacactgagacatgtacaagcttttcttccggctggtgttcaagcggatggacccggagcaggcgcactacctggccttccggtggatccgcctcgccgcccgtatccccgtgctgcgcacgttcgtcgccgccgcgctcgcaccccgcttcaaggagctgcgtaccgaggcgttcgggctgcgcatgcacggcccgttcgggctcgcggccggcttcgacaagaacgccgtcgccgtcgacgggatgtcgatgctcggcttcgaccacgtggagatcggcacggtcacgggggagccgcagccgggcaaccccaaaaagcggctgttccgccttgtgccggaccgggcgctgatcaaccgcatgggcttcaacaacgagggctcggcggccgtggcggcccgcctggccgctcgtgaggcggtcttcaggacggtcgtgggcgtcaacatcggcaagaccaaggtcgtaccggaggaggaggccgccgacgactacgtgaagtcgaccgagcggctcgcccggcacgccgactacctggtcgtgaacgtctcctcgccgaacacccccggtctgcgcaacctccaggccaccgaggcgctgcgccccctgctgagcgccgtccgcgaggccgccgaccgcaccgtgacggagcgccgcgtcccgctgctggtgaagatcgcgccggacctcgccgacgacgacatcgacgcggtcgccgacctcgccgtggagctgggcctggacgggatcatcgccacgaacaccaccatcgcgcgcgaggggctcggcctgaagtccgaacccaccctcgtcaaggagaccggcggcctgtccggcgcgccgctgaaggcacgctccctggaggtcctgagccgcctctacgcgcgcgtgggcgaccggatcaccctggtgggcgtgggcggcatcgagaacgccgaggacgcctggcagcgcatcctggccggcgccacgctggtccagggctacagcgccttcatttacgagggccccttctggggccgcgccatccacaaggggctcgccgcacgtctgcggacgagcccgtacgccacccttgccgacgcggtcggcgccgacgtgaggaagtccgcatgagtctggaacccttcggcgcgcgcctgagccgggccatggacgaccgaggccccctgtgcgtcggtatcgacccgcacgcctccctgctggccgactggggcctgagcgacgacgtggcgggcctggagcggttcagccgcaccgtcgtcgaggcgctgggcgagcacgtcgcggtcttcaagccgcagagcgcgttcttcgagcgcttcgggtcccggggtgtcgccgtcctggagaagacggtcgcggaggcgcgggcggccggtgccctggtcgtgatggacgccaagcgcggcgacatcggctcgacgatggccgcgtacgcggaagccttcctccggaaggactccccgctgttctcggacgcgctgaccgtgtcgccgtatctgggctacggatcgctgcggccggccgtggagctggcgcgcgagagcggggccggactgttcgtgctggcgctgacctccaacccggagggcggcgaggtgcagcacgcggtgcgtacggacggccgtgacgtcgcggcgaccatgctggcgcacctggcggccgagaacgcgggggaggagcccctggggtccttcggggcggtcgtcggcgccacgctgggcgacctgtcctcgtacgacctggacatcaacggaccgctcctcgcgcccggcatcggcgcccagggggccgcaccggccgatctccccggggtcttcggggcggcggtgcgcaatgtcgtgccgaacgtcagccggggtgttctgcgtcacggtcccgatgtccgcgccctgcggacggccgcggaccgtttcgcggaggagatcagggccgccgtggccgccgtctgagtcctccgacgagtgcctcgggagcggcccgagtccgaatacatcctcaaatccggggcagtatgtcggaaatgtctggctcgacggaggctgaccaggacttttccgctgttctcgctgactccggcggacttgcccgctagtctccgtcgagagcgaaggggcaagcgtgttgctcgtagctcaccaggtgaggggcgattaggttcctcaccggtccgtatccgacagttcgacatccgaggtgacgtaggcgtggctcttccgccccttacccctgaacagcgcgcagccgcgctcgaaaaggccgccgcggctcgccgggagcgggccgaggtcaaaaatcgactcaagcactccggcgcctcccttcacgaggtcatcaagcagggtcaggagaacgacgtcatcggcaagatgaaggtctccgctctcctcgagtccctgccgggcgtgggcaaggtccgcgccaagcagatcatggagcgactcgggatctccgagagccgtcgcgtacgcggcctcggttcgaaccagatcgcctccctggagcgtgagttcggcagcaccgccggctgagtcctgggcactccgggattgctggaataatcgctgcatggcagtaacaccccgggggacgtcccccgtacccccggacgcacgtccgcggctgaccgtgctctccggcccctccggggtcggcaagagcacggtcgtcgcccatatgcgcaaggaacaccccgaggtctggctctcggtgtcggcgacgacccgcaagccgcgccccggtgagaagcacggagtccactacttcttcgtctccgacgacgagatggacaagctgatcgccaacggcgagctgctcgagtgggccgagttcgccggcaaccgctacgggacgccgcgccaggccgtgctggagcggctggagcggggtgagccggtcctcctggagatcgacctccagggcgcccggcaggtccgcgagtccatgcccgaggccctgctggtgttcctggcccctccctcctgggaggagctggtacgcaggctcaccggacggggcaccgagccgcccgaggtgatcgagcgccgcctggacgcggccaaggtcgaactggcggcggagcccgagttcgatgtgacccttgtcaacacctccgtcgaggacgtagcgcgcgagctgctagccttggtggacgttgtgtgatcgttttttcgatctcatcccatctttcggaaggtagagcgtgtcctcttccatcaccgcgcccgagggcatcatcaaccccccgatcgacgagctcctcgaggccactgactcgaagtacagcctcgtgatctacgcggccaagcgggcccgtcagatcaacgcgtactactcgcagctcggtgagggcctcctcgagtacgtcggtcccctcgtcgacacccacgtccacgagaagccgctctcgatcgccctgcgcgagatcaacgccggtctgctgacctccgagcccgtcgagggcccggcgcagtaggcgttcgttcgctcattgttcgctcatctcaggcccggcagccgactgtcgggcctgtggtgtgccgggggcgcggtgggtcgcccctcgcgatgttgcagcatggagccgtagatttcacgagtgtggggagacccggtggacaagccgaaggtcgtgctgggagtcagtggcggcatcgccgcctacaaggcctgtgagctgctgcggaggctgacggagtcgggacacgacgtccgcgtcgtgcccaccggctcggcgctgcacttcgtcggcgccgccacctggtccgcgctctccggcaacccggtctccaccgaggtctgggacgacgtccacgaggtgccgcacgtccgcatcggccagcacgccgacctggtcgtcgtcgcccccgccaccgccgacatgctcgccaaggcggcccacggcctcgccgacgacctgctcacgaacacgctgctgaccgcacgctgtccggtcgtcttcgcacccgccatgcacaccgagatgtgggaacacccggccacccaggagaacgtcgcgacgctgcgccgccgcggcgccctcgtcatcgagcccgcggtgggccggctgaccggcgtcgacaccggcaagggccgcctgcccgaccccacggagatcttcgaggtctgccgccgggtgctcgcgcgcggcgccgcacggccggacctcgccggccggcacgtggtcgtcagcgccggcggtacgcgcgagccgctcgacccggtccgcttcctcggcaaccgctcctccggcaagcaggggtacgccctcgcccgcaccgccgccgcgcgcggcgcccgggtcaccctggtcgccgcgaacaccgggctgcccgacctggcgggtgtcgacgtcgtccaggtcgggacggccgtgcaactgcgcgaggcggtgctgaaggcggcctcggacgccgacgccgtggtgatggcggcggccgtggcggacttccgtccggcgacgtacgcgaccggaaagatcaagaagaaggacggccaggagccggaagcgatcgttctggtccgtaatccggacattctcgcggagatctcggccgaccggccgcgccccggtcaggtggtcgtcggcttcgccgccgagacggacgacgtcctggccaacggccgtacgaagctggcacgcaagggctgcgacctcctcgtggtgaacgaggtgggggagcgcaggacgttcggctcggaggagaacgaggccgtggtgctcggcgcggacggaagcgagatcccggtgccgtacgggcccaaggaggccttggccgagaccgtgtgggatctggtcgtgccccggctcgggtgacggtcccattcgcccaaagggccgtctcgaatcgctcgaaagcgggtgtggtgaggctggcggagaccccgtggcattgggcagaatgcccgtgccgcaggtcacagcgctcccgagaggcgagacaggggggcggatggccgagtgcgaccgataaactgttctcggacgacgccgggcgcagcctccgtcccgtccgccaatgatcagccagcagccgctgcaaccccagggagcgttgtgtcccgtcgcctgttcacctcggagtccgtgaccgagggccaccccgacaagatcgctgaccagatcagcgacaccattcttgatgcgcttctgcgtgaggacccgacatcccgggtcgccgtggagacgttgatcacgaccggcctggtgcacgtggccggcgaggtcaccaccaaggcgtacgcaccgatcgcccagctggtccgcgacaagatcctggagatcggctacgactcgtcgaagaagggcttcgacggagcttcctgcggcgtgtcggtgtcgatcggctcgcagtccccggacatcgcgcagggtgtcgacacggcgtacgagaaccgggtcgagggcgacgaggacgagctggaccggcagggcgcgggcgaccagggcctgatgttcggctacgcgacggacgagacgccgacgctgatgccgctgccgatccacctcgcgcaccgtctgtcgcaccgcctgtccgaggtccgcaagaacggcacgatcccgtacctgcgtcccgacggaaagacccaggtcaccatcgagtacgacggcgacaaggcggtccgtctggacaccgtggtcgtctcctcgcagcacgcctcggacatcgacctggactcgctcctcgcccccgacatccgcgagttcgtggtggagccggagctgaaggcgctcctcgacgacggcatcaagctggagaccgagggctaccgcctcctggtcaaccccaccggccgcttcgagatcggcggcccgatgggtgacgccggtctcaccggccgcaagatcatcatcgacacgtacggcggcatggcccgccacggcggcggtgccttctccggcaaggacccgtccaaggtcgaccgctccgccgcgtacgcgatgcgctgggtcgcgaagaacgtggtcgccgcgggtctggcgtcccgctgcgaggtccaggtggcgtacgcgatcggcaaggccgagccggtgggcctgttcgtcgagaccttcggcaccgccaaggtcgaggccgacaagatcgagcaggccatcgcgacggtcttcgacctgcgcccggccgcgatcatccgcgacctcgacctgctccgcccgatctactcccagacggcggcgtacggccacttcggccgcgagctccccgacttcacgtgggagcggacggaccgggtggacgcgctgcggacggctgtggggctgtaacggcctgacgttctgtttcggagcccggcattccctcggggtgccgggctccgccgtgtcgagcgccgggtgccgcggcggcccggatcgggtacgcaaatggctggcggaccaaagtggcgtcttcgtacgctggtgatctcccggtgcggaggcctcggatacttcggtggagcgtgcttcggcgtgctgtgaaacttgggacgagccgtggccggatcgatctcgggaggccgacgacgcggcccggtgcgacgggtgcgggtacttctggggtgtctccctcgcaggttcgaatcctgctgccggtcctggaccggtatggccgagcggtccatggcggaagcgcccttcgggcgtgcgtgatccgcagccggactgatctcgggcgcgcgtcggtgtcagtggggtttggtaagaatgctggtgtgagcagcgagaacgggcaggggggcggcggtggcgaagaggcgccgccggagcagcttgcgttgatccgtgaggccgtgcggaaggccaaggtgcccaaggccaagccgcggacgtggcggggagccgcgctggccaaggagttgcccgtcgcgcgtgtgctggtcgacaagggcgtacttcatcttgatcggtacttcgactatgccgtgcccgaggaactggctgccgtcgctcagccgggagtgcgcgtccgtgtgcggttcggagccggcgggcgcaccgtgcgggacggcaggcgggagggcggctcactgatcgacggcttcctcgtcgagcgggtcgccgagtccgactacggcgggccgctggccgcgctcgcgcaggtcgtgtcccccgagcccgtgctcggccctgagctgctcgggctcgcccgggccgtcgccgaccggtacgccgggagcctcgccgatgtgctccagctggccgttccgcccaggcacgggcgggccgaggccggcaagacggccgagccgctgccggctcctcccgcgcccgaacccggctcctggcggcggtacgcgcgcggggcggagtttgtgaagtccctcgccgccgggggttcgccccgggccgtgtggaccgcgttgccggggcccgactgggccgaggagatcgcccgggccgtgcaggccacgctcgcctcggggcgcggcgcgctcgtcgtcgtgccggccggacggcccgccgcgcgcgtcgacgcggcgctccgcgcgctgatgggtgaggggcggcatgcactgctgaccgccgacgcggggcaggagcggcgctaccgggagtggctggccgtgcggcggggggccgtgcaggcggtggtcgggacgcgggccgcgatgttcgcgcccgtgcggaatctcgggctcgttgtcgtgtgggacgacggggatgcttcccacagcgacgacaacgcgccgtttccccatgtgcgggaggtgctggagcttcgggcgacccgggacaagtgcgggtttctgctggggagctggagctgcacggtggaggccgcgcagcttgtcgagagcgggtgggcggcaccgctcgtggccgagcgggaacaggtacgggcggctgctcctctcgtgcgcaccgtgggggacggggatctcgcgcgggacgaggcggcccgggccgcgcggctgccgaccctcgcctggcaggccgtgcgggaggggctgcgccacggacccgtgctggtgcaggtgccccggcggggttacgtgccccggatggcctgcgcgcagtgccgggcgcccgcgcggtgccggcactgcgcggggccgctggaggcgcacgacgccggggcgctgcggtgcggttggtgcggacgggaggacgcggcttggcactgtccggagtgcggtgggttccggttgcgggcgcaggtcgtgggggcgcggcggaccgccgaggagctgggtcgtgcgttcccggccgtgccggtgcgcacctccgggcgtgagcaggtgctcgacaccgtctcgggggcgcccgcgctcgtggtgagtacgccgggggccgagccggtcgccgagggcgggtacgcggctgccctgctcctcgacgggtgggccatgctcggccggccggatctgcgggccggggaggaggcgctgcggaggtggatcggggcggccgcgctcgtccgggggcaggcggccggcgggaccgtggtcgtggtcgccgagccgacgttgcggcctgtgcaggcgctggtgcgctgggatcccgtcggacacgcggtgcgcgaactcgccgagcgggccgagctggggtttccaccggtgtcgcggatggccgccgtgtcggggacggccgaggcggtcgcggggtttctgagcggggtcgaactaccctcggacgccgaggtgttggggccggtgccgttgccggtcacggaggccggacggcctcggcgcgtgggcgggccgccgccgggggagcggtgggagcgagcgctcgtccgggtgccgccggggagcggggccgcgctggccggcgcgttgaagaccgcgcaggcggctcggatggcgcgtgggggcggggggaacgggagcgaggccccggtgcggattcggatcgatccgccggacatcgggtgacgtgagtgactcgggttgctcgccgtggctcgggtggctcgggcgtggggggacgtacgtgcggcggtgcggtggtgcgagcgtgtgcccgggcgggtcccggcatacggctgcctcccggtcgtacaccgggaggcagacaaggggagggggccgtcgggtgtcggccgtcgtgcgttccgcgtgtgctggtcagccgttgcgcgggcccgggaaggccgtcggcctggcctcgtcgcggagcgtggggctgcccgccgtcggctgggtcggcatggagcgggccgcggggaccgtcggcaccgtggggatgccggtgttgacgctcaccgtacgagcggccgtcggctcggtcgcgcgctcggcgtccgcggctgcctgggcggcggcgcgccgcgcgccgtaacggcggtgcaccgcctgcttggtgactccgagcgcggagcccaccgcgtcccacgagaagcccagggagcggtcgaagtccacggcggccgtgaccagggtctcgacactgtcgcgcagttcctgggcgaggcggacggtcggagcgggagcgcgtccgtagacgacgaagcccgtggacgggccggagcggcgtgggcggtagacgttgcccaactgggcggtgagcgtgcgcagtgcgtccacctgccggcggacccgctcgatgtcccgcaccagcaagtgcaggctggcccgagcctgggcgtcgtgggttgcgtggtcggccatgaacaagcctctcgaaccggcgttgaaaaggatcgggccgcgattgcggcccgttgtggtcaactctctcttgaccaacgcgcttcggggattgtggtcacggtgcgggggcgtatgagcatgtacacagggcgcgcgcacgcccgtacgccccggccccgatgactcgccggggtatctccaaagaggcgtcaggggagttgtcagggacggcgtcgaggggcgtacggctccgttccacagccatacgccccctcaaactcctgctcccatagactggtgcgctgccccgcacggctttgcgcagccggatcgcgcggggctgacagaactcccgcccgagaggccgacatccacccatgaagctcgtctttgcaggtactcccgaggtcgccgttcccgccctggacgctctgatcgcctccgggcggcatgaggtggccgccgtcgtgacgcggcccgacgccccggccgggcggggacggcggctggtcgcgagtcccgttgcccagcgggcggaggaggccgggatcgaggtgctcaagccggtcaagccgcgggacgaggagttcctggcgcggctgcgggagatcgcgccggactgctgtcccgtcgtcgcctacggcgcgctgctgccgcgggtcgccctcgacattccggcgcacggctgggtcaatctgcacttctcgctgctgcccgcctggcgcggtgccgctcccgtgcagcactccatcatggccggggacgagatcaccggagcgtccaccttcctcatcgaggagggactcgactccgggcccgtcttcggcaccgtcaccgaggagatccggcccaccgacaccagcggcgacctgctcacacggctcgccttcgccggttccgggctgctcgtcgcgaccatggacggtgtcgaggagggcaagctgaaggccgtgccgcagcccgccgacggcatcactctcgcgccgaagatcaccgtcgagaacgcgcacgtcgactggtctacgccggcgctgcgggtcgaccgggtggtgcgcgggtgcacgcccgcgcccggtgcctggaccgtgttccgcggcgagcggctcaagctcatccaggtcgtcccggtgcccgagcggaccgatctcgccccgggcgcgctgtccgtcggcaagaacaacgtgtacgtcggcaccggttcgtacgccgtcgagctgctgtgggtgcaggcccagggcaagaagccgatgcgggccgccgactgggcacgcggcgtacgcatcacggacggcgagcccctcggcgcgtgacccgcgctcccgcgccgcgggggcgcggccgctgggctacgacgcgcgtccgacgggggcaccgggcgccggctaccggctaccggtcaccggggcgccggctacgagggcgcccgtccttggccaccggggcatcgggcacgggctgtgggggcacctgtccctggccgccggggcatcggccaccggctgcgggggcctctgcccccggccgcgagcgaccggggcaccggctgtgggggcgcctgtccctggccaccggggcatcggccaccggccacgggccaccaggaagcggctcccgtccggtggggcagccgcggtatgcccagccgtcccttgcgggaccggtagcgcgtggctccgccaggcggccccgtcgacgcacgccccgcctcgggtcggcccccgagccaatggcaccgccgagccgggccgtgtgcccgcggaggtgtgatcgccgagttgggtggcgcggcttacggacgtacgaccgctgagccgggtcgtgtgccggtgggggtgtgatcgccgagttgggcggcgcgctcacggacgtatgaccgctgagccgggtcgtgtgcccgcggatgtaggccgccgagcccgggtcgtgtgcctgcgaagacgtgaccgccgagctgggcggcgcgctcacggacgtatggcgtgtgcctgcgcagacgtgaccgtccagctgggccccgtggctcacggacgtgtgaccgtccaggtgggccccgcgtccgcggacggatcgtcgcccggggcggctgcgccccgtagcccccacgacgtaggctgaaaggcgcacttctccccagatccggagcacctttttcgtgagcgagcagtcccgtcagccccgtaagccgggcaagccccaccgtcgtccccagaaggaccccgtccgcttcctcgccttcgaggcgctgagggcggtggacgagcgggacgcgtacgcgaacctcgtcctgccgccgctgctgcggaaggcgcgccagaagggcgacttcgacgggcgggacgcggcgctcgcgaccgagctggtgtacgggacgctgcgccggcaggggacgtacgacgcggtgatcgcggcctgtgtcgaccggccgctgcgcgaggtcgatccgccggtgctcgatgtactgagcctcggtgtgcatcagctgctcggcacccggattcccacccacgccgcggtgtccgcctccgtcgagctcgcccgcgtggtgctcggcgacgggcgcgccaagttcgtcaacgccgtactgcgcaaggtcgcccagcacgacctcgacggctggctggagcagatcgcgccgccgtacgacgacgacgccgaggaccatctcgccgtcgtgcactcgcatccgcggtgggtcgtctccgcgctgtgggacgcgctgggcggcgggcgcgccgggatcgaggacctgctggaggccgacaacgagcggcccgaggtgaccctcgtcgcccgcccggggcgctccaccgccggtgaactcctcggcgtactcggcgaggagtccgcgctgccgggccgctggtcgccctacgccgtccgcctcacggagggcggcgagcccggtgccatcgacgccgtgcgggaaggccgtgccggcgtacaggacgagggcagccaactcgtcgcgctggcgctcgccaacgcccccctcgacgggcccgaccaggcctggctggacggctgcgccgggcccggcggcaaggcggccatgctcgccggtctcgccgccgagcgcggtgccgtgctgctcgcctccgagaagcagccgcaccgggccgggctggtggcgaaggccctcgccgggaacccggggccgtatcaggtgatcgcggccgacggcatccgtccgccgtggcggcccggcaccttcgaccgggtgctgatggacgtgccctgcacggggctcggcgccctgcgccgtcggcccgaggcccgctggcggcggcggcccgaggacctggacggcttcgcgccgctgcagcgcggcctgctgcgcaccgccctcgactccgtgcgggtcggcggtgtcgtcggctatgccacctgctcgccgcacctcgccgagacccgcgcggtcgtcgacgacgtcctcaagcaccacacggtcgcggccgagctgatcgacgcccgcccgctgctgccgggcgtaccggcgctgggcgagggccccgacgtacagctctggccgcacctgcacggcaccgacgccatgtatctggcgctcatccgccggactgcctgacctccgcgtcgggcgccgccacggtggcggcggcgccggcgtcgccgccgtcctcgtgcgacaaccggtgcggccaccacaccttggggcccccgtccaggaacagcgccgtgaccagcaccgaccgcacgacgaacgtgtccaggagcacgcccagcgccaccgcgaagccgatctccgcgaaggcgaccatcgggagtgtgccgagagcggcgaacgtgccggccagcaccagccccgccgaggtgatcaccgcgccggtcgcggcgaggcccgtcacgacgccgggccgggtgccccggcgggccgcctcctcgcggatgcgggtggtcaggaagatgttgtagtcgatgccgagggccaccaggaacacgaagacgaacagcgggaagtccgtctgctcgccggcgtagtcgaagaggtgccggaaggcgagcgcgctcgcgcccagcgccgccgcgaaggacagcacgaccgtcccgatcagcagcagcggtgccaccagggcacgcagcagcaaccccaggatcagcaggacgaccaccaggaccgccgggatgaccaccaggttgtcgtgcgtcgtcgccgcgtccatgtcgagcagcgccgcgctgccgccgcccacccgcgcccgggcgtcgggcacggcgtgcacggcgtcgcgcacccgctccacggtccgtttcgcggcgtcgctgtcggacgggtcggtgagggtcgcctcgaacagcaccttgcccccggacgacggtttcgtccccggcggcacggtgacgctgtccgccaccacgcccttcgtccccgcgaccgccttccgtacctggtcgccccgcgcctgatccgcgacgacgaccagcggatcgccggtgcccgccgggaagtaccgcgccgacacctcctggccgacgatggagtcgggcctgccggtgaaggcgtccgcgttgccgatgccgctcgcgcggagctggagcaggcccagggagagcgccgcgaggacgagcgccgtgccgctccacacgaggcgcggacggtgggcgatacggcggcccatgcgcgcccacaggccccgttccgtggggtcggccgcgccgaagtgcgggatcgcgggccagaagatccagcggccgaagaccaacagcagggcggggaagagcgtcagcatcgccagcagcgcgatcgccaccccgatggcggccaccggacccaggccgcgcgtcgagttcatctcggcggcgagcagcaccagcatgctcaggacgacggtcgcgccggaagcgagcacggccgggcccgcccggttcagggcgagtgccatcgcctcgtggcggtcctcgtggcggcgcagcccctcccggtagcgggcgaccagcagcagcgcgtagtccgtgcccgcgccgaagacgagcacggtgaggatgcccgcgctctgcccgttgacggtcagacccgtgtgttcggcgaggagatagatcagcgcctgggcggtgaacagcgcggcgaccacaccggtcagcgggacgaagatcagggtgatgctgcggtaggtgaccagcagcatcacgatcacgacgcccatcgcggagagcagcagcgtcgagtcgatgccctcgaaggccttggagaagtccgccgaggtgcccccgggccccgtgatgtgcacggcgagcccgccgccgcccccgcccacctggtcgcggagggagtcgacggccggggcgagctcctgccagcccttctcgtccatggtgatgggcacgtggatctgggcggcctcgggcgccgacggggtgtcgtaggcgggcccgcggctctcgtcgccgcgtaccccgtgcgccgtgagtcccttgatccggtcggcgtcccgggcgatccgccgcttgtcctgcgcggtcagcccgccctcgcgcgcgtacacgacgaccgcggggatctgctccggcctgaacgtgccggacgtgaccaggacttgggtggactcggccgagcccggcagccaggacgccgcgtcgttgtcctgggcgccggtgagcttcgacgcgagcggtgccgcgaccaccagcagcaccagccacagcgcgacgatcagccacttgccgcgccgtccgcacacgcatccgacgagtccccggggcagcacggatccgctgagtccccggcgcgcacggcgcccttctccgaccgtcatggcgccccccgtggccgcttgtggagccggtggcccggccagcatggcacgcggggccccggcgcgacatccgcatgacgggaccggctttggaccggggagagcaaccggcccggggcatggcaggcttggggcatggccgtgcagatcaaccccagcatcctgtccgccgatttcgcccgtctcgccgaggaggccaaggcggtcgaaggcgccgactggctccatgtcgacgtgatggacaaccatttcgtaccgaacctcacgctcggcgtgccgatcgtagaggcgctggcgcgggcgacggacactccgctggactgccatctgatgatcgaggacgccgatcggtgggcgccgcagtacgtggaagcgggtgccggttccgtcaccttccacgccgaggcggccgccgcgccggtgcggctcgcccgcgagatccgggccaagggggcccgtgcctccatggcgctcaagcccgcgacgcccatcgagccgtacgaggacctgctgcccgagctcgacatgctgctgatcatgacggtcgagccgggcttcggtggccaggcgtttcttgacatcatgcttccgaagatccgccgcacccgtgagctgatcagcaagcacgggctcgaactctggctccaggtcgacggcggagtctcggcttccaccatcgagcggtgtgcggaggcgggcgcggacgtcttcgtcgcggggtcggcggtgtacggggcggcggaccccgcagacgcggtacgtgcattgcgcacccaagccgagggggcgacggccctcgcctcctgggcgtgcgaccactgaaccaacggaacctgaacgacgaccgtccgggctgatcaagtacgcgggatctgcgaggatgaacggcgaatccagagtgtgaacagcagtgaggagatggccgtgtctggtatgtcggcgggccggtcagcgatgcggatgggacccgctgagctggtgcaggcggcggccatggcccgccgcttctacctcgagggcaagtccaagatccagatcgccgaggagttcggcgtcagccgcttcaaggtggcaagggtcctggagaccgctctcgaacgggatctcgtgcgtatcgagatccgcgtgcccgccgagctggacgcggagcgctccgacgcgctgcgcgcccgctacggcctcaggcacgccgttgtggtcgagtccccggccgaggccgaggagtcgcccgacccggagaacctcggtgaggtggccgctgacctgctcggcgagctggtcaccgagggcgatgtgctgggtctggcctggggccggtccaccatccacatggcggcggccctcgaccggctgccaccctgcacggtggtgcagctgacgggcgtgtacgacgccgggaccgccgagcgcggctcggtggaagcggtgcgacgtgccgcgcaggtgtccggcggggacgcccaccccatctacgcgccgatgctgctgccggacgtggccaccaccgcggcactgcgcaaccagacggggatcgcgcgggccttcgagtacttcgacaaggtcacggtcgcctgtgtctccatcggctcctgggagcccggcatctcgacggtgcacgacatgctcagcgacgaggagcgcgcccactacgcgtccctcggggtcgccgccgagatgtccgcgcacctcttcgacgccgacggccgccgggtcgggcgggacctgggggagcggtgcatcaccgtcaaggcggaccagctgcgccgtgtccccgaggtcgtcgcgatcgcgggcggacagcgcaaggcggcggcgatcgacgcggtgctgcggtccggtctggtcaccagcctggtcacggacacatcggcggcggactacctgatggcggcgggtcccacgcccaggcccgcactcaaccgggcggacccggacggcccctgaccgcgcgcccgcggagggacggctgtgacagcatcggcggcatgctgctgcggtccgtcccccgtgtgctcgcggggctgttcgtctgtctggccgttctgctcaccggctgttcgccgaccgggccgaccaaggcgcccgcctcgtccgcgcgtccttcatgggccgccggcatggccacggtcaaggagtcccagctccccgccgaggcccggcagaccctcgcccgcatcgaccggggcggccccttcccgtacgccatggacggcgcggtcttcgggaacttcgagcggctgctgccccggcaccagcggggttactaccacgagtacacggtgaagacgcccggctcgcgcgatcgcggggcccggcgcattgtcacggggcagagcgacgagatctactacaccgatgatcactacaaatcgttcagggcggtgctgagatgaccgacggcacgctcgccgacgtactgcgcgcctgcggctggacccctatcgagctggacctcggcggggtcaccaccaagcccgccttcatggaccgtgtcgccctcgccctcggcctgcccgactggttcgggcgcaactgggacgccctcgccgactgcctcgccgacctgtcgtgggcaccgcccgcccggggacggctgctcgtcatcaccggatggcaggagtacgcgctggcggcgccgcacgactggggtatcgcccaggaagtgttcggcgaggccagtgaccgcgggcgtggcaccggcaccgaactccatgtcgtactggctctcggaggatcctcccaaggcacctctgaccagcctggatgatctgtccgggccccgcacacccggtgtcatgggagaatgaagtacgtgctcttccccctggctgacctgtccgggggccacctctgatcgactgggatgtgcagcacgtgcgtttcctcaacgacatcaagcccccgtacgacctgacgtacgacgacgtcttcatggtgccgagccgctccgcggtcggctcccggcagggcgtggacctcacctccccggacggcacgggcaccaccatcccgctggtcgtcgccaacatgaccgcgatcgccggccgccgcatggccgagaccgtggcccgccgcggcggcctcgtcgtcattccgcaggacatcccgatcgaggtcgtcaccgaggtcgtctcctgggtcaaggggcgtcatctggtcctggacacgccgatcgtgctcgtcccgcaccagaccgtcgcggacgcgctggccctgctgccgaagcgggcgcacaacgcgggtgtcgtagtggacgaggacggccgcccggtcggtgtggtcaccgacaccgacctgaccggcgtcgaccgcttcactcagctgtccgaggtcatgtcgagggatctgctgctgctcgacgcggacatcgaaccgcgcgaggccttcaacaagctcgacggcgccaaccgccgctacgcgcccgccgtcgaccgcgacggcaggctggcgggcatcctgacccgcaagggcgccctgcgcgccacgctgtacacgcccgccaccgacgccgacggcaggctgcgcatcgccgccgcggtcggtatcaacggcgatgtcgcgggcaaggccaagcagctgctcgacgcgggtgtcgacacgctcgtcatcgacacggcgcacggccaccaggagtcgatgatcagcgcgatcaggaccgtgcgcgcgctcgacccccaggtgccgatcgccgcaggcaacatcgtcgccgccgatggtgtgaaggacctggtcgaggcgggcgcggacatcatcaaggtcggggtcggccccggcgccatgtgcaccacccgcatgatgacgggtgtgggccggccgcagttctcggccgtcatggagtgcgccgccgaggcgaagaagtacggcaagcacgtgtgggccgacggcggtgtccgtcacccgcgcgacgtcgcgatggcgctcgccgccggcgcgtccaacgtgatgatcggctcctggttcgcaggcacgtacgagtcgccgggcgaccttcagcaggatgccgacgggcgcctgtacaaggagtcgttcggcatggcgtcggcgcgtgcggtgcgcaatcgcacgtcggaggagtcggcgtacgaccgcgcccgcaagggcctgttcgaggagggcatctccacctcgcgcatgttcctcgacccgggccgcccgggcgtcgaggacctgatcgactcgatcatcgcgggcgtccgctcctcgtgcacctacgccggcgccaactccctggaggagttcaccgagaaggccgtggtcggcatccagagcgcggccggctacgccgagggcaagccgctgcacgccagctggagctgacccgcgacgccccttcgaacggcccccgtggtacgcccgcgggggccgtcggcgtaccgccgccgccagggcctagcgttggccggatgaagatcgccatgtgcagggccgccgatgtcgcgctcctcgaccagtacatcggctccgccggcgtcacgtcctcccacgcccgccgttttgcctgccaggaggcgggagagagcacctacctcgtcgcctggctcgacgaccggcccgtcgggcacgcggaggtgcgctggaccggctgcgccgctgccgaggtgcgggccgcccgccccgggtgtcccgagatcaacgggctgggcgtctggcccggggaactgcgttcgcgcggcatcgggagcgccttgatccgcgcggctgaggagctgacccgggagcgcggcctcgacgtcatcggtctgggggtgggtacggacaatccgcgcgcggccgagctgtacgcgcggctcgggtaccggcccctgaccgggtacgtcgaccgctggtcgtacgagggcggggacgggacgacccacgagtgcgccgacccgtgcaccttcctggtcaaggagctgccgcgctgaccgcgagacggcaccgcggggccgttgcgcaaccatcgaaagggcttgcgcaacgaacacgcgcctggctgcgatgaacgcaacgatcttgcggagatgcgcaaggttgctgcattacgcccgtgaagcccggcctcgtagggtcaagcgctgtacgtggcgtggcgaggaccccgctcggtgggtccccgttgccagggggtgccgccggtccccgccgccctgaccggcagcgatgaaggagccgatgcgtgctcgaccaaggcgcacccccgcagtcccgcagtcatccctcggccccgggcctcggcgcccgcctgatgcgccgtaagccggtggaaaacctggtcgccgagggcggccagggcgagggtggcactttgcgccgctccctcggcctctggcagctgaccatgatcagcatcggtgccaccctcggcaccggaatcttcgtggtgctcggcgaggcggtgccgaaggcgggccccgccgtgaccctgtccttcgtgatcgccggtctcaccgcgctcttctcggccctctcctacgccgagctcgcgggcaccatcccggtctccgggtcctcgtactcgtatgcgtacgcaacgatgggtgagctgatcgcctggatctgcggctggtgtctcgtcctggagtacggcgtctcggtcgccgccgtcgcggtcggctggggcgagtacctcaacgaactcctcgacggcaccatcggcgtcaccatcccggacgcgctctccgcgccgcccggcgacggcggcatcttcaatctgcccgcgctgatcgtcgtcctgctcgcgatggcgttcctgctgggcggcgcgaaggagtccgcgcgcgccaacacgatcatggtgatcgtgaagatcgccgcgctgctgatgttctgcgcgatcggcatccagggcttcaagtccggcaactacgagaacttcatgccgctgggcatggcgggcgtcagcgccgccggggccacgctcttcttctcgtacatcggcttcgacgcggcctccacggccggcgaggaggcgaagaacgcgcagcgcgacctgccgcgcgcgatcatgctctcgctcgtcatcgtgaccgcgctgtacgtgctcgtcgccgccgtcgccgtgggtgccaagccctggaaggggttcaacgactccgaggccgcgctcgccgggatcatgaaggacgtcaccggacagaccttctggggcaccctgctcgccgcctgtgccgtcatcgccatcgccagtgtcgtcctgaccgtgctctacggacagacccgcatcctcttcgcgatggcccgggacggcctcgtgcccaaggtgttcgcgcgcgtccaccccaagacgggggcgccccgcgccaacaccgtcatcgtgtcgctcttctgtggtgtcctcgccgccgcgatcccgctcgggcagctcgccgacgccaccagcatcggcaccctcttcgccttcgggctggtcaacatcgcggtcgtggtgctgcgccggacccgcccggacatgcggcgcaccttccgggtgccgctgtccccggtgctgccggcgatcggcttcgcgctctgcgtctggatgatgggcagtctctcggccgtcacctgggtggtcttcggagtctggatggccgtcgggctcgtgttctacttcagttacggccaccgccgttcccggctggccacggcagacaccgcagtatccgcacagaagtgaaccacccaccttgctgaacgatctcgacgaacgcatcgtgcacgccctcgccgaggatgcccgccgctcctatgccgacatcggccaggaggtcggtctgtccgcgcccgccgtgaagcggcgcgtggaccggctgcgcgcgaccggcgccatcaccggattcaccgtacgggtggacccggcggcgctcggctgggagaccgaggggttcgtcgagatctactgccgccgcaacacctcgccggagaccatccagcggggtctggagcgctaccaggaggtcgtggccgcctccaccgtcaccggtgaggcggacgcggtcgtccaggtcttcgcctccgacatgcgccacttcgagcgagtcctggagcggatcgccggggagtcgttcgtggagcgtacgaagtccgtgctggtgctctctcccctgctgcgacggttctcctcggggtcgcccacctagcccgcgggcttgcgggccagcgcgttgttccccgtcgagtggtgcgcgccgaagctcacggcgtccgagcggtagtggtcgtccgaccgctccgccgggcgcccttcgcgtgccgtggtgacccggcggacgcgcagcggcgggctggtgcggcgcacgccgagcggtccggcgtcccgcgcacttgccgccaccgcgtcgaggacgcccctggccggacatcgccggcgacgaccggccctcggaccacgcggcggtcatcaccacctgcgccgtgcgcagccatgccgaccgagccggtgttaccccaggcaaccattgcggtccgggcgggccatcccgtaggttgagcgctcgctaccggcgggtaacaccggtgggtaacgccggtgggcaacgccggggggaccgaccaacgcccggccacccgaccgttccgccgtcctggggagaccatgcgctggcccatcggccgtcccaccacggtccgtgcgcggatcgtggcgctggcgctcgcgccggtgatcgccctgatggcgctgtggagcttcgccatggtgtccgtcaccggcgaactgcgcgcgctcgtccgggtccagggtgtgtacgaggacttcggcacacccgtcgacacggcgatcgggcagatccagatcgaacggcggctctcggccgggtacctgggcgccgaccaccgtacggcgcgggcccccgacctgatggaacagcagcaccgcaccgacctggccctgaccgccctgcgcgacgcggtccgggacggggaccggggccggctctccgaccggcagcggcatgccctcgacgccatgctcgactccaccggccggctggagaagctgcgcgatcgcgtgctgtcccgggacatcacctgggaccgcgcggtggccgagtacagcggcctggtggagccgggcttcgacgtccagtccaccctcaccgcgctccaggccgggcagctggcacgcgaggcgcaggtcgtcatcgagctggtgcgggtgcgggagttcgtgtcgcgcgaggacgcgctcgtcgccggggcgcgggccgccggaacgctcaccgaccgccagtacgacgcgctcaccgcgacgatcgaggaccgccgggtcttcgagcggacgtatgtgccggaccttccttccgactcgcgggcgctgttcgaggagttccagcgcggcgccgtccaccgcgcgttgacgaggggcgaggacgccctgctgcgggcgggggcggaccgggcgggcgaggccgtggcggccgactcctggcgcactaccaccgaccgtgccgtcaagcgctacatgcggctgtgtacgcggtcggccgtcaactccgccgaccggggacgggcgttcgcctaccgggagctggccaaggccgcggtcgtcggggtcctcgggctggccgccgtgggcctgtccctgtggttcgcggtgcgcggcgcccggcgcatctcgcgccggctggagctgctgcgggacgccgccgatctgctgaccaaccaccaactgcccgacgtgatgacgcggttgagcgcgggcgaggacgtggacgcggtggccgaggcgccgccgctcgccgatggggagctgcggcccgacgagatcggccaggtcggccgctccttcaacaccgcacgcctcgcggccgtcgaggccgccgtcaagcaggccggcctgcggcgcgggctcttcgcggtgctcctcaacatcgcccgccgcaaccaggcgctcgtgcaccgtcagctgaagctcgtcgacacgctggagcggcgtacggacgacccggacgtcctggaagagctgttccggatcgaccatctgaccacccggatgcggcgccacgcggagagcctgatcatcctctccggcgcggcgcccggccgcagatggcggcggcccgtgcccgtcgcggacgtcgtggcctccgcggtgggcgagatcgaggactacgcccgcgtggtggttccgccgatgccggaggtgggcgtcgcggcggacgccgtcgcggacgtcgtccatctgatcgccgaactcgccgagaacgccaccgtgttctcgccgccccacacccgggtcaccatgcgctgcggccgggcgcagggcggcttcgtcctggagatcgacgaccggggcctcggcctcggacccgaccagatcgaagaggcccaccgcaccctcaccgggcccgacgacttcgaccccacccagcacgaccggctcgggttctacgtggtggggcgactcgccgcgcggcacggcatcgaggtcacgctgtgccggtcgccgtacggcggcacgaccgccgtcgtgctgctgccggaggcggtgctcgcgaccgtggagcccgcggcggcggacgcggagcctcgcgccgcgcggcgggagccggcctcgcggagcggcaccgcgccggccgcccgcgagcaggcgtcggacggtcctcgcgagccggcgtcggagcgtcctcgtgagccggcgtcgcagcgtccccctgagcaggcgctggaccgtcctcgtgagcaggcgctggaccgtcctcgtgaggtgagcgtggagcgcgaccgagagtggctgcggcgccgtacggcggacaccggcccggacccgggcgcgcccgccctgcccacccgcacacgtcagtcctcgctcgcccccggcctgcgcaccgaaggcccggccgccgacgagacgccggaacgtgcggtgacccccgaggaggtgcgcgcggtgttcggggccttccagcgcggcctcgaccgtggccgtaaggggatcccggcgcaggccggcccccaggagcgaaccgacaccgaggaaggaacggaccccgacgatgcaccgtgagcaggcccccgagcaccgtgatcgaacctccgagcaccgcgatcggacccccgagcgccgtgaccggacccccgaaccgcccggccgggcttccgggccggccgcccccgcccccgcttccgagccgcccggcacggacctcggctggctgctcgaggacctcgtggccagaaccgaccatgtccgccaggccgtcctcctcaccgcggacggcctcccgctcagtgcctcggacggcatgcgcgcccgggacatcgagcacctcgccgccgtctgctccggtttccacagcctggcccggtcggcgggggagcggttcgccgccggcgacgtacggcagaccatggtgatgctcgacgacgcctacctcttcatcaccccggcgggcgacggctcccggctggcagtgctgagcgaggtgcagacggacgtcggtcagctggcccacgagatggcgctgctggtccgccgggtcgggcgccacatggacgccgccgtgcggtcggccgtccacagcgccggttcctgaaccggctgtgaccgacgaccactggtacgaggacgagaccgggccgatggtgcgcccctacaccgtgacgcggggccggacccggccctccgaccggcacaccatcgacctgatgtcccaggtcacagccctggagacggatcaggggcggccaggcgtcgatcacgcccgcgcgtccctgctcgacctggtgcgccgcgggccgcggccggtcgtcgagctggccgcggacgccgacctgcccctgaccgtcgtacgcgtgctgctcggcgacctcgccgaggccggtctgctgcgcatcgacgcgccgcggcggatggtgccgggcggcaccgtcgacccggagctgctgcgcgagatcgtggagaggctgcgcgagctgtgacgacagggcctggaaggcgagccgggtccacccggcgccgcgctgtcgtctcggaccgcggcggatccggccgccccggtggtgaacagcccggcgacaccgaccacgacgagccccgtacgacgcgcggggcgcgccacggcggtcctttccgcaggtgaagcggcctgccacacggttccgccgccgcgcccgcgccccatcgtgccgcggccgccgccatgcccctgccgtccggtgggggcacggctgtgatctgcctctcgcggagggcggggcccacgtctcgggacgcgcaacgaatcgccgccggaccggtgacctacgcaacgattcgttcactggcacgcaacggctcctccttgtccggccgagcccgccgaccgtacggtctatctggcccccaaaccccctccgtccggtggagaacacgcatgcgcacagccctgctccagagctccggccgccccggctcgatcgccgagaacctcaaggtcctcgacgaggccgcgggccgtgccgcggccgccggtgccgggctcgtggtcgcgccggagatgttcctcaccgggtacgcgatcggcgacgacgtcccgcgcctcgccgagcccgccgacggagactccgccgacgcggtcgccgagaccgcctcccgccacggtgtcgcgatcgcctacggctaccccgagcgcgcgggcgagcaggtcttcaactccgcccagctgatctcggccgacggcacccggctcgccaactaccgcaagacccacctcttcggctgcttcgagcgcgaccacttcacgccgggcgaccagccggtggtgcagacggagctgaacggcctccgcgtcggcctcatgatctgctacgacgtcgagttcccggagaacgtccgcgcgcacgccctggccggcaccgacctcctcgtggtgcccacggcccagatgcacccgttccagttcgtcgcccagtccgtcatcccggtgcgcgccttcgagaaccagatgtacgtggcgtacgtgaaccgggtcggccaggaaggggagttcgagttcgtcggactgtccacgctggccggacccgacggagtggcgcgcgcccgggccggacacggcgaggaactggtcttcgccgacgccgaccccgccgccctcgccgcctcgcgcgaggcgaacccgtatctgaaggaccgccgcccggacctctacgggtccctcgtctgaacccccagccttccccccgaagctttcgtgcaaggagtccgtaccccatgacgtccacggtgcccaacgccgtccagcacgccgacgcgcagcagccgccgatcaccatgttcggcccggacttcccgtacgcgtacgacgacttcctcgcccacccggcgggcctcggccagatacccgcgaccgagcacggcacggaggtcgccgtcatcggcggcggtctgtccggcatcgtggccgcgtacgagctgatgaagatgggcctcaagcccgtcgtctacgaggccgaccagatcggcggccggctgcggaccgtcggcttcgacggctgcgaccccgcgctgagcgccgagatgggcgcgatgcgcttcccgccgtcctccacggccctccagcactacatcgacctggtgggactggagacccggccgttccccaaccccctcgccgagacgacgccttcgacggtcgtcgacctcaagggcgagtcgcactacgcgaccaccgtcgacgacctgccgcaggtctaccgcgacgtgatgaacgcctggaacgcctgtctcgaagagggcgccgacttctccgacatgaaccgggcgatgcgtgagcgcgacgtcccgcgcatccgcgagatctgggcgaagctcgtcgagaagctcgacaaccagaccttctacggcttcctctgcgagtcggagtccttcaagtccttccggcaccgcgagatcttcggccaggtcggcttcggaacgggcggctgggacacggacttcccgaactccatcctcgaaatcctccgcgtcgtctacaccgaggccgacgaccaccaccgcggcatcgtcggcggctcccagcagctgccgctgcggctgtgggagcgcgagccggagaagatcgttcactggccgtacggcacgtcgctgaagtcgctccacgtgaacggcgagccgcgccccgccgtgacccgcctcaaccggacctcgggcaaccggatcacggtgaccgacgccaacggcgacatccgtacgtaccggtcggcgatcttcaccgcccagtcctggatgctgctctcgaagatcgcctgcgacgactcgctcttcccgatcgaccactggacggcgatcgagcggacccactacatggagtcgagcaagctcttcgtgcccgtcgaccggccgttctggctggacaaggacgagcagacgggccgggacgtcatgtcgatgacgctcaccgactgcatgacccgcgggacctacctcctggacgacggcccggacaagcccgccgtcatctgcctctcgtacacctggtgcgacgacagcctgaagtggctgccgctgtccgcgagcgagcggatggaggtcatgctgaagtcgctcggcgagatctacccgaacgtcgacatcaggaagcacatcatcggcaacccggtgaccgtctcctgggagaacgagccctacttcatgggcgcgttcaaggcgaacctgccgggccactaccgctaccagcggcgcctgttcacgcacttcgtgcaggaccggctgcccgaggacaagcggggcatcttcctcgcgggcgacgacatctcctggacggccggctgggccgagggcgccgtccagaccgcactgaacgcggtctggggcgtcatgcaccagctcggcggcacgaccgacgcgaccaacccgggccccggtgacgtctacgacgagatcgcccccgtggaactcccggaggactgagcctcgtagcggggctcagatcccggccgcgcgcgccttctcgtacacctcggcggcgacctccttgagctcctgcgcgtcccgcgtgccggactgaaggtcgacgaggatctcgtcgagaccgacctcggcgtgcgcggcgaggtcctcgacgatctggtcggcgctgccctcgaagggggaccggccggccccggcgtggcccttggccaggtactgggcgttggtgcgcagcaccgtccggatcggttccgtgcgcccgcgttcggcggccagttcccggagcccgcgccactgtgcggcgagcgcctcggcgcccatgcccaccggcagccagccgtcggcgtggtcgaccaggcggcgctgggccttcccggagcccgccgccaggaggatggggatcggccgggcgggcttggggccgacgaccgccggggcgatcttcgtgacccgcccgtcgtacgacaccgggtccgggccccagaccgcgcggcacacgccgatcagctcgtccagtcccgcgccgcgctcctcgaacgggcgcaccgacgcggccgcgtactcgtcgtgcgaccagcccgtgccgaagcccgcgatcacccggccgccgctcgccgcgtccagcgtggcaagggccttggcgagctggaacggcacgtgcagcggtgcgaccagcacgctgctgcccagccggacccgctcggtggccgcggcggcgagcgtgagcgtgacgagcggctcggccaccccgcggtacccgtccggccaggggaggccctcgatgccgtacagaccctgggtggcggggtcggggacgaggagccgctcgtacacccagaggctctcgtaaccgatctcctcggcggtgcgtgccacgtcgggcacgtcccgaccgaggtcgtactgcttgttctggggaaggccgagtccgagcttcgtcgccatgcccactgctccttcgacatgtggtgcggttctgtcgaacgtacaacgttcacaaaggtgttggggcggacggcgacgccaatcagccatccggtcggccggatcagtccggcagcggggtcagcagcatgcgacccgcgcatccgaccgccgcgtccaggcgctcggtgaactccccggccaggtccggcagccggcgcagcgcccacagcgcccgcgccgccgaccaggcggcgtcccgggcccgctccaggctccaggagcccagcagatgcgtgagcgggtcggcgatctggagcaggtcggggcccggcatcagatcttcgcggatccgctcctccagcgtgatgaggagatcacccacacgctcgaactcgtcttccagatcggcgggttcgcagccgagcgtacggcaggcgtccacgaccgccagcgcgagatcgtgcccgatgtgcgcattgatgcccgagagcgcgaactgcaacggccgtactcccggatgccgccggaactgcagcagcggccgccagcacgcgggcccgggcccgtcctccgccaccgtcagatagcgctcggcgaaccgcacgtccagcgtgatcgcggcctgcgggtccgggaaccccccggcgtccagccgccggtcgaactcctcggtgacagcgaggtagacacggttgaagaccgctacgccgtcgcgctccggcaagacctcgcacagcgcgcgcatgcgggagacgaccgtgtcgacgggagtcgtgaactgttccgaccgcaccatgagggcagggtcccagccctaggcttttgcgagtgccgccgggccggacgcttccccagaacgggggaacccgccggtgtcgcgggagggggagcacgacgtgtcaggcttacgcgcccagcggctggccgcccgcagggccgagcgcaggcgcgccgtccggcggagcgcgatggtggcggtggcctcgttcgtggtcgccgtcggcaccgcgacggggatgatgtcggcgttcgacgacggccgtacgcccgaccaggcccgcccgcaagtgaccggcccgcccagccgccggccgctgcccgccgtcccgtccccgtcgcccgccacgacgtccgcgaggccgagtccggccaccccgtcggccgggcccggcccgaagtcctccccgagcaagagggagccgaccactgcggccgcccccgcccagctctatcgccaccccgaatcccaggtcctcgactgggtcggcgcgcatccggacgacgcccggcgcgcggtcatcgagtcccgcatcgccgaccggcccgccgcggtctggttcgccgacttcgctccgtcgaccatcaccgcccgggtcagggcggtcacggcggccgccgccgcgcaggaccgggtcccggtcgtcgtgccgtacacgatcccggaccgcgactgcggcggggcgtcgcagggcggcgcgcccgatctcgccgcttacgacgcctggatcgacaagttcgccgccgggctcggctccggcgaggtcatcgtcatactggagcccgactcggtcgcccagtccgactgtctgtccgaggggcggcaggccgaccgcttcgcctcgctggctcgcgcgggccgggtcctcaaggccgcgaaccccggggtccgggtctacttcgacggcgggcactccgagtggaatccggccgccaaacaggcctcgctgctcgaccaggcgggcgccgcctcgcccgccgcctccgacggcatcttcacgaacgtgtccaacttccaccgtacgagcgacgagatcgcgtacgcccggcaggtgctggccggcctcggcggccccgcgagcctgggcgccgtcatcgacaccagccgcaacggcaacggcgcgccggccggcggcgagtggtgcgatccggcgggccggaagatcggccgggcgccgaccctgacgaccggggaggccgggatcgacgcctacctgtgggtgaagctgccgggcgagtccgacgggtgcaagggcacgcccgggaccttctcgcccgcctacgcctatgaactggcgcgctgatcctcggccttgtcgtccccggcctcgctgaccccggccttgtcgccctcggcctcgtcgtacgacgaggtgcccgaatccagcagcggctcctgcgtcttgaggtgcgccggagccatcgctcgcagcccgtggtacccgatgatcacgacgagcgtgccgagcgcgatgccgctcagcgagaagttgtccgtgaacttcaggctgacgccgccgacgccgatgatgatgcccgcggcggccggcaccaggttcagcgggttgcgcaggtcgaccctggcgttgagccagatctgggcgccgagcagcccgatcatgccgtacaggatgacggtgatgccgccgagcacgccgcccgggatcgccgccacgaccgcgccgaacttgggggagaggccgaagaggagcgcgaaaccggcggcggcccagtaggcggccgtggagtagacgcgggtcgcggccatcacaccgatgttctcggagtacgtggtgttgggcgggccgccgaccgccgtggagagcatcgaggcgacgccgtccgcggagatcgcggtgcccagcttgtcgtccagcggatcacccgtcatctcgccgacggccttgacgtgacccgcgttctcggcgaccagcgcgatcacgaccggcagcgccacgagaatcgccgaccactggaaggacgggccgtggaaggacggcaggccgatccagtccgccttgccgacgccggacagatcgagtcgccagtggtcggtgagcttgccgctcgcgtccaccgagtggatcttgccgaagatccggtcggaggcccacgagatcccgtacccgaagaccagccccaggaagatcgcgatccgtgaccagaatccgcgcaggcacaccacggccagaccggtgaacgccatcaccagcagcgccgtccactggtcctgcggccagtacgtggacgcggtcaccggcgcgaggttgaagccgatcagcatgacgaccgcgccggtgacgatcggcggcatcgcggcatggatgatccgcgccccgaaccgctgcaccgcgagccccaccaaaaacagcgcgacgccgaccacgaagaccgcgcccgtcaccgtcgcgctggtaccgccctgcgcgcggatcaccgcggcgacgcccacgaaggagagcgagcagccgaggtagctcgggacgcggccgcgggtggcgagcaggaagatgaccgtcgcgacgccggacatcatgatggcgagattcgggtccaggcccatcagaacgggtgcgacgaacgatgccccgaacatggccaccacgtgctgggcgccgagcccgaccgtgcggggccaggacagccgttcgtcggggcggactaccgctcctggcgcgggcgtccgcccgtcgccgtgcagtttccagcgcacgccgaggtccatggtgagtttcgctttcttcgtacgtgaaagttcgtccggaccattgtcacgggtacctggcggtcctacgctcgcacggtcttactcatgaactgtgttcacaagtatgatcggagccttgatgagtgcacgcccccgtctggctgtcctcctcgcggccgcggccacgctcgccgcggtcgtcgttccctccgcctcggcccatacgcccccgaaggctccccggaccgccgttctcgacggcacccggctccagcagacccgactgcgactcgaccgcggcgacccccgactccggcgcacgctcgaggacttgaccgcccgcgccgacaactggctgaaccagggcccctggacggtcgtcgacaagccgaagcccgcccccggcggcgacgtccacgactacctcagccaggccccgtactggtggccctcgcagcccaagtccgccgacaatccctggggttgcccctacgtccagcgcgacggccaacgcaatcccgaggtcgacaccggcaccgaccgccaggacgtcgagaaggtcttcgactcggcgtacgacctctcgctggcctggtactacacgggcaggaagcagtacgccgagaaggccgccaccgtcctgcgcacctggttcctcgcgccggccacccggatgaacccccacctgaaccacgggcagttcatcccctgcaagtacgacggccgggccatcggcatcatcgacttctcgcagtcctacacgagcgtcctggacgcgctcgcgatcctggacacgggcgcccccggttggtccagggccgaccgcaccgcgatgcgcgcgtggaacgtcgactaccgcgactggctggtgaacagcgccttcggtgccgaggagggcgccgccaagaacaaccacggcaccttctacgacatgcagctcgccgccctggcgtacgcgaccggcgacacggacctcgcccggcggaccgtcctcggcgcgcgggcggggcgcatagccccgcagatcgccgccgacggcagccagccccaggagctcacccgcacccgcagctggcactactcgaccttcgacctggtcgcctacacgcgcctcgcggccatcggcaggcacgtcggcgtggacctgtgggcgtacgagggaccggacggtcagagcctgttcaaggcggtcgactatctgctgcccgcggcgacgggggccgcgccctggccgcacccggagctggagttccaccggttcgcggcgagcgacgtcgtgcacgcggcggccgatgcgggggaccgggcggcgcgggcggcggtcccgaagctggaggcgccgcccggcggcgacctgtgggcgctgcggcccgccgccgagcaactggactcgatcgcgggctgagcgcctgacctgcacctcccgtgcgggacctgctgagcgtttgcttaggatggggtgtccccgccaccccgcaccgcaccgcccaggagccccgcccgtgaccgccgaagccgccgaagccccgaccgcgcccgctccgtcctacggccggctgatccccgtcaccgtccacttcgacgacctggacgcgctcggactcctccacaacgcccgctacctggtcatggccgagcgcgcctggaccagcctgtggaacgagcgcggcttcggcggcttcgagggtgactgggaggcggccggcgacttctgcaacgccgtcaaggagcagcggatcagctacgaggccccggtcacccggccgggcgcgtacgccgtgcacctgtggctggagcggctcgggaacaccggactgacgttcggcttccggttctgctcggcggacggcgcgctgacgtacgcgcacggcacgcgggtcctcgtccggctcgacgccggcaccctgcgtcccgcgccgtggagcgagccgttcagggtcgtggggcgggagctgctgcgctcggcggactgaccgtcggacggcttcggtcgcccgcgcgcagcacgcccgcgaagaccacgagcccgcaggccagcacggtcaccaggccgaaggagaccatcaggctggtggcctgcgccagcgtgccgatcgcgctcggggcgaccagccccgaggtgtacgtgatggtggcgacgcccgcgatggcctggctcgggttgggcccgctgcggccggccgcagcgaacgccagcgggacgaccaccgcgatgccgaggcccatcagcgcgaacccgaccatcgccaccgccgggtgccaggcgctcacgacgagcagcccgccgagcgtggcgagcaccccgccgacgcgtacggtgcgcaccgcgccgaagcggtccaccaccgcgtcgcccgcgatccgcgcgacggccatggtgagcgtgaaggccgtggtggacgccgccgccaggccggccgagctgtccagccggtcgcgcagatagaccgccgaccagtccaggctcgcgccctccgcgaacaccgcgcagaagccgaccgcgccgatcagcagcgccgacctgggcggcagcgcgaaccgcgggggcggctcctcgtcctcggtgggcttcaggtcgagcacccatcggcaggcgaccaggccgagaaccgtcaggaccccggccgccagcacatggtgcatccgcgcgtcggagcccaggtgggcggcgagggtgccggccgccgagccgaccagggcgcccgcgctccacatgccgtgcagcccggacatgatcgacttgtcgaggcggttctcgacctcgacgccgagcgcgttcatcgccacgtccgccatgcccgccgtggcgccgtacgtgaacagcgccaggcagagcgtgtacaggttcggcgcgagcgagggcaggaccagcgccagcgtccacaggctgatcagcccgcgcagcgcggtgcgggaaccgaaacggtggctgatccggcccgcgagcggcatcgccacggacgcgccgatcgccgggaaggcgagcgcgagcccgagctgtcccgcgccgatcgaggcatggtcctggatccacgggacccgcgtggcgaacgaaccggtcaccgcgccgtgcaccgcgaacacggcggccacggcataccgggcgcgcttcaactcacgcacgtcgtcaaccacttcacccatggtgccgctgcccctcccggacgtcctccccgctgtcgccgtaaactatcaggaaccctgcctgataaatagatgaggcaggggcgaggccgctgtgccgcctcctgatctggaagaatcccggcatgcccgcatctccgagcaccgccagggccatcaacgaccggctcgcgctgcgcctgctgcaacaggaaggccccctgacggcggggcagctgaagcagctcaccggactgtcccggccgaccgtggccgacctcgtcgaacgcctcaccgccgccgggctgatcgcggtcgtgggggagtcgggcgagcagcggcgcggcccgaacgcacggctgtacgggatcgtcgccgaccgcgcgcacctcgcggccctcgacgtacgcaccgagggcgtctccgtcgtcgtgtccgacctgctgggcgcggaactcgcccgggcgtcggtcccgatcgccgacgacacggggacgggaccggccgtcgagcaggcggtggcgctggtggagcgcgccgcgaaggaggccggagccgagcgcctgcacacggtcgggatcggcgcgcccggcctgatcgaccccgccaccggcgaactccgcgactcctccggtctgccggagtggcaccgccgcctggtcgccgccctccaggagcggctcccggcccgggtgaccgtcgagaacgagaccaacctcgccgccctggccgaacagcgcgagggcgccgcccgcgaccgggacacgttcgtgctgctgtggctgggccacggcaccggcgcggccgtcgtcctcgacggcagactccgccgtggcgcctcgggcggcaccggcgagatcggcttcctgccggtaccgggtacgggcgcactgccctcggcgacggactgcgagggcggcttccactcactggcggggtcggcggcgatcgcccggctggcgagggagcacgggctcgtggcggccgggccggcccatgagccgcaggcggcggcgctggtgcgggcggcggccgcgaccccgagctccccgcgttccgcccgcttcctcgacgtcctcgccgaccgcctcgccatcggcgccgccgccgtcgtggccgtcctggaccccggctgtgtggtcctggccggcgaggtcgggcaggccggcggggacgtcctcgccgcacgggtcgaggagcggctcgtccggatgtcaccgctgccggccgaggtgcgggcgagcaccctgggcggcgacgcggtgctgcgcggcgccctgctgaccgcgcgggacggcgcacaggacgaactgttcgggccctcgccccggtagcccgccggcccggccttgtggcccctgggtgtcaccgccggccgtcagggcgacgggcgccacgccggccccctcggcagcaccatgtcccggctcgctcaccgcccccgccgaaccgcgccgccacgtacgcctcgaacctgccctcgcgcaccgcccgcctcggtgtcagatgcccaccgtcccgcagcgcgccgtaggccccgcccgtgaggcgcacgttcacccgcggacgccgcattcaccgtcggccgggcagaggcccgtcaggaggcccggcggcggggcaagggcctccgtcaccgccgccgggccgttcttgggacggcgcaacgccgggaacgcagacgctaagaggactagaccaggtcagtcaataggtatggaccaattatcaagatcgcgccggtttccggggagggtgagaagtccagcatgtgaacatgtgagccaccccacagtcgttcccttgcatggccgccgatcggccgtggcaaactggccatgtaccagaagcagcgcactccggggtcggtgaaagtccgaaccggcggttatagtccgcgacccgctcgcctcggcgatcggttgaccaggtggaattcctggaccgacggttaaagtccggatgggaggcagtgcgcggcgggcaggcattcgtgcgtgccgccgtctgtttcgacctgtccgcaggacaggtctcattcggcgacgctcccggtgccctcgcccgtatgttctgtcgtcatcgacaggccccggagtccgtgcccgaaatggcaggaggacccgggaagtgttcaccggaatcgtcgaagagctgggtgaagtcaccgccgtcgagaacctcggcgacgcctcccgcttccgtctccgtggacccgtcgtcaccgagaacgcgcagcacggcgactccatcgccgtcaacggcgtctgtctcacggtcgtcgagcacgagggcgacgaattcaccgccgacgtcatggcggagaccctcgaccgctccagcctcggcgctctcgccgtcggctcccgcgtcaacctggaacgtcccatggccgtgggcgcgcgcctcggcgggcacatcgtgcagggacacgtcgacggcacgggcgcggtcatcgagcgcaggccgtcggagaactgggagatcgtcaaggtctcgctcccggccgacctctcccggtacgtcgtggagaagggctccatcaccgtcgacggcatcagcctcacggtcgtcgacgcgggcccggactacttcaccgtcagcctcatcccgaccaccctcgcgctgaccaccctgggccgcaagcagcccggggacccggtcaacctcgaggtcgacgtcgtcgccaagtacgtcgagcgcctcctcggcgaccgcaccagggagaccgcgaagtgaactggctcaactccgaagccttcacggtcctcgaccagcacatcatctggtccgacatgatcggcaacaccgtcggtctgatcgccctggccctcggctggctgcgcaacataggaacctggcccgcccaactcctgtccggtgccgtcctcgtggccgccaacctctccgtgcaccagggcggcggcgtcggcaagcaactcgtcgtcatcgtcgtggccctctacggctggtacgcctggacccgcggcaggcagcaggcccaggacggcaccatcgccgtacggttcgccacctggcgggagcgcgcctacctcgtcggcggcgccgcgatcggcaccctcgccgtcggcggcctgttcaccgcctacccctcgctctcctggagcccgtgggccgacgcgtacatcttcgtcggcaccctcgccgcgatgtacgcccaggcgcgcggcatggtcgagttctggttcgcctggctgctggtcgacctggtcggcgtaccgctcaacttccgcagtgggctcgccttctcgggcctcatctacatcgtgtacggcgcactcgtcctgtggggcatgcgcgactggtggctgcgctcccgcaaggccgggcagcccgttctggaaggagccccggcatgaccacggcgccgatcctgtacagcacggacaacatcgaggacttcgcgctcgacccggtcgagcgggccatcgccgacatcgcggccggccgcccggtcgtggtcgtcgacgacgaggaccgggagaacgagggcgacctcgtcatcgccgccgagaaggcgacccccgaaatcgtcgccttcatgatgagcgagtgccgcggcctgatctgcgcgcccatggagggcggcgaactggaccgcctccagctgccgcagatggtcgaccacaacaccgagtcgatgcggacggcgttcaccgtgtcggtcgacgcgagcggcgcgcacggggtcaccaccgggatctccgccgccgaccgcgcgaccacgctccggctgctcgcccagggagaggcgggggccgccgacttcgtccgccccggccacatcttcccgctgcgcgccaagcccggcggggtcctcgtccgcaacggccacaccgaggccgccgtcgacctcgcccgcctcgcgggtctgcgaccggccggcgcgatcgtcgagatcgccggcgaggacggccacatgctgcggctgccggagctgatcccgttcgcccgcaagcacggcctgacgatcatctccatcgaggacctgatcgcctaccgccagagctccgagcccaccgtccggcgcgaggccgaggtccatctgcccaccgccttcggcgagttcacggcctacggctaccgctccaccgtcgacggcgtcgaacacgtcgccctggtccacggcgagatcggcgacggcgagggcgtactcgtccgcgtccactccgaatgcctcaccggcgacgtcttccactcgctgcgctgcgactgcggcccccagctggaggcctccctggagcgcatccgcagcgagggccgcggcgtcgtggtctacctccgcggacacgagggacgcggcatcgggctggtgtccaagctgcgcgcgtacgagctccaggagcgcggccgcgacaccctcgacgccaacctggaactcggcctgcccgccgacgcccgcgactacgcggccggtgcgcagatcctggaggacctcggcgtccgcagcctgcggctgatgaccaacaaccccgacaagaccgacgcgctcctgaggcacggcctcaaggtcaccgggcgcgagccgatgcccgtacaggcgggcgagcacaacctccggtacctgaccaccaagcgggaccggatgggccacgatctgccctggctggacacggtccccgtgtccacctgcggcaaccagtaagagagcactgaggagagacgtgagcggcaagggtgcacccgaactgtccgtacgcaactgcggcgacctgcgcgtcgcggtcatcgcggcacagtggcacgaaaaggtgatggacggtctggtggacggcgcgctgcgcgccctgcacgaactgggaatcgacgagccgaccctcctcagggtccccgggagcttcgagctgccggtcgtcgccaaggtcctcgcgggccggggttacgacgcgatcgtcgccctcggcgtcgtcatccgcggcggcaccccccacttcgacttcgtgtgccagggcgtcacccagggcctcacccaggtctccgtggacaccggcgtccccgtcggcttcggcgtactgacgtgcgacaccgaggagcaggccctggaccgcgcgggcatcgagggctcccacgaggacaaggggcacgaggcggtgaccgccgccgtggcgaccgcggccacgctgcgctcagtatccgaaccctggcgctgaggcacggccggctcggcgtagggtaggcagcaccatgtccaagaagacgttcgaggagctcttcaccgagctccagcacaaggccgccaacggcgacccctccacttcgcgcaccgccgagctggtcggcaagggcgtccatgccatcggcaagaaagtcgtcgaggaggccgccgaagtctggatggccgccgagtacgagggcaaggacgccgccgccgaggagatctcgcagctcctgtaccacgtccaggtgatgatggtcgcccgcggaatctccctcgacgacgtgtacgcccacctgtagatccccctgtttcccagccccaccccttcacgcaaaggaagccgacctcatgctgcgcatcgccgtccccaacaagggttccctgtcaggccctgcggcggagatgctccatgaggccggctaccagcagcggcgggagtccaaggaactgcggatcgtcgacccggagaacgaggtggagttcttctacctccgcccccgcgacatcgcgatctatgtctcctccgggcgcctcgacatcggcctcacgggccgcgacctgctcatcgactccggggccaacgcggaggagatcctcccgctcggcttcgcccgctccaccttccgtttcgccggcaagcccggcaccgccaagggcatcgaggacctcgcgggtctcactgtcgccacctcgtacgagggcatcgtcgccaagcacctcgccgacagcggcatcgacgcctccgtcgtgcacctcgacggcgccgtcgagaccgccatcgaactcggtgtcgccgaggtcatcgcggacgtcgtcgagaccggcacctcgctgcgcaacgcgggcctggaagtgttcggcgagccgatcatgaagtccgaggccgtcgtcatccgccgcgtcggagccggcaccgacgaggccgccgagtcgaaggtgcagcagttcctgcgccgcctccagggcgtcctggtcgcgcggacgtacgtgatgatggactacgactgccgcgccgagcacctggagaaggccgtcgcgctcaccccgggcctggagtcgccgaccatctcgccgctgcacaacgagggctgggtcgccgtacgggcgatggttccggccaaggaggcccagcgaatcatggacgacctgtacgcgctcggcgcacgggccatcctgaccacggccatccacgcctgccgcctctgagggaccgtacgtcgatgcccgatctgtctgctttgcctgccctgcctgtcaccttccggccgggccgtacccgtgccgtcctgctgaccgccggcgtcaccatctttgtggttctcaccacggtcgtgatgctcctcgaaaccctcaccccggcggaacgcctcagcttcgtcttcaccgcggcgctgctctgcggcgtgctcgtcctcctctcccggcccaaggtcgtcgccgacgagagtggcgtcaccgtcgtcaacatcaccagcaggcggcacctggcctgggcggaaatcctccaggtcaacctgcgtcccggtgatccctgggtgttcctcgacctcagcgacggcaccagcctgcccgcgctcggcatccagccgggcatcgccaaacagcgtgcgatcgccgacgcgcggacgctgcgggcgctcgccgaggcgcgttccgcacgggaccccgaggaacatcagggctgactcggggccgtccaccctgccgtatcggcgggtgtcttgattaatctggtggcggaggcgttcttccttgcgcctccgccctgctgctccgtccggtgcggcaggggtacctgctacccgaggagtgattccctccagcgatggacggatcgtcctgtagtacctgcgccgccccctctcgacataccgcggaccgtgtccgcgtccctgcggaggcggcggcatcatgaccgactctctgctgctcctcggggcggcattcctgctcattctggccaacggcttcttcgtggccgccgagttcggactcgtcacggtcgaacggccggaggccgagaaggccgcggccgagggcgaccgacgggccggtacggtcgtcgagtcgctgaaggagctgtccttccagctctccggcacccagctcggcatcaccatcacctcgctggtcgtcggcatgctcgccgaaccggcgctcgccgacctgctgcacggcccgttcaccgccatcggcctccccgaaggagccgtccccgggatcgccgtggtcgtcggcatgctgctggcctcggccgtgcagatggtgatcggcgaactcgtgcccaagaactgggcgatctccaagcccttgcaggtggcccgcttcgtcgcgggcccgcagcatgtgttctcgcgtctgttccggccggtgatcgcggcactcaacacggtcgccaaccggctggtgcgcgccctgggcgtggagcccgccgaggagatggcctccgcccgcacccccggcgaactcgtctccctcgcccggcactcggcccaggccggcgcgctggagcaggacacggccgatctgttcgtacggacgctgtcgctcggcgagctgaccgcacagcacgtcatgaccccgcgcgtgcgggtcagcgcgctccagtcctcggcgaccgccgaggacgtggtcaacctcacccgtgccaccggcctgtcccgcttccccgtctaccgggaccggatcgacgagatcgtcggcatggtccacctcaaggacgccctcgcgatcccctcccgcgaccggctgcgcacccccgtcggccggatcgcccagccgccgctgctcgtcccggagacgctgcccgtgcagcccctcctggcgcggctgcgcagcgagcagcccatcgccgtcgtcgtcgacgagtacggcggtacggcgggcgtcgtcaccctggaggacatcgtcgaggaactcgtcggcgaggtccgcgacgagcacgacgggcaggacctgcccgaactcgccgtcgcaccgcccgaggacgggcggcccgcatgggacgcggacggcagctgccgcgtcgacatcctccagcgcataggcctcgacgtgcccgaggggccctacgagaccgtggccggcctcgtcgccgatctgctcggccgcatccccgcccccggggaccgggccgagctccccggctggcggctgtcggtgcgccaggtcgggcactaccgcgccgagcgggtccgtctggtgaagaccgcggacaccacagacaccacagacaccacaggcattgcggacatcgcggatgcctcggtcacagcgggcgcgggcaccagggacaccgcggcttccgcgcctgccgcggaggctgtccgatgaccctgctccagctactgttggccgccctgctggtgctcgccaacggcttcttcgtcggcgccgagttcgcgctcgtctccgtacggcgcagccagatcgagccactggggacggcacgggcccgccaggtgctgtacggcctggagcggctgccgcagatgatggccgcggcccagttcggcatcaccatctgctcgctgacgctgggcgcggtcgccgaaccgacggtcgcgcatctgctcgagcccggcttcgaggcggcccgtctgcccgacgggatgatccaccccctcggatacgtcatcgcgctggccctcgtcgtcttcttccacctggtcatcggcgagatggtgccgaagaacctggcgatggccgcgcccgagaggacggcgctgtggctcagcccgggcctggtcgccttcgcccggctgtgccggccggtcacggtcgcgctgagcgcctgcgcacgggtgatcctgatgctcttccgggtggagcccaaggacgaggtcgaggcggtcttcaccagcgagcagctcaaccagctggtggaggactccggccaggccggtctcctcgacccggaggagcaggagcgcctggaggacgcgctggaactgggctcgcgcccggtcacggacgtcctgctggaccgcgactcactggtgaccgtgggcccctcggtcacgcccggcgaggtggtggcgctgaccgcgcgcaccgggtactcccgctttcccgtcgccgcggagaccggcgccttcatgggctatctccatgtgaaggacgtactcgatctggaggagtccgagcgggcggtgccgcagcagatctggcggccgatgaccacgctcggcgcggagctgccgctggacgacgcgctgaccgtgatgcgccgggccgccacgcacctcgcgcaggtcgccgacgggtccgggcgggtgctcggcctggtcaccatggaggacgtcctggagctgctggtgggcgaggtcagggacccggcccaccgggacgcgcagccgccgagccgggtgacggaacaacgcgccgagacgcccggcgaggcactggcgagccagcttcggtgagccggccgcgcgtggccctgggaccgtcgggttccagggccaccgctcacagtgccgaaggatcctgcggtccccgccccgacagcacctcgccgtacgcctgcatcagatccggcagccgcagcgtggagagatcgtcccgcgacggggtcctcggatagcccgtcagccgcagatcccggtacgcgcagctcttctcgtacagggtgcgcaggaagcggccgttgccgagctcgtcgatccagccctggtcgatgacgtgcccgctgatggagcgcagctcgtcgagcgcctcctcgtcccacacgtcgccgttctccgcggccagcacctcgccgatcgaggtgagttcgagcgggcggtacgaggggaagtccacgcgggtggtgaagcgggaggagagaccggggttcgcggccagcaggcggtccatgccctccgggtagcccgcgaggatcaccaccaggtggtcccggttgtcctcggcccgtttcagcagcacctggagcgcctcgtcgccgtacgcgtcgcccttgccgtagccggagttcgacagcgcgtacgcctcgtccacgaacaggacgccaccgatcgccgagtcgatcagctcgttggccttcacggccgtctggcccaggtactcgccgaccaggtccgcccgctgggcctccaccagatggtcgccgccgagcagcccgagcgcgtagaagacccggcccaggatccgcgccaccgtggtcttgccggtgccggagggtccggagaagacgaagtggcgtttgggaggctgtacgggtaagccctggccggcccgcagccgcgccatgttcaactgcgccgacagcgccttgacctggcgcttcaccggttcgagcccgaccatccgctccagctccgccagcgcctcctcgaggagctcggggtccgtgggcccggccggcagcggctgcaccggcaccacggtcttctcccgtaccgcgtcggcctcctgtggcagggcgccgggcggtgccggttcgggctcggagagcttcagctcccgcccctcgccgccgaagaggggatccaccccgtccggcccgtcgatcaggtcctgtccgatcccggtgagcgtgatcgccgcgaggtcgaccgcctcgtcgtacccgtcgccgtcggagatcgccgcgagccgtgcggaggtgtccatgaaggcggggtccacccggtgcaccgcccggtacaggggcagggcggcggcgctgcggcccgtgccctcgtgcgcccgtgccagccagtagcgcagctccttgcgctgcggctgctcgctgcggcagcgcatcagcgcggcggacagcaggggctcggcctgtccgaacatctccagccggacccgggccatgccgccgaacagcccggcctcgatacccagcatggcgtcgtcgatcagcggatccgtgtgccggaccagctgctcccagtccttgaccagataggcccggcaggcgtgcaggaagcgcacctgcgggtccgtgtccaccggcggcaggctcgcgagcgcccggtccaggtcggggacatggcgtccgtccagccagtgggaggcgtgcgcgagcagcagatcgcgcggactctccagcaccggctgcacccaccagcccagccagtaccaggagttgagggtgcgccggtgccgggtgcgctgctccccgaagcggtcccggtgccggaacatccggagcagcgcggtcgtcgtgtcgacgcgcagcgcgtgcagtccgagccagccgtcggccatgcccggatccatccgcaccgcggtgcggaactcctcctccgcctgcggataggcgcccatcgtgtaggcatccacacctcgcagccaggcgaggtcggccggagcctcggggccccgcgtgccgaagtccatcacgtcccccacagaccgtgcccccgttggttcaccgccgggccggtgcccgtcggcagtcgtcgaaccgctgtgccgcggacgggagttgcatgggtgcgcagagcagccgtccgaaggtcgcaccgagaggcatggtacctgcggggccgtcgcctgccgaagggtgccgcacaggccgtttgacgaggtgggagcagatggggcgcactgcgcatggtgaccgagggtgagcgaatcacgtctcccggcgcccgaaatgaggtgctcagggcaaaacgaagcccccgatcacgggggaacaatcgggggcttcgcgtctggcggcggcctcgaaaggccgctcattcagaacgtaagtcctgtacggccccccggtcaagacgagttggagcacttggagaagttctccggcgggggtcttcacaagttcagcacattgcggatggtccctcactgtgcgtgagatcctggtccggtcctggcgtcccagcaggccccggcagcacctcgtacccctccggacactgctgtaccagaaggtcggcgaagggcctggacgggtccccggcgaagtgccggcgctccgcctcgacccacccggcccagaactcgcgctgcgcctcgccgtccctctcccgcccgcgcgtccaggacgcctcgtgcggcagctccatccacagcagccgcgcgagatacggacgcagcgcccggcggcccgcgccgacgccctcgacgaggaccacgggcgcgggcggcagggcgcgggccgggtcgaagtcgcgggtgtgccagttgtaggggcggtagtgcgcgggctcgccgcggccgagcggtgccaccacctcgcgcagcagacggtccgtccacgcgaacagctcctcgtgcgtggcgatgtcgtcgaggtgcagcacgggcgcgccgtcgagtgccgcggccaaccgcccggcgaacgtggactttccggagcccgcgtgcccgtcgacgccgacgagccggacggggccgcacgagggcggcagtcgtcgcaggcgggaggcgaggtcgtgaatggtcgttcctcggggtcggcggggtgtgggcatatttcaaacgaacattctatagcgggtgcgagaaggcggatccgggtgtggcggcgcggggggatccggggcacgaaattagtgtcgcgttgaactatgtaggaaaagcctcaaccattttttctcaggctcgcggtcaaaggcccccacgtgtcggaccaggcattcggcaatcggcattccgcttcccccgcatgctgagtagggtgcctggtgcgcaacggcgtggcatcggacggggatggacaggggagcatggccgcggggttattcgaggggcagtacgtatggcatccggcggccgacgaccgcacgctcgcgagcgtatgcgtggatgtgcgcgccgggcgttatcggagcgcgcgcgaagcgctcgccgacacgcgcgacgatttcggactgcgtgcccatcgctcgctggtcctcgcctcggaggcggccgactccgacctcgcggagcgctggctggccgaggagcccactcccgaggccgcactgctgtgggcgcgggtcgcggtgctgcggacgctgcgtgccgccgccgcccacgacgagcgcgccgaggcgctggagcgcatcgcgctcaccgcgtgcgagcgggcctcgacggcggccccgcacgatcccacgccctgggtggccaagctgacgatggcccggctgcacgacatccgcgagccggccccgcaggggctgctcaccgcgccggccggcccctggcggctgttctcgcacgtcctgcggctcgacccgtggaaccgtgaggcccaccaccgcttcctcgcctgcttcttcacgcggtacggcggctcggtgaacgcggcctgggacgtcgccgcctttctgggccagcgggcccccgccacctcaccgctgcgcctgctgcccctggtcgccctcgtggagagctacaaccccgcgcaactgctggccgaccgggtctgggagcagccccagtggcgcgccaccgccctcgccatctaccagaactggctgcccgagaccgcgggctaccgcttcacgccggtgctcgacctcgcgtatctcgcgcacgccctgttgatggcccagcgcgagttcgaggcgcgcgccgtcttcatggccatggggccctacgcctcccgtatgccctggagcgtcttcggcgaccccgaggagcagctctcccgcgcccgccgttcctgcggactgcccgtacccggagccgcctgaccccgctcaccccggtctccggcaccccccccacagaaaggtcaggttgtgtcagaacggatatcagcgcccggtacgtcacatgcgagaggacgtgcgggtgcggatcccggcgcactcgacgacgatgcgacgctgcatgcgatgggctatccgcgcaagctcacccgacgatttcaggcgttcgacaatttcgccatctccttcaccatcatcaacatcatctcgggcatcttctcgtccttcggattcggtatgaacgcgggcgggccgcgcattctcgtcttcggctggatcggcgtttccgtcatggtgctgttcatcggggccgcgatggccgaggtcgcctccgcatatccgacgagcggggcgctctatttctccgccggaaagctcgccaagcggcacaagggcgcctggtcctggtacacgggctggctcaatttcgtggggcaggtgggcggtacggccgccaccggatacgcggccgccaccttcatccaggcgttcatcgccctgcaatggtcctcgtacgagccgaccgctcaccagacggtcctgatcacggcgctgatcatcgcgctccaggggctggccaacacctacaccgtgcagctcgtcgccgtcctcaaccggatctccgtgtggtggctcctgatcgggctcgtggtgatcgtgagcaccttgaccgtcatgcccgacgaccatcagtcggcctcgttcgtgacgcatttcgcgaacaacaccggtttcacgaacgggatttacggcgggatgctcggtctgctggtcaccagttggaccttcaccggcttcgacggcagtttccacatgtccgaggaaacggtccgggccacggtcaacgcccccaagggcatcacacgtgccatcggctattcggcgatcaccggactgatcctcatgctcgccctcgtctacagcattcacgactatgaccaggtggccggctcctcggcgccgcccgtgcagattctcatcgatgggcttggcatgggcactgcaaaggtgctgttgctgatcgtcatcggcgccatgctcttctgcggactggccaatctgaccagcaacacccggcagatcttcgccttctcccgggacggcgcgatgcccggctcccgctggtggcacacggtctcgccgcgcacccgtacgcccgtcaaggccgtctggctggcggtcggctgctcgctcgcgctggtgctgccgggctggtggtcccacaccgccttcaccgccatcgtcagcgtcaacgtcgtaggcctcttcctcgcctacgccgtgccgatcttcctcaggctgcggctcggcgacgagttccgggccggcccgtggaacctgggccgctggagcaggcccgtcggcatcctcgccgtgacctggatcctgctcagcagcgtcctgttcatgctgccgcaggcctcgccgatcaccgtcgactccttcaactacgccccgatcgcgctggccgtggtgctggtcgtcgccacggtgtggtggttcgccaccgcgcggcgccgcttccaggggccggtcagctacggccggccggacgaggtcgcggcgatggacctcgtctgacgcacccgccccgggctccggcgtacggcctgcccgtacgccggagtggcggcccccaggcagtgccagtggtcgggaccaatattggtgacgcgccgcgtgccgaagtgctggcagaagtctgcgtccggcggccatagttggcccacagccgcgcgtctgagctgccgcttccggacaactgggggtcacccaccgatgaccagagcttcagagccgtcccgcagaaccgtcatcgccgcggcggtcgccgtggcagcggtcggcgccgcgggcccggcggccgcggcgccgaccgcccggccgacgaaagcatccccgaacctcgtggacaaccgcgcctggacctcgtactccgactggcgcgggggcaccgcgaagggcacccgggccgtcgcgggcgcccgccccggcctggcgatcgccacccccgcgggccgcaccgactacaccgacccgcacaccggcaggaccgccacctgggagtacgcgacctggacgtccccggtgcaccggctcgccgtcccctccaccgaggtgatcgcctcctggaacgcgcacaccccggccggcacctggctccaggtcgagctgacgggcacctactccgacggcaccgccacgccctggtacgtgatgggccgctgggcggccggcgaccaggacatccggcggacctcggtcgacggccagagcgacggcaagagcagcatctggacggacaccttcgccatcgacgacaccgcctcgggcctgcgcctggtctcctaccggctgcggctcacgctgtaccgcaccccgggcggcgggatcacgccgaccgtgtggcgcctcggcgccatgggctccgacatcccggaccgcttcaccgtgcccgcctcggcgccggggctcgcccaggagctgagggtcccgcgctactcgcaggagatccacgccggccagtaccccgagtacgacaacggcggcgaggcctggtgcagccccacctcctcacagatgatcatcgagtactggggccgccggcccacacccgggcagctggcctgggtcgacccctcgtacgccgacccgcaggtgtgccacgcggcccgcttcacctacgactaccagtacgcgggctgcggcaactggcccttcaacgcggcctacgccgcgacgtacaaggacctccagggcgtggtgacccggctcggctccctcggtgatctggagacgctgatcgcggcgggcatcccggtcatcacgtcccagtcgttcctcaagacggagctgacgggggcgggctacggcacctcgggccacctgatgaccgtgatcggcttcaccgccgacggcgacgtgatcgccaacgaccccgcgtcgcccggcgacgacgcggtccggcgggtctaccagcggcgcgagttcgagaacatctggctgcgcaccaagcggtacaacgcctccggcaaggtcgtctccggcacgggcggcgtctgctacctgtacttcccggcccatccctccgcgcgccggcgcaaggcgctcgcggcggtgggcgtccgctgacgaggggcggcccccgggagagtaccgggggccgccgccccgtgtgaccaaggtctccgccgcaaaagccctttccggtggcaaggtggacagaccggtgggggggagtccattgcaagacgacgtcagcgagaagccatgaccgcaacctctgccaccgcaccccgcgtccgcacgggcggccccaaggaagacggcccgaagatcctggagcacgtcatgggctggaccctcgtggtggtcctcgcgatgctcgtcacccagctcggcctgctgtgacctgagtggcccgccccgcggggcgtcccgaaccgcgtccggttcgccgatcggagtcgaacatcctggtgatgatgttctgacatactgccgatgtcccgctggcagttggagacttgggccggaattgaacaacagtcaacagcgcggcgtggtgcgccccggggcacggggcacggaccgctctgccgcgcgtcgcgccgaactcatcgccatcggacggaagctgttcgccgacacgtcgtacgacgcgttgtcgatggacgacatcgcccgccaggcgcacgtcgccaaagggctgatctactactacttcaagtcgaaacgcggctactacctggcgatcatcgaggactcggtgaccggcctggtcacccgcgccgccgaggggctggagctgccgcccgaccagcgggtgcaccgcaccatcgacggttacctccgctacgccgagcacaaccaggcggcgtaccgcgcgatcatcagcggtggcgtcggcttcgacgccgaggtgcaggccatacgggacggcgtgcggcaggcgatggtcgacgcgatcgccgaaggcgcttacgggcgccacgagatcgcgccgctcgcccgcatgggcctgctcggctggctgtgcagcgtcgagggtgccaccctcgactggaccggccgcccggagctgccccgcgacatcatgcgcaaactgctggtcaagatgctcggcggcaccctgcgcgccatcgaggagctcgacccggcgtatccggcaccgccggccgcccgccgggacacctgagcgagaggcgggggccgttcggacccccacctcaagtgacctgcttcgacggctagttgatcgccttgatcagttcaccgttcgaggtgtcgccgctcagctcccagaagaaggtgcctcccaaaccctgcgcgttcttgtacgtcatcttcccggcgatggtcgacggggtgtcgtaactccaccagttgctgccgcacttggcgtaggcggtgccgccgaccgtgccggtcgccgggcacttcgtcttgaggaccttgtagtcgtcgatgccctgctcgtacgtgcccgccgccgggcccgtggcgctgccgcccggcgccgcctgcgtgacgcccgtccagccgcggccgtagaacccgatgccgagcagcagcttcgaggccgggacgccgaggcccctgagcttcgcgatggtcgccgaggtgtggtaacccgccttgggaatgccggagtacgagttcagcggcgagtgcggagccgtggggccggtcgcgtcccaggcgccgaagaagtcgtacgtcatcgggttgtaccagtcgacgtactgcgcggcccccgcgtagtcggccgcgtcgatcttgccgccgctggtggcgtccgcggtgatcgccgaggtgacgaggttgccgctgccgaacttcgaacgcagcgctcccatcaggttcttgtacgccgccttgccgctggtgtcgcaggtgttgccgcaggcgttggggtactcccagtcgatgtcgatgccgtcgaagacgtccgcccacttggagttctcgaccaggtcgtagcaggactgggcgaacgcggccgggttcttggcggcctcgccgaaaccgctcgaccaggtccagccgccgaaggaccagaggaccttgaggttcgggtggagcttcttgagcttgcgcagctggttgaagttgcccctcagcggctggtcccaggtgtcggcgacgccgtccacggattcggccgcggtgtacgcccggtcggtcgccgcgtacgcgtcgcccatcgcgcacttgccgcccgtgacgttgccgaaggcgtagttgatgtgcgtgagcttggcgcccgagccggaggtctcgatgttcttgacgtagtacttgcggtcgtaggtgccccattcggtgaagtacccgacgaccttggagccggcggcggccgccctggcgggggcctgggcctccgtggcggtcgcggtgcccgcgccggcgagcagccccgcgccgaggacggcgcaacatgcggcggacaggagcgcccgcagggaggcgccccctgttcgaacaggtttgcgggtttgggggaggacgcgggggcggtgcggactgagcatcgtgtctcctcgtgggggagaggggagcgtgcgtcggttggcatgaacgcgtagacgcgctggggacgaaacagtaggaggactagaccagttgggtcaatggttcggaccaatttcgcgtcggaggcggcgcgggggccgctccctggggcagggtggcttcttttttgagtgagcgctcgttaactggtgacgcgatgcctccgatcgggcatactcacagcgcacagccgctggtcagcagcctccgtgacccggaggcggcagcatcggcagtgtccagtgagacccggcggggccgccccaccccaggtgagcgttcgccgatgtgcccgacagggaggagagcgtcgccatgcccgaccgcgccccgcagccggtggaccgtcagctgcccacggatgaggcccgggatctgatctcgctcgtccgcgacatcgcgcagcgtgagatcgcccccgaggcggccgagggggaggacgccgggcacttcccgcgcgaagtcttcggactgctctcggaatcaggactcctcggcctgccctacgactccgagtacggaggcggcgaccagccgtacgaggtctacctccaggccctcgaagagctcgctgcggcccgcctcaccgtcggcctcggtgtcagcgtccacaccctcgcctgccatgcgctcgcccagtacggcaccaaggaacagcaggtcgagcacctgcccgcgatgctcggtggcggactgctcggcgcctactgtctctccgagccgtcatcgggatcggacgcggcctcgcttcgcacgaaggcggtgcgggacggcgacgactgggtgatcaccggcaccaaggcgtggatcacacacggcggcatcgccgacttctacaccgtcatggcgcgtaccggcggcgagggtgcccgcggcatcacggccttcctggtgccgggcgacgccgagggcctgcacgcggcgctgcccgagaagaagatgggcatgaagggctcccccaccgcgcaggtccacttcgacggcgtgcgggtgtccgacgagcggcgcatcggcgacgaggggcagggcttcgcgatcgccctgtccgcgctcgactccgggcggctcggcatcgcggcctgcgccgtcggcgtcgcccaggcggccctcgacgaggcggtcgcgtacgccaccgggcggcagcagttcgggcggccgatcgccgacttccaggggctgcgcttcatgctcgccgacatggccacgcagatcgaggcgggccgggcgctctacctggccgccgcccggctgcgcgacgcgggccgaccgttctccaagcaggcggccatggccaagctgctgtgcacggacgcggccatgaaggtgaccacggacgcggtccaggtgctcggcggctatggctacaccgcggacttcccggtcgagcgctatatgcgtgaggccaaggtcctgcagatcgtcgaggggacgaatcagatccagcggatggtcatcgcccggcacgtcgcgggtcccgactcgcgctgaggcgcgtcgcggtcgtgcgccgcgctctgcgggccgtggggcgcgccgaggcgccccgcgggcctgaagtgcgctgaggggcggtgtgcggggccgggaccggccggggctcaggcgtccgccggaggggtccggccggcgccgaactggcccagcccgaccgggggtgccgccaggcggacccactccgggtcgtgacggcccgggagcgtgcgccctccgtcggcccatgtccgcatcagggcgcggtagatgggcgggtcgacgggctgcggcggccgcagcggaaccgattctgccggtgccggaacgagtacccgacgccgacgcccggtcgctggataggtggaagtcatacccgggcaacgcgcgggcggcggccgggtcaccggtgcctggaatagagcgtgagttcatgacgggcccggtaaggggtaccgcgggcccctctcggcccttgggcggcgcgcgcggctggaggtgtcctgcgcggcgctgtgccggccgaggaagccgcgtccctcgcccccctcggcgaggcaagcctcttgcgtcgccacgtcacgactcaacgtacccacggcacatgggcagttgacgggccgtcacgcccgccgcccatcgaggacgtcgtcgaccggtcgacgacctccggccacgcgaagagggcggggcgctgctcggtcggccgacgcgcgcaccgagaacgtcgtcgcgggagtcgggcttcggctggacggtctccccgtaccgcttcttcccgggcccggccgtgagcatcggtcgacgcgggctgctgcccggcttcccgcggcgcgacgatgccgagcgacgctgtgcgcggctcaccggccacaccccgcgggacacggctctccccacccggcacgcgggcccgcggcaggcgatcgtcatgccgcgcgtcgcccaccgtcacgtgcgctgcggcgaggtggcccttacggcggatccggacgcactgaacctgcaccacggcgacctgcgagccgtggtgcagggcagctacggggatcgagggaccacgcgcgggccgcgcgccgcctcgtgccgtgggtcaggcggcctcgcgccgcatgtccggcacccgcatcgggcgcgaaccggggccgccgacgtgcgagaacggctgcgtccgccagtcgaggccctgagggagcgtcaacagcagggcggtgtcctgctcctggggttcgacggactcgtccgccggccgggcgtcggcggcctggcggcccgtaccggcgcagaccgtcagcccgaacgggttccacggggtcgcgcacagcgcgtgctcgggcaggacctcctcgtccgccaggagcgcgatcggttgcgcgcagtccgggcagacgacccggtacatctcgaaggtgtcgtaggcgtcgaactcgtcctcgccgggttcgacaccctccggctcgggctcgatgacgagctgctgccgcttgggtgcggtacgacctgggcgcttaagactctgcatgggattctccccctcgggctgggccgacaaggcactgcggcctcgaccacagcaagcacttcccgccccgtctcggcggtaatcacgagaacatcacggagcctgttcgggcactgtgtcgttcgtcacatgccgcgcgcagatgcccgacgcggtggatttgtcccacgggcggccggcagccggccgtcggccacatcacgaaccgggtatgacctgcgcggctcaggtatccgaggagatcagacgcactgtaggttcttgcgccatggaggagctcgaccgacagatcgtgcagctgctcgtcgccgatgggcggatgagctacaccgacctgggcaaggccaccggcctgtccacgtcggccgtgcaccagcgggtacgtcgcctggaacagcgcggcgtcatccgcggctacgccgcggtcgtggactcggaggccgtcgggttgcccctgaccgccttcatctcggtgaaaccgttcgacccgagcgcccccgacgacatcgcggaacgcctggccggcgtcccggagatcgaggcgtgccacagcgtggccggcgacgagaactacatcctcaaggtccgcgtctcgaccccgcacgagctggaggagctcctcgcccgggtgcggacgctcgcgggcgtctcgacgcgtacgacggtggtgctgtcgacgccgtacgaggcacgcccgccgcggatctgacggccccggccgccacgggagcgcacgcaggcgcgagactgttccccatgagtgagagcaccgccccgtcggacaccgtgctgctgcgcggtggagaagtccacagccccgccgaccccttcgcgaccgcgatggtcgtggaacgcggacaggtcgcctgggtcggctcggaaggcgccgcggacgccttctcggccggtgtcgacgaggtcgtggacctcgaaggcgccctggtcacccccgcattcaccgacgcgcatgtgcacaccacctccaccgggctcgcgctcaccggcctcgacctgtccggcgcaccctccctggaggcggccctcgccctcgtacgcgacttcgccgcggcccgcccggacgaccgggtcctgctcggccacggctgggacacggcccgctggcccggcggacgccccccgacacgcgccgaactcgacgaggcggccgacgggcgtccgctgtacctctcccggatcgacgtccactcggcggtcgtcagcaccgccctgctcgacctggtgcccggcatcaccggccgcgccggatacctggacggcccgctgacccgcgacgcccatcacgccgtccgcggcgccgcgctcggcgccgtctccccggcccagcgcaccgaggcccagcgtgccgccctcgcgcacgccgcctcgctcggcatcggttccgtccacgagtgcgcgggccccgagatctcctccgaggacgacttcaccggcctgctgcgcctcgccgccgaggagacgggcccccgggtcgtcggctactgggccgagtggggcgaagagggcatcgacagggcgcgtgccctcggagcggtcggcgccgccggtgacctcttcgtcgacggcgcgctcggctcgcacaccgcctgcctgcaccagccgtacagcgacgccgggcacacgggtacggcctatctggacgacgacgccgtcgccgcccacgtgatcgcctgcaccgaggcgggcctccaggcgggcttccacgccatcggcgacgccgccgtgacctccgtggtcgagggcgtgcgcgccgccgccgagaaggtcggcctcgcccgcgtccgcgccgcccggcaccgcgtcgaacacgccgagatgctcacccccgagaccatcgcggccttcgcggaactcggcctcaccgcctccgtgcagcccgccttcgacgcgctgtggggcggcgcggacggcatgtacgcgcagcgcctgggcgccgagcgggcccgtacgctcaaccccttcgccgccctcctgcgggccggcgtaccccttgccttcggctccgacagtcccgtcaccccgctcgacccgtggggcaccgtccgcgcggcggccttccaccgcacgccggagcaccgtgtctccgtgcgcgccgcgttcacggcgcatacgcgtggcggatggcgggcgatcggacgggacgacgcgggggtcctggtgccgggcgcgcccgccgactatgccgtgtggcgcaccgaggaactggtcgtgcaggcccccgacgaccgcgtcgcccgctggtccaccgacccgcgctcgggcaccccgggactgcccgacctgacccccggcggagacctgcccgtctgcctgcggaccgtggtgggcgggcggacggtattcgtacggcccaacgagtgatgtccggggacggcgcggcggcgatcaccaccggccgcccggcgcgcgacctgcgcatcctccgcactgcccggtcggatgagggaatcgtcgcagctcgaacggctgttgacagccgacctcggggggccggtaggttcggccgggtccaccaccggacgtccgaccggggaacttccgcgcactcgccggagcgtcgctgggccaggggtggtgcgccgcaccggcgcaccgccactgggagccaggcccagcacccgcgccacgacgagggatcgttccgcacgccggacggaggtccctccctgctcgagcggaaccgagagtctggggggaagggtgtgacccgggtggggcccggacgctcagtagacaacggctctcggtcgacccgcagccagcgggccccaggtcggcccgaagggcgccgggccccgattccgtggcgtgcacgcggacgggcggcggaatcggatgcgcgcactggcgcaaaagtgcctcttacccgactcttgtgtaatcgacaccccccatacgaacgtgctgacacgtcggtgcaggccgcggccactatggtggacccctgcgtacggacttgaaggggcagcagtgaacgacggcgacgagaccctcacggcaggagctcaggggagacagttcggcccgctcggcaccgccttggtgatcattccgacctacaacgaggcggagaacatcaagtcgatcgtcggccgggtacgggcctccgtgcccgaggcgcacgtcctcgtggccgacgacaacagccccgacggcacgggcaagctcgcggacgagctggccgtcgaggacgaccaggtgcatgtgctgcaccgcaagggcaaggaagggctcggcgccgcgtacctcgcgggcttccgctggggcctggacaacggctacggcgtactggtcgagatggatgccgacggctcgcaccggccggaggagctgccccggctgctcaccgcgctcaagggcgccgacctcgtgctcgggtcccgctgggtgccgggcggccgggtcgtgaactggccgaagtcccgcgagttcatctcccgcggcggcagcctctactcgcgcctcgccctcgacctgccgcagcgcgacatcacgggcggctaccgggccttccgccgcgagaccctggaagggctcggcctcgacgaggtcgcctcccaggggtactgcttccaggtggacctggcacgccgcaccgtcaaggccggctaccacgtcgtcgaggtgcccatcaccttcgtcgagcgggagttcggcgactccaagatgagccgcgacatcctcgtcgaggcgctgtggcgcgtcacgacgtggggcgtcggggaacgggtcggacggatcacgggccgggggcccaagtcctcgtgaaccgccgcctgcggaccgtacgggttcacgggcggcgttgatcattcccttatcccgcactgagccggggccaggcacactggacgcatgacgactggcgctccgactccgacgtaccccgcccgcccccggcgctctcggctgcgcacgttcctgccgctgggtgtggccgcatggctggtgctggagatctggctgctcacgctggtcgccggtgcggccggcgggttcacggtcttcctgctgctggtcgccgggttcgtcctcggctccgtggtgatcaagcgtgccgggcgccgggccttccgcaacctcagcgagacgctgcaacagcagcagtcggacgcgccggtgacccgcggcagaagcgacggcaacgggctgatgatgctcggcgggctgctgctgatgctgccgggcctgatctccgacgccctgggcctcctgctcctgatcccgccggtccagaaggccgtgagccggtacgcggagcgcaccttcgaccgcaagatccgcgaggcgacccccggcacgctgggcgacgccttccagcaggtccgcatccaccgccccgacggcaaggtggtccagggcgaggtcatcaggcaggacggcccccaggacccggagccgggcccgcgcccgccgctgaaccgctagggcggcccgtccggccgatcatgcaaacggcacggcacggcacggcacggcacggcacggcacggcacggcagacgtccgtaggtgttacggacagcacaaaaccgcaggcgccgtacattcgtacggcacccacggtcacgtgcgtgcgttgtatgccgctctgcccccggagggactacgcggacttgcggctgtcccggggatgaaccgcgatgttcatcgcgccggatcgcagaaccgccaggcgctcctcgaggacctcttcgagctcctcacgggtgcgccgctccatcagcatgtcccaatgcgtacgcgcgggcttggccttcttttcctcagggccgtcgccgtccaccaggagtgcctgggccccgcagaccttgcactcccactccggcgggatctccgcctcgaccgagaagggcatctcaaaccggtgccccttctcgcatgcgtactccacggcctggcgcggggccaggtcgatgccgcggtccgtctcgtagctggtcaccacgaggcgcgtgccgcgaagagctcgctcactcatgaatcgtgcctcccgggcttgtcgcccacaggacaggtgtcgctgtcgtcgtcatccggtcaacgtccggtcggcggtaaagattcccgttccgggtcccgttccgggttgtgcgtcgccgtcgtagccgccccttgttgtacccaccggcgcccggtttgtcacatctgctagcagatgtcacccagcgtttcggcttctttgacgcgcagtaacggtacgcctggcaggccaaacgcgtacactaccgccctttggccctgggcgctaaatcctttcgggaacggagttccccgcgtcgcgcaccgcctgccgtaccggaaccctggcgagcagcacgaatccgaccacgaagaaggccaccagcgagatgatcgcgtcccggtagcttccggtcagctggtaggtcaggccgaacaggagcgggcccagccagctcatgccgcggtcgctcatctcgtacgccgagaagtactcggcctccttgccggcgggcaccagatgcgagaagagggagcgggacagggcctggctgccgccgaggacgagaccgatcccggacgccaggacgaagaaccagaagggcgcgccggccggcaggaagtagccggcgcccagcgtgaccgtccaggccaccagtgagccgaggatcgtgcgccgggcgccgtacgtccgggccagccgccccatgcccagggcgccgcccaccgcgagcacctggacgagcagcacggcgacgatgagcgtggactggctcaggcccagttcctcggagccgtacaccgacgcctgggagatcaccgtctggatgccgtcgttgtagatcaggtaggcgagcaggaacgagagcgtgagcgggtggcggcgcatgtcgcggacggtcgccgcgagccggcgcggtccgggggcggtgatctccttgacgggcgacccgcggtcgcgcagccgcttcagcggtatgagggtgaaggcgccccaccacagacccgccgaggccagacagatccggaccgcggtgctctccgagacaccgaaggagtcgtgggcgaggaacagcaccaggttcgcgatgaggacgagggctcccgccgcgtacccgaacgcccagccgcgggacgagacggcgtcgcgctcctcgggcggggcgatctgtggcagataggagttgtagagcatcatcgagacggcctgcgcggcgttggcgaccaacaggagcacgccgcccagcagatagcggtcgccgtccaggaagaacatgcccgccgtcgccgcagcgcccacgtaggccgtcaccgcgagcagcggcttcttacggcccgtgcggtcggcggccgcgcccaccaggggcatcaccacgacggcgacgatcacggacagggacacggagtacgcgaagaacgacccggcgcgcaccgggacgcccagcggatgcacatagccgtccgcgtccgccgccgacttcgcgaccgacgtcagataggggccgaggaacacggtcagcacgctcgtcgagtagacggagcaggcccagtcgtagaagtaccagccgcgttgttcgcgccgtcgctcggcggcctcgtcggtcggccgtgcctgcgcggtgtcggtgcccacccgtgtcctcgcttccccgtggtaggggccgcgcgagggttcagatccaggtgccccggtcttccaggaccttgcgcagcgtgtcgatgtgatcggtcatgatgccatcgacgcccaggtccaggagctggtgcatctggtgcggatcgttcacggtccacacatgcacctggagtccgcgggcgtgggcggcgcgcacgaaccggtggtcggccacgggaacgcccgactgggacatgggcacctgggcggcgatcgccgagcggcgcagcgcggccggtatgccccaggagcgcagccgcaggctcaggacaccgcggatgccgtacgacgtcgccagccgcggtccggccaggcgctgggcgcgaaccacccgcgcctcggagaacgaaccgacgcagacgcggtcccaggcgtccgtgcgctcgatcaggtcgagcagcgggcgcagggccggctcggccttgacgtcgacgttccagcgcaccccggggaaggtttcgagcagttcctcgaagaggggcaccggctcgctgcccgccacgcgcgcgtggcgcacgtccgcccaggggagatcggcgatccggcccgctccgtcggtgacccggtcgagggtcgagtcgtggaaggcgacgagtttcccgtcggacgtcgtgtgcacgtccgtctcgatgtagcggtagcccgccgccaccgcgcgccggaactggaccatggtgttctccaggccgtccgccgccccgccccggtgggcgaaggcgatcgggcccggatggtcgaggtaggggtggcgtatgtgcgcggtcaccgtcgaagtatcgcccgcgggggtggcccctcggcaacgaccgtgctgccgcccgacgccccggagggggcgaacaaacgcaggaagagctgggcgagggggccgatcgccaccgcgtacaggacggtcccggcgcccacggtcccgccgagcgcgaagcccgtcgccacgaccgccacttcgatgaccgtgcgcaccagccggatcgagcgtccggtgcgccggtgcaggcccgtcatgaggccgtcgcgtggacccggtccgaagccggccgcgatgtagaggccggtcgccactccgttgagcacgatgcccgccgcgagcagggggatgcggacggacagggtgtgtgccccgggaagcagggcgagcgtgccgtccatggcgatgccgacgacgaagacgttggagacggtgccgagtccggggcgctggcgcagcgggatccacaggagcaggaccgccgcgcccacgatgatggacaccacaccgatcgtcagaccggtcagctccgcgagtccctggtgcagcacgttccagggctcgagcccgagtcccgactcgacgaggagcgcggagctcgcgccgtacagcgccaggccgacgtacaactggatcaaccgtcgcccgcgacggttctgtgtggacaggacgccggacaagacgtgcccccctgtggtggttgtggactgacccgtgtcactctgtggcttggaaagagaagccatccatggccaattccgggaaggtggactggcaaccatggctcagtggacttcggcagtgggcgccgcgcagctcgcccggctgctcaactcccagcaggaacgccccgcgggccccggcacccgccgccccccggcctatcgcgcactcgccgacggtatccggctgctggtcctggaaggacgcgtgcccgtcgccgcccggctgcccgccgagcgggaactggcgctgtccctgtccgtcagccgtacgacggtcgccgccgcctatgaagcgctgcgtgccgagggcttcctggagtcccgccgcggagcgggcagctggaccgccgtgccggccgggaacccgctgcccgcgcgcggcctggagccgctgccgcccgagtcgctcggttcgatgatcgatctgggcaccgcggcgctgcccgcccccgagccgtggctcacccgcgccgttcaaggagccctggaggagctgccgccgtacgcgcacacgcacggcgactacccggccgggctgcccgcgctgcgctcgatgctcgccgaccggtacaccgcgcgcggcatcccgaccatgcccgagcagatcatggtgacgaccggcgcgatgggcgcgatggacgccatctgccatctcttcgcggggcgcggcgagcgcatcgccgtcgagtcgccctcctacgccaacatcctccagctgatgcgcgaggcgggggcccggctggtgccggtcgcgatggccgaggggctcatgggctgggacatggaccgttggcggcaggtgctgcgggacgcggcgccacgcctggcgtacgtcgtggccgacttccacaatccgaccggtgcgctggccgacgaggaccagcggcgccggctggtggacgcggcccgatcggccgggaccgtgctggtcgtcgacgagacgatgaccgagctgcacctcgacgacggtgtggagatgccgcgcccggtgtgcggcttcgaccccggcgggtcgacggtgatcacggtcgggtccgcgagcaaggccttctgggcgggcatgcgcatcggctgggtgcgggcggctcccgacgtgatccgcagcctggtctcggcccgtgcctacgcggacctgggcacaccggtggtggaacagctggccgtgaactggctgctcagcacggggggatgggagcaggcggtggaggtgcgccgggcccaggcccgcgagaaccgtgacgcgctggtcgccgccgtgcgccgggagctgccctcctgggagttctcggtaccgcagggcgggctgacgctgtgggtgcgtaccggcggtctgtccggctcccgcctcgccgaggcgggggagcgggtcggggtacgcgtcccctccggaccccgcttcggggtggacggcgcgttcgaggggtatgtgcggctgccgttcacggtcggcggcgcggtggcggaggaggcggcggcacggctggcggccgcggcgcggctcgtggagacgggcgcgtcgggagccggggagtcgccgcggaccttcgtggcctgagcccggcccgagcgggttcagccctccgcgggcacggcttccgcggccacggcctctgtgaccacggccttcgtggccacggtttccgggacgacggcctcagcggtcacggcctcagcgggcacggtcttcgcggccacggtcaccgtggggaccggctccgccgcgtccgccggagtgctccgccccggcagcaggtcgagcaccgcccgccggtgggtctcgctcgtcgcgtcgtcgtacgggtccggggtcgccggcacctggagccggtgcaccggcccgccgccgagccgggcgtaaccccgccccggaggtacgtccttcgcgggcgtcgtgtgcggcggcgcccccaggatctccgccagccggtccggagtcgcggggccgagcaccacgcgcgcgcgtgtgtgctgacgtaccgcctcggacaggccgtcgaggccgtcgaactgctccgccacgacgaccgtgacgttcgccgcgcgaccgtgccgcagcggcacctggagcagcgactggggatccttgcgcccctccgccgccgcgaggtggcccagtgcgctcggccggtcgagaaggagccagagcggacgcttgatgtcctccggcgccggatacccctcctggcgggcacggttcgccgcgatcaggcgccgttccgtctcgtgggtggcccactccaggctcgccaccgcgcccgccggcccgcattcgaccgccagcacgccgtcccggccggtcaggcacgcgtactcgccggtgccgccgccctcgacgatcacgacgtcgccgtgctggagggcctggagcgcgatggagcgcaccagggtcgtcgtaccgctgccgggctcgcccacgaccagcaggtgcggttccgtggaacggacgcccgtgcgccagaccaccggaggcacgtcccgctgttcctcgccgtaggtcagggggagcgtgcgctggacgccggtcgggtcggtgaagccgaggaccgtctcgccgggtgccgtcacgaagcgctgggcggcgatgtcggtgggcagcgggccgagaacggtgaccgtgagctcgttgccctcctcgtcccaggtgaagtggtactcgcggccccggcccgacttggcgtgcaggagctgctcgatccgggcacgggactccgcctcgccgtccgtgaagtaggccgggtagcggatgagcaggcgcgagatgcggcccgtgccgtcgaagtcgtacgcggggaacgcctcctcccactcgccgccgtgggcgtacaggggagccgggtcctcggcggtcgagaagtacgggaccagcgcctcgtacagcgaccgcaggcgcttggtctgcgactcgtcggggccggcgggtcgcttcgccccggggtcgcggcccatccaggctgccgccgccatcagggccacggcggcgagcagtggtccgtacggtgccagggcgacgaccaggatcaccgaggagaggagaaagaggagcggcccgcgccggtccttcggtgtgtcggcccacctgcgccgtccggccgccgccagccggcgcagtccacgggtgatcgtgatcagcggatggaggacgtcggtggcgctgtcggccgccgtccgggccagctcccggctccgggcgagctgcgcgctgccgttgctcagaatgcgggggagggggcgccgggccacgtcgttctcctgagggtgcgtgcgaagggaagggcggtcagaacctgatcccgccgaggagactcgccaggctcgcgccgccggccttgatgctcggggcgatggcggtgctggagaggtagaagccgaacagcgcgcacgtgcacgcgtgcgtgcccttgaggccgtccttgcggaagaagaggaagacgacgatgccgagcaggacgacgcctgacatggacagaatcatttcggttctcctggttggtggggacagtcaccatgagttcttccaggctcacaggatgtatccatacgataaaaggtgcaaatggatggaattagactgatttcatccggctggcggagccgttctgggccgcccggacaggccggttgcgccgagcggggcgtgcggtgatctttgcctcgggcggtgccggtcatgtaccccggaagccagtacgctggcgattcacccgtacggctgcaccgctcgccgtcgtacgctccccagtccccagaagcagtcgtagtgagaggtggtccggccgatgagcgaagcccccgaccccgaggtcgtggagctggcgaccaagatcttcgatctggcgcgccgtggcgagaccgagccgcttgtggcgtatgtcgacgcgggggttccggccaacctcaccaacgaccggggcgacaccctggtgatgctggccgcatatcacggccatgccgaagcggtgcgcgccctgctggagcgtggcgccgaggccgaccgggtcaacgaccgaggccagacaccgctcgcgggggcggttttcaagggcgaggaagcggtgatccgggtccttctggacggcggtgccgacccggccgcgggcacgccctcggccgtcgacacggcccggatgttcggcaaggcgaacctgctcgaactgttcggcgcacgctgatccgaatgccctgaccaggcacgacacagaaaacgggggaggcgggacggggccgccggaaatacggtcgcggcaggaagaaccgccgggtcatcatgacgtcgtgattcacggacgcgatggctgggcagttgttgccgcaccgcgcgggccgtgacgcggcccgcatgggccaccgacgagaggcagaggaagatggtctacagcaagcaggaaacggcgggcgccccgacgtgttgtcacgcggccaggtaaagcaggacccccggttgcgtcgacgcttgatgtgaggctgtttcccatgttcgatccggtcatagcgcccagcggtacgctgctcggcctgctccagcggggccgcggcgacggcacactccacgcgctcaccgcaccgcgggccgaggcgctcgcggccctgaatcactgtgtgctgcgtgacccccgccacgactggcaggtggagaaccgctccctgtactacgcccgtctctacctcgacctgagcggtgagctcgacgagatcgagcggcacctcttcgacgccgaggacgttctcgacacggacgagtcccgcacggggctcgccctcgcggtcctcgggcacctcgcctcgtacggcaggctcgacgcgctcgcgctgctgcgcaggtacgcggccgtcggcaccaactgggcctgggccctcgacgagctggcgctgcgcgacgacgacgcgggcctgcgcgccctcgccgctcccgtgctggcccgcttcccggtcgatgccgagggcgaggccgagctcgccgccgccgtgcgcgacgccttcgaaccccggccctggcggctgtgggccgaggatccgcgcgaatccatcggcacgcgcgtgcgcggcgcccaggagaccggctccttcgaccgctggcagcgccagatgcgaccggccgggccccggcccgggtggagcgtgcaggccgtcttcgactgggcccagcagggactcgaacgcggagcgctgctccacgttccggccgcccgctgcctcacggccgtcgcgggccccgaggaccggcccgagatcgtcgaggccgcccgttccggcggcgacggcgcccgctgcaccgccctgcgctatctcaccgacggcaacgatccggacgccctcgacctcgtcgagggggccgtggccaccgggtccgcggtcgtcgtggaggccgcgctggacgccttcgaacgtatgtgcagtgtcgccgccgtggaccgcgcgcgtggctgggcccaccggcccgaccctctgggcgccgccgccgggcgcatgctcgcctgccggggcggtgcgcaggacagcgaactggtgctgggcgccctgcgggaggccgtacgcggagagggccccgacgcgcccacgctgtggacgctcgtcgacggcaccgggcggctcggcatcgcgtgcgcggcgcccgtgctgcgtcatatctaccgcgagaccgcgtcatcccatctccgcggccgggccgcccgcgccctggccgccaccgatccctccttcgccgccggtttcgccgtcgaatgcctgtgggactgcgaggagttcactcgcgaagtcgccgcccggcacgccgagaccggcgacgcgcgcgtggtcgaccagctccgccgcctggccgcggacccggccgaggaggcagaggtccagacggccgtacgcagccggatcgggcccgacatgcccgccgtatgaacagcgtgcccgccgtatgaacgacatgcccgccgtatgaacgaggggtgacccgcgcggcggtcgggcatggacgtgggccgacctgcccgggtgtgcagcgcaacgctcatgggacgttcctcgtccggaaagatccacgttgacgcggccacgtccagcacgacgacaacaccggtatgcgtgtcgtcatcgtgaccgagtcctttccccccgatgtgaacggcgtggcccactgcgccctccagaccgcccggcaccttgtcgagcgcggtcacgcccccctcgtcgtcgcccccgcctcccccaagtccccgacatcgctcgggcagggcggtgcccccttcgccgggcaggggcccgacgccctcgcgccgtgccgcgtcatccgggtgccctccctcccgctccccggctacccccaggtccgcgtcgccctccccagccgccgcgtcgccgcggcgatcaccgaacaccgcgccgacatcgtccacctggccggccccttcgtcctcggtgtccgcggcatggcggccgccgcccggctcggcatccccgccgtcgccgtctaccagaccgacctcgccggatacgcccgcacgtacatgggtgcgggcgaggccacggcctggcggcgcatacgctccgtccacgccgccgccgaccgcaccctcgccccgtccaccgcggccctgcacgacctggaggcacacggggtgccccgggtgcggctgtggccgcgcggtgtcgacaccgtccgtttccgccccgagcaccgggacgagtcgctgcgccgcgaactcgccccgaacggcgaaccgatcgtcggctacgtcggccggctcgcccccgagaagcaggtcgaactcctcgccggagcctgcggtctgaggggcgtgcgggtcgtcgtcgtgggcgacggcccgagcgaggtgacgctgcggggcgcgctgcccggcgccgtcttcctggggcgccgcacgggtgacgaactcgcccggatcttcgcctcgctggacgtcttcgtgcacaccggccccttcgaaaccttctgccagaccgtccaggaggccatggcgagcggtgtgccggtcgtcgcgcccgccgcgggcggcccgctggacctggtggcgcacggccgtacggggctgctggtcccgccgcgtgacgccggcgccgtgcgcgacgcggtgtggtccctggccgccgaccccgcgctgcgggccgcgtacggagcggccgggcgggccaccgtcgagggccgtacctgggcggccgtcggcgaccagctcatcgggcactacgccgaggtgctgtccgcgcggacggcggtggcggcatgagcccgcgaagcgacgagggcggcgtgcacgagccgccgcggaccggcgggccggccggggcgctgcggatcgtccggctcgccaacttcgtggcccccgcctccgggggactgcgtaccgccctgcgcgagctgggcaagggcttcaaggaggccgggcacgagcccgtgctcatcgtgcccggcgagcgccacaccgaccgcgagaccgggcagggccgcgtgatcaccctgcccgggccgctgctgcccggcaccggcggctaccgcgtgctcaccgacaagcggcgcgtcgccgccctcctggccgagctggcccccgaccgtctggaggtctccgaccgtacgacgctgcggtggaccggcaagtgggcgcggcgcgcccgcgtccccgccgtgatggtctcccacgagaccgcggacggcgtcctgcgcacctggggcctgtcggagaacgtgtcccggcgcgccgccgacgccctcaacacccgtacggcacacacctatgcgcgcgtggtgtgcaccacggagttcgcggagcgggagttcgtccgcatcggggcccgcaatgtcgtacgcgctcccctgggcgtcgacctggagcagcgccgccccgcgctgcgggacccggggctgcgcgagcgccacgcgcgcgtggacgagacgctgctcgtcatgtgctcccggctgtccgtcgagaagcggcccggcaccgccctggacgcgctggaggcgctggtgcggcgcgggcggcgcgcggtgctcgtcgtcgccggggacggcccgctgcgggcccggctcgaacagcgggcgcgggagcggaggctgcccgtgaccttcctcggccatgtcggcgaccgggcgctgctcggcgcgttgcaggcctccgccgatgtgtgcctggctcctgggccggccgagacgttcgggctcgccgccctggaggcgatggcctgcggtacgcccgtggtcgccagtgcctcgtccgcgctgtcggaggtcgtcggctccgccggagtcacagccgcggatcacggcgacgccttcgcggacgccgtcgcatcgctcctggaacgccccgagtacgagcgccggcagaccgcacgcgcgcgtgcggagtgtttcggttggaagaccgcggtcgacgcgttcctcgccgcgcacgacgcgggggcgccggctcccgctcgggagggcgtccgatgagaccgccgcgcttcgtggcgctcggcgactcgctgaccgaaggcgtgggcgaccccgtcggggacacctggcgggggtgggccgcactcctcgccgccgggctcgcccccgcggacgcgcccgccgagttcaccaacctcgccgtcagcggcgcccagacgcgcgacgtcctggaacggcagaccccggccgggctcaccctgcgcccggacatcgtgtcggtcgtcatcggcgtcaacgacacactgcggtgcaccttcgacatccacgccgtcgccgcacggctcgaccaggtgtacgcggcgttccgggcgcgggacgcggtgctggtcacggcgtgcctgcccgaccccggggcgatgttcgggctgcccggggcgctggcccgtccgctggcccgccggcagcgggctgtgaacacggtcgtgcacgccctgtccgagaggtacggggcggtgcatctgcacgcggcggaagaggagtggctgaccgatcgcgcgctgtggagcgcggaccggctgcacccgggggagcgaggccaccggcagctggcggtccgcttccacgcgctgctcgctcaggagggcctcgtgaccgggaccgcgcccgcggccgagcccgagttccccgcgcccacccggtcggcgagcctctggtggctggccaccgcggggaccggctgggtggcccggcggtgcaccgacctgctgccgcagctgctcaccctggccgcctccgaggtacgccaccgggcacgcggcaccagcgcccggctcgacctgagcgcctcgcacgcggcggcgtccgcgctggccgccctgtcggggacggagcagccggacgcggcctgagccgtcagcggcggcgtacggccacgaagcggacgggggtgccgggaaccgcctgggcggccgccgggaggtcggcgggccggacgaccgcgatcaccgggtagcccccggtggtcgggtggtcggcgagaaagacgaccggccggccgtcgggcggcacctgcaccgccccccacaccatgccctcactgggcagttcgcccgtccgggaccgttccagcgcgggcccttccgtacgcagtccgatgcggttgctcgcggtggacacgcggtacgcgcgggtgacgagcgtgcggacggccgtcgccgtgaaccagtcgtcgcgggggcccggcgtcacccgcagcaccagttcggccggcgggcccggctggggaacggcgtccacgcgcgcgtgggggccgaccgggtgccccagggggagcaccgtcccgtcggtgaggggtgcgggaccgagcccggacagcagatccgtggagcggctgccgagcaccggttcgacggcgactccgccggagacggccacgtaaccgcgtactccggactgcgcgggtccgatgtcgagcaaggtgccgccggggacgcgtacgggcgctccccagggcgcggggcggccgcccacggtcaccgcgcagggcgcgcctcccaccgccacggtgaccgccgaacgggggcgcagagcacagccgttgagcgtcgtctccaggacggccgcttccggcggattgccgaccagccggttgaccagcgccgccgcgggcgggtccagcgcaccggagcgcggcactccgaggtgggcgtacccggggcgccccaggtcctgcacggtggtcagcgccccggcccgtacgacggcgagcgcccgatccgtcatacggaccccaccgcgacgaagcggacgcgggcgccgggcgcgagcagggcggccggtacgcgcgcgtggtcccacaggacgcggtccgtggtgccgatcagctgccacccgcccggcgacgcacgcgggtacaccccggtgtacgggcccgcgagcgccacggagcccgccggaacggacgtgcgcggggtcgcccggcgcgccacgtcgtagcgcgcgggaagcccggtgagatagccgaacccgggcgcgaacccgcagaacgcgacccggaattcggccgccgagtggatgcgcgccacctcgtcctccggtacgccccacagggcggcgacctcggccaggtcggggccgtcgtaccgtacggggatctcgatggcctcctccgcgcgcgggggtaccggcggcactgtccagtccgcgagctgggccgcgagccgggagggctcctccaggccgtccaggaggaccgtgcgggccgcgggcacgacctcccgtaccgtcagggttccggccgccctgcggcgcagcagctcggcgtgcagggcctgcgcctcgtcacccgaggcgagttcgacgagcagggcccggtcgccgaccggcagtgccctcatgcgaaggccgccacgcggacgcccgaggcctccagccgcgacctgacccggcgggccagctccaccgcgccgggcgtgtcgccgtgcaggcacaaggagcgtgcccgtaccgggatccggcgcccggagtgcgcgtcgaccaccccgaggcgggcgaggttcaccgagcgttcgacgaccgcgtcggggtcggtgaccaccgctccgtcctcgccccgcggcaccagcgtgccctcctcggtgtacgcgcggtccgcgaacgcctccgtgacgaccggcagcccggccttctcggccacctccagcaagcgcgagccgggcagcccgagcaccgggagcgaggcgtcggcgagccgcaccccgtcgaccacggcgccggcctgcccttcgtcgtgcaccacccggttgtagagcgcgccgtgcggcttcacgtacgacacgcgcgtgcccgccgcgcgggcgaacacctccagggcgccgatctggtacgccacttcggccgccagttccgcgggcggcacgtccatcgcgcgtcgcccgaacccggccaggtcccggtaggagacctgggcgccgatccgtacgccgcgctcggccgccagctcgcacacccgccgcatggtggccgcgtccccggcgtggaagccgcaggccacgttggcgctggtgacgacggacagcagccgttcgtcgtcggtgagctcccagcggccgaagccctcgccgaggtcggcgttcagatcgatcatggtgtctcctggtcaggccacgcggtactgctcgtcgcgggcgtcggtgaggaacatctggcccggggcgtgggtgatggcgaacggcggacgggacgccatcaccgcggcctgcggggtcacgccgcaggcccagaacaccgggatgtcgtccggttcggcgtccaccggatcaccgaagtcggggcggccgaggtcatcgatgccgaggcccgacggatcgccgcagtgtacggggctgccgtgcaccgccgggagcatcgtgctctcccggatcgccgccgccaggtgctcgggcggaacgggacgcatcgacaccaccatggggccgtgcagccggcctgccgggcggcaggcgcggctggtgacgtacatggagacgttgcggccctgctcgatgtggcgcatcgggacgcccgcctcgctcagtgcccactcgaaggtgaagctgcacccgatgaggaacgacaccagatcgtccctccagtacgcgacgacatccgtgggctcggccaccagctcgccgttctcccacacccggtagcgcggcagatccgtgcgcagatccgctccctccgcgagcggagtggtccaggaaccggcgtcggtgacgtcgaggaccggacacggcttggggttgcgctggcagaacagcagcatgtcgtacgcccagtcggcggggagcgagatcaggttcgcctgggtgtgtcccgcggcgaccccggccgtgggtccgaagacgccccagcggaagcgggcccgcgccttgcggggggtccacgcgtgcgcgtggccgtcgatccggctcagggggcggtccggggtgacgcggttcaccggagctccttcccgcgggtctccggaagcccgagcagcgccagcgccgccagggcgtagccgatcgcaccgaagaccagcgcgccgcccacaccccagctgtcggccaggaagccgaccagggtggggaagacggcgccgacggcgcgtccggtgttgtaggtgaagccctgtccggtgccgcgcacggccgtcgggtacagctcgctcaggaacgagccgaagccgctgaagatcgccgacatgcagaagccgagcgggaaaccgagcaccaggaggagggtgtcggcgccgctcgggatgttggcgtacaccaggacacagatcgcggagagcaccgcgaagagcaggatgttgcgcttgcggcccagtttgtcggtcaggtagccgccggtgaggtagccgatgaaggcaccggagatcaggaacgtgagatagccgccggtgccgacgacggacagtccgcgctccgtcttgaggtacgtcggcacccaggtggccagcgtgtagtagccgccctggacgccggtcgagagcaggcccgcgaagaccgtgatccgcagcagaccgggcgcgtcggccgtcccgggcctgaagatcgccgtgaacgaacccttgtgagcgctcttctggcgctcgacggccgcctccggggcgtcgtgcaccctgcgtcgcacccacacgaccagcagcgcgggcagcgcgccggtccagaacatcacacgccatgcgaggtcgtcgcccacgaaggagaagaccagcgtgtagacgacggcggccagcgcccagccgacggcccaggaactctggatcgcgccgagcgtccggccccggtgccgggcgctcgcgtactcggcgaccaggatcgcgccgaccgcccactcgccgccgaaaccgagcccttgaagggcgcggaagaccagcagggtctcgtagttgggcgcgaagccgcaggccaccgtgaagacggcgtaggtgatcacggtgatcatcagggccttgacgcgcccgatgcggtccgcgaccacacccgcgacggcgccgccgatcgccgagacgaccagggtgaccgtcgtgaacagtccggtctgaccgctgtccaggccgaagtaggccgcgagcgcgaccatgctcagcggcagcgtgaagtagtcgtacgagtccagggcatagccgccgaacgcgccggcgaaggcacgccggccgcgcggaccgagcgcgcgcaggaagccgaaggcgccgtcttcggaggcgggttcacccgcgccgggcgcggtggcggcggtcagttgtggagagggaggggtcgtgctcatgggcacctcgctaagagggacggagggtgcttgagggacgagccgtgccgtgcgggggtgcgtggagcgggtggcgctgttcggggggcgtggagcgggtggtgccgtgcgggggtgcggaggaggccgtgccgtgcgcaagccgcggcgccgtcgtgcgagcgggcggcgcctgtcaagcaaggtaggggatcgttgaacgatccttcaatacccacgttgtttcgttgttgtatctgcgattgaattccgggcatggcagatcagctgacgggactggccgacgaccgcgctctgctggggcgcaccagcaccgccgagcgggtctcggacatcctcaggggccgtatcgccgagggctacttcccgcccggcacccggctgtcggaggacagcatcggcggcgcgctcggggtctcccgcaacacgctgcgcgaggcgttccggctgctcacccatgaacggctgctcgtccacgagctgaaccgcggggtcttcgtacgggtgctgaccgtcgaggacgtgcaggacatctaccgcacccgctccctcgtcgagtgcgccgtcgtacgcggtctcggtgagccgccgtacgccctggagggcctcgcggaagccgtcgcggaggggcagcggacggtgcgcgaaggtgactggaaaggactgggcacggccaacatccacttccaccgggaactggtcgcgctcgccggcagcgcccgcaccgacgaactgatgcgcagcgtcttcgccgaactccgcctcgccttccacgtcgtggacgacccgcggcggctgcacgagccgtatctcgcgcgcaaccggcagatcctccaggccctggagacgggcgaccgcgacaaggcggagggactgctcgcggtctatctcgacgactcgctggagcgggtcgtggaggtctaccggcggcgcgtgggcgacgacgggcaactgtgaccacgggggtgacgacgggcagctgtgcccccggctgtcatgcactgtgaccccggctgtcatgcactgtgaccacgggtctcatctgcgtcgtttcgaccgctgtcagaccgaggacctagtctgtgcaccgtgacttcgcctgcatcgacggacagcgttccgccccagctcagcgcggggccgcgcccttctccgggcccggccgccgacgagggactggcgcggcggctgcgcgcgctcgcctgcacggcgccgctgcacgacctcgatgcgcgcaaggccaacctcgccggtgagtacgcggtgtacgggatggcggaggtggccctcgccgccatcgacctggtcacactgaacatggacttcgacacgggcgcggaccacgaccagatagtggcccgcctcatcccgcgcatcgccgcccaggccccccggcggcccgtcgccgagcacgagcgggtggcccgctgggtcctggagaacctgatcaacgtcggcagcgtcgaccgaggtttccgcgccgtctacggcacgttcgcgcccgacggctcctatgtgcgccgcgactacgacttcaagctgatcgaggaggtccccgggtacggaggaagcgtctacctccgtacgacggacgaggcggtcaacgtcctcgtgggcgccctcgacaccgatgtcaccagcgcgcagatcgccgccgaggtcaagctggaggtgctgatcagccgcggtcggctcgcggacgcgcagctcgccgccgagcaggcgcgctaccggaccgtccagtactcggagacgttgcgcaaggcactggacgcgacccggcgcaatgtgcgggccgtcgactggctgaactcggtgccggacatgatcgccgaggccctcgaccacgtcgccgaccgctaccggcacgagaacgcgatcctgaccaacatccgcaaggcacgcgacgagtccgaggaccccgagcagaagcggcgcgccgccgagctggtcgacatcgtcaaggactgcatccgccggcacacgctgctccagtcccggctcctggaggcgggcccgctgttccgcgccgagcaggaccggcaggccttcgcgacccccatgacgacgtccgggatcgatctctacgggcatctcgtcgcccccgtgctgccgctgcccgtggagcaggccctgcgcgtcacggacgccttcttcgcgcgcggcaccgggctgcgcacacccgcgtccgtgcgggtcggggacctcgtcgacctgctgctgacaccgcccgtggagcgggagcacctcggcgcggagatgccggagccagacctgatcgccactcccgacgacagccggttcagcgaggagcagctggccgccgccatggagctgctcgacctgccggcggacgcgccgcggcggttgtcgggactgctcgcggaagcgcgccgccaggattccgaactgccgtaccttgtcgccctgctggccgtgcacgcggccagcccgccggtgggcaccgcctaccggcagggggaggagaagctgctgttcgccgtggacgacggggtcgaactggacgacgacgagttcggcggggccgatctcatcgtgggcatggcgatgctcgacgcgatggggatggcggcggaccggaagtgaacgcctcgtcggcggagccgcacatgccacagccccgcgcccatgagggggcgcccgaccgcaccatcgcttttgagatcaaggagccccaaccgtgaccgagcacgtcgagtggagtgagccggaagtcgccgccacgccggtgaacgccgccgtcacccccgccgacgccgccgacgcggcgcggctcgtggccttcgggctccagcccaagctccagcccgcccgcgaccaggagtacacggagttgctgcgccgctaccgcgaggacccgcccttcgcgcggctcgcggacgccgtggccaccgggctcggcctggtcgtcctggaggtgtccccgcgtgccggtatggccgtcaccgccgccgaggactccgtgttcgccgtccgcatgggcgactacgcgcggcgcacggcggccgactccggcgaccgcttcctgcatgggctcgcccatctcgccgtcgccgccatggcgttcccgcgccccgaggacctcgcggacgacggctacatcgggcgcgtctcggtcaacggcgtcgacgccttcgtacgccaggcctgccgccgcctggaggagcgggccgaggagcagggcgagaacaccgacccggccacggacgcgcccggcctggaggcggcctggcggatctgggccagacgcagcgccgccggggccaccaaggacgcgcgccggctcgccggttcgaccaccgggatcgtcggcaaggccgtcgtcttcctcaccgactccggctttctccagcggaccggcgacgactccggcggcacctaccgcaccaccgcccgctatcagctccaggtgcgcgacatggccggcagcgccgccctggccgagctgctcgagctgggcatcgtcccggtgaccgacggcaccgcgagcctgctgccccccgaggacaccgacgacctggaactggtcgccgacgccggactgccgttccactcctgacccggcctccccggccccttcacccgacctccgcccccgaactcccctgacgactacgagagtccgcacatgtacgagctgtcccgggtccgcctctactccatcgggccggccggtgcgcgctacgccgacaccgtgctggacctgcggggtgtcggcgcgcccgtgcccgaccccgcgcccacccaggcggagttcttcgaggacgagcccgtcggcccgccgcgccggcccgcgcccgccggcgtgctcttcctggagaacggcggcggcaagtccgtactgctcaagctgatcttctcggtgatgctgccgggccaccggaacacgctcggcggcgccagctccggtgtgctgcggaagttcctgctcgccgacgactgcgggcatgtggcgctggagtggcagcacacgctgaccggcgagtgcgtcgtggtcggcaaggtgagcgagtggcgggggcggcaggtctccaacgacccgcggaagttcgccgaggcctggtactccttccggcccggccccggactcagcctcgacaacctgcccgtcgccgaggccacctccgtacggccgcaggccgagggcgtgtccggtgcgcaggggcggcgccgcaccatgaagggcttccgggacgccctcaccgacgcgggcaaggcgtatccgcacctcgaagtgcactgggaggagatccacgaccgctggaacgagcacctcggggacctcggtctggaccccgaactcttccgctaccagcgggagatgaacgccgacgagggcgaggccgccggtctcttcgcggtcaagaaggactccgacttcacggatctgctgctgcgcgccgtcaccgacacccgcgacacggacggcctcgccgacctggtcggaggcttcggcaacaagctggggcggcgcgccgagctgatggccgagcgggacttcacggccggatccgtggacctgctgggccggatcgtcgacgccgccgacgctcgggcacgcgcgcgtgacatccacgccgccgccgagcggcgcacccggacgctggcccgccggctgtccgcgcgcggcgtgcgggagcgcgtgcgggccgccgacctcgcgcagcgggtgaccgccgcagcgtacgccgtcacgcacgccgagggcgcccgcgagcgcagcgccctgatcgcggccgaactcgcctaccggcacgcctcgttggcgctcgccggagccgagaagtccgcggccgcgcagaagcgcgagctggccgacgcgcgcacgctgcactccgcctggcaggctgccgaggccgtgctgcggcaccgggccgccgccgaccgctccgcgcgcgtggccgtcgcgatccgcgaggccgagcgggacgccgcgccggcgctcgccgcccgcgccaaggccgccgtcgacctcgtacgtgccctgcacggtgccgccgagagcgcggagaacctcgccaacgaggaggaggagcggtccgcagggctccaggacgtgggcgagagggcgtaccgggactcgacctccgccgccacggaggcgcagcgcgcccgcagcgaggccgggcatctgcgccagcggctcagcgaggtagcgcaggagaccgccgaggcggtgcgcgcggggtggctggacgacagcgcgcccgacgcggaccccgcacgcgcggcgctggccgcgagcgacgccgagaagacggccgtcgccgcctgggacaccgcgcgtgaggcgtccggccgggcctccgagcacgccagggaggcggcgtccaccgagtcccgcgcggagctgacggcggcccgcgcggcggacgcggcgacggcggccgagcgcgcgtacgaggcggagttccgtaccgccgagtccctggcgggggaggagcgtttggcggacctgctgagcctgccggcctccagcaggcagggggcggtaccgacgccccggcgcgagggcacagcgggtgcgacggccgaccgccagggcggtgcgcacagcgcggccgagggttttgccgcgccccgccctggcgccccgcggcccgcgagcgaaggccccctcacccccgaggagctggaccgcttcgccgacgaactgcgtgagctgctcgacgactcggtcggctccgccgagcggcagctgttcgagttgcagaccggcgccgccgacgactcccggatcctcggcgccctcggcgacggcggcctgctgccgcccggcccggacgtgctgtccaccgtcgagtacctgggcgagcacggcattcccgccctccccggctggcgctacctcgcgcaggccgtcgaccccgccgatcacgcgcgcgtgctggcggcccgccccgagctggtcgacggtgtcatcatcacggaccccgacacgcacacgcgggcccgcgaagccctgagcgaggccgcgctgctgccccgctccgcggtcgccgtcggtacggccgccgcgctcctcgcccccacgccggcgcccgaggcgggcgacagcggcgtgttcctcgtaccgccgaacccggccatgcacgacgaacacgccgccgacgaggaacggcaggccctgcgcgcgcgagcggcccggcgggacgaggagatccgggccctcgcggcccggctcggcaaggaccgggagctggccgcacggctctcgtcctggcgcaccggatgcccggcggggcggctcgtcgaactcgccaccgccgcacgggacgcgcgcggtttcgccgaggaaaccgaggccgagctggccgaggcgcggaccgtccgggcggaggccgacgaagccgccgccgaggccgcgcacgtacgggacgagcggcaggaggccgcccagaaggcgcgccgcgccgccgacgcgctcgccggactcgccttccggctgcgtgagcgtgccggctggcaggtcaagctccgcgaactcgccgacgaggcggccgagtcggaggcccgcgcccagacctgcctggagcgcgcccgcgccgccgacgaggaccggcgcgccgcccagcgcgccgccgacgacgcccgccgcacggcccgcgcgctgcgcgccgagcgcgcggagatcgcgggcgcccccgacgacgtacccgaggacgagcccggagcggcgaagtcgtccctgcccgccctccgcgaggcctaccgggccgcctcccagctgtacgagaaggtcggcgtcggcgccgatctgcgggccgaacaggcgcgcgccgagagcgacgagagcgccgcgctcaccgagctgaaccggctcagcaacaaggtgcggacccgcgcggcccagctcctggagtccccggacggctccgacgggccgtcccggcaggccgcggccgcccgtgtcgaggagctggtgcagctcctggagacccggatgtccaccgcgagcgagcagctcggccggctgcgcggcgaggccgagcggcacgcgcccgagaacggcgaggcccacaccgagctgtccgacgagctggtccccgagaacgccgagcacgcgcagaccctgctgcgcaccgcgaccggtgaactggccgcccgcgccgatgcgctgggccaggcgcgcgaggcccacgcggagctgctcgacgcgcaccgggccgccgaggacgcggccggcggcttcgacgagaccgccgcgctgctccgtgacctcctgcgtgagcagcaggccgaggacgagcaggaggaatccgaggcctaccccggtaccctggaggaggcccggcactccgccgccgaggcccgccggtccctgcgcggctgcgccgccgacctgtccgccgccgaggcggccgtgcgcgaggcgagcgacatcctcgtccggcacgccaactccacccgctacgagcaggtgcgcacccccgcccggcagcagatccgcgagctgcccgcgtccgcgctgcccgagcacgcccagaagtgggcggacgccttcgccccccggctccgcgtcctcaccgacgagttggcgcagctggagcgcaaccgggactcgatcgtggaccggctgcgcgggctcgtggagtcggcgctggccaccctgcgggccgcgcagcggctgtcccggctgccggaagggctcggcgagtggtccgggcaggagttcctgcgcatccgcttcgaggagcccgaccaggccacgctcaccgagcggctcggcgaggtcgtcgacgaggccacccgggcggccgtcaagaagaactccgacctgcggcgcgacggcatgtccctgctgctgcgcggagtcggtgccgcactcgagccgaagggcgtcgccgtcgagatcctcaagccggacgccgtactgcgcgccgagcgcgtgcccgtcggacagatgggcgacgtgttctccggtggtcagctgctcaccgcggccatcgccctgtactgcaccatggccgcgctgcgcagcaacgaccggggccgggacaggcaccggcacgcgggcacgctgttcctggacaaccccatcgggcgcgccaacgcgacgtatctgctggagctccagcgggccgtctcggacgcgctcggcgtccagctcctctacaccaccggcctgttcgacaccacggcgctcgccgagttccccctggtcatcaggttgcgcaacgacgccgacctgcgcgccggactgaagtacatcagcgtggaggaacacctccggccgggactgccgcgtgaggctcccgccggggaggccgggtacagcgagatcacggcgacacggatgtacaagcgcccggcgccgagcgcctcataggggtgggggcgtgacatcatgcggctccgccgcgtgggcgcgacccgccccatacggacagggcccgcagttctccgccccaccccctacgcgtcctccttcaggagatcggcgcacttctcgccgatcatcatcgtcgtgatgcacggattgacggagatcagctccggcatcaccgagccgtccgcgacccgcagaccctcgacccccttgacccgcagccgcgcgtcgagcggggccgaggcgtcgtcgtccgcgcccatcttcacggtgcaggacgggtggtagacggtgttgtgggtcttgtggatgtagtcgagcagctcgtcgtcggtccggatgtccggtccgggggagagctccgcccccgcccagccgctcagtgcgggctgtgacgcgatcctccgcgccagcttcaggccgtacgtcatcacgcgcacgtcgtgctcgtgcgtgaagtagcgcggatcgaccctgggcttgtcgcggtagtcgcgggtacgcagccgcaccgtgccgcgggacttggcgcgggtcacgttcggcgtgaggcagaaggcgttctcggaggtcgggaagccgtggcgggcggtgttcatgtcgaacggcaccgagccgtagtggaacatcaggtccggccggtccaggcccggttcggtgtcgtagaagatgcccgcctcccaccactggctggacgtggtggtcatcggctgcctggcctcccacatgatgacgccctcggggtggtcctggaggttctcgccgacgcctgccgagtccacgaccacgtcgaccccgacctcgcgcagctgctcggcgggcccgatgcccgacagcatcaggagcttgggcgtgtcgatggagccacaggacacgatcacctcgcggcgggcgagtaccgtccgcgtgtggatcaggtccgggtccaggtactcggcgcccacgcaccgccgcccgtcgagcacgagcttcttggcccgtacgcccgtgcgtacctccagattgggccgcttgccgatgatcgggtggaggtacgccaccgacgaggactgccggatgttgttctcgtcggagttgatctggaaccagttggcgccccggaccacggtcttcccggtgttgaaggccgtggtggggatcccggcctgggcgcacgcctccaacagggccgtgccgcaggggtcctcgcccttgagcgtgcgcagcttcaccgggccggtgcggccgtggtggtcgccgggcgcgtcgttggactccaaccgccggtagagcgggaagagttcggccgcgctccagccggtacagcccgccgccgcccagtcgtccaggtcctcggccggggcccagaaggcgatacaggagttgtgcgaggaacagccgccgaggaccttggcgcgggcgtgccgcatgaagctgttgcccaaggcctgcggttcgaccgggtagtcccagtcgtagccggactccagcagacccatccagcggtccagtctgaggacgtcgtcgtcgccgacgtcgctgggccccgcctccaggacgcacaccgtgacggacgggttctcggaaagccgggcggcgaccacgttgcccgcggtgccgccgccgaccacgacatagtcgaactcgtcgatactcatgggaagttgacctccttgaacagttcttcagtcggtcttcagccggtcttcgggcggacttcagccggtcttcgcacgccctcggccggtctgcgggcggtcctcagtcggccgtgggagcggcgaggggagcgggcgcggcggtggtctggaggcggtgttcggcgagcacgccggtcttgtgccgctggatgaaccagtagtaggcgaagccgccgccggcgatgaccgcgacgaacaggaccgcaccccagcgcaggtaccagtggaacggggcggcggcgttgtagacctcggaccgcggccagatcaggttgagcgtcatggccgcgccccacagcacggcgacgatgttgaccagcagcccccagcggcccagtgagaatctgccgtcgcccgcgggctgccacttcccacgcagccgggccaccagcatcgggccggtgacgccgagataggcgaggtagatcatgatgatgccgatgctggtgacgacggtgaagatctgcggctggcggatgttgacgacgaggatcgccacggcgaggacgccgatgatcaccgcggggagcaccggggtctggaagcgcgggctgacccgggcgatcagggaggacgcgggcaggttgttgtcgcgggccatcgcgaaggccagccggatcgccgccgtgtgcacggcgagcgcgcagacggtgaccgcgatgagcacgcaccacagcatcgccttgccggccgtcgggccgagcacgtcgagcacgatgtactggaggccgtccgtggacagcttgtcgcccttcaggctggagacgctcatcagggcgagcagcagcacgagcccgccgaggacgaacgaggcgacgatcgcgcggatgatcgcccgcggtgcgttgcgggacgggtccagggactcctcacccagcgaggcggccgtgtcgaagccgtacatgacgtacgccgacgccagcgaggccacgaggaacgcgcccaggtagccggtcgtgtgcccggcgccggtgccggcggtctcggtgacgacctgcggtccccgcgtgatgtggacggcgaacagcacgatgaggacgacggtcgcgaccagctcgatgaacacgcccgcgctgttgatggtcgccatcagcttcacgccgaaggcgttcaccagggtcgtgaacaggatcagcaccgcggccaggacgaccgcgttcgtcgccacgtcgtacttcccggtgccgtccccgatgaactggaacgtcgacgagatctgcggcagcgtgagctggtaggcgagcgccacagccgagatcgacacgatggaggcgatgagcatcatccagccggcgagccagccgaggtgcggattgcctatcttcttggaccagttgtacacggagcccgcgacgggatagcgggcggccagctccgcgaagcacagggcgaccatgaactggccgacgaagaccatcggccacgaccaccagtacgcggggccgccgctgccgtagccgaagtagaacagctggaaggtgccggtcaggatcgagatgtagctgatcccggccgcgaaggtgtggaagttgccgagggtgcgcttgagttcgggcttgtagccgaactcggcgagttcggtgtcgtcgtggtgactctgtgggccggacggttgctcggttgtcgtcatgtgcgactcctggtgcgccggggggaggggaaggggagggaaggagatgggaggggtgggatcagacggctgaacaacgggggtatcaagggcgtgttacgcgaaccagccctgtggtgacggatccgtgttacgccagatgtgcttcgcctcccggtactcggcgagccccgagggccccagctcgcgcccgaagccggactgcttgtagccgccccactcggcctgcggtacgtacgggtggtagtcgttgatccacaccgtgccgatccgcagccgggacaccacccgctgggccttggcctcgtcggtggtccagacggcgccggcgagcccgtagacggtgtcgttggccaggcgcacggcctcggcctcgccggtgaagcgctcgacggtcagcaccggtccgaaggactcgtcctggatcacggacatcccgctggtgcactcgtcgaggacggtgggcaggtagaagaagccctcgtccagcccctcaggacgcctgccgccgcagcgcagcaccgcgccctcgtccagccccttcgcgacgtaggcctcgaccttcgcccggtgcgcggccgagatcagcgccccggtctgcgcccgctcgtcgaacggccccccgagccggatctccgcggcccgccgcaccacctcgtcgacgaaccggtcgtgcagcgagtcctcgaccagcagccgcgcccccgccgagcagacctgcccggagtgcaggaacacggcggtcagcgccatgtcgaccgccgtgtcgaagtcggcgtcggcgaagacgatattgggattcttgccgccgagttcgagtgccaccttcttcaccgtgccggccgcggcggccatcagccgcctgcctgtgtgcagaccgccggtgaaggagacgaggtcgacgtccggatggtcggcgagcggcgcgcccgcctccgggccggcgcccaggaccaggttggcgacgcccggcgggagttcggcctcttggaggagccgcatcagatggatcgcggtgtgcggggtcagctcgctcggcttgaggacgaaggtgttgcccgccgcgagcgccggggcgaccttccaagccgtctggaggagcggatagttccagggcgtgatcagcgcgcagaccccgaccggctcgtacacgacccggctgtccgtactcgccgatccggtgtcgatcacccggccggactcggccgcggccaggcggccgaagtagcggaaacagttcacgatgtcgtcgatgtcgtactcgctctcgacgaaccgcttgccggtgtcgagcgactcggcgcgggccagcttcgccctgtcgcgtacgaggagatcggcgacgcgcagcagcaggtcaccgcggtcggcggcgggcagccagggccacgggccctcgtcgaaggcgcggcgcgccgcggcgatcgcctcggcggtgtccttgccgcccgcctcgtcgacgactccgacgagggagccgtcggcggggcagcggatctcccgcgtgcgcccgtcgagcgcggctctccactcgccgtcaatgaacaggtcgggcacgatggcctcctggggtgtcgtacgggtcaggcatggtcgcctcccagctgcccgagcagccactcgtggaagatcccgatgtggtgctcggtgggcaccagcacaccacccttccggtacgcccgcgacgccatggccggctgcgtccgttcacaggcgtcgaagtcctgcacgttcacccggtggaacagctcgaccgacttggacacgtcggcgccggactcgacgacctccggagcgtacagccagtcgcactcgacgatcgtgcggtcctcggcgagcgggaacatgcggtgcaggatcacatggtccgggacgagattgatgaacaccgtcggcttcacggtgatcgcgtagtagcggcggtcctggtcgtcgtcgacggcgggcagcttcgcgaagccctcgctgccgtcgaccgtgaaccccttgacgtcctggccgaactcggcaccgtgcccgacgtagtactgcgcggcgtagccctcggcgaactccgggaggacgtcggtgagttcggggtggatcgtcgcgcagtgatagcactccatgaagttctcgacgatcagcttccagttcgctcgcacgtcgtaggtgatgcgcttgccgagggcgaggttctcggtgccgtagtgctcgatggccgccgcgtcgccgagccgttccacggccgcgcccatcaccgtctcctcgaaggagggcggctcgtcggccaggcacacccaggcgtagccgagccactcgcgcagcgcgaccttgaccaggccgtactcgacccggtccacgtccggcatccggaccaggttgggcgcggcgaccagcttgccgtccaggtcgtaggtccaggcgtgatacgggcactggaggttgcggcggacctcgccggactcctccgtgcacagccgggcgccgcggtggcggcagatgttgaggaaggcgcgcagctcaccggtgcgcgagcgggtgatcaggacgttctcccggccgacctggacggtgcggaaggcgccgggcctgcccaggtcggcgccgcggaccgcgcagaaccacatcgactcgaacaggtcggcctgctcctgccggaagatctccgggtcggtgtagtagtgccccggcagcgtcgccaggaggctcggcgggagggcggagaggggggagacgggggtcgtcgtcacgtgcgtactcctcaggcgggcgcggcggcgaggcggcgggggtcgaacagcccgatcggatgggcggtggtgccggtcagggcgaggtcggcgacgatctctccgaccaccggcacgaatttgaagccgtgcccggagaacccgcaggccacggtcacggagtccgggtgcgcggggtggcgggcgatgacgaagtgctcgtcgggggtgttggagtacatgcaggtggcggccttgaggaaggtgccgggcagatccgggatgcagcgggacatatggtccgccatggcctggacctcgtggtcgtgcacggtccggtcgatcgtctccggagtgcagaccacgcccttgcggaagaaggcgaccttggcgccgaggtccggcccgtcgatcgacgggaagccgtagacctggactccttcggcgtcctcccagatgtagatcgggtggttctcggggcggaagggccccacgccgtgcctcggctggaaccagtacatgacctgccgctcgatggtgaacggcactccgagatccgtgagcagctgcggcgcccacgcacccgggcagatcaccaactggcccgccgtgtaggtgttctcggccgtgtggacgcgtacgccgtcccggtacggctcccagcgcgtcatcggctcctcgaagtgcagctccgcaccctgccgggtggccagctggaggtgcgcggcgaccatgttctcggggcggaccaggccggccttcttctcgtagagcgccacctcgtcgttgctcgggttcagcgtcgggaagcggcggcggatctccttcgcgtcgagcatctcgtggggcaggtcccactgggtggccgagcgcagtgaaccggcgacggtcagcgagtcggggcggccgaccatcacgccgccgctgagggtggcgacctcgcgcccggtcgaccgctccacctcctcgtacaactcgtacgagcgcagcagcagcggtacgtacgccgggtcctcgaagtacgactgccgggtgatgcgcgaaccgccgtggctggagccgcggttgtggaccgggccgaacttctccaggccgagcacgcgggcgccgcgcgcggacagatgatgggcggcggcgctgcccatgccgccgagaccgatcacgatcacgtcatacgtgggggacacgggcgtctcctatcggcggatgcgggtcatcttggggtcgaagagcggctcttcggcgacggtcgcggggaccttctcgccgaagtactcgatgtgcacgcccgtgccggtcgcgagcggcggcagccaggcgtacgcgacgcagcggcccagcgtgtagccgtacgaggcgctggtgacatagccggacgggacgccgtcgacgtacaccggctccttgccgaggacgttggcggcggggtcgtcgaggaggagcggggtcagcctgcgcgtcgggggcgcggccgcgtcgagcgcctcccggcccacgaactccttgtccatgcgcaccgcgaagccgacgcccgcctcgaaagggtcgtgctcgtcggtcatgtcggtgccccaggcgcggtaccccttctccagacggagggagttgaaggccgagcgcccggccgcgatcacgccgtgcttccggcccgcctcccacagcgtgtcccagagccgcaggcccaggtcggccgtggtgtacagctcccagcccagctcaccgacgtaactcagccgcatcgcggtcaccgggacgtgcccgaggtacgtctccttcgcgcggaagtagccgaagccctcgtgcgagaagtcgtcgcgggtcagcggctggaccaggtcgcgggcgagcgggccccagacgccgatgcagcaggtgccggacgtgatgtcccggatgtgcacgccgtcgggggcatgccgggtcagccagtccaggtcggcgggggagttggcgccgacctggaagcggtcggggccgaggcgcgcgacggtgaggtcggagcgtatgccgcccgtgtggtccaggagcagggtgtaggtgaccgcgccgggcttcttgcggaggttgttggtggtcatgcggtgcaggaagtcgagggcgccggggccgctgacctcgagcctgcgcagcggggtcatgtcgtacagggcgaccttctcgcgggtcgcccgcgcctcggccgccgcgatcggcgaccagtagcgggccgaccaggcgtcgcgctcggggagcgggccgagggcgtcgacgagcggggcgttcgcctcgtaccagtgcgggcgctcccagccgccgccctccaggaagcaggcgccgagggcctgctggcgggcgtggaaggggctgacgcgcagcgggcgcggccgctccatcggctggagggggtgcaggatgtcgtacacctcgacgaactgttgcgcaccgcgctccctgacgtacgacggcgagcgctgtgcgtcctcgaagcgggtgaggtcggcctcgtggacgtcgatggacggccgcccgtcgaccatccactcggcgaccgccttggcgacaccggcggagtgcgtcacccagaccgcctcggccagccagaagcccctgagggcccgcgactcgccgagtaccggcatgccgtccggggtgaaggagaagacgccgttgaaaccctcctcgatctccgtgtcacgcagggccgggaacaggcggcggcagtcctcccagctcggcgcccagtcctccgcggtgaaggggtacgaggacggcatctccatgtcgttcgcgcgcgcctcgtcgtaggcggggatcgcgaacgcgtcgacggtgagcggccggtgggcgtagctgccgatgccgatacggtcggtgtgctcgcggaagtagaggtcgcggtcctggaagcggaggatgggcttcgaggcttcggccgtggcgccggccagttcggggagcttcggagtcttcgcgtactggtgtgcgagcggctggagggggacgtcgattccggccatgcggccgatgacggggccccagaagccggcggcggacacgacgtggtgggcggcgaaggtgccccggtcggtgacgaccgcggtgaccctgccgtcctgccgctcgatgcccgtgacggtgtggcggtccaggaagacggcgccgcggctggtggcccgctccatctgggcgcgggcggcgagcagggcgcgggccagaccgtcgtcgggggtgtggaagccgccgaggacgaccgactcgtcgatgaggggccagagttccttgcagcgggcggtgctcacgatctcgccgcgtacgccccaggaggcggcgtagccggccttgcggtgcaggtcggcgaggcgctcgggggtggtcgcgagctccagaccgccgaccgggtcgaagcagggcactccgtccgcctcgagggagttgaacttctccaccgtgtactgggcgaacgacgtgagcatcctggaggggccggtctggaacaccaggcccggcgcgtgcgaggtggagccgcccggagcgggcaggggtccctgctcgaggacggtgacgtcggtccagccgcgggcggtcagctcgtcggccagggagcagccgacgatgccggcgccgatgatgacgacctgaggaccgcgcgggcgggtttcgggcgtgctggacatgcccctccttgtggtggcggggatggcaggggttgggggaagcggcctacacggcagggacgttgagccgttcggcggcgatcgtcgtgtcctcgccgtgcccggtgtgtacgacggtgccgccgggcagcgtgaggatccggttgcgcagggaggcctcgatggtgggccggtccgagtacgagcggccggtggcgccggggccgccgtggaagagggtgtcgccggtgaagacggcgttcaggaacggggcgtggagcgagcaactgccccaggtgtgaccggggctgtggatcacctggagctcgatgccggcgaccgtcaggactcggccgtcgctcagctcgccgtccggcttgcgaccggggtgggtgagcgaccacagctcgttgtcgccggggtgcaggagtacgggggcgccggtcaggacggagagctcggccgccgcgtcgatgtggtcgtcgtgtgcgtgggtgcagacgatcgccgtgacatgacggccggcgacggcctcgtggatcgtacgggcgtcgtgggcggcgtcgacgatcagaacctcctcgtcgtcgccgatcagccagacgttgttgtcgacgtcgaaggtgtcgccgtcgaggctgaaggtgccggaggtgacgacgcgttcgacccgtacggtgccccgcgcggtcacaggaccaccaccgaccgaagtacctccccgcggtgcatcttcgcgaacgcctcctcgacctgttcgagggagatggtctcactgacgaaggcgttgaggtccagcagaccgtacaggtactggtcgatgaggaacgggaagtcgcggctcggcaggcagtccccgtaccaggacgacttgagggcgccgccgcgcgagaacaggtcgatgaggggaaggtcgatcttcatctcggggtcggggaccccgacctggaccagcgtgccggcgtggtcgcgcatgtagaaggcctgcttgtacgtctccgggcggcccaccgcgtcgatggcgatgtcgaccccgaacccgtcggtgagcgcgcggaccgcctcgaccgggtccgtaccacgggagttgacggtgtgggtcgcgccgaacttctccgcctgatcgagcttcttgtcgtcgatgtcgacggcgatcaccttcatggcgccgttgaggcacgcgcccgcgatcgccgcgttgccgacgccgccgcagccgatcacggcgaccgtgtcgccgcggccgaccttgccggtgttgacggcggcgccgtatccggccatgaccccgcagccgatcaggcccgcggcctccgggcgggcggccgggtcgatcttcaccgcctgtcccgcggcgaccagggtcttctcggcgaaggccccgatgccgagggcgttgctgagcggggtgccgtcgagcagcgtcatcggctgggtggcgttgcgggagtcgaagcagtaccaggggcggccgcggcgacaggaacgacaggagccgcagggcgcgcgccaggcgaggaccacgtagtcgccgggggccaggtcggtgacgcccgcgccgaccgcctcgaccgtgccggccgcctcatgccccagaaggaacgggaagtcgtcggtgatcgcgccctcccggtagtgcagatccgtgtggcagaccccgcaggcctggacggcgacgagcacctcgcccgggccgggatcggggacgacgatcgtctgcacctcgacgggtgcgccctttttgacagcgactacggcacggacctcgtgtggcacgaccaagctcctctgctgttgcgcaatgcacgatgggttgcgcgatgaggaacatattgagaacgccgtcgcggagccgtcaagaggtgcgcgttaacccttggcaaaaggaacgggcgggccgaaatctcgccgacacacagcggcgcggggccaggaacctcctggccccgcgccgtgttgcgggtagacccggcctgtatggccaggcctgtatggctcggtctgtatggccaggcctgtatggcccggcctgtatgacccgaaccgtatgacccggactgcctcagaagccgtagcccatccgccgggacagctcggcgccggccgccaccgtccgcttggtcagctcgggcagccggtccgggcccatccggtacaccggccccgagacgctgatcgccgcgatcaccttgccgtcgtgggcgcggaccggggcggccacggcggcaaggcccagctccagctcctcgatggtgactccgcagccctgctcgatcaccgcctccagttcgccgcgcaacaccgtcgcgccggtgatcgtgcgctccgtgaagcgcggcagcgagcgcgcgagcaggccctcgcgcagggtgggcggcagatgggcgagcagcaccttgccgctggaggtggcgtgcagcggggtgcgtctgcccagccagttctgcgccgtcacggaggcggtgccgcgggcctgcatgatgttgaccgccgcgtcgtcgtcgaagaccgcgatgttgacggtctcgcccagctcgtcggcgagttcacggcagaccggcacgccctcctgcgagatgtccagccgtactgccgccgcccccgccaggcgtagtacgccggcgcccaggtagtacttcccgcggtccttggcctgggccaccaggccgcggttctccaggacgccgagcagccggaaggcggtggacttgtgcacgtccagttcctcggcgatctcggtgacgcccgcctcaccgtgccgggcgaggatctccaggacgctcacggcgcggtcgaccgactggaccgcactggccgtgcccctgccgttctgcttcgctgagtttccggagtgctcgtcgctgcgctcagcctgcttctgcgtgcgggtcatagctcaactctcaccacctgacggcccggtttgggccgcatctgcgggaaccccttgacgcgacggtcgtcccgcccggattctgttgcgcatagcgctccctcgtgcgccatacgaaacatcatgttaccgaagcgtccggaacccgaaaggtctcggacagcgtggaccgaagaaggtcccggtactccctgaccgcacgtccctgactgcctggaccaagtaggtcccggaccgcgcgtcccggaccgagaggggggcccgtgattcccgtctgccgccttgaagacctccccgcgggcgagtccgtccgtgtcgacaccacaccacccatcgccgtcttcaacgccgacggcgagctgtacgccattgacgacacctgcacccaccaggacgcgtctctgtccgagggctggctggagggctgtctggtcgaatgcccgctccacgcggcctcattcgatctccgcaccggcctgccgacctgtctcccggcccgccgcgccgtccgcacccaccgcgtcacggtcgacgacggcgtgatccacgtgcatctcgcgctggaggaggggaacgccgcatgaagcgccgcatgacgacggcaaccgccacccgcaccacgggcacctgcaccacgggctcccgcaccacgccccgcgccctgtgcggccacgccccgtgcacccttgcctctgccgtccgccccgggggcgcccgcgcgggggagggtgccgtatgaggaccgtgaccgtcgtcggggcctcgctggccgggttgtacgcggcccgggaactgcgtgcccagggcttcgacggacgactcgtgatcgtcggggaggaaccccacccgccgtacgaccgcccgcccttgtccaaggacttcctgaccggccgggccgaccaggaccgactcgcgctcgccgacgccgaggagaccgccgaactgggcgccgagtggctgctcggcgtgcgcgcccgcggcctcgacccccgcggccgcaccgtgctgctcgacgacggccgcacggtgtccacggacggcgtggtcatcgccaccggcgcctcggcccggcgccttccgggcgacgacctctccggcgtgcacaccctgcgcaccctcgacgacgcccgcgccctgcgcgacgaactctcccggggagcacgccgggtcgtcgtcatcggcggcggtttcatcggcgccgagaccgcgtcctcctgcgcggcactcggccacgacgtcacggtcgtcgaggccgccccgctgcccctcgtcccccaactcggggcagagatggccgccgtgtgtgccgcgctgcaccgccgaggcggtgccggcctcgtcaccggcacgggggtcgccgggctgcgcggccgggcgggcgccggggcggagaggagcggccaccagggggcgggcgccgccggtccgcgtcgtagcgtcacggccgtcgaactctccgacggtcgcctcctgcccgccgacggcgtcatcgtcggcataggagccacccccaacacaggctggctcgcgggctccacgctcgccctgcacgacggcgtgctgtgcgacgacggctgtgcgaccgccctgccgcaggtggtcgccgtcggagatgtcgcacgcgtcggcggcacccgcgccgagcactggacctcggccaccgagcagccccgggtggccgtgcgcaacctgctggccggacgcaccacggagaccgtccgctcggtgccctacttctggtccgaccagtacggcgcgcgtatccagttcgcggggcgtcggcacgacggcgacaccgtacggatcaccgagggcgcgatcgagcgcggcgggcccgcggagggcggactcctcgccctgtacgaacgcgacggccgcaccaccgcggtgctctccgtcgaccgcccgcgccccttcatgcgggcccgacgcgaactctcccgcgctgccgacccggtggagccggcggcgctgtgacgaccgcatcaccaggaggcggggcccgcgcggggtctccctcctggcagtgcaccagggagtggtgtctctgccaggagaggtgccctgccagtgggtggtgcctctgccagtgggtggtgccctgcccgggagcggtgccctgctaggggtgcgacaactgcccgctgccgccccgccggcgtatccgctcctgcgcccgctccgccacccgcgtctgccggcgtatccggcgccgctcgcgccgcagtgcccgtgccgtgctgctgggggccgacaccaccccgttccgctggttccacacctggtgtgtcacccatacgtccagcacgccccaggtcgccacgaccgtactcaccaggctgctcagcaccatggggaaggccagccaggaaccggccatcgtgcacaggaacgccaccaccgcctggatcagcgtcacggcgatgatgagcaccgcccgcacggccgccgtacgcaccggatccggcagcctgcgtcggcgcgcgggctcctcgacccacaacgcccggtaatacgccccctgttcctcctcggtctcggccgccgcggcgcgccgctcggcgcccgcgtcatgcccaccggatggaacgcgccgcccgtccgccgcctcggacttctgtgccggcaaccggcgtccggacgccggaacgtcgcgatccggtgcctgggcgtccggtcgcgccaccgtgggcgccgcgacgccgttcccggtcgtcgcgcgcaactccgccgtgcccatcaactcgatctccccaccgccgacagacccttcaacccggtgtccccagaccccggttccccagtggctgcccggcttgcgctgttttacgccgcctgggcgcggcatacggcacctctggccgtttccgccccccattcccgtacagaaagacgatcgacgcactgcaaagattcccgcagaacgaaaaattccggccaagagcccgggttcccggccagatgcgatccgaacccaagtgccggaatccgggaggcaatctcccgtaatgacgggacaactccccatgccccgttcgccgtacgcggggcgtgcgcccggccggctcttcgagatacctgtgcgtcggtagtaggctcacgccgtttgttgacgcacatgtgtgcccccgggccggcgggggtcgagctgggggaggccatgcgctttcgcgggaagtccatccgccggaagatcgtggcgctgctcctcgtgccgctgttgtccctcaccgccatctggtgctttgcgaccgtactcacgggccgggcggcccagtcgctgttcagcgtgtcgtacatcgtggagaaggccgcctaccccaccgaggacaccgtccacgtcctccagcaggagcgccgccagaccctcgtctacctcgccgatccccgcgcctccgacgcgctctccgccctcaggcgcagccgtgccgccaccgacaaggccgtggcgaagatccgcaagaacgccaaggacgagaagttgcgcgaggagacgggcgaggccaccgccgagcgcctcacctccatcctggacgccctggacggaatcgattcgctgcgccgcagcgtcggcgacggcaccgtcaaccgctcccaggccctcgacctctacaaccgcctggtcgacccctgctacgcgctgctggccaacctccacgtcctcgacaacgtggaaatggacaagcagagccgtgccctcgtcaacgtctcccgcgcgcatgagctgctctcccgcgaggacgccctgctgggttccgcactcgtcgccgggcggatcacccgcgacgagatccgtgacgtctccgacctcgtcgcccagcgcagcctgatgtacgacgtcagcctgccgctgctgccctcctccgagcgggaacgcttcacgcgcttctggaagaacgccgacacggcgccgctgcgcgtcgccgaacagtccgtcatcaatgcctcccccggcacccccagcggtgtgagcgccaagcactgggacagcgcggccggtcaagtcctcgaccggctcggcgagatgtccacccaggcgggcgaccgctaccaggaccgcgtccgccccgtcgccgtcggcgtcatcgccaaggcggccgtcgcgggcgttctcggcctgatcgccctgctcgtctccctgatcatgtccgtacgcatcggccgcagcctcatccgcgacttgcgccggctgcgtctggacgcccacgaggcatccggagtgcggctgcccagcgtcatgcgacgtctgtccgcgggcgaacaggtcgacgtcgagaccgaagtcccgcgcctcgagtacgacaagaacgagatcggcgaggtcggccaggccctcaacaccctccagcgcgccgccgtcgaagccgccgtcaaacaggccgagctgcgcgaaggcgtctccgaggtcttcgtcaacctcgcccgccgcagccaggtcctgctgcacaagcagctcaccctgctcgacaccatggagcgcaggaccgaggacaccgacgaactcgccgacctgttccgcctcgaccacctgaccacgcgcatgcgccggcacgccgagggcctggtcatcctgtccggcgccgccccctcccggcagtggcgcaaacccatccagctcatggacgtcgtccgcgccgccgtcgccgaggtcgaggactacgagcgcatcgaggtacgccggctgccccgcgtcgccatcaccggccccgcggtcgccgacctgacccacctcgtggccgaactcctggagaacgccacggtgttctcgcccccgcacaccgccgtccaggtcatcggcgagcgcgtcgccaacggcttcaccctggagatccacgaccgcggactcggtatggcggccgaggccctcctcgacgccaacctgcggctcgccgagaccccggagttcgaactctccgacaccgaccggctcggcctcttcgtggtcagccggctcgcccagcggcagaacgtccgggtctcactgcaaccctccccctacggcggcaccaccgccgtcgtcttcatccccgacgcgctgctcaccgacgacgtgcccgacaccaacggcatcggattccgcctcgaccgcgcgctccccgccaaggagccggcgctggacgaggaccgcacggcggcgctctcccaggtgcccgtgcagttcctcggcctgcccacgtcgatcctggacgggcccgtcgagctggaggcaccggtcgacctggacgccctcgacgacttccccggcgccctgagcgacgaggacagcgaacgcggcggcctgttccggccccggccctccatcgccggcgtccccggcccgcagcatcagcagccccgcgacggccgcggcgagccgggccgctcgggcgacaccgaccaccccgatgccccggttccgctgccccgacgccggacccccaagctcgtcagctcgcacggccgcccggtcacggggacacggtccaggagcgcgggagcggacgaggggcccgtggagggcatggacccgatggaaccgggcgtggccgcgttcgacgaacgcaggtcgaagccgtcggcagcccgcctggccgaccggcgtgagtcctcgaaacgcccgcgcggcgaccgcgagatcccgaaccgcccgcagggcgagcgcagcgacgctcccgccctcccccagcgacgccgaagccgcccctccgccggcacggaggagaccaccccgcgtctcggggccgcggcagggaaggcagaatcgggtgcggggccgctgccccggcgcgtacgacaggccagcctggccccgcagctgaaggacggccccgagcggcgcgccgaacgcgacaaggcccgcaccgcgagccgggcggacctcgccgagcgcgacgccgacgaggtacgcagccggatggcctcgctccagcggggctggcagcgcggccgcgaggagaacgccgtgggcgacgatgcccaggacggctcagtacgaggaacgacaaggggggacggtcgatgaccgcaccgaaggccgcagggcccaccgcgagcagcacggcgtcgggggagctgaactggctcctcgacgacctggtggagcgcgtcgccagcatccacaaggcgctcgtgctctccggcgacggcttgcccaccggcgtctccaaggacctgagccgcgaggacagcgagcacctcgccgccgttgcctccggattccacagtctcgccaagggcgtcggccgccacttcgaggcgggcagcgtccgccagaccgtcgtcgaactcgacgaggccttcctgttcgtcacggccgccggcgacggcagttgcctcgccgtgctggcggacgcggatgccgacatcggtcaggtcgcgtacgagatgacgctcctggtcaagcgggtcggcgtacatctggggtccgctccgcgcaccgatctgccctcgggcgggtagtgggacagcatgagcggagacggtcagggaagaagccactggttcgacgacgacgccggaccggtggtccgtccgtacgccatgacgcggggccgcaccagccatgcggcccagcaccgcctcgacctgatcgcggtggtcgtcgcggaatcgcacgcggacgaacccgaggcggaccacatgctgtccccggagcatgtggacatcgtcggactctgccgtcacaccccccagtcggtcgccgagctcgccgcggaactcgatctccccatcggagtggtacgtgtcctcatcggggacctcgtggacgaggaactcgtccatgtgacacgtcccgtacccccggccgagctcgtcgacgagagtattctgcgcgacgtgatcagcggcctccgggcgctctgaacagcgcggaagcggggaacagacgtgacaggctggcagttctgggtcgaccgaggcggcaccttcaccgacatcgtcgcgcggcgcccggacggccgcctgctcacgcacaagctcctctcggacaacccggcgagatacgcggacgcggccgtcgcgggcgtgcgggaactcctcgaggacggcgcgcggatcgatgccgtccgcatgggcacgaccgtcgccaccaacgccctcctggagcgcaagggcgaacgcaccctcctggtcgtcacccgcggcttccgcgacgccctgcgcatcgcctaccagaaccgcccgcacatcttcgcccgccaaatcgaactgcccgaactgttgtacgagtgcgtcgtcgaggcggacgaacggatcgccgccgacggcacggtcctgcgcgcccccgacctggacgccctggccgggccgctccagcaggcgtacgacgacgggatccgcgcgatcgccgtggtctgtatgcacagtcacctccaccccgcccacgaacaggccatcggcacgctcgccgcccgcgtcggcttcccgcagatctcgctctccagcgaggtcagccccctgatgaagctgatcccgcgcggggacacggccgtcgtcgacgcctacctctcgcccgtgctgcgccgctacgtccagcacgtcgccggcgaactccacggcgtgcggctgatgttcatgcagtccaacggaggcctcgccgaagccggtcagttccgcggcaaggacgccatcctgtccgggcccgcgggcggcatcgtcggcatggcccgtatgtcgcagctcgccggcttcgaacgggtcatcgggttcgacatgggcggcacctccaccgacgtctcgcacttcgcgggcgagtacgaacgggtcttcaccacgcagctcgccggggtccggctgcgtgcacccatgctggacatccacacggtggcggccggcggcggttccgtcctccacttcgacggctcccgctaccgcgtcggccccgactccgcgggtgccgccccgggccccgcctgctaccggggcggcggtccgctcaccgtcaccgacgccaacgtggcgctcggccgcatccaacccgcccatttcccgcgtgtgttcggaccccggggcgaccagcccctggacgccggactggtccgcgagcgcttcgccgccctcgcgcgcgacatccgcgacaggacgggcgacgaccgcacacccgagcaggtcgccgagggctacctgcagatcgccgtcgccaacatcgccaacgccgtgaagcggatctccgtccagaagggccatgacgtcacccggtacgcgctcaccaccttcggtggagcgggcggccagcacgcgtgcagggtggccgactcgctcggcatccacacggtcctcgtaccgcccatggcaggcgtcctctccgccctcggcatcgggctcgccgacaccacggccatgcgtgagcagtccgtggaggcgcccctggagcgggcctcgatgccgcacatcctgaagacagccgacgacctggagggcgccacccgggccgaactcctcgccgaggacgtccccgaggaccgcatccgggtcacccgcagggcacagctccgctacgacggtacggacaccgcactcaccgtcgagctgaccgagcccgacaccatgatccgcgccttcgaagaacgccatcgcgccacctactccttcaccctcgaccgcccggtcgtcgtcgaagccctctccgtggaagccaccggtctcaccgaaccccccgatctctccgccctcgccgcattcgagggccgctccgccacccctgagacggtcagcctgcacaccggcggcgcctggcgcgacgtgcccctgcaccgccgtgaggcactgccgccgagcgagaccgtgaccggaccggcggtcatcgccgaggccggcgccaccacagtcgtcgacgacggctggcaggcggtcatcacgggcgacggccacctgatcatggaacgggtggcggttacggagagttccgatctcggcacggaggcggacccggttctcctggaggtcttcaacaacctcttcatgtccatcgccgaacagatgggcgcgcgcctggagtccaccgcccagtcggtgaacatcaaggagcgcctggacttctcctgcgcgctcttcgacccggacggcagcctggtcgccaacgccccgcacatcccggtccacctgggctcgatgggcaccagcgtcaaggaggtcatccgacggcgcggcgacggcatgcgtcccggggacacctacgcggtcaacgacccgtaccacggcggcacccacctgcccgacgtcaccgtcatcactccggtgttcgacacggagggcgagcgggtgctcttctacgtcgcttcgcgcggccaccacgcggagatcggcggcatcgcgcccggctccatgcccgcgaacagccgcaccctcgaggaggagggcatcctcttcgacgactggctgctcgccgaggacggccgcttccgcgaggcggagaccctcagcctgctcaccgaagcgcgctacccgtcccgtaatccgaacaccaacctcgccgacctgcgcgcccagatcgccgccaaccagaagggcgtcggcgaagtcgcccgcatgatcgagaacttcggcctcgacgtcgtccaggcgtatatgaagcacgtccaggacaacgccgaagacagcgtacgacgggtcatcgacacccttgaagacggtgagttcgcctacgagaccgactccggcgcggtgatccgggtgcgggtcctggtggaccgcgagaaacgctccgcgaccgtcgacttcaccgggacgtcgccgcagctccccaccaacttcaacgctcccttctcggtcgtcaacgccgcggtcctgtacgtcttccgcacgctggtcgccgacgacatcccgctcaacgacggctgtctgcgccccctcgacatcgtcgtaccgcccggctcgatgctcgcccccgagccgccggccgcggtcgtcgcgggcaacgtcgagacctcccaggcgatcaccggggccctgtacgcggctctcggcgtgcaggccgagggctccggcacgatgaacaacgtcaccttcggcaacgagaagtaccagtactacgagaccgtggcctccggctccggcgcgggcgacggcttcccgggcgcatccgtcgtgcagacccacatgaccaactcgcggctcaccgaccccgaggtcctggagtggcgcctgcccgtcgaactcgacgagttcgcggtgcggcacggaagcggcggcgcggggcgctggcgtggcggagacggcgccgtacgccgcatccggttccgtgagcccatgaccgtctccacgctctcccagcaccgcagggtcccgccctacggcatggcgggcggcgagccgggagcgctcggcgccaaccgtgtggagcgggccgacggcacggtcaccgaacttggcggaagtgatacggccgatgtcggccccggcgacgtactggtcgtcgaaacccccggcggcgggggctacggcccaccgccgcgcgacaacgatcaagcaggagaagagaccgatgatcttcgggcgcactgagcgcggcaagcccccggtcgagcccgtcacgctcaagatccttgtggccggcggcttcggcgtgggcaagacgacccttgtcggcgcggtcagcgagatcaggccactgcgcaccgaggaggtcctcaccgaggccggccgcccggtcgacgacatcagcggcgtggagggcaagcacaccaccaccgtcgccatggacttcggccgcatcacgctccgcgaggacctggtgctgtacctcttcgggacgccgggacaggaccgcttctggttcctgtgggacgaactcgccaccggtgccctgggtgcagtcgtcctcgccgacacccgccggctggaggactgcttcgccgccgtcgactacttcgaacgccgctccatccccttcgtgatgggcgtcaactgctttgaagaggccgcccgttacccggtggaggacgtccgccgggccctcgacctcgacgacgacgtgcccgtcgtgctgtgcgacgcccgggaccgcgagtcggtcaaggaggtcctgatcgacgtcgtccggcacgcgatggcccacgcggccgagcgccgcgagaccgtgagcggctgacgcgcgcatacggcccgtacccccgccgaccggggtacgggccgcagccgtgcacgcgcgcgtggctcacgaaggacgcacgcgcgtgtgcacgtccctttccgccggggccctgtcggcgggcccctctcagttcacgccgtcctcctcgtgccagccgaagctcttctccaccgccttgcgccagttgtggtactcgcggtcgcgctccgacgcctccatggagggcgtccactcgacgtccttctgccagtgcgacttcagctcgtcgaggtcgttccacacgccggtcgcgagcccggccgcgtaggcggcgcccaggcaggtggtctcggagaccctggggcggatgaccggcacgccgagcacatccgcctggtgctgcatcagcagattgttcttggtcatgccgccgtcgaccttcagggtggtgatccgcaccccggagtcctggtacatggcgtcgacgacctcacgcgtctgccagctcgtggcctccagtaccgcgcgcgccaggtgtgccttcgtgacgtaccgggtgaggccggtgacgacaccgcgtgcgtcggagcgccagtacggcgcgaacaggccggagaacgcgggcacgatgtacgccccgccgttgtcgtcgacgctcgccgcaagggtctcgatctcgtccgccgtacggatgatgccgagttggtcgcggaaccactgcaccagcgcgcccgtgatcgcgatcgacccttcgaggcagtagaccggcgcctcgccaccgatcttgtagcccatggtcgtcagcaggccgttcttcgacggcacgggccggttgccggtgttgagcagcaggaagctgcccgtgccgtaggtgttcttcgccgtacccacgtcgtagcaggcctgtccgaacacggccgcctgctggtcgccgagcgccgacgcgacgggcacgcccgaaagctggcccacggccgtcccgtacacctcggacgaggacctgatctcggggaggaccgcctcggggacgttcatcgcggacaggatggaacggtcccactggagcgtctccaggttcatcagcatcgtgcggcctgcgttggtcacatcggtgacgtgccggccgccgtccgtgccgcccgtgaggttccagatgagccaggagtcgatggtgccgaaggcgatctcgccgcgctcggcacgggccctgagcccaggcacgttgtcgagcagccaggccgccttgggcccggagaagtagctggccagcggcagcccggtctgctcgcggaaacggtcctgcccgtccgagccgcccaattcgtggcagagcgcggacgtacgcgtgtcctgccacacgatcgcgttgtgcacgggcttgccggtggcgcggtcccacaggaccgtcgtctcgcgctggttggtgatgccgagcgcgctgagctggtcggcgcgcagtccggccttggcgatcgcccccgcgaccaccgcctgcaccttggaccagatctcggtggcgtcgtgctccacccagccgggcttggggaagatctggcggtgttcacgctggtcgacggcgacgatcgcgccgccgtggtcgaagatgatgcagcggctcgaggtggtgccctggtcgatggcggcgacgtacttctgggcgttgtccggcatggctaccccttggtcgcttcagaaggctacgtggtagatgaggcctgcgagcgctcctccgatcagcgggccgacgaccgggatccaggcgtaaccccagtcggaggtgcccttgttcgggatcggcaggaaggtgtgcacgatacgggggccgaggtcacgcgccgggttgatggcgtaacccgtcggcccgccgagggagagaccgatgccgacgacgagcagcgagacgatcagcaccgtgataccggactcaccgagccccttggtgagtccgaaagcgaggatcggcaggacgagagcgatcgtcgcgatgatctccgtgatcaggttggcgaccggattccggatctccgggatggtggagaagatgccgagcgtaggcaccggctcgtccgccgtgccctccgtggtgccctccttgcgcacgttcgcctggaactgggcgaggtacacgaggtacgcgaggacggcacccagcacggcgccgacgagctggcccagcagatagatccagaccttgccccaggtgcccgtgtcgatggcgatcccgatggtcacggccgggttgaggtgcccaccggagagcggtgcggcggtgtacgcgcccgccagcactccgaaaccccagccgaacgcgatgacgacccagcccgaggcacgtgctttcgagtatctgagtgtgacggcggcgcagactcccgcgccgaagagaatgaggatcgcggtgccgatgatctcaccgacgaatatgtctccgttgctcatggcgactcctaggccctcgcccggggcgatccccggttgaccgtgcagggtgcgtttcccatggctacgtcagccgaaggcagggagtgtcccgcgccccgcccggcgtccgtgatgagcgtgccgtcgcagtggaatcgcccgtgggggatggcccttcgaacaggcgtgggcccgagcggcgcggtgcctggagacgcccgaatgcggcgatgccgaccgacaaccggaagtgttcaccggcacccagggagcgtcaaggtcgtggacagcaacggttgggcgccgcaaaagaggacacgctcggcggccccggtgaccgacggctgtgcccgtcgtccggccggcctcggtatgccgggttccggtcgtccgttcgggaccgccgggctccacggtcttcttgctaccccgcatgggccgcggccgcgcccgagccgcgacggatctcatggcccggcaggcccgcgcggccgagtacccaactggcgccgctgagcgccttcgccgcctgcttgaggggtgcgagacaggccgccgcctgccggtggtcggtcacactgcccggcgggcacaggacggtggccagggacagcgtgacggtgcgtccacccgccgaccagggagcgtcgagcaccgaagccgccaccggatcgagtgcgtccgcatcggccaggaccaggaagtcgtcgccgccgatgtgccccacccgcgtggctccggacgccgcgcgctgcaacgcccgccccacggcccggatcagctcgtcgcccgcggcgaacccggcaccgtcgttgacctgcttgaagcggtcgacgtccagccagctcagcgcgaacatccggccgtccgcgatccaccggtccacctctccggtgatcgcgtccgaaccgggcagccgcgtcagcggattgagccccgcggcctcttcgacccggctctcggccagcgcccgtacgagatccgcgagccgtacgacccccacgcaccggccgtgccggtcgacgaccgcgacgtcgtcggaggtgcggtccgggcccccgaccgccaccacgtcgagcacctcccacgccgtggcgtcgaccccgaccgttcgcggcggatcactgagcttcgccgccggccggtcggcatacagcgcatgtccgtagcgcccggacatcgacagcaggaagcgcgaccggtgcaccgaacggaccggcaccccgcccgcgtccaccagcagcaccccggacacgtcgggcgatccggtgagcagcgcccgcacctgtgccgccgaggccatggcgggcagcagggcggcaggccgtacgaactgccgtaccggcggtccggtgcgcggggccggcacggcggcgggggagagcgtcggaaggtatacatccgccacaggcagccgcgagggcggcgcgaacaactcgccctgcgccagctgggcccccgccgcgagggccgccgcgcactgcgactccgtctcgacgccctcgacggagagcagcgcgcccaactgctcgcacagtgtccgcatcgcccgcaccgcggccggccgcgtcagcagcgacacgtccagcttcagcagatccggcgccatgtccgtgagcagccgcagcggtacgtcgccgtcgccgatgccgtccgcgcagatccggaaaccctcgctcctgattgcggcgaccgcctccagcagcgcctggtgcgggacgtgtgtgtacggcgggcagatgtcgaccgtcacctcccagggcagtcgccccgcctcgcgcacggcgtcccgcagcgcggcgagaccgccgaggtcggccggcgttcccgcgaacacgttcacatgcagtggcagcagcgtctccttgagcgctgcggcacggatccccgacgcggccagcctgccgtcgagttccgggtcccggcgggcctgtgccagcacgtcgccggtctccgggcgagcgagtatctccagcgccgcgacccctccggtcgtcagattgaccaccggttggaaagcgaagcggagagtatccatccaggagggcacggcagcatgatggcgccgcccgcacccgctgaggcccagttcatgagctgttcacacagcattccagggtgatcacagagcgtgtcggcaccccgcgcgccggctcatctcactctcatctcaccctcatcggaccgcgatcaccgacgacccgtgcccgaacagcccctggttcgcggtgatccccacccgcgcccccgggacctgccgatcacccgcatcaccccgcagctgccatgtcagctcgcacacctgggcgatggcctgtgccggaaccgcctctccgaaggaggccaggccaccgctgacgttcacaggtatgcgcccgccgggcgccgtcgcgccctcccgcaggagcttggccgcctcgccctcgctgcacagccccaggtcctcgtaccactgcaactccagggcggtggacaggtcgtacacctcggccagggagaggtcctcaggcccgaccccggcctcctcgtacgcgacccgcgcgatcgacgtacggaacgtctcggccgggggctcgaccgccaccgccgagtccgtcgcgatgtccggcaggtcgagcacggtccggggatagcgcgggctcacggtggacaccgcccggatccgcaccgggtccggtgctccgcggcgccgcgcgaactccatgctggacagcacgagcgccgcgccgccgtccgaggtcgcgcagatgtcgagcagccgcagcggatcggcgaccaccgcggaggcggcgacctcctcggcggtgacgcgcttgcggtagcgggcgttcggattcaacgcccccgaggcggcgttcttcaccttgacctgcgcgaaatcctccacagtgtctccgtggacggccatcctccggcgcgcgtacagcccgaagtacgtcggattggtcgccccgaggacccggaaccgcagccagtccgggtcgtcgggccggtcgccgcccgccgggcggaagaaccccttgggcgccgagtcggcgcccaccacgagcaccacgtcggcgagccccgacaggatctgcgcccgcgccgcgctgacggcctgcgcgcccgatgcgcaagccgcgtacacgctcgtcacccgcgcgccctgccacccgagggccttcgcgaacgtcgccccggccacgtagcccgggtagccgccgcgcacggtgtccgcgccgacgatcgagccgacctcccgccagtccaccccggcatcggccaaggcggcgcgcgccgccgcgaccccgtactcgacgaagccgcgcccccacttgccccacgggtgcatccccgcgccgagcaccgccacatcgtccgtcatgccgtcacccccgtcggccgccagtgccaggtcgtccaggtcgtccccgcgtcctcgttcagcacgccggggacgacctccacctccatgcccaccgtcagatcggcgacggtgaccccgggaaccgactgtccgagcaccacgatccgctccgctgcgagctccacagcgatcaacgcgcgaggctcccacgagagttccggatccgtcacatacggtgacggcggtcggtaccggctgtccgtgtacgaccagacgcgcccacgcccggacagggcgacctcggccagttcgccgccggggcagcccggattgcggcagtgggcgtcctcgcgagggaagaagacggaagcgcacgccgagcagcgtgtgccgaggagccggaagtcgttcccgtccccggcgaaccatccggagaccacaggagtgcgggtacgcgacaaaactcctccacggcactcgacctgatccgacctgacctgacggaccgtcagaagtgtgccatgggcaacggaaaatgggcagtgcgtcgcgcagaacgggtcgacgccgccctgcgccggagtatcggtcgaggacgggcgggcccatgagggtggttccggccgcccctcgcccgatcaggcggggacggtatggggatcgctcgcttgatcggatacagtccgccgggtgtccgcatcccgtcaccccaccgccaactgcgtgccggactcccactgttcgagctgcggagcgccctacggagagggcgtctccggctggccccgcagctgccccgtgtgcggcacggtggcctaccgcaatccgctgcccgtcgcggtggccctgctgcccgtgtacgacgccagaggcaccgccctggtcgtcatcacccgaaccatccctcccgcgcgcggggccgtcgcgctgcccggagggttcatcgaccatcgggaggactggcggcacgccgtcgtccgtgaactcaaggaggagacgggcatcgacgccgcgagccgcgatgtacggctcgccgacgccatgagctcgcccgacggccatctgctgctgttcggactcctcccggagcgcccggccgccgaccttccgccgtcgacgggcacggacgagaccgagggctggcagctgctgcgccggccggccgagctcgccttccccctgcacaccctggcggtacggggatggttcgagggccggtacgtctgacggccgaccgcacggcaggcgggcgtcggcacgtgggcatcacgcctggggcagtcctcgcacacgcaccggatacgagggctcgcccgggccctcgtcgccgtcccgctcgacgaccacccgctgcccccgcaggcgtgtcacatactgctcgatctccggctcgtcccagccgtcccccgagtccggcacgacgagtccgcccccggtgcgcccgcgcgccggcctccacacctccaactccagacggccaccgtcgccccgcaccggcaggacggcacccgcgcgcgcgagcaccggaatccgcgacaggggggcgccgatcagcacctggcccggtccgtcgtacgccttctcggtgaccgtgtcgtaccagcgcccgcgcggcagctgcaccgcacgccggtccgcccccgggtccaggaccggtgccaccaggaggctgtcaccgagcaggaaggcgtcctcgcagtcgcgcagcgcccggtcctcgggcgcgccccaccacacgggccgcacatagggcgctcccgtacggcgcgccagatgcgccagcgtcatgaagtacggcagcagccgccgccgttcgacgagcgccacgcgcgcgtgctcgaggacgtcctcgccgaactcccagagctccctgcgccccgcccgcaggcccgcacgggtacggaacaggggaaggtacgaaccgagctggaaccaccgcagatacagctccggcgacggactcccgtcgaaaccgcccacatccggtccggagtagggcaccccgcacagacccaggcctatcaccagcgacagggacgcgcgcagaccgggccagccggtggtcacgtcgccggaccacgcccctccgtagcgctgcattccgctccagccggagcgcgagaagatgaagggcctctcctggggggacagttcccgcagcccctcgtacccggcgcgggccatgcccagggcgtacacgttgtgggcctcccggtggtcgccgccgcggccctccaaaaggtgccgggccgaccgggggagggtgttctccccgaaggccgtgaacgacaccggctcgttcaggtcgtgccagaagcccgcgaagccctgagccagccgctcctcgtagaggccgccccaccacttgcgcacgcgcgcgtgcgtgaagtccggatagaccgactcgccgggccacacgactccctccacgacccgcccggcggcgtcccgtacgaaggcgtcctgcgcactcccggcgtcgtacacggcgttacccggctcggccctgaccgccgggtcgacgaccgacaccagacgtatcccgtcgcggcgcagctcctctgcgagcaccggcagcttcgggaagcggtcccggtccaccgtgaacacctggtgcgcgtcgtagtgatcgttgtccagatggaccgcgtcgagcggaagcccgcgctcctgataacccgagacgaccccccgcacctcctgctcgctgccggatccccggcgcgcgtgatggtgtcccagcgcccacgccggcggcagcgcgggcgccccggtcagcgacgcccaggtgtgcagcacgcgcgcgggggtgcccatcatcacccagcagcgcagcggaccaccgtccatccgcagctcgctcgtccccgcccggtcgtgccccgagcccgccccctcctcgccttcgcgcagcgtcaccgtgccgtcccacgaggtgtcgtggaacacgagatgcgtggccgcgtcggcgaccaccagctgcaccggcatcgtgaggtacagcgggtcgtcgcccggtccgacagcgtgaccgggatccgtgttccacagccggtaggtcccgccgcgcagccgcggcccggcggcgcggccgcccagaccgaagaaccgcgcgtcagccgcgacttccgaccgctgcatccagtgggcggcgccaccgtcggccggctcccaccagcggggcggcagatcccggcgcagcgtcactccgccgggcgtacgcacctcgaccgcgccgtgccgcgacaccatgaccgtgccgcgctcggccacgacctgccagccaccgtccttgtcgggctccagaacggcccgggggtcgggttcgggacagcggcccgcgagggcgtacgacggctccggcccggccccgtcccagccccagaacacggcgccgttcacggcgaccgtgatgcgcagctcggaccgcgcgaaccggatgacgccaccgcccgggccgggcaccacgccctgcaccgggccgggcacccgggcgcgctcggcaccgcgcctcggcagcccggaggcgtcggcacgcctcctgcgccacgcggcccgtaccgtgcgcaacccgcccgccgcaccccccgagccgaccgctttcaccgaacgcaccaggtcacgaccgtccatgctgctcaccctgccattgacacccccgtacaggggtgtcgttcaactgtcgttcacccgtggcaggagcacatcttcatgtcgccgactatgtgtggcacaccctggtgcagaagtcgatcacatggcatcgtccgtgtcagccgcgtgccgcgcacaccccagcccgtgcgcgacctacgcacacgaagcgcacagtccgggagccgccccatgaccccagcgaacccctcgccgctctggcgacccgacgaggaacgcatcgcccaggcacagatcaccaggttccagtcctgggcggccgaacaccacggagcacccgccgacggcggctacgcggcattgcaccgctggtccgtcgacgagctggacaccttctggaaagccgtcaccgaatggttcgacgtacggttttccaccccctacgcgcgcgtgctcggcgaccgctccatgcccggtgccgcatggttccccggagcgaccctgaactacgccgaacacgccctgcgcgccgccgacacgcgcgcggacgaaccggctctcctgcacgtcgacgagacccacgagccccgcccggtcacctggtccgaactgcgccgccaggtcggctccctggccgccgaactgcgctccctcggcgtacgccccggagaccgcgtcagcggctatctccccaacattccgcaggccgtggtcgccctcctcgccacggccgcggtgggcggcgtctggacgtcctgcgcccccgacttcggcgcccgcagcgtcctcgaccgcttccagcaggtcgagccggtcgtgctgttcacggtcgacggctaccggtacggaggcaaggagcacgaccgccgtgaaacggtcgccgagctgcgccgcgaactgcccaccctgcgtgccgtcgtccatatccccgtgctcggcaccgaggcccccgagggcgccctggagtggtccgccctgacctcctccgacgtggcgcccgagttcgagcaggtcccgttcgaccaccccctgtgggtcctgtactcctccggcacgaccggcctgccaaaggccatcgtccagtcccagggcggcatcctcgtcgagcacctcaagcagctcggcctgcactgcgacctcggccccgaggaccggttcttctggtacacgtccacgggctggatgatgtggaacttcctcgtctccggcctcctcaccggcaccacgatcgtcctgtacgacggcagcccgggctttccggacaccgccgcccagtggcgcatcgccgaacgcaccggcgcgaccctctacggcacctccgccgcgtacgtcatggcctgccgcaaggcgggcgtgcacccctcgcgcgacttcgacctcgcgcgcgtgcggtgcgtggcgacaaccggctcgccgctgccgccggacggcttcagctggctgcacgacgaggtccgcgccgacctctggatcgcctcggtcagcgggggcaccgacgtgtgctcctgcttcgcgggagccgttcccaccctgccggtgtacatcggcgaactccaggccccgggcctcggcaccgacctccagtcctgggacccgagcggcaagcccctggtcgacgaggtcggcgagctggtggtcaccaatccgatgccctccatgccgatccgcttctggaacgacccggacggcagccgctaccacggcagttacttcgacacgtatccgggagtgtggcgccacggcgactggatcaccgtcacctcccgcggctccgtggtcatccacggccgctccgactccacgctcaaccgccagggcgtccgcatgggctcggccgacatctacgaagcggtcgaacgccttccggagatcaaggaatccctcgtcatcggcgtcgaacagcccgacggcggctactggatgcctctcttcgtccacctcgccccgggagccaccctcgacgacgccctcctgggccgcatcaagcagaccatccgcgaacagctttcgccccggcacgtccccgacgagatcatcgaggtcccggccatcccgcacacgctcaccggcaaacgcatcgaggtcccggtcaaacgcctgctccagggcaccccgctggagaaggcggtcaatccgggctccatcgacaacctcgacctgctgggcttctacgaggacctggcccgcaagcgcgcctgatcaacctccgtaggtggcctcggactcacccagcacgaccgcgaagtccgaggccagccgcgccgcgtcgacaggttcgagctcggcgaccgagatccgcacaccgggcccggcgacgagccggaaccgggcccccgccgcgacccaccacccgtacgaccgcagcccgttcaccacggccgactcgtcccgcacgggcacccacacgttcatcccactcgtcgcgtgaccctcgagtccgtgcttttcgagctcttggaggagagcaccgcgccgcagcgcgtacgtctcccgcgcccgtgtcaccaacgcgcgcgtgccgtcgtccgtcagcagcccgtacacggtctcctgaaggagatggctgacccaccccgacgtgagcagcagccgtccgtcgtgccgtgccagcgtggtcggatcacaggccgcggcagcccagcgcaggtccgtcccgaggaacttgctcaccgtccgcacatgcacccagcgggtcagtccgcccgcggtcagcgtgtgtaggggcgcatccgcgacggcggacgcatggtcgttctccacgaccaacacctcgggctcctcccggagcacctcgaccagcgcgtcccggcgctccgtggagaagcgcccgccgtacgggttctgtgcccgcggactgcacacgaccgcccgtacgccggcccgcaacgcaccccgcagggcgtccggacgtaccccttcgtcgtccacggccaccgaaaccgtacgcaaccccagcgccgtgaccaggtcgagcagatggtggtagccgggatcctccatcgcgacggcgtcacccggccgcagctccaccgagagcagccgcccgatcagatccagcgccccgtgtgcgaaggtcacgtactccgtgggcacgccgtcgggccgcaaccagtcgcgcaccgcgtcctcgagccgcgccagccggggcgtcgaccgatgggaccgcgcaccgggggacaggtgcgagggcggcaccagacgggggagcagtgcgggatccgggtgaccgcccgccaggtcgcgcagcccgtccggaactctgggcggccgtcgtgaggccactgccggggccgccgcgaccacggttccgccacgcccgcgcgtgacgacgatgccgcgccgccgcagctccttgtaggccgtcgccacggtccccgggctcaccccgagctcatcggcgagccgacgcaccggaggcagcgccgcccccgggcccaacgcgccttcactcacgcctcgttcgacggacgaggcaatccccttggccgtcgtaccactgatcccatattgtgttgccacgtaaccaagtatgtatcaatacataactggaaacaagggggagcagtgaatccgaagcgccgcgcagccgcctggtcgacccgtattccaggaggtcgcgacgggcgcagaatgctctggatcgccctcgtcgaccggatcggcagcggcctgtgggcatccgtctccgtcctgtacttcacctacgtcaccggcctctccgctgcccaggtcggcaccctggccgccgtctccggagccatcggcatcgccggcgcccccctcggcggccgcatcgccgaccgcctgcccctcacccgcgtcctgatcgccctgcaactcctgcgcgccctggcctccttcgccctcctcaccaccggcaactacgccctgctgctggccttctctgccgtcggcagcctcggcgaccgggccgcgaacgtgctgaccaagctctacgcgacgcgggtctccggccccgaccgggtccgctaccaggccgtcaaccggaccgtcgccaacgccggctgggccgtcggcggactcgccgccgccgcggccctcggcctcggcacctccaccgcctaccaggcgctgctggccggcgacgccctctccttcctcggcgccgcgctcctcaccgtccgctgcggcgaaccaccctcgccgacccgcaccgtggtcacatcgaaggacccgctccccacgacgaagccggcgaaaccctggcgcgaccgcacctacctcgcatacgtcgccaccgagaccgccctctgcctccacgacgcggtgttcaaagtcggcctgcccctgtggatcgtccacggaagcaacgcaccccacggcctcgcgccgctgctcctggtcctcaacaacgtgctcgtggtggccctccaggtacccctggcccgattcggcgccaccacgaccgcggcacgcgccctgttgctgcccctcgctgccttcttcgcgctgggcggcgtggccatggccctttcgtccgccggcggcacccctatcgcgaccggttgcctcaccgccgcagccgtctccttcacgatggccgagatgctctacgccaccgtctcctgggaactctccgtcgcactggcaccggccaccgcgcagggcgcctacctcggcgtccacggcctcgcccagtccgtccagcgcagcgtcgggccactcgccgtcacagcggccatcgcgaccggaccggccggctggaccgtcttcggcgccaccatcgccgtgacctgcctgatccagcaccggctggtgcgcgaccgcctggccggaccgtcgttgtcagtgccgccagttactgtgagtgagcattgatcgactgcgcacagggggaaacatggcgcacaccgagcaccagaccatgcgacgcgtactgcgccgcgaaatcgccggcaccatcggcttgttgaccgacgaacacgacttcactgcgatgctgcgctaccgcaccttcgccttcgacgaccacgcgacctacctccagcaggtggaagccctgctgaggaccctcgccgcccagggcggccacaccacggtggccctcttcgaccccgaggagtacgcggagttctgcgccgagacaggcctggaaccggacgcgccgtccagccgcacccgcttcaccgcggaactcgccgcgaccggcccgaccgtcccgtacgagggccaaccgctggccgacctggtcccgaacctcatcgacgaagcggtccgacgagccacctggcagtacgcgacgaccgtcctcacccgcatcggctcctgcgcctcctgcggcgaggacatcggccgggccgccttcgcccgcgcgtcccacctcctcgcccgcgtcctcgacaccgcggacccgggccaccgccacctcgtgtgcagtgtctccaccacccctgaaggagtcatcgcggtgctccacgccgatgacgacgcggacggcacagcccgcctcgacgagaccgaggccctcgagttcacgacggtcctcgccctcggcatcgcgacccggagcgcgggcggcctcgtcatgcgcaccagcgcccccggcaggaccgaccgtgtctacggctggcgcctgcgcggcgaaggcctgcaccccctcaccgcgggggaggtcttcgacgcctactgcaccgacatcgcatccggagagatcgtctcgccggaatccggcgtcgactacagcgaaccgcccgacctcggcgacgcggaacaccccacaggccacacccactgaccgagcgaagggcgcctgaacgaacgaggggcgccccaccgacaggtgaagcgcccctcgacaaaccgctacgacgtccggtgccgtctattcgccggacagcaccgcctgagccgcgttgcgcgcctcttcggccgtgtccgcggcacgtgcggcggccgcggcccgctcgcactgggccagcgtgtacttcgccagcgtcgcccgtacataaggaatcgacgccgcacccatcgacagggaggtgacacccagaccggtcagcacacacgcgagcagcgggtccgacgcggcctcgccacagacgccacagctcttgccctcggccttcgccgcctcggcggacagcgcgaccaggtcgagcagagcgggctgccacgggtcctgcagccgcgacacggcacccacctgccggtcggcggcgaaggtgtactgggcgaggtcgttggtccccagcgaaaggaactcgacctcctggaggatcgagcgcgcccgcagcgcggccgacggaatctccaccatcgcgccgaacttcgcctgcagcccggcctcccggcacgcgtccgcgaacgccttggcgtcggtacggtccgccaccatcggagccatgacctcgaggtagacgggcagtccctccgccgccttggccagtgcggtcagctgcgtgcgcagcacgtcggggtgttcgagcagaatccgcagaccgcgcacgcccagcgccgggttcggctcgtccgccggagtcaggaactccagcggcttgtccgcgcccgcgtcgagcactcgcacgacgacacggccctcggggaacgcctcgagaacctggcggtacgcctcgacctgcttctcctcgctcggcgcgttcttgctgtcatcgaggaagaggaactcggtacggaacagaccgacaccctcggcccccgcctcgacggcggcaggcacgtcagcgggaccgccgacattggccagcagcggcaccttgtgcccgtcggaggtggcgcccggcccggtggacgcggacagcgcggccttgcgctcggcggccgcggcctccagctgttccttcttctccggactcggattcacgaagatctcaccggtgctgccgtccacggcgatcactatgccttcgccgatctcacccgcacccggcagcgcaaccacggcgggcacacccaacgcccgcgccagaatcgcgctgtggctggtcggcccgccctcctcggtcacgaaaccgagaaccagggtcgggtccagcagagcggtgtcggcgggcgcgaggtcacgcgcgatgaggacgtagggctcgtcgctgtccgggacacccggcatgggcacccccaacagccgggcgacgatacggttccgcacgtcgtcgaggtcggccacacgcccggccaggtactcacccgcgccggccagcagggcacggtacgaggcgaaggcgtcgtacaccgcgcgctccgcggtgctgccgacggcgatgcgacgctccacgtccgccatcaactcggggtcctgggccatcagtgcctgagcctcgagcaccgcctgtgcttcgccccccgccaggttgccgcgcgcaatcaggtcggccgccacagcgtccacggccttgtgggcgcgcccctgttcgcgctccgcgtcctccgccggaatctgcttggcaggcggttccagcaccgccgtccccatgtgccgaacctcgccgatcgccacaccgtggctcacgccgacgcctcgcagcgttgtctccatctcacccgtctccgatagtgcggcgactcccgccgccgtgatgattgtctgcctgccgtctaatacggcgttgatgtcactgccaggagaagagcgggtcgccggccttcacgtcgccctcgtcacggacatcgcccagcgaatcgaccgtggcctcgagtgccacgaccgggcacaccggggacttgccggcttcctcgacggcggccgggttccaacggaccacggcctgcccgcgcgtcacggtgtcacccttgttgacgagcagctcgaagccctcgccgttgagctggacggtgtcgatgccgaggtgcgtcagcaccccgtgtccctcaccgtcgacgaccacgaaggcgtgcggatgaagcgagacgatgactccgtccacaggggcgacagcctccgagggctcgcgcacggggtcgatcgccgtgccggggccgaccatcgccccggagaagacggggtccggcactgcggcgagtccgatggcgcgtcctgcaagaggggacgtcacggtggtcatgggaagcctcccaggggtggagattcaaatgggccgtcactgcctgtcccggacggcgcactgttgagcagcgtatgtcatatgaagtgccggttccccgcgagacggaccggttgacagccctaggagcagagcgcaaacgatttgcgcccactcgacgccccaggtacagtcgtactcctgcttgaggctgagcgacgcgaccaagtgtccccgccgggcagcatccaacttgtcagatcctatctcggggtctcgttctgcatgtccgcaggacggtggtcagagagacggaaaaacgctgatagagtcggaaccgccggaaagggaaacgcgaaagcggaaacctggaaagcgccgaggaaatcggatcggaaaacgatctgatagagtcggaaacgcaagaccgaagggaagcgcccggaggaaagcctgagagagtctctcgggtgagtacaaaggaagcgtccgttccttgagaactcaacagcgtgccaaaaatcaacgccagatatgttgataccccgtctccggccgatcggctgggacgaggttcctttgaaaaagtcctgccgacgttgttcggtaggcgcacagcgaggacgctgtgaacggctgggcttattccgcccggctgttccgctctcgtggtgtcgtcccgattacgggaaaacattcacggagagtttgatcctggctcaggacgaacgctggcggcgtgcttaacacatgcaagtcgaacgatgaagcccttcggggtggattagtggcgaacgggtgagtaacacgtgggcaatctgccctgcactctgggacaagccctggaaacggggtctaataccggataatactctcgcaggcatctgtgagggttaaaagctccggcggtgcaggatgagcccgcggcctatcagcttgttggtgaggtagtggctcaccaaggcgacgacgggtagccggcctgagagggcgaccggccacactgggactgagacacggcccagactcctacgggaggcagcagtggggaatattgcacaatgggcgaaagcctgatgcagcgacgccgcgtgagggatgacggccttcgggttgtaaacctctttcagcagggaagaagcgaaagtgacggtacctgcagaagaagcgccggctaactacgtgccagcagccgcggtaatacgtagggcgcaagcgttgtccggaattattgggcgtaaagagctcgtaggcggcttgtcacgtcgggtgtgaaagcccggggcttaaccccgggtctgcattcgatacgggctagctagagtgtggtaggggagatcggaattcctggtgtagcggtgaaatgcgcagatatcaggaggaacaccggtggcgaaggcggatctctgggccattactgacgctgaggagcgaaagcgtggggagcgaacaggattagataccctggtagtccacgccgtaaacggtgggaactaggtgttggcgacattccacgtcgtcggtgccgcagctaacgcattaagttccccgcctggggagtacggccgcaaggctaaaactcaaaggaattgacgggggcccgcacaagcagcggagcatgtggcttaattcgacgcaacgcgaagaaccttaccaaggcttgacatacaccggaaagcattagagatagtgccccccttgtggtcggtgtacaggtggtgcatggctgtcgtcagctcgtgtcgtgagatgttgggttaagtcccgcaacgagcgcaacccttgttctgtgttgccagcatgcccttcggggtgatggggactcacaggagaccgccggggtcaactcggaggaaggtggggacgacgtcaagtcatcatgccccttatgtcttgggctgcacacgtgctacaatggccgatacaatgagctgcgataccgcaaggtggagcgaatctcaaaaagtcggtctcagttcggattggggtctgcaactcgaccccatgaagttggagttgctagtaatcgcagatcagcattgctgcggtgaatacgttcccgggccttgtacacaccgcccgtcacgtcacgaaagtcggtaacacccgaagccggtggcccaaccccttgtgggagggagctgtcgaaggtgggactggcgattgggacgaagtcgtaacaaggtagccgtaccggaaggtgcggctggatcacctcctttctaaggagcacttcttaccgatcccttcggggtgaggtcagaggccagtacatcagcgactgtctgatgctggttgctcaagggtggaacgttgattattcggcacactcgacctgctcaggttggcaagtactgcttcggcgtggaaagcgaacatgggagggcgagggtgtcgggcacgctgttgggtgtctgagggtacggccgattgtggctgccttcagtgccggccccggtaaagatctgcttcggcgggttgtgacgggtggttggtcgttgtttgagaactgcacagtggacgcgagcatctgtggccaagtttttaagggcgcacggtggatgccttggcaccaggaaccgatgaaggacgtgggaggccacgatagtccccggggagccgtcaaccaggctttgatccgggggtttccgaatggggaaacccggcagtcgtcatgggctgtcacccatacctgaacacatagggtatgtggagggaacgcggggaagtgaaacatctcagtacccgcaggaagagaaaacaaccgtgattccgggagtagtggcgagcgaaactggatgaggccaaaccgtatgcgtgtgagacccggcaggggttgcgtatacggggttgtgggatctctcttttacggtctgccggccgtgagacgagtcagaaaccgttgatgtaggcgaaggacatgcgaaaggtccggcgtagagggtaagacccccgtagtcgaaacatcagcggctcgtttgagagacacccaagtagcacggggcccgagaaatcccgtgtgaatctggcgggaccacccgctaagcctaaatattccctggtgaccgatagcggatagtaccgtgagggaatggtgaaaagtaccgcgggagcggagtgaaatagtacctgaaaccgtgtgcctacaagccgtgggagcgtcgcgcatcgagtttactcggtgcgtcgtgactgcgtgccttttgaagaatgagcctgcgagtttgcggtgtgttgcgaggttaacccgtgtggggaagccgtagcgaaagcgagtccgaatagggcgatttagtagcgcgctcaagacccgaagcggagtgatctagccatgggcaggttgaagcggaggtaagacttcgtggaggaccgaacccaccagggttgaaaacctgggggatgacctgtggttaggggtgaaaggccaatcaaactccgtgatagctggttctccccgaaatgcatttaggtgcagcgtcgtgtgtttcttgccggaggtagagcactggataggcgatgggccctaccgggttactgaccttagccaaactccgaatgccggtaagtgagagcgcggcagtgagactgtgggggataagctccatggtcgagagggaaacagcccagagcatcgactaaggcccctaagcgtacgctaagtgggaaaggatgtggagtcgcacagacaaccaggaggttggcttagaagcagccacccttgaaagagtgcgtaatagctcactggtctagtgattccgcgccgacaatgtagcggggctcaagcgtaccgccgaagtcgtgtcattcatacaatagggccaacgcctgtatggatgggtaggggagcgtcgtgtgccgggtgaagccgcgccggaaggcagtggtggacggttcacgagtgagaatgcaggcatgagtagcgatacacacgtgagaaacgtgtgcgccgattgactaagggttcctgggtcaagctgatctgcccagggtaagtcgggacctaaggcgaggccgacaggcgtagtcgatggataaccggttgatattccggtacccgctgtgaagcgtcaaacatcgagcccattaatgctaaggccgtgaagccgccctggagccttcgggcaaaggggagtggtggagccgctgacccaaggtggtagtaggtgagtgatggggtgacgcaggaaggtagtccatcccgggcggtggttgtcccggggtaagggtgtaggccgtgcgataggtaaatccgtcgcgcattaaggctgagacctgatgccgagccgattgtggtgaagtggatgatcctatgctgtcgagaaaagcctctagcgagtttcatggcggcccgtaccctaaaccgactcaggtggtcaggtagagaataccgaggcgttcgggtgaactatggttaaggaactcggcaaaatgcccccgtaacttcgggagaaggggggccatcactggtgatccaatttacttggtgagctgggggtggccgcagagaccagcgagaagcgactgtttactaaaaacacaggtccgtgcgaagccgtaaggcgatgtatacggactgacgcctgcccggtgctggaacgttaaggggaccggttagtcaaacttcggtttggcgaagctgagaacttaagcgccagtaaacggcggtggtaactataaccatcctaaggtagcgaaattccttgtcgggtaagttccgacctgcacgaatggcgtaacgacttctcgactgtctcaaccataggcccggtgaaattgcactacgagtaaagatgctcgtttcgcgcagcaggacggaaagaccccgggacctttactacagtttgatattggtgttcggttcggcttgtgtaggatagctgggagactttgaagcccgcacgccagtgtgggtggagtcgtcgttgaaataccagtctggtcgtgctggatgtctaacctgggtccgtgatccggatcagggacagtgtctgatgggtagtttaactggggcggttgcctcctaaagagtaacggaggcgcccaaaggttccctcagcctggttggcaatcaggtgttgagtgtaagtgcacaagggagcttgactgtgagaccgacgggtcgagcagggacgaaagtcgggactagtgatccgacggtggcttgtggaagcgccgtcgctcaacggataaaaggtaccccggggataacaggctgatcttccccaagagtccatatcgacgggatggtttggcacctcgatgtcggctcgtcgcatcctggggctggagtcggtcccaagggttgggctgttcgcccattaaagcggtacgcgagctgggtttagaacgtcgtgagacagttcggtccctatccgctgcgcgcgcaggaatattgagaagggctgtccctagtacgagaggaccgggacggacgaacctctggtgtgccagttgtcctgccaagggcatggctggttggctacgttcgggagggataaccgctgaaagcatctaagcgggaagcctgcttcgagatgagtattcccacctccttgagagggtaaggctcccagtagacgactgggttgataggccagatctggaaggcgggtaaccgctggaggtgactggtactaataggccgagggcttgtcctcagttgctcgcgtccactgtgttggttctgaaaccacgaacaaccccattccatggtcacgggatggtgcggttgacagtttcatagtgtttcggtggtcatagcgtgagggaaacgcccggttacattccgaacccggaagctaagccttacagcgccgatggtactgcaggggggaccctgtgggagagtaggacgccgccgaacttcttttagagctccggctcttgggcaatatgcccaagagccggagcttttttgttttccggggcgtcgccacccctctgcacccgggtctgacggctgcgggtagggtcagggggcatcgttggctcgtttcccacaggaggcccccgggtggaggtccaggagacccgcgtccagacagaccgggtcctcaccatcccgaacatcctcagcatggcgcggctcgtcggcgtacccgtcttcctgtggctgatcctccggcccgagttcggcggcccgaagagcgatggctgggcgcttctggtcctggcgctgagcggcatcagtgactacctggacggcaagctcgcccggcgctggaaccagatcagcagcctcggccggctcctcgaccccgcggctgaccggctctacattctctcgactttggtgggtctcacctggcgcgagattctgccaatctggttgaccgccgcactgctggcgcgagagctggttctgctggtgatggtgggtatcctcaggcgccacggctatccgccaccccaggtgaacttcctcgggaaggccgccaccttcaacctgatgtacgccttccccttgctgcttctgagtgactcaagtggatggatcgggtcactcgctgctattttcggatgggcgttcgccggatggggtacaacgctgtattggtgggcaggagtcctctacatggttcaggtccgccgacttgtcagggcggacgccgtagccgattgatcccgcctgattgggcggccgtagtggcgcgatggcccgcgcgggaaaactgcgggacaatctagatgggtgaagtcggctagaccgtcgtctctcagaggaggacgcttccgacatgaaggccgtcgtgatggccggaggcgaaggcacacgccttcgcccgatgacctcgagtatgcccaagccgctcctgccggtggtaaaccggccgatcatggagcatgtcctgcggctactcaaaaggcatgggctcaacgagaccgtcgtaactgtgcagttcttggcgtctctcgtcaagaactacttcggtgacggcgaagagctcggcatggagctcacttatgccaatgaggagaagccactcggtaccgccgggagcgtcaagaacgccgaggaagcgctgaaggacgacactttcctcgtcatctccggtgatgccctgaccgacttcgatctcaccgagctgatcaatttccacaaggaaaagggtgcgctggtcaccgtctgtctgacgcgcgtgcccaatcctctggaattcggcatcaccatcgtcgacgaagaaggcaaggtcgagcgcttcctcgagaagcccacctggggacaggtcttctcggacaccgtgaacacgggcatctatgtcatggagcccgaagtcttcaactacgtcgaggccgacgtctccgtcgactggtccggcgatgtcttcccgcagctgatgaaggacggcaagccggtctacggctatgtcgccgagggctactgggaggacgtgggcacccacgagagctatgtgaaggcccaagccgacgtcctggagggcaaggtcgacgtcgagatcgacggcttcgagatctccccgggcgtatgggtcgcggagggtgccgaagtgcaccccgacgccgtgctgcgcgggccgctctacatcggtgactacgccaaggtcgaggctgacgtcgaaatccgcgagcacaccgtcgtcgggtcgaatgtcgtcgtgaagagcggggcctttctgcacagggccgtggtccacgacaacgtgtacatcgggcagcacagcaatctgcgtggttgcgtcatcggcaagaacaccgacatcatgcgggccgcccggatcgaggacggcgccgtcatcggcgacgagtgtctcgtcggtgaagaatcgatcatccaggggaatgtgcgggtctacccgttcaagaccatcgaggccggcgcgttcgtcaacacctcggtgatctgggagtcgcgggggcaggcgcatctgttcggcgcccgtggcgtgaccgggatcctgaacgtggagatcacgccggaactcgtcgtgcggctcgcgggagcgtatgcgaccacgctcaagaagggctcgaccgtcaccacggcccgtgaccactcccgaggcgcgcgtgcgctgaagcgggcggtcatctcggcgctgcagaccagcgccatcgacgtacgcgacctggagaacgtaccgctgcccgtcgcgcgacagcagaccgcgagaggcagcgccggcgggatcatgatccgtacgacgcccggggtgccggactccgtggacatcatgttcttcgacgggcagggtgccgacctctcgcagggcagtcagcggaagctggaccgagtgttcgcgcggcaggagtaccggcgagccttcccgggagagatcggggacctgcacttcccggcgagcgtcttcgactcgtacaccgggtcgctgctgcggaacgtcgacacgaccggtatctccgagtcggggctcaaggtcgtcgtggacgcgtcgaacggcagtgcggggcttgtgctgcccagtctgctcggcaagctgggtgtcgacgcgctcaccatcaaccccggcctcgacgagtcccggcccacggagacggccgatgcgcggcgctccgggctggtgcggctcggtgagatcgtcgcatccgcgagggccgcgttcggcgtgcgcttcgaccccgtcggtgagcgactgtcgctcgtcgacgagaaggggcggatcgtcgaggacgaccgggcactgctcgtcatgctcgacctggtggccgcggagcgacgcagcggccgcgtggcgctgccggtgacgacgaccaggatcgctgagcaggtggcggcttatcacgggacgcaggtcgagtggacgaccacgtcgcccgatgatctgacgcgggtgggaggcgacgaatcgaccatcttcggtggtgacgggcgcggcgggttcatcatccccgagttcagcagtgtcttcgacggtacggcggccttcgtgcggctgatcggtctggtggcgcggacacagctcacgctcagccagatcgatgcgcggatcccgcgggcccacgtgctgaagcgtgacctggcgactccttgggccgtcaaggggctggtgatgcggcgggtcgtcgaggcggccggcgatcgctttgtcgacacgacggacggcgtgcgggtcgtcgagtccgacgggcgttgggtgatggtgctgcccgatcccgccgaggcggtcacacatctgtgggccgaggggcccgacgacgcctccgcggaggccctgctcgacgaatgggcggcggtcgtggacagcgccggccgctgagcacacgcgcgtgccggacaagtgtccccaagggggcctgtccggcacgccggtggggccattcggaggtagtactcgcgacgtgcgacgatgtgcggcatgccgcagccgccccccgttcggagcacccctacgcgccccccgcgcccggacgcctccatgtcgctgctcaccaacgtcatggatcacagcctcgacgacggatatgccgaggccgccgcccggaagaaggccgagggcaccggcggcatgccgaagaccgtgcgggccaagctaggtctcgcggccggactggtcctggcggcgctggtggtgaccgtgggtgcggcgcaggcgcggatagcggccccgacgatcgccaaggagcgtcaggagctcgtcgaccgcatcgggcgtgagaccacggtcgcggacaagctcgagagcagcgtcgacactttgcgggacgacgtgagcgcgcggcagcgcgaggcactgaagaagtacggcggcggcgaccaggccgacgtagtgggcatcctgtcgggtgccgtcgcagtccacggccccggggtgaagctcgtcgtggacgacgccaaggaagccagcaccggcggcaacggtgatccgcgagagacctccgggttctccgacaccggacgcgtccgggaccgcgacatgcagcgtgtggtgaacggactgtgggagtccggcgccgaagccgttgcgatcaacgggcagcggttgacggccctgtcggccatccgggccgcgggtgacgcgatactggtcgacaacaagccgctcgtaccgccgtacacggtgctcgcggtgggggacggcaagcacctcagcaccgggttccagaacagccccgacgggctgtatctgcacgcgttgcaggagaactacggcatccggaccggcatctccgtccagggtgacgtccggctgcccgccgcaccgagtgtgatcgtacgtacagcacagccgagcacagagaagggcacatcgtgatcgccgtactgggcctcgtcgtgggagtcgtggctggattgttggtccggcccgaggttccggcggtcgtggagccttaccttcccattgccgtcgtggccgcactcgatgccgtgttcggcggtctgcgtgccatgctcgacggcatcttcgacgacaaggtcttcgtggtgtcgttcctgtcgaacgtcgtcgtcgccgcgctgatcgtcttcctgggcgacaagctgggtgtcggcgcccagctgtccaccggtgtcgtggtcgtcctcggcatccgcatcttctccaacgccgcggcgatccgtcggcacgtcttcagggcgtgagacagatgagccatgaggacgagacgcccaagggaccggacacgccggaggccgccgagcaccggctgcgcagagagctgccggaagaggtgcccgagacggccgcggagaccgcgaacgaggacgccaccaagggctccgggcctgggttgaccggccgtcagcgcctggtgcagggactgtggccgccgcgcgtcagccgtgcgcaactcattgtcgcgctgctgctgttcggcctcggcttcggtctggccgtgcaggtggcgtccaacagtgacagcggcaacgccttgcgcggggcgcgccaggaggatctcgtacgcatcctcgatgaactcgacaaccgcacacagcgtcttgcggacgagaagcaaggtctcgaggaccagcggtccgagctggagaacagctcgaaccaggccgaggaggcccgtaagcagacggtcgagaaggagaagcaactcggcattctggcgggcacggtcgcggcacagggacctggcatcacgatgaccatcgacgacccgaaggggacggtccgggcggacatgctgctcgacgcggtccaggagttgcgcgcggccggcgcggaggcgatccaggtgaacggtgtgagggtcgtcgccaacacctatctgacggactccggcaagagtgtgagtgtcgacgggaacaagatcagccagccgtatcgtttcaaggtcatcggcaagtcgcaggacctcgagccggcgctcaacatcccgggtggcgtggtgcagactcttgagaaggagcaggccaccgtcgcggtggagcgttcgacgaagatcattgtggacgccttgcgagcggcgaagcggcctgactacgctcggtcgtcctccgagtgaacgcgaggtgcatgggggtcgcccggcgagggcatgaggttgcggggggtcggcgcaccgaatgggtggtgcgtggtggaaactgtctggtggatacggacgttgtgaggatgtccgggtcgaccggtgtgttcaatcagggttcgtcctgccccacgggcgggtctgtttcggtcaaggggaatcgcccgtgaagttgtttgcgaagttgttcggcaagagctctcgagagggcagcgacaacgccactgcccgccatcgcgcgccgcgctccggggatgcggaggcacagggcggcgagcgcccgctgttccgcgatcaggtcggtggacccggtggcgacatttccggtggtcagggcgcgtcgtctgttgaccctgcccagtccggccgcataggtttcggggatccgtcaacctcaggtgcgggtggagggttcggctccgacccgtatgcgtccaatgccccggcggggcagccgcggcaggaggatccgtcgatgtcggccctggtgtgtacgaggtgcggtaaccgcaacgcggaaaacagccgtttctgctccaactgcggtgctccgctgcggggcggggcggctccggagcggccgtccgagacgacctccacgatctccatctcgggtctcgaggcctacgatgccgaggtcaccggccagacggcgatgcccacgctgtcccccgaggcgcaggcggccgtcgacgcgttgccgctcggctcggcgctcctggtggtgcgccgcggccccaactcgggcagccgcttcctgctggacggtgagctgaccacggcggggcgccacccgcagagcgacatcttcttggacgacgtgaccgtgtcacgccgccatgtcgagttccgtcgcggtgcggacggcacgttcacggtggccgacgtcggcagcctgaacggcacctatgtcaaccgggagcgcatcgaccaggtcgctctctccaacggtgacgaggtgcagatcggcaagtaccggctggtcttctacgcgagccagcggggcatctgacccgacagggaagggcccatgcttcacacaccgagcggcggtgccggcagtggcaccgccgccacggacggcgagctgatgagcatcggcacggtgctcaacgctctgcgtgacgagttccccgacatcacgatctccaagatcagatttctggagtcggagggcctcatcgagccgcagcggaccccctcggggtatcgcaagttcagcgccggcgacatcgagcgtctcggtcacgtgctccggatgcagcgggaccactatctgcccctgaaggtcatccgagagcatctggacgccctggagcgcggtgaggaagtgcggctgccctccatggggcgccaacgcgacccgggcgagggagaaagcctggtcgacctcttcggggagcccgaggcgcccacggcggcccgggtggggcgcgccgagctgctggccgccgccgagatcggggagcaggagctcgaggagtgggagtcgtacgggctcatcgcaccgctgccggacggggcgtacgacgcggagacggtcactgtcgccaccctcgtggtcgagctggggcgcttcgggatcgagccgaggcatctgcgtgtgatgaaggccgccgcggaccgtgaggcggggctggtggaccaggtggtggctccgctgaggcggcaccgcaatccgcagaccagggcccacgcggaggctcgtacgaaggaactggcggggctcgcggtgaagctgcacgccgcgctggtgcagaccgcgctgggcgtacgcctgccctgagtcggggcgtgttcgccggtggcggatcgtccacccgttctgtgctcgactacccaaacgtcccgggcacggcctagggttactgtgtgaacgagctcgatgtcgtaggtgtccgggtggaaatgccctccaaccaaccgatcgtgctcctgcgtgaagtgggaggcgaccgttacctccctatctggatcgggcccggggaggcgacggcgatcgccttcgcccagcagggcatggcccccgcacgaccgctgacccacgacctgttcaaggacgtgctggaggccgtcggccaggagctcacggaagtgcgcatcacggatctgcgtgaaggcgtcttctacgcggagctggtgttcgccagcggcgtcgaggtgagcgcgcggccgtccgacgccatagcgctggcactgcgtaccggaacgccgatctatggcagcgacggggtcctcgacgacgcaggtatcgcgatccccgacgagcaggaggacgaggtcgagaagttccgcgagttcctcgaccagatctcgcccgaggacttcggtacgaacagccagtgacgcccgcccgtgcggggctgatgaccgggagggcccgctgccgtggtgattgcggcggcggcgccccgcctcttcgcccacggtcggcggggcgcggcacatgccggtggccagggggcgtcacgcggctcgccccgaaagcattcggctagcctttccccgcgggagggcacgggaaaccactcctagggtgattatcactcggcgtgccgagtgtggcgatcgttgacgcacccctggtgactgcctaccgtcgaggaggcaggtcaaggacggaggtcggcgtgagaagcagcggcgacggtacggctgggggtgcccccggacgcagtctgggggagagcggcccgtacccgcttcacggcagcgcggccggccccgctcatcagcggccgacggcagtagcgggcgacgaagaggcggcttccgaggaagtcggctatcgcggtcccacggcatgcgctgccgcgggcatcacctaccggcagcttgactactgggccaggaccggcctcgtcgagccgagcgtgcggcccgcctacgggtcggggacgcagcgcctctacagcttccgggacgtggtcgtcctgaagatcgtcaagcggttcctcgacaccggagtgtcgctgcagaacatccgcaccaccgtccagcacctcagggagcgcggcttccgggacctggaacggatgacgttgatgagcgacggagcgacggtctacgagtgcacgtcccccgacgaggtccatgccctgctccagggcggccagggcatcttcggcatcgccgtgggcgtggtctggcgggacgtggagagcgcgctttcgcaactgcacggggagcgggtcgacacgggggagaccctggtaggccacaaccccaccgacgaactggcgcgacggcgcaaccgggcggtctgaagccaaccgggcggtctgaagcacggagcgaccgggcggtctgaggtacggggcgcacggcggtctgaggtacggggcgcacggcggtctgaggtacggggcgcacggcgcgacgcgctgggacggagcggcgggcaagacgccgcgaaagcgtcgcgatcgacaggtgatgccccggggagccggggcattgtcagtggcgtagggcagcatcggagatgtgagaaacgcgcccacgatcctgcatctcgacatggatgccttctacgcctcggcggagcaggcagccaagccgagcctgcgcgggaaggccgtcgtcgtgggtgggctcggaccacgcggggtggtggccacggcctcgtacgaggcacgggttttcggggtgcactcggcgatgcccatggcccaggcgcgacggctggcgccgaacgccgcgtatctcgtgccgcgcttcggtctgtaccgggaggtcagtgagcaggtgatggggctgctgcggggcctgtcgccgctggtggagccgctgagcctggacgaggcgttcgtggatctggaggccggaggagtggcctgggacgcggagtcggcgcggctggtcggggtgaagctgcgcgcggacatcaggaccgtcaccgggctgacggggtcggtggggctcgccgcctccaagatgctcgcgaagatcgcctccgaggaggcgaagcccgatgggctggtgctgatagagccgggcacggagcgggccatgctcgggccgatgtccgtgcggacgctgcccggcgtggggcccgccacgggggaccatctgcgccgggccgggatcaccacggtcgaggagctcgccgaggcgggcgaggacgagctcgtacggctgctgggcaaggctcacgggcatgcgctgtacgccatggcgctggcgcgcgacgagcggccggtggtggccgagcgggaggccaagtcggtgtcggtcgaggacacctacgacgtggacatccatgacaggacccgggtcgggatggaggtgcagcggctcgcggatcggtgtgtgcagcggctgcgcggtgcggggctgtccgggcggaccatcgtcctcaaagtgcggcggtacgacttctccacgctgacccgctccgagacgctcagggggcccacggacgaccccgcggtggtacgggaggcggcggcccggctgctggactccgtggacaccacgggcggcgtacggctgctcggggtgggtgtcagcgggctcgccgactacacacaggaggatctgttcgcgcaggcgcatgtgggggcggccgagtcggtggcgcaggagcagccggagacggtgggggccgtggtgtcggacgagccggcaggggaggaaccggctgtggccgagcggcactggcgtgccgggcacgacgtacggcatgccgagtacgggcacgggtgggtgcagggcagcggcctcggccgggtgacggtgcggttcgagacgcccgactcggagcctggacgggtacgcacgttccggaccgacgatccgaatctggaaccggtggatccgctgccgttggtggcgcgaagaccggaggccgccggggccggggcctccggggcggaggaaaccgggcccgaggtcggtgtggccggctcttcgggtggggcgggcgagtgttcggccgggagggaggggtctgagggtgggacggaggagtcttcggcggtgagggacggtgcttcgagtgggacgggcggccctgcggcccgggcggccggttccgtggcggtgccggcaggttctggggtaggcggggccggcgtggccgacggggtcgactccgagggcgcggggccggggggtcaggcttcgtccgttcccgccaggcggccgaagtcgtggtccggcagcggggggaggggggccacgtcgaggccgtagtggtggtagagctgcaattcctgttccggggaaaggtgtcgccccacgccgaagtcgggggcgtccttgatcagggcgcggtcgaaggggatccggagggtgccctcgaccagctcgctgggctccaagggcacgaaggcgtccctgctgaacaggcccgtgcgtatggccgcccactccgccactccggtcgcgtcgtcgaggtagatctcgtcgatcgtgccgatcttcgcgccatggcagtcgaacgccttgcggccgatcaggttgcgcggatcgatgtcggtctgcacgggccctcctcttggtcgcaactcatccgtaagcactacgaaagagcacattcagcaaggcggccactcgaaagctcgtgcaatgtcctcgctggtaggctggcaaatggctgctgaccccgtgcgggagagtcctccggaagtcgtcggaggcgccgaaggagcaaatcctccccggaatctctcaggcacacgtaccgcacggacgaggtcactctggaaagcagggcggatgtctatggcttccgctctcaccgacggtgaaagccggagcgccctcgggcggaccggcgaagctctcaggttgagatgacagagggggaggccgtcggggtacccgcgcaggggtgcccctcgaaggtcgcgtcagaccaggaggcctccgcaatgaccgcccatcgcattccgctctccgatctcgaacagggaatccccttcgagcagcgccacatcggccccgattccgaagcccgggccaagatgctcgcccaggtcggctacgggtcgctcgacgagctgaccgcgaccgccgtcccggacgtcatcaagaacgccgaggcgctggagctgccgggcgcgcgcaccgaggccgaggtgcttgccgaactgcgctccctcgccgaccgcaaccaggtcctcggttccatgatcggcctcggctactacggcaccttcacaccgccggtgatcctccggaacgtgatggagaacccggcctggtacaccgcgtacacgccgtaccagccggagatctcgcagggccggctggaggcgctgctgaacttccagaccgtcgtcgccgagctgaccgggctgccgacctccggcgcctcgctgctcgacgagggcaccgcggccgcggaggccatggcgctgtcccggcggatgggcaagaacaagaagggcctgttcctggtcgacgcggacgcgctgccgcagaccatcgccgtcatcgagacccgtgccgagccgaccggcgtcgaggtcgtcgtcgccgacctgagcgaaggcatccccgccgggatcgccgagcgcgagatcaacggcgtgctgatccagtacccgggcgcctccggtgccgtacgcgacatcaagccgctcgtcgagcaggcgcacgagctgggcgcggtcgtcaccgtcgccgccgatctgctcgcgctcacgctgctcacctcgccgggtgagctgggtgccgacatcgcggtcggtacgacgcagcggttcggtgtgccgatgggcttcggcgggccgcacgccggttacatggccgtgcgtgagaagttcgcgcgcagcctgcccggccggctcgtgggcgtgtccgtggacgccgacgggcacaaggcgtaccggctcgccctgcagacgcgggagcagcacatccgccgcgagaaggcgaccagcaacatctgtacggcccaggtgctgctcgccgtgatggccggcatgtacgccgtgtaccacgggcccgacggactgaggacgatcgcgcggcgtacgcaccggtacgccacgatcctcgccgaagggctgaaggccggcggcgtcgaggtcgtgcacggcgcgtacttcgacacgctgaccgcgcgggtgccgggccgggccgccgagatcgtcgccgccgcgcgtgagggcggggtcaacctgcacctcgtcgacgcggacctcgtgtcgatctcctgtgacgagaccaccacgcgggcccaactgggcgccgtctggaccgcgttcggcgtcgagggcgacatcgaggcgttggacgcggcggccgaggacacactgccggccgcgctcctgcgtaccgacgactacctgacccacccggtcttccaccagtaccgttccgagaccgcgatgctgcgctacctgcgcaggctctccgaccgcgactacgcgctcgaccgcggcatgatcccgctgggctcctgcaccatgaagctcaacgcgaccaccgagatggagccggtcacctggcccgagttcgggcagctgcaccccttcgcgcccgccgagcaggcgcagggctacctcacgctcatccgggaactggaggagcggctcgccgaggtcaccggctacgacaaggtgtcgctccagccgaacgccggctcccagggcgagctggccgggctgctcgccgtacgtgggtaccaccgcgccaatggcgacgagcagcgcacggtctgcctgatcccgtcctccgcgcacggcacgaacgcggcgagcgccgtgatggccggcatgaaggtcgtcgtggtgaagacggccgacgacggtgagatcgacgtcgaggacctgcgcgccaagatcgagcagtaccgcgacgagctgtcggtgctgatgatcacgtacccctcgacgcacggtgtgttcgaggagcacgtcgccgacatctgcgcccaggtgcacgaggcgggcggccaggtgtacgtcgacggagccaacctcaacgcgctggtcgggctcgccaagccgggccacttcggcggtgacgtctcgcacctcaacctgcacaagacgttctgcatcccgcacggcgggggcggtccgggcgtcgggccggtcggtgtgcgcgcccacctggcgccgtatctgccgaaccacccgctccagcccgaggccggccccgcgacgggcgtcggcccgatctcggccgcgccctggggctccgcgggcatcctgcccatctcctggtcgtacgtccggctgatgggcggcgagggcctcaagcgcgccacgcaggtggcggtgctgtccgccaactacatcgccaagcggctggagccgcactacccggtgctctacaccggtcctggcgggctcgtcgcgcacgagtgcatcatcgatctgcgtccgctgaccaaggcgaccggcgtgagtgtcgacgacatcgccaagcggctgatcgactacggcttccacgcgccgacgatgtcgttcccggtggcggggacgctgatgatcgagccgaccgagtccgaggacctgggcgagctcgaccggttctgcgaggccatgatcgccattcgtgcggaggtcgagaaggtcggctcgggcgagtggccggcggaggacaacccgctgcggaacgcgccgcacaccgcggccgcgctcggcggagagtgggagcacgcctacagccgtgaggaggccgtcttcccggcgggtgtctcggccgcggacaagtactggccgccggtgcgccgtatcgaccaggccttcggcgaccgcaacctggtctgctcctgcccgccgctggacgcttacgacgactgatgcgcgcgatcgcccggtgtccgcgtgctcgcggtgcaccgggcggccctggattctgaccgctctcgcagagagtggtgacggggagtagccgcccgtggatacgcgtcggggccggttcgggaggtgtctcccggccggcccctcttgtgtctgggcgggtgtgcggctcaggcggccgtcatcacctggtcggtgcccagtgggcggtgcggggcgatgatccggccgtccggcagcagctcaccggtgtcctcgaagagcagaacgccgttgcagagcaggctccatccctgctccgggtggtgcgccatgagacgggcggactcccggtcggcggatgcggctgtcggacagagtggctggtgctggcacatggtggaggggatctttcgctctgttgtgaggtctgagatggctgttgtgtctgtcttgcggctcgaagcgttgttcatggccgccccccgtttttgacaagtcggattttgacaagtcggtctgagacccagtgttgccctacgggcgtcaatccgcagggatttcgcagcaccgcttctcacaggttgatgacgcatcacccggccggacggttcatcccaactgcactgtcactttgggtggttcggagtgaccggatagggctagtccggacggggagtgggctttttccggctcttacgagcgtattgacgcccgtaagagcgacgtaccccgccaccgggaattcggcgacggggtacgcggagtcgtgcgggtgcgctcggtcaggcgggtgagccgagcaggggtgcgggagtcacccgggtggtcaggaccggaagcagttccgcgacccggtgcgggcggtgtgccgcgatgccgggcggcgccggagccagcgggacgagcaggtcggtggcggccgggtggcccgtcgcgccgtcggccgtggagtcgccgtgcagccagagggtgagcatgtatagctcgggcacggacagcagccgggcctggtagggctgtttcatggtctccgcctggcgcagggcgcgctccgtggcggtgatgtacgggccttcgaagaagtgggagaaagcccagccgtcgggggtcagcatcgtctcggcggcggccaccgcgcgatcgccgcagcggatgaggaagcgccatccggcgagccgggtggcagaggcgcccgcgggggtgatccggtccaggacgtgtacgggtagcgggagttcgggagtgacgggtccctgggcgttgcgcagggacggggtacgagcctcgcggaccgcggtgggggaaccgagtgccgtgagaacggtgcgcagggcgggcgcgggagccggggggacatgcagcggcatggtgggtcgcctctctcattcgacaggcacggtgaagcgaggggtggggcgggcggacggcgctgtcagctctcggggtcagaggggcgggggctccgtacccggacggatgacggcgctttgtcgacagggcccagaaccgcgagtgccaactctctgcctcgttcgcagagtttatacgacacgtgttcacgcggtgtttcggctagctgtttcgggcatcacgggcaagggggcattcggtcggtgataaggggggttcgtcccggtactacatgggtacccgaccggtgacctcgtaatacgtcgccgaagcggtcggccgattctcgtcggcgattatcacgagatcattgcgccgtgaaactgcgtgctgctccatgcccggcgaatgtgccgcatggcagttgcattcagcgtagcgggcgccgggtcgacgcggggcgttatggatcgcgttgcctgggcatcatcacccgtgacccggggacaccagcggccggatcgtcggcctgcccatccgaggagggacacgtcgatgggggagaaggtcgtggcggggtcgttcgacctgtccgatcgccagcgctaccgcggcaagctccggcagtgcctggcggggctggcgcgactgttggaggagaagcggttcgatcgccccaagaacctcatgggtctggagatcgagctgaatctcgcaggtgcggacggcctgccaaaaatgatgaatgagcaagtactcgaaaggattgcgagccgcgatttccaaacagaactcgccatgttcaatctggaagtcaacattgccccacatcgattgggcggccgggtattcgaccggctcgccgaggagctgcgcacctcactcgcctacgcgcaccgcaaggcgaacgaggtcgacgccggaatcgtgatgatcggcatcctgccgacgctcggccgcgacgacctgatctcctcgaatctctccggcggcgaccgctacaccctgctcaacgagcagatcgtggccgcgcgcggcgaggacttcgtgctggacatcgacggcatcgaccggctcgtgtgcacctcgaagtcgatcgtgcccgaagcggcctgtacgtccgtgcagttgcatctccaggtcacgccgggccgcttcgccgacgtgtggaacgcggcgcaggcggtggccgccgcgcaggtcgccatcggcgccaactcgccgttcctgttcggtcatgagctgtggcgtgagtcgcggcccccgctgttccagcagtccaccgacaccaggccgccggagctgcaggcccagggcgtgcggccgcgcacgtggttcggcgaacggtggatctcctccgcgtacgacctgttcgaggagaacctgcgctacttcccggcgctgctgccgatctgcgacgacgaggatccgctgcgggtcctcgacgacggaggcataccgaagctcgccgaactcgtcctgcacaacggcaccgtgtaccgctggaaccggcccgtctacggcatcgccgacggcgtcccgcatctgcgcgtcgagaaccgtgtgctgccggccgggcccaccgtcagtgacgtgatcgccaacgcggccttctactacggtgtcgtacgcgcgctcgccgaggaaccgcggcccgtgtggacgcggctgccgttcgagtcggcggccgccaacttcgacgccgcgtgccgggacggcatcgacgcccgcctggagtggccgcggcgcgggcggtacggcgggaccacgcaggtcgatgccgtgcacctcgtacgcgacgaactgctgccgctcgccgaggcgggcctcgacgcgtggggtgtcgaacccgcggaccgggacttctacctcggcatcatcgaggagcggtgcaggcgccgggtcaacggtgcgagctggcaggccgccaccttccaccgggcgctggaggcggggctggaccgggacgccgcgctggccgcgacgacgcggcggtacagcgagctgatgcacgtcggggagccggtgcacacctggccggtggggctgccggagccggtgccgctggggtgagaccgggcgcgtcgacaggccacagggtctgtccggcggatcgggccggaggaaagcggcggtacctgtcagcccccgcgtctacggcctgctccgccgggcaggacctagctctggttgccggcctccatgatcgctttgaggatcaccgagtggatctgggcggggctgtcgacctggtggcccgagccgccggtcgccccggcgatccgctcggcctcctgccggtgggcctccggtcccacggcgatcatgatcagcggcaccgggtgtcgcgggtcggccagtttccgcagttgggtgagcagggtggagcgggagatgcttcccgggtcctcgttgacgccgtcggtcaggatgaccagtgcgttgaacttccccttcacatatgaggcggtggccgccttgtacgcggcgagcgtcgtgtcgtacagaccggtggcaccgccccgcaccggctccagcgcgctgaacgccgccgacagtctgtcccgctgcgtgtcgcggcccccgcggtctccgagccgcccggtcggtacgagcacgcggtagtccttgtccccgtcgagcttcgcggagaagttccacagcccgatctcgtcatccggcgtgaacgtggtgagggtctggagcagcgacgccttggtgacgtccattcgcgaccggctgctgcccggcacggcctcggacatcgaggccgagatgtccacgacggtggtgatccgggcgctctgcaccgtgatcgtccacgtgccgagcgactcctggagcgtcttctcggaggccggttcgggtgcgggctcctcgtacggctgcggggagcggccgcccgccgccgtcacgaccgtggcggagacgtcctcgtcgtcgatgcggaagccgtgcttctgaaggatcctggtgcccttcggctgctccagcagcgtcatgaaccggagggcggcgcggctctcgtcggtggacagtcgcggctggtcgacgagtgtgaacgggtagtcgagccgcggtgatccgtccttggggtagaagaggtcgagcttcaggtcgctgtcggccgaggtgttgtgcgtgaacgccgcctgctcggagaggatcagcgcctggttgcgcttcgggtcgccctgctcggtgcccgaggagtcgcgcggcagcgtctccaggacctggctgtcgctgtcggctgtgcgctgggagagcgccttcgccatggccgccgtccgggtgtcgccttccttcaccttggcggtggcgccggtcagccgggtgagggcgagcagcccggtcgcgctgcgcgaggggtcggccgtgccgagtttcggccggtcctcccgcagggtcgcgccggccagttcggtccaggtgtacgtcttgtccggccaccccagggacttcgccgccgtcggaaccacggccatcccgacgggggacgaggcgatgttgccggcctgggtgacctgggtcgccctggcatcggcggtgacgcgccgcacccacaggtccgcgtccggtacccacgcctggatgtcggacttccggcccgacagcagcgattcggtgacctggtaggcatcgcgtgcggtcacgtgtatgtccaggcagtggccgtcggaggtgatgttcttcctacgggcctcgtcggccgccgcacggagggcgggggccacgtccggggaggcggcgatcttgaggcgtacggcgtggtcctggcaggaggagccgaaggacagcagtccgccgcggaccgccgccgcggtgccggccgcgacggtgagtacgagagccgtcgcgatggccacggtgcggcgacgcgcccgcgtacgggggtcgacgccgcccgccccgtagccgtcgggcaagctgtgacgtcccatgacggtggccctccctgttgagccgtgagccgtgaggcggacgtatggcagaacgcgagggggaggtacgcccgtacggcgtccgtcccccagcggcctgtcgcgcacgatcttcgcaagttctttcgagaccctagcggggcgaagatggggacgaggcgggattactcaactggaggcgggagtgcaggtggaggcggggtcgatggccgattcttttccgaaggagcggctgacacgacggattctccgggacgagacgctgctcgtcctggggctctcactcggtgcgagcggggtgtccgcgctgatcagctttgtcggctcggtcaccaaacccgggggtctcaaggaccaggcggccaccctcaatgcctcggccgcgcccggtcgtccctggctcgatctggcgtggcagctgttcggtatcgcgtccgcgctggtgccggtcgcgctcgtggcgcattttctgctgcgtgagggggaggggctgaggacgctcggcttcgaccgcacgcggccgtggccggacctcgggcgcggcgcggcgatcgcggcggtgatcggcagtacggggatcgccttctacctggcggcccgagggctgggcttcaacctcaccgtggtgcccgaggcgttgcccgacgtgtggtggaagtaccccgtactgatcctttcggcggtgcagaacgccgtcctggaggaggtcatcgtcgtcggctatctgctgcggcgcctgggccagttggggtggacgccgggcacggcgctggtggccagctccgtgctgcgtggctcgtaccacctctatcagggcatcggcgggttcatcggcaacatggtgatgggcgtggccttcgtctacctgtaccggcgctggggacgggtgggccccctggtggtggcccactcgctgctcgacatcggggcgttcgtggggtacgcgctgctggcggggaaggtgggctggctgcctacggcgtgagcagctcgccgtcgatgacggtgaccgcgcggccggtaagcagcgtgcggtcgtcgcggagttccgtacggacgtggccggagcggggcgaggcctggaggccggtgaggtcggggcggccgaggcgctgcgaccagaagggcgcgagggccgtgtgggcgctgccggtgaccgggtcctcgtcgatgccgacgttcgggaagaagcagcgggacacgaagtcgtggccctgggcggggtcttcggcccgggcggtggcgatgatgccgcgctcggagtagcgggcgagggccctgaggtcgggggcgaggccccggaccgtcttctcgtcggccagttcgatcagcaggtcgccgacgttcgggccggtgtcgcaggccgtgagcggctcggcgccgagggcctcggcgacgccctcggggatctcgaccggggtgagcggggcggtcgggaagtccagtgtgatcgagccgtcctcgcggggcgtcgcgatgaggacgccgctgcgggtggcgaaccgtaccgggccctcgtgggtacccgaggtgtgcagcacgtgcgcggtggccagggtcgcgtgaccgcacatcgcgacctcggtggcgggcgtgaaccagcgcagcgcccagtccgcctcgccgccctcgcccctgggcaggcgatgggcgaacgccgtctcggcgtgattgacctcgcgggccacgtcctggagccaggcgtcgtccgggaaggcgtcgaggaggaggaccccggccgggttgccggcgaaggggcggtcggtgaaggcgtcgacgattcgaatccgcatgccctgacgctagacggtggtggaggccgggggacaaggccaatcggggtgagctggaccggaacaggagtctctcccggcctcagaagcctttcccgtgacaccgccggcgaccgcgggcggctcctggggctcggcggcacgtcgacggcactcctgccggttcgccggacacgatccaaggcgccgagacgcgggggcacgcggcttcggtgaacttcgtacggtgtgcgcgcactccggcgggcggtagttcggacgtggcccgagccagggcggtgtgtgcctccgcgagggctgacaggcggtcgtcgccgtcccgctaccggcccggaaagaagagccttgtcatgcgagctgttccgatatatcgttgaggcatcgcgaccgatcaacgatggaatggagtgatggcgatgcgttcccgtggagaagacttcggatacgaacacggacatggacaccacggcggccccggccctcggggtcggggcggcttcgaggggcggcgcggggccttcgggcccttcgggccggggggtcccggtgggcccggcttcggcggaccgggcttcgggccgggcccctggggcgggcgcggccggggcggaccgcggggcagggcgcggcgcggcgacgtacgcgcgtcgatcctggccctgctcaaggaccgtcccatgcacggctacgagatgatccaggagatcgccgagcgcagcggcggggcatggaagcccagcccgggttcggtctaccccacccttcagctgctggaggacgaggggctgatcgccaacgagtccgagggcggcaagaagctgttctcgctcaccgagtcgggtcgcgcggcagccgccgagggtcccgaggcgccttgggaagaggcctcgcgcggggtcgactgggaggcgctgagcgagatccggcaggccggcttcggtctcatggaggcgttcggccaggtctggaagaccggcagcaaggagcagcgcgacaaggcgctgacggtcatcaacgaagcccgcaagaagctgtatctgatcctcgccgacgagggctgacggcatgctgtggttcgcgccggcgcctcgcggaagcttttccgcggggcgcctgtccgtctacggctgctggtgtcaggccaccagtgcgctcagcttgcgcagcgactcgttgagggcggccgtcgccgagtccttcagcttgcccgccatgatggacacggcggcaccggtgaactcgccgtcgatgcgcaacgtcgtcgcgtccccgtccggggtgagcgtgtagcgcgtggcgacgttcaccgccatcgggcccttgccgctgatggcgaggacgcggacgggctccagttggtcgatggtccagtcgacctcggccgggaagcccatgagcttcatgttctccgcgaaggtcccgcccacctccagggtctcggggccgcccttcgggaaaccggtgtgggtcgcgttccactcgccgtacgcggaccagtcggtgagctgggcccagaccttctcggcgggcgcctcgatgcgcgcttccgcgctgacttcggccatgcgaccaccccttcgtgtcgggtgctgcgcccggcgcagccacggtgtcgcggaacgtagccgcagcgcctgcaacattcaatactgatgaaccgtcagaaaatgtggagagagggcgctctggcgctcccggccgacccgccgcggcaccgccgtgccgtgtcgctcaccgccggagcgccgggggtgcctgcggcgtgaggcaaggcggcgcgcatcccatcggggaaacggcgcgatgtcattcgtaaggaggaggggccgtgtacgcctccccaacctgcgccggacgcgggaatggttcccggcggggatgacctccgtggacgaggctgatgaggtgggggatgtgccatcccgtactccccgacagccggccgccgaatccggctcgcgccgcgccgaactcgacgccgggctcaccgcagagctggcctcggcggtggccggtgcgcgcagacgggcggtgcgggacggggaccggcaggtcgacacggcccatctgctgcacacgctcctcgagacggacccccaggtgcatgccgtcttcgacggcggcccgcaggtcgcccggctgctcggctatctcgtgcagcgcagcatcggctacgggctgcgctggcggagccgcgtcgaggactccgccgccgggccgaccgtgggggagccggagggctggtcgccggtggcggccggcgccatgggggccgcccatgagcgggcggcgcgccgcggcgaggaccgggcgcgcggtgtggatctgctggccgcgatcgccgcggaccccgagtcccgggccgtggaggtgctcgggcgggcgggagtcgacgtccgtgtgctgctgacgcgcatcgaggcgtggctcgagttcgaggacctggtcgggggtggcgaggtcgcgccctgagacccgtcccggcgcctttggccgagcccggccggggtccctcggccctgtcgtcacgtccagtcgctgagacaggtgtcatttggggtgacgctcatgtcatcgcctggcatcatgtgccggtgcgtacgtctcaggccagtcagggcaatcgtggaaaaggcgtcggcctggggcttgccctggcgtcggcggtcgccttcggtggatcaggtgtcgcggccaagccgctgatcgaggcagggctcgacccgcttcacgtggtgtggctgcgcgtctcgggcgccgccctggtgatgctgccgctcgccgtacgccaccgcgccctgctgcgccggcggcccgcgctgctcatcgggttcgggctgctcgccgtggccggtgtccaggcctgctacttcgccgcgatctcgcggatccccgtcggggtcgccctgctcgtcgaatatctcgcccccgcgctggtcctgggctgggtcaggttcgtccagcggcggccggtgacacgtgccgcggctctcggagtcgtcctcgcggtcggcggcctcgcctgcgtcgtcgaggtgtggtcggggctcggcttcgacgccctcgggctgctgctcgcgctcgccgccgcctgctgccaggtcggctacttcgttctgtccgaccagggcagcgagacgggggaggacgcccccgacccgctgggcgtcatcgcgttcggcctgctcataggcgccctcgtgctcaccgtcgtggcgcggccctggaccatggactggtcggtgctcgggggccgcgcggacatgaacggggactcggtccccgccgcactgctcctcggctggatcgtgctgatcgcaaccgttgtcgcgtacgtgaccggagtgctctccgtgcgccggctctccccgcaggtcgcgggcgtggtggcttgtctcgaagcggtcatcgcgaccgtgctcgcctgggtgctgctcggcgagcacctgtcggcgccgcagatcatcggcggcgcggtggtgctggtgggcgcgttcatcgcgcagtcgtcggcgcccgcgaaaccgtcggacgggcccgtcaccggtgggggcggggccgaaaggcagttgtcggcccgtggcaccgccgcatagggtgacgatcatgcctttgacgctcgttcttccgcctccggccgcctgaggcgggccttcccgaacgcccggcgcatgaccgggccgagcggtgctgcccgcagaagaagtccgaggacctttccgtgagccggtgacccgcgcgcgtatctccgtgacgcgtgcacaccggcggcgacgtggtcccttcctgaacttctgctgacctgcggagagaacacgtgtcgaatgctgtttccggcctgcccatcgggcgaggcctgctctatctgaccgtcgccggtgccgcctggggcaccgcgggcgcggccgcgtcgctcgtctaccgcgccggcgacatggggccggtcgccctgtcgttctggcgctgcgccggcgggctcgtcctgctgctcggtgcccggctgctgcgctcgcggggccggcgggccgcgctccggccgctgggccggtgcgagccgaccgagccgcgtgagtcaccggcgcgcaaggcgctgcggatcggcgccacgggcctcgggctcgccgtcttccagaccgcgtacttcgccgccgtcgaggcgaccggcctggcggtggccaccgtcgtcacgctgggcgccgggcccgtgatcatcgcgctcggggcgcggttgaccctgggggagcggctcgggcggggcgggatcaccgccgtcgccggagcgctcgccgggctggccgtcctggtgctcggcagtgggggcgcgacggtgcgtccctggggcgtgctgctcgcggtcgtctccgcggccgggtactccgcgatgaccctgctcacccggtggtgggggcgcgacggcagggccgacgcgtccgccacgacggtgggggcgttcgcggtgaccacgctctgtctgttgccggcggccctggccgaagggctgctgccgtacacggctgaaccggtccacgtcctgggcctgctggtgtacatcgccgccgtccccacggccctcgcgtacgccctgtacttcgcgggtgcggccgtggtccggtcggccaccgtgtcggtgatcatgctcctcgagccggtgagcgcggcggtcctggccgtgggcctgctcggtgagcgcctgacggcggcaacgctggtgggcacgctgctgatgctcggttccgtcgcggggcttgcggcggcggagacacgggccgcggcggcgggcgttccgcagggggagccgacgctcgtctgatccggggcatcgggtgcgggcaactacgggggccgggggccggtatctcgggtgcggggtgcggggtgcggggtgcggggtgcggggtgcggggtgccgggtgtcgggtgccgcgtgcgggtaaggccgggcccgcacccggccttacccggcggcgggctaggccgggtcgtcctcgacgtcctcgacgtccacgtggtccacgacgtccgcccgacgtgcgcggtgcaggacggccgcatggaagcgcgcccggcggagcccgccgggcgcccggtcgtcgacggccctcagcagcacgtccggggacgctcggacggcggcccgcagcgggtccgggcggatcggcggggcgagtgcctcgccgacccgcccggcgtcgtacgcgccatcacagagccgcgagatagtcgggcagttcgatcccgggtgccaggtcggcggccgggaccggggcgccgtagccccgggtcagcggcaggacgccggtccagtgggggagcgtcaggtcctcgggctcgtcgttggggccgccggtgcggagcttggcggagacctcgtccaggtcgaggctgatcacggcggtcgcggccagttccttggcgttggccggccgggagtcgtacgagcggccgggtacgacgtggtcgaccagggcgtccagggcctcccgcttctcatcggggtcggtcacctggtgggcgatgccgtgcaccaccaccgaacggtagttgagcgagtggtggaaggcggaccgggccagcaccagaccgtcgacgtgggtgacggtcaggcacaccgggagtcccggatcggcctgaccggtcatccgcaaggggcgtgagccggtcgaaccgtggacgtagaggcgcctgccgacccgcccgtacagcgtgggcagtaccaccggggcgccgtcgcggacgaagccgaggtggcagacgtatccctcgtcgaggatcgcgtgcaccagctcgtggtcgtacgcggcacgctcacgggaacgggtggggacggtgcggtcggtcggggtgtaggcagcgggctgcgtcgtccctggctgggtgctcgtctccggcattgcgctctccattgtattagtgcataatctgctttgtgctaggagagtatcggatcgaagggcgtcgtgcggcggagattgccgccagtgtcgagcgcgcggtgggctcgggggagctggagccgggtcaactgctcccgccgatgcgggagttggcgctcgacctcggggtgaatcccaataccgtcgcggccgcctaccggaccctgcgcgagcgcggagtcatcgagacctccggccgccggggcagtcgtgtgcgccccaagccggccacgacgggacgcgaggacatccgggtcgaggtgccggccggcgtacgggacgtcgccgacggcaacccggacccggcactgcttccgggcctcgccgaggcgttcgcgggggccgccggggaggcggaccgggcgccggtgatgtacggagaggacgccgtcgaaccggagctggcacggctggcgcgcgcggccctggacgccgacggtgtgccggacgggcccctcgtcgtcacctccgggtcgctcgacgccatcgagcgtgtcctggcggcccatctgaagccgggggacgcggtcgccgtcgaggaccccggctggggcagcctgctcgacctcgtgccggcgctcgggctgcgcaccgtcccggttcgggtcgacggcgaaggaccgctccccgacgacgtgcgaagcgccctggaggccggcgcgcgcgccctcgtcgtcaccgaccgggcgcagaaccccacgggcggcgcggtgagcgccccacgcgcgcgtgccctgcgcgcggtgctcgcccagcacccccagacgctgctcatcgaggacgaccacggccacgcgatcgtcgacctgcccctgcatcccctgagcggtacgacccggcactgggccttcgtccgctccgtggccaaggcctacgggcccgacctgcggctcgccgtcctcgccggggacccggtcacggtcgaccgcgtgcacgggcggcagcggctcggccccgggtgggtgagccggctggtgcagcgggccgtcgtgcggctgtgggtgagcgacgcggtggacgtaccggccgtgtcggcggcgtacgggcggcgccgggacgcgctcatcggcgcccttgcggagcggggcgtggaggcgtccgggcgcagcgggctgaacgtgtgggtgcccgtcccggacgagaccggggcggtggcgcggctgctgcacgccgggtgggccgtcgcgcccgggtcccgtttccggatgagcgcgccgccgggcatccggatcaccgtctccaccctcacccccgacgacgtcgggccgttggcggacgccgtcgcctccgccgtccgccccgcgcccgcgcgccggtacgtgtgagtcagcgccgcgccctggcctgagtgagcgccgcacccgccagaacgatcgccgcgccgaccggggtcgaccaggtgagcgactcgccgaggatggcgacgcccgccgcggtggcgatgaccgggatgaagtacgtgaccatctgggccgtggtcggaccgacctcggcgaccaggccgtactggaggaggacggcgagcccggtgccgagggcgcccagggcggctatggcgagcagcgggacgaccgggaagtggctcggcagggtggtgaacagcggggtgacgaaggcgagttgcgcggtggccaggagcaactgggcgccggtcatcgacaggtgcgagtggctggagccggccagggtgcggcggacgtagatccagccgatcgggtagctgagggaagcgagcagggccatggccgtgcccgtcgcgtccaggccgtggaagccctgccaggcgccgagcaccgtcagcacgcccaggaagccgatgcccagaccggccaccctgcgccgggtcggccggtcctcggagagggcgaccagggagagggccatgccccacagaggtgaggtcgcgttgcagatacccgcgagcgtcgacggaatcgtcagctccgagtaggcgaagagcgagaacggcagggcgttgaggaagaacgccgcgaccgccagatgcccccaggtgcgcgcgccgcgcggcagacgctcccgcttcacggccatcgccacagcgagcaccgcggtcccgaacaccagccgcccgagcgtgacgtggaacggtgcgtaccccgccgtgccgaccttgatgagcaggaagctgaagccccagatcagggagaggacaccgaagcggatccgccagtcgagggcggtgcggcggcggggcgtggacccggtcggggtgacgggtcgagaagtggcgacggtgctcatggagacaacgatgcggcagaacaatctcgtagcacaatcgagatttctcatccgatatctcgtagcattgcttacatgttgaacctggagcgcctgcgcacgctcgacgccctcgcccgccatggctccgtcagcggtgccgccgaggggctgcacgtcacgacatcggccgtgtcccagcagatgtcgaagctggagcgcgaggtcggacagcgactcctcgcgaggaacggacgcggggtgcgtctcaccgacgcggggcggctgctcgccgaccatgccgcgcgcatcctgtcgcaggtcgagctggcccagtccgacctggaggcgcagcgcggtcaggtggtgggggagctgcgcctgtccgcgttcccgacggccgcgcgcgggctgttcccgaccgcactcgccgccctgcgcgccgagcacccggcgctgcgcgtgcgctccagcgagctggagcccgaggccggggtcgccggagtggtgcgcggtgatctcgacctcgcggtggtgctcgactggtacaacaagccgatgccgttgcccgacggcctggtcaaggcggcgatcctcgacgaccccgccgacgtcgccctgccggcggaccaccggctggccggcagggcggaggtggacctcggcgagttcgccgacgacgagtggatcacctggggcgagggcgagttctgtcatgagtggctgatgttcacgctgcgctccaagggcgtggagccgtgcgtcggccaccgcgcggcggagacccatacccagctcgggctggtcgccgcggggctgggggtgtgcatcgtgccgctgctggggcgccatccgatgcccgccggagtcgtcaccgtgccggtgcggcagcgtgtgcggcggcatgtgtacgtcgtctggcgggcggacgccgaccgccgcccgtcgatccgggcggcggtgggggcgctgcgggcggccggcgaggccatcggctgagcgcatgggttgcggcgcgtgcgccgggcggcctcgcttgctttgcccgagcccgagcccggccagggcgacgggacacgtcccgggcgccgacggagcgaacgcggccgcggcgaccggggcaacctccgcccgccgaccgccccctacatcggccccagcttgcggaagtcccacgaggcgatcgccgtcggtgtcagccgggcccaggcgtggcggccgtcgtgcggcatctcctccaggccgaagttcttgcgcgcgaacaaggtctccggggcgtcgagttcggcacacagttccccggtgcggggaacctcgcccacgaattccaccgtgccggacagctccacgccccgcagctccccgtactcctcgccggtgtcgatcaccacggcgatccgcgggtcccggcgcagctccgtccagcgcttgctgcgcaccaccgagtacagccacagcgacgtgctgtcccagacgaaccagagggtgctcacatgcggggcgccgtccttcgcgacggtggccacgcggcaggtgcgctgggtcgtgaggaactcgtccagctcgccgggcgtcatcatgatcttccgacccctgcgctgagtgacggccatgaggtcccctcttcttatgtgtcatcagagattttctgacactccgtcagaaaagcatgcgccgtcttccgtccccacgcaatgctcgttactctcgcccgctccggcttcgacgacaaggggacaccgtggcgtcgtacgaacagctcagcgaactcctcgaccccgcgaccaccgtgctgctcaccgtcgagtgccagcagggcgtcgtcggcccggacagcgcgctgcccgaactcgccaaggaggcgcgctcgtcgggagcgctcgccaacgtggccaggctggtggcggccgcgcacgagagcgggctccaggtgatccacgcgatcgccgagcggcgcccggacggccggggtgccggccgtaacgcccgtcttttccgcgccgccgagcggctgcccgtgcagcagttgtcggggaccacggcggtacgcgtcgcggccccgatcgaggtggcggagcaggacctcgtcgtacggcgactgcacggcctgtcgccgatcacgggcaccgacgtcgacgcgctgctgcgcaatctcggctgccgcacactgatcgtcaccggagtctccgccaacgtggccatcccgaacaccgtgttcgacgccgtcaaccggggctacacggccgtcgtgcccgccgatgccatcgcgggagtgccctccgactacacccccgtgatgatccgcaacaccctcgccctggtcgccaccatcgcgaccacggacgaggtgctggcctgcgtcacgcgtccgcgcagggcggggcggccctgatccccggctcagggcggtcaccggtcccgtccttgctccgggcggtcaccggtcccatcctggttccgggcgggccccggtcacgcgagcttgatcgagtccccgtcgacggtgatcttggccgcggccagggcctgcgtcgccggccccttcttcacgctgccgtcggtggcggagaactggctgttgtggcagggacaggtgatgacgccgtcggcgatgcccttcaccgcacacccctggtgggtgcacttggacgagaaggccttgtacgtgcccgcggtcggctgggtcacgacgacgccctggtccgcgaagaccttgccgccgccctcgggaatgtcggcggtcttggccagcacggtgccgtccgagccggccgccgcgctgtcgccgccggccgtaccgccgccgctcgcactgctgttgtcctgcacatcggaggagccggacgacttgtcgtccgaacccccgcaggcggtcagcgcgacggcgagtcccgccgcgccgaccgccgctacgaccgtgcggcgagccggtgccgagacggggtgaagcgattcgctggtcatgctgacgttcccttccacggatgtttcgtagatccgcccagaggtacggtgctcgggtgtcggctgttcagacggagtcggcatcgacctgatcgggatcaggcggacacaagggcccacgggccgcgtccaccgcccgtcaacaccccagtagcctggggcgatgctcaaggaagtcatcgcgacgcgctacatcgcgccgctgcgtgagggcggctcgctgccggggctcgtcgaggccgacgatctcggtacgtacgtcatgaagttcaccggcgccggacagggccgcaagacgctcgtcgcggaggtcgtctgcggcggactcgcgcgccggctcggtctgcgggtgcccggcctggtgacgatcgccctcgacccggtgctggggctcggtgagccggaccaggaggtgcaggagctgctcaagtcgagcggtggcctgaacctcggaatggacttcctctcacgcgcgctcggcttcgactccctcgccttcggggtgagccgcgaggaggccggccgggtcgtctggttcgacgcgctggtcaacaacgtggaccgctcctggcgcaaccccaacctgctcgtgcggcagggcgaactgtggctcatcgaccacggcgccacgatgatctggcaccacaactggcccggcgcacaggcctcggccgcgaagccgtacgacgcctccgaccacgccctcgcacccttcgggccggacgtcgcgggcgccgccgccgagctcgcgccccgggtcaccgaggaactgctggccgaggtgaccgccgagatccccgacgagtggctgacggacgagcccggcttcgagtcgccggacgagctccggcgggcctacgcggagccgctgctcgcgcgcgccgccgtcatccacgagcgcatcaagggggcacagtgaccgagcgggacgtcttcgagtacgcgctgctgcgggtcgtaccgcgagcggagcgcggtgagtgcttcaacgcgggcgttctggtgtactgccgcgccaagtccttcgtggccgcccggacgtatctggacgagaccaagttgctggccctcgacccggaggcggacgtggcgggtgtacgggccgcgctgcgggccgtggagggggtctgcacgggtggagaagccgcaggtcaggccgcgcaggacgacgccggacggcgttttcgctggctgatcgctccccgctcgacggtggtgcggccgggtcccgtgcacacgggactcaccacggatccggaagccgaggcggagcggctgctcggcctgctggtgaggtaatcgatcacacacgcgcggtgtgccgttgacaccgagtgccaggacttctagcgtcacgtgtactgaaggtactaagcggtcgctcacctgagggcgtaccgtgtgagccgcaggcttttcagggcttttcaaaggcgaggagaaccagcaatgtccaccactgagcagcgcgtcgcggtcgtcaccggtgccgcgcgcggcatcggcgccgccactgccgtacgactggccgccgagggccgcgccgtcgcggtgatcgacctcgacgaggccgcgtgcaaggacaccgtggagaagatcaccgccgccggtggcaaggccatcgcggtcggctgtgacgtgtccgacgaggcccaggtcgaggccgcggtcgcgcggatcgccgaggagctcggggcgccgacgatcctggtgaacaacgcgggcgtgctccgcgacaacctgctgttcaagatgagcgcgtccgactgggacacggtcatgaacgtgcatctgcgcggcgccttcctgatggccaaggcctgtcagaagcacatggtggacgcgaagttcggccggatcgtcaacctgtcctcctcctccgcgctgggcaaccgcggccaggccaactactccaccgccaaggccggtctccagggcctcaccaagaccctcgccatcgagctcggcaagttcggcgtcaccgcgaacgccgtcgcgcccggcttcatcgtcaccgacatgaccgccgccaccgccgcccgcgtcggcatgggcttcgaggagttccaggccgcggccgccacccagatcccggtgcagcgtgtgggccagccggcggacatcgccaacgccatcgccttcttcacgggcgaggaggccgggttcgtctccggccaggtgatgtacgtcgccggcggaccgctcaactagggccgggggacacggacatgactgcacttcccgaactttccggcaaggtcgcgctcatcacgggcgcgagccgcggcatcggctacggcgtcgcggaggccctggtcgcccgcggtgaccgcgtctgcatcaccggccgcaacgaggacgccctcaaggaggccgtcgaggcgctcggtgccgagcgcgtcatcggcgtcgccggcaaggcccacgacgaggcccaccaggccgccgccgtcgagcgcaccatggaggccttcggccgcgtcgactacctggtcaacaacgctggtacgaacccggtgttcgggccgatcgccgatctcgacctcaatgtggcgcgcaaggtgttcgagaccaacgtcgtctcggccctcggcttcgcccagcagacctggaaggcctggcagggcgagaacggcggcgcgatcgtcaacatcgcctccgtcgccggcgtctccgcctcgccgttcatcggcgcgtacggcatcagcaaggccgcgatgatcaacctgaccctccagctggcgcacgagttcgcgcccaaggtgcgggtcaacgcgatcgcgcccgccgtcgtcaagaccaagttcgcgcaggccctgtacgagggccgggaggcggaggccgccgcgtcctacccgctcggccggctcggggtgccctccgacatcggtggcgccgccgcgttcctgacctcggcgcagtccgactggatcacgggccagacgctcgtggtcgacggcggcatcttcctgaacgccggggtcggctgaccgaacctcgcggcggcacgggcgcccctggacagaatgggcgctcgtgtcgacgtgagagagacgctctgacggatgacaacgtcgtcatatacgcgctgatcaacagccctgccggaacatggttcagtcgcggggcactgcggtatggtctgccgaccttggtacggcagatcgaggagcgagcgcgtgtccaaccggtacagagccctgcgtcaggtggcggcggtcacgtccatatccctggtggccggctgcggtgtcctcggctccggctccgccgacgacgagggaccgattgtcgtgggcaccaccagcgcgcccagcacactggatccggccgcttcctgggacggttcctgggagctgttccgcaacatctaccagaccctgctgagctacccctccggtgcggccgcgcccgagcccgacgccgcggagagctgcgggttcaccaacagctcgaatctcgcgtaccgctgtgtgctgcgcaccggcatgaagttctccgacggggacacgctcgacgcgcgggccgtgaagtactccatcgaccggatcaggaggatcgacctgtccggtggccccgccggcctgctgggcagcctcgaccggatctcgacgcgaggcgaccgcgagatcgtcttccatctcaacaagcccgacgccaccttcccgttcgtgctggccacccccgccatgtcgatcgtcgaccccgacgactacccggcccgctccctgcgcaaggacggcaaggtcttcgggtccggtccctacagcctgcgctcgtacgaggacggcaaacaggccgaactcgtcaagaacgatcactacaagggcttcgccgagcgcaagaacgacgcggtcaccatccggtacttccagaactccgccgccatggtcaaagccctcagggacaagaagatcgacgccacctaccgtggactggccgcctccgacatcgtctccctgcagagcaagcagtccgaggaggacctccagctcgtcgagggcgcgggcaccgagatcagctacctggtgttcaacccgaaggacccgtgggccggcaaggccgcggtccgcaaggccgtcgcgcagatcgtcgatcgcgcggcgatcgcgcacaaggtctacaaggacaccgtcgacccgctgtactccatggttcccaaggggctgacggggcacaccacgggcttcttcgacgacttcggcgaacccagttcgtccaaggcccgcaagatccttctggaggcgggcatctctcagcgcgtcccgctcaccctctggtacacgaccgaccgctacggatccgagaccgcacccgagttcgaggagctcaagagccagctcaacgactccgggctcttcagcgtcaagatcgagggccgcccctggaagacgttcgaagcgggctaccgcaagggcgagtaccccgcgttcgggcgcggctggttccccgacttcccggacgccgagaacttcatcgcgcccttcgtcggtgagcagaacgccctcggtacgccctacccgacgcgggagatcaccggcgtgctgctgccccagtcgcggcggcagagcgaccgcggggccgtggtgaaggagttcgagcaggcccagcagatcctcgtcgacgacgcacggctgctgccgctgtggcagggcaagcagttcgtcgcggcgagcgaggacatctcgggcggcgagcgggccctggacccctcgacgatcatgatgatgtgggagctgtatcggaaaaccagctggtagcaaggggtgcggggccgattgtcagtggtcgcctgtaggttctgtcctcaggaagtgaccgcacatcggaggaagttgacgtgaccgacaccgccatgctgcccgagtcctggcgcggcgtcctgggcgacgagctgcagcagccctacttcaaggaactcaccgagttcgtcgaggaggagcgcgccaggggtcctgtctaccctccgcgtgaggaggtcttcgccgcgctcgcggcgacgccgtacgagcgggtgaaggtgctggtcctcggccaggacccgtatcacggcgagggccaggggcacggtctgtgcttctccgtccggccgggcgtgaagacgccgccctcgctccgcaacatctacaaggagatgaaggaggagctgggcaccccgatcccggacaacggctatctgatgccgtgggccgagcagggtgtgctgctgctcaacgcggtgctgacggtgcgctccggcgaggcgaactcgcacaagggcaagggctgggagaagttcacggacgccgtgatccgcgcggtcgcggaccggcccgacccggcggtcttcgtgctgtggggcaactacgcgcagaagaagctgccgctcatcgacgaggagcggcacgtggtggtgaagggcgcgcatccctctccgctgtccgcgaagaagttcttcggttcgcgtcccttcacgcagatcaacgaggcggtcgcggagcaggggcacaccccgatcgactggacgattcccaacctcggctgacggcgaacggcgaacggcgaacggcgaacggcgggtggcggagagaggacggacgggttctgtggtctccggcccgggggccccgccgtcaccggcctggcccagtggcgtacggagccgcctgaccgtgaatgtcagtggctgcggttagcgtcgtggggggatgggcgacgaccttggaggacgtggtggcggagcgacaggagcaggtggcgccggacgccatgatgacccgcatcgggcaggtcgcgatgttgcaccacgccggtgaccgcgaggaggcccggggccgcttcctgggcctgtgggcggagatcggcgacggcggcgaccccctccaccgctgcaccctggcccactacctggcggacacacaggacgacccggtggatgaactcgcctgggatctgcgggcgttgtcggcggccgaggagctcaccgacgagcgcgtcgccgagcacgagcacgaggacgcgctcgcggtgcgtgcgttctacccgtccctgcacctcaatctcgccgcggactatgtgaagctcggtcgctccgacgccgcccgcagtcatctgcgccgggcccgcggcgcggtgggcgtgctcggcgacgacagctacggggacggcgtccgggcggcgatcggacgcctggagctgaggctcgacggcgacgggccggcgggcggcggatcggaccccgcgggcggcgccgggccgttcgggggtccgggcccgttcgacggccccggaggggagaggccggggccgcccagacagcggccgtagggggcggggtgggggagggcaggcgggggacggacggagagtaccgacggggcccgggacgcggcagcgcccggcaggggcacgacggcaccggccggtccgcgaagtgacgtcggccggtccgcgaggtgacgcggccggtccgcggtgcggcgaagtggcgccggccaggctgtgtgcggcggagtccggaccgttgacggcggaggttctacgcggggtgggacgggcgggtgtgacccggtcccctgccgcggacgtgcgggcgcgctgcacctaggccgctaggccgcatcggccgcatcggccgcatcggccgcgccgcgcgccgtcgcctgccggggccggtggccgcctcgtacggtccgtctcaacgcccgtacgcgtttttgcagatggtcgcctcagggctgtccggctgccatcccccgtacttgcgcccgagcgcgcacacgtccccgtccttcgggaccagcttggacacggacgtcggtaccgcgtcccggggttcgggatgcgccggcttcgcgggcgggtccgcgtgcggacggcgcggaaccgtcaccggtgcggcggcgcgcgccggaggaggcgtccggtgcggcgcggcggcggtcggcgacgggcggtgggagggctcgatgagctccagtgcctcccgcgccggagcctggacgacttggggatccccgctgccgtccggacgtggcaccgacgggtggggcggtgccaccgagggagccggggcaggcagccgctggacggtcacacagccggagaggacggtgacagccgcggtgaccaggagcgtcgcggtggtcgtggttcgatgcacccgcgcaactctgctgcgtccggcccgatttggggagcggacaggcggaggttgccccgcacgggtgatccttccgcctcgtccggacggagccacggcacgagcgtgacgcaccgagggcgtcactctccggtcgtgccgtcgacgcgctccctgatcaggtcggcgtgaccgttgtgacgggcgtactcctcgatcatgtgggtgtagatccaccgcaggttgatggggctgtcggtgaacttgctcgtgccctcgcagacgtcgtccaggccgaagcgtgccgcgttgtgccgggcgatcccgatctccgcctgccaggtgccgtaggcctccgcccaggtgtcggcctcggtgaggtggaactcgccgtcgcggtcctcgtcgctgtagtagatcggcccaggatcgtcgttcgccaacaccttgcggaaccagccccgttccacctccgccatgtgccgcaccaggccgagcagggagagttcggagggcggcaccgaggcggttctgagctgagcgtcgtcgagcccctcgcacttcacctcaagcgtccggcggtggtagtcgagccacccctccagcatggatcgctcgtcggcgtcggtcgcgggttcggtgcgctgtgtcgtcatgccccgaatcctgccgcaccggaaccggccgtcaccaccgacttacggccaccgcgacggccgtatgcttccgacgagccacgcgtcgccaatccctaggagaacccccgtgaaggtcggctgcatcggactcggtgacatcgcgcagaaggcgtaccttccggtgctcggtgtccagccgggagtcgaactgcacctccagacacggactcccgccaccctcgcccgggtggccgacagcctccgtctgccaccggcgcaacgtcacaccgacctgtcggagctgctggcccaggacctcgacgccgccttcgtgcatgcgcccaccgccgtgcaccccgagatcgtcgagcggctcctcgcggccggcgtaccgacgtacgtcgacaagcccctcgcgtacgaactcgccgactcggagcggctggtacggctcgccgaggagcggggcgtcagcctggccgtcggcttcaacaggcgttacgcgcccgggtacgcccagtgcgccgaccatccgcgtgagctgatcctgatgcagaagaaccgggtcgggctgcccgaggagccccgcacgatgatcctcgacgacttcatccatgtcgtggacaccctgcggttcctggtgccggggccggtcgacgacgtgacggtacgcgcccgcaccgggggcggtctgctgcaccacgtggtgctccagctgtccggtgagggcttcaccgcgctgggcgtcatgaaccggctgagcggctccgccgaggagatcctcgaagtctccgggcaggacaccaagcgccaggtgctcaacctcgccgaggtcgtcgaccacaaggggcagccgaccgtacggcgacgcggcgactgggtgccggtggcccggcagcgcggcatcgagcaggcggtcctcgtcttcctggacgccgtacgcgcgggcaaggtgctcagcgcccgggacgcgctggcgactcacgaactgtgcgagcgggtggtacgcgcggtgacggaacggtccgcctgagccggaactcccgtacgccctcagcggtgcacagcgccgcgaggatcagcagcgccgcgtgcaccggccagtcgccgaagcggacgtacggagtgacaccgcgggccaacggcacgtcgtacaccgctgacgtgctcttcccggtgccgagccaggagccgacgcgctcgccgctcgggccgtagacggcggagacgccggtgagtgtcgcgtgcaccatcgggcggccggtctccgcggcccgcagcgcggcgagcgaggcgtgctgttccggggcccagctctgctggaaggtcgaggtcgacgactgcgcgagcagcacctcggcgccgtcctcggcgagatggcggctcatgtcggggaacgcggtctcgaagcacaccatcgggccgatgcgcagcccgtgcccggcgttcatcaccacctgctcgctgccgcgcctgcggtcctcgccggccgccttgccgacggaggtggcccagccgagcagggagcgcgccggtatgtactcgccgaacggcacgagccgcatcttgtcgtagcggtccccggtcgggccgtgcgggccgacgagcacggaactcttgtagatgccgggccggtcggagcggcgggcgtcgacgttgacgaggatgtccgcgccgacccgctccgagagaccggcgatccgccgggccaggtcgggacggtccgcgaggtcgaagccgacgctgctctcgccccagaccaccaggtcgacgttctgcccggcgagttcccgggtcagctgctcctcgcggtcgaaccgcctgtcagcgctgccggttccgtcgatcacgcccggctggacgatggcgatccgcatgtccccgtcatggtcggggcgcggtgaccacgcccaggccgccgaggtcgcggcggccgtggcgaccagtccggcgagggcaggcatacgggacgcgcgcaccgagacgagcaccgcgaccgcgatgttgaccgtcaccaccaggaagctcagcagccacaccccgccgaccgaggccagccgcagcgcgggttccacctgccactggctggacccgagcagcccccaggggccgcccagcccctgccaggaacggacgagttcgaccatgagccagcccgacggcaggacgagcatcgccgccgcgacccgccccggcgagggcaccccggccaggaagcggcgcaccagccagccccacggcgcccacagcgcgccgagcagcgcggctatcaggaccgtgaacacatgcaggctcggcagcagccagtggtgcacggccagcatgaagccgagcccgcccagccagccgtcgtacgcggcgcgtccgccggtcggggcggtgcgggcgagcaggatccaggggaccagggcgacgtacgcgaaccaccaccaggacggtgccgggaaggcgagcatgggcagggcaccggccagcacggccgccgcgccgcgccaccagcgggagcccagccagtcctcgggcatcctcatccggcatctccttccccagggagtgcctccagtgtgctcgccggggacgatctccgacagggggcgtcggagcgtggcgagggggcgctcagggggtcgcgttcccctcgcgcgccggttgcatgcggcgccacttctcctggacgaccacctcgcgcagccgccagccgtcatacgtgcgcgcgaacgcgaacgcgtaccggcccccgcagacgaagtccggttcgcccgagccgccgtccgggccgccgtcggatccggcgaagcgcatcggattgacgtagtcggcctggacccgcgccgtgtcgccgatgtcctgttcccgtacgccgaaccgcacccgtcggttcacgatcaggtgctgccgcatcgggaacagccgcatgttctcggcgagccacgcggcgacctgccgggcgtcgccctcgatcccgccggccgagcggtagtcggcgcgcccgtccgccgtgaacagccctcggtacgcctcccagtcgccgtcgtccacggccaccgcgtattcggtgatcagttcgtcgatgccgaggcggtccatcacggttgcgagctccacgcgctgcgtcatcggctcagtgttggcgacggagggtgtccagccaaggggtgtgccgtgacaatcggccgcggggacgacgagtcgctggcggacccggcgttcgtggcccgcgtagcggccggtccgccttgcgcgcagcgggggttggcactggtggacgattcctatactgaccggatgatcaccgttccgctcagcgcgctcgaagtggccatggtccaagcgggcgcccgagccgcagacacgttacgagacaccaccgagttcgccctgcgcctcgaagacctcggctacctgcgactctggtacgccgagcatcaccattccccggccatcggagcgttcccgcccgtcgtcctgaccgcccacgcggccgcgttgacgtcgtccatccggctcggctccgggggcgttctcgctcccaaccacgctccgatcatgctggcggagcagttcggcacgctgtccgcactgcacgcgggccggatcgacctgggcatgggccgtgggccgggtaccttcgacgattccacggcgcgggccctgcgccgtggggccggtccgacaacggacgtcgagtaccgcgacgatgtgtcatcgactctgggtttcttggtggacgaggtcgcgctcggcccgctcccggagccatggctgctgtcctcgagcacggccggtgccgcgctcgctgcggaactcggactgccgatcgccttcgcccatcacattcgccctgacaacaccctggccgcgctcagccactaccgagagcgtttctccccctcccgttggtgcgagcgcccgcgcgtgctgatctgcgtggaaacggtatgcgccgagacgcaggaggaggcggcccggctcgccggtccgatggatgtcgtcaaggccggactcctcaaggggcgaggcgacatccccttccccacgcccgaagaggcggcgacccactcgttcaccgcggaagaggcgcaggcgctgacggccttccgtgcccaacaggcacacggctcacccgagaccgtggcgaagcacctgacggacctggtggacctgacgggtgcggacgaactcatgctggtgacgcccatctacgcgctggccgaccggttgaggtcgtacgagctcgtcaggcagcacgtcatgatgccgacggcgtcctggcaatgatcaccacgtgaactcagttcagttcagtccagctcggcgctggcggccggcgcgggtcgagcgggggcgtctatgccttggaacggtcgcgacggttcgcgtccttggggcggcggtgagagacctgttcccgtgcggtacgccaacgtgaccgcgtctgttcgaccacgctgtcccattggcggcggacgtcatggtcggacgggcggtggccgtggcggatccgggtgagctcgtcgcgtacctctcggcccagtgccgccgacgcgacgatgacgagcatccccccgaagagggccgagatcatcgcgaagacggcaccgagcgctccgtatcgtgcggcgtaggagttgaagaggcgcggtaggtagacggtcgtgcccacggagtaggccgcctccaggagggccgctgcgatgccgaaggggagcaggtccggccggttgatccgcttcgcggacaggatccagccgctccagacgaggaaagcggcggtcaccggtacgtcgcacaccagggccgccagacccagccggcccccgcccaagacggcggagagccacccggtgaccaccgtgtagccgccgagtgtgaggatccaccacaacccgttgcgcgtattgcgcatgctgagcggcttgagctcccatgtctgctcgaagagccgctgcgtggctcgcgcgaagctcagtaccgagatggtcaggaagacgactccgaagatgcccacgctcgcgcttgtgtgctgggcgggggagaagagggactcgactgcctcggcgcctgctccggtcaggccgtagcgcttgatgacccgctccgccgcgtcgtagtgcgcgaaactgctcacgacggtgccgccgaggactgcgagcgggagcagggtggtgagagcactggatgccagagccatcgagcggtcgaaacccacgatcttctgaaaccggttgatgacccgcagtgcgaaggcagggcgcagccagaacgtcagtgtcctgaccaggcgctcgcgattgatcctcgctgtcctgccctccgtgaagatcggaacttgtgtggcggcgcgagcttaacgggccgtcgtcggctcgatgagcggcgacacgaatgcttcgctcgaagggcggagagcggcggttgtcatgggtctgaccggcgtgtgccgcgccgttccgggcagttccgggcagttccggacagggagtgcgtgtcacgacgtgacgttcacgagtttctccggcaagcgggatgcctcgtcgcacacctcccgctggatgtcggcgtctcggccgggcgacggggaccgcactgtcggtccgggcaacgtcgtccggtgcagcaccgacattccgccgacctgaaggatggcagccgcaagtccgttactccgcggtgccgaaagtccacacggcgcgggcgcccgggccgacgacgagggtcgaccggccgagccgttcctcgtgccggtactccacgggccggttgagcgacagctcgacctgccgcaagcccacctggtcgcgcggaacggcgtcgaatcggatcgtggtgcccccgcgccgcgcaacgatgccaccgtccgccacggcctgggtgacgaacccaccggccggcagcagcggcaccgtgttcgcgaggtcacgcgcggagaccgcgaggcggacagaggtcacgtcgcgcatcagtcagcaggatctgctcagccgcctgccacaagggttcggcgctgccgcacgctgggcgcgcacggcggttggagcgggtgtatgccacgcgggatccggtggaggcctgtgcgggatgtgtgcgtccgctgtccccgtcggtcggcgtcgtgcgtccactgtccctgtggatcgtcgccgcccggggctcaggccgcctcgatgacctctccgcgtatcgcctcggcccattccacgaccaacagctcgtactccgcccgctcctgcgccgacagtgagccgcccgcgcgcatccacagcgcgcggatctgctcgtttaacgcggccgcagaccgcacggaaccaggggtcatggagtcgggggacatgcgcacaagcctaggggcaaggactgacactgcgctaccggtcggctactcgcaccgtatgtggttggtcacggtgggtcctgaacccaccggcacgagtgatcacgtggtgatcgcgggggcggcagccgtccgtggcctccgtgcggctctcccgcgtcagcccgccgactccgccgcgtgcgggctgagcgcacccgtcgcgaccagcgcgatgatggcgatgccgagcgcgatgcgataccagacgaacggcatgaagctcttgttggagatgaacttcatgaaccacgcgatgacggcgtaaccggacacgaacgcgatgaccgtggcgaagaccgtcggtccccacgcgacatgtccgctcgcggccgcgtccttgagctcgaacacgccggaggcgaggacggcggggatggcgaggaggaacgagtaacgggccgcggactcacgggtgtagccgatgagcagaccgccgctgatcgtggcgcccgagcgggagacgcccgggatcagggccatcgcctggcaggcgccgaagaccagaccgtccctgatgttcaggtcctggagcttcttgcgctccttcgccgcgcggtgcttgccgcccgtctcgtcacgcgccgcgagccggtcggctatgcccaggatcacgcccatgacgatcagcatggtcgcggtgatccgcagatcgcggaacgggccctcgatctggtccttgagcgtcacgccgagcacgccgatcgggatcgagccgacgatcaccagccagcccatctgcgcgtcgtggtcgtgccgcatctccttgttcaccagggagcggaaccacgccgagatgatgcgcgcgatgtccttgcggaagtagatcagcaccgcggcttccgtgccgatctgggtgatcgcggtgaaagccgctcccgggtcctcccagccggcgaaggccgccgtcagccgcagatgcgcgctggaggagacgggaaggaactcggtcagcccctggacgagtccgaggatgagggattcaaaccaagacatggagttatgtggtccaagcgctgatcgaggaggggcgacggacacgccgcgccgacgcgggcggtgatcaagtgtgttgtggggcagcgtagcgtccccggatgacagcccggccacaggggtttggcggttggccgccgggcagggcgatccggtgccggcggccgacgttgtccggaccgtggaacgcccgcgtccgcggtgttgaccggccgctcgaacgacacatacgttgcagcgaggagagaaagcgcttgctgtctccgggtgccccggagccgacaggcccttggccagcgtctgacgtcacgtcgatggagtgctgatcacgtccatgcccacagcccgcaccgcgtccacgtccacagccaacaccgcgtccgcgtccacagcccgcaccgcgcccacgtccacggctcacgacacgtccacgtccacggctcacgacacgtccacgcccacagcacgcgacgcaaccagcccggaaccctcctcgcccccggactcgaggccgaaccccaccccgtacccgaaccgcccggcggccccgctcgccggccgccggatcagggccgccctcatcggcacgggtgccatcgggggcggcagccatctgcccgcgctcgccacgctcgccgaggagggcgagacggagatcgtcgccgcggtcgacatcaacgccgacgcgatcaccgcgttctgcgcggagcacggcatcccgcacgcgtacaccgacctcgaccggatgctccaggagcagcggcccgacctggtctccatctgcaccccgcccaccctgcaccgcgaacagaccctcgccgcgctgcgggccggtgcctgggtgtggtgcgagaagccgcccgtcccgacgctggcggacttcgacgccatcgagtcgcaggagggcacggacggcggtccgtacgccgcgatcgtgttccagcaccgcttcggctcgggcgcccggcacgtccggcggctgctcgccgaacaggccctggggcggccgctcgtggcgcactgccagaccacctggtaccgcaacaccgcctactacgccgtgccgtggcgcggacgctggcagaccgagggcggcggccccgcgatggggcacggcatccaccagatggatctcctcctcgatctgctcgggccgtggagcgaagtgcgggcgatggccggacgcctggtccacgacgtggagacggaggacgtctcgaccgccctcgtacgcttcgagaacggcgcgatggccaccgtggtcaacagcgttctgagtccggacgaggtcagccggatccgcatcgactgcgagcgcgccaccgtcgagctgacccacctctacggccacagcaacgccaactggcgcatcacgcccgctcccgacgtgccggaggaggaggccgcggcctggcgtgacttcggcgcggacgtgccgagctcacacctggcgcaactgcgggaactggtcgcgagcatgcgggcccaggcgcgtccgcgcagcagcggcgcggacgggcggaccagcctcgagctgatcaccgccctgtacaagtcggcgttcaccgatacgaccgtgcgggccggggcgatcggcccgggagacccctattacacggctctgcacgggggcgcgccgggctgggcgcccgtcgggttcaccggcagccagtctgccgacagccagtccgccggaagccggcccgctggaaccggatccaccgtgaacgactccgcatcgagcaaggaggtgccggcatgagcgaggccaccggtctgcgcatcgtgcacgcccacggtgaccgcatcacgatcaccgaacggtccaccggcgtcgatctgctgagctatgtctacgctcccgaggcggcctgggaggctccgaagccgtatctgcatcccctccggacgctcgccggtgacgtcgtcaccgactaccggcccaacgaccaccgctggcacaagggcctccagatgacggcctcgcatctgtccgggcagaacctgtggggcggcaacacatacgttcatggaaaggggtatctcgcgctcccggagcgggtcgggtcgatggcgcacgtcggctttgacgcggtcgacgccgacggtgcccgtgccgtgatcgccgagcggctcacctggcacccgtacagcggcgagctgtgggccgaggaggagcgtcgtgtggaggtgcacgacgtcgaccccgagtccggttcgtgggcgctgacctggaccagcgccgtcaccaaccggcgggacgaaccgctgctcttcggcagcccgaccaccgccgggcgtgaactggcgggatacacgggcctcttctggcgcggcccgcgagccttccgggacggccggatcatcggacccgactccgaagggcacgagctgatggggcggcaggcgccctggctcgcgtactcgggcgaacacgatggcgccgacggacacgccacgctcgtgttcgcgcatgcccccgagaacgaccatgacggctcccaaggagcgcaccccgcccactggttcgtgcgcaacgagcccttcgcggctgtcgctccctcgtgggcgttccacgacgagctggagctggggcccggcgatacgctcacccgtcgctaccgggtcgtcgtggccgacggcgcctgggagcgcgaggaggtcgccaagtaccttcaggagcacccgtggtgagcccgggggaattcgccggactgccgggggaattcgccggactgccgggagtgttcaccgggctgcccggggcggtcgccgtctcgcacctgtccgtctacgactggcccgcggtcgacggagtgtgcggcggaactccccatatgcatctgacctgttcggaggcgtacgtcgtcaccggcggccgcggcgcggtgcagacgctgacgacgtccgggtacgaggtcacacccctcgcgcccggaacggtcgcgtggttcacgcccggcaccatccaccggctcgtcaacgaggacgatctgcgcatcaccgtcctcatgcagaacaacggcttgccggaggccggagacgcggtgctcacgctgcctccggagtacctcaccgatcccgggacgtacgccgccgcgaccgtcatcccggccgacgcgtccgaagaggagcaggcgcgggtcgccctggcccggcgcgacctcgccgtgcgcggctaccgcgcgctgcgcgacgccgacgggcccgagccgctcgccgcgttccaccgggccgcggccgctctggtgcggccgcgtgtcgccgcgtggcgcgagcggtggcggcgcggggccgaggctgccaccgcggccaccggggaccagctggaccggttggagcacggcgacgcgtcccatctcgcggacgccctcgtacgcgccgaacagccttccacgtacggcaggttcgggatgtgcgggcggctcgacgtctaccaggggacgtcctagttccagagcggctgtcggggagcccccctccttttttgggggctccccgacagccgcttctccttacgccttttccttacgccgccgccggccccttcaccgtccagcccggcgcctgcgggtgcgccgtcaggtcctcgtggtggacctcctcaccgcagaccgagcaggtcacgagcggaatcagttcattgccgcagatgtgctcgatcaccatggggcggtcgtcgtccttgcgcagatgccggtcgccccaggccatgagcgtcatcaggaccggttccagttccagacccgcctcggtgggccggtactcgaagcgctgcgggcgctcgctgtagacggtcttcttcagcatgcccgcgtcgaccagccgcctcagacgcgtggccaggatgtcgcgcggggcgccgatgttgcgtacgagctggtcgaagcgcccgttgccgaggcacacctcgcgcaggacgagcagcgagtacttctcgcccacgagcgccagggtgtcggcgatcgagcaggggcgcgggtctttggtggcggccatgaacccagtctaggggagggtttgtttttccaaccctcggcgctatggtgggtccagatttcctactcactggtagccgggacatatagcccagggcccgacagccggggaccaagtagccaggaccaagtagccaggaccaatcggtcatcgcccgtagggaccatggccggccaaggaggcccgcaccatgcgtgatgccgtcatcgtcgaagccgtacgcacccccatcggcaagggcaagccgaacggctcccttgcccacgtccaccccgtcgaactgctcgcgcacacgctgcgcaccctcgtcgagcgctccggagtcgacccggcactgatcgacgacgtcatcggcggcaccgtcgaccaggtcggcgagcaggccatgaacaccacccgctacgccgtcctgtcggcgggcttcccggagacggtgcccgcgaccacggtggaccgccagtgcggctcctcgcagcaggccgtgcacttcgcggcgcagggcgtcatgtccggggcgtacgacctggtggtcgcctgcggtgtcgagtccatgagccgcgtcccgatgtggtcgaacgtgccggccggccaggaccccttcgggcccggagtcgcccggcgctatcccgagggcctggtcccgcagggcatcagcgccgaactgatcgccgccaagtggtccatcacccgggaccagatggacgccttcgcggtgtcctcgcaccagaaggcggccgcggcctgggcgggcggtctgttcgacgccgaggtcacgccgctggagggggtgaggcgcgacgagtgcgtacggcccgccagcaccaccgagatcctcgccggactcaaacccgcctactacgacccgaacttcgccgagcgcttcccgggcatcgagtggaacgtcaccgcgggcaacgcgagccccgtcaacgacggcgcgtcggccgtgctcatcacctcgagcgagaccgcggcccgcctcgggctgcgcccgatcgcccgtctgcacagcttcgccgtcaccggctccgacccgctgctgatgctcacgggagtcgtcccggccaccgagaaggtgctccgcaaggcgggactcacgatcgacgacatcgacctcttcgaggtcaacgaggccttctccagtgtcgtcctggcctggcggcaggagacgggagccgacctgagccgggtgaacgtccacggtggcgcgatcgcgatcgggcacccgctgggtgcgagcggtacgcgtctgacgaccacgctggtgcacgccatgcgcgcgcgtggagcccgctacgccctccagacgatgtgcgaggcgggcgggctcgcgaacgcgatggtgctggagaccgtctgaccggtcagttgccgcgcaggtggtggcgcttgcgccaggccaccaccgccccgaccagggccggcacggcgatgaagcccatcgcgatcaggaaggcgggcgaggtcggcctcgaggcacgggcgccggcgacggcgtacgcggcggtattcggaatggagccgagcgccgtcgcgacgaggaacgggacccagcgcatccgggagacggcggcgcagtagttggccgcccagaacggcacgccgggaaacagccgggccgccatcatcgagcggaaggcgtgcctgctcagctgtccgtccaccgccttcagccagcgcccccgcagcagcgggcggagcgcgtcctgcccgagcatccggccgaggccgaaggcgaccccggcgccgagcaccgtacccgcgagtgcggtacccgtgccccactgcgagccgaagagggcgcccgccgcgaggttgagcagcggccgtggcacgaacgcgaccgtgcacagcccgtacgccaccgcgaacaccacggccgccgcggcgccgccgagctggggcggccagccatgggccagcagcttctgcggctcgaacagcagcacgctcgacgcggccgccgcgagcagcgccaccagcagggacagccgcgaccacggcgagaggagcactctcgtgcagcgggcggtgaagcccgtcggtacggcgacggcggccccaggggccgtgacgccggccgcggcggcggccgtggcgacggtgaggtctgtggcggtggcccggggagtggccgtggcggtgcccccagagcgggtggtggcatcgagcattcggtgacactaaccgacccatgtgtgtgatcgccgtatggttcgtctcacgggcgtcacaggatggggaacgttgggtgcgcgacgtgcgcgccggccgcgcgtaccccttacgtcggcgccgcctttccgggctgccgtgggggtgtctcgcacatctccggccccgtccgcccctctgggtatccctgaactcaccccgtacaaaaaccattcgacgcggccggatccgtcgacgatgatctacaacatgttccggtacgccttcctcctcgcagcatccgcagtcgcggatgcgccgaaggctgccgtcccgatcatcgcggccgctgtcgacggcgcccgaagctgacccttcccggatcgtccggcggaccccgcagggggagggtcggcaggtccttggggtccccgtcccggccgctctccgcgccggggccatcactcagctccgctgacactgaagaggcttcgaggtacagccatgcccaagacggcttacgtgcgcaccaaaccgcacctgaacatcggcaccatgggtcacgtcgaccacggcaagaccaccctgaccgccgccatcaccaaggtcctcgccgagcgcggctccggcacgttcgtcccgttcgaccgcatcgaccgggcgccggaggaggcggcccgcggcatcaccatcaacatcgcgcacgtcgagtacgagacggacacccggcactacgcgcacgtggacatgccgggccatgccgactacgtcaagaacatggtcaccggcgccgcgcagctcgacggggcgatcctcgtcgtctccgcgctcgacgggatcatgccgcagaccgccgaacacgtgctgctcgcccggcaggtgggcgtcgaccacatcgtcgtcgccctgaacaaggccgacgcgggcgacgaggagctgaccgacctggtcgagctggaggtccgcgaactgctcaccgcgcacggctacgggggcgactccgtaccggtcgtacgcgtctccgggctgaaggccctcgagggggacccccggtggacggcggcgatcgacgcactgctggacgccgtggacacctatgtgcccatgcccgagcggtacgtcgacgcgccgttcctgttgccggtcgagaacgtgctcacgatcaccggccggggaacggtcgtcacgggagccgtcgagcgcggcacgatccgtgtcggcgaccgcgtcgacgtgctcggcgcctccgtggagacggtggtgaccggcctggagaccttcggcaagcccatggaggaggcgcaggccggggacaacgtggcgctgctgctgcgcggggtgccgcgtgacgcggtgcgccgcgggcacatcgtggcggcgcccggcagcgtcgtacccagccgccgcttctccgcccgggtgtacgtcctgtcgacgcgcgagggcggtcgtacgaccccggtcgccaccggctaccggccgcagttctacatccgcaccgcggacgtggtcggcgacgtcgacctcggcgagacggcggtcgcccggcccggcgacacggtcacgatgacggtctccctggggcgtgacgtcccgctggagcccggcctcggcttcgcgatccgtgagggcggccggacggtcggtgccggcacggtgacgaccgtggaggactgaccgtggactgaccgggggtgtcggcgacgggcggtggcgcgcgggccgccgcccgttccgttcggccgcccgttccgctcggtcgcccgttccgttcggccggccgtccggaggtccgcccggacggccggcgcccgcggcccggcacaatggacccgtggacgagccgatacccgtgacacgggacgtggatcacgggaccgccaagctgatgcccgacgtcgaccggcggcgggcctggctgctgaccgtcgacggggccccgcagtcgtatgtcgatctggacgcgccgacgcatctggagttcgagtacgcgcggcggctcggccatgcgctggacacggtcgccgagccggggcgggccctggacgtgctgcatctcggcgggggcgcgctcaccctgccgcgctatctcgccgccacccggccgggatcgcggcaggacgtgatcgaggccgaccacggcctgctggacctcgtcgtcgagcagctgcccctgcccgccgacgccgggatcgcgctgcaccgcgccgacgcccgcgcctggctggaagcagccgtgcccgactccgccgatgtcgtgatcgccgacgtcttcggcggctcacgcgtcccggcgcacctgacgtcggtggcgtacgcgcgcgccgccgagcgggcactgcgcgacggcggcgtctacctcgccaacctcgccgacgcggcgcccttcgcctttctgcggtcccaactggccacgttcgcgacggtcttcggggagctcgccgtcatcgccgaacccgccgtcctgcgcggccgccgcttcggcaacgccgtgctcctcgcctcccaccgtccgctcgacacggccaccctcgcccgccgcaccgcctccgacgccttccccgcccgggtcgaacacggcgccgcgctccgggacttcatgggcgccgccgagcccgtgcacgacgagaacgccgtaccgtcacccgagccgcccgacggagccttcggcatcggctgacccgcgcccggcgtcggccgccccgctctccggcacttcctgcgccaccgccttcgtccggcgcgtcagattccgtacgtccggcacgaacagcaccgccacggtgaccaccacgaccagcgtcgcgcagccccacagcgcggtcgtacgcccgacggcccgttccgccggtcccgccagcgccgtggcgagggggaccatggcgacggagccgaaccagtcgtacgcggagacgcgggagagcttctcctcggggatctcctgatggagcgcggtcatccaggaaacgccgaagacctcgatggccacgccggtcacgaacatgaccgcgcacaggccgcccaccggcaggggcaccgccagcgcggcggagggcgcggccagtgggaagacgcagagggtgcccgcgagcagcagccggcggggtttccagcgcgtcatcagcagcgcgccgccgaccgtgcccgccccgaaagcacccagggccagaccccagggccccgcgccgcccaggctgtcgcgggcgaccagcgggccgtacaccgactcggcggcgccgaccaccgcgaccaccacggagaactgcgcgacgatcgtccacagccagggccggccggtgaactcccgtcggccgtcgcgcagatcggccagcagtccgccgcccggctcgcgcggcggaatgtggctcacatcgaggaaggaccgcagcgagccggcgaccgcgaacgccaccgcgtccacggcgagcacccagccgggaccgatcgcggcgaccatcgccccgccgagggccgcgccgccgagagccgctccctgcatcgccatccggaagagggcgaaggccctgctcgcctgctcgccgctgaccgaggacatcagcatgccctcggccgccgggctgaagaacgcctgtccggtgccgccgagcgcggccagcagcatcatctgccacaggcgcggttcgccgccgaggacgagtgccgcgaaggcgccctgcgagaggaagttgagggcgttggccgcgaccatcacgcggtgtcgcggcagccggtcggcgaccgcgcccccgatcagcaggaagagcaccaggggcagcgtgcgcgccgccgccaccagtccgacgtcgcctccgtcgccgcccgtgtcgagcaccgcgaacgcggccgcgatcagggcgccgtggctgcccaggttcgtgacgaccgcggcggcggccagcagggtgtagttgcggtccgcccagtcggggcggcgagggcggcgtgtgcggcgagggcgtccggcggagtcggcggcagaggtcaccggccgactatcgccggaccgcaccgggcctgccaaaccaattgcccggccgggtgccgaaccacctgcccggccgggtgccacggcatctgcccggccgggtgccacggcatctgcccggccgggtgccacggccgttcgcgcagtgcgaaggacagggcacccggcaacggcacgcggctcagctctccgacgggtcgccgtgcagtcgcacggtgctgaggaccttcatgatcgtcgcgtcggggacttcctcgttcacgcccgtggctccgaagaagttccacgcgacgtagtcacccgcggagttcttgaacccgaaggtgatggccttgccgtcgctcgcgcacttccccttccggggcgtgttcttggaacgggcccaggcgatgctgccctcgatgcccgccgccgtcttgtacggcttcgccttctcgtcgaaggtcaggctcttcttgtcgggctgcgtgtaaccgccgtacacccaccaggccacctggttcacggcgacctcgtcggtgttcttggcgccgttggcgcccttggtgcccgccgccgcaagggacgtgtcctcggtcctgccgtccttgtcctcgtcggacgagcaccactgctctttgaggacggcggtaccggtcatggtgacgaggggcttggtgctctcgcccgactcgtcctcgaaggcgatgaacacgccgggcgactgcacttcccagtccgccggcacgtcgaacgccgtgccccacttggggttgacgacgaccttccagcccttgatggtcggcttctcgtcgtcgccgccgcgcgggttgtcggcggagacggacggactcgggtccttggacgcgctccccgaggccttcgcgtccttgccgccgtcagccttgtcgtccttcttgttgcccaggaccaggaaaccggtgacaccagcggccacgaccacggccgtggccgcgacgatcgcgacgaccttggtccggtttccgccaccgccgccaccgccgccgggtgactgcggcgcgcccgcgggtgccggggtgccccaccccggctgccccggctgaccgggctgctgcgggtaggcgttcggctgctggaatccgggcggctgctggtattcaggctgctggtacggattcggctgctggtaccccggctgctggtaggggttctggtcctgcgggttctgctcgcccccgggcggctgctgtcctggccacatgggcagtaacactagtgccgtctgtgacacgttcaggtcactgcccctcgtcggacaggtaccggatcaggagtccgacgggtccttgtagaggcggacggtgccgaggatccgcttcaccgtcgcgtccggtacctcgtcggatacgcccctggcgccgaagaacgcccacgacacgatgtcaccggcgtcgtccttgaaggcgaacaccgtggccttgccgtcggtcctgcattttttcgatttctccacacccgacgacgacgcggtggccagactgcccgtgatgccggacttggtcgtgtacgactccaccgcaccggacgtgaccagcttcttgtccggctgggtataggcgccgtagacccaggtcgccgcgtcgtcgcgggcggcttccgcgggcgtcttcgcgccgttgctgcggcggctcccggcgccggcgagcggtgcgtactccttggtgccgtccctgtcgtcgtcggagccgcaccactgctcctcgaggtacgccggagcggacatgccgatgaggggcgtgtcgtcggggtcgtcgttctccgacacgtacgtgacccagctgctcgccttgagggcccactgggccggcacgtcgaacgcgatgtgccgctgcgggttcttcacgaccttccagcccttgatcgtggcccggtcggtgtccgcgccgcgcgggtcgctcgaactgggccgcggggaaccggacttcgtggggtcggggtccgccctgtcgtccttgcctccgccgagcaggacgaatcccgtgaccgcggcggcgatcacgacggccgccgccgcgacgatcgcgacgaccttggtccggttcccgccgcccgcaggcgcaggcaccggcgcacccgccggctgcgtgggggcgttccacggctgcggctgcggctgttgctcatacggattcgtctggtggtatccgggctgctggtacggattcggctgcgccgcgtccgccggcggctgctgcggattctgcccgcccccgggcggctgctctcctggccacatgggccgtaacgatacggcggcccgcgacaggacctggtcaaggttggctactcgtgggtaacatgcggttcatgagcgcagaccagatgtcgatcggcgagatgctcgccgccaccgtgccgatggccaggaccctgaacctcgagttcctggagacctcgccggagaaggcagtggtggccctgccggaccagagcgactatcacaaccacgtcggcgggccgcacgccggagcgatgttcacgctgggcgagtcggcgagcggggcgatcgtgctggccgcgttcggggagcagctcgcgcgcgccgtaccgctcgccgtcagcgccgagatcgcgtacaagaagctcgcgatggggccggtcaccgccaccgccacgctcggtcgccccgccaccgaggtggtggccgaactcgacgccggccggcgccccgagttccccgtccacatcgccatccagcgcgcggacggcgccgtgaccggcgagatgaccgtcgtgtggaccctgcgccccaacggctgaggccggtccgcagtcgagccgggggcccggccggggggtacgccccggccgggcccctcgccgtaccgcggtcgtccgcgttcagaaccgcagataccggctggcgtcggaagccgcggcggcgcggacgctgaggacgtcgggccgctggtcgttgaactcgctgcggtagttgtactcgtacagcgtgacccggccgtcgtcgcgcaccgcggcgacgtacgccacatggccccggcggccggtgccgtgcacgccggggtcccactgcgcgatgtcgccgacgtggggcacggagctggtggcggcgcccctccagtgcccggcgtcacccagaaagtcgggggactcggtgtgggggtggccgtcggcgcggatcgcccaggcggcgaaggagacgcaggagcgcttgaaatagccgtgcccgtcgagttcccgggtgccgtgcgcgttcttccaccggtaggcggtggggtccagtgcggtggtggccggggcgggcgcggaggagacgggcccggcggtgggcgtggcgtgtccggtggagccgaagaggacgaggaaggccgtggcggtgactcccgcggccacgacgcgcggccacttcttcgacgtgcgcctgtgcatggggggttggtcctttcgcggagcgtcctgcggtcattcgtggtcggtgccgacgagggcgcgcacttcgaagtcggcgtagcgggcggagtcctggtgccggcccggaacactgcccagccagccgaggagaaagcctgccgggatcgagacgatgccggggttctgcagcgggaaccaggcgaagtccacatcggggtagagggaggccggtgtggaggacaccacgggggagaacaccaccaggagcacggagcagatcagtccgccgtagaggctgagcagcgcgccccgcccggtgaagcgccgccagaacaggctgtagaccaggaccggcaggatggccgaggcggcgatggcgaaggcgaggaacgccagtgtggccgtgctgatctcccaggacaccagggcgagcagcatgccgaggacaccgacgaccacgccggacagccgggcgacgcccagttcctccgcctgggtggcccggcccttgcggatcacctggccgtagaggtcgtgggcgagcgaggaggccgcggcgagggtgagcccggccgcgaccgccagcagggtgacgaaggccaggctggagatcagcgcggtcaggacaccgccgccgagggactgggcgagcagcagcacggccgcgtcgcccttcgggtcgatcctcgcgatggcgtcccggcccacgacggccgtggcgcccagaccgagtacgcccgccgccaggcagacgaacccgaccaggcccatggcccagacgaccgaggcgcgcaggacccggccggtgcgcggtgccaggagccgcatcgccacgtgggggagggcggcgaggcccagcacgatcgccagttgcaggctgaagaagtccagcttgctggtcgtcccgcccccgtagcgcagtcccgacgccaggaagcgctcgccgactccgctgttgtccgcggcggccgcgaggagcgcgtcgacgttccagcggtagtggtgcagcaccatgaaggccgtgatcgccactccggacacgagcatcaccgccttgacgacctggatgaaggtcgcgccgggcatgccgccgagggaggcgtacaccacgacgacggtgccgatggcgaccacgcacagggtgcgggtggtgccgctgggctcgcccacgaactgtgtcagcagggcgacgctgccgacgagctgggccacgaggtagagggtggtgacgacgagggtggtgacggccagcgccagccggaccggccgctggtggtgcggcagacgcagggcgagggtgtcgccgagcgtgaacctgccggagttgcgcaggggttcggcgatcaccagcaggaccaggacccacgcgacggtcgtcccgccgaggtagagcaggccgtcgtagccggtgagggcgaccaggccggtgctgcccagcagggtcgcggccgacacatagtccccgcacatcgcgaggccgttgcgcagcggggacatgttccggttgcccaggtagaactcgctgatctcgtcgcgctgtggggccgtcagcagcgccgcgaacagcgtcaccacgacgaccgagacgaagagtacgagcgtgagccgcagggtgaactcgtcgatcacaccggaggagacgacgacaccggaggagaagacggcagcggcggagtcggtcaccacgagcggtaccgccgcgggccggggagagggggctgctcggcccggcgccggtccagctgggcgcgcaggccgcgcgccaccgggtcgacgcgcctgcgcatgtgcaccgtgtggcgccatgcgaccagggccaggacgacgaactgcacgaggccgagagcgaggccgacagtcatacggcccgccagcggctggttcagcgcaccgggggcgaagccggacagcaggacgtacagcagatagccgcccacgccgagcgtcgccgccctggccccgaagcttcggtgagcgcggcgcatggcacggaattcggggtggtcgtgtatcgcctgtgtgggcaggagttccgggtcggcggggggcggtggacgaagactgtcttgtggtacggagtgccaggacatgtcgcaccttcttcactgctttatgccgcacgcccggctctgtcgagccatggccattccccttcggcgcggaacagaacagagatgagccgtggtcatctttttcccgggggaaatggccgacggacacttctgttcgccgaagtcaggcgcttgtgcggactttgtggggagttcgtgaattccgtcggccgggcggctttgtggcggccgaggcggccctgtccggggtggagaccaggccgaaagcggagtatggcagcggtgacattgaataatcaactgctcgtgtgaattcttcagggcgactgcgccatgcgcatattccccggcccgttccgggtgctcttcggcccgtcggcggccgatacggggattttgaagacgccggttttctctttcggtcggctcgaatgcgccgcacgaatcgcccgcggccgacgggcgtgaccggtcgggtgaggggcgtcgaatccacgggagcagggggcgagccgcgggactccgccgtcgtacgccgagcgggtaggcttcccggcgtgcgcacacatgcgcaccagggggagcgaacgccggggggtcacgcccggccggcaccagactcacgtacagcgaaacgggaggaagcggcgttgcacgtccaggaatggctcgagacggtgcccgcggtcagcatctacgcgctggtgggcctggtcatcggcctggagagcctgggcatcccgctgcccggcgagatcgtcctgatctcggccgcgctgctgtcctcgcagcacggcggcatcaatccggtgatcctcggcatctgcgccacggttggtgccgtggtcggtgactccatcggctacgccatcggccgcaagggcggacggccgctgctcgcctggctcggcaacaagttccccaggcacttcggcgaagggcatatcgcgaccgccgaacggtccttcgagaagtggggcatgtgggccgtcttcttcggccgcttcgtcgccctgctccggatcttcgcgggcccgctcgccggtgtgctgcggatgccgtactggaagttcctgatcgccaacgtcctcggcggcatcatctgggccggcggcaccaccgccgtcatctactacgtcggtgtcgtcgccgagtcctggctcaagcgcttctcctatctcggcctggtcgcggccgtgctgatcggcctcgcctcgatgctcgtcatcaagcggaaggccaagaaggccgcggccgagcgggaggcggccgagccggagaccgtcccggccgcggactgacgctcagtcctcctgcgcgtgcaccgcgcggtgcgacttcgccagttcgacgtagtacgtgccgttcagcttgatgccctcgcgctcctcgtcggtcagcggccgcttgaccttcgcgggtacgcccgcgacgagcgagcccgggggcacccgcatgccctgtgggaccagcgcctgcgccgcgaccagggaacccgcgccgatcacggccccgttgaggacggtggcgcccatcccgaccagacagtcgtcctccaccgtggcgccgtgcaccacggcgttgtgtccgaccgagacccgctcgccgatggagatcggaaagccggggtcgacgtggagcgtgcagttgtcctggatgttgctgtccgcgccgacgacgatcggaccgcagtcggcgcgcagcaccgcgccgtaccagaggctcgcgcccgcgtgcagcgtcacctcgccgatcaccacggacgtgggcgccgtgaacgcctcctgatccaccttcggatccttgccgccgatgcccgtgatcagcgccttgtgcgtcatggccgtcccctcttccgtcgtcggtacaccggcaccgtatgtcatcgtccgaggtcccggccgggcccggtggggctcctcggggagctccggggaagctccggtggggcgaagatcacagccgtacgtcgtcatgggcgccccgcgcgctgagtaccgtgagcgggtgcccaggagcaagaacacgttctcatcatggcggcgccgcctcgcgcagcgcgccgtccacgcgggctgggcctgggcacaacgaacaggggccgtgagcgccgagcaccccggacggctccgtttcggcgcgatgggaacagctaccagactcgccttcccgcagggcaccgtcttcggtgagccctggatccacctcggctcgcactgcatcatcgccgaacaggtcaccttgaccgccggtctgatgcccgacctcgacctcggccccgacccgatcctgcgcatcggcgacggggtcgtcctcggtcgtggcagtcacgtcatcgccgacaccacggtcacgatcggcagcgactgctacttcggtccctacgtctacgtgacctccacgaaccactcgtacgacgatcctcacgagcccatcggcaagcagtggccccgtatggaacccgtgtcgatcgggtccggctgctggatcgggacgggcgcggtgatcctgccgggcgcccggatcgggcggaacgtcgtggtggccgccggagcggtggtgcgcggtgtggtgcccgaccacgccgtggtggccggggcgcccgcgcgggtcgtacgacgctggacccccgccgacggctggcagccgccgctgcggacgccggcgccggtgccgatccccgaaggggtcacccccgagcagttgctggcgctgtccgaactcgacgacgagagtgccgcccggctcgcggaactcgacgtcgagtcctgatccgggcccgcgctcagcccgtcgcgagcagcagtgtgccgaccagtgcgaggcccgcgcccgccgcctgcacgccgcgcagccgttcgctgaggaagccgcgtgcggccagggccgtgatcaccgggtagagcgaggcgagaacggcggccacggtgaccgggccgtgctgggcggcgatcgagtacgtgccgttggcggcgacatcggccaggccgacgaagccgagcgcgggcagcgcacgccaggggaagccgctctcaggaagggcgggggcgccgcgccgcacggcgatgaacagcgcggcgccgcccgcggccacattggtcacgcgctgcacgaacagcgccaggaagagaccggtgaccgtcgtcgaggcctccgagatcagcgacatgaccgcgccgaagcccaccgccgccagcagggtgaggaagacggcccggcgctgcacgggcgcgcccttcagctggggcccgcccgcgagcacgacaccggtgacggcgaccgcgacgcccgcgaactgcaacagtcccgggcgctcgccgaggacgagaccgacgcccaccggcacggccacgccgagggagccgagcggcgacaccacgcccatcgggccgagcgccagcgccttgtagaaggagagcatcgcgaccggtccgaccagtccggcggcgacggcgaaccagagctgcggacccgcctcgctccagccgccggtggcgacgacgacggcgccgagcacgaccaccgcgatcgactgcgagacgacgaccaccgtcagcgcgggtgtacgtcgggtcagcagtccgccgccgaagtcggccaggccccacagcaggctggtggccagggcgaagagtgccggcagtgcggccatcgggcgcctcgcagtacagttcggtgaacaatcaggtgcaccacaccatagttcattgcattgaactctgtcatccagaatattggacggaatgtgtcggacctcgacctgctgactcagtccctggcgcgcaatgtgaagcgctggcgcaccgagcgcggcttcaccctggacacgctcgccgcgcgggccggggtcagccgcggcatgctcatccagatcgagcaggccaggaccaaccccagcatcggcaccgtcgtcaagatcggtgacgcgctcggtgtcagcgtcacgacgctgctcgactacgagcaggggccgaaggtccgtatcgtcccggccgaccaggccgtacggctgtggcacaccgacgccggcagctacaaccggctgctcgcgggcaccgaggcgcccggcccgctggagatgtgggactggctgctgatgccgggcgagggcagcccctccgacccgcacccgaacggctcggtggagctcgtccatgtgacggccggggagctgaccctcaccgtggacggcgtggtgcaccacgttccgacgggcgcgagcgtctccttcgaggccaacgtgccgcacaggtacgcgaattcgggtgacgcgccactggagatgatcatgacggtgtcggtcccgccggtgcgctgagacgccgtccgggaggcgtgggggctgctgttagcgtgccgtcatgcgcgcacccatcggagacttcgaccacgccacgcccgccccggacagcctcgacgaactcacccgcccggtcgccgacgccgtacgccactggcgcggcagcgtccccgccgaccggatcgtgtacgtcgacaccgaaccggagtgggccgacacggccgtcttcctggagcactacggcaaggacctgctcgaccggtcggccaactgcgtggtcgtcgcgggcaggcggggcggcgagaccgtgctggccgcatgcgtggtcctctccgccacgcgcgtggacgtgaacggcgcggtccgccgccgactcggcgcgcgcaaggcctcgttcgccccgatggacacggcgacgggggagaccgggatggagtacggcggcatcaccccgatcggactgccgggcggctggccggtgttggtggactcggcggtcgtcgatcttccctacgtcctggtcggcagcgggcggcggagggggaagctgctggtgcccggcaaggcgttcgcggagcttccgaacgcggtggtgctggaggggctcgggatctgagggtccggggcggttcgggcttgagggtggggcggctcgggctctgagagtccggtcaggccgccgtcaccgagggatcggtgtggtgggcgagcgccagatgggggtccgtctcgcccggcagcggtgccggatcggcgtgcaccagggcggcggtgagtctcggaacggcgtgcaggagggcgtgttccgcctcgaccgcgatgtgatgcgcctggcgcacgctcacctcgccgtcgacgacgacggccacctcggcccgcagccggtgcccgatccagcgcaaccgcagctcaccgacgtcgcgtacgccgggcacctcctccagtgcccgctcggcccggtccaccagcgccgggtcgacggcgtccatcacccgccggaacacctcgcgcgccgcgtcccgcagcaccagcgcgatcgccgccgtgatggccagccccaccagcgggtcggccgccggccagccgagcgcggcgccgcccgcgcccacgagcacggcgagcgaggtgaatccgtccgtacgcgcgtgcagcccgtccgcgacgagggcggccgagccgatcgcgcggcccacacggatgcggtggcgggcgacccactcgttgcccgcgaagccgatgacggccgcgagggcgacgacgggcagatggttcagcggtcgcggctccagcagccggtcgatggccgcccacgcggtgaagaccgccgacgccgcgatggtcagtacgatcgcgatgcccgccaggtcctccgcgcgaccgtagccgtaggtgaaccggcgcgtcgccgctcgccggcccaggacgaaggcgatgccgagcggtacggcggtcagcgcgtcggcggcgttgtgcaccgtgtcgccgagcagcgcgaccgacccggagagcaccaccacgaccgcctgggcggccgccgtcaccccgagcacggccagcgagacccagagcgcccgcatgccacgggccgaggactccagggcggagtcgagcttgtcggcggtttcgtgggagtggggggtgaggaggtggcgcagacgcgggaggagggtggtgggtctgtggtggtgagcgtggtcgtgggcgggtgcccggtccggtccgtggtcgcgggaacggtcgtggggctgtgcgtcggggtgtgcgtgggggtgtgcgtgtgcgtgcgtgtgtgcccggtccggtccgtgatcggggccgtggctgtgggcttggtgccggtcggtcacgtgcgtggtcccttccgccgggcggggagtggacgcggtcgcctccacggaaccattatgtgcgtatgaacgcacgcatgcacctaccacctgcgcatggtgcgcactcgcgcacgggcggcgagcccgaggcgcacccacgaacccccggcgaggagcagttcgtactcgccgccgaactcctcgccctgctcgcggaccgcacccgtctcgccctcctgcacgccctgactggtggggaggcggacgtctcgacgctcacgcaggtgtgcggcgcggcgcgtcccgccgtgagccagcacctggcccggctccggctcgcgggtctggtgaacacgcgcaaggagggccgccgcgtgatctactccctgcgcgacggtcatctgcgccgggtcgtggacgaggcgctgagcctcgccgaccaccgcctcagcgaccggcccgcgcatgactgagccgcggggcggcgcccgtgcccgtgtctggcgggcgaacgggtgccgaacgcggcggggtcgcgcgtgggcatgcgagaacggccgtgggccgaggctttccgcctcggcccacagccgtcgcgcgtatcgggccggctcgctcgccggccgggtgatcaggccgcggcgggcgcggcctgcgagctgagctgctcgatgaccttggtcaggccctcgacgacctcggcgtcgtcggccgggtggagctctgcgaagcgggtcacggagccggggatggacagcttgacgtcctccaggaccgtgccgcccgcgatgcccgcggccttgcgggtgtcgtcctgcgcccacacgccgccgaactggccgaaggccgtgccgaccacggcgaccggcttgccggacagcgcaccggcgccgtacgggcgggacagccagtcgatggcgttcttcaggacggccgggatcgtgccgttgtactcgggcgacacgagcaggaaggcgtcggtcgcgccggccgcggcacgcagccgggcggcggccgcgggcacgtcgccctcgacgtcgaggtcctcgttgtagaacggcacgtcggccaggccctcgaagagctcgatctcgacgccctcgggggcgtgcttgacggcggcctcggcgagctggcggttgtgcgaaccggcgcgaaggctgccgacgagcgcgaggatacgtacggacatgagctaactcccaggatatgcggtcagagccaagcggaccggggtccgtttaatgttgtagcacctaaacggaccgaggtccacttgtcctggtggagcgctaacctgaatccatgacccagctgctcccgcccttccccgcaccgcaggacgaccccggcgggcgaacggacctcaccctgacgcccggtggcgagacgccgcagctcagggcggacgccgcccgcaaccgcagccgtctgctggaggtcgccgcccgcctggcggccgagcgcggcgccgcgaacgtgaccatggaggccgtcgcctgcggcgcgggcgtcggcaagggcacggtcttcaggcggttcggcgaccgcacgggactcctcgaggccctcctcgaccaccacgagaagcagctccaggccgccttcctcaccggcccgccgccgctcggcccggacgcccctccggtcgagcggctgcgcgccttcggctcggcggtgatccgccgcgaacacacgcacagcgacctgtacctggccgcccacgcggaggcggcgcgacgccacacggctccgccgtaccagctccggctcacccacgtctgcctgctgctgcgccaggcgcggacggagggcgacatcgaactcgtcgcgcacacgctgctgggctacctggacaccatcctcgtcgaccatctgctcacccggcgcggcatgaccctggagcgggtcgaggccggctggtacgacctcgtcgaccgatgtacgggcgggcagagccgatgtagtacggggtgacgcccctccggcaccgatgatggggccatgaccaccccgggcagaagagccgagatgttcgtcgccgccgaccgcgatccccgcgtcctcggccccgcgaccggtaccgaacgcaccctgctcgtcgacttcctggccgcccagcgcgcgacgcttgagctcaagtgctcaggcctggaggcggagttgtcgcaacgctccgtggcaccctccaccctctcgctgctcggtctgctgcgccatctcgccgacgtcgaacgccgctggttccgtcaggtcatggccgcacaggacgcgccgccccgcttctcctcgccgtccgaccccgacggcgacttcaccggcgccgtccccgacctgtccgtggtcgccgaggcctggcgggcctggcgctccgaggtcgccttcgccgaggactacgtcgccgaggcgccccacctcgacgtcgagggccacgactcctggcgcggcaccgtctccctgcgctgggtcctcgtgcacatggtcgaggagtacgcccgccacaacggccacgcggacctgctgcgcgagcggatcgacggggcgaccggagtgtgacgcaacggtttacgtttccgcaggtcagcggcgtgttaacggagatgacaacggtcaccggtgcagcctttgccgatcagcaccgcgatgcgtttgactgcggtggaggcacccgacgcgagggggaaggcgcacgacatgagcgaccacggccatgaccacggcccgcacggccataccgggcactccgggcactccgggcacgccggtcactcccacggagtgtcggcggacgccgaccgccggtggctggggatcgcgctcgctctgatcaccctgttcatggcggccgaggtggtcgtcggtgtcgtcgcgagctcgctggccctcatctcggacgcggcgcacatgctcaccgacgccgcctcgatcgtgctcgcgctgatcgcgatgcgactggccgcgcgcccggccaagggcggcttcacctacggactcaaacgcgcggagatcctctccgcccaggccaacgggctgacgctgctcctgctgggtgtctggctggcgtacgaggccgtacgacggctcgtcgagccgcccgacgtcgagggcggcctgatgctgatcaccgcgctcgccgggatcgtcgtgaacgtggccgccgcctggtgcatctccaaggccaaccgcacctcgctcaatgtcgagggcgcctaccagcacatcctcaacgacctgttcgccttcatcggtaccgcgatcgccggcctggtcgtcgtcgtgacgggcttcgcccgcgccgacgccatcgccacgctcgtggtcgtggtcctcatggtcaaggccggctacgggttgctgcgcgactccggccggatcttcctggaggccgcaccggccgacgtggacccggacgcgctcggcgacaagctcgtcgcgcaggcggccgtcgtcgaggtccacgacctgcacgtctggcagatcacctcggggcaggccgccctgtcggcccacgtcctggtgcagcccggcagcgactgccacgcggtccgccgcgacctcgaggaactgctgcgccaggactacggcatcacccacacgacacttcaggtcgaccacatcccggaacagctcctccaggtggccctgcgcggcgaccggatcccgccggacggcgcgccgcactgcgaggacgcccacgggccggtccaccgggaggagccgcacggacactgacgccggcgcgcggcacagcggtaggcggtaggggggcggacggccttgtgcgggccaaggcccgggaagcctggggcggcgcgccggccgggggcccgggccggcgctccgtccggcgcaggggcccggtctgacgcaggcactcggtctgacgcagggacccggtctgacgcaggcgcccgatctaacgcaggcgcccgatctcgatcgccgggcaccggtccatcaccatgtccaggcccgcttcccgcgtccgctcgtacgccgcctcgtcgacgaccccgagttggtaccacacggccttggcgccgatcgtcacggcctcgtcggcgacgggccccgccagatcgctgttgacgaacacatcgaccacgtcgaccgggaacgggatcgcctccagggacgggtagccctgctcgccgtggaccgtctcggccttcggatgcaccggcacgatgcgcttgccgaagcgctgaaggacgtccgccaccccgtacgccacccgatgccggttcgaggacaggccgacgatcgcccaggtgtcaccgagctcggtcaggatcttgcgggtcgttgctgagtcgccgtacacggccggtctccttcgacgtcctgcgggctcgtcccgcacgaggcttgctgtgcctggcaacagcgggccgttcgccgggattcccccgggtgtcggaggcgcacacgggcgcgccggtgggacgcgcgcgcgagcttggacggcgtacgcatgtccggaacggtccccacctccctgcgcccgagggccctggcgcctacgctcaccccgtgctgcgtatcaccgacgccggaaccggcgagcccaccgacgtccgaccaggcctgaccaggatccacgcgcatgtggcgcgggccgacacgtccgccctgcgcgtgctgctcgtcgccgacgtgctcgcccgtgccctcgaactcggcgggacccccgtcgtcatggtcgccgacccgcccgccgaactccgggcgcgcgccgacgcgctcggcatccggcgcgcggagaccgacaccctgggcggcgggcggatcctgcacgtgctcggtcccgaggaccccgtcgtggacggcatccgcgtcgaggtcgccccggcgggcggtccggccgactccgccgagtctgccgggtcctcctccgccgtacgcctcgccctgctcgcccacccccgcagcagccccgccgacctcgacagcggcgcgctgaccgaggctcaggagacgctcgcacgctggcgcaagaccgtcgccctgtgggcgaaccacccctccaagcccatccccgaacacgtacggcaggaactgcgcgccgcctgggaggacgacctcgacctcccggcggtcctggacgtgctgcgacgactggagggcgccgacgacgtgccggacggcgcccgattcgagtcgtacgcctacgcggaccggctcctcgggctcgaactcacccgggagatcggggcatgggcatgaacgcgccgcgccccggcacggggccgctgcgcagactcgtggtgcttcggcacgccaagtccgcctggcccgccggggttgccgaccacgacagaccgctcgcaccgcgcggccgccgggacgccccggccgccggacgtgtgctcgccgaggccgacctcctgcccgacctcgccctgtgctccaccgccgtacgcgcccgccagacctgggagctggccgcggcgcagtggggcaccccgccggccgtacggctcgacgcgcggctgtacgcggccgacgcgccggacctgctcgcggcggtgcgcgaagtgcccggccaggtggggacgttgctgctgatcgggcacaacccggggctcgaggaactggtcctcgaactggccggggacggcgtcgacgacacactggaccgcctcggcgtcaagttcccgacctcggcgatcgcggtcctggcctggcacggcgagtcctggcagaccctggcccccggcacggcactcctgacggagctgaccgtcccccgaggccacaagcaccgctgacctagggcccgttgcgcgcgtggcaggcgccacttccggaacaggccctagcccacgtggacccggggccggcgttgcggatcgggttccgcgcggcgcaggacctcccgggtgaccggggcgacctctccgtcgccgaagacgaggaagcgcagcagttggctgaacgggttgccctcggtccagttgaagtaggcgtgcgggacctcaccggtgcggtcccgcagctgcatcaggacggccgcgatggtgttgggcacggtcgcgccctccacgcgcagcctgcgcaccccgtgcttctcgtcgccgtggacggccagatcggcggtgaagtccgaggagtccgtgacgaagacctccaggaagagcaccggacgcccgtccgggatgtgggtctgctcgcgctggctgtactccttggcgcggtactcgcgcgtgctgtgttcctgcggctcgttggcgatcagccggagaggcccgctcgccgcggcctcgtcgaggaaccgggaggccgtctcgtcgaacgtgacggcggcggcccgcagttcgaaggcccggcgcacacgggaggcgaacgaggtgatcaggatggccaggatgaagatcgccgcgatcttgatgccgtccggccgctcgatcacgttcgtgaccagcgtgtaggcgaagaccgcggtgatggcaccgaacccggtcgcggcgccccggtggccgcgcttgtgcacggcgaccgtcgacgcgaaggacgcggagagcatcaggaccaggacgccggtcgcgtacgcgccgctctggtcgtcgacgttcgcgttgaaccacagcgtgatgaagaccgcggccgccatgaagaccagcaccagggggcggaccgcccgggtccattccggggccatgccgtaccgcggcagatagcgcggcacgagattgagcagtccggcgagcgcggaggcgcccgcgaaccagaggatcgcgatggtcgcgacgtcgtagaccgtgccgaaggcctcgcccaggtgctggtgcgcgagatacgccagcgcgcggccgttcgcggcgccgccgctcctgaactcgtcctgcgggatcaggatcgtcgtcgccagactggagagcagcaggaagcagctcatgatcacggcggccgtggtgagcagcttgcgggtgtcgcggatccggcccgtcggcttctcgtaggtgtccgtggggtcgccctcgacctgcggcatcaccgcgacgcccgtctcgaagccggacatgccgagcgccagcttcgggaagacgagcagcgccacggcggccatcgcgagcggagaggagtgttccgtcgtcatcgcgtcggtccagtcgccgatcttgaccgggtggctcagcacctcccacgccgagacggccagaacgacgacattgagtgtgagataggtcgccaccagcgtcacggcgatgcccatggcctcacggaagcccttgaggaagaccgcccccagggccgtgacgaggacgagcgtgatccaggtgttcgcgccgtgcagccagtgcggagcgaacggattctccacgacgtgcgccgcggcgtcggcgccggagagcgtgatcgtgatcaggaagtcggtggccgcgaacccgagcagcaccaggacgaagatcttccccgcccaccagggcagcagccgctccagcatggcgatggaaccctcgccgtgcggactctcgtgcgcgacccggcggtagaccggcagcgcgccgagcagggtcagcgcgaccagcacgagcgtcgccagcggcgacagcaggccggccgcgagcgccgcgatgccgggctggtagccgagcgtggagaagtagtccacaccggtcagacacatgacccgccaccaccggtgccccgcgtgcccctcgtcggtcgtggcgtgcgggcccgggtgccgggccgtctgctcgctcaggccctccaggagccaggcccgccagcggggcgtggcggcggagggccctggttcgtcgggctcggcggtgtccttactgtccacctgcgtgccgctcatgctgcgatctccctgacctggggccttcggacaacgacgagcgagtatccaccacacggccgcccgcacccccgccgggggcgaccggacggcccggacggaccggacggaccgggcggaccggacggaccgggcggaccggacggcgcggcggcagtgcgctgcgcacgcacgcgtgacacgtgccctgatccggctgccgcacgcgcgcgtgcggtgcgcgttcgatccgtggtgcgatccgtcgtgccgcccccgcgcgcgcaccgcatacgctggcgtgatgcaggacgagtaccgcacagtcgcccacgcgggcgtgcacgagaccgagatcaaccgctcccgcttcctgtgcgccctcgccccggcggccaccgagcaggaggcccaggacttcatcgcggccgtccgcaaggagcacgcggacgccacgcacaactgctacgcgtacgtcatcggcgccggtgccgccgtccagaaggcgagcgacgacggggaaccgggcggcaccgcgggcgtccccatgctgcagatgctgctgcgccgggacatgcggtacgtcgtcgccgtcgtcacccgctactacggcggggtcaagctcggcgcgggcgggctcatcagggcgtacgggggagcggtgggcgaggcgctggacgtgctcggaaccctcacgcgcaaacgcttccggctcgccacggtgaccgtcgaccaccagcgggccggcaaggtgcagaacgacctgcggtcgaccggacgcacggtgcgtgacgtgcgttacggggaggcggtcacgatcgagatcggcctcccggacgccgacgtggacgccttccgctcgtggctcgccgacgccaccgccggcacggccggcttcgaactgggcggcgaggcatacggggacgcctagcgacacagcgacacagcgatacagcgatacagcgacacagggatacgggatacggggacagtgaacgggcgctccgcccagtcggcggcctgtgctgatttccggagtcatggcgacttgtgtgcatcccggccggttcgggccgcagtggcacgttcaggacattcgccgtgcgtggtcatggcatcatgggtgaaaagtagtactccgccgcgtcggcgcggtcggcttctttttttgtcttgcacccggctcgttcctgcaattcattcggctcgtgcccgccgagaattcctcgatgcgtgccctgtcgaggaaggttctccatgaaccgttcagctcgcacgaacgaccgcttctccaacacccgtaagaaggatggctccgccggttccggccggggcgcccgctcgggtggcaacgggcgccgtccctccacaccgcagggggagttcgcgttgccggtcaccgtcacgccggccctccccgcggctgcgacgttcggcgagctggacctccccgccgagttgctgaagacgctcaccagcctcggcgtgaacgagccgttcccgatccaggccgccaccctgccgaactccctggcgggccgcgacgtcctgggccgcgggcggaccggatcgggcaagacgctcgccttcggcctggcgctactcgtgcgcacggccggacagcgtgccgaggcccggaagccgctggccctgatcctcgtccccacgcgcgagctggcccagcaggtcaccgacgcgctcactccgtacgcccagttgctgaagctgcggctggccaccgtggtcggcggcatgtcgatcggccggcaggcgagcgcactgcgcgccggggccgaggtcgtcgtcgcgactccaggccgcctcgccgatctcatcgagcgcaaggactgccggctggaccgggtgagcatcaccgtcctggacgaggccgaccagatggccgacatgggcttcatgccccaggtcaccgaactgctcgaccaggtacgccccgacggccagcggatgctgttctcggccacgctggaccgcaacatcgacctcctggtccgtcgctacctccatgacccggtggtccactcggtcgacccgtcggcgggcacggtcaccacgatggagcatcacgtgctgcatgtgcacggcaccgacaagttcgccaccgccaccgagatcgccgcccgcgacgggcgcgtgctcatgttcctggacaccaagcacgccgtcgaccagttcaccaagcacctgctgggcagcggcgtgaaggccgccgccctgcacggcggcaagtcgcagccccagcgcacccgcaccctggcgcagttcaggaccggcgacatcacggcgctcgtggcgaccaatgtcgcggcccgcggcattcatgtggacgatctcgacctcgtcgtcaacgtcgacccgccgagcgaccacaaggactacctgcaccgcggcggccgtaccgcgcgcgccggtgagtccggcagtgtcgtcaccctggtcctgcccaaccagcgccgtgagatggcgcggctgatgtccgatgccggcatcaggccgcagatcactcaggtccgctcgggtgaggccgagctgagccgtatcaccggcgcccaggcgccctccggtgtccccatcgccggcagcgggccggtcacggagcgccccaagcgcggcggtgcccccttccggggtatgggcactcgcccgggccgcgccggtggtgagtcccgccggtccgccgaggcccggcagacggccgaggcccgcaaggccgcccggatccgtcgcggcgcgtagcccgagcgcagctgaacgcccgcgggaccgcccgcccgaacgcccgtcggccgcgccgcaattcaggtcaatgtggacatctatggctataggtggcggatgtcaggggcggaccgggatgtgtgaggaatcgggtgccgacaggcgttagcgtggtcggtgctgacggtgaggcccgtgctggtcggcgccggttccaggggcgtagggcgtagtaaggggaagcatgcaggtcggagcggtgtcttgaggattctgcacacgtccgactggcatctgggccgggcgttccaccgggtgaacatgctcggtgcccaggccggtttcatcggccatctcgtcacgaccgtgcgtgagcgcggcgtggacgcggtggtcgtgtcgggggacgtgtacgaccgggcggtgccgccgctggccgcggtcgagctcttcgacgacgccctgcaccggctggcggacctgggcgtgcccacggtgatgatctccgggaaccacgactcggcgcgccgactgggcgtgggcgccggcctcatcggccgcgccggcatccatctgcggaccgaggtctcggcgtgcggtacgcccgtgctgctgtccgacaccttcggcgacgtcgcgttctacgggctgccgtatcttgaaccggccctggtgagggaccagttcggggtggagaaagcggcccacgaggccgtgctcgccgccgccatggaccgggtccgggccgacctcgccacgcgcccgccgggcacccgttccgtcgtcctcgcccatgccttcgtcaccggcggcgaggccagtgacagtgagcgggacatcacggtcggcggggtggccgccgtgcccgccggggtcttcgacggcgtcgactacgcggcgctgggacatctgcacggcagccagaccatcaccgagcgcgtgcgctactcgggctccccgctgccctactccttctccgaggccgagcaccgcaagagcatgtggctcgtggacctgggggccgacggctcgatcgaggcggagcgggtcgactgcccggtgccccgcccgctcgccaggatccgtgggccactggaggaactgctcgccgaccccgggctgacgcgccacgaggaggcgtgggtcgaggccacgctcaccgacccggtgcgccccgccgagcccatggcgcgactgaccgagcgtttcccgcacacgctcagcctcgtcttcgacccggagcgggcaccggaggacccggacgtctcgtacgcgcggcgcctggctggccgcagcgaccagcagatcgcggaggacttcgtggcccatgtgcgcggcgccggacccgacgcgcgcgaacaggccgtgctgcaggacgcgttcgacgccgtccgcgccgacgaggcggtccgggaggtcgcccgctgatgcccgcgaccgccggacacccacggcgcccggtgcggcgaccgcactcgaacacggaggggagccgatgaggctgcaccgcctggacatcaccgccttcggccccttcggcggcgcccagaccgtcgacttcgacgacctctcggccgccgggctcttcctgctgcacggaccgaccggggcgggcaagacgtccgtcctggacgccgtctgctacgcgctgtacggggccgtgccgggcgcccgccagagcggccagggcatgaccctgcgcagcgaccacgccgcgccgtccacccgtaccgagatccggctcgaactcaccgtcgccggacgccggctggagatcacccggcagccgccctgggcgcgccccaagaagcgcggcgccggtacgacgaccgacaaggcccagagccggctgcgcgaacacgacgcggcggcgggctcctggaaggacctcagccgctcccaccaggagatcggtgaggagatcacccagctgctcggcatgagccgggagcagttctgccaggtcgtgctgttgccccagggcgacttcgcacgcttcctgcgcgccgacgcggaggcgcgcggcaaactgctcggccgcctcttcgacacccaccgcttcgcggaggtcgagaagcggctcgccgagcggcggcgggcggtcgaggccgaggtgcgggccggggacgccacgctgctcgccgacgcgcaccgcatgcagcaggccgtcggggacgtcgtcgaggtgccgctgcccgacctcgcgcccggcgacccaggactcgccgagaccgtcctcacctgggccgccgtcgcccgctccaccgcccgcgagcggctgaccctggcccactgcgcgcgtacggcggcggagtccgcgcaggccgccgccgaccgcgtactcgacgacgtacgcgaagtggcacgccttcagcgcaggtacaccgaggcgcgcgagcgcgccgcgctgctggaggagcgctccgacgcccaccgggaggcgcagacgcggatggagcgtggccgcaaggccgaggcggtggcccccgcgctcgatctgcgcgacgccgccgaggccgagcaccggcgcgcggccacggacgaggcacgcgcgcgcaccgccctgcccgagacgttcgccgacgccggcgcgcccggcctcgcggcggcggcccgcaaggcggccgaggaactgggcggcctggaatccgcccgccgggccgagcgccggctcggtgaactcaccgaggagcgtgcctccctggaccgccaggagcgcgccgacgacgacgtcctccaggacgccgagagctggctcgccacctgggaggcgacccgcgccgacctccaggccggcatcgagtccgcgcaggaggccgcgacgcgcgccgagcagctcgccgtgcgccgcgaccccgcccaggcccgcctcgcggccgcccgtcggcgcgaccggctctcccaggacacggacgaggcccgggcccgtgccctcgccgcccgcgagcacgcgacggacgcccgggtccactggctcgacctgaaggaacagtgccttcagggcatcgccgcggaactcgccgccggtctcgtcgacggcgctccctgcgccgtgtgcggctccctcgaccatccggcgcccgcgcggaagatcaccgggcatgtcgaccgggagaccgaggagcgggccctcaccgcctaccagcgcgccgacgagacggccaccgtggacgagcggcgactcggctccgtacgcgaggagctggccgccgcgaccgcggaagcgggcgacgcgccgaccgcccacctcgcccaggaggcagcggagctggagcggcagcatgccgaggcgcgcgccgccgcctccgggctgcacaccgcgcggcagcggctcgcacaggccgagctcgaacacgaacggcgggtcgccgaccagcagcaggccgccctgcgcgccgccgcccgggtctcccaccgggacacgatcgaccgggaaagggcctcgctggaggaggagttggcaaaggcccggggcgccgccgacagcgtcgccgcgcgtgccgcgcagctggagcgccggaccgccctgctcacggacgccgcggacgccgtgcgcacggccgaggacaccgcgcagcgcctcaaggacgccgacgcgcgcctggccgacgcggccttccgcgccgggttcgacaccccgggggacgcggccgccgcgctcctcgacgacgcggcccaccgcgacctccaacggcgcctcgacgcctggcagtccgaggaggccgccgtacgcgcggtgctcgccgaggccgacacggccgccgccgcgcggcagccggccgccggcctggccgccgccgaagagaccgccgagctggccgcccggcggctgcgggacaccgcctccgcccaggacgcggccgctcggcgctgcgccgaactggaccggctgtccacgcgcgcgctcacgtccgtacgccggctggcgccgctgcgcgaggagcacgaccgggtggcccgtatggccggactggccgcgggtacctccgcggacaacgagcggaagatgcgcctggagtcctacgtcctcgccgcccgtctggaacaggtggcggcggccgcgaccgcgcgcctgcgacgcatgtcgtcggggcgctacacgctcgtccactccgacgaccgggccggacgcggacgcagcggtctcgggctgcatgtcgtggacgcctggaccggccgcgagcgggacacggcgacgctctccggcggcgagaccttcttcgcgtcgctggctctcgccctcggcctcgcggacgtcgtcaccgacgaggccggcggggtgcgcctggacaccctgttcatcgacgagggattcggcagcctcgacgaccagaccctcgacgaggtcctcgacgtactcgactccctgcgggagcgggaccgcagcgtcggcatcgtcagccatgtcgcggatctacgacggcgcatcaccgcgcagctggagatcgtgaaggggcggacgggttcggtggtacgacagcggggcgggctgtgacgcccggcggccccggggtcagcgacccagcgggcgtcggggcagcggtgacgagtacacgacgctcgtcgtcacggaccccagagcgccgatcttgcccgacacctcttccagatggcgcatcgagcgcgcggcgaccttgatgacgaagcagtcgtcgccggtgacgtggtgcgcctccaggatctcgggcgtcacggcgacgaggtcgtggaagggcttgtagttcccgttcgggtagcgcagccggacgaaggccaggatcggcaggcccaggctgtccgggtcgacgaccgccgcgtatccctggatcacgccggcctcctccagccgccgcacccgctcggtgaccgcgctcgaggacatggagacggcacgggccagctcggcgaagctggcccgtccctcgcgctggaggacatcgaggatgcgccagtcggtggcgtccggggaatacgtggtcattcccgaggaatagcaggggaatccccggcagatcaagagtgacgccgtgaatcactccttcaggacggggatcaccggccgtagattctcagccatgagggtcccgtacggccggagcaggcgaacgcaccggaacggcggggcagggagggaaggcaccacgatgaccaccacgacgacgcccaccacgacgacccccacatcgcccccgaccgtgaaggccccgaccgtgaaggcccccaccgcgaagaccgccaccgcgaagaccgccgacaaccccgtactccgcgtcgcccccgcctccccggccgcggccgccgcctacttcggcgcgagcctcgccttccacgccgacgtgtccgatgtcgccaccgcactggcggccggcggcgaccccggcttcgtggttctcgactcgcgctccaccgcgtcctgggaccagggccatgtgcccggcgccgtccatctgcccaccgcgctcatcccggagcaggccgagcagctcctggacaggtccgtaccggtcgtcacgtactgctggggccccggctgcaacggcgcgacccgggccgccctggccctcgccgaactcggcttccaggtcaaggagatgctgggcggcttcgagtactgggtgcgcgagggcttcgagtacgagacctgggagggccgcgaccaccgcgtcgccgacccgctgacggcgccggtggacgcggacgactgcggctgctgaggcgaccgggcgtcgtaccaccgcgggcggaccccgcgacgcacggacgccggaaggcggccgcggcccctgcatgtaggttctgcgcatggccagttgcacggatgcgggtgtcggcgcggtcgcgtgggtggagtcgggcggcggcccgctcatcgccgtacccgaggtggtgctcccgttctgggcgggggcggacggcgacgaactgtccaccgactacgaccgcgcctgcgacgtcgacgcgttcatcggcctcgtccctgtcggcgacacccgggccctggtcctcggcgacgaccccgggtcgtgatgatgacctccggacaggacggtttcagacgctgaccgcggccgggctcgcgccggtgacgcgaacccggccgccgccgaagggctgcgacagccgacgaaccgtcacagccgcgacagccgacgaaccatcacagccgcgacagttcgtcgaccaggtcgtccaggcccagcgagccctgggacagggccgccatgtgccatgccttcgcgtcgaaggcgtcgccatgacgcttcttcgcgttctcgcggcccagcagccaggcccgctcgccgagcttgtagccgatggcctgacccgggatggagagatagcgggtgagctcgctctccacgtagtccgccgggcggctgctgtgcgcggcgaagaactcctccgccagctcgggagtccagcgcccacccgggtggaacggcgagtccgccgggatctccagctccagatgcatgccgatgtcgacgatgacgcgggccgcgcgcatcatctgggcgtccagatagccgagccgctgctccgcgtccgtgaggaagcccagctcgtccatcagccgctccgcgtacagcgcccagccctcgcagttggcgctgaccccgccgaccgtggcctggtagcgcgagaggttctccgcgacgtgcgcccactgggcgagctggaggtggtggccggggacgccctcgtggtaccaggtcgacacgaggtcgtacaccgggaagcgggtcaggcccatcgtcggcagccaggtacgcccggggcgcgagaagtcctccgagggggccgtgtagtacggcgccgccgcactgccgggcggcgcgatgcgggactccaccttccgtacccgctcggcgagttcgaagtgcgtgccgtcgagcgcctcgatcgcctggtccatcagtgcctggagccagtcgcgtacctcgtcgacgccctcgatgtgcgcgccgtgctcgtcgaggtgcgcgagcgccacccacggggtctcggcgcccggcaggatcttctcggcctcggtcttcatctcggcgaggaggcggtggtactcggcccagccgtacgcgtacgcctcgtcgaggtcgaggtccgtaccgttgtagtagcgcgaccagcgcgcgtaccgttcacggccgaccgtgtccggcgcgccctcgatcgtcggcgcgtagacgtcgcgcatccagtcccgcagggacaccagggccccggtcgcggtgcgcgcggccgcgtccagctccgtgcgcagcgactcggggcccgacgccacgaagtcctcgtaccagccgcggccctgcccgtccgtgtccgaccactcggtgagctgcccgatgaacgtcgcggtggggcgcggccccgcgtacagcttgcgctccaggccgagggcgagtgactcccggtagcccgccagggcggcgggcacggcgcgcagccgctcggcgaccgaggcccagtcctcgtccgtgtccgtgggagtgatcgtgaagacctcgcgcaccgagtgcgcgggcgagtccatgttgccgaccgcccgcagcccctcgtcggcctcgtggacggcgagttccgcggtgaggcgctcacgcagcagccgggcgcagcggcgctcgatgtcgctgtccgcgccgggctgccgctccgcctcgtcgagacgtgccagcgtggtccgcgtcagcttcgccagggcctcgtggcccgcgggcgagaagtccggcagcttgccggcgcttgccttgtcaccgagatacgtacccgtgaccggatcgagggcgatgaggtcgtcgacatacgcgtcggcgacctcgcggggcagcgggctcttcgtctctgacatgcggacatccttatacggagagctggtccgcgtcaggccgatatgccgggtcgggcgcggtgtcagcctgatttcgccgagggcgtgacctgcggcccgggcggcagcagcggaccgcagtcccactgctggaagatcaaccgggtctcgacccgggccacttcgcgctgcgacgtgaactcgtcgaggaccagcctctgcagatccgccatgtcggcgaccgcgacatggacgaggtagtcgtcggggccggtgaggtggaagacggtacgcgactcgggcagcgcccggatccggtccacgaaggggcccaccaactcccgccgatgcggcctgacctgcaccgacagcagcgcttccagcccccgccccagtttcgccgggtccagtcgcagttgatggccgagaatgactcccgcgcggcgcagccgcgtcacccggtcgagacaggtcgagggcgccaccccgacctgcgccgcgaggtcgcggtacgtcgtccgggcgtcgttctgcaacagccgcaacaaatgaagatccaccggatcgagtacgacggattcgcccatgcgccgaacgtaacacgaccttcttcgcccggaccccggccgctgttcaggcttcccggcatgaacttcggcagctacgacacatacgtggatgaaaccgcggacgcagcggacgcagcggacgcagtggacgacggccggggcgccggcggcttcgggggcgggcccgcggtgcgggcgctggacaccgaggccgtgcacgccgggcgggacgacctcgcccggcagggtctgcacgccgcgccgatcgacctgtccacgacctacccctcgtacgacagccgtgcggaggcggcccgcatcgacgccttcgccgccgacggcgcggagccggccgggccgcccgtctacggccggctgggcaacccgaccgtggcccgcttcgagaccgccctcgcccggctcgagggcacggacagcgcggtcgcgttcgcgagcggcatggcggcgctgagcgcggtgctgctcgtacggaacgccatgggcctgcggcatgtcgtcgccgtacggcccctgtacggctgtagcgaccatctgctgaccgccggactgctcggctccgaggtgacctgggtcgacccggcgggcgtcgcggacgccctgcgccccgacaccggtcttgtcatggtggagtcaccggccaacccgacgctggccgaactcgatctgcgggcgctcgcccacgcctgcggctccgtaccgctgctggcggacaacaccttcgccacccccgtgctgcaacgccccgccgaacacggcgcccggctcgtgctgcacagcgccaccaaatacctgggcggccacggggacgtgatggccggagtggtggcctgcgacgaggagttcgcccgggggctgcgccagatccgcttcgcgacgggcggggtgctccatccgctcgccggctatctgctgctgcgcggtctctcgacgctcccgatacgtgtacgggccgcctcctcgaacgccgccgaactcgcccgtcggctcgccgccgacccgcgggtcgcccgcgtccactatccccgcatcggcggcgccatgatcgccttcgaggtgtacggcgatccccatgaggtcatcgccggggtccgcctgatcacccccgccgtgagcctcggcagcgtcgacagcctcatccagcacccggcgtccatcagccatcgcatcgtggacgcggcggaccgccggggtgccggagtgagcgaccggctgctgcggctgtcggtgggcctcgaggacgtcgaggacctgtgggcggacctggacggggcgctggggacggaccggctccccgagacggcgggagcgggccgcgaaccgtcgcggaccgcgctccggctcccggagcgggccgcggaccgatagccctcctggagcgggccgcgggccgcggcccggggaccgggggccggggtcgcccgccctccccgtcgggggttcgggaggtgccggggacccggccacgcacaccggcccggcgcgatgcgccgggccggtccgtccgatctgctgcgtaccgctgcgtaccgctgcgtaggaccggtgcgtagggccggtgcgcgcctagtccctcgtgccgtgcccggtgtgctgccccagcgccgggtcgtacggcggctgcgggggcaccgcggccgcgtccaggcgggccgtgatcaccagggtgccctcctcgatctggtagtcgaggggcaggtcgaggccgcgcatcgcggcgaccatgccggtgttggacgcctgcgtgaccgcgtacacgttctcgcagcccgcctcgaccgccatcgccaccagacggccgagcagttcagcgccgatgccgcgccgctgccagtcgtcctcgacgagcagcgcgatctcggtctcgtcgccgtcccagaggagatggccgagcccgacgatgcggcccgacgcggtctgcacggcgagcgtgcgcccgaaacgcggactgagcaggtggttgaggtaacggtccacgtcgccgagcgggccgtgatagcgcatgctcagcgtgcgcggcgagcagcgctcgtgcatcgccttcgccgctgcgaggtccgagacgtcggcccggcgcacggtgatcgcgctgccctcgggaagctgtagtacgtcgtggctgcgcggaatgcgcggaccgagccgcgcgtccagttccaccagcgcccgcgcccgcgcgaactccgtcggggtgaacggcagatacggccgctccaccgtgatcactccgccttccggcgcccgtagccgcagcaccgtgccctccagggccccctcgacgggcgcgccctcgttcacgcggccggagccgggggaggcggcgggcagcgagcggatcgtgcaccggccgagcaactgccgcagtgcgagcgggagttccgccgcgtccagcgccgtgcgggtggccagtccgagcacgcgtgtcggcgcgtccaccaggtcgtgcgcgtccgcgcgctcgatccaggtcccggtgccgccggcccgcgagatggcgtacgtgacctccgccccggccagctgcgccggagcacgcagcaggaactcgtcgaccgtgccctgcgccagcggatgcgtctgcaggctgaggatgtccacccgctgtccggccagcgccgtgcacagcgcggccagcgagcccggctcgtcctgcaccgtcgtccgcatccgccacagcacggtcgcgcccgcgaccgcgttcgcgtcggacggcccggcctgctgcctctcggcgggcggccgggggccggtatcgtccaccggcggggcgtgcccagggcgccgtgcccaccatgtgtggaatccggccgtcgcggcgagcacgacagccgtgatcaccagcagggcggggccgtcgggggcgtgcccgatcagattggccaccgcgtccgccaccgccaccgccgtgaacagcgcggcgagttcgacgacgtcccgccgccagtggtggaccggacgcccgtgcttcgcacgggtcacatcagacatgtctggagtcatgcagccactgtggaggaacggtgttgcgtgatcacaaacgctctgtgaccgatcggtaaagtgtgattctgcaccttttgttgttcttttgaatacttcttggcgccgagtgtgcgagctgcgcgccctgtctggtcagagcggtggcgtggcccgcaggagcggggacatacggcagccgcgcaccgggggatgactccggtgcgcggcgtgatgatcgagagtacgcgagtcggcgggccgccgtcgcacaccgaccgccgggcggatcaggggcgggccgcgccaggtgaggcgacaagtcgacgaccggccgggcgagttaccggctgatgctcgcccgccccgctgtcactgccccacgcgccccggctgcaacacctgtgtgaacagcaccgtcccgtcctgctcgcgcagccggaccgtcagctccccgctgtcgccgtcgatgtcgacctcgccgaagaactggtatccgccggcgggagagacgttcgacgcggtcggcgccttcacgaacacccgctccggaccgaacgtgtcgtccagcgcgctcgccgggaacgcaccggcgttcaacgggcccgagacgaactcccagaacggctcgaagtccgtgaacgcggcccgtgacggctggtagtgctgtgccgaggtgtggtgcacatcggccgtcagccagaccgtgccggtgacccgccggtgcttgatgaaccgcagcagctcggcgatctggagctcccggccgagcggcgcgcccgggtcgccctgggccacggcttcgatgttcggcttcccctcggtcgtgtcgggcacgaccaggcccagcggcatgtccgcggcgatcaccttccacaccgcgcgcgacgtcgccagctcccgcttgagccacccgagctgctcggcgccgaggatgccctgcgggtcggtggtctgccggccgggcgagttcgcgttgcggtacgtacgcatgtccagcacgaagacgtccagcagcggaccgtgccgcacgacccggttcacccgcccttcaccggcgccggggtgcagcgtcgagatggggaagtactcgctgaacgcccggcgggcacggccggccaggacgtcgacgctcttctccgtgtaacgggtgtccgagtccgcgatcacctcgcccgggtaccagttgttccgcacctcgtggtcgtcccactggatgatcgaggggacctgggcgttgaaccgcttgaggttctcgtcgagcaggttgtaccggaagttgccgcggaactcggccagggtctcggccaccttggacttctcctcggtggtgatgttccgccaggtgccgccgcccggcagcgcggcggtggccgagatcggcccgtcggcgtagatgctgtcgccgctgcacaggaagaagtccgggtcgagcccggccatcgcgtcgtagatccggtaaccccccaggtccgggttgatgccccagccctgccccgccaggtcgcccgaccacaggaagcgcaccccgccgcgccgcccgggcggcgtcgtgcggaaggtgccggtgaccggctcaccggtgcgccgcggatcgtccgggtcggcgaggagcacccggtagtggatctgctcgcccgcgggcagcccgtgcagccgcgtcgtgccggtgaagtccgtgttcgcgccgacgagcgggccctgccacctgcgcgggctgcggaacgcctcggtcgcggaggtctcgacgatcatccgggccgggcggtcggaccgtacccagacgagaccggaatgggccgtcacgtctccggcctggacgccccaccccgccttcggccgccccgagagggcgaacgccggtgccgagccgggcatggcgggcagagtcagggccgccgacgcggcgagggagccgcgcagcacgctgcgacggcccggcaacgggagtagtgacatcgatgagcctccagggacggattccggccggtgtgcaacgccacaactactggtgcgccgcagcgcacatggaaaccacaagtgaacaaccgaccccggcgccgacggaaccggggtgacgcgaacgtgtcacgacagcaggacgccggccgcgaagcgcttgtcggcgtgtggcggtgtgcgtcggcgtgtgtcggcgtgcgacggccgcgaggcgctggtcggcgcgccgtcgacacggccctgacgtcgggtcagccgcgcaccgcgtccgacatcagccgtacccccgcacggatccgcgcgggcggcagatgcgcgtagcccagcaccagccgtaccgcgtcgtccggtgccgtcccgtacgacgccagcggccgcaccgcgactccggccgcggccgcccgcttcaggaaccggtccaccggcccgtaccgatcgggcagcgaggcgatgacatgcaggcccgccgcgatcccggagacctccgcccccggaaagtgctcctccagagcggatacgagagtgtcgcgccgctccttgtaggcgcgctggcagcggcgcagctggcggtcgtagtcgccgccttccacgaaccgggccaggagcgcctgatcgacgaccgggttcccgaggtccatggtccgcttccgctccacgacctcctcggcgatcgaggcggggacgagcagccagccgagccgcagtccgggggcgagcgacttactgatcgaacccgtgtacgcgacatgctcgggatcgagtccctggagggcgcccacgggggcacggtcgtaacggaagtccccgtcgtagtcgtcctcgaccaccagcccgttcaccgagcgtgcccagtccagcagttcggcgcggcggcgcgccgagtaggcgattcccgaggggaactggtgggcgggcgtggtcacgaccgctcgtacgcccgagtcgcgcagcggcccggtggccagcccctcctcgtccaggggcagcggtacggtgccgatgccggccgacgcgtagagggcactgtgttccgggcttccgggatcctcgacgcccacggtcgtcgtcccgcgcgcgtgcagcacgaatccgagcagggtggtcgcctgcgccactccggagacgaccacgatccgctcggggtccgcgacgacgcccctgcgccgtgccagcagctcggcaagggcggtacgcaaccgggccaggccgcgcggatccgggtagcccagcgcgtggtgggggagctccgcgagcacggcgcggtgtgcggccgcccaggccgtacggggaaacagggacaggtccggagtgccgggcaggaagtccgcgcgggcaccgggggagcgcggggcgaagtcacgcgcgcgtgggtgggcggcgcgggctgcgccgcccacccaggttccggcgccccggccgctgcgcagatacccctccgcggtcaactgctcgtacgcctccgtcaccaggccccgggacacgccgaggtccgcggcgagttcacggctcgacggcagccgggtcccgggcgcgagcctcccggagcggacggccgtacgcagggcggcctggagaccgcgcccacgcgcgcgtgccggcgccgcggcggccggcaggagcaactcccaggcggcggcccacggtgcggacccggacgacacggactcgcccgccccagacacctgtccggacggcgccggcccggactcgcccggcaccgccccgagcccgcccggcacctccgcattggtccccgatgacgtcatggaagtggaccttaaaccggaccggttccgttcgtagcgtcgccgtcatgaacgcgaccaccacccgcggggctctgctcgccgccctcgcctgtgtcctcgtcggaggctccttcaccgccaacagcgtcctcggccactacccgtacgcgggcggccagttcctgcgctacggcctcgcctgcctgctgctcctgcccctggtcggccggggcggcacggcgccgctgcgctgcctcacgtcccgtcagtgggtacgtctggccgccctcgcggccgtcggcatggtcggcttcaacctctccgtgatcgccgccgagcgctccgcggagccggcggtgccgggcgtcttcgtgggctgtgccccggtggtcgtggcggtcgtcatgccccttgtggagggacgccgtccgcaacgcctcgtcctgtgcggtgcgtcgctcgtggccgtcggcgccttcaccgtgcagggctggggtcgtgcggacggtgcggggatcgccttctccttgagcgcgctggccggtgaagtcgggttcgccgtgctcgccgtgcccgtgctgcgtccgctcggcccgaggctgctgtcggccgtcgtctgcgcgatggccgcggccgagtccgcggcggtgggactcgtcgtggacggcacggcatggctgcgcaccccggaccgcaccgaggccgccgcactgctgtggcaggcggcggtcgtcacggtcgtcggcttcgtctgctggtacatgggcatgcagcgcatcggcgccgagcgcgcgaccctcttctccggcctcatccccgtcgcggcggcctgcacggcgcccctggtcggcaccggctcgtacggcgccgtccaggccgcgggcagcgggctggtcggagccggagtcgccctgggttcgggcgcgttgcggcgcggcgccgggcgctcagcgactgccgtccaggacgacccgcgcgaccagcgccggatcgtcgttcatcgggacgtgcccgcaaccgggcagccgcaccagccgggccctggggatgatctgcttcgcccgcaccccctggcggcggaccaggagccggtccttggtaccccacgccacggtgaccggcacggcggggatgtcgtccgtgaactggacggtggtgcccgccttgagggtctcggagaacgccgcggcgttggccagggcgagcgtctcggcgacgaccgcctcgggtgaacggcgccccgggcgggcgtagatggtgctcgtcagcgcggcgcggccgaccgccgtacgggacagccgctcgaccaccggaagcggcagctgccgtgcgccctgtcgcatcgccatcagcaccccgaaggcgtaccgccgctcgaccggcgtccagaagccggcgggcgagagcgccgtcacggaccgcacgagcttctcccggcccaactccagggccagcagaccgcccagggagttgcccgccacatgcggacgctcgatccccagtgcctcgcacagggcgccgagcacgggcaccaccgtcgacaggtcgtgcctgagcccgtcgggcagcgcgggggactcgccgaagccggggaggtcgaccgcgatgacgtcccgctccgtcgccaggatgtcgacgaccgggtcccaggcctgccggtggtggccgatgccgtgcaacagaagcagcggctcgccggcgcccacgcgcgcgtaggagacggtcgcggtccgcgggccgcgcggagaggggacactgaacgagaccgtggcggacatgggccgctccttgtctggggacgcactgacggacgctttcgtagacagcttgtcagcaactgctaccgacgggtagcccccggtcaccgtcaaccacgcgcgcgtagcccttcaacgcgccctgcgcgcctccaggttgaactccgcgtccccgaagtgccggaagaggtccgggcacgggtggaccccgcggccattgtgctccggccgacaccggttccgcctggacacggcgggaggcgtcggatgggatggaagcgtgaccaccgacgccgcgaccgaggtcttcgtagagcaccgccccgtcctgatgggtgtcgcctaccgcatgctcggacgggtggccgacgccgaggacgtggtgcaggaagcctggctgcgctggtcgggcgccgaccgctccgatgtgcgcgagccgcgccgctacctggtgcgcatcaccacccggctggccatcgaccggctgcgccagttgcggtcgcgcaacgaggcgtacgtggggccgtggctgcccgagccctacctgaccgacttcggcgacaccgtgccggacgcggcggagcgggccgtgctcgcggactccgtctccctggccgttctcgtcgtcctggagtcgctgtcgccgctggagcgcgcggtcttcgtgctgagggaggccttcgggttccccttcgcggacatcgcggtcaccctggagcgcagcgaggccgcggtacggcagctcgccggacgcgcccgcaaacacgtggacgaggggcggccgcggtacgaggtcgaccccgccgagcgccgcgacctgaccgagcggttcctcgccgccgcggccgagggcgatctcgaggggctcatgtcgatgctcgccccggacgtccgactggtcggcgacagcggcggccgcgcccgggcaccccggcgggtcctggagtccgccgacaaggtcgggcgcttcctcgtcggcgtcacccggaagggcgtcgcggacgtgtcgttccgctcccttgaggtcaacggcggtccggcgctgctggtcctgtccgcgggcaagcccgacagtgttttccagctggacgtggccgacggccgtatccagtgcgtctacatcatccgcaatcccgagaagctggtgtccctctccgccggctagggcaggcgcgtacgaccacgaggagcccccgttctcatgaacgggggcttccgctgtgtgacgcggacatcgcgcggcgcgaacgccctgtgaacgctcagcgtcggcgtacccgcgcaatccccaagcgatcgaggattggtcttgaccaagggtgggggcggccctatggtcgcagagaaagtgcaacaacctttaataaacaagggcgctaaaaagccgccgggccacggcgattgcggaggacagggtggggaccacgcagctggaatcggtaccggagcctaagtactggcatctcaagaccgtgctcagtgaggcactcgactccgagttctcggtgggcgagatcctgccgaacgagcgtgacctcgcggcccgcttcggcgtcgcccgcgccacgctccgccaggctctggaacagctcgaactggaaggccggctccagcgccgccggggtgtgggcaccacggtcgccccgccccgcatgggggtggccgtcgggtccgagcagcacacctggccgggcgcggccggtgacgcctggcagcccgtggactgcacggtggcggccccgccccccgcggtcgccggcgtcctggagaccggccggaacgagcaggtgcacaccgtacgccgctcccgcgtcactcacggacaccccgtcgccgccgaactgctctacatcccggacttttcggtgcccgacctgtcggccatcgacgcaccctccggcgccgcacgcgcgcgtgccgtgctgcgcgagttgcagcgcctggagctggagggccaggaccgggccgtggagctgggctcggcccgcgccgaggacgccaaggaactcgaccggctgcccggcgcgcccgtcctcgtcgtcacgacccgcttcttcgccgagggccgtgcggcggcggtctccgtcgccacgtatcgcgctgacacatgccgactgaccttcggtgactcggggggcgtggagatacaccacgacccggagcgccgggcttcctgaacggtccgcgggaccggccaccgagcccgcccgcacccgcggcgccccggacagccggacacccggtcagccggacaatccaagccgcacccgtcgcgccccggacaacccggggcgcgacgctttttccggacgcgccgcctcttacccgtggggcctacccatacggcttacccacagggcttgtccgagcggcctggccaaagggcttaccccaagggcccgttcagcgccgcgccgtcaccgtgccctccaccgcgaacagctgctcctccacgtggtcgagggccagacgcagcgccccggtcgccaccgccgcctcgcccagcatcgacagggtcaccttcggcgggcgcagacagtagcgggccagctcgcgccgcagcgggtccagcacgccgtccaggcccgccgcccagccgccgatcacgaccagttcggggtcgagggccagggcgagggccgccacgtcgtgcacaaggcgctggatgaagcggtcgacggccgcacgggcccgctgatccccctcgcgcgcgtgcgcgaagacctcggcgaccgcccgctcgtcgagcggatgcaggggctcgtcggtggtcgacaacagcgtctccggggtcgccccgcggcccagcagatgcagcgcgccgatctccccggccgcgcccccgtagccccggtgcagccgcccgccgatcagtgcgccggcccccgggctcagcccggccagcacgaacacgaggtcgtcggactcggtcgccgcgcccttccagtgctcggcgaccgccgccgcgttggcgtcgttctccaccagcaccgggcacttgaaggaacggttcagccgctcgccgagacgcagccccgtccactccggcagcgccgtccccagccgtacggtgccgtccgcctcgatgatgcccgggctgccgaccccgacggcgcgcagggagctgcgggcgacgcctgcccggcgcagcagctcggcgaccgccgtacgcagccgctccagccgctcgtccgccgaggcggtctcgtcgacgtccttggccatggcgcccaggacccggccgtccaggtccgcgaggagcgcggccacccggtgcgggccgatctccagacccagcagatgacccgcctcggcccggaaccggaagcggcgggcgggccgcccctggcgccgggcggcaccttcctcggcggccttctcgaccacgagcccggcctcgatcaacccctccacgacaccctcgacggtgggccgggacagtccggtcacccgggtgacctcggtgagcgtcgcgcagtcggcggcacgcagcgcgtgcagcaccaccgcggaattgatccttcgaagcagagaggggtccccgccggtcagccgccccaacgtccgtcctcccagctcgtgcgcgtgttggccggatcgtactcggcgcggcggaccccggcgagtgccgggcccggccttcctgccgccgggccgccgtcagcccggcgccacgaaccccgactcgtacgccgcgatcaccgcctgggtacgatcgcgcgcccccagcttggccaggacggcgctcacatgcgacttcaccgtctccgtcccgacgaccagctgcccggcgatctccgcgttcgacagcccccgggccatcagccggagtacctccccttcacggtcggtcagcgcggcccgctccatcaccgcgcgggccgcccggttcccgccgccgtccccgtgctcggcggccaactgccgtaccgaggccgggaacagcagggactcgccctcggcgaccagccgcaccgcgtgcacgatctcggccggccgcgcccgcttcagcagaaaaccgtccgctcccgcgcgcagcgcctcgtacacgtactcgtcgttctcgaaggtcgtcaccacgaggatcttcggcggccggtcgacggtgcgcagcacggcgcgggtggcctcgatcccgtccatcaacggcatgcgtacgtccatggcgacgacgtcgggccgcaactgccgcaccaggggaatcaccgccgcaccgtccgccgcctcgccgacgacctcgatgtcgggctgcgcctccaggacggcgcgcagacccgcgcggacgaggggctcgtcgtcgacgagcagaacggtgaccggcacccggccagcgtagatcagcgcagcggcagctcgacatgcacctgccagtcaccgtcggccggacccgtccgggcccggccgccgagcagtgcggcccgctcccgtatgccccgcagcccgctgccccgcagtccgccgcccgggccgggcccgggcggcctcgtggtgagcggattgcggatctccagggtgacgtcggcgtcctggaccgcgatacggacgtgcaccgggacgccgcccgcgtgccggatcacattggtcagggactcctggaggatgcggtagccctcgcgggagaccgggcccgggaccgactccacggggccggaccactcggcctcgaccttcgctcccgaggcgcgcgccgactcgaggagccggtcggcctcggccagcgtcgggcggctgctcgcgggccgctccgcctcgcgcagcacgccgagcacccgctccaggtcctccagcgcggcccgcccggtctcctcgatggcgtccagcgcccggtcggtgaaccgcggatcgcccgccgcgcgcgcggcgcccgcctgcaccaccgccacggtcagggcgtgaccgatggagtcgtgcagctcgcgggcgatacgcgtgcgctccaggaggtgctcggtgcgctcctcgagggcggcgagtcgctcaccggccgaggggccgagcagaccgcgtgccacggcggtgatcagctcacccaggcccaccaccgccccgtacaggacgagcaacgtcaacgggatcagcagcgcgtacgcccagtggggatccgacacccggaacaaagggttgtcgaccggtgccgggccggtggcggacctgaccagatccacggcgatcgtcggcaaccagacggtcgctcccaaggtcaccgctccgagcgccatacgcacctcgagccacagcaccgtccgcagccggtcgccccaagtcgccgagggcgcggccgagatggcggcgttccggccgccccggtcgcccggagccagcagcaactgcgcctgcacgccctcgcccagccgcaccgccgggatcaggcccagcggaatgagcacgagcgcgggcatccaccaccgccgcatgtcgatgaacagccacacgctttcgaacagcatcggcacccacaggtgcagcaagcgcgtgtacgtggtcccccggctcagggggcgcaggaagcggcccatgggggcatcgtgccagccgcccccgaccacggacctcccccgggcgggggagacgatctccaccggcgggggaggccccggccccccgaccgaggccacgctgaggccatgaccagcatcgacgtccaagacctcaccaaggagtacggcaccggacgagccgtggaccggctcaccttccaggtgcttccggggcgcgtcaccggcttcctcggccccaacggcgcaggcaagtccaccaccatgaggctcgtgctcggactcgaccgtcccacgtccggcaccgccaccgtcggtggccgcccctacgccgcgctccatgaacccctgcgtcaggtgggagcgttgctcgacgcacgggccgcccacgggtcacgtaccgcccgggcccacctgagggcactggccgcgagcaaccgcatccccgaccgccgcgtcgacgaggtgctggaggagaccgggctcgcgtcggtggcgcggcgccgggtgaagacgtactcgctgggcatgcggcagcggctcggcatcgccgcagccctcctcggcgacccgcccgtcgtgctgctcgacgaaccgtccaacggcctcgaccccgaaggcatcatctggatccgcgagctgctgcgccgcctcgcccgcgagggccgcaccgtgctggtctccagccatctgatgaacgagaccgcgtccttcgccgaccagctcgtcgtcctgggacgcggccggctgctcgccgacctgccgatgcgggagttcatcgacgcgcgcgtgcagccccgggtacgggtgcgcaccagcgacggcgccgtgctgggcgcactgctcgcccggcacggatacgaggcggccgaggccgaggacggacggtggaccgtgcggcacgcgcgcgtggcggacatcgggcgcctcgcctcggacgcgggcgtctccatcctcgaactcgccgcggaagagggcaccttggagcaggcctatctcgacctgacggccgccgaggccgagttcacgaccccgacgcagccgcaggaggcctgagccatgcccttcgcacccgcactccacgccgagtggatcaagatccgtacgctgcggtcactggtcggcggactgctcgccgtcttcctggtgaccgtcctcttctccgcgctcgccgggctcgactccgaaggcccggacttcgaccccctgttctcggcgttcttcggcgtcaacttcgggcagatcgccgcgatcgcgttcggtacgacggccgtttcggccgagttcgagggcggggcccttcaggtgtcgctggccgcgatgccccgtcgcggccgctggttcgcggccaaggccgtcgcgatcggcgtccccgtcctcgccgtcggcctggtcacggggttcgtgagcctcgcggtgggcaaggccgtcctcggggccgaggcgagcgggctgacctgggacgaagggctgcgtggagctctcggctgcgccctctacctcacgttgatggcgctgttcgccgcgggactcgcggccctgctgcgcagcggagtcgccacgctgagcgtgctcgtcccgttccttctcatcgtgtcgttcgtggtcgggggagcctcgggcaccgccgccgacctgctgcccgaccaggcgggccggctcgtcctccacgagacgtccgacagcgtcctcggaccctggaccggtctggcggtgaccgcgctgtgggcggcggccgcgctgttcgccggggcatggagcgtacgccgccgggacgcctgacctcacgcacctggtgacgccacacccattgtcagaggcgacgggtttactggatccatgaccatcgagcagtgcctcgccacgatcgacctgctgtgcgcccgcccgttcccggcggagcacggcaggacggacgtgggctcggggggaccgggctatcacatcgccgagttagggacgagcgacggttacggggcggaggactgctgggaccgggccgagacggcggaggagtgctacgagcgcggagaggaggtacgcgatcagctgaccggccggtgggggccgtccgaccacatcggcctccagaccgtccaactgcgcacggagaccgaggacatacccgagccctgggtgcacctcagcgcacgcgtgggcgacatccacctctggcggacggaggggaacggccgctggatcgccctcggagtcgccgaccgcgacgaggcggacgagatacggctcctggtcgtcgtcacggagatcgaccctccctgacgccggctcacgagccgatgccggctcacgcgtcccgcgcggcctcccgcaaccgtccgaactcctccgccatcgtcgccgccgtccaatgcgcgttcagcccgctggggttgggcagcacccacacccgactggcgccgatcgtccgctcctgcggtcccacccgcgccttccggtcgtcgaaggccgcccggtacgcggtcacccccaccaccgcgagccaccgaggacgcagccgctccaccttggcaccgagcagccgcccgccctcccggtactcctgcgcggtcagctcgtcggcacgcgcggtcgcgcgcgccaccacgttcgtgatcccgaggccgtacgagagcaactcgccctgttccgaaggcttcaagagccgcggggtgaagccggacaggtgcagcacgggccagaagcggttgccggggcgggcgaagtgatggcccgtcgccgccgtcatcaggcccggattgataccgcagaacagaacactgaggccgtccgcgacgacgtccggtaccagacggtcgcgggcggcctccagctccgccggggtgaaccgggtcagaggatcgcccccggggtgtaggccgccgcctcggggtgctgcttcacgatctcctcgatgcggccgacgaccacggcgacctggtcggcggcggcgcccgtgaaggacagcttgtccgccatcagctcgtcgagctgggcacggtccagcgggatgcgcccgtcggcggcgagcttgtccagcagctcgttgcgctcggcgccctgctcgcgcatggcgagggcggaggccacggcgttctccttgatggcctcgtgcgcgacctcacggccgacacccgcacgcaccgcgcccatcagcaccttggtggtcgcgaggaacggcaggtagcggtccagctcacgggcgacgaccgccgggaacgcgccgaactcgtcgagcaccgtcaagaacgtctccagcagaccgtcgagcgcgaagaacgcgtcgggcagcgcgacccggcgcaccaccgagcaggacacgtcgccctcgttccactggtcgcccgccagctcgcccgtcatcgaggcgtagccgcgcaggatgaccatgaggccgttgacgcgctcgcaggagcgggtgttcatcttgtgcggcatcgcggaggaaccgacctggcccggcttgaagccctcggtcaccagctcgtgcccggccatcagccggatcgtcttcgccagcgacgaaggcgccgcggccagctgcaccagcgcggtcacgacctcgtagtcgagcgagcgcgggtagacctggccgaccgaggtgaacgcctgggagaagcccaggtggcgggcgatccgctgctccagctccgcgagcttggccgcgtcgccgccgagcaggtcgagcatgtcctgagcggtgccgaccgggcccttgatgccgcgcagcgggtagcggccgaggagctcctcgacgcggccgtacgcgacgagcagctcgtcggcagcggtcgcgaaacgcttgccgagggtggtggcctgcgcggcgacattgtgcgaccggccggccatgaccagctcggcgtactcgcccgagagcttgccgagccgggcgaggacggacaccgtgcggtcgcgcatcagctccagcgagagccggatctgcagctgctccacgttctcggtgaggtcacgggacgtcatgcccttgtgcacgtgctcgtgcccggcgaggtcgttgaactcctcgatccgcgccttgacgtcatgccgggtgaccttctcgcgctccgcgatcgaggcgaggtcgacctggtcgaggacgcgctcgtagtcggcgatcgccgcgtccggcacctcgatccccaggtccttctgggcccgcagtacggcgagccagagctgtcgctccagcttcaccttctgctcgggggaccatagcgtggcgagctcggcggaggcgtagcgtccggcgaggacgttggggatacggggcttggcaggcgcagtcacgtgtatggattctactggcgattcgtgcaggccagcgccgcggggttgtttgtcggaagctacgaaggcggcgcggccccgtccgcgatctccgccagcacgtccccgtggcacagctcgggtgcgcaccagcacgccagcgtcctgccccgcagcgccggcacctgggccagcagctcggggtgctccacgaggtacgcccggtacttggccatcacttcggcgcgggtgccgtcgcgcttccgcgtgggggtgtcaggggcgaacgggttgtacagcgggtgctgcggcaggtcccagtggcccatggtccagcggcggccgatgtacaccaggtcctcgggcgcgtcctccagccgggggccgaagtcgtggatgcggcccttcaggttgatcaccacggtggtcacgccgggctccctccggagtggttatgccgccggtccctcgtacggcagcagctcggcccgcttggccgggagcccgtcaccggacgagcgccccgtcagccgccgtacgatccacggcagcagatgctgccgggcgaagcggacgtccacgatccggcgcgcggcccatcccggcggcagtgtggccggcatgggtgtgtgccactccgtatcctccgcctcgtacccgagggtctgccacacggcctcggcgacccgccggtgcccctcggccgtgaggtgcagccggtcgaagtcccacaggcggggatcggcgagcgagggcgctccgtagaggtcgacgacgagtgcgccgtgtcgggccgcgaggtcgtcgacgcacgcgaacagctcctccatgcgaggccggaagcgctcgaggaccgggccctggcgggccgggctgcgcatcaggaccagctgcttgcaggagggggccagccgctcgacggcctcctccaggagaccgcgtacgcggcccatgtcgcacttgggccgcagcgtgtcgttgaggccgccgaccagcgtgatcacatcgggctgcatggcggccgccacgtccacctgctcggcgacgatctggccgatcagcttgccccgcacggcgaggttggcatagcggaaaccgggcgtccgcgcggccatccggccggcgaggacatcggcccagccgcggtaggagccgtcgggcagcaggtccgacatgccctcggtgaaggagtcgccgatcgcgacaagactggtgtggttggcgttcgtctgcatggcgtaggagatggtaacccgcgcccatacccgccggtcggtcggccgccgcgaacgccctgcccgggcatgcgtggctgcgaccggtcggtcggccgccgcgaacgccctgccgggcatgcgccgtcgggaacgtcctgccgggcatgcgccgccgcgcacgccccgaggctctcggcctcgctcgcgcagggagggatccccttgccccccgcccggccccgctcacccgtgcctacaggattccgccggcttcctccggcctgatccgcggaccggccccggccccgggacccctcacgcgggctgcccgaacagctgccgcagcacgtcctccatcgtcaccatccccgccagccgtccgtccgacccgaggaccgccgccagatgcgtacggctgccgcgcatcgccgtgagtacgtcgtccagcggcgtggtctcccggacgcgggcgatcggccgcatgtcccgcaccgcgaacggcacatcgcggggcgtggcgtccagcgcgtccttcacatgcagatagccgacgatccggcggccctcgtccaccacgggaaaacgcgagaagccggactcggccgagagccgctccaactgctcgggcgtgatgcccacgcgcgcgtagaccacgcgctccagcggaagcacgacgtcgcgcacgggccggcggcccagctccagtgcgtcgtgcaggcgctcctgggcgcggtcgtcgaggagcccggcgtcgacggagtccttgaccagccgggccagttcgtcgtccgagaaggtcgccgtgacctcgtccctcgtctccacacgcagcagcttgagcagcccgttcgcgaaggcgttcacggcgaagatcaccggtcgcagcgtccgggccagggtgaccagcggcgggccgagcagcagcgcggagcgcaccggctcggcgagcgcgatgttcttcggcaccatctcgcccagcagcatgtgcagataggtcgccagggtgagcgcgatgacgaacgacaccgcgtggcccgcaccggccggcacgcccaccgcgtggaacaccggctccagcagatgcgcgatcgcaggctccgcgacgacaccgaggaccagggtgcacagggtgatacccagctgcgccgccgccatcagcgccgacacgtgctccagcccccacagcacgctgcgggcccgccggtcgccctcctcggcgtacggctcgatctggctgcggcgcacggagatcagcgcgaactcggcccccacgaagaaggcgttcacgaccagggtcagcaggccgatcagcagctgtacggcagtcatcgctccctctcatgggacaccgaagaggcttcgtcctgcgcgccgggcgcgtgcagcagtacccgcgccgcccgccgccccgacgcgtccaccacgtcgagccgccagccggcgacctcgacggtgtcgccctcggccgggatacggcccagctcggccgcgatcaggccggcgagtgtctcgtacggcccgtccggcgcccgcagccccacccgcgcgagctggtcgatgcgggtcgcgccgtcggccgagtacagcgcgcggccgtcgtcgtccgtgccggccggggccaggtccggtgtctcgtgcgggtcgtgttcgtcgcggacctcgccgaccacctcttcgacgatgtcctccagcgtcgcgaccccggccgtgccgccgtactcgtcgatgacgatggccatggtccgtttcccgccgaggcggtcgaggagccggtcgacggtgagggactccggtacgaagaggggctcgcgcatcacgcgtgagacagggcggcgggtccgctcttcggcggggacggccacgacgtccttgatgtgcgcgataccgacgaccgagtcgaggttgccgcggtagacggggaagcgggacagcccggtcgcccgggtcgcgttcgccacgtcctcgcaggtcgcctggacgtcgagcgcgacgacctggacacgcggggtcatcacgttctccgcggtcaggtcggcgagattgagggtgcggacgaacagctcggcggtgtcggcctccagcgcgcccgccttcgcggagtgccgggcgagtgccaccagctcctgcggcccgcgcgcggaggcgagctcctccgccggttcgagtccgaagcggcgtacgacgtggttcgccgtgttgttgagatgcgtgatgaacgggcggaacgcggagctgaacaagcgctgcggagttcccacccgcttggccacggccagcggcgaggagatcgcccagttcttgggcaccagctcgccgaccaccatcaggaacaccgtcgacagggccgtaccgatgaccagggccaccgagttggacacggagggcgagacgccgaccgactccagcgggcccgcgatcagtttcgcgatcgacgactccgagagcatgccgaccaccaggttggtgacggtgatcccgagctgtgccccggacaactggaacgtcaggttgcgtacggccttgagggcgcccgccgcgccgcgctcgccgcgctccgcggcccgctccagctcgctgcgctcgaccgtggtcagcgagaactccgccgctacgaaggcgccgcaggccaccgagagcaggatcgccaccagcaggaggagcacttcggtcatcgggtcacctccgtcccatggtcggccagggaggcggagaccgcgcgatgtcggctacggggaggttcgcccatgggcggacgctcacacccttccaaaggggggacggctggatcttcttcccatggtaaaggatcggcaaagtggttcagtcggcgagcggcttcacccaccgtcgccactgctcctcgggcgtgtaccccgccgcccgccaggcatggtgcgcggtctcgttccggcgcagcaccatcgcgtccccgcggcgccccccgagccgtacgaaccgttcctccgcggcggcgagcagcgcggacccgatgccgaggcggcggcgctgaggatggaccgccagccggtacagatggcagcgccatccgtcgaagcccgcgatcaccgtgccgaccagctccccgtcccgctcggcgaggatcagcgcctccgggtcgcgggcgaccagtcgctgcaccccgtcccggtcgtcgctgatgctcgtgccctcggccgccgtcttccagaaggccagcacggcggagaggtcctcgggggcggcggcccgcatgcgcagctcagtcatacggcgatcccagcacgcacgccggaccgggacgcggaattccaccatccggacggcgccggcccacccctcgtcggccgcttgcccgcgccgtgcggcgccgcccggcaccgacccgcccctacgcgccccgcaacgcctcgatcaccggcgcgaacgcctccatgtacggctccaggaccgtcagatacgagaacccgtaccgctcccgttgtgccagcacctgcgccgtgatctgcgccggcgtcccgaccaggacgatcggcagctccagtacctgctcctcggtcagctgcggtacgcgctcgcgcaggccctggacggcggcggcgcggtcctcggtgacggcgaccatctgcaccagcaggttcagctcggccggctccgcgcggtccgccgccagccgccggtatctggcgacccgctcgtccagttccccggccgtgaccggcgccagcttccccgtcgtgctgcccggtaccagatgcgcgcccgcgaaagccgcgatgtcggcgtgctcggcggtgagccgcagcatccggtcgccgttgccgccgatcagcagcggcacccggggcttctgcacgatccccggccggtgctccggggagccgagcagccgctccaactcctcgaccgtgcgcacgagatggtccacccgctcgcgcggcgaaccgtagggaaggcccgccgtgtcgtgttccgcctgtacgtacccggtgccgagaccgagttcgaggcgtccgcccgtcagcgcgtcggtggtcgccacctcgcgcgccagcaacgcagggttccagaagccggcgttgagcacgaatgtgccgaggcgcacccgctccgtggcctcggccgccgcgacgagcgcggggaacggcgccggcatgccgaggtggtcggggaccaggatcacgtcgtagccgagttcctcggcccggcggcacttggcgcgccactcctcggcgggtgcggggtcgagcaggttgacgccgaaacggaacgggcgtgccatgaactctcctcggcgggacggctacttgggcgcgtgacgggagtacatcagtcgtgcgctatggccgccagcacattcatgcgggatgcacgcaacgccgggagcagtgccgccacgatgcccacgaccgccgagcccaccacgaccgccacgatcgtcgtccacgggatcgcgagtacccgcatgccctggagggcgagcacctgctgcacgcacacgccccacaccagccccagcgcaaggcccagaaccgcgccgaacacggcgatcaccaccgactccaggcggatcatccggcgcagctgccgccgggcgagcccgatcgcgcgcagcagcccgatctcccgggtgcgctccacgaccgacagggccagggtgttgaccacgccgagcaccgcgatgacgatcgcgaggccgagcagcgcgtacacgaggtagagcaggacggcgatctggtcgtgcacgagcttcttgtagtcggcctggtcgcggacctggacctgcggatacgggtcgagggtccgctccagccgcgggcgcaaccggtccgcgccggtgcccgacccggcgttcacgtacagcgcggagtcctggccgccgggcaggtacttctcgaccgtcgcgatcccgaagtacagcccgccctgcatgccgaagccgtcggagccctcctggtcggtgagcgcggcaaccttcagttcggtctttcggccgcccgggaactcgacggcgaccgtgctgccgatccgtgcgtcgtgcttcttcgcgaagtccgcgtccatggcgatgccgccgcccgcgagcgccgccgccgtatcgccctgggtgtacgtgatgtgggcgacgtcgtcgagccggttgtcgtagcccgcggcggtcgtctcgacgcgcttgtcgtccggcagccggaccgcgacgggggtgaaccgctgccgtacgacgagtccgacgccgtcggtggcccgcaccttgtcggtgacctcctgcgggaacggcaggaagttgctgttctgcaccacgaagtcggcgcccagcgtcttgtcgatctgctggtcgaaggacgcggacatggacgcgctcgccaccgacatcccgccgaccagcgcgaggccgaccatcagggcggccgccgtggcaccggtgcggcgcggattgcgcagggcgttgcgctgactcatccgtccgaccgggccgaacagcgcggggaaggccgcgcccagcacccggatcaccggccgcaccagcagcgggcccgcgatcacggtcgcgatgagcgtgaggacgacgccgagtcccagcagggacgccgccgacgcggtcttcgacgaggtcgcgcaccccgcgagcgcggccgccccgagcacgccgacgacggtgcccaccacgccgcgcaccttcaacggccgccccaccccggcgatctcggcgtccgcgagggccgccatcggggagaccccggcggcgcgcctggccgggaggtacgccgcgaggaaggtgacgccgaccccgacgacgtaggccgtgacgggcgtcgcccagccgatgaccatctcggtggacttgaggttcatgccgaacgcgcccatgagcttgatgagtccggccgcgagcccgatgcccgcggcgagcccgagcgtcgagccgaccagcccgagcagcagcgcttcggtgagcacggagcggcgcacctgccgccggtcggcgccgagggcacgcaacaggccgagttcgcgggtgcgttgggcgatcagcatcgagaaggtgttgacgatgaggaagacgccgaccaggacggcgattccggcgaagccgagcatcacgtacttgatcacgtcgaggaatccgccgaggtcggccgcgtcggaggtggcctgttcgtccgcggtctgcacgtcgtaggtaccggagccgagttcggcggcgatgcgccgtttgagctgggcgtcgctcacccccttggcggcgtccacggagatgctcgtggcggcgtcggccctgccgagcagtttggtctgcgcggtcggggtgtcgaggaagacgagcgcggccccggggttggtggtggtgaacgtggcgatgccgacgatccgcaccttgaacgacccgggctgcgccagcacggtcagcgtgtcgccgatgcgtacgtgcttcttctcggcggtgtccgcgtccaggagtgcctcaccgctgccgtgcggggcgtgtcctgaggtcagccgcaccgggctgcggtcggtggggtcccagttggtggcgatggtgggggcgcctgtggtggacccgaccggctcgttcctgacgtccacgaccgtgatgttctggaccgccgcgtccacatgggtggcggccacgccgtcgacgctcttcaggcgctccgcgagcgcggcgggcacggtctcggtcgccccggtcgggacctgcgaggtgaggtcctccttgggctgcacggtgacatcggccgctgtcgaggcgaacagccggtcgaaggtgcgggtgaccgtgtccgagaagatcaggctgcccgcgacgaacgccacggacaggacgacggccagcgccgacaggagcagccgccccttgtgcgcgaggaagctgcggagagtcgctttgagcacggcgtcctgcctcagtcctggtcgggggtgccgtcggcggagtcgccgccgggcgggacggcgccgggcgggacggcgccgtcggaggcggcgtggttcgtgtcggactcgggcgtctgggagggtcccccggagaagaggcgcatccgctccagcaccgcctccgccgtcggccgtgccatctcgtccacgatccgcccgtccccgaggaagagcaccaggtcggagtgggcggccgcgccggggtcgtgcgtgaccatgacgacggtctgccccagttcgtcgaccgcctcgcgcaggaagcccagcacttcgaggcccgcccgggagtcgaggttgccggtcggctcgtcggcgaagatcagctcggggcgggaggccagggcccgggcgcaggcgacgcgctgctgctgcccgccggacagctgcgcgggccggtgcctcagccggtcccgcaggccgagggtgtcgatcacctggtccagccacttctggtcgggcttctggccggcgatgtccatgggcagggtgatgttctcgaccgcgttgagcgtcgggatcagattgaacgactggaacatgaagccgatccggtcccgccgcagccgggtcagctcgccgtccttcagccccgtgatctcggtgttgccgagccacacctgtccggccgagacgctgtcgagcccggccagacagtgcatgagggtggactttccggagcccgagggccccatcaccgcggtgaagcggccgcgcgcgatgtccacgtcgaccgagtcgagggcgagcacggtcgtctcgcccgagccgtacgccttcgtcaggccgcgggtgcgggcggcgaacccgtccgcctccgggcggccgggggcgtgctccgcagcaggtgtggacaacgccgcctcctaggtcgtggacgtcccgattaccttgtgttccccgtccgggccgatgtctccccggtccgggccgagggtagtgtgacgcagggcacacccgatatccccctgaggtgccggaccttctccaccccaggtcgggcccctgataccggtgtaagggacacgctccatcccggggtggagcccttgccggtgctagcaccacggcgctagcttcgaggtatggcgaagactcagctgaacgtgagggtcgacgagggcaccgcccgcgccgcccgcgagcgagccctggagcgcggcatgagcgtgaaccgttacatcgaagaactggtccgacaggacaccggggaagcgggccacaccttcgtggaggccgccgcagacttcatgaagcagtacgagaccgtcttcgccgaggagttcggcgcggaccgcgagggcacgcgcgaaagtcgtcgttgatcccttggagaatctcagaatcgacctcgcctggctcctcatgatcgccgagcagaagacgcccggagatccccaggtcaccgactggggagccctcgtcgccgccgtcagccggcacgaggcggagatattcggcatccccgtctacgacacgccgcacgcccgcgccgccgccctgctccagctgctgttgcacgtgccggccctcgaacgctccaacgccctgttcgcgtccgccgtcgcctacgcctatctcgtcgcgggcggcgccaaggtcgtcacctcgcccgagcaggtgcgcgagctcgcccggctggtgaagagcggggaggccggcgtcgacgacatcgcgcgcgaactgcggcaatggagcctgtgagcacccgcgggcacgctcagtccgcggacccgggccgccacgcggtgccgaggacgcagtacgaggtgggcagccgcggccccttctccggcagcagcatccgccggtaggggcccagctcgaacccggcctcgcgcaccgcgctgacggcgtcccgcgtgaggtgacagccgccgttgagacgcggccacaccgtgcggtcgagggcgcgctgggttgcggccatcgcgcgcccgccgcccgcgccgtgctcgaagaaccgcagcgtgcccccgggccgcagcacccgccgcaactcgccgagcgcccgcgacacgtcccggacgctgcacagcaccagggagacgacggccgcgtcgaaggcctcgctcttgaccggcagcgcctccgccgcacccggcaccacgtcgaccggcacatcgcagcgcagcgccgcctcgaccgccaactgccgcagcagccgctcgggttcgatcgcgacgacctccgagacggccccgggatagtgcgcgaagttgagaccgttgcccgcgccgatctcgatgacccggccgctgagcccggccagcagccggtcgcgtacgccgcccatcccgagccgggtctcggcggtgacgctgatccgggcgtaggagcgggcgaacagcggatggtgcacggcgtcccgcgacgccttgcccgatccggcggaccgcagcggcatgaggacctccctggaggacgggccttacccgcattgtcccccgtacgggctgcgcccacccccgctgtgcggcccccgtcgcgcgggggccgcaccgggcgctgccggcggctcagccgacgaaggtccgcacctgctggtagacgccgtagtcgttgttcatgtcggtgtgcgagacgcacccgacctcgacattggtcgcgccgctcaggatcgcgctggtgtccggggtgagcaggtcgtcgcagttcgaccagtaactggcgtacgccacgccgcccggcgtctcgtcaccggagttgagggaggtcaggaacgagcttccggtgtacatctccgaacaggacgtgtagagccacttgcaccacgaggcgacggtcgtcccgtggttcaccccggcggtggagacgaagtcgtcgacgtacgacgtcccgccgaggttcttgaggtagtaacgggcactcagcgcgcccatggagtgcacgaccaggtcgaccttggacgcgccggtcctcgcgagcacgctcctgacctcggtggccagttgctgcgcggtcgtcacattcgactgggaccagtcgtacgaccacgcgtccagctcggaggcggtgtagccgtcggcctcgaagtcggcgatccagtcgtcccaactgctcgccgaactgctgatgccgtggacgaagatgacggggtcgtgggtcgcggctcgagcggggaccgcggccagggagagcgacagaaggatcgaagcgaccgcggccgagaagaccgcggtgacgcgccgcacgcggcgttgcatggtgcctcctgaaacgggtggggtctctggagtgtcagccgggttctacgcgcgccgcatcggtgaaatcgccggtctttacggaccagttaacccgccagtaacgtcaaacgcgtggtgacttcggtgaacccctcgccccttccgcggacttcgacaccgcaggtcacgcacgcgtggccgcgcctggacccgccccttcccgaaggcgtacgggtacgggtgctgcgcgccgcccacggagacccgcgcgccgccctggaactcgcctccgtactgagcacccgtcagctgaccggcctcgacccgctcccggccgaccccgcctccctcgtccccgcaactctgcgggcccaccgccgggagatccgcgccctgcccgacgacacccggctgctgctcctgctcgccgccgccgaccagtacccggtcgccacccacgccttcctgcgggcggtcgccgcggcccggctcgacacccggcccctggacgccgccgagaccgcgcagctcgcgcacaccacgcccggcgggatcgtcttccgcgacccgtggaccaggatcgccgcatacgagaccgcctccgcggcggaccggcgcgaggcccaccagctgctgggccgggtcctgagcggcgcgggtgaggcaccccgccggttctggcaccggggcgccgccgcgctcggccccagcagacggctcgcggcgcagctgggaccggccgcggcccaggcgcgccgggccggcgaacacgccctggcctgcgccctcgcggaacgcgccgccgcactcaccccggacccgcacgagcggccccggctgctcgcccgcgcggcggccgacgcctggcagtccggcgacggcgaccgggcccgccggctgatcgcggccacggacaacgacgcgctgggcggtctgctggcgctccgcgcggggaacgccggcgacgccttcgacgcgctgctcgcggcggcggcccggcacgcggccgccgcccacgccctgccaccgggcgcccccgaccccgccgtccacctcctcgcccgcgccaccgaagccgccatctacaccggggacctgcgccgctgccgggaggcggccgccgtggcggaccggctcgggatcgtgccatcgggcacgctcggcggactggcggccgcgttcgagggccgctacgccgacgcccgcgacctgctccaggccgccgccgggcgctgcggtcccggcggcgatcccaccctgctcatccattccggcatcgccgcgctgctcctcggcgaccacaccggcgccgccaccgccaccgcgcgggcggccgcctccgcccgcaccaggggcgagacggtcaccgtcccgcaggccatggagttccgggcctacgccgagttctggaccgggcgcccgcgggccgccgaggcgggcgccctggagtcgctgcgccaggcgtacaccaccgggcaggacaacggcgcctgccatctgcaggccgccctcgccatgttcgccgccctcaccggcgacgcggaggtgtgccgcgaccgggccgaggccgcccgctcctacgccctgccacgcggcctcggtctgccggccgccctcgccctgttcgccctggccttcctcgacctcagtaccggccgcttcgccgccgccgcggcccggctgcgcgccctggccgctttcggccccggccacggccaccgcgccatccggcacctggccaccccccactacgtggaggcggccgtccgcaccggcgacacccgggtcgcccgcgccgcccacgccgactacgaccactgggcgcgcaccatccgcaaccccgacgagctggccctgagcgcccgctgccgagcccttttggccggcggccccgaggccgtggaccactaccgcacggccctcgacctgcacgcctgcggtacccgggacttcgaacgcgcccgtacggagctgctgttcggcggcgcactgcgccggctgcgccgccgggcggaggcgcgtgaccgcctgcacagcgccctggcggccttcgagcacttcggcgccccgcagtgcgcggcgcaggcccgggcggaactccgtgttctcggcggtctgggcggtctcggcgaaccgtccgcacccgcccgcggcgcggacgacctggccgcccggttgaccgcccagcagctgatggtcgcccgcatggccgccgagggagccaccaaccgggagatcgccgcccgcctgctcctcagcccacgcaccatcgaccaccacctccggggcgtcttcgcccggctggggatccggtcgcgcatcgagctggtacggctcctgggcgagacggacgtgtgaggcctacggcacgaacgccgaggcgaacgtgtccgcgtcccacgttccgcccagtcggggcgccagccaacccggcgcccccgcacggaagccgacgggcgagtgcgcgccggcccccgccggaatcgcgccgagcagaccggctccggccacggccggcaggtcggcgaggttgcaacgggaggcgaggtcgggcgactcgggccagctcccgatgacgacacccgcgaagccgatctcccggcgccgcagttcacgtgccgtcagctccgtggtgttcagcgtgcccagtcccgccgacgccacgaccagcaccggcgcgtccagcagccgggccgcatccgccagggtgccgtccgcgtcgtcgaagcgcacgagcagcccgcccgccccctcgaccagcacgagatcgtgctccaccgccagcttcgccgcggcctcggccacctcgtgcggccccacgggcggcagaccggcccgccgggcggcggtcgcgggcgccaacggctcgggatagcgggcgagttcgagcgtcgtcaccgcacccgcgagacgggccacctcgtcggcgtccccgcgctcgtcgggccgtacgcccgtctgcgcgggcttgagcacggccacggaccgcccggccgcgacggcgaccgccgcgacggcggccgtcgtgaccgtcttgccgacctccgtgccggtccccgtgatcaccagtaccgacatgtcacccttcccttgccgccgcgcacaccgcgccggcgatccgtgccacatccgcgtcacccgtgacgtacggcggcatcgtgtagacgaggtcgcggaacggccgcagccacacgccctcgcgcacggcggcccgtgtcgcggccgccatggccgcctcgtcgagggggcggtcgagctgaacgacaccgatggccccgaggacccgtacgtcccgcactccgggcaggtcggccgcggcggcgagcccctcgcgcaaccccgtctcgatccgcttgacctcggtctgccagtcctgcccgagcagcaggtcgatcgaggcgttcgccaccgcggcggcgagcgggttgcccatgaaggtgggcccgtgcgcgagcaccggcacctccccccgggagatcccgtcggccacccgcgccgtgcacagcgtcgccgccagcgtcagatagccgccggtcagcgccttgcccagacacatcacgtccggcgtcaccccgacgtggtccgccgcgaacagcgcgccggtgcgcccgaaaccggtggcgatctcgtcgaacacgagcagcacgtcgtgcgcgtcgcacgcctcgcgcagcacccgcagataggcgggggagtggaaccgcatcccgcccgcgccctgcaccaccggctccacgatcaccgcggccagttcgtcggcgtgccgctcgatcagttcgcgcagctgatccgcgtacgactcctcgtaggcgaccggcggcgcgtcggcgaacacctggcgctggagcacgccctgccacagctcgtgcatcccgccctgggggtcgcacacggacatcggctgccaggtgtcgccgtggtagccgccgcgccaggtcagcagccgctgcttgccgggacggccgagcgaccgccagtactggaggcacatcttgaccgcgacctcgaccgagaccgagccggagtcggcgaggaagacgtgctccagaccctcgggcgagatgtcgacaagacgcttcgcgaggcgcacggcgggctcgtgggtgagcccgccgaacatgacatggctcatccgcgacagctgctcgcgcgccgcttcgttgagcacggggtggttgtagccgtggatcgccgaccaccacgacgacatgccgtcgatcagttcgcccgttccgtcggccatgcgcagccgcaccccgctcgccgcctcgacgacgagcggttcctgacggccgggcatcggcccgtacgggtgccagacgtgccgccgatcgaggtcgagcagctcggccagggacaggtcaggcattgggcgcgaggtccgttccggcaccccggcggcgtacggcgaccaggtccgtacgggcctcgtcggtccgcggcgcgggagcggaaccgcaggctccgccgccctcgtgcgacccgcaccccgcgctctgctcagacccgcagccgccggccggcgcccggtgctccggcagcgtcacctggtcggccccctccacctcgaacccggcgtccgcgatcatctccaggtccgccttgcccgcctggccctcgctggtgaggtagtcgccgaggaagatcgagttggcgaggtgcagcgcgagcggctgcatcgtacggaggtggacctcgcggccgcccgcgatgcggacctcgacgtccgggcagacgaaccggaccatcgcgaggatgcgcagacaccgctgaggcgtcaggttccactccttggcgagcggggtgccctcgaacgggatcaggaagttgaccggaacggagtccgggtccagctcgcgcagcgagtagaccacgtcgaccaggtcctcgtccgtctcgcccatgccggcgatcagccccgagcaggccgacaggcccgccgcgtgcgccttctgtacggtctccacccggtcggcgtacgtgtgggtggtcgtgatgtccccgtacgtcccctcggacgtgttgaggttgtggttgtaggcgtccgcgcccgcctcgcgcagccggtcggcctggccgtcggagagcagaccgaggcaggcgcacacctcgacgccctcgttctggtccttgatcgccttgatggtgtcggagacccggtccacgtcccggtccgtcgggccgcggccgctggccaccaggcagacccgcttggcgccgccggccagcccggccgccgcggcctgcgaggcctcgtccggcttgagccaggtgtacttcaggatctcggccttggagccgagccgctgggagcagtaggagcagtcctcggggcacaggcccgacttgaggttgacgagatagttgagtttcacccgtcggccgaaccagtgcctgcgcaccttgccggccgcggccaccacatcgagcacgtcgtcgtcggaggtggcaaggacggcgagcgcctcggctcggctcggcagctcgcgccgaagccccttttccaccagcgtgttcagcaggtccatgagagccgatcctgtcctatgcgacgggcccgggccaaggagagtttgcacaacagagacggttcaacgtgtgggtattgccacatcctgggcggccgacggtcccgctagggtctgtgcactgcctacaaaacacccgtcactacggtccggaggacacatggcgttcggctggatcgacgagcaggcgcacacgcgccgccgggccggtctcgtacgcaccctgcgcccgcgccccgccgactcgcccctcctcgatctcgcgagcaacgactacctcggcctcgcccgccatcccgagatcaccgagggcgcggccgaggcggccaggacgtggggcggcggcgccaccggctcccgcctcgtcaccggcaccacggaactgcacggcgaactcgaacgcgagctggccgacttctgcggcttcgaggcggccctggtcttctcctccgggtacgcggccaatctcgccgcggtcaccgcgctcgccccgcacggctccctgatcgtctccgacgcgggcaaccacgcctggctcatcgacggctgccggctggcgcggggcaccacccaggtcgtcgcgcacgccgatccggacgccgtgcgcaaggcgctggggacgcacgagggccaggccgtcgccgtctcggacacggtcttctcggtggacggcgacgcggccccgttggcggacctcgccgaagcctgccggcagtacggtgcggggctggtgatcgacgacgcgcacgggctcggcgtcctcggcgacggcggccggggcgccccctgggcggcggggctcgcgggcgcgccggacgtggtcgtgacggtcacgctgtccaagtcgctcggcagccagggcggcgccgtgctcggtccggcccgggtgatcgaccacctgatcaacgcggcccgtacgttcatcttcgacaccgggctggccccggcggcggcgggcgcggccctcgcggcgctgcggctgctgcgccgcgaaccggagcgtgccgcacgggcccgtacggtggcgaaggaactgcacacccggctgacggcggagggccacgaagcggtacggccggacgccgccgtcgtctccgtgcgggcgccctcccccgagcaggcggtgcggtgggcggcggactgccgggcggcgggtctcgccgtcggctgtttccgcccaccgtccgtgcccgacggcatctcccggctgaggctgaccgctcgcgcggacctcaccgacggtcagatcgaccgtgccgtgcgggtgatcggcgagacgcggccatacgtcggcgtaacggccgtgcatcgcacctagtgcgggacgagcggtcggctgtcagtccagtccggcgacgaatccctcccaggcctcgggggcgaacagcagggcggggccgctcacgttcttcgagtcgcggacggcgaccaggccggcccaggggccggggcccggccgggccgtctcgacgcagttgttcattccccgtgctgcggctgctgcgcagccaccgcacacctggcagagaggtacttgaggatacgcaccgaggcagtgcagtcatggtgcctccttacgagccgtcacctaatgcggcgcatgtaatccaacgtgtccttgggtgaaagggcgtggaaccgaagggtgtcgaaggcctcgctgtaggcctggaggtcttctttccgctcgagatagaggctactcgtcaggtggtcgagaacaaccacatccagatcagatctgctcggaaaggagaagataacgaaaggcccggtgattccgatgtgggcccccgcggcgaacggcagtacctgaagccgcacttgaggcagcttggccgcctccagcagccgttccagctgctgcgtcatgacctccgggccgccgacctcccggcgcagcaccgcctcgtcgaggaccgcggtcagttccagcggcgggttcgaacgcaggacgtcctgccgggccagccgcacctccaccagagtgtccagcttggcgtcctccgcgctgccgaccgcggcccgggtcaccgcccgggcgtactcgggcgtctggagcaggcccggcaccaccgaggtctccagcgtgcgcatcgcgctggcctgcgactccagactgatgaagtcgcggtacgtcggcggcagcaccccgcgataggcatgccaccagttctgccggacgccgccgtcgtcggagcccgccaacaccagcagcagctcgcgcagttcgggatcctcgacgccgtatacgtccaaaagcagccgtacgtcgggcggtttcaccccgctggagcccgtctcgatccggctcaccttggactggtgccagccgacgagaccggccgcctggccactggtgaggcccgcccgggcgcgtagggagcgtaattcggcgccgagtttgcggcggcgcactgctggtccgtactgcatggccgactcctttcgcccgggaagcgggctcgcggcgacggtagaggatgggccgaatgcccacccaaatacggtcggtcgtcggagagttcaccgcttcgggcgacagatatatgcatatcttggtggatcggcaccgaggccgccctggtgatggcagtctggcgcgaagcaccagtccgggaccgtactcgaaccctccgctccgtgtcgggccccggtcccgtgggaaagggacgacgtcgccatggcagatcaccaggaagcatccgtcactctgccgagcgatcccgcctcggtctccgccgcccgaaaatacgtcgcgagtgtgctggccgaatggggcctgccgggcgacgcggaagtcgcggacaccgtgcgcctgatcgtgtccgagctcgccaccaacgcggtccagcacaccttcgggcagtcacccacgttcacggttgacatcgcgctcgaccgcgacgaacacctgcacatcggtgtcaccgacagccatccacgcttcccgaaacgactgcccgcggccgtccagcaggacaacggccgcggaatggtcatcatccgctggctgaccgccgagtgcggcggcaggatgcgggtccggcccacccgggagggcggcaagacggtactgatcgaactcccgtgggcggtgtccgcgcagccggtgacggcaggggggcagcaagaaccctgaccgcgctgaactgtgccgcacggctgcttgaaccggccaccgggagagcgcgggcgcggtgcggccgaggtgttcggccgtccgggtgatcgagccggccccggcgaccgccgtcagcgccacgggtcggggcgggtcggggcgcaggcatggtcgccgtgccgcgtgtggacgtctgtcacggcgtacggacgctgcggtcgccgcgcacggcgccgcgtgcagcccgggccgtcgtggccgtcaccggcgccgttctcagggttctcggcgtggttctgcttccgggccggccggccgcgcgagagccgaacgctgcgccatcagcggcagtacgacccacagggccacgcacacggccagcgtccccgcgccggcggcgatgccggcaccccggcccagggccacgtccaccacgagcagcaccgacccggtgaaggccagcatcagcactccgaggccgatcgaggccaggcgggaggagagccgcacgatggtgggcttggcgttctgctggaacagcccccggtgcaccgcggcgggcgccgtgaacagcgccgcggccagcatggagagcagcagcgtggtgacgtacgtggcgcgctgcaccgtgtcgagggccgggaagcggggggtgaaggccagggtcagcaggaaggcgaacaggatctggacgcccgtctgggtgacccgcagttcctggagcagctccgcgaagttgcggtcggcgcgttccagggatgtctcgtcgcgcaacgctcgggcaggtcggtcggccatgggtgaacgagtaaccgtttcggcccgtgtcacgccccgtcggggtgacggcgcggccgcgccgtcaccccgacgggtgggtcagctgacccggccgtaccacacgctcttcgtccagatcttctggagcttcaccacttccccggtcttcggggagtgccagatctttcccttcccggcgtagatgccgacgtggtacacgctccggcccgagtggaagaacaccaggtcccctgccttgcggtgggacgcggagacatggtgggtcttgttgtactgcgccgcagccgtacggggcaggctcttgcccgccttcttgaacgcgtagagcgtgagcccggagcagtcgaagcggcgcggccccgcggcgccccacttgtagggggagcccttcttggacgccgcgatctggagtgccttcgtcgctggtgtcgcggccgcggcgtcggaggcgacgcccgggaccgcgatgctgccgcccacggcagcaagggtgagagctgaggccgtaccggccctggtcagcagcgaggggacacgattgagcgcagacatgcgcaacccttcgtcagccgcctgtgaaggatgacctgtcggattcggactggcgaagtagcccggccgcgtactgcggcttcaccccaaggaccttccggatctctccggaggcccgccttgctgggtcctccactcctgccgatccactcctgtcgaccagtcatccgggcggcggcaggactcggcgtccgcccggaccgccccgccgctgtggcgggggcttgccgtcaggaagggatcttcacccacaggtgtccgaaaatcccaacggaacggggagtttgtgttgttactcaccactcacccgttcgggtggacaccccttgttttcgaacggtgttgggagcaccgaggaggcccggacctgcactggaatgctctattccgcttttggcttacgcgcgttgcgcaacttgtacgggcctgaaaaattggggcttctacgctgatcgggggtacgccatttggttcgtttggaacccgggccggacgctcgtggcgcgcggtgggcgccggcccgggtgtgggtgcgtcaactgtcggatcgcggcggcacggtgacccgggccgcgcgccgctcgccgtcgaggacgcgcagggcctgcgcgagggtcggggcgtgcagctcgctctcgccgcgctggtgcatcagcgtcagcgcgtcgcgcagcgcggtcgccttgcccaccagtgcctgggcggcgcgcagtccgcggtaggtgtctcccgggcgcgcggggttgatacggccgaggaggtcgaccacgtcgaggtaacggtcgatcagctcggcctcggcgcgggtcagtgcgggcagcggaggcagttcgggcggcagcatcggcggctcacctcgcgccgggcgcggcggcggacgacttgcggctcgggacgacccggtcgaccaggccgtacgccacggccgccggcgcgtccaggatcttgtcccgctcgatgtcggcggcgacgcgctcggggctctgcccggtgtgccgtacgagcagttcctccaactgctcgcgggtacgcgccaattccgcggcctggatgaccagatcgctcgcctggccctggaccggcgcgggcagcgacggctggtggatcagcacgcgtgcgccgggcagcgcgagccgcttgcccggtgtgccaccggccagcagcacggcggcggccgatgccgcctgccccaggcagatggtctccacgtcgcagctgacgaactgcatcgtgtcgtagaccgcggtcatcgcgctgaacgagccgccgggggagttgatgtacagcgagatgtcccggtccggggccaggtgttcgaggtgcatgaactgggccatcacatcgttcgccgacgtgtcgtcgatcggtgtcccgagaaacacgatccgttcgtccagcagcttcgagtacggatccagtgtccggagcccggtactgaggcgctcggtgaactcgggcagggcgtagcgggcggacggtcggttcatggcttgcccctcctcggaatgactcctgtcgaaaatgtacaggacgtacagactgtggggaggtctctcgctgacagcgaaaatccccgtggggcaagggctccacggggatgcgcggcggctcggagctcagggaagaggggcggggcggcggccgaagtgtctcggaaggggacacgtcaacgggatcctccactccgggaggccccctgagcccggtctaagctggaggacatggcctacgagattcccgtgacgcaagccagggctgagctcgccgatctgatcaaccgtgtggtgtacggcggcgagcgcgtcgtcgtgacgcggcacgggaagcccctcgtcgccctggtctccgcggccgatctggagcggctcgacaagctggacgcggcggaggagcaggtggtcagcgcggtgtccagcgtccgcgaggtcgccgccgcaccccgcgagcgacagcgcttcggcatcgcggccgagcatcggggcccgaatgcctcgtagggcgtagaagagtgccgtagacgaagggcaccgggcgcagtggcgaggtgctcggaccgggtggcggccagtgagtggccgagagccccgaccggccgcggccccggctgcgtctgtggagctcaagtccagcccgggaacggattgccgagcgacatgatcagcagtgcagtgcagtgcagtgcagtgcggcgcggcgcggcgcgccgagcctgacgccggccggcccggggcgcggcacgagcccggtggcggccgtgctcaccgtcggcgccggcggccctgcgtgcccgtctcggcggctcaccggtcctgtcggcgcccaggctgaccgtgtgcgagaccggccgtcgcaagtttcaccaggtggcgggtgacggataggacgcctgcggccgaagtggtcggcggctggggctcctctgcggtgacgatgaccgcgccgtatacggtccggtcctcgaccacctctcgcgccgtgcccacatgggggtggcggtcggtctcgaacgcgccctcgtgccgctcccgttgccgccgcatgcggccggtcgcggccgccgggcccggcatgccgagcgggaggccgccgggcggacacggcaggcgggtgcgggtggcggggcggccgacggcgacgggggcaccgttctccccggtgcgggaccccggggctggaggtcaccaaaaagagcgggcgttcgggccgtcatgagtggatcaagggctggttaacgtagttgaaactccggcgaactagcctgccgatccatgccaccaggggttttcgtatccggagtgcgcatgatcgcgcaatctgtctgtatgttacatctatccccgccgcggtggctgcggcagccggaccccgcacggtccggagcgaggactgtgaggtgggacgccgtgcaactgaccccgcacgagcaagagaggctgctgatccatgtggcagccgacgtggccgagaagcgccgggcccgcgggctcaagctcaaccaccccgaggcggtcgcgctcatcacgtcgcacatcctcgaaggcgcgcgtgacggccgtacggtcgccgaactcatgtcctccgggcgcaagctgctcacccgggacgacgtcatggagggcatccccgagatgatccacgacgtccaggtcgaggcgaccttcccggacggcaccaagctcgtcaccgtccacgacccgatcgtctgacggggggagagcgcgccatgattcccggagagatcctcttcgccgacggacccgtcgcctacaacgagggccgcgaggtcacccggctgaccgtcctcaacgccgccgaccggcccgtccaggtcggctcccactaccacttcgccgaggccaaccccggtctggacttcgaccgcgccgccgcccgcggcaagcggctcaacgtcgccgccggcaccgccgtgcgcttcgaacccggaatccccgtcgacgtcgaactcgttccgctcgccggcgcccgcgtggtgcccgggctgcgcggggagaccggaggtgccctcgatgcctgagatctcgcgtcccgcctacgccgacctgttcggcccgaccaccggcgaccgcatccggctcgccgacaccgatctgctgatcgagatcgaggaggatcgttccggcggtcccggactcgccggtgacgaggccgtcttcggcggcggcaaggtcatccgcgaatccatgggccaggcgcgcgccacgcgtgcggacggcaccccggacacggtcatcaccggtgtcgtcatcgtcgaccactggggcatcgtcaaggccgacgtcggcatgcgcgacggccggatcaccggcatcggcaaagcgggcaacccggacaccatggacggtgtgcaccccgacctggtcatcggtccggagaccgagatcatcgcgggcaacggccggatcctcaccgcgggcgccatcgacgcgcatgtgcacctgatctgcccgcagatcgccgacgaggcgctcggctccgggatcaccaccctcgtcggcggtggcaccggccccgccgagggctccaaggccaccaccgtcacacccggcccctggcacctggcgcggatgctggaggcgatggaggagtacccgctcaacttcgggctcctcggcaagggcaacaccgtctcgcacgacgcgatgctgtcgcagatccgcggcggagcactcggtctcaagctgcacgaggactggggatccacgccggccgtcatcgacgccgcgctgaccgtcgccgaccggaccggcgtccagatcgccatccacacggacacgctgaacgaggccggcttcgtgggcgacacgctcgccgcgatcggcggccgcggcatccacgcctaccacaccgagggtgcgggcggcgggcacgcgccggacatcatgagcgtggtctccgagccgcacgtgctgcccagctccaccaacccgacccggccgttcaccgtcaacaccgccgaggaacacctcgacatgctgatggtctgccaccacctcaacccggcggtccccgaggacctcgccttcgccgagtcccgcatccggccgtcgacgatcggggcggaggacatcctgcacgacctgggcgccatctcgatcatctcgtccgacgcccaggccatgggacgcgtgggcgaggtcatcatgcggacgtggcagacggcccatgtcatgaagcggcggcgcggcgcgctccccggtgacggccgcgcggacaaccaccgcgtacgtcgctatgtcgccaagtacacgatcaacccggcactcgcgcagggcctcgcccgcgagatcggctccgtcgagacgggcaaactcgccgacctggtgctgtgggagcccgcgttcttcggggtcaagccgcacctcgtcatcaagggcggacagatcgcgtacgcgcagatgggcgatgccaacgcgtccatccccacgccgcagccgattctgccccggccgatgttcggggcgatcgggcgcgcgccggcctcgaactcgttcaacttcgtggcgccgctcgccatcgaggacgggctgccggagcggctctcgctcgggaagcggttcgtggcgatcgagtcgacgcgcggtgtgaccaaggcggacatgcgggagaacgacgcacggccgcgggtacggatcgaccccgacagcttcgccgtgcacatcgacggggagctggtcgaggccactccggccgccgaactgcccatggcccagcgctacttcctcttctgatgtcccgcgcagcactgctcgtcctggccgacggccgcttccccgccggagggcacgcccactccggcggcgccgaggcggccgtcaaggccgggcgcatcacggacgcggcgagtctggagaacttctgccgggggcggttgcacacggcggggctggtctcggccgcactcgccgccgcggccgccctcgggatcgatccggtgacgctggactcggccgcggatgcccgtacgccctcgcccgccctgcgggttgccgcgcgcaggctcgggcggcagctgatgcgggccgcccgggcgacctggccgtccaccgaactggacgcgctggcaagggagttccccaagggagcccatcaacccgtggtactcggaatggccgcccgcgccgccggcctcgcgcccgacgacgccgcgtactgctcggtgtacgagagcgtcagcggtccggcgaccgcgacggtacgcctgctgagcctcgaccccttcgacgccacggccgttctggcccggctcgcgcccgagctggaccgcatcgcacaccaggcggccggagccgctcgccaggcactcgacgacggcgtcgacatgctgcccgcggcctccgctccgctgctggagatcagcgcggaggcacacgcggcctggccggtgcgcctcttcgcctcatagaaaccctggagccgctccatgcatctcgaccacgcccacacccatgacggcccctccgccgtgagcgcggacgcccaccggcccgacggcacccggcgtgccctgcggatcggcctcggcggaccggtcgggtccgggaagaccgcgaccgttgccgcgctgtgccgtgccctgcgcgacgcgttctccctcgccgtcgtcaccaacgacatctacacccgcgaggacgccgagttcctgctgcgggaggccgtgctgccgcccgagcggatcaccgccgtggagaccggcgcctgcccgcacaccgccatccgcgacgacatctccgccaacctggaagccgtggaggacctggaggacgaagtcgggccgctcgatctcgtcctcgtcgagtccgggggcgacaacctcaccgccaccttctccaaggggctcgtcgacgcgcagatctttgtcatcgacgtggccggcggggacgacattccgcgcaagggcggccccggggtcaccaccgccgacctgctcgtcgtcaacaagaccgacctcgcgccgtacgtcggctccgatctggggcggatggccgccgacgccaaggcgcagcgcgccgaactgcccgtcgtcttccagtcgctccgcaccgagcccggggtcgcccccgtggccgactgggtgcgggcgcggctcgccgcgtgggcggcatgaccgcggcaggggtgcgggcgaccgcgcggatcggggcccggggcgacggacgcggcggtacgtcgctgcccgtactggagggtgaggggccgctcgcgctgcggcgcacccgggcgagcggctccgaggcgcgggtcatgctcgtcggggcgatgagcggcccgctgggcggcgaccacttcaccgtcgaggcgacggtcgccgcaggtgcccggctgcacgtcgggtcggcggccgccaccatcgcgctgcccggccaggccaagggcgaggcccgttacgacgtgctgctcgacgtcgccgcagggggcgagctgcgctggctgcccgagcagttgatctcggcgggcggcagcgagctgtatgtctccacgcgcatcgatctcgaacccggcgcccggctcgtcttccgcgaggaacaggtgctcgggcgcgtcggcgaggaacccgggcgcctcaccagccgtctcaccctgcgcatcggggggcgtgcggtgctcgaccaggagctggcctgcggaccgggggcgcccggcggctgggacgggcccgccgtgctcggaggacatcgcgctctgggacaactcgtcgtcgtgcggccggagttcgagcgggagccggtgcgggcccggctgcttggggagtccgccgcgctgaccccgctcggcggggccgcggcgctcgtgaccgcgctcgccccggacgcgcttttgctgcgccgcgtgctggacgaggcactgagcagcctcggctgaaccggcccctctccgctcaacggacaagcgcgtaccggttatcggattggcaaagaagccacgtcacccctgttctcagggacctcacagccgaaaggatccccgtaccattcgcaacgatgtacggggaggccccacttgaggggtatgagaccgacgagacgggtcacggcactgggttcggccggagcgctcgtgacggcgactctgatagccggtgccatggcggcaccgtcggccaccgccgactcgcgtcacggtcaggaccgggaggcccgcggcgccgcgatcgccgccgcgcgggccgccaaggccgggatcgactggcaggactgtccggccgactggggcttcgccaagccgatccagtgcggctgggtcaccgtcccgctcgactacgcccgcccgaacggcaagaagatcaagcttgccgtcgaccgcatcgggaacacgggtaccaaggaggagcgccagggcgccctcgtctacaacccgggcggccccggcggctccggcatgcgcttcccgacccgggtcaccaacaagaacccgatctggaccaacgtcgccaaggcgtacgacttcgtgggcttcgacccgcgcggtgtcggccactcggcgcccatctcctgcatcgacccgcaggagttcgtgaaggcgcccaaggccgatccggtcccgggctccgaggcggacaagcgtgcccagcgcaagctcgccgccgagtacgcggacggctgcgccgagcgcagcggcgacatgctgccgcagatgaccacgcccaacaccgcgcgcgacctggacgtcatccgcgccgccctcggtgagaagaagctcaactacctgggcgtctcgtacggcacctacctcggtgccgtctacggcacgctcttcccgggccacgtccgccgcatgatcgtggacagcgtcgtcaacccgtcgcgggagaagatctggtacgaggccaacctcgaccaggacgtcgccttcgagggacgctggaaggactgggaggactgggtcgccaagaacgacgcgaccttccacctcggcgacacccgtgccaaggtgcagaagcagtggctgacgctgcgcgccacggccaagaagagccccctcggcggtgtggtcggtccggccgagctgatctccttcttccagagcgctccgtactacgactcctcgtgggtgccggtcgcgacgacgttcagcaagtacgtcgccggtgacacgcaggcgctcgtggacgcggccgcaccggacctgtcggacaccgcgggcaacatcgcctcggagaacagcaacgcggtctacacggccgtcgagtgcaccgacgccaagtggcccaccagctggaagaagtgggacaaggacaacacgcggctcaacaaggactacccgttcatgacgtgggccaacgcgtggatgaacctgccctgcgccacctggccggccaagcagcacacgccggtgaacgtgaagacccacaagggcctgcccgccgtgctgatcgtgcagtccgagaatgacgccgccaccccgtacgacggcgccgtcgagctgcacaagcgcttcaagggctcccgcctgatcaccgagaaggacgcgggctcgcacggtgtcaccggtctgctcaacccctgcgtcaacgaccgggtgaacacctacctgctcacgggcgggacggacggcgccgacgtgacgtgcgccccgcacgccacgcccaagccgtagtcgtagccgctaggtgtgcgatggaggggtggccgggattccggtcaccccttcgtcatgccgacagccgtcaactcagcgggatccggggaaacttgcgggccttcgccgccttctcggcggcctcctcggccttgacgaccgccgcgtaccggtcgacgtactcctgttcggagagcgtgaggatggcgtacatgatctcgtcggtgatggcgcgcaggaccgccttctcgttctccataccggcgtagcgggagaactccaggggcttgccgaagcggatcacgacggggtggatgttcgggatgaccttgcccggcggctgggcctcgaaggtgccgatcatcgcgcagggaatcaccgggaccccggcccgcagggccatcaccgcgacgcccaccttgcccttgtagaggcggccgtcgtgcgagcgcgtgccctccgggtagatgccgagcagctcgtccttgcgcagcacgccgaggccttcgcggatcgcggcctggcccgcgtccttgccggagcggtccaccgggatctgtccggcgctgcggaagaacgcggccgtgagccggcccttgatgccggggcccgtgaagtactcggccttcgccaggaaggtgatgcgccgtttgaggatcgcgggcatcaggaagtggtccgagaacgacagatggttgcccgccacgatggccgggcccgacgacggtacgtgttcgagaccctcgatccgaggccggaacaccagcttcaacagcggtccgagaatcacgtatttgagcacgtaataaaacacgccgacgctcctttggtccccctcgggagcgatcagtgtaggcgtggccgtcgccgggcgtaaccacccggtgtgacgctgtgtcgtcacttggctggtatcaggcctcttgcgtcaacaccttctccagggtccccagagccgacgccagttcctcgccggtgatcgtgagcggcggggccagccggatcgtcgaaccgtgggtgtccttgaccaggatcccctcgcgcatgaggcgttcgctgatctcgcgcccggtgccgatcgcggggtcgatgtcgacgcccgcccacagcccgcgcgcccggaagcccacgacgcccttgccgacgagggcggcgagtccgtcccgcagcaccacacccagctcggccgccccgcgctggaattcaccggtctccagcagcccgaccaccgccgagccgaccgcggcggccagcggattgccgccgaacgtcgagccgtgctccccgggccgcagtaccgcgaggacgtcccggcgggcgaccaccgcggacaccggcacgatgccgccgccgagcgccttgccgagcagcagcatgtccgggacgacactctcgtgctccacggccagcgtgcggccggtgcgcccgaggcccgactggatctcgtccgcgatgaacagacacccggtgcggcgggtgagctcgcgtacgccggccagatagccgtcgtccgggatgacgacgccagcctcgccctggatcggctcgatcagcacggccgccgtcgtctcgtccacggcggcctcgagcgcggccaggtcgttgtacgggacgatccggaagcccggcgtgaaggggccgaaccccgtacgggcggtgtcgtccgtggagaagctgacgatcgtcgtcgtacggccgtggaagttgtcggcggccacgacgatcgtcgcctggtccggggcgacgcccttcacctcgtacgcccatttgcgggccaccttgatggcgctctccaccgcctcggcgcccgtgttcatcggcagcaccatgtccaggcccgtcaactcggccagggactcggcgaattgggccagtcggtcgttgtggaaggcgcgggaggtcagggtcagctggtcgagctggcggtgtgcggcctcgatcagcaccgggtgacggtggccgaagttcagggccgagtagcccgccagcatgtcgagatagcggcggccctcgacgtcctccacccaggtgccctcggccctggccacgaccacgggcagcgggtggtagttgtgcgcgaggaccggcgcctcggcacggatcaggtcggcggacgaacgcgtacgggcgggagcggtcatgaacggatctcctgagtgcagcacttgatgccgccgccggccttgaagaactccgagaggtcgacggggacggggacgtatccgtggcgtacgagctggtcggcgagggccgtcgcccccggtgagatgaagacgtgacggccgtcggagacggagttgaggccgaaggccagcgcgtcctcgcgggtggcgagcaccgcgttggggaagagccgctggagcacctcgcggctgccgggcgagaacgcctccgggtagtacacgatgttcgcctcgtggccgtcgtcgaggacgaacagcgcggtgtccaggtggtagaagtacgggtccaccagccgcaggctgatcaccgggacgccgaagaactcctgcacctcgcggtgcgcctcgaccgtcgtacggaagccggtgcccgccaggacgtagcggcccgccgggacgaggtcgccctcgccctcgcacaccgactccgggcggtacacgtcgaagcccgccgccttgaaccaggagtcgtacacggtggactcggggcggcgctggggcgcgtggaagtacgagccgaagacacggcccgcgaggacgagggcggagttcgccgcgaacaccatgtccgggaggtccgcgaccggctgcacggtgtccacggtgtggccgtgggcgcggtaggcgttgatcagcgcctgccactggccgcgggcgagatcgacgtccaccgaggtgtcgggatgcatccaggggttgatggcgtactgcacgccgaagtggctcggctcgcagacgagaaagcgccgggggcgcggcacacggctttcggccacagaggggtacctccgcttcctgcggtgtcgactgggggttgacaccaaggtaggaactaacggaggtggtcgacaagcgacaaaagctgcgtgtgtgcgcaggaatgctgcgttgctggccgagtcagcgcaggtctgatgcgtcctgcggtgccggctggctcgcgcccgcttcggggctttccgggaggaggtgggacagcaccatgtagctgaccgtcttccggatgaagggctccgcccggatccgctccagcacctcctcgaagtgctccacgtccgtcgcccgcacgtgcagcagggcatccgcgccgcccgtcaccgtcatcgccgcggtgatctccggatggttgcgcacgacctccgcgagccgccggggcggcgccgcgccctcgcagtacacctcgacgtacgcctccgtgcgccaacccagcgccgacggcttcaccgtggccgtgaaccccgtgatcaccccggtctcgcgcagtcggtccacccggcgcttgaccgccgtggccgacagcccgatcgccgcgccgatctcggcgaaactgctccgggcatgtgccgtcagagcggtgatgatcttgcggtcgaggtcgtcgaacgtcgtcggcttgctgttcatgtcggcactgtatccagcggcaacgtccatgccccggacatgtccaggcgtacgaaatgctcttacactccacgttcatgctgcgcgcgctcgccgtcgacgacgaacaaccctccctcgaggaactcctctatctgctgaacgccgacccacgggtcagcagtgccgagggcgcgagcgacgccaccgaggcgctgcgccggatcaaccgggcactggagtccgggcccggcgggcccgaggcgatcgacgtcgtcttcctcgacatccacatgccgggtctcgacggactcgacctggcccggctgctcaccgggttcgccaagccaccgctcgtcgtgttcgtcaccgcccacgaaggcttcgccgtgcaggccttcgacctcaaggccgtggactacgtgctgaagcccgtccgcagggagcggctcgccgaggccgtccgccgggccgcccagctgacggacaccgctccgctgataccggtgcacgagcccgaccccgaccacatgtccgtcgaactcggcggagtgacccggttcgtccccgtcgaggacatcacgcacgtcgaggcgcacggcgactacgcccgcctgcacaccgcccagggcagccacctcgtccgcatcccgctgtccaccctggaggagcgctggcgcgcccgcgggttcgtccgcatccaccgccgccacctggtcgccctgcgccacatcgacgaactccgcctggacacgggcacggtgagcgtcctggtcgactccgtcgaactccaggtcagccgacggcacgcccgcgaactgcgcgacctgctgatgcgccggaccacgagctgaggagcccctgcccgtgccccaggatccgacggaacggcgcgtggtcgtcaccggaccgccccggcgcgcccgccgggcctttgactactaccgcccgcgtaccgagatcgacgaacagaccaccctcggccacacctatgtccgctccctgatgcgctcccaactgcgcgccggactcgccgtgttcgcggtcctcgtgctgctcgtcggcccgctgcccctggtgttcgcggcgatcccggacgcccgccgcctcacctgggcggtgctcggcttctgcctctacgcgccgctggtgctgctcgcccgctggtacgtgcggcgcgccgaacgcaacgagcgggacttcgtccgtctcgtcgaggaccgctgaggccgtgaactccagctacgccgttcccgcggtcgccctcgtcgtcctggcgaccgtcctcgtcggcgcgttcggcctgcgcatctcccggaccacctccgacttctacgtggcctcccgcacggtcggcccccggctcaacgcggccgcgatcagcggcgagtacctgtccgccgcctcgttcctgggcatcgccggactcgtcctggtccagggccccgacatgctctggtaccccgtcgggtacacggccggccatctggtgctgctgctgttcgtggccgccccgctgcgccgctccggcgcgtacaccctgcccgacttcgcggaggcgcggctcgcctcgcaggccgtacgacggctcgccggggccttcgtcgtcggggtcggctggctgtacctcctgccccaactccagggcgccgggctcaccctggccgtgctgaccggcgcgcccgactcgctcggcggagtcatcgtcgcggtcgtcgtggtcgcgaccgtcgccgcgggcggcatgcgcagcatcaccttcgtccaggccttccagtactggctcaagctcaccgccctcctggtccccgcgctcttcctggtcctcgcctggcagggcgcgggcgcaccgcgcaccgccttcgacgaaccggcggccttccgcgaacagcgggtcgtgacggtcgacgagagcctcgacctcaagctgtcccgcccgctcgacgtcacggcgagcggcacggtcgacgggcggcggtacagggggaagcgggtggccctcgcccccggcgtgcaccgcgtcgagggcggcacccggctgaccttcgccgagggcgatcccgtcccggccgccgaccgcggcggcaacggcggcatgtcgacctccctggcggccggccgcgaggaacgtccgctgtacgccacgtacggactgatcctcgccaccttcctcggcaccatgggactcccgcacgtcgtcgtccgcttctacaccagcccgcacggagtggccgcccgccgtaccaccgtcgccgtgctcggcctgatcggcgccttctatctgctgccgccggtctatggggcgctcggccggctgtacgcgcccgaactcggcctcgccggcgacgccgacgccgccgtactgctgctgcccgaccggctgatcggcgggctcggcggcgatctgctcggcgcgctgctggcgggcggcgccttcgccgcgttcctgtccacggcctccgggctgaccatggcggtggccggggtgctcacccaggacgtgctgccctcgcgaggcgtacggcacttccggctcggtacggtgctcgcgatggccgttccgctggcggcgagcgcgctggtgggcgggctgccggtcgccgacgccgtggggctcgcgttcgccgtgtccgcctcgtccttctgcccgttgctggtgctgggcatctggtggcggcggctgactccgccgggtgcggcggccgggatgctggtcgggggcggttcggcgctggtggcggtcggcgcgaccatggcgggctacccgcggggcggggcgctgcacgcgctgctggcgtggcccgcgttgtggtcggtgccgctcggctttctgacgatgacgctggtgtccctggcgacaccggggcgggtaccggcggggacggcggcgatcctggcacggttccatctgccggaggaactgtccggcggaccggtgcgggcggaggccaaggcgtgagcggatttctggcggggctgtgcgtggccgtcctgcccctgctcgccgccggcttctggctcggccggcggaccgcgcgccccgagagcctcggcgggctcggcacgcccgtggagcacgccaccttccagaccctgcacaccgcctcgctcgccgcgccgccactgcgcgcgggtctcaccgaggagacggcccgcaagtccacgcggcggctgcgcaccctgctcggcacggacgcgctgtgcctcaccgacccggagacggtcctcgcctgggacggcgtgggggagcaccaccgcaccgagatcatggaacggctcgccgggcccctggagtccggccgcggcgaggccttccggctgacctgcgacatcccggactgccccctgcgctgggccgtcgtcgcgcccctcaccgtcgacgagcgggtgcacggcgcgctcgtcgcctgcgcgccccgcgaatcggccgtactcgtccgcgcggccggcgaggtcgcccgctgggtctccgtccaactcgagctcgcggacctcgaccggtcccgtacacggctgatcgaggccgagatcagggcgctgcgcgcgcagatctccccgcacttcatcttcaactcgctcgcggtgatcgcgtcgttcgtccgcaccgaccccgagcgggcccgcgaactgctcctggaattcgcggacttcacccgctactcgttccgccggcacggcgacttcaccacgctcgccgacgaactccacgccatcgaccactacttggcgctcgtcagggcccgcttcggcgaccgcctctcggtcaccctgcagatcgcgcccgaggtgctcccggtcgccctgccgttcctctgtctccagcccctcgtggagaacgccgtcaagcacggcctggagggcaccgccgacaagcggcacatcagtatcaccgcgcaggacgccggcgccgaggcgtgggtcgtcatcgaggacgacggcgcgggcatggaccccgaggtgctgcgccgcatcctcgccggagaggtcagcccgtcgggcggcatcgggctctccaacgtcgacgaccggctgcgccaggtctacggggacgaccacggcctcgtcatcgagaccgcggtcggggcgggtatgaagatcaccgcccggctgccgaagtaccagccgggcgtgcactcggcgggccggctgccccgggaatgaacggggcagccgtggtgggcgtcaggcgctgcgcgacatcaccatgccgaaagtgatcagacccagcacgacccagccgaaccacagccagccgttgctgccgagcgccaccgtgtaggccgtcaccacgacgagcccacccatggtgagcacccccatggtcttcgtagaaccgggcatcgcaacaccctcctcatggttcggtcccctccatggtgcccccgttctgccgctggacgctgcacacgacgagatgtgtgccggagtgccacgctccctttgcggcccacgaagccgcttcgtagacccccgggtcgtacccgtactgggccggcggcacgtcccgcgcgcaggcggcgtccgattgagcggccgccttcttaagggtggtgccggcgctgagccgggtgaagccgagcacttgctgatcgtgcggtccggcacaggagaccagctgggccctgcggagggaaggggcgtccagacagtcccgcttctgcatgttcgccgtgtccacgaaccacatgccgggcgtgcggtgacggtcgagcggcccgtacaccgcaccgtgcgcgcccagcaccagacaggcggtgcgccgcccggccgcctcgaatcccgcccgcgtcggcaccacggcgtagctgcgcacgtcggcgagcttctcccggatctcctgcgtgcgctgctcgcacgcggccggaccgtgctgccgcgccgcctcggcggacgtcgccgcgacgaccgccatgacctggccgtccggcaccttctcggcgcaggtcgggtccacggccagcttcggcgtgccctggaaggcggcgccgggccagtcggcgacgacgcagtcgccgtccttgagcggcgcggcgagggccacggccgctccgtaaggcttcgcgtcgccgccgccgggcggcagatgcgccaccgcgtaccagacaccgcccagcgcgaggacgaggccgagggtgaaggcgatgacggactgaaggacacgagggcgcttgcgacgccgccgaccggaaccgaaaccagcggcaccgaacgccgctccggcgggccggccgatgacatccgaaccgtacgaggaggcactgaggcctagccgtacgggtcgcggccgggctctggccgtacggcgacgcggtggggtcgtgggcgtacggggtcgcggccgggctctggccgtacgagggggcggtggggctgcggccgtacggcgaggcggtggggccgggtccgggtcgtggcgcgcccggctcctggccgtacgagggggtggcggggtcgtgggcgtacggggcggcgttcgggtcctgcccggacggtccggcggccggcccccgcaccggccccggctccgagggcgtgccccgccccgccgttcccgcggtcgcccccggtggcggtgaccccggcgcgctccccgccccggaccccgtgccgcccggtccgtacgcgcccgacgttccgttcccgccgggaccggcccccggcccgtgccccggatacccggtctcggtggtccacccggcctccgcccacggcggctgcgaccccaggtcgaactgggtgcgcggatggggctggggcgtgacgatcgccgacagcgcggcctccgtgtcctccgccgtgatccgctgcccggggtccttcgcgagcatcgcggcgagcaccggttccagcgcccccgcccgcaccggcgggcgcggctcctccagcaccacggcggtgacctcggcgagatgcgtgtcccgctcgaagggcccgcacccctcgaccccgaagtacagcgtgcaccccagcgagaacaggtcggcggtcgcggtcggcggcccgccggtcgcccgctccggcgccagatagccgggcgtgccgaccagcgccgacgtgagggtgtaccgggtctcgcccgcgtccggttgcacggagatgccgtagtcggtgagcagcacgcgcgcgtacgccgcccccgtgcggtccggcgccagcaggatgttcgccggcttcacgtcccggtgcatgatgccgcgctcgtgccccgcggtgagcgcgtcgagcacggcgagcccgatgcgggcgcactcggcgggcgccagcgggccgcgccggcgcacgaggtcccgcaggtcgagcgcgcccgccacgtactccatcacgatccagggcaggccctcgtgctccagtacgtcgtgcacggtcaccacatgcggatggccgcgcagcccggcggcgtgccgggcctcggcccgggcacgtgcgacccgggccgtgcgctcctgcccggcctccgccggactgcggaacacgatctccttgagcgcgacctcgcaggccagccgctggtcatgggcgagccagacatggcccatgccgccgctgccgagccggttcagcaggaggtaccggccggcgatgacccggcccactcccgactgcggtgatcctgatggcatcgggtctccccggctaggccgtggtggtggaggtcgcttcgccggccacgggaccggaggcgaccggatcggaggcgaccggatccgacgtgaccggctgggcggtcgccggggcactcgtcaccggagcggacgtcaccggagcggacgtcacgggcgcgctggtgaccggccggctcgtgggcggcgaactgctcacggcaggcggcgggctgctcacggcaggcggcggcctggacgcggacgcgctgctcgccggcggcggctcggaactctcggaactcccggaactcctcgaggcgccaggagggccaccgctcgtcgcggacgagggcggagacgaagcgggcggcggggacgaggtcgtagcgccaccggaggacggaggcggctggccgctccccccgggcgtcgtcgagcccgatgccgggggagcgctcgtaccacccgtgcgcccctcgccggtttcgccggtggtcccgtcgccgctccccctgcccgtcttgccggccgtcccccgctccacggacagcgtcacgtactccccgaactccagctcggtgcccggcgccgggtcggagccggtgacccgggcgtcgtcgggtggcggtcccttttcgccgtacgccgctgcgaggcccttgtccgccagtcgctgactcgcgtcgccgaaccccataccggccacttcgggcaccttgtgccgctcgtgggtgtcgaacggggagtcgtgtgcgccggtggtgccggccggccgggtgatcccccggtccgggttgtcgacgtcgacgagcgcgagttgctcgatgcgccgcggggcgggcttgacggccaccagagaggcacggtcgtagccgtcccacttcttgttgccgttctcgaacttgaccgaaatcctcgatgcgtcacccgcgaagggccgcagcggatttccgcaggaacacttcaccgcgggaagtccctgctcatccaccaatatcgcgatgcccgcctcgagcaaggagttgaaaggggctgccctgccctttttgtagtcgtggttctgcacgagagtgtcgtgacgcagcaggaccggtgtgagcctgtcgaggtaggcgggaatctcgtcctgggaaatcttgagcacctgcgcccagacatgtgcctttcggtcgttcctgggatcggtgaggaatttcttgagacggttgacgtcgcagatcgtcggcttccgtgtgcccccgtacaggcctggcgtgttgccggcctgtaggccgctgtgcggctgttggcgacggaccgtggagtcgtggccgaggccactttcctcatcgaagaaaggtgcgagtgaaggaactcgcgcggcgacggctttcaccgtcaacagctgcgggcctctgtcgcacccgctcaggaccagagcgcagaccagcagaatgccaagcctgcggaccaccgattttcctgccctttgcatgggcatgcaaaatgtcataccgctccccccagcggttcccccatcaccccgcagtacggaagcagggcttcgcccaccatgctactgaatggaaaagcctttcacgcaaggcgagttgcaaagttaattcagttgccgcgtgcgttgagtgaggccagataggcgttgtacgcctcgagttccttgtcgccgtcccggtccgcggcccggtccgtgcggcgggcctggcgctgctcggagttgtaccactggaagagcagcgcgagcaggacgagcacggaggggatctcgctgaacgcccaggcgatgccgccggccgcgttctggtcggtgagcgcgtcgacggcgagcgaggcgggggggttcttgtacgagttgaccatcggctcggacgccatcatcaacgcgatgccgaagaacgcgtggaacggcatgcccgcgaacagctccagcatccgcaggagatagccggggcggtgcgggcccgggtcgacacccatgatcggccagaagaagaccacgccgacggcgaggaagtgcaccatcatcccgatgtgcccgaccttggatcccatcaggaagtcgaagagcgccgagaagtacagcgcgtacaggctcgcgatgaacagcgggatcgtgaacgccggatgggtgacgatccgcaggtagcggctgtgcagcagcatcaggagcagctcgcgcggccccgtccggtcacggccggccgtcggcagcgcgcgcagcgccagcgtgatcggcgcgccgagcagaatcaggatcggtgacagcatgctgatcaccatgtgctgcaccatgtgcacgctgaacatgaccatgccgtagtcgttcagcctggtgcacatcatcagcatgacggtcagtacgccgatgacgtacgcgacggtccggcccaccggccacttgtcgccgcgccgcaccaggcgcaccacaccccagccgtacaggccgagccccagcaggcaggcgacgaggaagaacgggtccgcggaccactcgagcccccgccccagcgtgaacggcggcagatccgtggtcatgccgtgcccgccgctgtgatccatccgtcggctcctgattcgtacgttgtgcgctgtctgtccgcaccagagtagaactgcccccggccgcagccgcgaccgggggcaggtgtgctcacgtgtgccttacaggacgcactccgcctcggcgtaccgctcctcggggaccgtcttcagcgtctcgaccgcctcggcgagcgagaccatcacgatgtcggtgccgcgcagcgcggtcatcttgccgaactcgccccggtgcacggcctccacggcatgccagccgaaacgggtcgcgaggacgcggtcgtacgccgtcggagtgccgccgcgctggacatgtccgaggatcaccggccgggcctccttgccgaggcgctcctccagctccagggagagctggcgggcgatgccggcgaagcgctcgtggccgtagacgtccttcttgccctcgtcgaagtccatcgagcccgcacggggcttggcgccctcggcggccaccacgatcgcgaaccgcttgcccgcctcgaagcgctcgccgaccttggcggccagttcctcgatgtcgaaggggcgttccggtacgacgatggcgtgggcgcccgccgccatgcccgagtgcagcgcgatccagccggtgtggcggcccatgacctccacgatgaggacgcgctggtgggactcggcggtggtcttcagccggtcgagcgcctcggtcgcgacgcccacggcggtgtcgaaaccgaaggtcacgtcggtgaccgcgatgtcgttgtcgatggtcttcggcacgccgacgatcggcaggccggcgtccgacaggaggcgggccgccttgagcgtgccctcgccgccgatcgggatgatcgcgtcgaggccgagctccgcgacatggcccctggcccgctccacgccgtcacgcagatgcgccggctggacccgggaggagccgaggatggtgccgccgcgagccaggattccgctcaccgcgtcgaggtcgagcttgaggtagtcgcactccaggaggcccttccagccgtcccggaagccgatgacctcgtcgccgtggtcgacgacggcccggtgcacgacggaccggatgacggcgttcaggccggggcagtcgccaccggacgtgaggacaccaatgcgcatcgcccgaaataccttctcaacgtgggccgggaccggaccacgctgtccggctggatccccgccaccctaccggcggtagggggcggggccgtacggggcgtccgcctgctggacgcccccgcacacgtgagcggaggcctggtcagacgggcctgtgcggaaccgtttcatgcggcgctgacatgggccttacgcgggctgctgcgccgcggcgatgcgctcgccccgcagcgcctcgtaccaccggtcgtcgatcggcggcagcgcgttcacatcgagggccagcttcagcagcaggtccgcgatcagcgggttgcgggcgagcacgggaccgtgcatgtacgtaccgaagaccgtgtcgttgtacgcgccctccgtgccgtcacccgtgccgttgcccttgccgagccgcacctgggccaaggggcgggcggaggggccgaggtgcgtgacgccctggtggttctcgaagccggtcagctggggcaggccgaggcgcgggtcgatgtccccgaggacgtcgccgacgcaccgctcgccctcgccgcgcgtggacaccacgtcgagcaggccgaggcccggctcgcgctggccgaggtcgttgatgaactcgtggccgaggatctggtagccggcgcacaccgagaagacgatcgcgccgttgcccaccgcgcggtgcagaccgccgtcacggcgcagccgctcggccgcgagccgctgcggacggtcctcgccgccgccgatcaggtagatgtcgccggaggtggggatcggctggtcgctgcgcacgtcgaggcgggccacgtcgaggccgcgctggcgggcccggcgctccacgacgagcgcgttgccctggtcgccgtaggtgctcagcaggtccgggtagatccacaccagccgcagttggttgtctgtcatcggtcgtcctcgtcctctggggtcagttgccgacacggcgccgcaggtcctggaaggcggtgtagttcgcgatgacctcgatgcggcccggcggggcctgctggacgcactggtcgaggttctcgcagacctggaaggactggttggcgacctccagacgcacggccaggtccagcttgcggtctccgatgacgaagatcgggtggccggtcagccgtgtgtagtcgacgtcccacagccaggaggtgtcggtgccgtcggcgccgcgcgcgttcaccgacaggatcaccggggtcggcggcgggtcgatcagcgagaacgtctccagccagcccgccgggttcttggcgagcagcaggcgcaggtcgcgctgcatgaactggacgacgtcatagcgcccggccaccgcctggaccgcgtacatgcgctccagggcgacctgcgggggcacgccgaagacggcggcgacggcggccgaggaggcggcgttcgccttgttggcgcggcccggcagctggaggtggatcggccaggcggagccgtgcgggtcgaggacgtggtcgccggacagcgcccagctgggcgtcggccggcggaaaccgcactcgccgcagaaccagtcgtcgccggggcgctgcatcacaccgccgcaggacgggcaggaccaggcgtcgtccttccacatctggccggctgcgacccagatcacattggcggaggacgacgcggcccacacgaccagcgggtcgtccgcgttggcgatgacgacggccttggaaccggccaggccctcacgccagtgctcggcgagcatccgggtctcggcggcgcggtcgagctggtcacgcgagaggttgagcagcgcgatgcacttcgggtccgtgtcccgggccacaccggcgaggtacttctcgtcgacctcgatcaccgcgtacttggcgtccgagccgcccgcgagcgccgaggtgatgccggccggcatgttggcgccgagcgcgttggacacgaccgggcccgcggcgcgcagcgcctccgcgatcagccgggtcgtggtggtcttgccgttggtggccgacaccaggatcacgtccaggtgctgggcgagccgggcgaggaggtcggggtcgagcttgagtgccacccggccgccgatcaccgatccgctcccgcgtcccgcggccctcgatgccgccgcgaccgccttgcccgccgtcacggccagcttggcccgcggcgtcagcgggtccgagttgcctgccatcagttctcgatcctccttgcgtacagcgccgcgccctgtcccggcaacgtgtgggcctcagcctatcgagatccactcaccggcccgaatcgcggcaccaccccggtgcccgcgcgacattgaggaccgtacccttgccgccatgcgacacggctccatcccgggcacccgagggcacgtcagacccctcgctctgctcggcgaccccgtcctgcacgcaccgtgcgaggaggtgaccgaccacggccccgaactggcccgcctcgtcgaggacatgttcgccacgatgtacgcggcgaacggggtgggcctcgccgcgaaccagatcggcgtgccgctacgggtcttcgtctacgactgtcccgacgacgaggatgtccgtcatgtcggacatgtggtgaatccgcgtctgatcgaggcggacggtgtggtgttgcgggggccggagggctgtctgtcgctgcctggcctggaggcgggcaccgagcggtacgaccgtgccgtcgtcgagggcttcacgacggacggcgagccggtgcgggtgctcgggacggggtggttcgcccggtgcctgcaacacgagtgcgatcacctcgacggcggggtgtatgtggaccgggtctccggctggcgacaccgaagggtgatgcgacaggcggcacgggccccgtggaatcgccaaagagccccggagccccgctaggggtgcgagaccaaccatggacgaccggaacccgggatcggccaggggcgaccagaacccgggaccagccacggaccaccgggaaacccgggaccagccacgacgccccgaacccgggaggcggctctcagaacccagggccgccgatcttgtcgcccgccgcggcgagccgtccccacagcaggtcggccagactccgcaccaactcggcccgcgagcacggccgttcgcccagccaccagtcgcccgccgcatgcatcatgccgacgatcccgtgcccccacacccgcgcgagctgctggctgccgggcccgaggtcgagccgttcctcgatgacctgtgccagttcctcgcccatgcgccgcagcacgggaacggagttcttgcccgtgtcgaagccctggtcgctctgcgagccgccctccgacgggtgcatcaggaaccggtacacctgcggccgtgcctcgatcgcggcgaggtaggtgtcgagtgtggactcgacgcgctccctgcgttccgcgggtgcgtcgagcgcggcccgcagcgagtcgagcagggcgtcggtgtggcgcttggcgagggcggcgtacaggccgctcttgtcgccgaagtggcggtagaggatcggcttggtgatgccggcctccgcggcgatggcgttcatcgaggccccggggccgtcgcggagcaccactctgtcggcggcctccagcagctcgcgccgacggcgatcggcggaccgctgttgatcggtccgctgctgcgtggtgtccatgagcctctccccacccgtgctgttttcggtgacgcctgcgcaaactaacacccacaggcctgctcgtatcgaacgggctgccgaaggaggcccgggagttgactttccctactggtcagtaacagactctggttaccgcaagtaacaccttaatgcagcgctggaggggacatggccgagttcaccatggagctcaacgacgaacagaaggaggtcagggactggctgcacggcttcgccgccgatgtgatccgccccgcggccgccgaatgggacgagcgtgaagagacgccgtggccggtcatccaggaggccgcgaaggtcggcatctactccctggacttctacgcccagcagtacttcgaccccaccggcctcggcatacccatggcgatggaggagctgttctggggcgacgcgggcatcgccctgtccatcgtcggcaccggcctcgccgccgtgggcgtcctcgccaacggcaccgaggagcagatcggcacctggatcccccagatgtacggcgatgccaacgatgtcaaggtcgcggcgttctgctcctccgagcccgacgccggctccgacgtgtcttcgatgcgcacccgtgccgtgtacgacgaggccaaggacgagtgggtcctcaacggcacgaagacctgggcgaccaacggcggcatcgccaatgtccacgtcgtggtcgcggtcgtcgactcggagctgggctccaagggccacgcctccttcatcgtcccgccgaacacgccgggcctgtcccaggggcagaagttcaagaagcacggcatccgcgcctcgcacaccgccgaggtcgtcctggagaacgcgcggattcccggttcctgcctgctcggcggcaaggagaagctggacgagcgtctggcccgggcccgcgagcgggccagggcggggggcggcgagcgcgtgaagaacgccgcgatggccacgttcgaggcgtcccgcccggcggtcggcgccatggcggtgggcacggcccgggccgcgtacgaggaggccctggagtacgcgaagacgcgcgagcagttcggccggccgatcatcgacaaccagggtgtcgccttccagctggccgacatgcgtacgtccatcgacgcggcgcggctgctggtgtggcgggcctcctggatggcggtcaacggcaagccgttcaccgcggccgaggggtccatgtcgaagctgttcgccagcgagaccgcgaagaaggtgaccgcccaggcggtccagatcctcggtggcaacggtttcacccgggagtacccggtggagcggatgcaccgggatgccgcgatttatacaatcttcgaggggacgagcgagatccagcggctggtgatcgcccgcaccctgtcggggatgccgatccgttagtacgccgcctggcggggcgccgcggtcggcggtatctcagtggtgcttcagcctcagcggtgtgagctgctggatgtcgtatctcgcccgcagttcctcgatcgccgcgtggtccggcgggccgccgctgcccaggatctccaggagttcgtcgaagtaccgttcgtggtccggtggcggggacgcctggaagaacatcttcgccggggtgtcggtggggttcgcgaaggcgtgcgggcagccgggcggtacgacgatgaccgtgccgggagtggcccgtaccacccgggtgcccgaacgggactcccagtgcttccagttgtcgggcgtgcggacccgcggctcgaaggcgagcacgtccagctcgccttcgagcacgtagaacagctcctcgctgcgggtgtgcacatgcgcgcccacgtcgaagccgggcggtacgaccacctcgaagctcgacgccatccgtgagtgcgtgccggtcaccttgaacgtcacgtgctgggcgggcgtccggacgacgcggccgtgccccggcggcacgaggagtccttcggtggccgtcatgagcccgctcaccaggtcacgggcagggcttcgggcccgcggatcaacgcacccttcttgaagggcaccaggcccggcgggaccgcgagccgcagccccggcacccggtcgagcagcgcctcgaccagcagctcggactccagccgggccagcatcccgcccacgcagtaatgcggtccgaagccgaacgacacatgcgggttcgggctgcgcgtgaggtcgatccgttcgggatccgggaagacgtccgggtcgcggttggcggccaggtacgacacgtacaccgtgtcgccctcccggatgcgtacgccccggatctcgatgtcctccgtcgcgatccgcgagaggccgaccgcgttgcggtgcgggatgtagcgcagcagctcgtcgatgccctgcggacggatcttcggctcggcgcgcagccgttccgcgaggtcggggcgggtcagcaggatgtagaacagctgcccgctgttgttggtgaccgcctcgccgccgatctggatgagcacggcgagcccgacggcctcgtcgagggtgatctcgccgctgcccacggcggcgccgagcagcgaagtgacatcctcgcccgtgctgccgcgccgctcgccgatgagccgctcgaaatgcgcgcccatgtcgttcctggccttctcgctgacctcggcgccgtgcgcggaggacaggatcagctgggtccaggtgtgcatgctgtgccggtcggcggccggcacgcccatcagctcgcagacgaccgcgatcgggaaggggctcaggaccgtctcgacgaggtcggcgggcggcccgccccggagcagctcgtcgatcagctcgtcgagcatccggcgggacttctcccgcacccgctccaccccgcgcgccgtgaaggcggccgccaccgagcggcgcagccgggtgtggtcgggcgggtcgaggaacccgaccgcgcccgccgtgggaatgaagtgcggggcgagccgggtgacctgccgccccatgaccgccgcgcggctgaaccgggggtcgttggcgaccatgcgtacgtcgtcgtagcgggtcaccagccacgcccagccctcgccgttgggcagctggatccggctgaccggaccctcgctcatcagctgggacagcaccgggtcgaactccacgcccgtcaggttgagcgcgggccagtggcggacgggcggcagggcctcggtgatcgttttctcggtcatctctctacgcctcgtcggtgcggtgccagcggcccagcgacatctcggcggtgatgccgggcccgaagccggcgagcatgccgcgcgccgcgtgctcggcgccgccctcgtcgaagagccggcgcagcgcgtccaggacgacggcgctcgcgatgttgccgtactcggtgagcgtggcccggctgaaccggaaggcctccggcggcactcgcaggaacttgctcaggtcgtccaggatgcgcggaccgcccgcgtggatgatgtagaagtccaggtcggaggcgtcccagccgtgctggctcgccagctcctggagtgccggagcgagcggctccatcgtgccaggcacccgcttgtccagcaggaagtggaagccggtggcgcggacgtcgtaactgatccactcgtcggtcttggggatcaggtacgacgcgttgcgctccagcgtgatgccggtgccgcccttgccgcggacggccgcggcggcgatgccgtcgccgaacagcccgttcgacaggagtgagccgacgcccaggtcggtgggctggtagcacagggagcagaactcgcaggccacgatgagcgcgttggcctgggggtaggccgtgcagaagtcgtgtgcccggttgatcgccgagccgcccgcggcacagcccagctgggctatgggtatctgccgggtgtcggagctgaagtccatcgagttgatcaggtaggccgtcagcgagggcatcatgaaccccgtgcacgacacgtagatgatcacgtcgatgtcggtggtgagcagctcggcctcgtccagcgcccgctgcaccaccgcggggacacgggccttggcctcggcctcgtagacgtggttgcgctcctcgaagccaggatgcttcagcgtctcctcgatcggctgcacgatgtgccgggtgtggacccccgtgttctcgatcagccgcagcgcgagcgggagttgggggtgatcggggtgtcgggagcgcgccagttcgagcgtctcctccattgtgatcacgtgttccgggacagagaccgcgggtttgcacagcgtcgccatggaggaccttctttcgccttccggaggactcttcgtcccccgggggaagtggggctcacccacgatcacccgggggagcgtggatatcccgtcggactactccgttccagcgagtgacagtgcgtgacccccgcccgtgaccagcacatgagacgctggtgggagggcaacagagcagcgaagccgaaggagtggcggcgatggcgcggacagcaagggaactgctggagacgaccaccggaagactcgcccccgacccccatgccaaccggctgctgccgctgatcgcccggggtgccgcccggcgcaccacactcgcggcgctcgccctcgaacagcgccatgtgatcgcggcggaccgccaggcgttcctgcatctggcacagcggtcggtgaacgaaccggagtgcgccgcgttcttcgacattctcacggagagtgaggatctggccggggaccggctcgcggcgtacgccgccgcctgcggggtggacgaggcgtggaccgccgcgtacgagcccctcgcggactgccagacctatccggcgtacgtcgcctggctcgcgctgaacggctcgccggccgacgtggtgctcgcgctgagcgccaacttcgccacgtggggcggctactgcgcgacgatcgccgaagccctgcgccgccactacggcttcgacgacgcggcctgcggcttcttcgacctcttcgccgagcccgcgccggagctggaacagaaggcgcaggccgccgtgcaggcaggcctggactacgggctggtcgacgaggacgaggcccagcgctacgggcggctgctccagggctacgaggcgaggttctggcacgccctgtgggagctggaccagcgcacggcctgaggggccgcccgtacgtcagccggccgtcgtcccgctgctgtgggcgatgcaggccacgtcgatgcggtcggcgagcttggcgagttcgatggtgagcgtcgccaccgtgtcctcgtccagcccgtcctgaccggcctccaccagatgcagccaccggccgcccaccgtgcgcagcagcttgctgacgtcggcggccgagacctgcaacgtgccgcggtcgtcgacgatcagaggcagggtcacttcgcggttcacagaggggatcgtagccgcggaacgctcacgctccgtgccatacggtggtgatgttgcagaactcgcggattccgtgtccggacagctcacgaccgtaacccgaccgcttgaccccgccgaaggggaacgcgggatgggatgccgtcatcccgttgacgaacacgccaccggcctccaggtcgcgtacgaaccggtcgacctcggcgtcctcgcgcgtccagacgttggaactcagtccgaacggcgtgtcgttggcgatggccaccgcctcgtcgagatcggccgcccggtagagcgtggcgaccgggccgaacgcctcctcgaggtggatgcgcatctcgggggtgatgtcggtgaggacggtcggcgcgtagtagtagccgcgctccgtgtacccctcggggcgctcgccgccgcacagcaccgtcgcgccgttctcgaccgcgtcgtcgaccagctcctccagatcggtgcggccctgctcggtggagagcggcccgacctccgtgtcctcgtccagcgggtcgccgaccttcagcgccgccatgcccgccgtgaagcgctcggcgaaggcgtcgaacacgtccgtgtgcacgatgaaccgcttcgcggcgatgcacgactgcccgttgttctggacccgcgcggtcaccgcggtcttcgcggcccggtcgatgtcggcggacggcatcacgacgaacgggtcgctgccgccgagctccaggaccgtcttcttgacctggtccccggcgaccgaggccacggcccggccggccggttcgctgccggtcagcgtggccgcccggacgcgcgggtcgcgcaggatgccctcgacggcgccggagccgatgagcagcgtctggaagcagccgtcggggaagccggcccggcggaacaggtcctccaggtagagggcggtctgcgggacgttcgaggagtgcttgagcaggcccacgttgcccgccatcagcgcgggcgcggcgaaccggaccacctgccacagggggaagttccacggcatcacggccagcaccgggcccagcggccgatagcggaccagggcgcgcgaggccccggagtccttcacatcggaatcggccggttcctcgtccgcgagcagctcctcggcgtggtcggcataccagtgcatcgccttcgcgcacttcgcggcctcggcgcgggcctgcttgaccggcttgcccatctcggtcgtcatcacccgggcgatgtcccgctggtcctcgtcgagcaggtccgccgccctgtgcagcagccgcgcccgctcggcgaacgtggtcgtgcgatgggtccggaacgcgctctgtgccgccgcgagcctgcgctcgatcgcctcggcgtccagggcttcgtacgtcttgagcgtctcgccggtcgccgggttcaccgtcgcgatgggcatggccgacctcctgatgcgggctgtccttcgaccctcccgcgcggcgcggggcggcgcaacgcgaagggtgctctcagcccgagtgctccgccagccggtcgagaaaccccgtctgccccttcacgatcacggcgcgcgcccggtccaggccgaaccactccacccggtccagctcggggaactcctgacttcggcccgacttcggcggccactccatcgtgaaggtgccgggcaccacggtcgccgggtcgaggtccgcctcgatcgcccacgcggtgacgatcttgccgttcgcctgccggacctcgccgagcggcacggcctgcccgtcgggcggcgcgagccccagctcctcctggaactcccggcgcgcggcgtcccaggccggctcgtcgggctcgtactcgcccttcgggacggaccacgccccggcgtcacggcgggcgaagaacgggccgcccatatggccgagcaacacctcgataccgtcgtcggtgtgccggaacaacagcagccccgcgctgcgcttcccgctcaccgggtcacctccgggtgcgcggcgagcaaggtctcgaccgtgtcggcctcggccggggtcttgtcctcgcggtaccggacgacgcgggcgaagcggagggtgacgccggccgggtagcgggtggacttctggagaccgtcgtacgcgatctcgacgacgagttccggccgtacggtcaccacggagccgttctcctcgacggccagctccgtcagccgctcggtctgccaggtcagcatcgcgtcggtcatgcccttgaacgtcttgccgagcatcgcgaaggacccgtccgcggcgcgcgccccgaggtgcaggttggacagcttgccggtgcgccgcccgtggccccactcggccgcgagcaccaccaggtcgagggtgtgcacgggcttgaccttcagccaggaggcgccgcgccggcccgcgctgtagggggcgtcgagggctttgaccacgacgccctcgtggccgcgcgcgagcgtgtcggcgaggaacgtctcggcggcggcgccatcgtcgggaccggacacgagcgcgcgccgcacgcgcagcggctcgggcaccagccgggccagctccgcgtgccgctcggtgaacggcaggtcgagcagatcccgtccgtcgacggacagcgcgtcgaagaacacgggggagacgggcaccgacgcggcggccgcggccacgtccacgcgcgagcccacgcgcccggcgatctcctggaaggagcgcggccgcccgttcccgtccagcgcgatgacctcaccgtccagaatgaaccggtcgcccttcaactccagggcggcggcggtgagttcgggcaaccggtcggtgatgtcgtcgagggtgcgggtgtagatccgtacgtggtcgccgtcgcggtggagctggacgcggatgccgtcgagcttctcctcgacggcacacgcgcccagcttgccgacggcctcggccacggatcccgccgtgtgcgccagcatcggcagcaccgggcggccgacggtgagccggaagccgtccagggcccccgggccctccgcgagcagcgcccgcgccaccgtctggagcgatccggcgagcatcaccgcccgtcgtacgtcggcggggggcgcgccggtcgcctcggccagcccctcgaccgcgaccgcgtccagcgcgccctgccgcacctcgccggtgagcagcccgcgcaggaaggcctgctcgacgtcggtggccgccgccatcagctcgcccatcaggcgcccgcgcccggcctgcgagccggtgcccgtgacggcgccgaccgctgtcagccgggcgtccacgtcccgcacggtgagcgacggctccgacgcgggcgtgaccggccggccgaggagcttccagccgatgccgagccgcccctgcggaaggcgtccggccagatacgggatcacgatcggcacgtcgtccgcgtcggcgtcccggaacagctcggcgagcagcgcgatcttccgggaccgcgccgaggtggcggcgacctcccgggacacatgggcgaggcggctcagcagcatgcagccatggtgcaacggaggcggccggtctacacccgctcagccgcgttctcggcctcgcccgaagcggcgggacccgcggcggcgtcgaggtccgcgaagagcaggtctccgttgatcacggcgcccgcccggtagccgccgctcgccgcgttcaccagctgctccgcgaatccgatcgcgtttcccgccgcccacacgccgggcacggtcgtcaggcccgtctcgtcgaccaccggatacgtgccgaacggtgtctcccgcagctcggcgcccagccggtcgaacaggtcggtgcgcgggacggcgcggggcgcgacgaacagcaccgagcggtcccgcgtcgtgccgtccgcgagccgcaccccggtgagccggtcctcgtccacctccaggcccgcgacctcgccggacaccagggtgaccccggccgcggcgagccggcgccggtcgtcgtgcgtgagctcgtcctcgccgaccgtgtgcaggaagagggtcacgtccttggaccactggctgaccatcagcgcctggtgcacgctcatcggcgtactggccagcacgccgaaggcctcgtcgcggacctcccagccgtggcagtacgggcagtgcagcacgtcccgcccgaagcgctcggcgacgcccggcaccggcggcagctcgtcgaccaggccggtggcgaggaccagccggcgcgcgtgcaccgtacgcccgcccgcgagcgtcacctcgaacgcgccgacgccgcctcggaccacgtccaccacgcggccttggaccagctcgacgccgtaccgcccgatctcccgccgcccctcggcgaggaactcggcgggcggcatgccgtcccgggtcagaaagccctgcagatgcgcggcgggcgcgttgcgcggctcgccggcgtcgacgacgagcgtgtgacgccgggcccggccgaggaccagcgccgcggacagccccgccgcgccgccgccgacgacaaccacttcgtacctctcggtcatggtgaccacctccacggagaaggtcgcccgaccatgacggtattgacaaatggctttgccgattctgcaatatgggcatgagcgaggaagagcagagcgaggaagagcagagcgaagaagtgcagacggacgcggttctggccgaagtcgggccgcggctgcggcggatccggaaggaacggggtgccacgctcgcggggctgtccgaggcgaccggcatctccgtgagcacgctctcgcgcctggagtccgggctgcgcaagcccagcctggagctgctgctgcccatcgcccgcgctcaccaggtgcccctcgacgagctggtcggggcgccgccggtgagcgacccgcgcgtgcgggccaaaccgatcgtgcggcacggccgcacccactggccgctcacccggcagcccggcggtctacaggcgttcaaggtgctcgaaccccagcgcaagctcgaaccggatctgcggacacacgagggctacgagtggctctatgtgctctccgggcggctgcgcctggtcctcggcgagcacgacgtggtgctcggaccgggggaggccgccgagttcgacacgcgggtgccgcactggttcgggtccacgggtgagggcccggcggagtttctgagtctgttcgggccgcagggggagcggatgcacgtacgggcccgtcccacccgttcgtgacgcacgcgactgttccctgatgggcaagcgaccgcttagtatgcgatcgaccccggtcagacgagcagtcccgtggaggccccgcatgcaggcatggcaagtgcaccagaacggcgagccgagcgaggtgatgcgcctcgaggatgtggagcggccggtgcccggcgagggccaggtgctcctcaaggtgcgggcggcgaacatcaacttcccggacgccctgctgtgccgcgggcagtaccaggtcaggccgccgctgccgttcacgcccggggtggagatctgtggcgagaccgaggacggacggcgcgtcctcgcgaaccccgtgctgccgttcggcggtttcgccgagtacgccgtcgccgatgccgcggccctgctgcccgcgcccgacgcgctggacgacgccgaggccgccgccctgcacatcggctaccagaccggctggttcggtctgcaccgccgggcgcacctggaggcgggggagaccctgctcgtgcacgctgccgcgggaggggtcggcagcgcggcggtgcagctcggcaaggccgcgggcgccacggtgatcggcgtcgtcggcggggccgacaaggccgccgtggcccgcgagctgggctgcgacgtcgtcgtggaccgacggaccgaggatgtcatcggcgccgtgaaggaagcgaccggcggccgcggcgcggacgtgatctacgaccccgtcggcggggcggcgtacacgcagtccaccaaggtcgtcgctttcgaggggcgcatcgtggtggtcggcttcgcgagcggcaccatcccgagccccgccctgaaccacgccctggtgaagaactacgcgatcctcggcctgcactggggcctctacaacaccaagaatcccaagctggtccagcactgccacgagcagctcaccgaactggcgacgcgcggtgcgatcaagccgctggtcagtgagcgggtgccgctcggcggcgccgccgccgccgtgcagcgggtcgccgacggcgtcacgacgggccgtgtcgccgtggtcccctcgctcgagaacggagcaaccgcatgaccgacgctgccgaactgcgccgcctcacccaggagttgctggccgcacatccgccggagaccacggaccggctcgacttcctcaaggaccgtttcgacgccggactcgcctgggtgcactacccggagggactcggcgggctcggggtgccgcgcacgctccaggccgtcgtggacgccgaactggaggccgcgggcgcccccgacaacgacccccggcgtatcggcatcggcctcggcatggccgcgccgacgatcctcggctacggcaccgaggagcagaagcggcgctatctgcgcccgctgtgggccggcgaggaggtctggtgccagctcttcagcgagccgggcgccgggtccgacctggccgcgctgggcacgcgcgccgtccgtgaaggcgacgagtgggtggtcaacgggcagaaggtgtggacgtccagcgcccacgtcgcccgctgggccatcctcatcgcccgcaccgacccggacgtgcccaagcaccggggcatcacctacttcatctgcgacatgaccgacccgggcgtcgaggtccggccgctgcgccagatcaccggcgaggccgagttcaacgaggtgttcctcaccgacgtccgcatccccgactcccgccggctcggcgacgtcggtgacggctggcgggtcgcgcagaccacgctgaacaacgaacgcgtcgccatcggcggcatgcggctgccccgcgaaggcggcatgatcggcccggtcgccgggacctggcgcgagcgccccgaactgcgcacccacgatctgcaccagcggctgctgaagctgtgggtcgaggccgaggtcgcccgtctcaccggcgagcggctgcgccagcagctcgtggcgggccagcccggccccgagggcgccggcatgaagctgtcgttcgcccgcctcaaccaggagatcagcgggctggaggtcgaactcctcggcgaggaaggcctgttgtacgacgactggacgatgcgccgacccgaactggtcgacttcaccggccgcgacgcgggctaccgctacctccgctcgaagggcaacagcatcgagggcgggaccagcgaggtcctgctcaacatcgtcgccgaacgcgtcctgggcctgccgtccgagccgcgcaccgacaaggacgtcgcatggaaggacctcgcccgatgaccacgcggagcacgcagccggatctgctgtactcggaggaggaagaggcactgcgcgccgtcgtccgcgacctcctccgcgatcactgcggggcggcggacgtcatcgcccgcacggagtcggacgccccgcacgaccgcgccctgtggaaggccctggcggacggcatgggactcgcgggtctcctggtgcccgaggcgcagggcggccagggtgcctcgcaccgtgaagccgccgtggtcctcgaggagttgggccgcgcggtcgcccccgtgccctacctcaccagtgccgtcgtcgccaccgaggcactgctggccggtgagggcgacgaggccgcgaagctgctggccgcgctcgcgtcggggcggacggtgggcgcgctcgccgtcgcgctgtccgtcgcgccgggcggagcctaccgggccgtacgccatgaagacggcgcgctgcatggcgagttgaccggcatcgcggacgcggcggccgccgatgtgctgctggtgcccgcagaggacggcgggctgtacgcggtgaacgccgacgacacggccaccgtcacgatcactccgcaggtctccttcgacctcaccaggccggtcgccacggtcaccttcgagggagcgccggcgcgtcgcgtgggcgccgccgagcccgccgtacgccgggccctgcgcgccggtgccggactgctcgcctccgagcaactcggcgtggccgactggtgcttgacggaaacggtgcgctacttgaaggagcgcaagcagttcaaccggcccgtcggcggcttccaggcgctcaagcaccggctcgcgcagctgtggctggaagtcgtcagcctgcgggcggcggcgcggaacgcggccgacgcgctcgccaccggcagcgcggacagcgacgtggcggtcgccgtcgcccaggcgtacgcggccccggtcgccgtccgcaccgcggaggaggccctccagctgcacggcggcctcggcatgacctgggaacacccggtccacctctacctcaagcgggcgaaggcggactcgatcgcgtacggcacggcgggcggtcaccgcgaggcgctggccgaactggtcgacctccgggccccctgacgcacacccggaagaagcccgccccacctggggcgggcctttcggtgtgccccgccgcgacgaagtgaacgcacggcggcggtccggccaactccgcgcacggccctgccccttgggctcgcgggcgccgcatactcgccggtgtcccgtacggcacttccagggaggcagagcatggccctcaccacccgtcgcagagccctcaccaccctcggcgccgccctcgccggctccgtcgcgctgcccgcgcacgcacgagcgagcgagcgggggcacggcccgcgcccgctgcggcgcgcccacgcgcacaacgactacgagcacccgcggcccctgttcgacgccctcggccatcgtttcggcagcgtcgaggccgacatctacctcgtcggcgaccagctcctcgtggcccacgacccggcggacctcgacccggcccgcaccctcgaatccctctacctcgatccgctggccgcccgcgtcagggccaaccacggctccgtgtaccgggggtggcgcacgcccctgcaacttctcatcgacatcaagaccgagggctcgtccacctacctcgaactcgaccgccatctacggcgctaccgcaacctgttcaccacgtacgcgcacggccgcgtgcaccccggcccggtcacggccgtgatctccggcgaccgcgcggcccgtacgccgatggaggcgcagagcgtgcgccgcgccttctacgacggtcgcctcaccgatctcggcagctcagccccggcctccctcatcccgctgatcagcgacaactggacgctcaacttcagctggctcggggcgggcccgttcccgggcgccgagcggcagaagctgcggggcatcgtcgcggcggcgcacgcacgccggcagaaggtgcggttgtgggccacgcccgatcgggcgggcccggaccgggacgcgctgtgggccgagctgctcgccgcggacgtcgactacgtcaacacggacgacctcgcgggcctggaggcgttcctcgacgcccacgagcggccgtagacaccacacgttcgggggacacgtcagccgcccggacgaaccctccgctacgcgacacttgcggcctaaagccgcggtatcgacgtggcggaggaggttccgatggccatttccatctctgtggtgctgctgcttctgatccttgtggtggtcttcgtgcgcaacggggcactgaagttgtcgcactgcctgatctgcgtgttgctcgggttcttcctggccggctccagcatggccccgaccatccacaacggcctgctggcgacggcggacatcgtcagcagcctgcacccctagcctgcgggaggccagggatgcgggccggacggtgcccggtcacgtccgggtgaacaccccgatgccgttcgggaccggccgttcggcgccgccgctcgggtggttgcgtacggtcacggaggtcgccccgggagcgcgggcgaccagcgtggtcgagccgccgccgtcgaggctgaaggcctcggtggcacccaagccgcgcatgaccgaggcgacttcggcgatggtcaggccgctgcggtaggcggcggcgccgtcgatcgcgaggagcagcagacggcggccggcgtccttgatgcccaccgcggtgcgtacggccgaggtgacggtgtcgaggcccggcagcggcttcccctgcctcagcaccgggtatccgccgatcgcgaagctgtacgcgacctgcgacccggccgccaccagacggtgctccaccgacacctcctcgcccgtggacagcttccgcaactgctgcgcgcctgcctcgcggccgaccagcaccgtggtgccggcggcgatcggtccgctgccgggggagtcggcgaaggacaccacctggccgtccctgaccgtcacttcgtaggtgtccgtactgcacggcgccgcccggtcggtgtccgtgccgcacacggcccgggcgcgcgagacactgccccagtccgcggtgtacgcgccgaccgaaccctccggcagcgcgtactggttgagcccgcggagcggcagctctcccgccgcggtgtccacggatccttcgagggccaggcggtcgagccgggcccggcggtcgtcgccgacgccgagcacgtcctcggtggtcgtaccgggcggcagcgccggcccgaagcgctggccgttcggcacggctgccttgagtgtgtgcccgtccgcgatcgccggaccgtcggtcgaaccggtcgcctcgacccccgggtgctgggtctcggtgatgttgaagaagtcgccgttgatgcccgcgagcgcgccctgcgagtcggcgagccgtgagaccggggcgcgggccgcgacggcgcccgggtgcaggaggccgacccgcacccgcggatcggcgagatcgacgctcaggagatgggcgtgcgtcactcctcggtccgccgggatgtcgaactgcgtgtactcgacgcccggcgcgagcgggacgctcctcggcgcgccgccggccggcgccgctcccgccagggccgcaccggccagcgcgctccaggccgtgagtaccgtcagtaccgttctgagccgtccgccgcgacgcgtcacagtcccccctgatgtctcgtcaactgtcccaggaatcaggggaagtgcaccagatgtcggtggccggcgcggtacctaggcgtcgacgacgcgggaacggatcagaaaacgcactccttcgggtgcttcgagggagaagccgctgcctcggccgggtacgacatcgacgatcagccgggtgtggctccacacctcgtactggttcctcgacatccagaagcccaccgcctcgtcgacgccctcgacctccagctccgcgagcagcacgtcggagccgccggtgcggaactcgccgtccggatagcacatgggcgcgctgccgtcgcagcagccgcctgactgatggaacatcagcggtccgtgggccgcccgcagccgccgcaccagctcggcggcggcaggggtgagctccacgcgcgggaccatctccacggtcggatccatgccctcagccgaccagccgccacgttgcgagaaggttgcacgcgcggggcggggcgccttcagggccgtacgaggagctggaactcgaaggcgtaccgtgacgcgcggtagatgtgggtgccgtattcgacggcgcggccggtgtcgtcgtaggcggtgcgccgcatggtgagcagggcggcgccctcgtgctcgtccagccgctcggcctcctgggcggtcgcgccgcgggcgctcacggactggcgggcgctgtgcagggtgatgccgacggcgcgcatcatccggtacaggccggtcgcctccagccgggcggtgccgaggtccagcaggccggccggcacgtggttggacaggaacgccaccggctggccgtgggcgaggcgcagccgttcgatgtggtgcacatcgccgccctcggcgaggcccagggcggccgcgacctcggcggacgccggctggacctcgttgcgcagcacccgcgtcgcggggttctggccggcggcctccaggtcgtcgtacaggctgctgagctccagcgggcgcttgacctgactgtgcaccacctgggtgccgatgccccggcggcgcacgagcagccccttgtcgaccagcgactggatggcctggcgcacggtgggccgggacagaccgagccgcccggcgaactcgatctcgttgccgaggaggctgcccgggcccagcgcgccgtgctcgatcgcatgctccagctgctgggcgagctggtagtagagcggcaccggactgttgcggtcgagtgcgaagtcgaggcgtacgggggtggcggggttcctgtgacgggacatcaggagtggctggggaagttcaggttgatggtcctcatggcgggtcctttcgtgagccgggaggcaggaggagtcagaggtgtcggcggcgttcggcggtgtgcccgtcgtaggtcgcgcgggcgtccaccgcggcctcgcgggaggccacctcggcgacgggcacgtcccaccacgcctgtgccgggggagcggtgggcgccgggtcagtttcgacgtacacgcaggtcggccggtccgaggcgcgggcctcggcgagggcgtcgcgcagttcccgtacggtcttggcccggatgacgtccatgccgaggctggccgcgttggcggcgaggtccaccggcagcggcgcgccggagaaggtgccgtccgcggcccggtagcggtaggcggtgccgaagcgctcgccgcccacgctctcggacaggccgccgatggaggcgtagccgtggttctggatcaggaccaggttgacgggcagcgactcctggacggcggtgacgatctcggtcggcatcatcagatacgtcccgtcaccgaccagcgaccacacgggcgtgccgggggcggcctgctggacaccgataccggccgggatctcgtagcccatgcaggagtagccgtactccaggtggtactggcgcggcgagcgggctcgccacagtttgtgcaggtcgccggggagagagccggccgcgttgatgaccacgtccgcgtcgcccacgacggagtcaagggcgccgagcacctgggtctgggtcggcacggcgttctcgtcgtcggcgcggaaggcgtcggccacgacccgctcccaacgctccttgcccgagcggtactcggcctcgtacgccgcgtccacacgatggcccgccaacgcctcggcgagcgcctccaggcccgcccgcgcgtcggcgaccaggggccgggcggcgagcttgtgggcgtcgaaggcggtgatgttgaggttgacgaaccgcactccggggttgcggaacagggtggcggaggccgtggtgaagtcggtgtagcgggtgccgacaccgatgaccaggtcggcggtgcgcgcgaggtcgtcgctgaccgcggtgccggtgtggccgatgccgccgaggtcggcggggtggtcgtggcgcagcgagcccttgcccgcctgggtggaggcgacggggatgccggtggcgtccaccagctcgcgcagcgccgtctccgcctcgctgtggtggacgccgccgcccgcgacgatcagcggccgctcggcgccgcggatcgcccgggccgcctcggccagttcgaccgggtcgggcgcggggcggcgtacgcgccagacgcgctcggcgaagaactcctcgggccagtcgtacgcctcggcctgcacgtcctgcggcagggcgagggtgaccgcgccggtctcggccgggtcggcgaggacccgcatggcggcgagcgcggacgggacgagcgtctccgggcgggtgatccggtcgaagtagcgggagaccgggcgcagggtgtcgttcaccgacaggtctgcctccaccgggtgttccagctgctggagcagcgggtccgcggcgcgcgtcgcgaagtagtcgccgggcaggagcagcaccgggagacggttgatcgtggccagggcggcgccggtgaccaggttggtggcgccggggccgatggacgtggtgacggcctgggcggagaggcggcccagctggcgggcgtagccgaccgccgcgtgcaccatcgcctgctcgttgcggccctggtggaacggcatggcctgctcgccggcttcgaggagcgcctggccgatgcccgccacgttgccgtggccgaagatgccccaggtgccggcgatcaggcggtgccgtacgccgtcgcgctcggtgtactgcgcggacaggaaacgcaccagcgcctgggcgacggtcaggcggcgggtggactggtccatggggacctggctcatcgggacctcactgggacggggcggtgtagcgggggagtcgggggtccacgggctgatccggccaggtggcgcggatccaggcgtggtcggggtggtcgcggatcagccagtcgcgctcggcgccgggacccgccatcacgttgaggtagtacatgtcgtggccgggcgccgccatcgacgggccgtgccagccgtccgggatgaggacggtgtcgccgctgcgcacctcggccaggacgtcggtgccccggccgtggccggagggcgagacccgctggtagcccaggccgggcgtgccgtcgtgggcggcgatctcgaagtagtagatctcctccagctcggactcctcaccggggcggtgctcgtcgtgcttgtggggcgggaacgaggaccagttgcctcccggcgtgatgatctcgacggcgatcagctggtcgcacgcgaaaccctgtccggcatcgcccccggcggggaccgccgcggcgaagttgttgacctggcgggagcaggtgccggtgccgcgcagctcgaccgggacggcggcggcgggcccgtagcgggcgggcagccgctcggtgcagcgggcgccggtcagcgcgaagcggccgccgccgcgcgaggcgagggagacctgggcgtcgcgcggcacataggcgaagtcgctgaccccgctgaagacgctctcgcgcccggccaggcggaaggtctcgccgccgacggccaccgtgcaggaccccgccagcggcagcacgatccactcgctgtcgccggtgtcgaaggagtgccatccgccggcgggcagttccagcacgcgcagactggagtggccccagccggccgactcgggggagatgtccaccgtgtaggggccgttcgccgccttgcccgcggggaggtggtgcgtggtcgtcatgatgcctttcctggaccgggtcggtgatgtcagagcaggccgaccgcggtgtccaccgccgtcgccacgccgccgtcggcgggatacaggagtgagcggcccacgaccatgccctggacggtgggcagccgcagcgccttgcgccatctctcgtacgcgccctcctggtcctcgccgacctcgccgccgagcagcacggcgggcagggtggaggcctcgaggacctcgcccatgtcgtcgggatcctcggtgaccggcagcttgagccaggtgtacgccgaggtgccggcgaggcccgaggcgatggcgatggagcgggtgacggcctcggcgccgaggtcgttgcggaccgtgccgtccacccggcgcgagatgaacggctcgacgaacacggggagtcggcgcgcggccatgtcgtcgatcgcgcgggccgtggactccagggtcgccgaagacccctggtcggcgtagtcgatgcgcagcagcagcttgcccgcgtcgaagcggagccgctcgatgtcctcggcgcggtgcccggtgaagcggtcgtccatctcgaaggacgcgccggccaggccgccgcggttcatcgaccccatgacgaccttgttctccagcacacccaggagcagcaggtcctccaggatgtcggcggtggccagtaccccgtccacacccggccgggacagcgcgacacacaggcgctcgagcagatcggcgcgatgcgccatggccagccctcggccgcccacgccgagcgcgccgcgcgccggatgatcggccgcgacgatcaggaggcggccgctctcgccgatcagcggccggcgcgtgcggcggccggccgcttcggcgatggcctccggatgccgggcccgcaccgtggcgaggtcggggatgctgatggtcaagacaggctccgttcggggtggcgggtcatccgcgcgcgacgaggtcctcgacctcatcgagggtgggcatcgcggaggagcaggcgaggcgggaggcgacgagggcgccggccgcgttggcgtagcgcatggtccgctccagctcccagcccgccagcagcccgtggcagagcgagccgccgaacgcgtcgcccgcgccgaggccgttgacgacctccaccgggacgggcggcacctcggcggtggtgccgtcgcggtgcacggcgaggacacccttggggccctgtttgacgacggccagttccacgcccgcctcgatcaacgcctcggcgcaggcccggggttcgcgtacgccggtggcgatctcgcactcgtcgaggttgccgacggccacggtcgcgtggcgcagcgcctcggcgtagtacgggcgggccgcccgtgggtcctgccagaacatcgggcgccagtcgaggtcgaagaccgtggtgccccccttggtgcgggccttgagggcggcgagcgtggcggagcggctgggctcctcgctcagcccggtgccggtgatccagaagattcgggcggcgcggagggcgaagaagtcgagctcctcggtgcggatctccaggtccggtgccttgggctgccggtagaagtacagcgggaagtcgtccggcgggaagatctcgcagaaggtgaccggcgtcggataggcgtcgacgggggtgacgaaccggtcgtcgacgccgaactcctcgagcgcctggtgcagataggtgccgaacgggtcgttgccggtccgggtgatcaccgcggtggagcggccgaggcgtgcggcggccacggcgacattggcggcggaaccgccgaggaatttcccgaaggactcgacctgcggcagtggaacgcccggctgtagggggtagaggtcgacgccgatgcgccccatagtgatcaggtcgaaagtttcaacggagtctggcatgcacgtcgctcctcatcgggggatgcgggcaccccgggacctgatggcctggtgcggtgtctcccaggtgtagggcgcccatcggtcttgtgtcaatagtttgtacggacattcggacctgctagtgaaatgatgtcttaacaaagtattgacaggtgggtgcaacagggacttgtatcgcgtcccaacgaagcagccgcgtcatcggcacatgatctgggcttcccgtccaggcccccggctcgggtcctgtgcccggagcactccgctccctttccctctggtcgcacagtgaggtgctggaaagatggaccgcacgttttacccccgctcccgcaggatcgccccgctcgtcgcggcggcagccgcctccgcgctgctcgtcgcgggctgctccagcggctccggcggcaagaaggccgaggagggcgggagcggcgcctccgccggcaaggccaacacgccccgtatgacggtcgcgttggtcacccaccaggcgcccggcgacacgttctgggacatcgtccgcaagggcgcccaggcggccgccgccaaggacaacatcaagctggtctactcggccgacccgaacgcgggcaaccaggccaacctggtccagaacgcgatcgaccagaaggtcgacggcatcgcgatcaccctggccaagccggacgccatgaagagcgtcgcggcaaaggcggagaagtccggcatacccgtggtcgggctcaactcggggttgagtgactggaagtcgctgggcctgatggagttcttcgggcaggacgagggtgtggcgggcgaggccttcggcaagaagctgaacgaggtcggcgccaagaaggccgtctgtgtggtccaggagcagggcaacgtcgggctcacccagcgctgcgccggcgtgaagaagacgttcaagggcacgacggtgaacctgtatgtcaacggcaccgacatgccgtcggtgaagtcgacgatcaccgccaagctcaagcaggacagttccatcgactacgtggtcgcgctcggtgccccgtacgccctgaccgcggtgcagtcggtgagcgacgcgggcagcaaggccaagatcgccaccttcgacctcaacaaggaactgaccagcgccatcaagaagggcgacatccagttcgcggtcgaccagcagccgtaccttcagggctacttggcggtcgactccctgtggctctacaagaacaacggcaattacagcggcggtggtgagcagccggtgctgaccggccctgccttcgtcgacaagaccaacgtcgagacggtcgccgagttcgccgcgaagggcactcggtgatctgaatgactcaagcaacggcaccggcgacgagtccctcgtcgccggcctcgccggccgcccccaaggacggccgtaccggcgaacgctcgttggggcggcggctgctggcccgccccgaggtcggcgcgctgatcgccgccgtcggtgtgtacgtgttcttcttcgcggtggccccctccttccgcgacgcgagcgccctgtccaccgtgctctaccaggcgtcggtgatgggcatcatggcgctgccggtggccctgctgatgatcggcggcgagttcgacctgtcggcgggtgtcgccgtgacgacctcggcgctcaccgccgccatcctgagcttccagctgacgatgaacgtgtggaccggcgtcttcgtcgcgctcctcgtgtccctcgccgtcggcgcgttcaacggctggctgctgatcaagaccggcctgcccagcttcctggtcacgctgggctcgttcctggtcctccagggcgccaacctggcggtcaccaagatcttcaccgacaacgtcgcgagcgactcgatcgccgacatggacggcttcgagcaggccaagaaggtcttcgcctccgagttcgacatcgggggagtgagcttcaagatcaccattgtctactggctggtgttcgccgccgccgccacctggctgctgctgcgcaccaagttcggcaactggatcttcgcggtcggcggcaacaaggacagcgcccgcgcggtcggcgtcccggtcggcctcaccaagatcgcgctcttcatgggcgtcggtgccggcgcctggttcgtcggcatgcacctgctgttctcgttcaacaccgtgcagtccggcgagggcgtgggcaacgagttcctgtacatcatcgccgcggtcatcggcggctgtctgctcaccggcggctacggctccgcgatcggcccggtcatcggcgccttcatcttcgggatggtgtcccagggcatcgtctacgccaactggaaccccgactggttcaaggccttcctgggagcgatgctcctcgtcgccgccctcgtcaatctgtgggtccgccgccaggcgacccggaggtgatctgatcccatgacaaccaacggaaccccgcccgacggaacccccgtcgaggagaccgggcccgcggacgccgagccgatcgtggaactgcgcggcgcaggcaagtcgtacggcaacatccgcgccctgcacggcgttgacctgagcgtccgcccgggccgggtgacctgcgtcctgggtgacaacggcgcgggcaagtccaccctcatcaagatcatctcagggctgcaccagcacaccgagggcgagttcctcgtcgacggcgcaccggtgcacttcaacaccccccgcgaagccctcgaccgcggcatcgccaccgtctaccaggacctcgccacggtgccgctgatgccggtgtggcggaacttcttcctgggctccgagctgacccgcggcccctggcccgtgcgccgcctcgacatcgcccgcatgaagcggaccgccgacgacgaactgcgcaacatgggcatcgtcctcgacgacctggaccagcccatcggcaccctctccggcggccagcgccagtccgtggccatcgcgcgcgccgtccacttcggcgcccgcgtcctcatcctcgacgagcccaccgccgccctcggcgtcaagcagtccggagtcgtactgaagtacatcgccgccgcccgcgaccgcggtctcggcgtcatcttcatcacccacaacccccaccacgcctatatggtcggcgaccacttcagcgtgctgcgcctcggcaccatggaactcaacgccgcccgcagcgaggtcagcctcgaggagctgaccaaccacatggccggcggtgccgaactggccgcgctcaagcacgagttggcgcaggtccgcggcgtcgacgtcgaggggctgccggatgcggacgacctccaggcaccggtggcggccgcttccgaagggacttcctgacatgacccctgccctggaccgcatccgggtcggatcggccccggactcctggggtgtctggttcccggacgacccccagcaggtcccctggcagcgcttcctcgacgaggtcgccgaggcgggctaccagtggatcgagctgggcccgtacggctatctgccgaccgaccccgcccgcctcaccgacgaggtggcccggcgcaacctccaggtgtcggccggcacggtcttcacctcgctgcaccggggaccgtccgtgtgggacgccacctgggagcacgtcgggcaggtcgccgcgctcacccgggcgatgggcgcacggcacctcgtggtgatcccgtccttctggcgcgacgacaagaccgccgagatcatcgagccgccggagctcacgggcgagcagtgggcccatctcgccaagggcatggagcggctcgggcacgaggtcaaggagacctacggcctcgacatcgtcgtccacccgcacgccgacacgcacatcgacaccgaggcccatgtcgagcgcttcctcgactcgaccgactccggactggtcaacctgtgcctggacaccgggcactacgcctactgcggcggcgacagcgtcaagctcatcgagacctacggcgagcgcatcggctatctgcacctcaagcaggtcgaccccgacatcctcgccgaggtgcgcgcgggcgaggtcccgttcgggcccgccgtgcagcgcggggtgatgtgtgaaccgccgtccggcgtacccgagttggcgccggtcctgacggcggcgcagcgcctcggggtggagctgttcgccatcgtcgagcaggacatgtacccctgcccgccggaccagcccctgccgatcgcccggcgcacccgcacgttcctccgctcctgcggagcctgaaccccccgaagggaccacgcccacccacgcctggatctcgcggtcgtgggcgtgcctgccgcctgccgcctggcggggcgggcgggcccgagagccgacggagccgtcgtcgcgcgaggatttcacgccggtcttccggcctcctcgcgtcgacgacggctccgtcgtgttgccgcgtggtccgcaccagggcgcgcggtgtcggctccgcgcccgggcacccgaccgtcagggcgtcggcacgtccacccaggcgcggctctccgcggacgcggccatggcctccagcaccgcggcactgtgcacggcgtccggcagcgtggccccgtacggtgtctcctccgcgatcgagcgcaggaagcggtacgcctcgatgaccttcaggtcgtcgtagcccatgctggtcgccgctccgggctggaacgcgccgtactcgccatggcccgggccgacgtggacggtggtgaggggctggtcctggtaggaggtgccgcggctgacgcccagctcgttcatacggcggaagtcccagaagaccgcgcccctggtgccgtgcacctcgaagccgtagttgttctgctcgccgaccgagacgcggcacgcctccaggacaccgcgggcgccggaggcgaagcgcagcagacaggagacgtagtcctcgttctccaccggaccaggctcgccccccgtggcgagggtgtggccggcggtcgcccccgtggggcgggcccgctcgggtacgaagaccgcggtgtcggcggtgagcgacgcgatgtcgccgagcaggaaccgggccaggtcgactccgtgcgaggcgaggtcgccgagcacgccgctgccgccgcgctcgcgctcgtagcgccaggtcagggcgccatgggggtgggcggcgtagtcgctgaagagccggatgcggacatgggtgaccgtgccgatctcgccggaggcgatgagctcgcgggcggtctcgacggcaggtgcgttgcggtagttgaagccgaccgtgccctggacgccggccttggtcaccgcgtccgacaccgcgcgggcgtcctccagcgtgagacccaccggcttctcgatccagatgtgcttgcccgcctccgccatcgcgacgccgatctcgcggtgcaggaagttcggcgcggtgatgctcaccgcgtgcacccgcggatccgcggccacctcgcgccagtcccgggcggtacgcgcgaacccgaactgcgcggcggcctcctcggcccggcccggcacctcctcggcgaccgtcaccagctccgggcgcacggccagctgcgggaaatggtgcagcacccgggcgtacgcctgggtgtgcacgcgccccatccagccgaaaccgacgaccgcgacgccgaggggacggcgtgcggctccactgccctcgttctccatgagccaccttctttggaccggtccaaaatcgctcagcccaccctgtgtggacggaagaggcagtgtcaacacctttgacagcgtcaaattcactctgcgaaagtgcgagtctctgtcgagacgcgatgtggaacggtccaagagatgtccgaggcgcagtccgaaggccggccgacgatccgtacggtcgccgagcgcgccggcgtgtccaagtctctggtctccctggtgctgcgcggctccgagcaggtgcggcccgagaagcgggaggccgtgctgcgggccatggcggagctcggctaccggccgaacgccgcggctcgcagcctcagcgagcagcgcacccgcacggtcggtgtcctcctcaacgacctgcgcaacccctggttcgtcgacctgctggacggcctgaactcactgctgcacgacaacggcctgcacatgatcctggccgacgggcgcctcaaccgccgtatcggccaggacctcacccgcccgttcctggacctccaggtcgacggactgatagccgtcggcaccctgcccgacccggccgcgctcggcacggctgccgcgcggatcccggtggtcgtcgcgggcacccgcgaacccgtgctccccggcgtcgacgtggtcgcgaacgacgacgagcacggggcgcggctggccaccgagcacctcatcggactcggccaccgcgccatcgcgcacatcgcgggctacggcgccgtcggcgacctgcgccgacgcagcttcgaggccacgatgcacgcacacgggctggccgacgacgcgctcgtggagcccagcgacatgaccgaggagggcggctaccgcgccaccgtgcggctgctcagcggcccccggcgccccaccgcggtcttcgccgtcaacgacatcgcctccgtcggcgcgctctcggccgccgacgaactcggcctgcgggtaccgcgcgacctgtccgtggtcggatacgacaacaccagcatctcccggctgcggcacctgtggctcaccaccgtcgacaccgccagccacgacgtcggcagacgcgccgcccgctgcctcctggaccgcttcaccgaccccggccgccccgccggggtacacctgtcgacgccgaccctggagatccgccgcaccacggcggcgccgagttgagctgctgacgggcatcggggccgcgatcgacgcgctggggggcggcttcacgatgcgctacgccgcgttggcggtcaccgcggcgcgaaccggtgctgtctgacctggtcggcatggtctgtccgcggccgaagggcggcgggttgcggtcgcgtacggcgccgctgcggaccgtgactccccgcggacaatgtgccacggtgagcggagcggctgttcccgtggcacggtgcgcctgaccgccccatcgccgggtccggccgggaagatgaaatactgatgtcacaggacaaggtctgggggtggaagcgtggagagcccacgccacagggatcagccctgcggtcaggcgcagcacaccgcggctgacctcgaggtttctcccctgtccgaccggccgggtgtgcgggccgccggggaagtcaccctgaccacgctcacggagtgggagcgggccctggaccaactggtccggcggcgtgaggacgcgctctacgtagagctctcagcggtcaccttcatcgatgtggctggtgcgtcggccctggcgctggcagcccagcggctccccgccggccagcacatccatctggaccggccacccttcggactgcggcgcatgttcgaaatgttctggcctgacctgctgacgattgagatggtggcgtgatgagtacggccgcccctgccgacccgtttgtgcacccggccctgttctaccgaggcgatcggcagtacgtggcgggaacggttccgttcgtcctggacggtctgtccgccggtgagccggtggcagtggccgttccgggcccccagctcaagctgatgaagacggaactgggcgcggacgccgatcaggtgcacttcctcgacatgacccaggccggccggaacccgggccggatcatccccggagtcctgcgggccttcgccgatgcccggtccacggcacgggtacggatcatcggtgagcccatctggccgggccgcacctccgcggaatacccggcctgcgtccagcacgaggcgttgatcaacgctgccttccgcggccgggaggtgaccatcctctgtccctacgacgcggatgggctggacgagaaggtgctcgccgacgcctacgccacgcatcccctggtgatcgacgaaggccgtgagctggccagcgccgcatacagccccgacaccgtcgtcgcccgctacaacgagccactggcgcccccgcccgcggccgtggcagccgccttcaccgtcgaagagctttccgccgttcggcatttcatggtccggcaggccgaagacctgggcctgtccggcgtcaggctgcaggacctggccttgctggtcgccgagttgacgaccaacagcgcggtgcatggcggcggttcaggaacggcacggatatggaccgagggggaccaggtggtgtgcgaggtccaggacggtggacgactcgtggatccgctggccggccggcgccccgcggagcgtggtcagatcggtggacgtggactgctgctggttcaccagctgtccgacctcgtacgtatgcacacgagcgagagcggcaccactgtccgctgttatctgagccgctagctcaggcgggcaccgcgcggacctcggggaagccggggccgcgcgcggggggtcggcttccgggtggccgtcggtcatctcggcgacggcccggccgatcggcagggcatgacggtcgtcccgtccgtcaccggagcggcaccgcgaggtacttgtactccaggaactcctcgatgccgacccggccgccctcccggccgagcccggactgcttgacgccgccgaacggcgcggcggggttggacaccagccccgtgttcacaccgaccatgcccacctccaggcgctcgctgacccgcagggcgcggtccaggccttgcgtgaagacgtagccgaccaggccccatggggtgtcgttggcccggcgcacgacctcgtcctcgtcgtcgaagacgagaatcgccgccaccggcccgaagatctccgtctccatcagccggctgccggggtcgacgtccgccaggacggtcggcgggtagaagcggccggggccgtccggcgccacgccgccgaccagtacccgggcgccccgctccaccgcgtcggcgaccagctcctcgaccttggctcgaccggcctcgtcgatcagcggccccacgtccacgccgtcccgggtgccgggaccgacgaccagcgcccccatccgctccgcgagccgcctcccgaactcgtccgccaccgagcggtggacgaagaagcgattggcggcggtgcaggcctcgcccatgttgcgcatcttggcggtcatcgccccgtcgacagccgcgctcaggtccgcgtcgtcgaggacgatgaacggggcgttgccgcccagttccatcgacgtgcgtacgaccgcgtcggcgcactgcgcgagcagcagccgcccgacccgggtggacccggtgaaggacagcttgcggatgcgtccgccggtcagcaacggttccacgacctccccggcccgggaggtggtgacgacgttgagtacgccgtccggcaggcccgcctccttcaggatcccggccagcgcgaggctggacagcggagtctgcggggccggcttgagcaccatcgtgcagcccgccgcgatcgccgggccgatcttgcgggtgcccatcgccaacgggaagttccacggcgtgaccagcagacacggcccgacgggacggcgcatcagcagcatgcggttgcggccgtccggcaggacgccgtagccgccgtcgatccgtaccgcctcctccgagaaccagcggaagaactcggccgcgtaggccacttcaccccgggcctcggccagcggcttgcccatctcgctggtcatcagcagggcgagttcgccggtgcgggagacgatgatctcgtacgcgcggcgcaggatctcgctgcgttcgcggggcgccgtacgggcccagccgtcctgtgcctcgacggcggcgtccgccgcgagccgggcgtccttgggtccggcgtcggcgacgtggcagaggatctcgccggtcgcggggtcgtccaccggcatggtggcgccgtcggccgcgtccgcccaggtaccgccgatgaacaactgcttgggcacgtcgttgaggatgctcacggtgtttctccttactggtcggcggccggggcgagcagttctgcgagagagacggcgcggacaccctggccgccggtgagacggtcggtccgggggtcggcccgggggtcggtccgggtggcgcagccgaagccgtccgccacgaccacggtgttcccgtcagcacccgacggcgtcgcccgccccgctggtggcgccgccccgcgcggtgacggggatgcccgacgcgcgacaggcccgcggcggagcggagatgtcctccgcggggcgcgggcaggccaccgcacgagacgcgaggcggtaggtggcggcgtcacaggcgtaggggccggtccggcccgcaccggtcccggtccggcccgcaccggtcccggtccggcccgcaccggtcccgatccgcgttcccggcgccgtccggccgatgccggcgcgcgggcgtgtcaggccgtggtcacccgtcatcgggccggcacgcctacttccacggcggcggaccacgcccgcagtccttcgtcgacctccgcctcgtcgatcaccagcgcgggaatcatccgcaccacctggttccacgcgccgcacagcagcaggagcagcccctcgtccacggcggcccgctgaacccgggcggcggtctcggggtcggggccgccgtcctcggtgacgaactcgctggccagcatcagcccgaggccccgtacgtccccgatggccggtgtcgtcgcggccaccgccgccagcccggcgcgcagccgtgcgcccatcgcctcggcgttgtccaccagcttctcgtcgcgtacgacgtcgagggtggcgcacgccgcggcgcaggccaccgcgttggcgccgtacgtaccgccctgcgagcccggccatgccttgcccatcaactcggcggaggcggcgatcccggacagggggaagccgctggccagtcccttggcggtgatgaggatgtccggcgtgacgccgaagtggtcgtgtccccagaaccgcccggtacggcccacgccggtctgcacctcgtcgaggatcagcacaaagccgtgacggtcggcccgttcgcgcagcccttcgaggaaggcgcgggtggcgggcacgtatccgccctcgccgagcaccggctcgacgatgatcgcggccgtgtcgtcgggggaggagatcgtccggagtgtgtagtcgagttcctggagggcgaagcgggtcgcggtctcctcgtcccagccgtagcggaaggccgtcgggaacggggtgacgaccactccgctcatcagcggggagaagcccgagcggaagcgggtaccggaggtggtcatggcggcggcggccacggtacggccgtggaagccgccgtgacagaccagaacgttgggacggccggtggcctgacgggccagccggagggcggcctcgacggcctcgctgccggagttggtgaagaacaggctgtccaggccggccggaagcacctcgccgagccggtcgaccaggcgccgcagcggagggtgcagcaccgtcgtgtactggccgtggacgagcgtgcccgcctgctcctgggcggcggcgaccaccctggggtgacagtgcccggtgctggtgacgccgatgcccgcggtgaagtcgagatagcggcggccgtcctcgccgtacagatggacgccctcgccccggaccgcgacgacgggtgtggcctggcggaggtgcggtgacagtgcgctcatggtcgtctcccagccccgggtgcgtgcgtcgtgtttcgcttccgcgtcccgagcatctccggcgtgcgggaccacggccacgcgcgaactgtccgccccacgcccaaggtttggacgttgtgtcaaccgctggtacgcgcggtcggcccctcccggcccgggcagccccgacggggacgctcttgtacaggtcagggacgcttgtcacagtgaccaggcatgtgaccaggcatgtgaccaggcatgtgaccaggcatgtgaggaggcaccgtgagcgaaccccaccccgcggccccgccgccacccgccgacgaacgggccgccggccgcccgctcaccgtggccggcgcgctcgcgctgccggtcctggccgcgggacagcccacggtcgtcaccggggaatcccaactcggccggccggtccgctgggtgcacgtcaccgagctcacggaccccgcctccttcctcaagggcggcgagctcgtcctcaccacaggaatgcccctgccggaggaaccggcccggatacgccggtacgtcgacgagctcgccgacatcggggccgccgccctggtcatcgaactcgtgcggcgctaccaccgcccgcccgaggccctcgtcgccgcctgccggacccgggacctgccgctcatcaccctctcccaggacgtcaacttcctggaagtcacccaggtcgtccatacgctcgtcctcggcgaccagaccgacgcgatgcgcagaacccagcggatccacgaggcgttcaccgccctgaccctgcgcggggcggaccccgaggacgtggtgcgcgcggcggcggagatgagcggccacaccgtcgtactggagaacctcgtgcaccaggcgctgatctgcgagcccgccggcgccaccgtcgaggacgcgctcaccggatgggaacggcgctcccgggcggccccgcccggcgaccaggccgatgtgcggggacccgagaactggttggtggcgcccgtggagttcaagggcgaacgatgggggcgggtcgtcatgctccccacccgtcgtgggcgtcccttcggcccggagcaggtgaccgtcctggaacggacagcgatgacactcacgatcgcccgcctcgtccacaccacgacgtgggagcgcagggcgcaccgcaacacgctgcgggacatcgccgagcaacgccaccgctcgccccacgaactccggtcccgcgccgccgccctgggtctgccgaccgaagactgccgcttcctcgccgtgctggtggacatcggtcccgacgaggacagcgccgagttggaagcgcgactggccgaggaactgacggcggcggggattcccgcactcaccggcacattgcccctcggacgcgtcggcagcctgctcgccctgcgtccctcccggacgccctggcggcagacggtcgaacgactggcccgcaccaccctgcgcctgcacccgcacgcgatcgtcagcgtgggctgcgaagtcacggacctccgccacgccgcccgctcctttcgtgaggcggcccgcgtggcggaggcggcgccgcccgattccccgaggctgcccggctccccggagaggtccttccacgaactgtccgacgtcggtctgcggcaactcctgtacgcactgcgcgaggacacccggatccaggactacgccgagcgcaggctcggccgcctcgccgaccacgacacccggcaccacaccgacctgctgacgactctgcggcactacctggaggccgccggcaacaagacgaccgcggcacgccgtgacgacctgtcacgccagacgctctaccagcggctgcagacaatcgagagactgctcggctgcgacctcgaatccggcgaccgacgcaccgaactgcacgtggctctcatggtgttcgacatcctccggccgcgctgacgtgacgcgtgccgcccggggaagcagcgacgccggaccggagcgcggccggcgccgtggacagagcacttaggtcttgcggtcatggaactgatggtgctggttgccgtggtggtcaccggtctgcagatccagcgaacggccccaccgggtcggctgcgcgggggaggacgcccaggaaccggcggccacatcgtcggagtcgagcacctcgtcgccgtagagatccttcagccagttggtctggtaaatggtgtcgaggtagcgctcgccgaggtccgggccgacggccaccgcggtgagttcacgcgcgtcgtgcccggccagccagtccgtcgcgccgctgaccaccgtgccggtggagccgccgaacaggaatccgcgcctggccagacgatggcaggtacgtatggtgtccgcctcctcgacacgtatcacctcatccacataggactcgtcgagcagcggcgggcgcatgctcatccccaggccgggaatcatccggcggcccggcggaccgccgaaggacaccgagccgacgctgtccaccgcgacgatccgcaccggccggtgccactcccggaagtagcgcgcgcagcccatcagggtcccggtggtgccggccccgacgaacagcacgtccagccgcgggaactgacgggcgatctccggcgccgtcttgcggtaatgcgccttccagttgctcggattggtgtactggctgagccacacgtaccggtcgtcggaggcgcacagcgcgcggacgtacgcgatccgagcgccgaggaagccgccgttggcctcctgcccggcgatcatgtgcacctcgctgcccaaggcctccatcatcatcctggtcgacaggttgccgcgggagtccgtcacacacaggaaccggtagcccttgctcgccgcgatcatgctcagcgccacgccgaggttcccggacgaggactcgaccaggatcgattccggcgtcaggactccatcgcgctcagcggcctccaccatctcggtcgcggccttcaacttgatcgagccggcgaagttgaagccctcacacttcaggaagagcgagtgcccgaagatcgaccggaggtcgacatagagctcctcttcgttgaaggcgtagggaacggaaatgacgggcacgatggtctcctcaatctggagcagggctttcggaacgtccgtccgggcgtgggcgggagcctgtgtcccaccgggccggacgggggccctgcgtcagcggccgctgtctcgtgcgccttgacctgcggcgactagaccggtgatctctgggggttggccctggacaagcctcctgggcgtcggccggctcatccgtaccggctcagttcgtggaagaagtcgtcgaccacgtgcaactccccgcggcggaccacgtcgtcgtagacgtacttgcccaccgcgaggtcgagcaccccgaggccgaagggcgagaacaccaccggccggtccgccggcaccgtcacccgcccggccagcacgtcgtccaatgtgccgtgcaggaagtcccggctgcccgtgagccgctcggccagatgcggcgaggtgtcggccttcaggcagtgctcgatgtcatcgacgatgttggtcgaggcgagcaggatctccggcgcgaggtcacgcagtgacacgtgcagcaccagcggattgtgtgcgaaccaggacaaatcgccgacatgtggctgcccggcgacggtggcgaagaccaccaggtcgctgccccggatcaactcctcggcgctgtcgtgcacggtgatccggccaggggtgcccgactgctccaggtagctctggaagcctgccgtgctgtcggcggacaggtcgtgcacgccgatctcgtcgaacgaccagccggtgccgacgaggaaggtgtggatgtagcgggcgatcagacccactccgaagaacccgacccgcgtcggtcgcggccggccgcggctgagccggtcggccgccgacgccgccgacgcggccgtcctggtggcgctgatgatcgagctttccagacaggcgaacgggtagccggtgtcatggtcgttgaggatcagcacggccgaggccctcgggatgccggccgtcacgttctccggaaagctggagacccacttcaggccgtccacccgcacctcgccgccgaccgaggcgggcagcgcgatgatccgggaggacgggcggtcggggaaacgcaggaagtacgacggcgggttcaccgaatcaccggcgccgtgcacccggtaggtggcctcgaccagctccacgatgtgtttctcacgtccgtgcagtgcgtgccggacctgggcgccggagatcaccgcgaacggtggcaccgtcatcggcgcggacgtcgcggactccgtcgtggtggaaccgatggtggtcatacggcggtcacctcgacggtcggcgagcagtcggccagacgcaccgggtcggccatggcgacgagcacctcgcgcggtccctcgtagggctccctgctgtgcgcggtgcggatgttgtcgacgagcatcaggtcgccgtcctgccacggctcacgtgcggtgttggcctcgtagacgccgttgagcaactgcacgacgtcctcgccgatcgggtcgccgttgccgaagcgggtgttgaacggcagcccgtcggcgccgtagacgtccaccaggtactcgcgcacctcgggggccatcgtccactcgttgaggaacgcgatctggttgaaccagcagcgccggccggtgaccgggtgacgcaccacggcgctgcggcgctgtctggtgcgcagtccgccgtcgggctgccactcgaacatgatcccgttggcgcggcagtagctctcgacggcgccacggtcctcggtgccgaacgcctcggcgacggacgccccgatctcgtcgttgtagctgcgggtgagcagccagccctctcgctcgaaccgctcggtcaactcggcgggcagcgcgtcgagcacggtcggtgagtcggccaccgcggtcgccccgccgtcgctgggcgcgccgaggcaggcgaacatcatcaggcccgggaactcaagcgtgtagctcagttcgtggtgcatgcacatgggctggttcgtcggccacttcgttgaggagtacacgccgtcggagtaggtctcccggggcgcgaagacctccttctcggtcatcaggccggtggccagcttcgagaagacggcgccggtcccggccgcgtcgcgcagcccgaggccgcggaccaggacgcagccgtgctcggcgacgacagcgcgcagcgcgtcccggtgctcggccgcccagtgcagcgcgtcggcggcggcctcggcccgcaggagcggaggtctgcccggtttcagttccacgtcgaccgatgacgctgcggatatggacgacatctcgttttcctttccgttgccactcgggtgccactcaggtgccgctcaggaagaggcggacagttcggcggagcgcggcacggcctgtgccgcctcggtcggacgggtgcgcaggacgttgtggccgccgtcggcggcgacatcccctcccctcacggtcgccacggtgctgtggaccgccggtcagcgcggcgtcgcaggcgccgtggttttctcggcggatcggcgggccggccctgtcgctcggccggcggggcatgctggtcgagagggttcagcgcggccttccgtcccagtgcgacgggccgatagggggcgtctcgccactccgtggcggggtttccgccccatcgagcgtgcctcgggacttcctcgcctttcatgagaaaggagtcgggggcgagcaccgagccgtcgcccatcgtcacgccgtagtggacgatcgcgccgacgccgagggtgcagccgtcgccgatcgtgctgcggtcggacttgaaggtgccgtcctcctgcgagtggcactggatcttgcttccgacattgagtgtgctgtcgctcccgatggtggcgagcgtccgctccgtcacgaggcagccgtcgttgaagaccctgctgccgacctgaacacccagcagccgccagaccacgttcatgaagggagtgccgttgaagacatggaagtactcgatgggcattttccacaggcgctcgtgcagccagaagttcgggtcgtagatggagcacaactgcggttgcagcgggcggaacaccgcgattccacgctccaccagtacgaggtagacggcgctgaccacgagggcgagtgccagggacgcggtgatcaccacccagccgaacacaccgtgcatgtcaactgccgcgaggccgagcacggtgagcacgaagaagtgcagccagcgcaccaacaggaacaggcccatcgagcggaggttgtaccgattcttcgcggcgaggtggcgacgcagttggtccccggaccggagctggtcgaaccggctgtcgcgttccaccgaccggggaatctcgaagcacggcgagccgagcaggcctactccctcgcggacctcgccgtcgagcgggaccatcaccttcgtcgcgagaaggcagttgtcacccgtcttggcccccgagggataggcgatgttgtttccaaggaagttgtgtggaccgatcgacgcctgggatacacggaaggacgtgctcgagaagtcggcattgatgacggagagtccgtcggcgatcatcgttccgctgccgacagaagtcaggtacggcgtctcgtgctgcacttcggtaccgaagttcgacccggtctgctcgacatgggacaagtcgtatccgaggccacgcaaatagtggacgatgtaagagctgtcaccgagaagccatttgaagaacttcaggttggtcatgcgcgcgatcgccctgtgcgccgagtaatggaggccgtacagcggatagaccttgtccggcttgaccatcagactcagtaggcgcggaacggtgaacaacagggcgaggcccaggacgatgaagccgaagaacagcacgagggacaggaccagcgcgtcgatgtagagcgtcggcgacgtgaatcccaccatgtccgggcccagcaggttcctcagttccggaacctcggtgatcagcatgtacgcgcccccgacggtcagcggcacgtacaggaagaacacttggagcacgctgatgaggccgtacccggcccggcgcagagtgccgcacgccgcgggcgcgatgctcaggtagtcgaactccgtgcgctgtgccggggatccgtgccaccgctggtcttccggtaccacctggccgctttgcagcgcggaggtgtggccgagctgtgccctgtcgcccatcgacgtgtcgatgtcgagcacggtcttctcgccgacgaacacgtcccggccgagggtgacgtggccggtctggatacgcccggcgtgcgcccggtagcagaggaagaacgcgtccttgcgaatcaccgtaccggcgccgatcgtcagcaggtcggtgcagaccggaatggtgcgggagaagatcgtgacgcccttaccgatccgcgcgccgagggcgcgcagatacagcacatacagcggattgccgacgaagaagatcatcgggttggcgtggaccagtgtcttgacggtccagaagcgcagataggtcagaccccagatggggaactcgcgggatttccagcggccgatgaggatccatttcgccgcgatcgggaatatgcacaggccgacgaggccggcgccgccgaagaggaccgcccgcaggtagacgttgcgcagacctgagccggcggagacccactcgtagccccggccggtgacaagtccggcgaggcagcaatatccgacgaaaataatgaactgcagcgttccgcagaggaggtactgccgcgtgctcgccggtgtcaccacctcggtcggcgccgggaccgacgactcgacaggggtgggcgcggcgtccgcgagacccgtcgccagacttcggatcgtcgggtgccggtagatgtccttcatcgacgccgaggggaggtccgcccgcttcctgacccgtgcgcagaagtgggccatcaccaacgagttggcgccgaggtcatcgaagaagtggctgtcgaccgacacctgttcgacggacatgacgtcagccagcacctcggcgaggtctctttcgatgccggccttcgggccggagtccctgcttttgtctctcgcagattcatccggcccggacgccaggacttcgatggatttctcctccatacaagctccttgagcaactttcgagcgccaccggccgtgagcgtcggcgccctgcactcgcgcttttcgatggccggagcgagcaatccggttgccctgaggtcgtgatctcttgtccggttcaaaacggtggcctcagtctctgctgtccaccgtcgggctgccactcgaactcgatcgcgtcggcggggcagtagcgctcgacggcgcccgggcgtccttgccgccggacgcctgccatcgggagcgcggagtgctcgccgcccggttcattcctcctcctcgatcccggccgacgggacggcgacgagcggcacacgggtcacgccctactgcatacgagtgacgtgttcctgacctgggagggagccgggccgggggcacgcaagggtcacccgtcctgtagccgtcggagcgcggcgatcggcccagggccgcgaggactgccgtacgcctccgggggcagggcagggcagggcagggcagggcagggcagggcagggcagggcagggcggcgcggggcggtccgacggcggcacactccgttgtcggaccgccccactcggtcacctggccgggggcggtccatgccggcgcggcccggtcggtgaacacacgccgggagcgggcgtccggccgccgaccgggtggcctctcccgggcaattagtccacaccagtgacgctccacaagaccggccgcgccaggcaggagaacgtacgaggagtggctttgacgaacaactcccttgtcctggccacgatgggcggctcctggggagccggcagcggtgacggcgttccgccccgcgcgacccatcgcacccgacgagacgtgaactcgaccatcactggagaccctttatgcagaaacctttcccccgtgcaccggccgtgcgatgtctgtaccggacggcgtgcgcgaccgcggcggccgcgctggtggtgccgctgctggtcaccgggccgtcgagcgacgcccagggtgaggcgacgacgcggttgcagcgcgcgttcgccgacgcggcggccgagtaccgggtgccgcagagcgtcctgctcggcgtgtcgtacctgcagtcccggtgggacacgcacgacggtgccccgagcgtcatcggcggctatgggccgatgcacctcaccgacacacgcacggccctcgccgaggccccgcatcacggcgtgacccgcgacacggccccgccgctcgcggtggcggcggggccgcagcagcccgccccccggcttcccggccagctgacgactctggagcgggtagccgggctgataggggtcccggcggcccggctgcgtacggacgccgacgtgaacgtacggggcggcgccgccctcctggcggcgacacagcgccggctcggcaagccgctgagtgccgatccggccgactggtggagcgcggtggcgcgcttctccggcgcggacgacagcgcgacggcggcgacgtttgcgaacgacgtcttcgcggtgatccgcgccggcgcgcaccgcaccacggacaccgggcagcgggtcacgctcgcggcgagcccgggtgtgcggcccgactccaggcaggtgcgggccatacggccacgtgcgacggccgaccccgatgtcgagtgccccgcgacgctcgcctgcgattggattcccgccccgcacacggagttcggcgacgaccagtacggcaatcacgacctggccgaccgtcccaaggaccagcgagtcgagtacatcgtcattcatgacaccgaggccacccggacctccatgatcgacacggtgcaggaccccagcgaggcgtcctggcattacaccgtccgttccagcgacggccacataacgcagcatgtcaagaccaaggacgtggcctggcactccgggagccagttcgtgaacgcccgctcgatcggcgtcgagcacgaggggttcctcacgcagccggacgcctggtactcggagcagatgtaccggtcctcggcccgcctggtggcgtacctggcgaagaagtacggcgtcccgctggaccggcagcacatcttcggccacgacaatgtgccggccccgaccgcctcgtcgatccccgacatgcacgacgaccccggccccttctgggactggcggcactacttcgacctcctcggcgcgcccctgcgcgccacggccggggcggacagcgacctcgtcaccgtgctgccggacttccgcacgaatcagccgctgtacacgggctgcaacgagtcgggcaagccctgcgcaccacatggctccagcgcggtccgcgtccacaccgagccgcacgaggacgccccgctgatccaggacccggggcggcgcccggacggcgaggactcgacggccgacgtcaacgacctgggctcgcgcatctccaccggccagacgtacgccgtcgccgaacgccgcggtgactggacggcgatctggtacctgggccagaaggcctggttcaagaacccgaagaggaatccgacggccgtcggagcctcaggtctgatggtgaccccgaaggacggcctgaggagcgtgccggtctacgggcgcgcccacccggaagaggaggcgtacccctcggaggtgcccgtgcagcccgactcaccgcttccgtacgaactcctcgagggccagcggtacgcgacgcagggccgtacgagcggctcgtacttccagccgtcggccaccgacgccgcactgaaccacgtggtgaagggagaagacctgtactacgagatccagttcggccatcggatcggattcgtccgcgcggccgatgtggatgtggtgcacgccgacaagcggtagcgcctcgtcaggttccggggtgggtcaggggaattcgctcacggcgtgttcctctgactcccacggcgggatcaacgctggtcccgcgcaacggtgttggtgacaggccggccatttcaagccatggaccacggcgtcccggacgggagcgacttcccggcacgtcggctgactgcgtagcccccgataccggccagggccagcagggtcccgaggctcccgagaggcatcagcaccgtcggcacggcggagccctccggcactcgtccccgcactccgcactccggacgccgcgacgctgcctgaccgctcgctgaggtggaaacgcgagtcgtcggcgtcgctcgcgtcaatccgctcgacgaagagccgatcctcccgggggtacgtggctctcatcgagtcgcccatgacggtggccgtcctgtagttcgcgagggtgtacacgatggttcccgacaggagagccaacccgagtggtgccaacacccgggccgccttggtgaaccagcagatcgttcctcgctgccgcatgagcatccctcccgttgcaccgcccgacggctgtgcgggccggcggaggctatgcggccgccggggcggaaacgagcccagctccggcccgcgccggccacccgcggccggcgcctctcctggaaggccgcggtgcagaaggccgcggtgatctacccacactccgacgaagggcgggagcagggaagttgccgccgggctggacgcgagacggagcctgagtccgggaaagccctgcgctgtcaggccggacggtcgagcgcgccgacgatgaggacttcgagctgctgtgccacctggtccagggggtccgtgctgcgcttggcgcggcacatggcgatggcgccctcgacggatgccacgatgagggccgcgagccccggagcctggtcggagtcggcgccatgcgcccgcagtgcctgggcgagcaggtgctcccactcctcgaacgcctcggcggcggcgacgagcgccggtgggatctcgtcggccggcggctcctcgaccgagacggccagcacggggcagccggcacggaagtcgctctcgacgacgatgccgcgccacagcgccaggaaggcccgcaggccggcgaccgggcccgcggccaattccttgcgcaggatgcgggcgaccgcttctcccgcgtagcgcactgcctcggtggccagctgctgcttgccctcggggaagaagtggtaggtcgagccgagcggtgccttggcgtgtttggccagctcccggatgctcgtggcgttcaggccacgccggctgatcaggtcggcggcaccggccacgatgcgctcacgtgacggcgcgttggatcgagccaagaccgtactcctctctggctataacgctcgtcatagtctagcgtgacctccggttataacgactgttatagatcctgtgcgcagagctgtgcccagagctgtgcgcacagctgtgcgcagaactgtgcacatccgaagggagacttcgccatgccgatgatccggctcaccgtcccgcccggttccctgaccgaggagggccgcaggaccgtccagcgcgacctggcggccgtcctgctgcgctgggagggagcgcccgacaccgcgttcttccgcgcccaggcgtggagctacctcgtcgagctgcccgaaggggcacagacgaccgccgaggacgacgcaccccgcttcctcgtggaggtgacggttccccggggcgcgctgtccgagcggcgcagggccgggctggtcgaggacgccaccaggaccgtcctcgacgccgccgggctcacccagtcggacgccccgcgcgtgtgggcactggtgcacgaacagcccgacggcacctggggcgcgggcggctccgtcatccgctacgccgacctggtggccttggcgaaggggcagcgggccgatgcgtgaactgacctacaccggccggaacaccgtcgagtggcgcgaggcgcccgaccccaagctccagtccgaccaggaggcgatcgtcgtgccggtggccgccacgtcctgcgacgtcgactccatgatcctggccggtcacggcttcatcgacccgcccttcgccctcggtcacgaatgcgtgggccgggtcgtcgagaccggcgacgccgtcaccaccgtcgcccccggtgacctggtggtcgtcccctggtccatcaactgcggcacgtgcgacaactgccgcgccggactgaccgcgcactgcacggccgtaccgcacatggccatgtacggcgcgccgatcggcggcagttggggcggtctcttctccgacctggtccgcgtgccgtgggcggacgccatgctcgtacccctgcccgccggcctcgacccggtcgccatggcctcggcgagcgacaactggtccctgtcgtggcgcctggtggccccccacctgaagaacaagcccggcgcccgcgtcctggtcgtcgcccgcggcagcatcggcctgtatgtctgcgacatcgcccgcgcgctcggcgcctccgacatcctgtacgtcgacccggaccccgaacaccgcgagatcgcccgcggctacggcgccgccaccgccgagacgctcgagcccttcccgcatggcttcgacatcgccgtcgaggccaccggacgcgtcgaccaactcgccctggccgtcaagtcccttgccccggaaggcatctgcgagtccgccggcaaccacttccggcccggcgagctgcccctgctcgacatgtacctcaccggagtcaccctgcgcatcgcccgcgacaacgtccgcaaccacatccccgacgccctcgaactcgccgcctccggcaaggtcgcccccgagcgcgtcgtctcccacgtcctcgactgggagcaactccccgacgcgctgcccgagaagcacctcaagcccgtcttcgtccgcgccgacagctgaccgcgtcccgaccccggcccttcacgccccgaccgagagacccgcctgagcatcctccttcttcgcagatgggcgcccaagccgtcgcggccgggctcggcccgcgcgccgttctccggctcagcaccgctctcatcgccctgagcctgatcccggtgcgccgcgtgctgcggcccaccctccgccacgacaccggcggcggaccactccaggccttcgccgcgatgtcacggcggccgcccccggtcaggcgcccgccgaccggtccgtcgagctcgacctcgccggactgcgccatctcgaccatgcccgcacgagcgccttgcagaactgggccgaccagtacaacgcccgcatcgtccagcccgagcgctcccgcacccgggcatgagtgccggcccgtggggcggttgtcccgaccgccccacgggctcgcgatgacatacgaggtgaacggccacttgcgttcacccgtacccccagccgtacgcctgtccgctggtggggacaggaagagcgcggatacgcggatacggagtagcacgtgcttcagcagccacggcagtcacagcagcgatcgcgcggccgcggcggccgcgtcacccgcacggcccgcctggcgcgcgctgccgtactggccgggagtctggccctccttcccctcagcacggcgtgcagcggaggcgaggacgatgccgccaagaagagcaaggcgtcgccgacgacagtgaccgacgccccagcggcgggggcggtggcaccggcgaaggtcgaggtgatcgccaacctgaccggctgcaagcccaagatccgtatcgacgcggacgaactgcgccagggcctctgtcacacgaaggagatcgactacctcatcaccaccttccccgaggagaagtaccagcaggcttggctggactccgccgccgtctacgggggcaagtacctggtcggcctgcggtggatcgtcagcgcgaagaaaccggagatgctggagcagttccgcaccaagctcggcgggacgattcgacaactgcgtggcataggcccgaccccggccccgagcacgtcgtgacagcctccccgttccggcccccgcactgcggcgagtccgtggcggaggtgtgccgccggaccgtcgcccgacctgaggctgcccgccgatgccggtcgggtgtcggccgtggccgtggcgcgcgctgcgctgccgcatgcgccgggcgcgccgcagcagtcgttccggcgcgtcgacgttccgctgctgtccgccattcagctcaccggtcagtccggccgctggaacccgcgggccggtgccgtcgggagcggtgagtcgcgccggccgggggtcggttcgtaggagctgatcgtgtacagggcttcgtcgtcgatggagttcttgtcccagtccagggagatccgcacggggtggccgtcggcggcgtagtccgcgtccgccgtgtccgcgtcttcgctgcgggcctgcttcagcgtcttcaacagctcgccgatcgtgggtacttcggcgcgcagatcctgtacctgccgccggctgtcctcgtcgagcccgaccacttccgccaccttgccgtcgcgtacctgcacctggaaggtccccgccaggacctgggtgttcgatgtcagcgtgtaggagtacgagacaggttcctcccaggtgctctgtggcttggtctcggcggaacctgcggatgtcgaggagccgcaggctgtggtcgcgcacgacagggcggcgagcagcacggcggcggacaggaaacgagcacgggcacgtccggcggtcatggtgactccctcggggtcggttaccgctgggacgccgggcggctcaagaacgttcacggaggccgcgggcgggcgccccgctcactgtccgacccgagcaggttcgcccgccggcacacacttcggccgggacggcgggcggtgctgtgctccaggggggacctacggtatggccagctcggcccagatcgtcttcccggacgaggtgtaccgcgtgccccagcgctgggacacctgggcgacgaggaacaggccgcggcctccttcgtcgtcccgacgtgctcgccgtagatggggtgcggtgtgcgcgttgtcggagacctcgcacagcaggcagcgatccctgatcagcctcagcatgacgggcccggtggcgtaccggatgccgttggtgaccagctcgctcaccacgagagaggcggtgaacgacagttcggacaggccccagatcgccaattggcgctcagtgagtgtgcgggcgtgagccaccatggtcggctcaggcggcagctccaggtccgccacatggtcggcgccgagccgccgggtgcggacgagcagcagcgtggcatcgtccgcctgtggtccgggcggcatgtccgacagcgcccggtcgcacagctcctccagcgggcatcgttgccaggtgagcacctgggccagacggtcgataccgatgtcgatgtcggtgcgccggtcctccacgaccccgtcggtgaagaacgccaccacgctgccgctggacaggttcagctcaacgttctcgtagggcaggccccccagccccaggggcggtcccggcgccagcgcggacaaggccaccgagccgctcgcatcggccacgatcggcgggggatggcccgcgctcgcccagacgcaccggctgctgaccgggtcgtagatcgcgtacaggcaggtcaccccgagcgcctcgtcgatcggcccgccctccgcgtgggagtccgagtcctgcgcgaccaggtcgtccagccgggtgagcagctcggccggatccaagtccagcagggccagggtccgtacggtggcgcgcagccggcccatggtcgcggccgcgtgcacaccgtggcccaccacgtcgccgacggtcaggcccactcgggcaccggacagcgggatcacgtcgaaccagtcgccgcccacgcccacgcggctgtcggcaggcaggtagcggtacgccacgtcgacggcgctctgctcaggcaggtgctgtggcagcaggctgcgctgcagtaccagggccgccgcatgctggctggtgtaacggcgggcgttgtcgatgccgacggcggctcgctcggccagttccacggcgagcgtctgctcctcggggccgaagggatcggggttgctgctgcgccggaaggtgacaaggccgaggatcgcatcgcgggtgagcagcgggacgaacaggcaggagtgcggggcggccgatccctccccgcccggtgcctcgggcggggaggcgtcgacgacggggcggctggtggccaggctcagtgcctgcggtgacgagggtgggtaggagacgggactggtccggaatccttccggggtccggccgtgcatccgcagcagactgtgccccggcgccgagcccgtcggcggctgccgtccctcgatgaccgccggcggcaggtccacgagcacctcgtcggccagctgcggtaccgccacgtcggcaatctccgcggccgtacggcgcacgtccagcgaggcaccgatgcgctttcctgcccgcaccagcagcgacaggcgttcctgtgcgcggtagcggtcggtgatgtccagggactcctcgaacagccccagcggttcgcctcgggcgtccagcatccggtggtacgagcaggaccagacgtgctcgcgccccgggtcggcgggggcgcgcccgcggtagtgcatgccgatgatcggttcccccgtcgtcagcacgtgctccatgatctggtcttcgtccggggggtggtggcgggagatgaattcgccctcaggaaagaggtccgcggccggtcggccggtgtactgggcgactcccccgagttccaagtcggtggagatgttcccccagacgacgcgcatgtcgctgtcgaagatcgtcaggcccacggaagactcggtcgccagtccctgcagcatcgccaactgcgcttcccagctgcgtagcgcctccacctcggccgcgaccacgacggtcgcagcgacgccccggtccgagagggggctgaacgtcacggccgcgcgcagggtacgtccgtcccgacagcagaggtccaagacggtgctgcggggcttgtgcgccttgcacagggcggacagccgctggcccgtgggctggcccgagggagcggccagcagccgggtggccgacttgccgagcacatcctcgggtgaatgtccgaggaggcgctgggccgagaatccccacccggaaatgcggccttcgtcgtccagcaccgcggccgcggccttggagaggtccagaggactatggaaatcgacgtcggccgcatgcggaaaacgatccatgacaccgcttcccttcgtgttttctcagcatcccgtgccgcacgacggacgacaaccgcacgcgcgcttgtcacctgctcacacagggcgaccaccgatggttttccggacgcgacccaccaggcagcatgcgacggggggcggcctggaaacggcccacacgcaaccccactcgtcatggcgcccgacccagccgctcgacgaggtgccggctcatcccggcgcctccgcctgccgcctgccgccggccgccggccgtggtccggatgacggccggcctgctgaaccggctgccgtgccttcgttcggcaccggggcgaagcggcggtgccagggggccgcggcggcgggctccggcctggaggcatgacccgagggtggccagcggcacgccgttcggacctcggtgtgagcagcaacaacagcggctgggccgccggtgaccgcgcgaccgtacgaccaggccaccgagcgcctctgccgaccggtccgaacggcgtacccccgtttgacgtagacgggcctcatcaagcggcactgatcagggctgcaaaaactgcgctgtccacggcttgaccagtggtgattgccccgctgtccacccgaacgggcgagtggtgagtagcaccacaaatacctcttctgggggagattttcgacgtggcgtgcgtcacgatccttctcaagccctcactgaggatggtgaggcggtccgggtggacgccgaatcctgccgacgcccggatgtctgaccacacacggagatcggcaggagcgggggacccaagataagtgccggtccgcgaactgactctgatgtgacgtcagtgaatcaggagccggctcggggtgaagccacatgagtgggtgtggccggacttcttcgccgtccgaacccgacagctcacctcgcaggcggctgacgaaggtgcgggaagccatgacggcaacgcagaacggcccgcagctctcggggtccagggacgagcctccgaagagcaacaagaagacggatgccttgatcgcggtgttgatcgcgatcatcggtggctgcttcgcgggcatcgtccgtcggacgatggagggggtctcgtactacgaggccatcagtacaggagcccttgcggcactggggctgggcggtttcatctttgtgatcttgacctacatcaggtcttgatccagtagtacatacgtggcttcaactagacccccaccaaccctcgggggcatcaagaccaaggtcttcacggagaccccgtagaagacgttgaaggacgcgggagaggtcttggcacccagaccaagacctctcctttcgtgatcatgaaacgggaactcatcgtcgcccgggccgtgtgcttggcgccgagcacttcttctgccggagttcatgcctttgaggcagaacacaggatcgtgctgcccgagccgtatcgggccttcgtcgctgagatagcggacggttcgtactccgggccgcccgagtatggactgctgtcggtggcggagctgccggacgactggggcgatgacgagcaggaacgcgacctgagtaagccgttcccgctggtggaggcatggatgtgggaggaggactcggacccgtccgaggatgccgacgagctcctggagcaggtctacaaccacggctcgatcgtgctcggcaccgacgggtgcgcgatgaactggcatctcatcgtcaccggacctcaccgaggacacgtctggctgatcagtgacgtcggcgctgtccccttcggtgcgcagttcgggttcaccactgctgagcctggctttgcgggctgggtccggcattgggcagcgaacaagccctggcatgacgctgcgtgacttttcaggagtgcggcctgcggcggttctctccaatccgatcgacttcatgggttcagtgagcgggacgaagctgtcggctgggcgacggggcggccgaccacggccacggcgcgcaggatgccggtgtcgtcggcggcaccgaccgagaagacctgtccggcgggcggggggtggtgccgatgccggaggcggacgaaatcctcggcgtcacgggagcggacgggcaccaggtgcgggcgggactcgttcatgccgccgttccgaagtcggactgcggcggcgtgtgtttcgctgcgccgtgctcgacttgcgcccgtggtgtctggagcccggcgcggcagaactgtctgcggcgtccgaccacgcgtcgaaggtgaccacgctggtcgatccaccgcccggcctcggtgatcgagcgggcctctgctacttggcgggcctccgcgaacgaggccgaggtcgtggctggctttgatgcgtagccggcggctacgcggctcggtagtcggcgagcggggacgtgtcctgatgagtgcctgtgtctgacccggccctgccaggccggcgtcctcatgtccggtgccaggcgacgttgtggaacaccgcgaggggcagccggatcccggctgcccctcgcacccgcttcagcggtccggcgtcgcggtccggacctgctgcctggtcatctggacagcggcgtagacgacgagcggggttgccatcgcgggcagggtgcggcggatgacgaggccgagggcgacgcccaggacgaaggcgaaagcggcctgggccatggggacgacaccccgtgcggcgaaggtcacggggtcgagccgcgggaagtacgtgtccgtcgcgccaccgtcgttgacagcccggtcgatggggctgctccaccaactcaccgcgagtgcggccagtcgggccgcggtcagggcggccgccgcaccaaggcccggcttggtcgccggccggcgtgtgcgggtgacgccctggttccacgccaggtagtgggtaccggtctccagttcacgggagatcagcggcgcgcggcacggagttcaccaccgggcacctcgatccggaagccggaagccgagctgaccacacgggacgcccgctggcagctgtgggcggggaactccaagctcagtcgtgcgccccggagggcgcctgacgggcatcttgcctggtcaggcgccctttttcggtggctagaagaagcccagcttcttcggcgagtacgacaccagtaggttcttcgtctgctggtagtggtccagcatcatcttgtgggtctcgcggccgatgcccgagcccttgtagccgccgaacgccgcgtgggccgggtaggcgtggtagcagttcgtccagacgcggcccgcctggatggcacggcccgcgcggtacgcggtgttgatgtcccgcgtccatacgcccgcgccgagcccgtacagcgtgtcgttggcgatcttgatggcgtcgtcgaagtcattgaacgacgtcaccgagacgaccggaccgaagatctcctcctggaagatccgcatacggttgtcgccctcgaagatggtcggctggacgtagtaaccgcccttcaactcaccgtcgtgctcgatgcgttcgccgccggtgaggatcttcgcgccctcctgccggccgatgtccagataggagaggatcttctccagctggtcgttggacgcctgggcgccgatcatcgtgtccgtgtcgagcgggtgaccggtcttgatcagctcggtgcgggcgaccgccgcctccatgaactcggcgtactggccgcgctggacgagcgcccgggacgggcaggtgcacacctcgccctggttgagggcgaacatcgtgaagccttcgagcgccttgtcacggaagtcgtcgttcgccgaccagacgtcgtcgaagaagatgttcggggacttgccgccgagttcgagcgtgaccggggtgatgttctcggaggcgtactgcatgatcagccgccccgtcgtggtctcgccggtgaacgccaccttcgccacccgcgggctggacgcgagcggtttgcccgcctccaccccgaacccgttgacgatgttcagcacgcccggcggcagcaggtcggccaccaggctcagccagtagtggatggacgccggggtctgttcggcgggcttgaggacgaccgcgttgcccgccgcgagggccggggcgagcttccacgtcgccatcaggatcgggaagttccacgggatgatctgcgcgaccacgccgagcggctcgtggaagtggtacgcgaccgtgtcgtcgtcgacctcgccgagggaaccctcctgcgcgcggatcgcgcccgcgaagtagcggaagtggtcgatggccagcggaatgtccgcggccagcgtctcacggaccggtttgccgttctcccagctctccgcgaccgccagcttctccaggttcgcctccatccggtcggcgatgcggcggaggatgtcggagcgctccgccacggacgtgcggccccaggcgggggcgaccgcgtgcgcggcgtcgagcgcgcgctccacgtcctcggccgtgccccgcgcgatctccgtgaacggctgcccgttcaccgggctcgggttctcgaagtactgtccgcgggccggcggcacgtactcgccgccgatgaagtggtcatagcgcgcctggtaggagacgatcgcgccgtcggtgccgggcgctgcgaaacgggtcatgctggcctgcctccctcagaagcgctgcccgccgttgggcagctctcggcgcgaggctagggacgaggacgttgcaacgacgttgcggacctcgcgcccccgggcgcggcggggcgcggtgcctcaccggggcgccgaacgggcccaacccgccggcgccgacagctcgtactccagctcgtcgaggcgtgccctcaccggcgccgtcggccgcaccgccgccagcgcacgccatacgtcgagatcgtcctcgccccacggcgcgtgcgcccagtccgccagcagatcggggtcgcggcgcgcgatgagcgccgtacgcagtccgtcggcgatcctgcgccgcagccgggccaccgccggagcctgcgaaccgggcagcaacggacccgcgtacgccgccacggccgccgtgaccgccccggtcccaagacgccgctccacgaccgccacgtcggactccaccgcggccgtgagccggtaggggcgcgaggccagcagaccgggaccgaggaggcggcgcagcctggccagttcggcgcgcagcgtcaccggtgtcaccgactcgtcctcgtacagcgcgcacagcagctcgtcgccggtcagcccctcgggatggtgggccagcagcaccaggatctcgctgtgccggcggctgagccggatcttccgcccgcccgcgaggagctgtgcctcgtcgcggcccagcgcggtcagttcgagcgtgtccgccgtgccgcgcgccggcgcgagcagcgccagctgggactcggccgcccgtgccaccgcctgtacgaagccgaggctgtgcggatgcgcgagcccgtccccgccggtgatgtcgaccgcgccgagcacccgcccggtgcgtggatcgtgcaccggcgccgccgcgcacgtccatggctggacccgccggatgaagtgctcggccgcgaacacctgcaccggccggtccaacgccacagcggtccccggcgcgttcgtcccgaccgcgctctccgcccagcgcgcacccggcacgaagttcatcccgtccgcccgctggcgcaccgccggatgcccctcgacccacagcagcctgccctgcgcgtcgcacaccgccagcagatgctccccgtccgccgcgaacgtgcccatcagctcacggaacaacggcatcaccggtgcgagcgggtgctccgcccggtacgagccgaggtcgccgtcggtgagctccacgctcgcggtgccgtccgggcccaccccggcccgcgcggaacgccgccaggagtcggccaccacggaacgcaccggccgtggcaccgtgcccgccgccgtgcccgccgctgtgaacgtctcgtgggcacggcgcagcgcccgcacacgctcggcggggtcggcacccggctccagtgccacccatggatcggacaactcggcctccccggaaggcgatgcggcggcgatgcggctgaggacatcgtcactcccgggttcggcacggacaaccgtttcgaccacgtcggcccgaacgagcgcatcgtcaggcgaagttgacgagcctcatgtaccggacccagtcccagttcggccccggatcggtgtggtccgtccccggcacctcgtagtggccgatgatgtgcgcccggtccttcggaatgccgtactgggcgcagatcgccgccgtcagcctggcggactcctcgtacagggcgtcggtgaagtacgcgggctggtccacccacccctcgtgctcgatgccgatgctgcgcgtgttgtagtcccagttgcccgcgtgccaggcgatgtcgcgctcccggacgcactgcgcgacgtgcccgtcggcggaccgtacgacgtagtgcgcggacacgcccttctgtgggttccggaagatgtccagcgtcgtcgggtacgtctcctgcgtcacgtggatgaccacgtagtcgaggggatagctcgaagggcggctggacgccgtgtagttggacgtgctggccgccgtccactcggcggacggatagtcgacggcccggggctcggcgccggcctgcgcggcgggcaataacgcgtaggggaccgcggcgacggccgcgcccttcagcagctgccgtctgctgggcagcgctctggctcgctccatgggggaagcacctttctgcgtgggggagaggaagggggagggggagtcgtgtgccgggtgctcaacgccgaagccccgcggccctttcccgcggccgcgcgtgggtcggagcgcttcctccggcgggcgagtcgatgcgggcgtcgctcatggctgcacggctccgttctgccgaaggtcgggcgagggggtcgcgtcgagacggacacgggcggtctcggctgtgcgcccgtggtggcgccgcaacgatcagcaccacgaccccggccatcatccacgcgccgacgaccggtcccgggtacgacacgggcgtggtcggcgccgctccggaacaggacctcgcgcggcccggtcacctcgcgccgcagccccggaatcgtctccctcgacatgtgaaaccccccatccaccaggacacacagccgtccgcccgacggctgcccctcacgtgaatgacggtacggcgcttgccggttgggcaggaagagcgcggcgtcttcggtggacaaccacgggactgtggacaactccgtcacccacaagggggatggagacacccatgagagggacggggcgccggcctaccggtgcgtcgccgcgcgggcactgtcctgtgcccgttccgccaccgccgccgggtcgtcgagcaccgcccgcaccaccgcgtgcgcggcccccagcagcggcccctcggaaccgagccgcgagacggacaccgcgcaggcgggaccggccgtgcgccgggccagctcccgttccagcgacggcagcagccagggcgccaggcccgccagcgcaccgcccagcacgaccgtctccggatccagcagattgaccgccccggtcagcgcgataccgagcgcggtcccggcgtcgcgcagcgccccgcgtacgtcctcgtccccctgagccgcgcgctcggccagcagcccgacgcggtcctcgccgggctccagaccggccgcgcgcagcacggcctcctcgcccgcgtactgctccagacagccgtgcccgccgcaggggcactccggtccgtccgggtgcacgggcacatgccccagctcgcccgcgaaaccgcgggtcccgcgcagcagccgcccgtccacgaccaccgcgccgccgatgccgatctccgccgacacatggaggaagtcgcgtggcgtgccgtcgcccagccagagttccgcgaggccgccgaagttggcctcgttgtccacggtcagcggcagctcgtcgggcagcagcgcgccgaggtccgtgtcgtgccagtcgaggttcggggcacggaccacggtcctggcgtcccgcgcgaccagacccggtacggccacggcgaggcccgcgggccacagcccttcctgttccgcctcggcgacgacccggcgcaccagccgggtgagttccccgatcaccgccgcgggctcccggccccggttggtgccgttccgtacggcccgtgcccgcaccgcgccgcgcagatcgaccgcgcacacggcgaggtggtcgacgccgatctccgcaccgatcccggccggtccgcgtccgctgaccgcgagggccgaacccgggcgtcccacccggccggggcgctcgggccccagctcctcgaggagccccgagcggatcagttcgtcgaccagggtggagacggccgcccgggtcaggccgatgtgcgaggcgacggcggcgcgggacagcggtccctcggcgctcacggtgtgcatcacccgcgccaggttgcggcggcgcatgccctgttgcgtgtcgggcagccgacggccccggccggccgggtgtgcctcgtgcagcggtgcggtcatgcctccctcgaatctcgtcggcgcgggcctcgacgcgtcagcgccggtccggttcccgctccagcagcggcgccgcgtcggagagtaccccggagatcctggccagcgtcgcctcgtcccgttccacggcatcgagcaccggcccgtgagccgtgtcccagcgccgggccaccgccgccggatcctcgcccgtcagcaccccggcggcctgcgccgcggcgccgagcgcgaccagctccctggcctcgggcacctgaacgggacgccccgacagccggcgtaccgtctgctgccacgccgtgccccgtgccccgcccccgatgagcagcagcggagccgagcggtccgcgtccgcgtcgagtaccaggtcgagggcgcccagcagtgcgtggaccgctccgtcgtaggccgcctggagcagctgtccgcccgtcgtgtcgtgccgcagtccgtgcagcagacccgaggcgtgcggcagatccggggtgcgctcgccgtccaggtaagggagcagggtcacgcccgtgcccggctccaccgcctcccggtccaggccgagcagcgcggcgacgcggtcgacggcgagggtgcagttgagcgtgcaggccagcggcagccagtcgccgcgcgcgtcggcgaagcccgccacggtcccggtggggtcggcggggcgccgggtcgagaccgcgtacaccgtgccggaggtgccgaggctcagtaccggcgtgcccgggcgcaggccgaggcccagcgcggcggccgcgttgtcgccggtgcccggggcgaccagagtgcccttggagaacggcaggtcatggctgtcgcgcacggtgccgacgacctcacccgggcgcaccacgcggggcagcagcgccggatcgaggcccacatgcgtgaggacctcctcgtcgtacgactccgtcgcggacgcccaccagcccgtaccggagacatcaccgcggtcggtcgtgccctgtcccgtgaggcgttcggtgaggtagtcgtgcggcaggcgtaccgcggcggtcgcgcggaccgcctcgggctcgtgctccgtcagccaggcccacttcgtgaccgtgaacgaggggcccggcacgctgcccgtgcgctcggcccaggccttcgggccgcccagttcctcgatcagccggcgggcttgcggcgccgagcgcacgtcgttccacagcagtgccgggcgcaccgggtcgccgtgcgcgtcgagggtgacgaggccgtgctgctggccgccgaccgagatcgccgccgcctcgtgtgccgcgtcgccgcactggtgcagggcctcgcacagggcgtcccaccactgccgcggatcactctcgcggcccgccccggcggagacggtgtggggcgcctggccgctcgccaccacccgtccggtcgatgcgtcgaccaccagggccttggtggactgggtggatgtgtccacaccgacgacgagcggaccctcggctgctgacatcgggctctccctcttccgcggctcgcgggatctggcctgttgggaacggaaacacctctgggaccacaacgcctctgggcacccagtacctctggaacgaaaacacctcgtctcccggcggagacacatcctctcttcccagagatgcctccgcatactaatttgttaaccgccatgacgaaatagtcggagcaagcaaggagccgcgacatgaactaccagcccacccccgaggacaggttcaccttcggcctgtggaccgtcggctggcagggaagggacccgttcggcgacgccacccggcgcgccctggacccggtcgagacggtgcagcgcctcgccgggctcggtgcccacggagtgaccttccacgacgacgacctgatccccttcgggtcctcggacaccgagcgcgagtcgcacatcaagcgcttccggcaggccctcgacgccaccggcatggccgtgccgatggccaccaccaacctcttcacgcaccccgtcttcaaggacggggcgttcaccgccaacgaccgggacgtccgccgttacgccctgcgcaagacgatccgcaacatcgacctcgcggccgagctgggggcgaagacgtacgtcgcctggggcggccgggagggtgccgagtccggcgccgccaaggacgtacgcgtcgcactcgaccggatgaaggaggccttcgacctcctcggcgagtacgtcaccgcccagggctacgacctgcgtttcgccatcgagcccaagccgaacgagccgcgcggcgacatcctgctgccgaccgtcggccacgcgctggcgttcatcgagcgcctggaacgcccggagctgtacggcgtcaaccccgaggtgggtcacgagcagatggccgggctgaacttcccgcacggcatcgcccaggccctgtgggcgggcaagctcttccacatcgacctcaacggccagtccggcatcaagtacgaccaggacctgcgcttcggggcgggcgatctgcgcgccgccttctggctggtcgaccttctggagagcgccggctacgagggcccgaagcacttcgacttcaagccgccgcggacggaggacctcgacggcgtgtgggcctcggccgcgggctgcatgcgcaactacctcatcctcaaggagcgtacggccgccttccgcgccgaccccgaggtccaggaggcgctgcgcgccgcgcggctggacgagctggcgcagcccaccgccggggacggtctgacggcgctgctcgccgaccgtacggcgttcgaggacttcgacgtggaggcggccgccgcgcgggggatggccttcgagcagttggaccagctggcgatggaccacctgctgggggcgcgtggctgatcgcgttgcggagcggccatgcgatcggtctccgcgcggaattgctccggaatcgtgcggtccatggcatcggtccgtatcaacttccgcgcgggggtcgcgtcatgaccggttcgaggcgactctggacggtatggccatgccgcccgtaccgcctcagccgccgggagagaacccgcatccccacaacgggggcttcgggccgccgccgggtgtgccgcccggcggccatggaccaccgaccgatgactacgggacgtcgtccggggggtacgtctccagcggatacggtccgccgcagggcggcgggaactggtcgtcggggcagggcgggggagaaggatggccacccggacagggcgggggagaaggatggccacccgggcagggcgggggagaaggatggccacccggacagggcgggggcggaggatggccgccgccgccctcgggaccgcccggcggtccggggcgccgccgcaacgtgctcttcatcgtgctcgccgtggtcgtgaccttgggagccgtgaccgccgtggtgctgatggccaatggcaggggtgacggctcgaccgacaagaagtcacccgccgagagcagcaagggcacgggccgctcgcccacgccgtcgctgagcatcccgtccgcgattcccagcgagattcccacggaactgccctccgggttcccctcgaaactgcccagcggcttccccagtggccttcccagcgactttcccagcgacttcccgagtgagttgccgagcggcctcgagtcgctcttcgcggccccggcgggcgacgaagtgccgtactacatgctgaagaagggcgactgcttcgacaccagcgtcagccggcccggccaggccgccaagcgctcctgccgcacgccgcacgacgcggaagtcgtgaaagtgacggagttgaagggcggttacgcgaccgacgccgcgctgaagaaggcggcggcgggcctgtgcgaggcgtcgctggcgcgcacggaggcccagcacgccgccggtaccgtgcgtggcacgctcgtgcagtatccggacacggcgggatacaagctcggcatcgacaaggtcgcgtgcagcctgaccgcggacgtcggtggtggggaccgcaagttcaccgcgccgctgaagtgagccgaaacgaacgccacgcgcgcgtggaggtccgacaggaacggcacgcacgcgtggaggccgaaaacgcggctcggaccactccggcgcggtctctgtctctcctctctcctccgccggatgcgcgcttcccaggggcagacgccctgggaacggccccgccacgcgagacgtgtgccggggccgtggacctgcgcggagcggaccgttcagagggcggccgggtgctcaccgcggcgtccggcgtggcgggccggggccgcggtgagcgtccgaggagcggcctcggtcatgatccagccggcgccgtgggccgtgcctgttccagacgcttgccgatgaactcgccgagcaccgcggcgctcgggtagtcgaaggccatcgtgaggggcaacgggatccggaaggccgcttccagggcgttcttcagttccaccgccaccagggagtccaggcccagttgcacgaactcggtgtacggactgatgtcgtcggcgtcgtcgatgtgcagcacgtcggcgacccggtgccggatgaagtcggtgatcttctcgacgcgttctccgtccggggacgccagcagcgcatcgaggtcgagggtccgcgaggaggtcccgtcggcgccgaccagctcctggtagaaggcgttgaccaccggcttggcggcggagaagcggtcccagtcgcactcgccggccagcacctgcgtcaccggctccccgagcagggagaccatggtgtccagggcctgccgcggtggaatgaagacgatgccctcgcgttccagcgcctcgatgtgccgtgcgttcaggcgggccgacataccggcctcggaccacggcccccagttgacgcccagggcgggcaggttctgcgcggcccgccagtgcagcaactggtccagatacgcgttggcagccgcgtagttggactgcgacgccccgccgaccaccgccgcggcggaggagtaggcgacgaagaagtccagctcgtcgaagccctgagcggcctcgtgcagcatccagcttccgtacaccttcgccgagaacagcgcgtcgatgctctcccacgtctgtgcggcgaccggggcgtcgtccaggccaccggccgtgtgcacgatgccgccgagcggctgcggcgccgcgtgcagcgactcgacgatccggtggacgtcgccgctgtcgccgacgtcgccgcgcaggaccgtcacctcggccctgtcccgcagccgctcccacagcccggcggcgtccgcggccggctccgcccgccggctgaccagcgtcagataccgggcaccctcgtccaccaggcggtgggcggtgagcagaccgagcgcgccgagaccaccggtgatcagatagttccggtcggggcgtacgggtgcggtgccgggttcggcgggctgctcaggggagtcgaaggcgctgggcagcagcctgtggacgtggcggccggtccggtcgcggtaggccacctggaactcgccggtgtcggcggccagccactccccgagcagcatctcctcggcagtgcggccaccgcccgccggcaggtccaccagggtgacccggtacgacgggtactcgttcagcagcacatggccgaagccccagagagtggcggccgcgaggtgtgcgccgctgcccggctcgtcacccggcaggacttgggccgcttcggtgaccagccacagacgcctggccaggccgccttcctcctgctccaacaggccgagcagcgtgagcagatcgcggtagttgtgctcgcactccgcccggagggactcggcactcaccgggccgtcgtccgactgccagaaccagcacacgtccgtcggctcacccgcgcgcaccacgtccagtgcctgctcggggtccgccgcgaaggacagccgtacgtcctgtccggcggcctgttccacgagcccggtgacgtcctgggcggcgcggttcaccaccagaacgtgccgggggcccgccaccgtccgggccgtcgggggctgctcgacccaacgcggttcgtgcaggaacgccgaccggggaccggccgcctcgtcctgtgcgctgggaccggtgccgttcggcagccagtaacgcttgcggtcgaaggcgtacagcggcaggtccacgcgtcggcccggacgaccgtcgtggaagccgttccagtccacccgcactccggcggagtacagcttggccaccgcctggaggatggtgagcccctgcttctccttcgggtgcaggctgttgagccagcggtgctccccggcgtcgacgcaactccgtgccagaccggtcagcgcgatggacggcccgatctccacgaagacgtgcctgccccgccgttcgatggcccgcatccccgcctcgaagttcaccggctccacgatgtggcggacccagtactccggcttcgagatctcggcgacccgggcgaccttgccggtgatgttggagaccagggtgagctggggctgccggaacgtgatgtccttcaaggcctcgcggaactcgtcgagcacctctgccatgagcggggagtggaaggcgtgcgacaccctcagctgtttgacgtccaggccgcggcctcggagcgtttcgctcacctcggccagcgagtccgttccgccggatatcacgcactgacggggcgagttgacggcggccatggtgaggtccgggtacgactcgagcaacggggcgacctgttcggcggcctccggcaccgcggccatcccacccggggcggacacggactgcatcagacgggcgcgagcggccaccagcgtcaccgcgtcctcgaggctgaacagccccgcgacggccgcggcgacgacctcaccgatgctgtggccgatcagcacgctcggacgcgcgccccacgacaaccacagctgcgccagggagtactccagcgagaacaacgcgggctgggtgaaacgggtctggtggatggcgtccggatcgtcgtcctcgccgagcaccagcgctcggatggagcggcccaggagcggggcgaacagccggtcgcactcgtcaagatgctcgcggaagacgacgaagcgttcgtacagcggtcgtcccatcccggcatgctgcgagccctggccggtgaagaggaaggcggtcttgcgggcccgctccgcggcgatggaccgtttctcgatctggccgagacccttcttgagcagtgcgtccaggtcctcccggccgccgacgacacccgccagccgcagggggtggtgcgcgcggcccacgttgcccgtgtagcacagactgcccaggtcggtggagggggagtcgtccaggtgtcgctggtaccgctcgatgagctgcttcagcgagcggtggttcttggcggacaccgtgaacacgtgctgctcgaccgccgaggcgctgtccgtgcggtccgcctggacggcggccggggcggtggccggctgctcgggcaccgggggctcttcgaggacgacggcggcgatggtgcccccgaagccgaagctgttcaccacggcccgccgggtgtcggccttccagggccggttctcggtggggacggtgacggggtagctgtcccacgggatgcggccggagggggtggtgaagttcaggtgcgggaagatggtctgctcgcgcatctggagcagcgtcttgatgacgcccacgaggccggcgaccggttccatgtgcccgaggttcgtcttgaccgagccgaccgtcagcgggcgttccttgtcgtgcgacgtggcgaagacatcgctgatggcgcccatctcgatggggtctccgagcggggtgccggttccgtgcgcctcgacgtactggatgtcgctcggctggagcgacgcccgctggatggccgcccgcatgaccgcttcctgggcgggcccgttgggcacggtcagcccggcgctgtccccgtcctggcccaccgcggagccccggatgaggccgaggacggtgtcgccgtcccgctgggcgtccgagagccgcttgagcaccgcgacggcgcatccctcggcgcgtacgtagccgtccgccgactcgtcgaaggtcttgcactgggcgtcgggcgcgagcatgttggcggccgagaagatcaccgggatgcgggggtggtgcagggcgttgaccgcgccggccagcgcgatgtcgcactcacctcggcgcagcccctcggccgcggagtgcagcgcggtgagcgaggaggcgcaggcggtgtccaggctcatgcacggtccgcgccagccgaggaagtacgacagccgccccgagagcgggaagaaggtgattccggaggccaggtggccgtcgagctcctcgtacgggagggagtccagttccagggcgtagtcgatggagctggccccgatgtagacccctccgttggcgcggcgcagcggggtcgggtcgatgttggcgtgctccagggcttcccaggccgtttccagcagcaggcgctgctgggggtccatgtactgcgcctctttgggcgagatgttgaagaacggcgcgtcgaactggtctatccggtcgaggaagccgccacctatggtgcggatgcggcccggttcgtcgtcctccccgctgccgtccgccacgtaggtgtcggtgtcgaagcggtccgtcgggaaggggccgatgcccgaccttccctcgcggaggaactcggcgaactcgtcaggtgtgttgctgccacccgggaagcgcagtccgatgcccaccacggcgatgggctcgtgcttctcccgcaggagcttgctgatggtctgctgctgctcctcgacggtgtcgagggcggagcggaggcgttcttcgacgggcacggagctgtcgggcacgggtgttcccttccttgggcgatggcggagctgcccgccttgtggctgcggtcggtctcaggaccggtacaggtcctcgagggcgtcgccggtcaggtcgtcttccagcgagccgttttccggcgcagtgcgcccgtcggacgctccgggggtcgctctgtcccggtcagccgcggggagttcggatgcgggtcgaagcaggtgcggtccggtgggagttcctcgtggtcctccgactgcgggccgaccctggacggggccgccaccacggcccgcggggtgtcgcggtgtgcgggccagggcaccgacagcagtccgcggacgtcgggggtcggtgtgtgctgctcagtcacggggtggcctccaacacttgcggactgtccggccggcacgggggcgtgggtccatacgagcactgcggactgatccgggcctgacattgcactgaccctgcgggtgccgcgcgcgtcccgccctgcgggcggcgcgtcctggcgttccgcggcccgggagaggctctgtccgagggcgtggcggctccggcgcacaccgggccgcggtccggtgacggccacccgccggtacggcacgcgcggccgcccgcatggctgtcgcggccccgatgagggggacggcggacgggcgacggcgcaccgcgcacggcggatgggcgtgccgcgcaccgcgtaccgggaagggaagagcgtcggggcgggtcaacggcccggggacggcggatcgaggagaccgccggcggggcaaccggccgtgcgcggcagttcagcggcaccggtgccgctgaactgccgccggtcggtaccgttcacccaactcagtaccgatcaggaccagtcggtaccggtcagtgtcggccggcgatctcaccgatcagccggacggccgcgctcactccgtcctcggctcgcagccgctcgccgatcgcggccgcccgccgccgtacgtcctcgccgaccagctgaccgagcacgccggtgaggtgatccaggtcgaactccaggaagttgctgtagccgccggcaccgagccgggcgacccggtcaccccagaacggctggtcgctgaagacggtgtagatccaggtgggcaggccggccgtcaggcccgcggcggtggtgcccgcgcctccgtggtgcaccaccgcccggcaccgcgggaacagccagtcgtggtcgatggcaccgatcaggcgcacggtgtccggcagttcgccggtcagccccgacaggtcggaccagcccgctccgaccagcagacgcagcccggttcgctccgcggcgcgcacgatcaggtcgaggagcttcggcggatccagcaccggcatgctgccgaatcccaggaacaccgggggaggcccgatggcgagccagccggccagccactcgggtatctcggcctcccccacacggcggcgcacctcggactggagccgccagaatccggtcatgacgttccgcggcccccagtcgtgcggtcgggggaccacctcctcgctgaacgcctggagcgtcggcagaccgagttcgacggtccaggtcagtgcggcgctgggggccggtggcaggccgagcgaccctcggaactcgttgatgtcgtcccgcttgccctgccagtacacgtcttcggccacctggtgggtccccaggttgtactgctcggcggactggtcggccggtacgacctgcggagtcagcggctgagggaactcgtcggtcagcaaccacggcgtcagatggccgaggacgatgggcgttccgcgggcctgggagactgccagcgcgtagtcctcggtgttgacgccggtcaccaggatgtcggcgccgtcggccgcggccagcaccgacgtgccgatggtgtgccgggcgtccgacagcatcttcgtgatgcccccgagatacgcctccacattgccggcggccagccactgctggccctcctcggaccgcagtacctcgcgtacttccaggtccatctcgatgaacttggcgtccgtcccggccaccaggcggcgcgcgtcgcgaggggcggcgaaggtgacctcgtgcccagcgctgatcagcgcctgggtgagcgcgacatacggttcgaagtcaccgcggctgccggccgtcgacacacttaccttcacgccggcacctccgccctgtcggacccggccgtgccgccgctgcgggttgtcggctgcttcatctcggacctcacttcgggttgggggatgaacggtgctcggcctcgcgctaccaggtcaccggcaggcactccaggccgtacacgagcgtgtcggtgtggaccgggacctggtcgcgtccgatggccagacgcaggtcggggaagcggcggaacacgctggtgatggcgatctccagctcggtccgggccagcggtccgccggggcagaagtggggtccgtgcccaaaggccagatggcggctgttgtcccggtggatgtcgaagtccgccgcgtcggggaagacggcctcgtcgtgattggcgcccgggacagagatgacgacggcgtcgccggccgcgatgcgggcgtccccgacggacaggtcctcggtggccgttctgacaacgttatcctgggctatggaccagtaccgcagcagttcgtcgaccacgggagtgagcaggcgcgggtcggcgcggagttcggcgagtaccccgggtctgtcgagcagggtgaagatgctgagggcgatctggttcgccgtcgtctcgtgcccggcgacgagcatcagccggaccatggccaccaggtcgtcgtgggacagctgcccggggcggacgaaattcaccaccaaccggctcaacaggtcgtctttcggctcccgttccttggcccgcgccaacccgtcgaggtaggcggtggtggcgagaaacgcctggacggccttttccggttccttctggttgagcagggcgctggtattttccttgaattcgctcatgtcttcgtccggcactccgaagatacgggcgatcgcgatacagggaagtggcagggcgaacaccgaatggaaatcgaccggcttgggcatcgcggccatctcgtcgagtaactcgtcggttatcgactgaaggagtgggcgaagggcctgcgtgcggtgggcgatgaactccgccgcgaccatcttgcggtaggccccgtgttccggcgggtccatccgccagaacgacacggcccgcggcggcacgggaaacagcagtcggttcggccagttggggtgctggtcgttgacgctcaggcgcgggtcggcgagtgcctggcgtacgtccgcgtagcgggtgatgagccaggcgggctggtcgccgcggagtagtacctggcggggcgggccgtcgcggaacgcggcgagggcgggtggttgggacatcggacaggtgcggtgcagcggccatgcggtggtaaccgcagcggtctgggtcatgatcccccttctagtctcgcaattacgcggatggcgcggtgctcggcatcagaagttgaatctggatacaaactattctgcgtaactgggctgacacggcgctgacatggcgtggacgtggtgcgtcagattccggaacgggtccgaaaatgcgtccaacgcaatggacaggactgcttacttgggcaagaatccatggggccgacgcgtcggctgtgcgtgcggacaaacccaacggagggctatccatgactaccgaggagttatccgagtcggagctcgccggggcacctgccgcgactgtcgcggaaccgccgccgcgatggagcccgctcattctcgtgtcgctcggcacattcatcaccgtgctggatttcttcatcgtgaacgtcgcggtgcccgacattcagcagagtctgcacgcgagctcggtcgcggttcagttcgtcctggccggttacggccttccgctggccaccttgatgatcacttcgggccggatgggggacctgtacggccggcggcggttgttcgtgaccggcctggcgttgttcacagccgcctccgcctgtgccgggctggcgcagagccccgcccaactcgtggcggcgcgggtgttccagggcatcgcggcctccctcgtcactccgcaggtactggccctgctgggcgccatgtaccagggcagggcccgcgcggtggcgttcaacgtctacggtctggcgatcggtctggccgcggtgttcggacagctgatcggcggatctctgatcgcgctggacccgggcgggctgggctggcgcgcgatcttcctggtcaacgttccggtcgggctggtcgccgtggcgctggtgccgaggctggttcccgagtcccgtgggggcgggcggaccaggctggacgtgatcggcatgctcctggtgatgctcggacttgtggcggtcgtgctgccgttgaccgaggggcgggagctcggatggccgctgtggtcggtgctgtgcctgatcgcggcggtgccggtgctggccgtcttcgcggtgcagcagcaccgcggcacggtccggggtggggcgccgctggtgaacaccactctgttccgctcgcgggcgttctccgtcggactgttcgccatgatgttctactacgccacgatgggcgcgtgcttcctggtgctctccctgtatctccagcaggggcgcggcatgtccccgttgggttccggtctgctgtacctgccgctgggtgccggcttcttcgcggcgacggcactggccggccgcctggtcgggcgactggggcggcaggctccggcggtcggcgcgctgctcgtcgtcgtcggctacggcacgctggctgttctggtctcggggatcggcgtcggcgggcgggtcgagtggctcgcgggaccgttgctggtggccggtctggggatggggctgaccatggcgcccctgtcctcgatggtgctcgcccccatcaccgcggaccatgcggccgccgcctcgggtgtactcaccaccgctcaggagatcggcgcgaccgtgggcacggcgctgatcggcagcatcttcttccggatggtcggcgaccacacacaagcccccgcgacgtcgcatgccttcagcgtctgcctggcggtgctggtggcgttcgacctgctggtcgtggtgctggtgcagctcatgggcaaggcctcggaaccggcgtccgactgaggacggggacggtgagacggggggtgcggcacccaggcgttgggtcagtcctggaaccactgacggccgcccttgagggacggccgccgaggagcgcccgtaggggcgcgggaaagcgcgcgatcagccacaggctgcccgcaccttacgactgccgccgcacctcctcgaccgtcaccggccgatgcgagtgcagcgacagcgtgcacgcctcggcgatccagcccgcctccagggcgtcggcgaccgtgcagggggaggggcgccgaccggcgacgacctcggtgaacgcggtgagttcggcgcggtaggcggcggcgaagcggtccatgaagaagtcgtgcggggtgccggccgggaacgaggtgccgggctcgacggagcgcagcggcagccggtcctccaggcccacggcgatgctgtcccggaagccgtgcagctccatgcggacgtcgtgaccccgggcgttgtggcggctgttggagacgacggccagcgtgccgtcgtcgagggtgaggaccgcggccgtggtgtcggcgtcacccgcggcggcgatgtagtcggcaccgcggttgccgccggtggcgtacacctcgacgacctcgcgcccggtcacccagcggatgatgtcgaagtcgtgcaccgagcagtcgcggaagatgcctccggaggcggcgacgtacgcgggcggcggcggggccgggtcgagcgtggtggaccgtacggtgtgcagtgcgcccagttcaccgctcgcgacggcggcgcgcgcggccacgaacccggcgtcgaaacggcggttgtagccgatctggatctcgaccccggcatcccggaccgcttcgagcaccgcgacgccttcgcgcatggtgcgcgcgacgggcttctcgcagaagaccggtacgcccgcctcgaccgcggccaggacgagacccgggtgggcgtcggtcgccgcggcgaccaccaccccgtccacgcccgcggccaggacggcctccggcgagtccgccacctcggcgccgaaccgctcggcggcgctcttcgccgcgtccgtgaaggggtcggtgaccacgagggacgtgaccgccggcagacccgagagggtctcggcgtggaacgcgccgatccggccaagacccatgatgccgatacgcatgtgctgcctttcgatggtgctgtggtggtgttcagtccagggcgccgagcacgttctggtcccagtcgatgaccgatccggtgacgacaccgctgcggtcggagaggagcaggacgacgaagtcggcgatctcgtccggatcgccgagcctgcccatcggcagcccccggcccgccctctcgcgccagtcgtcgcccgcgccgtggaaggcccgctgggtcgcgtcctcgccctcggtggccgtccagccgatgttcagcgcgttgacgcggatacggtcccagcggtgggcgtgcgccgcgttgcgggtcagccccgcgagcccggccttggcggtggaataggcggtcaggttgggtgggccgccgtgggcgcagttcgagccgatgttgacgatggtgcccggcgcctcgcgctccagcatgtccgcgacggcggcctgcatggcgaagaacgggcccttgagattgatcgccagatgggcgtcgaacagctcgggcgtcgtctccagcagggttccgcgcgaggtgagccccgccgcgttgaccagacagtcgatccggccgtgcgcctcgatcacccgggccacgctcccgcgcgcctgcccggcgtcggcgaggtcgacccgcacgtacgccgcctcgcacccggccgcgcgcagctcgcccaccagcgcctcgccgggttccgggcgccgcccggtgacggtcaccgcggcgccctcgcgggcggcggcccgggcgaccgcggcgccgatgccctggctgcccccgttgaccagaacgatcttgccgtcgaggaggccgcccgtgtcgtccagaagtctcttgccgctgtcgtggagatgtcccatgtcgctcgtttcctcagctggtgcggcgctcggcgccggcgttcagtgcctcgcgcagcgcgtccgccgtccactcctcgcgcagcgcacgccgtacgaggtcggcttgcgacggcggagccagcccgccgacgggcgggtcgcggtcgaggttggtggggaaggggtagccctcggcgcaggccgccacgacggtgtccagccactccacgctcgcgcccccggccttgcgggtgagcagcgcggggtagaccgcgttcaccacggtcgcgcggtcgacggtctccatggcccgcccgaaggcggacgagacctggagaagattggccatgcgcctgatgtccgacgaccggttcgtcccggccgcgtggaacagcgccgggttgaagaacaccgcatcgccctcggccagcggaagctggacgtgacgggactcgaagtacgcctggaaatcgggcagtcgccaggccagatagccgggctcgtacgtctgcgagtacggcaggtacatcgtcggcccggactcgacaggcatggcgcagtgcgcgaccgcgccctggagggtcagcgcgggggagaggcggtggacgtgcgccgggtacgtggccgccaccgcgttggacaggaggcccaggtggtagtcgcggtggacggactgggcggcgccgccggggttgaccacgttgatctgcgaggtgatctggtagccgggcccgagccacgcctgcgagacaagggcgatgacgtcgttggcgtagtagtcggcgaacgcctccggcgcgtggacggccagcttctgcagcgcgttccagacccggtcgttcgcacccggtgcggcgaagtggtcgccggcgaccgtgccggatgcccgctgggcagtgatgagcgcgtcgaaggcggcggtggcgcgcgccacgaccgacgggtcggggaaggcgcgccggaacacgacgacgccgggcccctcactgaaggcacggaccaactcggcctggacgtgacggagttcgtgggcggcgacggcggaccgcagccggtcgctgtcgtagaagaggacgttgcgctccacggcgtcggcgtacggatagtcgtccgcgtcggtcgtgcgctcgaccaggacacggaaggcgtcgaggtcgcagtcctcctcggcgagccaggacgggcgtacgtcggtggtgggggacatcgtcgtcctttcgtgccgggtgctgccattcttgtgagccggaacccctcgaacaaccagcagtgacccgtcaaaaacccctcaaggagtcccttccatgggccacccctatccgctgcgggagatcgcccgccaggcgggcctgagcgaggccaccgtcgaccgggtcctcaacggccggggcggggtgcgcgagagcaccgcgcgcgaggtgcaccgggcgatcgccgacctggaccggcagcggacccaggtcaggctggtcggccgcaccttcatgatcgacatagtgatgcagacgcccgaacggttctccaccgccgtgcgcgccgcgctggaggccgagctgcccgccctgcgcccggccgtcatgcggtcgcgcttccacttccgtgagacgggcccggtggccgagctggtcgcgaccctggatcggatcgcccgacgcggctcccagggcgtgatcctcaaggcgccggacgtccccgacgtcaccgcggcggtcggccggctcgtgtccgcgggcatccccgtggtgaccctggtgaccgatctgccggccagcggacggctcgcgtacgtcggcatcgacgaccgggccgcgggcgccacggccgcgtatctgatgggccagtggctcggtgaccgttccggcaatgtgctcaccagcatcagcagcggcttcttccgtaacgaggaggagcgcgagatgggcttccgcgccgccatgcgggccctgcacccgcgccgcacgctggtcgaggtcgccgaggggcagggcctggacgccacgcagtacgacctggtcgtcgccgccctcgaacgcgatccggagatccgcgcggtctactcgatgggcggcggcaatgtcgccacgctgcgggcgttcgaggcgacgggccgccgctgccaggtgttcatcgcgcacgacctcgaccacgacaacacccggctgctgagggaacaccgactgtccgccgtgctccaccacgacctgcgccaggacatgcgcgaggcctgccgcaccgtgatgcgggcccatggcgccctgccgcccgcggggcccgtgctgccgtcgccgatccaggtggtgaccccgtacaacatgccgactgtggccgaggcgactcccgccgccgcggactgagacacctgcggctcgtgcgccgcgaggccgtggccgagagtgctggccggctcccgtttcgacggtgaccgcggggtacccgcgaggggagaggaaccatgagggatacgggggacacgggggatccgggggacacgagggagaggatgcgccgtgaacacgcaatcgccgccggcttcggaagtccaggtggtactcaccgactgctccgccacggacgccggacatctcttcgacgccctgcgcaggcgcttcgaatgtgaccgcgaggacagcgacagccctgctgagaccccgaccgcctggacggccacgttcgacacggccgccgtgtgcccgcccgcgtcgggggcgtcggtgcccctctcgggtccggtgacggccgaggtccagggcagcccgcacgccgtacgagagctggaggacgccctggcggacgtcttcaccgtgcacgaggtgggctcggtctccggcgatcaggaggtcgaggtggagctgcggctggaaccgcgcgggtgagaggacgggcctcctgacggcggcgcacccgacgggccgacgggcgcagccgatgcgccgccgcggctcggccagggacccggccgcgcccggtggcctcctgcccggcacgatgctgtcgccgcccggtggcccctggggccacctgcccctgcccggggcgatggcgtcgcccgccgcaccgtcgtgcgatccgctctgccccgcctcctcggttcttctcgccttggccgaccggaccggtcgccgtcggccccgccgcgggccctgtggggaacgcatggccctgaggtcggcggagcggcagccgcaccgtgcggccgccggcctccccgcgggccctgtggggaaccccgcggaccctcagctaggcggagccgccacccgcagtggcacgggggctgccgtcggtgggagttcggcggcgcggtcggtgatgtccgcccaccaggcggcgccgtcctcgatgtaccgcagcagtacgccttcccggatggcccacggacagagggtcaccctgctgaccccggtcgtcttcatcaccgtgtgccccacgatcgccccggccaggctctgccgggcccgcggcgcggagatgcccggcagcaggtagcgctcggccgccggcagcgcggtcagccggtcgagacagccgcgcagctcgcggcgctccagatgccggtccacgaacggcccctgacggccgggcgccgccccgcacagccggcccagctgctgaaacgtccgcgaggtcgccacgacggtacgcggcccctcccaccggatccgcgcggccacatcccgcagctgatgccggaccttgcggcgcagcgccttgaccatcgcggcggacggcagatcctcgccctcgaagaactcccgggtcagccggcccgcgccgagcggcagcgaggccacgaagtccggcagccgcccgcgaccgaaggccacttccagtgagccgcccccgatgtcgaacagcgcgagcggccccgcgcgccagcccatccaccgccgggcccccaggaaggtgagctcggcctcctcctccccgggcagcgtgcacagccgcaccccggtctccgcccggacggcgcgcagcacctccagccggttcggcgcaccgcgcaccaccgccgtcgcgaaggccagcggtccggcggcgccccacttccgcgccgtctcatcggccgcggcgaccgccccgacgagtctgtgcacggcttcctcgggaatcctcccgtcgggccccaccacttcggacagccgtaacctccacttggccgtgtgcaccggcagcggtacgccgccctccgcgtccgccaccaccagccgcaccgtgttcgaacccacgtccaccacactcatccgcatgcgcgggacgtacccgcccccacgctccggacaccctgatcgaccccgacgagggcggggaacccggccgccgtgcacgaagaccactccggcaccacgcatcccacgcgtgtggagtgctgtcttctgggcactcaggaacaagtgggccagacattcagcaaacatgaaaatacgccacagatcggaggtgtccgatgggaatgccagccgggccctacctgctgacaccgccgggcgtctacgcaccgcaacacgacaccgaccttttggcccgcgccttgcgccgggaggacatagacacctcgacggaggtactcgacctcggtaccggaagcggcgcgctcgccgtgcacgccgcgcgcctcggcgcccgggtgacggccgtcgacatctcccggcgcgccgtgctcaccgctcgcctgaacgcgctgctcgccggccggcgcgtcaccgtccgccggggtgacctgaccgcggccgtgccgggacgctcgtacgacctcgtggtgagcaacccgccgtacgtgccgtcaccttcggcccggctgccgagccggggagcggcccgcgcctgggacgccggacacgacggccgggcgttcgtcgaccgtatctgcgacacggcgccggccgcgctgcgggccgggggagcgctgctgatcgtgcactccgcgctctgcggcacgcggcccaccctggaccggctggccgccgccgggctcgacgcctcggtcaccgaccgcgccttcgtccccttcggccctgtgctgcgtgcccgccgggcgtggctgcgccgccagggcctgctgaccgacgagaacctggaagaactggtggtcatccgtgccgaacactcctgagcgaccgcgccgcgtcaccgtcgaccgggacggacccctgctcgtcgagggcccggtcgaggtggtctgcgaggacggcacggtcgtcacctcgcgacggttcaaggtcgcgatctgcacctgccgccgcagccgtgcgtacccctggtgcgacaccagccaccgccgccgggtgaagggggacacgccgtgaggagtcctgaactccccaccccacgaggtgagttgtccaagtccgtcttctcgacgctggcctacagcactcccctccccacctggtcgcacgaggtgcaggaggccgacccgtacggggacgatctccaactcgccctctacgtcctgtacgagctccactaccggggcttcgccgaagtgtccgacgaacgggagtgggaccccgggctgctcggcctgcgccgcgccatggagctgcgcttcaccgaggccctgcgctccgacgtaccgctcgagcccgacgtcgacgtcgagaaggtgctggccgcgctcctggtggaacccgtgggacaggacgacaccagcgtcagccaccatctccagcgcgacggcgaactgtggcagttcaaggagtacgccgccctgcgctccctctaccacctcaaggaggccgacccgcacgcctgggtcatcccgcggctgcacggccgggccaaggccgccatggtggcgatcgagtacgacgagttcggcgcgggccgcgaggaccagatccacgcccggctcttcgccgacctgatggcggacctgggcctgcggacggactacggacactacgtcgacgcggcccccgccgaggtgctcgccaccgtcaacctcatgtccctgttcggcctgcaccgcgccctgcgcggcgcactggtcggccacttcgccgccgtcgaggtgacctcgtcacccggctcccgacgcctggccaccgccctgcgccgggtgggagcgggaccggccgcccagcggttctacgacgagcacgtcgaggcggacgccgtccacgaacaggtcgtacgccgtgacgtgatcggcggtctgctggagagcgagcccgaactcgaacccgacgtcgccttcggcatcctggccaccggtttcctcgaagaccggctcggcgcccgcctgctggacgcctggcggagtcgacgcagtgccctgcgcgtgccgttgaccggcgacgaggaaggtgccccccatgcctgacaaccccaccgaccagcatccccgccccgacttcccgcagcaggatcaggaacacccgggctggaccggccccatggacccgccgcccgaccacggcgaggactcgtacgagggaagcggactgctccaggaccgtgccacgctcctgaccggcggagactcgggaatcggccgggcggtggcgctcgccttcgcgcgcgagggcgccgacgtcatgttcacccacctcccggaggaggagaaggaggccgccgagaccgtccgcctggtcgaggacgcgggccgcaaggccgtcgccgtggcctgcgacatccgtacggaggaggcatgccgccgactggtggagcgcgctgtcgcggagttcgggcggatcgacgtcctggtcaacaacgccgcgtaccagatgtcccagccggacggcatcggcgccatctccaccgagcagttcgaccgggtcgtacgcaccaacctgtacggcatgttctggctctgcaagctggcgctcccgcacattccggcgggcggttccgtcatcaacacgacgtccgtgcaggcgtacaagccgagtccgcatctgctcgactacgccatgaccaagggcgccatcgtgaccttcacccaggggctcgcgcagatggtggccggtgacggcatccgcgtcaacgccgtggcgcccggccccgtgtggactccgctgatcccggcgacgatgccggacaccacggagttcggcaagcaggctccgctcggccgccccgcgcagcccgccgagatggcccccgcgtatgtcttcctggcctcgccgcgggcgagcttcatcaccgcggagatcctgaacgccaccggcggcacaccgctgccctgagccggtcccgagccgtggcgaaaggcgcgccacccgcgggcgtcagtccttcaggaacgggtggagcagggcgagcagggcgtccgggcggtgcaacgggatgatgtggccgcagtcctcgacgagatggccggtgaggtcgtcggcgaacgggcgcaactggcgctccagcgccgcgccgacgggatgcgagccgacggccatcgtggggacggtcagccgcgcggtgtcgaaggcccgctcgatctgcgtggcgctgacgggcagggcgcggtagtacgagaacgcgcagcgcagggcctcacgtccggtataggcgcggacgaacgcgtcccgtacggcgggccgcaccccgtcgccgagggtgcccgtgtcgaggaaccagtcgaggtagcgcgcctcgttgccctcgagcacggtctccgcgaggccgggtacggcatggaagccgaaccaccagggggcaccgcccgccagaaaggactcggcgccggggagtcggcccagcagggactccatgaccacgagccgcctcacgaggccgggtcggcgcagcgcgagcagcagggcgggcggcgtgcccgcgtcgatgcccaccacggcggccgggcccgcgcccagcgtctccagcagggccgcggcgtcgtcggccagcgagccggcgtcgtaaccggtcttggcccgtgtgctcgcgccgaacccgcgcagatccggtgcgatcacttggtaccgctcggacagcccggccatgacgtcggtccacagttcccaggtgtgcgggaagccgtgcagaagcaggacggcggggccctttccggccagggccacattgagttcgacgccgttgacggacacgcggcgcagcacggtcatggaacggtccctccaggtgggggatacggggggggatacgggggtggtcaccaaaggtgacaagcacacggtaggtaactaacctggtccttccaagaaggcactttcgtctcaggtggtgagctccgggtgaccaaggcgaaccgcggtgacctcttcgatccgcagtgtccgacccgtcggctgctcgaccgtatcggcacgaagtggacctcgatggcggtcaaggtgctggccgaggcggccccggacgaggtgcgcttcgcggaactgcggcgccgcatgccgggaatctcccagaagatgctctcggtcaccctccagagtcttgcccgcgacggtctggtggcccgccgtgtcgagccgacggtgccgccgcgcgtgcactaccggctcaccgagctgggcctgtcgctggagggccccctggccgctctgcggcactgggccgagcggcacatgtcggagatcgatcgcaacaaccgcctcgaggatgcccggagttcggccggctgatcaggagggcgagtccccgccgcggacatgtccctactcggcggggccaccgcgcccctcggcttccacgtgggcacggcccctgtgcacggccgcttcgagcccttggcgggcggcatccaggtcaccccggacatgaccgggtcccgcgtgtcccacgctcggcgtaccggggtggcggcaagtggatggtgcggggccgcgttcgccgacgatgcgcggcgtgcgccgttcggccgccctggacgcgacgcacctgagcacggtgaacggtggctccggggaggagttgcgctgcgtggccctggccaacatggccccaaaaggtgcaatatcgcggcaaatgcggttatctcttgatcgtcctatgctgatatccggaggactcgggcagacgacggccggtcctgcgccggcgggaagcgggcttccatggctgaacgacttaaaaggctggggttgatcggcgagctgtcggctgagttcgccggcaccatgattctcatcctcttcggcgccggcgtggtggcacaggtggtcgccggtggagcgctcacgaccccgccgggcggcctcggaaaccacgacagcatcgcgtgggcctggggcatcggcgtcaccatgggcgtgtatgtcgcggcgcggctgagcggtgcgcatctcaaccccgcggtgacggtcactctcgccgcgttcaagggtttcccgtggagcaaggtcgcgccctacgcggtggcccagacgctcggcgccttcgtggcggccctcctcgtgcgctggaactacaccgaggcgctggcgaaggccgaccccggccacaccctcaagacgcagggcgtgttctccacgctccccgccaacggcaacccgaacctgccggtccacgagtggggcgcgttccgcgaccaggtcatcggtaccgcgatcctcctgctgctgatcctcgccatcacggacctgctcaacacgccccccggcgccaacctggccccgttcatcatcggcctggtggtcgtggcgatcggcatggcctggggcaccaacgcgggctacgcgatcaacccggcacgcgacttcggtccccggctggccagcttcatcacgggctacggcagcgcatggcgagatcagtacgggaacttctacttctgggtgccgatcatcggtccgctgatcggcggtctgctcggcggggtcgtgtacaagttcttcgtgggccggttcctgccgacggcggagccggagccccccggacgcgtcccgacccccgaggcctgacacccaccagagaggcggcacgccatggcggacttcgtcggcgcggtggaccaggggaccaccagcacccgattcatgatcttcgaccacgccggcaacgaggtggcgaagcaccagctggagcacgcccagatccttccgcgctccgggtgggtcgagcacgacccggtggagatctgggaacgcaccaactcggtgatacagaacgccctgcggcacgggaacctgtccccggacgacctggcggcgatcggcatcaccaaccaacgggagaccaccgtcgtctgggacccgcgcaacggccgtccctactacaacgccatcgtctggcaggacacccgcaccgactccatcgccgcggccctggaacgctcgggccagggcgacgtcatccgccgcaaggcggggctgccgccggcgacctacttctccggcggcaagatccagtggatcctggagaacgtcgacggcgtccgcgaggcagccgagcaggggcacgccgtcttcggcaacacggactgctgggtcctgtggaacctgaccggcggccccgacggcggcatccacgccaccgacgtgaccaacgccagccgcaccatgctgatggacctggaaaccctcgactgggacgacgaactgctgggactcttcgacatcccgcgatcgatgctgcccaccatcaacccgtcctcccacccggaggcctacggccagacccgtacctcccggccgctgcgcgccgccatccccatcgccggggtactcggcgaccagcaggcggccaccgtcggacaggtctgctacgcgcccggcgaagccaagaacacctacggcacgggcaacttcctggtgctgaacaccggcaccgaactggtccgctcccagcacggactcctcaccaccgtggcctaccagttcggcgacagcccggccatctacgccctggagggctccatcgccgtcaccgggtccgcggtgcaatggctgcgcgaccagatgaagatcatcaagtccgcggccgagagcgagacgctggcgcgtaccgtcgaggacaacggcggcatctacttcgtccccgcgttctcgggcctgttcgccccgtactggcgctccgacgcccgcggcgcgatcgtcggcctcgcccggtaccacgacaacggtcacctggcccgcgcgacgctggaagccatctgctatcagagccgtgacgtcgtcgaggccatggagcaggactccggagtccacctcgatgtgctcaaggtcgacggcggcgtgaccgccaacgacctgtgcatgcagatccaggccgacatcctcggcgtaccggtcagccgcccggtcgtcgccgagaccaccgcgctcggcgccgcctacgcggcgggtctggccaccggcttctggcaggacaccgacgaactgcgcacccactggcaggagtccaagcgctgggagccccagtggtccgaggaccggcgggcggagggctacgcgggctggaagaaggcggtggagcgcacgctcgactggtccaaggtggaataggcgccgacgccgccggccggcgtgctccgacgagcggcgacggccgggcggcgcgccgacgcgactccgggggcctcggcccgggagggctgctcgtagggcccctcggcccgggagaggcggctccgggggcccggtccgggccgtgcgcgcagccggaaagaccggacgcccgaggaggcgaccgggccccggggaggggcggcagcggcctgtccgccgccctcggcgcgtgcggtagggtttacctgcgtgatcacgcgggaaaccgcgggagcgacgcaccgggacgtggcgcagcttggtagcgcacttgactgggggtcaaggggtcgcaggttcaaatcctgtcgtcccgacggtgcgaagggtcttcgcagacgaatgtctgcgagggcccttttcgcgtcctgggggcggggcctggcggcgggctcaggacaggcagcccacatgggcgagggcctgcttgaggaggactccctggccgcccggcatctcgttctggaccagctccgacgacgcctcccggggactgaaccagaccaggtcgagggcatcctgccgagggcggcagtcgccggccaccgggacgatgtaggcgagggagaccgcgtgctggcgggggtcgtggaacggcgtcaccccctgcgtcgggaagtactccgcgaccgtgaagggctgcagggaagcggggacccggggcagtgccaccggcccgaggtccttctccagatggcgcagcagggcgtcccggacccgctcgtgatgcagcacccggccggagacgagggcgcggctgaccgttccttccggtccgatgcgcagcagcagtccgatgctggtcacttcaccgctgtcgtctacgcgcacgggcacggcctcgacgtagaggatcggcatgcgtgcgcgggccatctcaagatcgtcggaagtcagccagccgggcgtggtttcggtcatgtcagacattggttgatcatactttcccggtctcccgactcccctctcccgtcccgcgcgtgccgctccgggccggtcgtacggcatcgtggccgcacgccgcacgccgcacgccgcacgccgcacgccgcacgccgcacgccgcacgccgcacgcggcgggtagtgggccgagtcctccgcgcggggcacaccctcggacgtagcgacaccccctgcccgccgaggcacaggcggatgatggggggagaccgtgtccggtcctgcggagggggagtcgtggagaaggcacaggccggtggccgtatatccggcgccgagggagccggcggcgagagcggatccgggggtggcggggccctcggccatcgggatgaggcaccgggtacgggcgaagcaggcccggccgagggtgcgtacgacttcgcggagctgcgcgcgcaggagttcggctacctcgattccggtgggcacacctatctcgaccacaccggcgccgggctcccgccacgctcgctcgtcacggcgagcgcggagcggatcacgggcggctgcttcgggaatccgcactccgagagcccggcgtcccgggcctcggggctgctgctcgccgaggcacgccgcgcggtgctccggcacttcaacgccgacccggccgagtacgccgtgatcttcacgcccaacgcgaccggcgccctgcgcctgatcggcgaggcgtatccgttcgggcggcacagccggctggtgatgtcgttggacaaccacaactcggtgaacgggctgcgggagtacgcgcgggcaaagggagcctcgacggcatacgtacccgtgagcgggcccggcctgcgcatcgacgaggagcggctgaccgccgcgctgacggcacgcggacgcgggctcggcctgttccgctcgcgggacggcggacgctcccgcgggctcctggcctacccggcgcagagcaacttcacaggtgtccagcacccgttggagtggatcacacgggccaaggagcacggctacgacgtactgctcgacgccgccgccttcgtcccggccaacaccctggacctgagccgcttccatccggacttcaccgccgtgagctggtacaaggtcttcgggcatcccaccggcgtcggcagcctgatcgcccgccgggaggcgctcgccacactgcgccgcccctggttctcgggcggcacgatctacgcggccagcgcccaggcgggctggcacgtcctcgcggacgacgaggccgccttcgaggacggcacggtcaacttcctcgccctgccggacgtgacggccggactggaatggctcgaccggatcggcgtgcgccgcgtgcacgaccatgtcagctcgctgacggatcaactcttacgcggtctcggggagttgagtcacagcaacggttcgccgctcgtccgggtgtacgggcccggggagggcgaggcggcgcgcggcgggacggtcgccctgaacctgctggcggccgacggcgggatcatcgacgagcgcgtcgtcacccgcgacagcgccctgcgcggaatctcgctgcgcacgggctgcttctgcaaccccggcgccggcgaggcggcgttcgccctgtcgccgcctcggctgcggtccgcgacacgcaggcaactcagctcgatggaggactacttggagttgctgcggctgccctcggcgggtgccgtccgtatctctgtggggctgtcttcgcagcccagggacatcgagacggtcctgcggttcgtgacggagacctaccgggaccaggtgccgggggtggcgggcctggccgcgcgatcgggctgctgagaccggcgctccggggccctccaccggccggccgcgcaggagaccccgtgatttctgttatcccggggtagtccgcccgtctcctgtgcgtacggatcgaaccctcaggagtcagccagtgaatcaggacagcagtggacgctcgatcagccggcgcgaagcactccgtggggcgggtgccgtcgcggtcgcaggggccggtgccgccgtgctcggcggtgcctccaccgcggtcgccgccgacgcgttcgcacatccggggttgctgcacacccgggccgacctggaccggatggcggccaaggtgaaggcgggcaccgggcagtggaaggcgggcttcgccaagctgacggccaactcccacgcgcggagcggctggcaggcgaacccgcagcggacggtgtaccgcggatcgggcacccccgagaactacggcacgctctacaacgacatccacgccgcctaccagaacgccctgcgctggcacatcaccggcgagaccgcgcacgccgacaccgcggtggcgatcctcaacgcctggtcgggcaggctcaccgcactcgacggcagcgccgaccggttcctcgcggccgggctgtacggctaccagttcgccaacgccgccgaactcgtccgtgaccacgacggcttcgaactggcccgcttccagaagatgatgctgaatgtcttcgccccggtcagcgaggacttcctcacgaaccacaacggcgcctacctcaccaactattgggccaactgggacctgaccgccctcgcctgcgtcctggccgtgggcatcctgtgcgacgaccgcgccaaggtgcggcgcgccgtcacctacttcaagtcgggccagggcatgggctcggtcaggaacgccatcccggtcgtgcacgccgacggtctcgcggagtgggtcgaggccggacgcgaccagggccacgccctgctcggcgtcggactgatgggcaccgtctgcgagatggcctggaaccagggcatcgacctgtacggccacgacgacaaccggttcctcaagggcgcccagtacgtggccaagtggagcatgggcggggacgtgccctacacggccaacacccggaagaagggcgctccgggggtctggtcgggcacggagtccgccaccagggcggcggacgtcgatccgaccatgacgcggccgatctgggccatgatctccaaccactacaccaagcgccggggcctgtccgcgccgtacctcacccggatcgccgccaaggccgctcccgagggcggcggcggtgactacggtcccaacagcggaggatacgaccagctcggcttcggcacgctggccttcacccgggaggcgggggacacggctgagtccaccaaggccccgacgcccacgcgcacggacgccgctccgtcagccgcctcgtccgccggcccggccacgtccccgtccgcctcggcgtccgagggcagccggtcgcagggcggcagcggcgacctggccgtcaccggcaccggtggcgtcgccgcggtcgcgggcaccggcgtcctggccatcgcgggcggcctgatcgcactgcgtcgccggcaggcgggcacccggccgtgacagatgcggtacggcggcggtacggcgaccggccgctcggccaccgccgtaccgcgaccgcgcatgttcacgcggcgcggcaggcgcacggcggtgagggtgggctccacccgcccgcctcacgcctgggagcgcagccgccacccgtgatccaccggcccgatgccggcccccagtgcgaaccccgccgcgatcgccgccgtgacgtagtccttggcctcccgcaccgcgtccggaaccggaaggccccgcgccagccccaccgccaccgccgaggcgagggtgcagcccgtgccgtgggtgtgacggttgtcgtgccggggggcgcgcagccagtgctccgcgctgccgtcggtcagcaggtccacggcctcgccgggcagatggccgcccttcacgagcacccagcgcgggccgtacgcgagcaggtgtgcggcggcgcggcgcatgccggactcgtcgttcaccgcgatgccggtgagctgcgcgacctcgtccagattcggcgtggccaccgtcgcgagcggcagcagccgggtccgtacggcatccagcgcgtcgtcggccagcagccggtcgccgtgcttggacacgctcaccgggtccacgacgaccggagccgccacgtccgacagcagctcggcaacggccgtgaccagggcggacgagccgagcatgccggtcttgaccgcctgcacgccgatgtcgtcgacgacactgcggtactgggcgcgcaccgcctccacgggcagttcccaggcgccctgcaccccgacggagttctgcgcggtgaccgcggtcagcacgctcatgccgtgggcgccgagcgccagcatcgtcttcaggtcggcctggattccggcgcctccgccggagtcggagccggcgatcgtcaggacccggggcagggcggtcatacgaggctctcctctcggcggtggcgcagccgcacgggggcgtagagggccagggccacgacgaacgccacgtagtacgacaggtcggcgccgtgcagcgcgtccgccaccgggcccacgtacaggctcgtgtccatgaacggcacggccgcggcgaaggcggccacgaacgccaccagcggcggccaccacggctgcggccggccggcctccgcggccaggtcgatctcggcaccctcgcgggtgcgggcccgggcgatccagtcgacgacgacgatcgccacgaacccgggaatccagtagccgacgaacagcagcacgttctggaagcgcgcggtggtgtttgccgcgtgcatccacagcaccagcgggaagccgagcgcggcggccagggcggcggccaccgggcgcggcacgcgcacgcccgcggtctgcagggccagggacccgctgtagtcgttcatcgcgttgctgcacagcgccgccagcgccacggccagcagcccgaacgccccgagggccccgccgcccagcacctggtccacgcccgcggcggtctggtcggtcagcacggacgcgccccacagtccgagggcctggaccgccacgaaggagaccgcgagacccagcagggtgcaccagaacatccgcgggcgggacgtggagcgcggcagatagcggctgaagtcgctggcgtacggggcccaggacagggccagactcagggcgatggtgctggtcagcacgaacgcgccggcccggtcggcgccgtgcgcgccgccggtcgacgcggcgtggacaccgtcgagcatgcgccaggcgatcagcgcgaacgcggcggcgagcacgaacgtcatgacgatctggagccggtggatggcctcgtagccgaggacgccgagcgccccctggccggccatcatgaccaggacgccgagccagaacggccagccgcacagctgtgccagcgcgtccccgccgaacagtccgatcagcgcgtcccaggccaccgaggacagccactggagcatgccgggcaccgccaccgcgcggccgaaggcgagccgggccagcggcagctgtccggcgccggtccggctgccccaggtgctcaggtaggcggtgggcaccgcgcccacgaccgtacccagcacgacggcggcgagcgcggtcgcgaagtccaggccgagcgcgatgccgatggttccggtgaacacgcccgtcatcgtcagattgggggcgaaccacacggtgaacaggcgtccggctccgccgtagcgattgttctcggggaccggttcgatgccgtgcccctcgacccggagatcgccgggcgccgcgggcatccgcccgtcgaagacggtccgccggccgtcggcgggcagcccgccgggaacatgcgccaaaggcatggaagacatccctccgccagtacgaactggttcaggttcgacgggtgtgatctcagccctcggatggggcaccccgtgtccggtacgacgaaaagcctaacccgatctccgccgacgcccctacggaggatgcgtgacgacggtccggcggcgggcgcggacgccgccggacctggggatcagcgctgggtgtagatgaagccgatcttgtcgacctcgtcgccggcgcggccgtggaatccggcgatctgccgaccggacggagcggtgcgggtcacgcagtcggacgtggtggtgccgcccgccaggctgttcccgaggttggtggtgaacttcgcgtagaagatccgggtgtggccgtccttcacgccctggcacagatgggcggaggtgacgtactcgccgctgccgagggtcagcgacgaggcggtgccgccggtgccgccgtgggccagcgtcgtgccgttgccgagcgtgagacccatccggtccacgcgggagccgctgcgcagcgagaccgtcgtggcgcgggcgccggccggcacgctgtcgatgtcgttgaagtagtcgccgtgcggcccgccgaactggtcgctcagctggaacgcggaggcgcgcgaccaggagaacgccgcggtgatcgggtcgtggtcggagagcatcaggccgtcggagttgaggaacgcggcgtgctcgttgtcgtacgacgtggcgtcgagcgtgacgagcttgctgccgcggtaaaggatcttgtcgacgacctcgcaggtgttgggcacggtggccccggtctggtcgcagaccagcgcgtcgctgcccttggcgggcgccgcgccgccgcgtatcagcttcacccaggcgtcggtcagcccgttggcggcggcgaactcggcgatggtgtcggccgaccgggtgtagcgggtgttggtgtcgcccatcaccacgacggcgttgccgttggagtgcgtgccgatgaaggaggtcagctggtcgaggttgtcggcgcgggaggcctcgtcgccgtcgttggtgccggcgttggtgtgcaggttgtagaagtcgacgtagacgccctcggccaggcgctcgcgcatgaaggtgaagcccttgggggtgaggcagtcgcccgaatcgatctggcaggagttccagccggcgcgctcgaagtcgtcaccgtcccaggcataggtcgagacggtgttgaggccgctgccgatgcccgcgcccccgctggtcgccgtgcggtaggggtgggtgtccgtggagtacaggtacgcgtggtagttgaagtcctcctggacgttgacgatgtcgtacggcgcgatgcgccggccgatctccgtggtgctcgtgtcgcgcggcgtcgaggcgctggagagggactccggcagaccggcgacgttgtaggtgagcacgctgaacgtgcccgagtcggccgccgcggcgggggaggcgctcaccgtgagcccgccgacggccacggccgcggtcgccagacaggcgagaagtctgcgcatgagggggtctcctgggggtgaggaaagagcgcgagtgatgcgagcatgtcaaaatgtagcgacaagctccgggcgcacggcgtcttcgaaactttcgaaaacttcagccggtgagcgccgggccgatcaccgtggtgacacgtgtacgacggccgactcgcggccgtgcggccgctgtccgacgcgcggattcgtgtgcacgcggaaacacggcaccggaacacgccctggaggtacggcagttcacgcgcaagggcgccaacacgggcgcggacgtgcacgtatcacctgatggaccagcgttgacatcgactccggcgcctgtcttacttacgccccagaacggtcaagagcgtcagcgacaagccctggcttgctgaccggcaaccctcgcgacgcggtggggtgccccaggtgacgaccggaccggatgaccttcggtaagcgcgaggccccccaagggccggaacagtgacggtgacggcgatggacgcagctacgaggacgaccgcacagcggcgcccccgccgcgtcctgctgtgcgcgaaccgctgtgtcgatctgctccgtgtcagcagcgcgctgtgtaccgccccgggctctgcccgccgtcgaggctgacggcgttctgattctctgacgcgcaccgccgccgcggtgtgctctccgcccgcccagtccccggttccggcgctctcccgtgcttcgtctcccgcagcggccttgcgccgccgtgtgccgtcgcgctcgccgcccggggtgtccgactccgctggagcctgccatgagtgaactccctggcgccgccgtgtcccttctctccgcgccacccgacggcaccgccccgcggcccctggcggcccagcgtgtgctgccgctgcgccggcccggccgctggatcctcacggcgatcgtgctcgtgctggtcgcccagatcggccacgggctggtgaccaaccccttctaccagtgggaccgcttcgcctactggttcctgcgccccacgatcctcgacggactgctcatcactctcgaagtggcggcgtacagcgccgtgttggggctgctcggtggcatcctgctggcactggcccggctctcccgcagccccgtgctgcgcgcggtcagctgggtctacgtgtggctgctgcgctcggtgccgctgatcgtggtgctgatcttcctctacaacttcagcgccctctacaagacgctcagcctcggagtgcccttcggcccggccttcctcaccttcgacgagtcccggctcgccaccgacatggccgtcgcggtcgtcggactgagcctcaacgaggcggcctacgcggccgaggtcgtccgcggcggcattctctccgtcgaccagggacagcacgaggcggccgccgcgctcggcctgccgaagagctaccagttcacgaagatcgtcttcccgcaggccctcaggtccatcaccccgaactacgtcaaccagctgatcggcctgatcaagggcacctcactggtgttctacgtgtcgctgctcgacctgttcggctccgcacagaccatgggcagcacctatcccggcgacatcgtgccgctgctcctggtcgtcaccgtctggtacctgatcctcacgagcatcgtgtccgtcgtccagttctacgtcgagcggcactacgcccggggcgccacgcgctccctgccgccgaccccgttgcagaagctgcggaccgcgctcggtgacctgcgggcccgcatacgcagggaggccgccctatgaccaccgagaccctcaaagtcgactccgccgcggtcgaggtccacgacgtgcacaagtggtacggcgcccaccgggtgctgaacggcgtggagctgaccgtgcgaccgggtgaggtgaccgtgatcctcggcccctccgggtccggcaagtccaccctgctgcgggtgatcaaccacctggagaagcccgaggtcggctacgtcagcgtgaacggcgagctgatcggcgtccgccggcacggcgacaggctcaaggagctgagcgagcgcgtcatcctggcccagcgcagccgtatcggcttcgtcttccagaacttcaacctcttcccgcatctgaccgtcctcgacaacgtggccgcggcccccgtcgcgaccggccggctgaagaagcccgaggcccaggaactggcgcgcgacctgctcggccgggtgggcctcgccgaccggaccggcgcctacccacggcagttgtccggcggccagcagcagcgcgtggccatcgcccgcgccctcgccctgcggcccggcgtcatcctcttcgacgaaccgacctccgcgctcgaccccgaactcgtcggcgaagtactcgccgtcatcaaggacctcgccaccagcggcaccaccctcgtcgtcgtcacccacgagatcggtttcgcccgcgaggtcgccgaccgggtggtcttcatggacggcggccggatcgtcgaacagggcccgcccgccgaggttctggaccatccgaaacacgagcggaccagggatttcctgagcaaggtgctctgagcccgcagcccgcccccgaagcacacctccgtcaccgatcaccctcaccgcacaccggacaaggacatacccatgcgcaccctcagcctccgcagcagactcctccgcggcctcaccgcgggtaccgccgtcgcctctctcgccgccgggctcgccgcatgcgggggcgacagcgacgcggccaccacgaccgacagcgcggcgtccgggaccgtcaccgtgggccgactctccaacggcgccgccaaggagaccgagctcaaggtgtccgaggtgaagtccatcagcgccgagctgcccgagtccgtcgccaagagcggcaagctggtcatcggtgtgggcgggctgccctccggctccgcgccgctgaactacgtgggcgaggaccagaagaccctcaccggtgtcgaacccgacctgggccggctggtggccgccgtcctcggactgaagccggagctgaagaactcgacctgggagaacctgttcgtcggcatcgacagcggaaagtccgacgtgggcttctctaacatcaccgtcaccgaggagcgcaagaagaagtacgagttcgcctcctaccggcaggacaacctggcgttcgaggcggccaagaagaacaactggaacttcgacggcgactacaagaacctggccggccagaccgtcgccgtgggcgcgggcaccaaccaggagaggatccttctggagtggaaggcgaagctggcgaaggagggcaagaagctcaccgtcaagtacttccaggacaacaacagcacctatctggcgctgtccagcgggaagatcgacgcctacttcggccccagccccgcattcgcctaccacgtcacccgggtcgcgaagacccccgctccgacgcgtatcgcgggcaagtactccggagccggcgcgacgctccagggcctgatcgcggccaccgcgaagaaggacagcggactggccaagccggtcgccgacgcgatcaactacctgatcaagaacggtcagtacgcgaagtggctggccgcctggaacctctccaacgaagccgtcgccaagtccgagatcgacccggcgggcctgccgctcgacaactcctgacctgtcacacggagataccggaacaccatgtcgaccagtgtccttcccgtcgcgtcgcggagcccggaggcaccccatgtgctggacaacgccgcctgggccgcgctgaccgggccgcacgcccgcttcgccgaacgcgtgggccgcgccgcccgctatccgctggacgtgtcccccttcaccgcgctcgccgacccgtccgatccacgcgcctgggacgacctggccgcactcgtcggccccggcaccgtcacccccgtctcgggggcgacggtgccgcccgccggctgggagaccgtgcgcagcggccacggcgtccaactggtcgccaccgccctgcactcggaacccgcccccgaagcggtacggctggggcccggcgacgtacccgagatcctggagctggtcgccgagaccgagccgggacccttcctgccgcgcaccgtcgaactcggcacctacctgggcatccggcatcgcggacggctcatcgccatggccggtgaacggctgcgcccgcccggctggacggagatcagcgcggtctgcacccacccggaccaccggggccggggtctggccacccggctggtccgcgcggtcgcggcgggcatcagggagcgcggagacacccccttcctgcacgccgccgcgagcaacaccaccgccatccggctctacgagtcgatcggcttcaccctgcgccgcgcaacggagtccgtacgggtccgcactccggaccggcggcaggaacagaccgcgggtccgtgccgttgtgatgcatgagccgagccggacggaggtgacgggcatgccgcccaggtcccgcctccgtgtgccgaagctcgccccgcgtcaccgcgttcatctccactcccggccccacatcgatctgcagcgcgtggccggcgcgctctgttgctcctgacccgttgccccgacgccgcatgctccacgcgagccggtgatcccgtacggccctccaggaaggcaccacactcgtggcctcgacacccccttcttccctgccctcttcctccccttctgcctcctccaccccttcgtcgtccgcgctgcatctcgccgtcgccctcgacggcgcgggctggcacccggccgcctggcgcgagcccgtggcccggccccgcgaactgctcaccgccggatactgggccggcctcgtcaccgaggccgagcgcggactgctcgacttcgtgaccatcgaggacgggctcgggctccagtcctcacacttcaccgagcccgacgggcgtacggaccaggtgcgcggacggctggacgccgtactcatcgccgcccgggtggccccgctcacccggcacataggtctcgtgccgaccgtggtggcgacccacacagagccgttccatatatccaaggcgatcgccaccctcgactatgtgagcaccggccgagccggcctgcgcgtccaggtgtcggcacggcagaacgaggccgcgcacttcggccgccgtacgtttccgcggttcgacatcgaggacctggacacccccgccgtacgcgaggtgacgaccgacctcttcgacgaggccgccgactacgtggaggcggtgcgccggctgtgggacagctgggaggacgacgcggagatccgggacgtcgccaccggccgcttcatcgaccgcgacaagctccactacatcgacttcgagggccggcacttcagcgtcaagggcccctcgatcaccccccggccgccccagggccagccggtcgtgagcgccctggcccaccagagcaccccgttccagctggtgggacgttccgcggacatcggatacgtcaccccgcacgacctcgaccaggcgcgggccatagtcgacgagatccgtgccgcgcagaccgcggcgggccgcgccggagacaccctgcacatcttcgccgacctgctggtgttcctcgacgacgaccccggcacggccgcggcccgccgggagcgcctcgacagcctcgccggacacccgtacaccggcgacgcccgcgtcttcaccggcaccccggcccaactggccgacctgctcctggagttgcggcaggccgggctgtccggcttccggctgcgccccgccgtcgtgggccacgacctcccgcagatcactcgcggtctggtccccgaactccagcgccgggacgccttccggcgtgcgtacgaggccgacaccctgcgcgggctgctcgggctcacccgccccgccaaccgctacgccgccgccaccgtctgagccggaggaacgtacgaccatgagcaagccgctgaagcagatccatctggccgcccacttccccggcgtcaacaacaccaccgtgtggagcgatcccgaggccggcagccacatcgagttcagctccttcgcgcacttcgcgcggaccgccgaacgcgccaagttcgacttcctgttcctcgccgagggactcaggctgcgcgaacagggcggaaagatctacgacttggacgtcgtcggccggcccgacaccttcgcgatccttaccgcgctggccgccgtcaccgaccggctcggtctgaccggcaccatcaactccaccttcaacgagccctacgaggtggcccgccagttcgccagcctcgaccacctctccgacggacgcgccgcctggaacgtcgtcacctcctgggacgccttcaccggcgagaacttccgccgcggcggctttctcccgcagggcgagcggtactcccgggccaaggagttcctcgccaccgcgaacgaactcttcgactcctggcgcggcgacgagatcgtcgccgaccagcaggccggcaccttcctgcgggacgcccgggccggtgccttcgtgcacaagggacagcacttcgagatcgaggggcagttcaacgtcccgcgcagcccgcagggccgcccggtgatcttccaggcgggcgactccgacgacgggcgcgagttcgccgccgccggcgcggacgccatcttcagccggtacagcaccctcaaggagggccaggcgttctacacggacgtcaagggccgcctggcccggtacggccgtacccacgaccagttgctgatcctgcccgccgcgaccttcgtcctcggcgacacggacgccgaggcccgggagctggcccgcgaggtacgccgccagcaggtcagcggcgccaccgcgatcaagcacctggagttcgtctggaaccgcgacctgtccgcgtacgacccggacggcccgctgcccgacatcgacccggacctcggcgaacacaccatcgcccgcggccgtgcccaggtccggatgtaccgcgacccgctggccaccgcccgcgaatggcgcgagcgcgccgcggccaacaactggtcgatccgcgacctggtcatcgagaccggcagccgccagtccttcgtcggctccccggccaccgtcgccgagaccatcgactccttcgtccaggccgacgcctccgacggcttcatcctggtcccgcacatcacccccggcggcctcgacgccttcgccgacaccgtggtcccgctgctccaggagcgcggggtgttccgcacggagtacgagggcaccaccctgcgcgaccacctcggcctggcccacccggacgccgatgcgccgggggagcgggtggcctcgtgaagttcctggccgtcacgctgatcgtgcacgcgccggatccggtgaccggggtgcggaaaccgaccaacgaccgcttccgggaggtcatcgacaacgcgctgctcgccgaggagctggggttcgacggcttcggcgtgagctgacccagaccgtggcaccgacaacgccccgacgcacgaagccgcccccggccggatcggatccggccgggggcggcttggcggtgcggtcggtgcttacgcgagcgacgcgatcgcctcgttgaacgtggccgacgggcgcatgaccgccgccgccttctcggggtcgggctggtagtagccgccgatgtcggccggcttgccctgggcggagatcagctcgtcgacgatcttctgctcgttcgtgccgagggtctcggcgaccgggccgaaggccttggcgaggtccgcgtcgtcggtctgcccggccagctcctgggcccagtacagggcgaggaagaagtggctgccgcggttgtcgatgccgccgacgcgacgggtcggcgacttgtcctcgttgaggaaggtcgccgtcgcacggtcgagggtgtcggcgaggacctgggcgcgcgcgttgcccgtggtcgtcgcgaggtgctcgaagctggacgccagcgcgaggaactcgcccaggctgtcccagcgcaggtagttctccctgaccagctgctggacgtgcttcggggcggagccgccggcgcccgtctcgaagaggccgccgcccgccatcagcgggacgatcgacagcatcttggcgctggtgcccagctccaggatcgggaacaggtcggtcaggtagtcacgcagcacgttgcccgtgacggagatcgtgttctcgccgcggcggatgcgctccacggagaacttggtcgcctcgacgggggacaggacgcggatgtccaggccctcggtgtcgtgctccggcaggtactgcttgaccttctcgatcagcacggcgtcgtgggcgcgggtctcgtccagccagaacacggccgggtcgccggtcgcgcgggcgcgggtgacggccagcttgacccagtccttgatcggggcgtccttggtctggcaggcgcggaagatgtcgccggcgccgaccgtctgctccaggacgacgttgccggcctggtcgacgaggcggaccgtgcccgtggtggggatctcgaaggtcttgtcgtggctgccgtactcctcggccttctgcgccatgaggccgacgttcgggacggtgcccatggtcgacgggtcgaaggcgccgttggcacggcagtcgtcgatgacgacctggtacacgccggagtagctgctgtccgggaggacggcgagggtgtcctgctcctggccgtccgggccccacatgtggccggaggtgcggatcatggccggcatggacgcgtcgacgatgacgtcggacgggacgtgcaggttcgtgatgcccttgtcggagtcgaccatcgccagctccgggccctcggcgagctcggcgtcgaaggaggccttgatcgcggcaccctcgggcagggactccaggcccttgtagatgccgcccagaccgtcgttcggggtcaggccggccgcggcgagcgtctcgccgtactgcgcgaacgtcttcgggaagaaggcgcgcaccacgtgaccgaagacgatcgggtccgagaccttcatcatcgtggccttgaggtgcacggagaacagcacgttctcggccttggcgcgggcgatctgcgcggtgaggaactcacgcagcgcggtgacgtgcatgacggaggcgtccacgacctcgcccggcagcacgggtacggactcgcgcaggacggtggtggagccgtcgtcgcccttcagctcgatacggagcgagccggcctcggagatcaccgcggacttctcggtggagcggaagtcgtcgacgcccatggtggcgacgttcgtcttggactcggaggtccaggcgcccatgcggtgcgggtgcgtcttggcgtagttcttcaccgaggcgggggcgcggcggtcggagttgccctcgcgcagcaccgggttcacggcgctgcccttgaccttgtcgtagcgggcgcggatgtcgcgctcctcgtcggtcttcgggtcgtccgggtagtccggcagcgcgtagccctgctcctggagctcggcgaccgcggccttcagctgcggaatcgacgccgagatgttcggcagcttgatgatgttcgcctcgggcgtcttggcgagctcaccgagctccgcgagcgcgtcggggatgcgccggccgtcctccaggtactcggggaagagggcgatgatgcgcccggccagcgagatgtcacgggtctccacggcgacacccgcctgcgacgcgtacgcctggaccaccggcaagaacgaatacgtcgccagggccggggcctcgtcagtgtgcgtgtagatgatggtcgagtcagtcaccgggtgctccgctccacgtctgcaacattgctcgacatcaagatatctcgtgatggggtcccactcgacaggaccctgcgtgcccgggcccgcggccgccctgatcggctcggcgggggcgtcgatcggctcgggggtgagctgcgcgtcggtcccgcggcgtacggcggagacgggcggcctatggcatgggcacgcccggcgggggagaccgtcggcgccccgtcttccgtaccgccggcgggcggggagaccgtcggcgcccccgccttccggacccgctcacggccgttcttccggacccgcagtacagcgcgaggaccaacggctgccgacctcgccgggccggccggtgtcctccgtccggtctgttctttgcgccgcgccgcgccacgcaaaccggccgaccggcgcctccggccggtccgtctttcgcgccgcgccgccggccggcgcaccccccgccgatccgtccctcgcgccgcgcagccggacgcgcgggggccgccccgatgggaccgcgccccgacgcgaccgcgccccgggagcccgtcagcgggctctcgcggtcgcctcgcgggtcactggtcgagcagggcggacgccgggccgccctgcccggccggcaggtcgtcgccggtgcgctgatgcgggatcgacacggacccctgctgcaacgcgaccgtccgggccggggccggaatgcggatgccttcctcgcggtagcgcttgtggaggcgcttgatgaactcgtgcttgatgcggtactggtcgctgaactcgccgacgcccaggatgaccgtgagaccgatgcgcgagtcgccgaacgtgtggaagcggacggccggttcgtggtcgggcaccgcgccggtgatctccgtcatcacctcggcgacgacttcggtggtgaccgtttcgacgtgctcgaggtcgctgtcgtagccgacacccacctgcaccagcagggtcatctgctgttccggccgggtgaagttggtcatgttcgtccccgccagctggccgttggggatgatgaccaggttgttggagagctggcggacggtcgtctgacgccagttgatgtcgacgacatagccctcctcgccgctggtcagccggatgtagtcgcccggctggaccgttttggaggcgaggatgtggatgcccgcgaagaggttggcgagggtgtcctgaagggcgagcgcgacggccagaccgcccacgcccagggcggtgagcaggggcgctatggagatgcccagggtctggagcatcaccaggaagcccatggccagcaccacgacccgggtgatgttgacgaagatcgtggccgatcccgcgactccggaccgggactgcgtgaccgcccgcaccaggccgctgatcacccgggccgccgtcagcgtcacgacggcgatgagcagcacggtcagcgtctggctgacgtggtgtccgaccgacttggtgagcggcagcgccgtggccgcggcagccgcgccaccggtgatcgccgcccatggcacgaccgtgcgcagtgcgtccacgatgacgtcgtccccgctccagcgggtgcgcagcgcgtgcttgcccagccagcgcatcagcatgcgcagcaggaaggccgccaccaggcccgcggccagggcgatgccggcgaccatcaggtcgtccagggtgagggcgcggttcatcggtcgcctcccgcgggagaggcggaacggtcgcccggccggatgtgaagtctcgtcacttgccacctgcttggaatccgagatgcacgatgacgtccggacgggtgttcgcccgtccggcgcgaacgctcatcctgccgcatgttcccgcacgtccgtcaccacgtcggcgcggagcggccattgacgcccggccgcgctccgggggagaccggccggcacgcggtgagcaccggcgacgggcggcgctgggcctcgatgccgggccggcaggagtgagagcgcgtgcgtcgaaccggcccgtccgcaggtcagttgggacacctgggaccggagcgcccctcgatccggccgtcgccgtacccggaattggcctggatacgccgtcggctcacccctgctcgccgaacgacccgtggcgtccggcgcccgccgcgaagcgggccgcgccctccacgccctgggccagtacccgcatgccgtgacggagttcaccgcgcatcgccgtcgtctcgtccaggccctcctggtcgaggacggaggcccggtcgccgcgcaggcagtcctgggggaagcggccgatggcggcggccagctcctcggcctccgcgcgggcgcggcccggcgggaccaggcggttggcgagccccatctcgtacgcctcccgggccggcaccgggcggccggtgaggatcatgtccatggcccggctggtgccgatcagccgggggagccgcacggtgccgccgtcgatgagcggtacgccccagcgacggcagaagaccccgaagacggcgtcctcctcggcgacccgcagatcgcaccagagcgccagctccagaccgccggccacggcatgccccgcgaccgccgcgatcaccggcttcgacagcgtcatccgggtcggtcccatcggcccgtcgccgtcctgagcgacccggttgccgcgctcgcccccgaccgccttgagatcggcgcccgcgcagaaggtgccgccctcgccccacagcaccgccacccgcgccgtctcgtcggcctcgaactcccggaaggcggcggcgagctcggcggcggtcggcccgtccacggcgttccgggcggccgggcgggagaggacgaccgtgctgacgtatccctggcgttcgatccggaccgacatcgggctgaccccttcgcgcgacgggagcgggctggcccggccgaggctactcccgggtatccgctgtcggtggtcgcggcgaggcaaaggccgctctcagatcaccttcagccgcaccagcgcacccagcgtcagcgccccgggcagcagaggcagccagaccgtgatgatccggtacgccaggaccacggccgtcgccacggccgccggaccacccgccgcgaccagggcgacaacgagtgccgcctccaccgagccgattccgccgggcgtgggcaccagagcgaccgcggccgtcgccgccagatacgcgaccgccatgtgcaggggcgggaccggcaggcccaacgcctgccccacggcggcaaggccggccgcctggagcgcggggaacgcgagcgcgccgccccacagggcgagcgcgcgggccgggcgggcgtgcaccgagcgggcctcgccgagcgccgtccgcaggaaggagagcacggccgtgcgcagccgtcgtacgagcagcagcaccgtcacggcgagacccagcgctccggccaccgcgagcagaagggggccgagcgctccgtcgggcacgagggagccgaggtggagggcgtccgggaaggcgatcagcaggaccagcagcagggccaggcgggtgatcgcctccgcgagcatgtacagcgcgagcgcggccgaggagcgtgcgagcggcacgccgcacaccgtcatgaaacggaggttgacggcgctcgcgcccagcccggtgggcagcagatggttggccgcgcccgccgcgaactgcgtggcgagcagccgccgcgcgggcagccgctcgacgaccgcgccctgccgggtgacggcggccgcgacccaggtgagacaggtcgcggcgaccgcgaccgccagccatggccaccgggccgtcgccagctggccgaagccctcggtgagcacggaccgctggcgcaccgcgaccaccagcacgagcaggagcgggaccaggcacaggacctggcggaccgggacgcgccgggggagctgctggggaagtcgaaccgctgtcacatcgggagagggtttccacaccgcaccaacgtggggttgcgggcacggggccggcggctgacacgccgggcacgtcatcgggttgctcgtggggtcctcctcgggtgcgcacctcaccggacggacgttcttgtgtgggtacctcaccggtcggacgttgacctcaagattgcttgaggttctaacgttcctcccatgagtatggagaccaccgcctggacccagttgcacagcgtcatgaacgcgcagcgggagacccgccccttcgcccgtgcgacgctgcgccgcatcgccgcgttcgcccgcccgcaccgccgccgtatcgcgcagttcgtcgtgctcagcgtggtgaccgcgctgctcgccgtcgcgacaccggtgctcgccggacgcgtcgtcgacgcgatcgtgtcgggtggcgacgagagcacggtcgtacgcctggccgtcctcatcgcggtcatcgcgctcgccgaggccggactcggactcgtcagccgcctgctgtcggcgaccctcggagaagggctcatcctcgatctgcgcacggctgtgttcgatcatgtgcagcgcatgccggtcgcgttcttcacacgtactcgtacgggcgcgctggtcagtcgtctcaacaacgacgtgatcggcgcccagcgcgcgttcagcaacaccctgtccggagtcgtcggcaatgtggtgaccctgctgctcaccctcgccgtgatgctcaccctgtcctggccgatcaccctgctcgcgctggcgctgctgccggtcttcgtgctgcccgcccggcggatgggcagccggatggcgaagctccagcgggaggccgcggacctgaacgcggccatggggacccggatgacggagcggttctcggcgccgggtgccacgctggtgaagctcttcggccggcccgacgaggagtccgccgagttcgcggcgcgggcccggcgggtgcgggacatcggggtgcgtacggcgatggcgcagtgggcgttcatcacggcgctgacgctcgtttccgccctggccctcgcccttgtctacggcctcggtggctggttcgccctgcgcggccgcctcgagccgggcgccgtcgtctcgctcgccctcctgctgacccgcctctacgcgccgctgacctccctcgcgggggcgcgcgtcgaggtcatgagcgccctggtgagcttcgagcgcgtcttcgaagtgctggatctgaagccgctcatcgaggagaaggcggacgcgcgcgcggtgccggacggcccggcgtcggtggagttcgacaacgtccgcttcggctacccggcggcggacaaggtgtccctcgcctcgctggaggaagtggccgccctggacacccgcggcggcgcggaggtcctgcacggcgtctccttccgtgccgaacccgggcagacggtggcgctggtcggctcgtccggcgccggcaagtcgaccatcgcccagctgctgccgcggctgtacgacgccgacgagggcaccgtacgcatcgggggcgtcgacgtacgcgacctgagcgcgccgtcgctgcgggccacgctcgggatggtcacccaggacgggcacctgttccacgactcggtacgggcgaacctgctgctggcgcgcccctcggccgccgaggacgaactgtgggacgtcctgcgccgggcccgcctcgacgagctcgtacgctccctgcccgacggcctcgacaccgtggtcggcgagcgcggctaccggctctccggcggcgagcgccagcgcatgaccatcgcccgtctgctgctcgcccgccagcgcgtggtgatcctcgacgaggcgaccgcccatctcgacaacacctccgaggcggccgtccaggaggcgctcgccgaggcgctcgcggggcgcacggccgtggtcatcgcgcaccgactgtccacggtgcgggccgcggacgtgatcctggtcgtcgaggccggccggatcgtggagcggggcacgcacgagcaactgctcgcggcggacgggcggtacgcggaactgcaccgcacacagttcgggaagcccgtgccgggggcggcggaggtcgccgaggcgggggaggcggtggcctagcagggaaccgcaccgtgttcgcggtggcgtcacccggtggcgacgccgcgagcagggtcaggcaaactgctgtacgagccgggaagtttgccgcggatgaggagaggccgtcctggccgattctgtccgataggtggccgaatcggtctcatgaggcgctgatactttacgagtacctcacaataatcactgataatttacgtggggcgcgaagtaccgactagatcgggcaggggggctcgcggtcgcatctgcggcagctgcatctatccgcgcgcaagtgcgagtgcggagggagatgcagtcatgaccagtgcatgtcatcgcagactggtgcgttccggggacggcgcaagcccggggagtgcggcgtgaccgagccggaggccggagccggtccgcgccgccgtcgcgctgccccgaagcagccctggcaccgccgtgtcctcagctccttcacgacctcggcggacgcggaggcgggggccgcggagcgcccctcggcccggccggccgacggggcggccagtgcgcaccgccgcggcgcccgccgcaaggcggcggagcccacggcgatcgcgcgtgtcaccgtccgtctcacgccctacgcccgacggctcaagccggagtacccgcggccgggcctcgacggctggcggcgctggatgccctccgtgcgccagtggctggggatctgcctcgtctccctgggcctgagcggcacgttcctggccgtcgcctacgcggcgaccgacataccggacaacctgaacacgtacgccacccagcaggacaacgtctacttctgggccgacgggacacccatggcccgcaccggctgggtgcgtcggcaggcgatgccgctgaaggacatacccgaggatgtgcgctgggcggtcctggcggcggagaacgcgagcttctactccgaccccggcatctccgtcagcggcatcggccgcgcgctgtggcgcaccgtgggcgagggggacacgcagggcgggtccaccatcacccagcagtacgtgaagaacgtctatctgacccagaaccgctccgtgacccgcaagttcaccgaggcgatgatcgccgtcaagctggaccagcggatgagcaaggaccagattctggagggctacctcaacaccagctggttcggccgcggcacctacggcatccagcgcgcctcgcaggcctactacggcaaggacgtcggggaactcaacgccagcgaggccgccctcctcgcctccctgctcaagggagccggcctctacgaccccaccctgagccaggccaaccaccagcgggccgtggagcggtggaagtggatcctcgaccgcatggtggagctcggcaagctgtcgcccaccgagcgggccaagtacacgcacttccccgagccgaccaagcaggcgcagacgtacgacaccggcaaccagagcgactacctggtggagctggcggcccagtacgccaagaaggccggacacatctcggacaagcagttcgacctcggtggctaccagatctacaccaccttcgacaagaagcgggaggaggcgctcaccgccgccgtgaagaaggcccgcaagaaggcgcagaaggacgacaagggcaaggccgaaaccgcccactacgggggctcttcggtggctgccgacggccggatcctcgccgtctacggcggacccgatcaccgcaaacagggcttcaacgagtccaacgcctccaccgtcccggccggttcggcgttcctgccgttcgtctacgccgccgcgctggagcacggcgtgcacaaggaccgcggatccacgacgactcccgtcaccccggattccgtatacaacggtgacgacggcgtccccgtcaccacgcccgagggtccctactgggaccgcagcggcaagaaggtcgccgcccacaacgacggcggcacgtcctgggggcagatcacgctgcgcaaggcgctcgccgagtccgtgaacacccccttcatgcaactgggcatggacgccggcctggccacggtccgcgagaccgccgaggcgacgggcatgctgtcgtccagcatggggccgcaggtgcccaccctgtccctgggcacctcgacgcccagcgcgatccggatggccagttcctacgccaccttcgcggccggcggcacccacaccgcgccctactcggtgcgccgcgtcacccgcaacggctccaaggtcgacctcgacaccccgcgcccccgtcgcgcggtcggcgccgatgtcgcccgtcaggtcaccgacgcgctcacggactccttccgcacccaacaccccaccgcggcacccgcgtcggcgcaggtcgccgggaaggccggcacgacggacaaggacaccgccgcctggtacgtcggcacgaaccgctcggtctccaccgcggtggtcgtctaccggatggacctgaccaagagcctcgaacccctgccactgaaggggatcgccggtactcccgcaaccggcgtcccctacgacatctggtcgagtgccatgagtcccctcggctgacgccgggggccgggcacagcgctccgttctccctccctcctcgaagaatgcgccttccatgacatcgaatgccggacgtcgacgccgccgccgtgcccctctggccgaccgtcgagcggcgctgaccagccgtaccgggatcgtcaccatggcggtcctgctcgtcgtcgcctgcatcgccgcgaccttcctggcgttgaacggcacggacgacacgaagccgaccgcgtcgtccaccgacggcggacgctccggcgacgacaccgacaagtcgacgagcgagcccaagtgggacggcaagacgaaggtgctcggcgacggttccacgtcgtacaccgggccgcagaagggacagctcaagccggagcggctcaagcccggtgagaagccgccccagttcgtggtcttctcctgggacggcgctctgcagggcgacgaccagctcttctcgcactaccgggagttggccaaggagtacaacgcccatatgacgttcttcctgacgggcatctatgtgctgcccaaggccaagaagacgctctacgaaccgccgatgcactcgccgggctcctccgcgatcagctaccccaccgacgagcacatccgcaccacgctgacggagctcggcaaggcgtggaaggacggcaacgagatcggaacccacttcaacggccacttctgcgacgccaagggcggcaaggactggagcgtggcggactgggagagcgagatcaagcagttcttctcgttcgtcgagaagtggaagaccaacaccggctacaccgatctgccggccctcccgttcgatgccaagcgcgagatcagcggggggcgcgcaccctgcctggagggccagaagaacctgctcaaggccatgcgggcgacggccaaggactacaactggcgctacgacgccagctccgcgggcgacttccagatatggcccgccaagaagaacggcatctgggacttcccgctgcagatgctcccctacgagggcggcaagtaccagggactgtccatggacttcaacttcctctacaaccagtccgacggcgagactgagggcgatccggtccagtacccgcagtggcaggcggagaccgtgcagtcctacatggccggcttcaaccgcgtgtactacggcagccgcgcacccctgttcatcggcaaccacttcgagaactggaacggcggcatctacatggaggccgtcgaccaggtcatcaagaacgtgtgcaccaagaagggcgtccgctgcgtgtccttccgtgagctggccgactggatggacgcgcagacccccgaggtgcgggcacagctgcgcaccctggacccggcccagtcgcccgactggtcggaggtcgtcaagtagcaaccggcctgcccggcaggcgagttcccgctgccggacgatgcggcggatcaaccggaatcaacctctccacgcggtctccatcattgcggagatcgtgcgaagattccgtccccggcatcgaagccggggtagaggggaaaactcagtgagatcaaggatattgagccgcagacgcgccaccgtcctcgcggtcgccgtctcggcggcgctgctgcccgtctcggccgccggtgcggccaccggctcggcagccacttccggcacggccgaccgggcgacgaccgacgccttcggccgcatcgccgacgcggtgctcaccgaccgcaccgcggcgctgctcgaccggcagcagctgaagtccacggccgcgaagatcaaaggcggtgtgcgactgtcctcggcgctgacgaagaccgaggggacggcactgtccgcgctgcgcggccggcagtcccggctcgcggccctgggggaggcgtacaccgccgccgacacccgggtcggcgtcgacaagacccgcatcaagggctcacgcgccacggtcgaggtcaccgagaccacggtcctgacctacaagaagatccgtggcgacgagccgcgcacgaccggcttcaaggcccaccacgaactgaccttcgtcgcgcaggcggacggcacgtggaagctgtcgggcctgcgctccacggacaagggcccgcgcgccgtcaacgagcccgtcacgacggcgccggcgaaggtgcgcccgtcggccgtcatcgacgccccgcgggcggccaccacctacccggcgccggccaacccgaagcagaccaccggtaccggctacgactacacggcgatggccgcctacgccgagaagtactggaagaactacaacacggcctaccggaagttcaacggggtcggcggtgactgcaccaacttcgtgagccagagcctgctggcgggcaagtggcagccgatcagcaccgtgaccccggaggagtacgacacctggtactacgtcgccaacggccagtccgactcctgggcgggcgtgaacgagtggtcctggttcacccagaccgccaagcgcaccacaccgctggcgaacgtctaccagctggacgtcggtgacgtcctgcagatggacttcgacaaggacgggtccaaggaccacaccatgatcacgtcctaccgcggctccaacggcgtcccgtacctgacgtaccacgacgccgacacctaccgccggtcgctgtcgagcctcatcgcgtcctacccgaccgcggcgttctacgggtaccgcacctgagcacaggagcctcgccgcaccatgggccgccgtggtgcggcgaggctctcggtgcgctggccggccctgcctgcgcgccatgggctccagccgcctgagcggctggttttgctcgacttcctcctgagtgtcagcggtggtccgtacgctcggtggcatggaggggaacgaagggaagccggtacgcggtgcggaagccgatgccgaggcctggcagcggctgagtgcgtactcctacctcagcgcgcccgagcgcctggagtacgtcgcggtgatgcgggtgttctgcggcacgctgctcgcggacctgtccgtacccgacctcctcgcgaagctggccgagaagggcgggccgggagcagcgctggacgcggagacgctcacccgcaggctcgaagagctcgtgcgctggggcaatctgctgcgtagcacgcacacggtcagggcgacgagcatcgccgaatatcagcgctcgcggtcccgctaccagctgtcgaagctgggggagcgcgtacagcgcgacgcggacgaggtactggccggggccgacgcggcacgcgaggtgagcagcgagctgctggccctcgtcgaccgcggcctgcgggagatcgccgccatggccgcggcaccgggcggtgccgatccgcagcaggccctggagcggatcagcacgctcttcgtgcagttcgccgaattcgccgagtccgtccgggacttctacgcctacctgggccaggtgctggcgcgctacgacctcgactcggccgagtaccaggggttcaaggaactgctgctcgactacgtggaggccatcaccgaggacgtctccttccgggccccgcgcatcgcggcccacctggacgccgtccggccgcacctgcccgcgctgctcgaccgtgtcgacgcacatgcggcgggcatcggagcgctcgcccacgggctgaccgagacgcgggtgcagcgcagccgcgggcgggacctcgcggactgggagggtctgcgcgactggttcaccgacaccggagggcacggaagccaggtcgaccagctcagggacgccaccctccgcgcactggagtcgctgctcgccaacgccaagcggatgctgcgttcggcctccggtgagatgtcccgccgcaaggacctgctgcggctcgcggcctggttcgacgccgcggagccggaagaggcccacgacctggcggtcgccgccttcgggctgtacggcgcgcgtcatctcggtgtggcgccggaccccgaccggtccgtgccggcgtacgtgagttggtggaccggacccgtggtggacgtgccggtggcgctgcgcgagcgcggcagcagggctccgcgcgggcgtgccgcggcggccgaggaccattccgagcagaaacgccgcctcatggagcgggcgcggcagcaggccgaggcccgacaggccgcggccgacgaactgcgcagcgcctcgggcaggttcgagcaggtgcgcctcagcgccccggccatgcgactgctgctggagctcctcacgaccgcactcggcaacgcccagctgcacaaggacgcccacgacttcctgctcgacggcgcgcaggcgcacgacgcggacctcgacatccggctgaccgcctggcgcacgcccggcaggtccacggtcctgcggtccgtggacggcgacctgacggcggacgatctcaccgtggccgtcgagagcgcgtccgcgcccgcggtgggggaggcgagcgcctgatgcccctgccctccgcgcacgacgtcgcactcgcggccgaacgccacaccgccgcccggctcctgctggcccaacccctggtcaccggcgccggaccgcacagcgacgccttcccgctgatccgacggcacgcggactggctggcccagcgcttccaacaggtgttcggataccgcctgctggtggaggcctcgtacgcccgtctcttcaaggcgggcctcggccccggctcgggccaccgcctggaacgaccgtcgaccggaacgccgttcagcccgcggacgtacgcgtacctgtccctcgcgctggcggtcctcgtcaccgccccggagcagctcctgctctcccggctggtcgccgacctgcgggccgcggccgtcgacgccggcatcgagatcgccgacaccgggcggcagggcgagcgacggaccctcgcggccgcgctgcggcaactcgtcgactggggggtcctggtggagaccgagggacatgtcgcggccgtcgcggaggaacgggccggggaggctctgctgaccgtggaccgcgagatcgcgcgagccgtcgtcgccggcccgctcgcccagagccgcgacggcgcggacctcgtacgccgggccgccgacccaggcttcggcgggccccgtacgtacgtccgctggcgtctcgtcgaaacccccgtcgtccacctcgacgacctcacggacgcggagcgagaatggctgcgtacccggcagcggcgcgaggcgcaggcattctccgaactgctcggtctggaagccgagatccgcgctgagggcatcgccctggtcgacaccgaggacgaactcaccgacctgcacctgccaggaaccgggacggtggctcaagccgcgctgctccttgtggagcggctggtcgaccggctgcgtcccgaagacccgggccatccggcagtcggcggacggctggtcatcggcgtacccgtcccggacgggctgctgcccgccctgctcgacgaactgatcgaggagtacggcaggcgcagcaactggcagcgcggtcacctggaggaccgggacggattcctcgcggccgtactcgacctcctcgtccggatgcgtctgatggctcccgccgggcccgtacgcgcggaaggtcacggcctgcccgaggggtacggggagacggtggccgacgaccgctccgtcaccgatgtctctcaggcgcgcggccagggccgtacggacggggtctggatcctgctcgccgcagccgcccggtacgccaccaccgtggcggtcaaaccccgcaccgaccagcccccagcggacgacgtctccaaggagtcgccccgatgaaccgcccgccgaacccgcaccgctaccgactgcaccgcgcgggcatccggaacgtctggcagtacgacgagcaggagttcgccttcggtgaggggcgcctgctgcttcgcggcaagaacggcgccggcaagtccaaggccctggagatgctgctgccctacctcctcgacggtgacgcccgtgcgttggacgccacgggaacggggcgcaccaccctggcctggctgatgctcgacggcttcgagcagaccaaccgactgggctatctgtggctggagttcgtacggacggacgacgaggagaacgaccaccatctgaccatcggcgcggccgtccgcgcgtcccggtcgaccaagacggcgaagccgatcttcttcaccacgcggctgcgggtcggtaaggacgtagacctcgcccccgccggtcggccacttcccgtcgaccagctcaagtcgctcgtcggcccggagaacgtcaccgaccgtgccgtcgagcaccgggccagggttgcccgtgaactgttcggcctcaccgactcggcgcgctaccgcaacctgctccatctgctgcaccggctgcgccgtcccaccatcggtgaccgcattgactccggcgggctggtctcggtcctcgccgagaccctgcccgccctcgacgacgaggtcgtggagcaggtggcccgcagcctggacgacctcgactccgtcagggcctacctcggacgcctcgaacgcaccgaccgagctctgcggaccttcctcgccgactaccgcggctatctgcacgggacgctgcgccgccgcacgggccgggcgaacggagcgctggagcagctgatggagtaccgcacgttcgcgggtgacgcgacgcgcaacgcggaagggctccgcgagcgcgagcgggaactcgatgcccgcaccgaggcgctcgaaggtgaggcgagtgcagccgagacggacctggccgcgctgcacgccggcgccgggtaccgcggtgtgaaggaactggcggagaagcgcgccaccgtcaccgccctgcacagcgccgctgccgccgccttcaaggccgtccgccaggcgcacagcaatcaggaggaggccgggcggcggctcaccgacgagtcggggcggttcggtgaagagctggtcgaactgagcacgctacagggcgagttggtgcgggaggccgaacggtccggggtcgaccccgtgcacctgggggagcccgtggggacccccgccgcgccggtcgcgccggccaggacggccgaactgaccgcgccggaaggtgacttccacctggtacggcacagcgaggtgctggcggtcgacatcgagacctgtgcgaccgcgctgtatgcctgggacgcccggctcgacgccgcacagccggtgatcaggaaccgctcccggttcgtcaccgaactgcgcgccctcatggggcggtcggacgaggcccagcgggaggcgcaggcggccgacgccgcccgggagcgtctggaggaacaggccgaccacgcgcgctccggcgccgagcagcgtcggcaggaaaccgtgcacgagggagaggcgtacgcggcggcggcccgagcgtggaccgagcagctgcggagcctcaccggggtgcctgtggacaccgccgtgtccgctctggccgggcatgatccggccgacggtccgctgtccgctcatgcccccgacgaggtggccgacgcggcccggtcggccgtcgacccgtggctggcggaactgggcgaggaacgcgacaccctcaccctggccgcccgtgaactgcagaccgaacgggaccgtctgcggcaccggcgcgaggaatgggaacgccgcaccgaccccgagcccccgcccccgtcccaccgcgcggctcctcgcgcacccggcacgggagcgcccctgtaccggctggtggatttcgcccatgacctggagccggacgcgcgggcagggctggaagcggcactggaggcgagcggcctgctcgacgcctgggtgcgcgccgacggcacggtcctggacccggccacgcgggacaccctcctggtcccggcagcacccgtgccgggggagacgctcgcccgggtcctgcggccggtcgacgcgccggacagcggagtgacggcggagcaggtcgagcgcgtgttgcgggcggtggccctggccaggggcgggatcggcgccggcgaggccgacacggcgggcgcggcgcacaccgcgatcggcgtcgacggctcctggcggctcggcgtggcccgcggccgccacgccaagcaggtcgccgagtacgtgggcgcggaggtgcgggcggagacccgccgccgggcgctggcggaactcgacctccggctgacccgtgtacaggatgagctggcggaacgtcagcgtagtctgcgcatgctcacccagcaccgcgaccaggtcggggacctcctgcgccgaccgccctcagcgcgtgggctgacggacgcgtgggcccgtaccgccgaggccgagcggaccgccgaatctttcgccgggcaggcggccacggcagcccgcgaggcggagcaggcacgggccggcgcggtcgtcgcccggcgtgaggccgaggcgacggcgagcgcccaggacctcccggcggacccggccgcactcgaaacggtccgcctggccctggaccgcctcgggcagggggcgcagcgactgcggcgccgggtgcgcgcggtcctgtccgcggccgacggccatcgcggcagccggacggactacgggcgtgccgagtcggcccgccgggaggccgagtcggactacgccgagccgctcggccgcctggaggccgcccgccgtaccgtccgtgctctggaagaggccatcggcgccacggaacaggagatcctcgaccgcgaggcggagacgatgcgccgcctggacgccgtgggacgccaactcccgcgcatccgaagggacctggccgacgtgcatgacctgcgcgttcgggcggaagaggaggagagggcacggcgcgaggcactcgccgaccaggaggccgaggcgttggcctgcggcaggggactgcgtaaggcccttgcgctgccgggtgtgctgagaggagcgggtctcgacaccgacggggacgaggtcgcgctgaagtccccggaccccctgcatctcgacgtgcgggagcgtatcgcggcgctgcgtctgctggtcgacgccgtgcgccgcggcctggacgccgaacgccacgacatctcggacaccaccctcctcaaccgccacaccgacctgcgcgaccagctctccggaggctacgacgcgacgatcgaggaacatgacggcatcaagctgtgccggctcgtcgacgaccacggcctccacgacatcgccgtggtcggcgagcgcatcgcggccgaggccgccgaggcacgtgaccgtctgacagagcgcgaacgcgaggtctttcagcgtttcctggcgggcgagttgggcgaccacctgtcctcgcaggtactggccgcgggcgccctggtcgccgccctcaacaccaccctcgccacggtccgtacctcacacggtctgggcgtcgccctcgactggaagctggccgacggtgtggaggcggacgtcaaggcggccgtcgacctcctgcgcagcccctccgggctgcgcacccgcgaacagtccgagcaactccgcgacgtcctccagcgccgcatcgaggacgcccgccgcgccgacccggccgccggatacgcggctcacctgcgtaccgccctggactaccgtgactggttcgccttcaccccctgggtggtgaacgacgcggcaccgggcagccgccgtagactctccggccgcacgggcctgagccagggcgaacagcgtgtcctctcctacctggtcctcttcgccgcggcggcggcgcacttcaccagcctcgccgacgccgccccgcacgcgccccgcctcatcctcctcgacgacgccttcgccaaggtcgacgagcccacgcatgcccgcctcggccgcatcctggtcgacctggacctcgacttcgtcctcaccagcgaacgactgatcggcaactggcccgacgtaccgtccctccacatctacgagtgcctgcgcgacccgcatgtgcggggcgtggccacactccattacacgtggaacgggcggcagcggaggctgatgtcggtatgacaggacccgagcgagccgacgtacgtcccccggacgccgacgccctcgcgtttctcacccggccgggcctcgcccgcctctggacggccgtacgcacccggctcgaacgcaacggccttcggccggccggagccatcagactggaccagctggacgcacgggaacgtgaggccctgtccctcctgctggccagacccgtcaccggcctcaccgtcacgatgcgcctgacggacctggacacccgcttgcgcgccagcgcggtcggacggggcctggtggccatgctggaagaactgggaccacccctgacggaccgtcgggcggtccgcgacgcggcggcggccgaacgcgcacatgtgtggtcgacggctcggtccgagctggaagccacgttgctgtccgcccagccctgggcggcacagtggttggaggagatccgacgcggcggcacactcgcccgccaggactcgcacaccgcgatcacggtcatcacccaggcgatccagaccctgggggcgctcttccccggcacgaaccaaccccccacccccgccacctggggccgcggcgaactggccacccgcaccaccggttcggcccacggcctggacgacggcacactgctgtcccggctggtcctccgcggcatcgcgctggcacgcggcgtcgagtcccccgccgacgcgccggcccgccgggccctgtggcgcatggcctcggtcacccccgacgaggtctccagcacggtgctcacctacggcctgcgccccaccggcggcacctggcgcgagcgggccctgcgcgagcgcgccgaccaccacatggaaacccacctgaccctgcgcgaactccgcgctctgcgcctggaggtgccaccgcgcacccgcgtccacgtctgcgagaacccccgcgtggtcgaggccgcggccgacaccggcggcggtacggagcccctgatctgcacctcggggagcgcgacgaccgtcgtcctcaccctcctggacgcgctggcggcggccggctgcacgttcgcctaccacggcgacttcgactggcccggcatcgcgctggccaaccggatcaggcaccggtacgcagccgagccctggcgtatgcgggcggccgactacgagtacctcgccacacgagctcagttgcacggcactccgcagatccccctcaccggcacaccgacggacgccgagtgggacccggaactgaccccgaccatggccgccctgggcatcgccttgcacgaggaggcggcgctcgatctgcttctggaggacctcggtacctccgtcggaacccacccgtccggcgattccccatgatgacgtcgttcggcccacctgccgcgagcggcacgcgccgaggaactgccggacggcgaagttcagatcagtgccggccggccagttgcggatacagcgcctccgggccgacggccagggctgcctgtacttgcctgctgaagtcgtcggcgaggacctcgtgcagtccggcctcgacaccgtcgagggtcgcgcgggccaccgcggcgggatcggacttcggcgcggtcaccttcgcggccagctccgtcgcgaggtaactgacgtgcagggctgtgacttgcgtgccctgttccgcgagggccactctcaaagcgttggtcatggaccattcagcagctttggccgcggcatatccggcgctggcggtgatcgatatccaggacagcacggacaggacattgactactgcgccgccgccgttgcgccccagaacgggggcgaaggccctgctcatggcgagggtgccgagaacgtgcgtctcgaactccaacctgaatgaatccaggtccgcggtgagcacgtcggcccgggtcgacaaaccggcgttgttgatgaggagtgtcacgtcctgggcctggtcggccgccgcgtgcacggattcgaggtcggtgatgtcgaccgcgacggggaccgccccgggcacggtgaccctggtggggtcgcgggatcccgcgtagaccttggctgctccagcgtcgaagagcgcccgtacgaattgctcaccgagcccgcggttcgctccggtgacaaaggcgacagacccctggaccttcatgggagcaccttccctgcgatgggttgcaggggcgtggaccggcggacgtgacagcgcgcaccccgcggccccgcccgcttccgattcgaacgtatatgaccaccgggccgggcgcagtccgggtggtgacgggcggaagtcgaacggctggggggatcccgggtcgactgcagatcgtccaggtccagtcgctccgaccgcgccgcgaagcttcccaccgtcacgctgcggcccgccgacgccgcggacagcaggggggaccagccactgggtgagcgcgaagtggccaaggtggttggtgccgaacatcagctcgtggccgtcctcggtctctcgacgcggcggctcgtcgagcgcgacacctgcgttgtggaccaccacgtcgagatgatcgaggcccagcctgtccacggcggtcttcagggacgacaggtcggcgaggtccagttgaaggggccgcacatgcgcgccgaagacgcgcgagcggatcgaggccatggcggcgtcggtcttcgcggcgtccctgctgccgagtacgacgacggcgccggtggcggcgagcagctctgcggcgaagtagccgaccccggctctgaggcagcgtgctcatggggagcaccatcccgcccgaggtcgcaacctccaccgacctaccgccgacagatcacggagaccgacgacagacttccgacacctcggagagcttcggagagctatcgagagcagaaggcccctacaacgcgactggcgcggaattgagagcgagcgcggcaaggtgacgcactcactggtcgactcgggtactcagtcacactgcttgatcacaaccacatacagacccttgaggcgccgatgccacgctccacggagccgtccgggcgggccgggactggatcctcgacgacccaagcaccgtgccgacgggcggcggtaccgcgccgaccatgacgtgccctgcctgtgaataccgaccgtcggccgtcgtgccaaagcacggtcgcagaatggttgaaggatttccggagaggggcccgctggtccacccgttcggcagcacgacgcgcctgcgggccggggcacccctagcatgctgactgtgcgacccattctcccgaagatcgagggcggccgggtacagggcctcctgcagctcatcgaggacggcatccacctcgtcgtcgcggcactcctcgtactgctcgcggggctcctgaccgtcggggtcgtccacgacgtcatcaggtcggtgcagggtccgtaccgcgaggagacggtcgttctctccgctctggacaacggccttgtgctgttcatcgtggccgagctgctccacaccgtccgcctgaccatcaggaaccagaccctcgacgcggagccgttcctcgtcgtcggcctgatcgccggcatccgcaaggtgctcatcgtgacggccgaggcggaggcttccttccggtggaacgtcgaggggatcgaactcctgatcctggcggggctgatcctcgtgatggcgacagcggcgtacgtgtggcggcgctcgacgcggccgggagactatttcccgctccaggaggcgcggcgctcttcgtcgccggcgccgtcacccgcccctgggcgcgggccctgatccgtcaccttccgtcaccttccgccgccagggtcgcccgcacccgctgctcctcgcgagcggagccgacgtcccgttccaggggtgtgcggctcacggccgtcgcgaggtcctccagggcttgcttctgcagttccgccccgcgccgcatcaccgggctccggtccccggcggcggagccctcccacgcgtggagtgcctcctccacgcgcccccagtccggattcctgtgctcgcgcacgtcgaccgccgcctgcgcggtgtccgcctcgagggcctcggcgaaccgctccgcctcggggacgaaacggctgtcggcccgcgggacgtggctctccatgagcatcgccgcccggccgaaccccttgagcgcctcctgcgcgtcctgcgcctcgcgcgacgtcagacccctggggccgaccggttcctgccttgcccggtcgtaggtctcctgccaggcggcgcgtgccttcctgctcgccagcagggccctgcgcatgtcggcgcgatgctcccgggtcggttcggcgtagctgcggagcaccgcggccgcgtagcggccgttggcggcgagccagtccgcgagccggcccgccagcatgggcgtctcccatgcggggaacaccacgtacgccaccattgccagggccccgccgagcagggtgagcaccacccgctccggtaccgtctgctcccacgcctggccgcccatgccgagcaggaagacgacgtatgcggcagtgaagcactgggagtaggcgtagccggtacggatcagcgtgtacgacaggcccgccgagaccaccgccagcgcgccgaacacatgggcgtccgggcccagggcccgcaccatcccggtggcgagcgcgacccccgccagggtcccggcgagacgggccaccgcacgcgcgtacgtccggtggaagtccggccgcatcaccatcaccgaggcgatgggcgcccagtagccgtggcccagggggagccgggcggcgatcagatagccgagcgtggccaccgccgccaagcggacggcgtgccggaacacgggcgagtcccggcggagctcacggcggaccgcccggacgacgaccgggaccagccggaacatagtcgggcgcaccaggaactgggcgtccgcggggccgggcggcgtgggcgtcctcccgctcgtgccgccgctcccggcgatctccaacacctcgccgagcagttccacgagccgctcggcggcctgcctcgcggggccctccaggacctcgtggtcctcgtcgacgcgcaggacgtccgtgctcctgggcggcacctcggcgggagtgccgcggcggatcgaacgggcggccgcgtccaggacgtcggcggccgcgtcgagcaactcccgcgcgcggtcccgcccgggtccctccgccggggcgccgacgtccgggtcggcgagcgcggcgacgaccggccgaatgcgctcggccaggccccgggggccgtgcaggacggggggacgggtgcgggcctgtgatggcgtcacggcggccgcgtcccgggccgtcatcaacggctccgggtcgaacggggcggtcgggtcgtgccgcagccggcgggcgtagtccgccacggcggccagggcgtcggcgagcgcgtcacgatgcgccccccaacggcggatcgggaacagcaagatcagcacggcctgcaccacgcctccgagcgcgatgaccccggcgtgctccagggctcgcccgacgctcgtgggcagggtgatggtcaccagcatgctgccgacggtcgtcgctgcgacgatccccgcggtcgatccgacggcccacgccatccccgcgacaaaggcccatacggccaacagtgggaggaacgtcacgagtcgccccgccgccaggtagcccacgaaggtgctgagcgccagacccgcgcccgcgccgagcgcgatcaccttgcgcggacgccaggtgcgctggaaggtggccccacccgcggagtaggcgccgagggcggcagacgcggcatacgcgggggaggccagccacagcgccggcccgacgacgatcgccaccccagcggccgtgcgcagcgcgagcaggggctccagccgcgtctcctcgatcgtgagcccggatcgcacgacctccccgaaggcccgcagccacgtcacgggtgtgagcctagccggaacaccctgccgggtcgcgtcggcctggtcgaggtgcggcagccgtcgggcaaggaagcctcccacacgccccgcgaacaggctggcggccgcagccgctggaccgggtgcagccactgcggacactgcggacactgctgagcgtccgccgtccgtcctaccgggccggagcgcgggcaatcgccgttggttcaggtccgaccggagcgcgggcgattgcccccggccccggccggaggacgggcaggtcgccgcccgtcccccggaccggttccggggaaactggcgggacggcggccccgggtcacttaccgcttgtggccgttcccgtgtccgttcggatgcaggaccaccttggtccagccctcgtcacgggcgtcgaagtgctcgtaggcggtaggggcctcatccaggctgagttcgtgggagacgacgaagctcggctttgccttcccgccggcgatcagatcccgcagcgcccggttgtacctcttcaccggcgcctgcccggtgcccatgtgctggcccttgaaccacatcaagccgaagtcgagcgggaccttgccctgtgcctccagttccccctgggcctccgcgccgccggggtcctggggcaggaacacgcccaccacaccgatgtcgcccgtgaacctgaccgagtcgatcagtccgttgagcgtgaggctggcgtcctcatgtccctcgggatcgtgtgcctggtagccgacgcactcacagccgttgtcggcgcccagaccgagggtggcctccttgacgacctcccccggcttctgctcggcggtgttgatcgggatggccccgatctcctccgccttgcgcagccggtcgggctggtggtcggccacccagacgcgcccggcgcccttgaggagggcggagtaggccgccatcagcccgacggggccggccccgaagacgatcgtctggtcacccggtttgacgtgggccatctcggtggcgtgatagccggtggggaagatgtcggcgagcatcacgtagtcggtctgccactcggcggcgtcctcacccagacgcagcgcgttgaagtcgccgtagggcacgcgcagcagttccgcctggccgccctggtaggggcccatgtcggcgaatccgtaggcggctccggcgagagccggttccggctgcatggtcaggcagtagttggtcagaccccgctcgcactgcttgcagaagccgcaggcgatgttgaagggcaggaccacatactcgccgacctggaccttgcggacggccgagccgacctccacgacctggcccatgttctcgtgtcccagggtgcggccggactcgaacgaggtgcggccctcgtacatgtgcaggtccgaaccacagatattggtagtggtgatcttgacgatgatgtcgcaggggtgttcgatcttcgcgtccggtacgtccttcactgcgaccgttcgcgggccttcatataccgctgctttcatgatcgcttccttcggtgccgcggcatgaccgcagcacgggtgcgatggaggaggcatacagagcctgactcccgggagttggtgcgacggggtccatcgctccggcatgcctctgggggccgttcacccggttcaggtggaacggtggtgccgccgtgggcctgcccgggcggagcctcggcgctccggcggcgtgccgtccgagtccccgtcggcccttgacgcgaaacagcacgcaccgatcgatcagcggaatcttcgtacgcggacgaccaccaaccaccaaccaccaacaccaaccaccaaccaccaacgaatctccggctcaggtcaccagctagtcgccgtcgtcgtcttggagcatgtggcggcgttcctgttcgcgcttggagtaggcggctgcccggatcgcctcgtcgctctccaagcctgatcccagcgccccgcccacggtggcgaccgaagcgacgaaccaggacaaggtccagtattccgcggcgttgagcggggttcgtgtcgtggaggcgaacacttggtcgttgaggatgaacagggcccacaccaagttgatgacgatcaaacccacgtagcagacgagcaccccgatacccacggtcatgaccgtcgaggcgttgtagagcctcgccctctgcctcgcctcccgcgagacctctgctgatcgatgccacagctgcgcgtccacgatcagccagccgatcatgagcgcgacggacccgaccgtggcgatcacgaggcggggcgtgctcagggactcggccaggttccagatggtggagttcacggtggcgaccgctcccgtggcgagtgcggccgccagggctttcgacaagcccggcaccaagcgccacggccggttggcgcggaccataccgacgagcaccctcaggtaaccgcgcggtccgctgacgacgtaccgaagatcaacggtctcctcctcaccgacctggcccgggtgaataggcgcgaggcgactgacgaagggccccagaagcggctgactccgcggaggtccctcagccccggtggcccgcgggcccgccaagctgagcacggcttcttccacggcccgccgggctctcgtctgcagacgcaagccccccagcggaggaagagacagcagggccaagccgtgttcgtgactcagatccaccacgagcctgcgcccgtgtgagtgcagcggaaggtcggtgagggccacgacgatgtcccaactctccgctcttccgcggtccatgatccggcgcatcaaggtgggcgggtcctcggtccttgcggtgaagggctcactgaccacctcgacgtcgaaccgtcgtccctggcctgacttgtcggcgagccgagcaggaagtatccgggccatgcgctgcgcgatctccgtgggcgcgtccggatccgccaggagagccacgaccgtaacgccctgagacgacacccgcatgactccttctcgtcggctgccccagcgatcgcccgtgcccacaggatgcccccgaggtatcgccgacgccgcgtgacacgctggcccctgccagcaggtgcaggcggtacggttctgggcagtgtcgtgagcggcctggggatcgacatcgaccgaccggggcgcaggctcaggaagaaggaccgggactggctgctgtacacggacgagcagccctccgtgtacatcgagccggaggaggaccgcgtcgactacggctaccagggcaagttctggagcgcccacaagcacgtcacgcacgtccgctctacctgctcgacgagccgacggcggggctgcacccctcggacatcgcgctgctgctgcgccagctgcacctggtcgtcgacgccggcaacacggtcgtcctcgtcgagcacgacctggacacgatcgccaccgccggctggggcatcgccctcgggccgggcggcggcgacgcgggcgggcggctggtcgcggcgggcccgccggccaaggcggcgagggcctgccgcagcgccaccgcgccctgtctcgcggcccggctcgcgcgctcctgacgacggcgcgaggggctgagtaccggtcagccgggttcggggcgcagggtcgtgcgcgtcgtcatgctgcgttccagcttgtgcgggtatcgctcgcgaggtgccccgtctgggcccattccgccgggtcagccgggcatggggtggtgcgcccgggcgaactgttccacgacagcggcgcagaaggcgggcaggtcggccgggctgcggctggtgaccagctgcccgtcgacgaccacctcctggtcgacgacctccgcgccggcgttgcgcaggtcggtgcggatgctgggccaggacgtcaggcgacggccgcgcacggcgtcggcttccaccagggtccacgggccgtggcagatcgatgcgaccggtttcccgctggccatgaagtccttgacgaactgcaccgcgtcgcggtccattcgcagctggtcggggttcatggtgccgccgggcaggagcagggcgtggtagtcgtcgacggaggcgtcggcgaccaggcggtccacggggaaggttccggccgcgttgaggtcgaactggcgggcctggatctcgccggggtggagcgagacgatctcggtcttcgcccctgcgccctgcaacgcaccgcgcggctggtcgagttccacgcgctcgacgccgtcggtggccagaatccccacccgcatcccccggagttcctgtgtcatggtacggctcccttcacgagtcgctggttgtacgacgcgagcggtagggacacccggcagggcctgtccgcatcccttttccgtggactgcaaggcccggccgaaggtgccccgagcactgtctgcgcgcggtcagtgaaagctgccgtccgagtggggacgaccttcgtccagcgtcgtcgcgggcgtcgaagtgctggcagctttcatgagtcttccctcggcgtgccggagcatcgcgggacgcgacggaccctcgaagcgaccttccgagtcagacgccgtcacgtgaaggcgagggggtgtgattttcctggccaggcgaccggccgcgctgaaaccgcgatcacgaatccccgagcgcctgcggggcgacccgggcctcggtgaaggttcccaggctccaccttccgctccccgtccggcatctcagtttgagtccggcgacatgcaccggggcgcgactgctacagcagccggtcgaacaccgcggtcacgccctcccagtgactggtctgcgggttcttcacatccggatacaagattttgaacgtctcggcgagggcgacgctgagaccgccgatgatctcggggtagcgctcttcggtctcctgggtgggtgtcctgtcgaggggaggatgcgcggcgagctgttccaggatcggcttcagctcgacctcctcgtcgagctgccggaacctgtggatgctctcctggaggcccttggtgatcggtagatcccacggttcgacggtatccctgccgttggccttggccgacgcctggccgacgaccaggaggtcgtagagcttggcgtcgacgaagtcgccgtaccgcttcaggtcgttcttgtccacgtcaaggcttgcggcggcgcggaagaacctctcgaacttcgacacacccatcacggtcatgcctctcgcctcctcaccgggaacggacgacgtcgttcgctcccgcccacgccgccatcggctgttacccggtcgagattcgcacagccccctgctgagcgcctccgcaccccaggccgaaaaagggcaccccctcttcccctggcagagcagcatgaaatgcgcaggcatccctcggccagccgtccggccgtccgtccgcaggaggctgcacggcgttgcaacgcctcgaacgagaattgctgaccggacgacacgaccagctcgggggagcgggactgcatcagggcacccagccgagactggaacaagaccgggctcgggtgaacgaccccatgcatgagcaggcaaggccggtcagaagaggcggccgaaccggcagggccctgcggacgtgagccggcgtgagcgtgcggggcgcgccatcctgtcgacttcttcagagcacctccaggggcgtgggcccgctgggtggcgggaacgcctcgtcgagggcgtcgagcgcctcggtgggaaggttgaggtccaccgcgccgcggttctcccgaacgtggtcgggtgatccggaacgcgggatcgcggccaccccctgttccagcatccaggcgagcgccacctgggtcggcgtggctccgagggcccgggccacggcacccaaggcctcgaccttcaggagtcgcccctgctcgatcggggagtaggccatgaccgtcaccccggcctcgcggcaccaggggagcagatcccactcgatgccgcgccgggagaggttgtacagcacctggtcgacggtcacggcgtcgccgccggggagggtggtcagctcggccatgtcggcgacgtccagattgctcacgccccagtaacggatcttctccgcctccatcaggtcggtgaatcccgcaagggtctcctcgagtggccaccgtcccttccagtgcagcaggtagaggtccagccgttccgtacggagccgccgcaggctgccctcgcaggcggcgacggtgcccttccggtcggcgtggccgggcagcaccttgctgacgaggaagacctcctcccggcgtccccaaagggcctccccgacgagctcctcggccgcgccgtcgccgtacatctccgccgtgtcgacgacggtcatgcccaggtccacgcccagccgcagcgcggcgatctcctgttcacgccgggccgggtcctcgcccaggtaccaggtgccctgcccgagcgccgcgacctcctcaccggaggggagtgcgaccgttctggccgattccgcagacatctcgtgcctcccgtctgccgcggatccgtgtcacgcgcacccgcaccgagtgcccaggtccgcgcctcccagacaaccggggccgcatgcgccgcagggaggtcaggaggggcgagcggactgcgccgagagcgtgccgggaccgggtgcgcggtcgcgcaacgcgacggcgaccgacacaacggcgccacaggagaggaccgccgcgaagccgatcatcgcggtctgtacggcgaaatgccgcagggcgatgctgaacaggacggagggtaggcccattccgaggtacgcgacgacgaagaacacggcgaggaccccggcgcgtgaggcgggctcggccactgaaacggcacgttcgaggcctcccttgaacagcagcccggagccggctcccgacagggacacggcgaccaggtagagccagagcgccgggtggtagagggcgacggcgcacaggaccaggccgaccgggaagaccaccgcccccacggtcaggacccggggcagtgggaggcggcccagcaccagctgggcggccgccgcggaaccgaacatgaggaaggccgccaggccgaccacgaggtgcgagtcggtgtgcagggtgccgtgaagcacgctcgccccgagggaggagatcaggccgaggatcgcgaaggcgaaggcgcccagcgcgccggccgcgccgaacgcccgccagccgccggggcgcaggacgaacctgctgggcggttcggccgcgggcagctccaggtccacggtctccggggtggacagcaccagcgccaggcacaccgccatggcgagcgtgaagatcgcctgggtggtgatcaggggcgtgggaagccactcggcggcggctccggcgaccaggggccctgaggccagaccgccgaggttggcggcggtggccacgatgccgggcagcaccgaacccgtccgttccggacgggcctcgtggtggaggtcgtgcaggtacgtcgtcgcggtcgaggccatcagccccagtccgacaccgttcaggatcctgcccgcgatcagccccggcaggtctcgccacacgatcagtacgaccgacgcgacgatgccgaccagcagcgccgggacgatgatgcgccgccggccgagccggtccgacaggtgtcccagtccgaggaaggcggccgccgcacccacgaccatcgaggcgtacgccaccgtgaccgtggtcgcgccgaagtggtcccgggcctcgtacagcggccacagcggggtcggcgcggtgccgaaggccatcagcacggtgaaggccaccgccacgaaccagaagccggtcgtgtgcgaggcacggcgccgggcgggggcgcggggcggcaggccggcgggagcgggtgctgggatccggtgggtcgggtcgtcgggagcgtcggcggtgggacggctcagcggcgtcggaacggcaggcaggggtacccctcctcgggcggaagtggatgacgctttccatcctcctcaccaggctggatcagtgccaacgaatgtttttgctgggctcgagcaatgcgagtgatacttctcgtgtggagctacgtcagctggagcacttcatcgcggtcgccgaggagctgagtttcacgcgtgccgcccgtcggctgcacgtggtgcagtccggggtgtccgccgcgatccgctccctggagcgcgagctcggttgcgcgctgttcgagcgcacgtcgcagcaggtccggctcaccggggcgggcgcggcgctgctgccggaggctcgggccaccctgcacgccgcccaggcggcccaggacgccgtgcgcgccgcacaggacacgctgcgcggcacggtgaatgtgggcgccatggcctcggtcgaggtggtggacctgcctgcgcttctcgggcagctgcacgcgcggcatccggcgatcgacgtccggctgcggctggcgacgaccggatcggcgggactggcgcacgcactgctcagcggggacctggacgtggccttcctgtcgctgcccgagcacaaacccgccgggatcgacgcacgggagctggccaccgtgccgctcgtcctggtggtgagcgccgaccatccgctcgcccagcggggggaggtggcactcgcggacctcgcggcggagcccttcgtggacttcccgccgggctacggcaaccgcgaggtggtcgaccgggcgttcgcgggggcgggcgtcgtacgccgggtggcactggaagtgcccgacatcgacatgggggcggcactggtccggcacggtctgggcatcgccttcctgcccgcgttcgccgttgcccgcacccccggcctgcacgtcctggacgtccacggcaccatgctccgctggagcatgcatctcggcacgtcgtcgacccggcggcccagctcggccctgcgggcgctgctcgacctggtcgacctccacgtcatcgccctgtgacgcccggccgcagcccgggcgtctcccgtcgatggtgtccggccccctgtgaggaacggccacccacccaccgcagctctgtaacagggcagcccgccccactgctgctgacaccgagcgcacgaaagttctggcgaggcatcagccggggccgcccagcacgatcttccacactcgggtcgccacctggaggttcagccggtcctcgacgttcgcgaggtcgttgccgctgatgtcgcggatgcgctggagccgatagcgcagcgtgctgcggtggatcgcgagggagtccgcggtctcgtcgtagttgccgccgcagtcgaagtaccgggacagggtctccaccatggccgtgtggtgccgggagtcgtagtcgatgagctgccccagccactcctggacgaacgtctccagttcccggtaatcgttgccaggccccaggatgcggtagaggccgagctcgtcgaagaacgtcgtgccgtagtgctcgcgggagtgaaggcgcacttccagggcgcgctgcgcttcttggtagtggtgggggatgtcgtccggggagtcgcaaggggcgctcaccccgatcgtcccggaccgtgtcccggtctcccgggcgagcgcctcgtacaacgcgcgggcgtgcggcctggcgtcggcgaccaggaccacgtggtcggaacgtcgggtcagcagcgagcgcatgcccacggcagaggccgcccgccccacggtctgcgcgaaggaatcgtccgcagtccggttcggccactgcaccacgacgatgtagtggctgcggtgcaggtcgtgtccgactgcctcggaccgggcgtaggcgctcccctcgtccgtccctgccaggaggtcgtcgaccagcccgcggtgcagcctcagctccacctcggccagattgcgcaggtgcgccagctccggggcgagcgacgcggcggcgtgttccagcgcgagcacggcgtgctcgtcggcctcgtcccgggcatcgaccagggccagcacgcccaggatctcgccgtgcgggcggaccagggtgatcagccggtcctttattcgcaccggcccggcctgacgggcgacggcgtgcagcatttcgtcccggcgcacggggtcaggctcgggataggggtcggggcggctggggccggtccaggacctcagccgaccgaagcggtcctcgaccagcgcgggaaatccagtgagcttgtgcagcacgcgggtgatggcttcctcgccgccgctcgaggcagtgacgtcggccatgagcgcgtgaacggcccgctggtacctcagctcggccacgacggagatcagctgccgctggagggctgtgcgttcgtccctcagtcggtgcagctcaagcgcgtcctcgcgttggtgtcggtatgcgaaggcgaccgacagtgcggcagcggtgtgccggacgagtgtggcgagcagggagcgctcggcctcggtgggccgggagcgggacgtcaccacgaggtagccgtggagtccctcaagtccgcgtagccccagggcccggccccagggcctgccgggtacggtcacagcaccgtcctgcccggccagctcccgcaccctccggttcacggccgaggcatgcgtctgccggttcctcgggctggggaccaggtcgccgtccaccttgaggtatccggcctcggcgctgtatggccccgcggcggctatgtgctccatggccaggcgcaggatctcgccttcgtccggggtgtcgagcagggcgcgggagagcaccgtcaggtcgcggagggcatgatcggccagggttggagcgggtgggcggggccctctccgcgcggctgtgtggtgccgcccggcgctgccccgcggaaggctgctctcccggtcggagcagcggcggtacaggttgtgcgcccggctgctggccatgggatcactccgttctcctcgagcctacaggcgagcggtggtacccgctcccgggccggctcatcccagatgttcggatgattcctctcgtactcgtggggcgaccggacccgtgcattcctgactcgccaggcgcaggcgtggaggcccccggttcgtcaccctgggggtgctcgagcgccttcgtgcgcacgggtgggaaaccggccgaggtcccacccctacctgaacgaacgtgatccggagagtcgacgcgggcgccgtaccgggaggagttccccatggccaaggcagtgggcatcgacctgggcaccaccaactcggtgatcgccgtgtgggagggcggcgagccgtccgtcgtacccaacagcgagggcaaccgcacgacaccgtccgtggtggccttcaccgacaccggggaacgcctggtgggccagctggcccggcgccaggcgatcctcaacccgaagggcaccatctactcggccaagcggttcatcggccggcacttcgacgagatctccgacgaggccagggcggtgacgtacgacgtcgtcgagggcgacggcggggcggcccgcttcaaggtgcgcgacaagctgtacgcgcctgaggagatcagcgcacaggtgctgcgcaaactcgccgacgacgcctccaagcagctcggggagcgggtcacggaggcggtcatcacggtgcccgcctacttcaacgacgctcagcgcaccgccaccaaggacgccggacggatcgcgggactggaggtgctgcggatcatcaacgagccgacggcggccgccctcgcgtacggcatggacaagaaggagcacgagaccgtcctcgtcttcgacctgggcggcggcaccttcgacgtgagcatcctcgacgtcggcgacggcgtggtggaggtgcgctccaccgccggcgacagccacctgggcggcgacgacttcgaccgccgtctggtggattacctcgcggacgacttccagcaggagaacggcatcgacctgcgcaaggacccgcaggcgctgcaacgactgttcgaggcggcggagaaggccaagaccgagctcagttcggtgacgcagacgcaggtcagcctgccgttcatcaccgccgacgcctcgggccccaagcacctcaccgacacggtcatgcggtccacgttcgagcagatcaccagcgacctggtggagcgttgcctgggaccggtccagcaggcgatggccgacgccaaggtcggcgagagcgacatcgacgaggtcatcctcgtaggcggttccacacgtatcccggcggtgcaggctctggtccgccgactgaccggcggcaaggacccgaacatgagcgtcaaccccgacgaggtcgtcgccctgggcgccgcgatccaggccggggtgctcaagggcgaggtcaaggacgtcctgctgctcgacgtcacacccttgtcgctgggcgtggagacgcgcggtggagtgatgacgaagatcatcgagcggaacaccaccatcccggtgcgtcgcagcgagaccttctccaccgccgaggacaatcagccggccgtcgatgtggtggtcctccagggcgagcgcgagcgggccgccgacaaccgggtgctgggccggttccagctcaccgacatccggccggcgccgcggggcgaaccgcaggtcgaggtcaccttcgacatcgacgccaacggcatcctcaacgtcaccgcacgggacaaggacaccggcaaggaacagggcatcaccatcagcgagagctccaacctggaccgcagcgaggtcgaacgcatggtccaggaggccgagcgcaaccagggccaggaccaggcactccgcgaggccgtcgacgcccgcaacgaactcgacgccgtcgcgtaccaggtcgagaagcgcctcgccgaactgggcgacgcggcgcccgcgcacgagaaggcacgcgccgagatgctcgtgtccgacgcccgggcggcggtcaaggaagaggcgggcgtggagcgcgtgcggcccctgacctccgaactccagcaggtgctcgccggactggcggcccatcagggcgccgccaccgcggatggcggtcccgcccagcacgccgccaccggtggtcccacgagcggcggtggcggtggcgacgatgtcatcgacgccgagttcgacaagggctgaggcgcgccatgcccacccgcccccaggaacccgaccgggccgcgtcggatccggtcgaaccggtcccggaaggtgccggacgccctcctcgcggtgatttgccgcaacccggcccgccggcccggccggaagcgacgaacggcgaaccgggacccgacgccgccggccccgcgcctgccgaggacgagtacacgaccgcgatccaggaactggaggaccgctggcggcgcacactcgccgacctcgacaacctgcgcaagcgccacgccagggaactggagcgcgaacgggcggtcgagcggtcccgcacggcggccgccttcctgcccgtcctcgacaacctcgaactcgccctgacccatgccggcgccgatccgggcgcgatcgtggagggtatccgggccgtacgcgaccaggcggtgaacgtcctcgaactgctcggctacccgcggcacgcggagaccggcgtcgccttcgacccggcccggcacgaggtggtcggcgtcgtccaggacccagacgccccaccgggcacggtcgtcgaggtgctgcgccccggctacggggacggggagcggcagctcaggccggccgcggtgaccgtcacgaagcgggagtgaccggcgatggcacgggactactacgaggtgctgggcgtgtcgcggagcgcgagccaggacgagatccagcaggcatatcgcaaactcgcccgcaggcaccaccccgacgtcaacaaggaccccggggcggaagagcgtttcaaggacctcaacgaggcatacagcgtcctgtccgatcccaagacccgagcccgctacgaccgcttcggcgaggacttccgcaagatccccgaggacttcgacgaacgggtcgcggccggagcgggcggcggcttccgcggtcggaggaccgcaggcgggggcggtcctcgtgtccggtacgcccccggcttcggcgacgacttcggagcggagggcatcgacatcgaggacctgttcggctccatgttcggagccggcgccgcccggggcggcgtccccggagcggaccaggaggccgaactgccgctcaccgtcgaggaggcgtaccgaggcggccgtcgcaccgtcacgctcgccggtcccgacgggcagccgcggcggtacgaggtcgacgtgccgccgggcgtcaccgacgggcagcgcatccggctggcgggcgagggcggccggggcagtggtgacgccgccgcgggcgacctgtacctgcgagtgcgtatccagccccacccccggttccggctggacggccgcgacgtgcacgtccaggttccggtcgccccctgggaggcggccctgggcgcgaccgtgccggtgcccacgcccggcggcggcacggccaaggtcacggtgcccgcgggctcgtccagcggccggcggctgcggctgcgcggcgagggcatgccgaacccgcgcggcgcgaacggcgacctgtacgccgaactccgcatcgtggtgccacccaccctcggcgaccaggagcgcgaactgttcgaggagctcgccgccacttcctcgttcgaccccaggaggacgcgatgaacgaccgacccgcgggagcggcaggcatcggccgggccggcgtgggcgaccgtccgggacgaacgggcgccgacctcaccgcctcgacggctgtccggtacgcgctcgtgcccgcccccaggctctccctggaggccgtggcccgtcgctcgggcctccaccccgatctgatccgccggttcgtcgccctcggcctgatcgacgccgaacgcgacgccgcggggcgcctggtgttcgaccccacggccccggcggtccttgcccgcatccagcggctgcgcaccggactctgcctcaactacgcatccatcggcctggtgctcgacctgctcgaccgcatcagcctgctcgaagccgccctgcgcggccgcggcacgaggagtgaaacacccccatggacatgaaccgtctcacccagaagtcccaggaagccctccaggaggcccagaccgcggccggccgcatggggcacaccgaggtcgacggggaacacctgctgctcgcacttctcgatcaggaggacggtctgatcccgcggttgctgcaacaggccggcaccgagccgaaggaactgcgcgcggccgtgcgcgaggaactctcccaccgcccgaaggcgaccggccccggcgcggcacccggccaggtcttcgtcacccagcgcctcgcccggctgctcgacgccgccgagcgggaggccaaacgcctcaaggacgagtacgtgtccgtggagcacctcctgctcgcgctggctgaggagagctcttcgaccgccgccgggctactgctcaaacaggccggcatcaccagggactcgttcctgagcgcgctcacccaggtccgcggcaaccagcgggtcacctccgccaaccccgaagtggcctacgaggctctggagaagtacggccgcgacctggtcctcgaggctcggtccgggcggctggacccggtcatcggccgggacgcggagatccgccgcgtgacccagatcctcagccgcaagaccaagaacaaccccgtcctcatcggcgaccccggcgtcggcaagaccgccatcgtcgagggcctggcccagcgcatcgttcgcggcgacgtccccgagggcctgcgcgacaagacggtgttcgccctcgacatgggctccctggtcgccggcgccaagtaccgcggggagttcgaggaacgcctcaaggccgtgctcagcgaggtcaaggccgccgaggggcggatcctgctcttcgtcgacgaactccacaccgtcgtaggagcgggcgccgcggaaggggccatggacgcgggcaacatgctcaagccgatgctcgcccgcggcgaactccacatgatcggcgccaccaccctcgacgagtaccgcaagcacatcgagaaggacgccgccctcgaacgccgcttccagcaggtcctggtcgacgagccgagcgtggaggacaccatctccatcctgcgcggactgcgcgaacgcctcgaggtcttccacggcgtgaagatccaggacaccgcgctggtctccgcggccaccctcagccaccgctacatcaccgatcggttcctgcccgacaaggccatcgacctcgtcgacgaggcgtgcgcccggctgcgtaccgagatcgactcgatgcccgcggaactcgacgagatcacccgccgcgtcacccgcctggagatcgaggaagcggccctgtccaaggagagcgaccccgccagcaagacccgcctggaggagctgcgcagggaactggccgacctgcgcggcgaggccgacgccaaacacgcccagtgggaggccgaacggcaggcgatccgccgcgtgcaggaactgcgccaggaactggagcaggtccgccacgaggcggaggaggccgaacgcgcctacgacctcaaccgcgccgccgaactccgctacggccgcctccaggacctggagcgccgactcgccgcggaggaggagcaactggccgccaagcaaggggagaaccggctgctgcgcgaggtcgtcaccgaggaggagatcgccgagatcgtcgccgcctggaccggcatccccgtcgcccgcctccaggagggcgaacgcgagaaactgctgcgcctcgacgagatcctgcgcgagcgcgtcatcggccaggacgaagccgtcaaactcgtcaccgacgccatcatccgcgcccgctccggcatccgcgaccctcgccgccccatcggctcgttcatcttcctcggccccaccggcgtcgggaagaccgagctggccaagaccctcgcccggactctgttcgactccgaggagaacatggtccgcctcgacatgagcgaataccaggagcggcacaccgtcagccggctcatgggcgcaccgcccggatacgtcggctacgaggaaggcggccagctcaccgaggccgtacgccgcaagccgtactcggtcgtgctgttcgacgagatcgagaaggcgcacaccgatgtcttcaacaccctgctgcagatcctcgacgacggccgcatcaccgacgcccagggccgcaccgtcgacttccgcaacaccgtgatcatcatgacgtccaacatcggctccgagcaccttctcgacggcgccaccgccgaaggtgagatcaagcccgacgcccgcgccctggtgatgggcgagctgcgcgggcacttccgcccggagttcctcaaccgcgtcgacgacatcgtgctgttcaaaccgctgggtgagcggcagatcgagcggatcgtggaactgcagttcgacgagctgcggcagcggctcgccgaacgccgcatcaccgtcgaactcaccgacgccggccgggaagtgatcgcccaccagggctacgacccggtgtacggggcccggccgctgcgccgctacatctcccacgaggtcgagacactggtcggacgcgccctgctgcgcggcgacgtccaggacggcgcgacggtccgcgtcgacgccgagcacggagagctggtggtcacctacgaccagcccgaggacgtgaagggagcgtgggcggcatgagcacgatgcaggcgacgaccgtcagttgtccgaactgcgggcgcaccaaccgggtgcccgtggccgcggagggccgccccaagtgcggccactgcaagcagcccctaccgtggatggtggacgcgagcgacgacgacttcaccgaggtcgccgagcgggccgacgtccccgtcgtggtcgacctgtgggccacctggtgcggcccctgccgcatggtcagccccgcgctggagaaggtcgccaccgatctcgccggccgcatcaaactcgtcaaggtcgacatcgacaagaatccgcggctgtcgcggcgtttcgaggtccaggcggtaccgacactgctcgtcctcgatcagggcgagacggtcgcccggcaggcgggggcggcgcccgcccccgtcctgcgccagtgggtggaacagtcgatcacggcccgggaagggtgatccggatgtccctgcacgcagacccccacctcgcgcttgtccggccggtccagccgctgaccccagaagggtgtcaggagtgtctgctgctcggctccccgtgggtccacctgaggctctgcctgacctgcgggcacgtcggctgctgtgactcctcgccgaacaagcacgcgcgtaggcacgcggctgccgacgcccatccgatcgtgcagtcgttccagcccggcgaggattggcgctggtgctacgtccacgaggcgttcgtctgatgtccggcgaccagccgctgccgggcgaagaaccggtgccggaggaagcggacgaggccgtcttcttggagaccccggacatctacggcgcgtatccgcgccttacggaggaccagatagcacgtctggcggagcacgggcaacgccggagcatggctccgaacgacgtgctgatccgggagggggagcgctgcgagacgctcttcgtcgtgctcagcggttccgtcgccgtcgtcgaggaccacggcactcccgaggaacacgtgctgcgcgtgcacggccccggtcgcttcatcggcgaactcgggctgctgtacggacaggtggccttctacaccgctgtcgccagggagccgggcgaggtcctcgtcgtctccttggaccagttgcgccgcctggtgtcccaggactccaccctcggggacctcgtgctgcgcgcctgtctgggccgtcgcgcgttgctcgtcggacagggcgccggcttccgcatcatcggctcgcgctactcgcccgacacccggcggctgcgcgagttcgccgtccgcaaccggctgccccaccgctggatcgacctggagaccgacgaggaggccgaggacctgctgcgccgcttcggcgtcggcccggaggagacaccgctcgtcatctggcgggacaccaccctgttgcgcaaccccagcaacgcggaactggcccggctcatcggcctgccgtcactccccgccggaaaccgtcacggcgacgtcctcatcgtcggctccggacccggcggcctcgctgccgcggtgtacgccgcctccgagggcctgagcaccaccgtggtggaggcgatggccaccggcggccaggccggcacgtcgtcccgcatcgagaatctgctcggcttccccgccggcatctcaggcgccgaactcaccgaacgggccgtgctccaggccgacaagttcggcgccaggatcagcattccggtggaggcgagcggtctccatcccaaggacgaggaccactacgtggtggcgttcgccgacggcagcgagatcgccgcccgcgccgtcgtcctggccacgggtgcccgctaccgccggctccaggtgcccggcatcgaacgcctggagggaacgagcgtccactactcggcgaccgtctacgaggcccagcagtgccgcaccgacccggtggccgtcgtcggcggaggcaactcggcgggccaggcggtgctgttcctcgccgggtacgcgccgaaggtgcacctgctggtccgcggacccagccttgaggccaacatgtcccgctacctggtcgaccaggtagagcgccatccgcgggtggaggtcatgctgcacaccgaggtcaccgaggtcatcggccaggaggtgctggaggagctcgacgtggtcgacaaccgcacgggcgggcaccgccgactcgcggtacggggcctgttcgtcttcaccggcgccgacccccacaccgagtggctcgccggcatcatcgccctcgactcccgtggcttcgtcctcaccggcccggaggcccaggaagcctgcgcccaccccgaggtgtggcacggccgcgggcgctcgtgcatgaccctggagaccagcctgcccggggtcttcgcggtaggggacgtccgtagcggctcggtgaagcgggtggcctcggcggccggtgagggcgcgatggccatccacttcgtgcaccggcacctggggcactcggccgcacccggtcccacgggcacgtccgctgccgcgggcggctcggacgtctccccacgcatacgtcacaaggagtccgcatggctcgcatgacgaatggcgggcgatgaggtcacgcccacccctctcgatcccctggtcgagctcgacgaactgcaaggacatcgccgtcgaggccaacggtcccgaactcgtggtcaccggagacatcaaggagcgggagcgcaagggcgtcctgcccggcagcacccgccacgtcggagccttcgagtaccgcttgcggctgcccggagagttggccacccacaagatcaaggccgacatgcaggacggagtgctcggcatcaccgtccccaagggcgaagccgccgggccccgccgggtccagatcagtgagtccggcgagggcgcgcgcgaagacgccgcccggagcggcgcagcggcgggcggcgggaccaccgccgcctgagaccccaccgagccggcggtgccggaccggtgtctgtcaccgctgccgtcgcgacgggggcgacggcctgcacggtgcggttggtcggcatggtctcgacgcacacggtcagagcccgggctaccgaccgatcatggcccgatcgcccaccgcatgcgcccggccgcatccacctccggatccgaaacccccgacgcacagcgctacttgtggaccgggcgtgccgtcacccggcaccgcggcggctggggggaactcggcaagaccttcgccatctgcctcggccgcgagatccgccacgccccaccgcctcgtctacgccgacggcctcgacctcaccaatgtctccgccgccacccacatcggcatgggctgccgcgtctgcgaatgcctcggctgcctccagcgtgccgcaccacctctcggccacccgctgcggatcgaccaggacctgaccggctctcgtcctctcgcgcggcatcagaaaagtcagcaacggtgtgagtcctcgaacacctggcgacagctgaccgaacatgcgaaaagatgtaatctccgaagaccgcccttgacctgcaatagcaggcagggagcctaagtccgggagtacctccatgctgcgtaccatgttcaagtccaagatccaccgagccaccgtcacccaggccgacctgcactacgtcggatccgtcaccatcgacgccgatcttctggacgccgccgatctgctgcccggcgagttggttcatatcgtcgacatcaccaacggtgcccgcctggagacgtacgtcatcgagggcgagcgtggctccggagtcgtcgggatcaacggggcggcggcccatctcgtccaccccggcgacctggtgatcatcatcagctacgctcaggtttccgacgccgaggcgagggcactgcggccgagggtcgtgcacgtggaccgcgacaaccgcgtcgtggccctgggcgcggacccggccgagccggtaccgggctcggaccaggcgcgcagcccgcaggccgtcaccgcctgaactccagactcaggcgcgggaatccgaggagcatccatgagcgacatcgagatccgcgacgaccggacggcgggccgtctcgaggcgtacgccggggacgaagtggtgggccacatcgagtacttcgtcctggagacgccgcggcgcgcgctcgtcccggtccacaccatcgtggagccggcgcacgagggccagggcatcgcgggctccctcgcccgtgagctgtacggcatcgccgcccgcgagagcgtcgtggtggctcccctgtgcccgtacgtcgtgaagtgggcggcgcgccaccccgaggaggcgccggccgcggatccggagctcctggcggcggcgaaggcgtggctcgtggcgcaccccggacggttctgatgacgtcgcggggcggcgtgggggcgccgcacgccacgctcgccctgctgcacacgtcccccgcccacgtccccgtgttcgacgcgctgcgcgacgaggggcacccggggctggaactgacccacttggtggccggggaactgctcgcccgcgcccgtgccgaaggccccgaagccgtggccggcgaggtgagggcggcgctggacagggcggtcgcggccggagcgggcgccgtgctgtgcacctgctcgaccatcggagcggtcgccgaggcggccatcgccgacgtgcccgtactccgggtggaccgcccgatggcggccgcggcggtggcggccggcccgcggatcgtcgtggtcgccacggtggagagcaccttggagccgacggtcgccctggtcgaggaggaggccgccgggcgccccgtcgacctccggaccctgctcgtggccgacgcctgggcccgcttcgaggcgggcgacaccgtcggctacgtccgtgcggtggccgaggcggccgacacggtcgccgacgccgacgcgatcgtcctcgcccaggcctccatggccccggcccagcacctgaccacgaccaccgtcccggtcctgtcgagcccccggccgggcctcgccgcgggggcggccgcggcgcgctcgggtcagggcccgtcccaggcccacctgggcccgcgtcgtcgcgcgacagggtgactgagcgagcgggcggcgggtacgtgggggaggagtccagagccgacgtaccgaagggctggaggacaccatgacccatccgcaccccgatcccgtaccgccgggtcccacccccggaccgggacccggacccggcccggcgccgttccccgaccccagcccgctgccgacccccactccggacccggccccgagcccggagccgtctccgatcccggagccgtccccgatcccgaagccgccgggcccggacccggtgccggagcccgaaccggggccgccgctctcctgaacgccgcgcaccgggtgacgccgtcagggcggcccaccggtcccccggcgaaccgccctcgggcgacggcgccgcgggcaccgtcacccgggcggcaccacggcaccgtcacctacgcggtgacctccgaccggtccccgccccacagcgtgtggaacgagccctcccggtccgtgcggcgataggtgtgcgccccgaagaagtcccgctgcccctgggtgagggcggcgggcaggcgctcggcgcgcagggcgtcgtagtaggcgagggccgcggcgaaccccggggtcggtacgccctggcgggtcgccgcgatcagcacctcgcgccagtcgtcctgcgccgccgcgatctcctgcgcgaacgtgtcgtcggacagcaggctcggcaggtccgcacgcgcgtcgtacgcctcccggatgcggtccaggaaggcggcgcggatgatgcacccgccccgccagatcgacgcgatcttccccaggtcgatgttccagtcgtactcgtcgctgcccgccgcgatctcgtggaagccctgcgtgtacgagacgatcttcgaggcgtacagcgcctgctcgacgcggtcggcgaaggccgccgcctccgactcgccgagcggagccgccttcggcccggccagcccgcgcgaggcctcccgcagctcctggtggccggacagggagcgggcgaacacggcctccgcgatgcccgacaccggcacgcccaggtcgagcgcgatctggaccgtccagcggcccgtgcccttctgttccgcctggtcctggaccacgtccacgaacggcttgccggtcgccgcgtccacgtgggacaggacctccgccgtgatctcgatcaggtaggagtcgaggcggcccgtgttccaggtccggaagatgtccgcgatctgcgcgggcgtgtagccggcgacgtcgcgcagcagctggtacgcctcgccgatcagctgcatgtccgcgtactcgatgccgttgtgcaccatcttcacgaagtgcccggcaccgtccggaccgacgtgcgtcacgcacggcgccccgtcggccgccttcgcggagatcttctccagcatgggcccgagggagtcgtacgactcgggcgagccgcccggcatgatgctcggcccgtgcagcgcgccctcctcgccgccggagatgccggtgccgacgaagtggatgtcctgctcgcgcagctcgcgctcccggcgccgggtgtccgcgaagtgtgcgttgccaccgtcgatgatcatgtcgccgggctccaggagcggggcgaactcctcgatcaccgcgtcggtgggcgcgcccgccttcaccatgatcaccaggcgcctgggccgctccagcgccgccacgaagtccttcgcggtctcggccggcacgaagtcgccctcgtggccgaactcctccacgaggtcacgcgtccgcgacgcggtccggttgtgcaccgcgaccgtatagccgttgcgcgcgaagttgcgggcgaggttgcggcccatgaccgcgagaccagtgacgccgatctgggctgttgtgctcataccgtgggctcctaagaggtcctgaggtaggtccttggaggacctgaagtaggtccgtgcatcggtggtgccggtcgtgctcgccagtattgtcccgttgaccatcctgacgtgccggttcgccgatcgcacatccgggtctcccggaccgcccgcgaccgggacggcccgcgtgtaccggcccgtatacggccgtgcggacaaccgaagggcgattcctggtcacttggcgggatggagcggccgattgccgccttgtcctggcctgttcgcagcgtttacttttgccgctcctgacgcatgtctagggggtcccccatggccgtacgcggccggcaccgccggtatcagccgaacaggatcaaccgcgcctcgctcaccgtcacggcgggcggagcgggcatggcgattccgctcatgggcaccggcgtcgcccacgccgccgatgcggacacctggaacaaggtcgcggcctgcgaatccagcgacaactggagcatcaacaccggaaacggctactacggaggacttcagttcacgcagtccacgtgggaggcgtacggcggcaaggtctacgcgcagcgcgcggatctggccaccagggaccagcagatcgccgtggccgagaaggtcctcgaggggcagggcccgggcgcctggccggtgtgctcggtccgcgcgggcctcacccggggcggcggcacgccggacatcgacccgtccggcagcgcgacacacacggcggaccggagcaccaagcggaccgtccgtgatgtgaagccacagacgacaccgcagtcgcaggcgggcaccgccgagatgtacaccgtcctgcacggcgacacgctctccgggatcgccgactcccggcacgtccggggcggttgggagcagctctacgccgccaaccgggggaccatcggcgccgacccggacctgatccttccgggccagcggctgcatctgcgcgccaaggccacgacccgcaccgacgacgcctccacgtcgacccacaagtcgtcgacgtcctcctccaagtcctcgacggagaaggcgtcctcggacaggaccgagaaggcgaccacgagccactccctcgtcgccccggtgaacgccgggacggggacgcaataccatgcggcgggttcgtcctggtcgaagggctatcacaccggcgtcgacttccccgtgcccacgggcacctccgtgaaggcggtcgcggcggggcacgtcgtcagcgccggctggggcggctccttcggctaccaggtggtgctccggcacgccgacggccgttacacgcagtacgcccatctgtcggccatctccgtgaaggccgggcagagcgtgacggccgaccagcgtatcggccgctcggggtccacgggcaacagcacgggcccgcatctgcacttcgaggtgcggacggggcccggcttcggcagtgacgtcgatccggtcgcctatctgagggcgggcggcgtcaggatctgacgcggtcgcgggcgcggtggcggggcaggacgggcagtggtacgtacgggccgccgtagaaggaggcgtacgtgagcggcgtcgcggcggcgtcggacggcgccaggtcgtcgtcgtagccgctctcctcgggcggcatccggaccggctccggttcgtggacgtcctgggcgctcgaggcgcccggctggggcggaagcccggcgagcagctcctcggcgggggacggtccggaggcggccgccggtgcgtgggtggcgtcggcggacacggtcgccgcgcgctgctcgcgtccgatccgctccgtcgtcagcaggatcagaccgcccgccgcgacgacgccgcagccgagcgcgagcagggtgcccgtggtgccgtagcggaaggtttcgccgaacatcgtcaggcccaccgccgcggccacgacggggttgacgaccgtcaccgtggccaggggggccgccagtcccgcgccgcggtaggaggcctgcgagaggagcaggcccgcggcggcgaggacggctatcacggccagggtgggcagcgaggcgagcgcgacgccgtcctcccagtccaccgcgacggtcttcgtgaacaccgaggcgatgccgaaggccacaccggccgcactcgcgagcagcacgctgcgcaccaccgggtgccggtgcacggcacgagccgccgtcatcagcgcgacgatcgcgccaccgctgaccacggccaccagcacccgctgcgtggtgtccagggtctgcgagtcggccgtgccggtcagtgagagcaggccggccaggcccaccgtcgccatgagcgcgccgcgccaggcggtcgccccggccttgcggcgcacgaagagggccgccatggggagcgcgaagacgatggtcagcgcgcccagcggctgcaccaggctgagcgggccgcaggccagcgccaccacgtgcagcagcgcgcccaggccgttgagacccaccgccgcccaccacaggaggtggcgcagcggtgcgtagggccggtccggcgtcgtcgccgcgacccgctcctgcacgatcgccccgcccgcgtacgcgacggcggagacgagtgacagcagcacggacaacgcgagggcgctcatgagcggctcctctgcgaggggccgggtcggctcacccggcgcgacgaacggtcggcttccatactcactacgatgcctcgcgaaatcgctcgcgtcgtcgtacctgagcaggcattgggtcctactgccgatggagtagaaccggcgccccgtcctccccagggtgggtgacaccggaggccggccccctggtgggaacccctaggggccttggtactactgctcttcgtggacctcgaccccgatctcaccgcactcgacgccctcggcggcttcttcgtactacgcaccgaggcgccgccgcgcggcccgctgccgacgctcgcacaggcgtacgcgggacaacacgtggatgtttacggagatccgctgattttccgggttcgaaaagtcaccgaaagtcttcgggcgcccgagccgcggatcgcggtctccgtggcccagcaggcactcgcggcccggctgtggtcgatcgctctcggctgcgccgccctgtacgaccaggttcccgacctcgatccccggctcctgcggtgggatccggacgccagcgctccggacgatctgtggctctccgaggtgcgcccccggcccgccacggcgatcggcgacctcgtacgagagggccacctcgccccgctgatcacggccctgcggcggcagcagcacgtgtccgcacgcctcttgtggggcaacgcggcctccgcgctggccggcgcgctccgccagctcaaccgctgggcacacgcgggcggccgcgacgaggtggccgaccgggcccgcgccttcgccgccgcgtccctcgcgcaccccgacctgtccggcaccctcgacccggccaccctccgccgccgcagctgctgcctctactaccggctgcccggcggcggtctgtgcggcgactgctgtttcgaccggccgccgcgccactcctgagatcggtggtcttccccaaccgccgcatctgggtgaccatgtgggaaccagccgctgcgacagggggttccgggtgcgagtgggactgctgacccgggagtacccgccggacgtgtacggcggcgcgggcgtccatgtcgagttcctcgcacgggagttgcgctccctcaccgacctggctgtgcactgctggggcgagggcggcgcgggcggagtcgtacgccaccggccctggaccgccctcgacggcgccaacgacgcgctgcgcaccttctccgtggacctctccatcgccgccgccctcgaaggccgcgaactcgtccactcgcacacctggtacgcccatctcgccggccacctcggcaagctgctgcacggcatcccgcatgtgatgaccgcccactcgctggagccgctgcgtccctggaaggccgagcagctcggcggcggatacgccctctccggctgggccgagcgcaccgcgatcgaggccgccgacgcggtgatcgcggtgtccggcgccatgcgcgaggacatcctcacctgctatccgacgctcgacccggcgaaggtgcgcgtggtgcacaacggcatcgacaccaccctctaccggccggaccacggcaccgacgtgctcgcccgcatcggcctcgacgccgaccgcccgttcgtcctgttcgtcggccgcatcacccgccagaagggcgtgccccaactgctgcgcgccgtgcgggacatcgacgcctcggcgcaggtcgtgctgtgcgcgggcgcccccgacacccccgagatcgaccaggagttccgtgacctcttccaggagctgagccgcgtacgcgcgggtgtccactggatcccgcagatgctgccgcgcccggatgtgatccaactcctcacgcacgccgccgtgttcgtgtgtccctcggtgtacgagccgctcggcatcgtcaacctggaggcgatggcgtgcggtaccgccgtcgtcgcgtcgcgggtcggcggcatccccgaggtggtggacgacggacgcaccggcgtactcgtccccgtggacgaagacttcgaggcgtcactcgcgcacgccctcgactccgtgctcggcgacccggaggccgcccggcgcatgggcgaggccgggcgggagcgtgcggtgcgggagttcggctgggacgcggtcgcgagacgcacggttcacctgtacgaggaagtcctcaaacaggggtagtcagcacgacacaaccgggcgtagaggggcggcggtatgcggcgcggaggaccttcggtgctgggaatcgtactcgcgggcggcgagggcaaacggctgatgccgctcaccgcggaccgggcgaaaccagccgtgaccttcggcggaacgtatcgcctggtggacttcgtcctgtccaatctcgtgaacgcggacatcctgcggatctgtgtgctgacgcagtacaagtcgcactcgctggaccggcacatcaccacgacctggcggatgtcgagtctgctcggcaactacatcaccccggtgccggcgcagcagcggctgggcccccgctggtacctgggcagcgcggacgcgatcttgcagtcgctgaacctcgtgtacgacgaacggccggagtacatcgcggtgttcggcgccgaccacgtctaccgcatggacccgcggcagatgctcggcgagcacatcgagagcggtgcgggggtgacggtggcggggatacgggtcccgcgcgccgagtcgtcgtcgttcggtgtgatcgcccccggctcggacgggcagaccgtggagaacttcctggagaagccggccgatccaccgggtctgccgggcgaccccgagtgcgtgttcgcctcgatgggcaactacgtcttcaccaccaaggtcctgatcgaggcgctccaacgggacgcggaggacggggactccgtgcacgacatgggcggttcgatcctgcccgcgctcaccgaccggggcgaggcacggttgtacgacttcagcgccaaccacgtccccggcgagaccacccgggaccagggctactggcgggacgtggggacgctggacgcgtactacgacgcccacatggacctgatcgccgagcggcccgcgttcaacctcttcaaccgcagctggccgatctacacccactccggacagctgtcgccggcgcggttcaacgccgggggcatcgccagcgagtcgatcatcagcgcgggctgcctgatccggggccaggtcacccggtcggtgctgtcaccgggggtcgtcgtcgacccgggggccgtcgtccagggctccgtgctgcacgacaacgtgcacgtcgggcggggcgcggtggtccgcggagccgtcctggacaagaacgtcgaggtgccgccgggcgcgacgatcggcgtcaacccggggcgggacgccgacctgtacacggtgtccaagggcggcgtgatcgggctgggcaagggacagcgggtgtcgtaggcccgcgcggccgcggtgcgccgggcgcggcgcgcccggcgacaccccaggttgcgcgggttcaggcgtggttgcccggactatgtggacatcgttgtcgcattccgggaggtctcctgcatgagatggaagctgcgcaccgcgggcgggctgacggccctcgccctgctcggcggcgcacttgccgggcccgccgcccgagccgccgagcagggcagcgaccggctcggcgacctggtcaacccgttcatcggcacccagaacgagggcaacacctacccgggcgccgccgtgcctttcggcatggtgcagctctcgccggacaccgggcacaacaccggttacgactacacgcagaaccacatccgcggcttctccctcgtgcatctctccggcgtgggctgccggatcggcggcgacctgccggtgctgccgacgacgggggacgtgaccgagacggactacgcgaagtacgcggccggattcagccacgacagcgagcgggcgagcccgggctactaccgggtgggcctcgacagcggcatcgtcgccgagttgacggcaaccgggcggacgggggtgcagcgctacacctttccggccaccgacaaggcgaacgtcctgctgaacgccggccaggcgctgcacaagaccgtctccaccgacgtcgaggtcctggacgaccggaccgtgcggaccaggatcagtggcagcggcttctgccgggacaccggcccgtacacggtctacacgatcacccggttcgaccggccgttcaccgcgtacggaacgtggcacgggggcacggtcaccgagggctcggcggaatcggccgccggcaccgggcgcaacggtgcctacgcccggttcgacgcgaccgaggaccgcacggtcgaggcgaccaccgcgctgtcgtacgtggacgcgcggggcgccgaggtcaacctccgctcggctgagggccgttcgttcgccgacgtccgggaggccgcccgccgctcctgggaggaccggctcgacgacgtacgggtcaggggcggcagcgacaccctccgccgcaccttctactcgtccctctaccggtccttcctcgcgcccaacatcggcagcgacgccgacggtcgctacaccggctgggaccaccggatccaccgggcgcggggcttcacgtactaccagaactggtccctgtgggacacgtaccgcacccagtgccagctgctcgccctgctcgcgccgcgcgagtcccgcgacatggcgatctccgtactcaagatcgacgaggacggcggctggctgcccaagtggggctacgggacggtcgagacgaacatcatgtccggcgacccggtcaccccgttcctcacgaacgcctaccagcagggcctgctcaaggggtacgaggagcaggcgtaccgggcgctcgcgaagaacgccgacgggttgccgcccgccgcctatccgggggtggggcgcgacgggaaccgggagtacatcgccgacgggttcgtgccctacatcaagggcggcccgcacgccaaacccggcgactccgactacgcccacggcgcctcggcgaccatggagtacgcgctgtccgacgccatgctctcccggatggcgcgcgacctgggacacgacgcggacgcggagcgctatacggcccgctcgcggaactaccgcaccctcttcgacgcttcgacgggcttcttccgggcccgcgacacctccggggcgttcgccggaccggccgaccccgccgacagcgagggcttccacgagggcacggcctggcagtaccagtggctcgtgccgcaggacctgccgggcctggtcgacctgatcggcggcaagcaggcggccaacgaccggctcgacgcgttcttcgcctacgagcagctcctccaggacccggcgcggacggcgcgcgaggtatgggtcgacggtccgtacgagtactacaactccgacaagtacaacccgcagaacgagcccgacctcatcgccccgtacacctacctctcgaccggccagccgtggaagacgaccgacgtggtgcacgccgcgctgaccctcttcaccgacacgccgaccggcatgaccggcaacgacgacctcggcacgatgtccgcctggcacgtcctgtcgtcgatcggcctcttcccggtacagccgggctacgacacctggggcctgtccacgcccgtcttcgagcgggtcgacctcaggctcgaccgcggctactacccacgcggcacgctgacggtgacggcacccggtacctcggaccgtgaccggtacatccagtcggtgcgcgtggacggtgcgtcgcacgatcggacgtatctgacgacccgtgtcttgcgcggcctggaagcgctccacttcgcggtgggagcgcgtccgtcggcgtggggtacggcgccgcatgccgcgccacctgcactgaagtgacctcggccgtccctgagtcccgcccttcgcagggcgggacttaatctgatgttaactgagcgtagcttgatcgtgcttgaccgtaatcgtcggtcaggggttgactgctgctcacccatcgtcgacacgagagcaagccattgacctctgacctgctcgccccactcgacctggcgttctggaacatcgagtccgcccagcacccgatgcacctcggcgccctcggcgtgttctcgtgccactcgcccaccgccggcgcccacgccgccgacctgctcgcctcccgcgccgccgcggtacccgggctgcgcatgcggatccgtgacgtctggcagccgctggccttcccgctgaccttcccgctcccgttcggcggcgcgacccgcgagcccgcccccgacttcgacccgctcgaccacgtacgcctgcacgcgccggccgccgacttccacgccgtcgcgggccggctcatgcagcgcccactggagcgcggccggccaccgtgggaggcgcatgtactgcccggggaggacggcacgtcgttcgccgtgctcttcaagttccaccacgcgctggcggacggactgcgggcgctgatgctcgcggcggcgctcatggaccccatggacatgccgacgccccgcccgcgtccggccgagcccgcgcgggggctcctcccggacgtgcgcaaactgccggagctgctgcgcggcaccctctccgacgtgggccgggccctcgacatcggcgcctccgtcgcccgtgccaccctcggcgcacggtcgtcgtccgcgctcacctccgagcccagcggcacccgccgcaccgcgggcgtcctcatcgacctcgacgcggtgcaccgcgtccgcaagaccgtcggcggcaccgtcaacgacgtactcatcgccatcgtcgcgggcgccctgcgtacctggctggacgagcgcggcgacggcagcgcgggggtcgcgccccgcgccctgatccccgtctccaggcgccgcccgcgcaccgcgcacccacagggcaaccggctctccggttacctgatacggcttccggtcgacgaccccgatccgctcgggcggctgcgcacggtgcgtatggcgatggaccgcaacaaggacgcggggcccaaccggggagcgggcgccgtggcgctgctcgccgaccacgtgccgccgctcggccaccggctgggcgggcccgtggtcggccaggcggcccggctgctcttcgacatcctggtgaccagcgtgccgctgcccagcctcggcctgaaactcggcggcagccccctcacggaggtctatccgttcgcccccctggcccgcgggcagtccctcgcggtcgccgtctcgacgtaccgcggacgcgtccactacgggctcgtcgccgacgccaaggccgtgccggacctcggccggctggcgcgtgcggtgaccgaggagatggagacgctgctcactgtctgcggcccctgacgggctgtcttcggcccctgacgggcccgccgccgcctccgtgatcatcgcgggtttggtacctcggccccgcgctttgtaaaattcgccgttcgaaagcgagcgcggtccgagcgccgcgcgggtgacccgaggaacggcagcgcgatgacggtgacagaggacggccccgtgggcatggacgaggtggcagacgcctcctacggtcccggcatcgacccggagcggctggccgtctgcctcggcgtgctcgacgagctggacaagctggaggtcgaccacccggacgcgatcgccgtgcgccgggccaccgcgggcgtctaccgcacggtcaagcagcgccgccgccaggagcgccgagccgccaagaccgcgcacgacaaggcggtcaccgaagccaccgcgaccggctccgcgcagcgcatcgacgacgagaccgagggcatcctgccgtcgtcggtgacggacgagggacagatcgcggggatactccagcgcccgcgctcctgctacatctgcaagagccgctacaccgaggtcgactacttctaccaccagctctgccagggctgcgccgccgagaaccgcgcccgccgcgacgcccgcgccgacctcaccggcaagcgcgcgctgctcaccggtggccgcgccaagatcggcatgtacatcgcgctgcgcctgctgcgcgacggcgcccacaccacgatcaccacgcgcttcccgaacgacgcgatccgccgcttcaaggccatgcccgacagcgacgagtggatcggccgactgaagatcgtcggcatcgacctgcgcgacccggcgcaggtcgtcgcgctcgccgactcggtcgccgccgcgggcccgctcgacatcctgatcaacaacgcggcccagaccgtacgccgctccccgcaggcctacagcgagctgctcggcgccgagtcgggaccgctgccggcgggcgagctgcccccggccgagatcatcggcacgttcggctccggcgccgtggccgccctcccggtggccggcggcggcgcgctgaccgcgcaggacgtcaccgacctcgcgctgatctccggctccgcctccctggagcggatcgcggccggcaccgcgatcgacgcgggcgggctcgtgcccgacctgcacgacaccaacagctggatccagtcggtcgaggaggtcaccccggtcgaactgctcgaggtgcagctctgcaactccacggcaccgttcatcctgatcagccggctgcgcgcggcgatggcggccgcgcaggccaagcgcacgtacatcgtgaacgtctccgcgatggagggcgtgttcaaccgcggctacaagggcgcgggccacccgcacaccaacatggccaaggccgccctgaacatgctcacgcgcaccagcgcccaggagatgttcgagaaggacggcatcctgatgaccgccgtggacaccggctggatcacggacgagcgcccgcacccggacaagatgcgcctcgccgacgcgggcttccacgccccgctggacctcatcgacggcgccgcacgggtatacgatccgattgtgcgcggtgagcagggcgaggacctgtacggcgtcttcatgaaggactacgcgcccgggaagtggtgacccgccgcccctgacgtgtgacctggcgaccgccgggaacccgggctctgtcgagagccgtgcaaggagttcccatggccagtccacacgacacagatccgcacagggtcgacatggacccgcgcagcgtcgacgacccgcgcaacgtctgtccgagcgacgccgacttctacgcgagcgaccgtccggcccaccctttgctgccggaggaccgtccccgcggcggtgggcccgcgacgccgctgaggcatcgcgggacctgggagacggtcgcgctcgtcgccgccgtcatcctggtgatcatggtggggatcgctctgttcccctgagggccgcgttcccgcgcggggccgcgttcccccgaggaaccggacgacgtcctcacgagtgaggtggtgcgtatgaccgcagccgctcctggacggcgtacccgtccgcggagtacgccgtcctgacccgcgtaccgccgtcgaccagcagatcggcgccggtgatccattcggccgcgtccgaggccagccagacgacggcacgcgcgatgtccgcggggtgaccgatgcggccgagcggaagcccggccgccagttcgtcctcgccgtgctcccacacgaatcgggccagctccgtgcggacgaggccgggggagacggagttgacgcggaccttcggggccagctcgcccgccagctgtcgcgtgaggtgcagcaacgccgccttcgtggtcccgtacgcgccgacgttgggtccgacgtgcccggcaccctccgtgcagatgttcaccaccgctccgccgtgctcgcccatccaggcccgccaagcgcactggaccagccgcaacggggcctcgacgttgatcgtgaacgcctcgcgccagcggtccgggtcggcgtccatcaaggggccgtacggctcgttggtcgccgcgttgttgaccacgacgtcgagccgtccgaacgcggcgagcgccagttccgtcagctcccgcggatgcgccggatcggcgacggaacccgcgagccccacgccgcccagctcctcggcggcccgacggaccccgtccgcgtcccgcgccgtgacgcacacgtgcgcccccgctgccgcgaacgcctcggccacggcccgcccgatcccgcgcgaggccccggtgacgacggcgaccctgccctcaagcccgtacggcgacgtcatccgcgtaccgtctcatgacgggccgtcagccaacagcccccggctgtggacgcgtcggcgggccggccgcatccagtcgcggcggaccggccgtacccggccgcgagttgcgggccgccaccagctccagcaccgtgcgccagtcctccaggacgccggcgtccaggccgggcacccggcccgattcgtccgcctgccgcagcgccgccaggtcgtcgtcgagcgagtcgtccgcccaggccgcggcgcgcagacggacgagccgggagacccggtcgccgagcagtgcacgtatcgcgtcggccgcgcggtcggcgtgcccggcctcgtcgccggggtccagcagctgcccgatgtcgtgcaccaggcccgccacctggagttctttgtcggccggacggcttctgcgcagcagcgcggcggtctgcagggcgtgctcgtgcggatcgaccgggtcgccgacggggggcccgccgcccgagccgggccgggaacgggggagacccgaggtggcccgggcaccccggcaggcgtgcagcagatccatcagctcctcgacgctgcgcagctccatgcgtcagtcctcccgcgagaaaagccgttgccgaccgtcagcagaacatgtccggtttgccacgcggccaacggagactgaactgcgaaccgagtgcggtggtgggtgcattcggaccgccgcggcctcggcgaggcccgccgaccaggggggtgcgccgttcgatcgttgagccgtacgggtgactgaaaaccagggcgaaatctgccaagagcgcccatatgatggccgaatgagtactgaacgactcgagacggttacctcttgttttcagccccatcgagcgggtgcccgctcatttggttaatctgtaccggacggacagcctgactgggttccacccacacccacagtccgtcccgggacaagccggtcaccacggcctgctctcagacgagttaccggcgccaccgcgtccgaactgctctcgactcagacccgagcgggcgtcaggcgcacagcagtggactgagcggccagtacgtcccgagggtgatccgacacataaggagtgcgcggtgacaccggagaagaccgatcttgatgagcgccccaaggaacgcaacgagggcgcgagcggtgggcccgagaagaagctcggcagcctcgacgtgtggtcgaggtccgccccgatccggctggcgggttacgaggacgacctcgccgagccgcacatcctgcccagcgtggactgactctccgcaggactcactcgtgctctccggacaggactccttcgtactctccggacaggaccctcaccgaacgctgacggcatgggcgtgccagactcacgcccatgctgatcagagaagccgcggccgacgactggccgcggatctggcctttctggcaccggatcgtcgccgcgggagagacgtacgcctgggacccggccacctccgaggagcaggcccgcgccctgtggatggcgcccggcaagcgcgtgtacgtcgtcgaggacgagaccggagcggtcgtcggctcggcctatgtcaccccgaactacggcggcccggccgcccgcgtcgccaacgccggcttcatggtcgaccccgaccacgccgggcggggcatcggccgcgccctcgccgaccacgtactcgccacggccaaggccgacggctaccgggcgatggtgttcaacgccgtcgtcgagaccaaccccgccgtgcagctgtggacctcactcggcttcaccgtcctgggcaccgtgccggacgcgtacgagcacccccggcacggcagggtggggctgcacatcatgtaccgggcgctctaggtctgttgcgcggatcaggaagtggcgttcgcgtcagccggccacccgcaccaccgccgtcgcccccgcgcgcaccgtcggcgtcgcgtacgtgtacgtcacgccgtcgaccgtcctggttcgcgcgcgctgcgggacaccgttgaccgtgatcttcttgtggaccccctggaagcgggcctcccagtggtaggcgcccttgcgcgcgttgttcgtcagcgtggtcttcgtcgcgccgtcgtgccgcacggtgatcgtgctcgtgccgatgggtacgtccgccgtctggagccacttcatgccggacggcagtcgcgactgcgtggtcaccttgtggttcgccgcgtccggtgcgatgcccatcaggccctcgacggtctggctgaccagagtgaacgacacctcggggtagtcaccgttggggccctggctggagttgacgtgctggagttcccgctggccgtagatcttcttcatccatgtccaggcggtgtcgttgcggttgttcttgaagaacatgtcgggcaggtacgtcgtcgactcgatgttgggtgacccctgcggccccagctcctgcgcctcgatgtagtcgagataggcgtcgttgcgcgggccgggatcgatgatctgcttcatcggcacgaacacgctgttctccttgccccagccggtgaccggggtgccggacgtggtgtacgcgcggaccatgtcggctccgcttccgcccccgctccagtcgtcgttgtagtacgccttcagatcggcggcacgccggtcgtacgccttggccagcgcggtgtctcccttgccgcgcgcgagcgtggccatcgccagatacgcctggtactgcgaggcgatgccgtccccggcctcggcgaggccgtcgccgtcctgctcgttgtagctggcggcgccggagaagatgccgttgcccgtgccctcggcgaccttgaccttgccgttgggcttggcggagttgtgcaggtcgatgaactcctcggtggagtgccggtagaagtcccacagcgccgggtcgtcgacgtatctccggtcgccggtccagaggtacgcctgggccgccttctcgacgagttcgaagacggccggtacctcgcgcacgaagttgtccgggctcttgtagtcgatgctcaggtaggtcttggcgtcgaagttgagggaccacaccgggaagtacttgtgcgcggcggtggccgacgacgcgtacgaacggagcatcgtctcgttctcggcgtcgaggccgatgatgtgggcaccggcgagctggtgggtcatgtcgcgggagtagtaggcgctgcggttggcgtatccggcccagtagccggccgcgtacggcgcggtgccggtgccgccggtctggtactcgtcgacgttgaccgggcccgtcgtgccgggtagctgcacccagctgttggccttcttcttggcccagccgaacatctcgacgacctcggggtcggacgaggtgaccttggggtcggcgggcgcggcgggggagatcatcaggtcgtcggcgttgacccaactgctgccggagccgaaggcgatctccagccggtcgccggtcttcagctcgacacggctgatggtgtaccgggcgtacgcgcggcgctccggcagggtgatcgtctcgacggtctcgtcgttgcgccggaccgtgtacgtgccgccggtgccggcgctcccgacccacgcggagaagtcgtaactgccgttccggggtgcgacgagggtcagcttcgcgctcttgccggctccggagtcgaggtagaggaagcgggcgccgccgtgggagttgccggtgccgaccccggtgcccgcgccgaaggtccagcccgtgccgccgttctcgaagcccgggtcgtcgagggtgagttgggcgcgggcggcggaggcggtgttcgctgcgggagtcgcgccgtctcccggcgccgccgcggccgacagcgcgggggccatcggcgcgagcagggcaacagcggtgagcagcatgagccttgagggcttcatcgggtctcccggtcttcggttacggcgggtggggcggccgagtggtggcggaaagctagcagggcccgaagcagcgattcaatggtcatgcgcaagaaacatgcaagtcacgcagcctgagtgccatgttgagtgttcagtgaggcagaaagttttcatcgatatcttgcaagtggcttgggcgcttgttagcttccagccgcgccacaagagccgcgcacccgccggacccccggagcagccatggacgcctcacccctgaaccagccaccgccggacgagccgccccgaaacggtctgaaccgacggcgcctgctcgcgctcagcggttcactgctcgccgccggagccgggacctcgctgctcggcgcctgctcggtgaccggcgccaccaaggcggggagcctcggcgacccggaccgggccgcgatcaccgtctggagctggcagggccccgccgccgccatgaaggctctggtccccgccttcgaggcgcggcatcccgggatcgacgtcaccgtgcaggacatcggaaacccggcgatctgggacaagatcaccacggccctggcggccggcgggcagggcctcgcggacgtcctgcacatcggcgtcgactatctcccggcctacaccgagaagttccccgaaggcctcgccgacctcggcccgctcggcgccgaccgctaccgtgacgccttcgccgacggcatgtggcagaccgtcacccgcaagggcaaggtcaacgcccttccctgggaggccaattcggccggtttctactaccgggccgaccttttcgaggccgccggtgtcgacggcgaggcgctggcgacgtgggacgacgccatcgacgccgggaagaagatcaagaagaggaccggagtccatctgctgggcatcgacaagcccgcgtcccagccggacgccgccaacttcttccagatgctgctccagctccagggcacgttctacttcgacgccgagggccggatcaccctcagctctcccgaggccgccaccgcgatgaccctcatcaaggagatgaacgacgccggcctggtcagcgatctggcgggcggctggaccgcgctggagagctccatcaagtccggcaccgctgccgtactgccctggcccacctggttcggcagcatcatcgagggcctggtccccaaggaatccggccagtggaaggtccgcctcccaccggcggtgaagcccggcggcaccacggccgcgaccgtcaactccacccatctcgccgtcgccggctccagcatgcaccaggccgccgcctgggcgttcgtcgagtacgtcctgaccagaccggcgtcgcaggaggcgatctaccgcagcaagggcatcgcccccgccctgctccaggcgtacgaggcccccgtcttccacgagccgtcgacattcttcagcggccagcacaagggcgagatcttcctcgacgccctcaaggcgcgctcgcccgccgtcaattactccgccgactacgcccgcgcgctcaagacggtcgccgacgcgcagacccaggtgctcctcaagggggccgaccccggccgcgcgctgcacaacgccgccgaccagctcgcccgccagaccggacgggagctcgcctcatgaccacgaccaccaccgccgagggtgtcctgaaaaccgccggcgccgcccgcccggcggccgcgtcccgccccaccgcgcggatcctgcgccggcgggccgtcccgtatctcttcatcctccccgcgctcgtcctcttcgcggtcttcaagctgtacccgatcggctcgtcgttcctgatgagcctgtacgagaacgtcaacggcacccaggagttcgtgggcgcgggcaactacacgcgggcgatggacgatccgctgctgtggaccgcgctgaagaacaccgcgatcatcctggtcgtccaggtgcccgtcatgctggcgctggccgtcggcatcgcggtcgccctcaactcgaccctcctgcgcggccgcgccttcttccggctcggcttcttcctgccgacggtgaccggactggtcgcgtacggcatcgtcttcgccgtcctgctcaacacccagtacgggctggtcaactggctgctcggcctggtgggcgtcggagaggtcccctggctgaccgacccgctgtgggccaggatctccctcggcctcgcactgacctggcactacaccggctacaacgcggtgatcttcctcgcccggctccagtcgctgccgaccgagctgtacgacgcggcggccgtcgacggggcctccgcccggcagtcgttccgccatgtcacgctgccggggctgcggcccgcgctcctgctgacgacggtgctgtccaccatcggcacccttcagctcttcgacgagccgtacgtcctgaccggcggcgggcccgacaacgccaccctcaccatcggcgtgtacctctaccagaacgctttcaagtacttcgacttcggctacgcctcggccgtcgcgtacatcctcaccgtcctgatcggcatcctgggcgtcgtgcagttccgcctgctgggagagaagtcgtgaccctcaccgccacccgcccgcggcccggccgcacgccccgcacaccccgatcccgcacccgcacgcgctcgatcctgctgacctcctcactgaccatcgccgtggcggccgtcctgctgccgttctactggctgatcatcgccgccacccacagctccaaggagatcttcgacagcccaccgccgctgctgcccggcgggcacctgagggagaacctctccaccctggagtcgtcggcgcggttcagcgacgtcatcgtcaactcgctgctgatcacggtcatttacacgatcgccgccggagcgatctgcacgctggccggatacggcttcgccaagttccgcttccgcggcagcggcgccctgttcgggctgctgatgctcgggctcgtcatccccacccaggtcacactgatccctctgttcaagatgatggtcgacctggagtggctgggcacctaccaggccgtcatcatgcccaatctcgccctgccgttcgggatcttcctgatgcggcagtcgatggccgcgctgcccgacgaactcatcgactccgcacggatggacggctgcggggagttcaggctcttcctcaaggtcgtgctgccgccgatgaaaccggcgctcgcggccctcgccatcttcctgttcctcttccagtggaacgacttcatctggccgctggtcgtcctgcgcgacgccggcgagttcacgatccccgtcgcgctggcgtccctccagggcctggaccagaccgactacggcgccctgctcgccggcacggccctcgccgcgatcccgatggccctcgtcttcctcgcactccagcgccacttcgtctccgggctcctcgccggggccgtgaaggaatgatccccgcgatgaccctcagcaccacccggcccgtcaccacggccgaactcccctcggcgcgctacgagccactcgtcgacggcgtccgtatcgcggtcctcacccacgcgcccggcgtcggcgcgcgctggacggtttgcgaactcggcgacgggctggccctgttggagatccggacggacggcgggccggcaccgacggaggtgcggatgagcgtgccgctcggcgacgcggccggctactggcacccgggcgccggctgggagcgcaccctcgtcgccgactgggcgggccgttcgcgcgtgagcctcgtcgacggcaccgccgccggctgtctctacgaccacgacggccgcacgcggctcaccttcgccgtcgccgacccggtccccgagaccgatgtcgtcttcggggtctcggaggagaacgacacccatgtggtgcacctgcacctggctcccgcgcccgacggcggcccgcgtcgcgtcctgctggcccgctcggcgcccacggtcgcgacggccctgcgcgggctgcggcagtggttcgccgcgcagccgcagtgcgcccccatgccggtccccgacagcgctcaggcacccgtctactccacctggtacgccttcaaccagcgcgtggacgccgcatcggtcgaggccgaggcccgcgtcgccgcctcgctcggctgcgaggtgctcatcctcgacgacggctggcagaagtacggcagcggtcgcggctacgccggatgcggcgactggcgccccgacccgacgacgttccccgacttcgccgcgcatgtgtcggccgtgcgggcgcagggcctgcgctatctcgcgtgggtcgctccgctgctgctcggccccgacgcggactgcgccgagcggctcactccctatgcccccgcgcccgccggtgtcccgggcgcccaggtcctcgacccgcgccgccccgaggtccgcgaccatgtcatcagtctgtgcacccggctggtcgccgaccacggcctcgacgggctcaagatcgactttctggacgaggccatggcgtaccgcggcgacggcgcgtacgcccaccacgaaggcaccgacatcgacgatgtcggccgggccatgaccgtcctgctcaccgacctgcgcaccgcgctcgaagagctgcggcccgacggcggactgctgctggaactgcgccagccctacgtcggccccggcatggcccccttcggcaacatgctgcgctccttcgactgcccgggcgacgccaccggcaaccgggtgcgcacgctcgacaccgccctgctcgccgtcggcggcgcggtccacggcgacatgctcctgtgggaccgcgacgcgcccgcgcacgcggtggcacggcagctgatcggctccctgcactgcgtcccgcagatctccgtgcggctgaccgagctgtccggcgagcaccgcgagacgctggcgttctggctcgccgagtggcggcggctgcggccggtgctgctgcacggggacgtggaatccggccggcccgacgagctctacaccctggtcaccgcggcccgggggagggcctgtgtcaccaccgtgcacagcgaccggatcgtgcccgtcgacaccaccgcgtacgacgacatcaccctggtcaacggcacggcgtcggaccgtgtggtgatcgaggtgaccggtgggcagcgccccttgcgcatgaccgtccgtgacgagcgtggacgtatcatcgacgactgcgaacggtcgccggcaccggggctgcacatcgtgtccgtaccgcgctcggggctggtggcactacgggtgacggagggaaccgtatgaaggtcggcatcaccgaggtcgcggaccgggcgcaggtgagcgaggccacggtcagccgtgtcatcaaccggcgccagggcgtgtcgcgcaagacccgcgaggcggtcgagcaggcgatggccgacctggggtacgagcggcagacgcggggtcagctcatcgcggtcatcaccgagtacgtctccaacccgttcttcgccgacgtctgcgaacggatcgagtccaccctcgccccgcacggcctgaagacggtcctgtgcccgtgcttccccggcggagtgcaggagctggacttcgtgacctccctcgccgaccggggcgtcgccgccgtcgtcttcctctcgtccagcaacacgatcgagggcgcggacccggaggcgtacgaactcctgcgctcccgccggatcccgttcgtcggggtcaacggccagttcgagggcgtgagcgaggcgccggtcttctccaccgacgacctgctggccgccgaactcgccgtcgaccacctttaccggctcggtcaccgccgcatcggcatggcatcgggcccggtcggcaaccgcccggccgaccgccgcgtcagcggcttcgtctcctcgctcgccaggcgcggtgtcgaggacccggagcagtgggtggtccggcagtcctacaccgtcgagggcggccagtccgccgcgatctcgctcctcggccgcggcgccacggccatcgtcgccgccagcgactacatggccctgggcgcgatccgcggcgcgcgccggcaggggtacgacgtcccgggcgacgtgtcggtcgtgggctacgacggcgccatgatcatggacttcgtcgaccctccgctcaccacggtccgccagccggccgaccgcctcgcctcggaggtggcccgcagcatcctcgccctggtcggcaaccgcgacgtccccgtcggcgaactcctcttcgaccccgaactggtgatccgtgcgagcacggcggcgccgagggcggagtgaggcgtcggacctcggtatcagtggcgactgctcgtccagaccattgacctagacatcggatctatggagactctgcacggggttccaatcgagatactggcggcaactccgcgtattcattggatgtttcgtggctcacggatgctccggaggggctatgtctcggttcgtgtttcttggggtggcactcgcgttgctcggaggtgccaccagtcctgccgccgcggcgccgagggtgacgccggtggtggtcgacgtggacgactacggagccgaccccaccggccggacggactcgacgcccgctgtcgccgcggcgctgcggcacgccaagagcgtcgaccggccggtcaggatcgtcttctccaagggcacctaccagctgtaccccgagcgggccgagacgcgtgagctgtatatgtccaacaccgtcggcgccgaccagcgttaccgggacaagaagatcgggctgctcgtcgaggacatgcacgacgtcaccgtcgacggcggcggggccaagctcgtccaccacggtcttcagacggcgttcgcgtcgatccgctcgaccgatgtgaccttccagaacttctccttcgactacgcggcccccgaggtcatcgacgcgaccgtcgccaccaccggtgtcaccgacggacacgcctaccgcgttctgaagatccccgccggcagcccgtaccgggtgaacggcacgcacatcacctggctcggcgagaccagtcccgccaccgggcagccgtactggtcgggtgtcgacgggctccagtacacacagatccacgaccccgaggcgcaacggacctggcgcggagacaaccccctgttcaacgacgtcgccgcggtcaccgacctcggcggccgccggatccggatcgactacaccaccgcggcgcggccggcggacgccgggctcgtctaccagatgcgcctcatcgagcgaacggagccgggcgctttcatctgggagtccaagaacgtcacgatgcgctcgatgaacgcctactacctacagtccttcggcgtggtggggcagttcagcgagaacatctccatcgacaaggtgaacttcgcacccgatccgaggtccggccggtcgacggcctcgttcgcggacttcgtgcagatgtccggcgtcaaggggaaggtctcgatcacccggagcctcttcgacggcccgcacgacgacccgatcaacatccacggcacctacctcgaggtcgtcgggaagccggggccgtccaccctcaccctcgcctacaagcacccgcagaccgcgggattcccacagttcgccccgggtgacgaggtcgagttcgccaccaagcgcacgatgaccccgctggcggacgcgcacgcacaggtcaccgcggtcgacgggccgagcggcatggaccacacgaaaccgctgaccacgatgaccgtcaccttcgaccggccggttcccgccggggtcgagaccggcggcacggtcgtcgagaacatcacggccaccccgtcggtcgtcatctccggcaacgtgttccgcaacgtgccgacccgcggcatcctggtcaccacccgcaagcccgtcctcatcaccggcaaccggttcgacgggatgtccatggccagcatctacgtctccgccgacgcctaccagtggtacgagtccgggccggtcgccgacctcacgatccgcgggaactccttcacgcggcccagtggtccggtcatcttcgtggagccgaccaatcaggtcatcgacccggcgaccccggtgcatcacaacatctcggtcgagcacaactcgttcgacatcggtgacgtcaccgtcgtcaacgccaagagcgtcggcgggttcgctttcaccggcaacacggtccggcggctggacggagcggatcacccgccgtacacctcaccgctgttcgtcttccacggcagttcaggcatccggatcgcacgcaaccactacgacaagggcctgaacacctccgtggtcacggactagcacgggaacggtgtactagggcccgcttcagccgagcggggccgtgcgtcgccaggggtgcagttcctccaactggcccgccagggcgaggagatcgagctcggaaccagggcgtcccaccagctgcacggcaccgggcgcgccgctcggcagtgtgccgaacggaaccgacagggcgggccagcccgtgagattccagggcggggtcagcggcgagtaggtggtgttgaccagcagattgcgcagccagccccgctcgtgccaggccgccgcggcggggccgcgccgggcgagggcgggggtcagcagcacgtcgtgctcctcgaagaacggcgtcaggcgctcccgcaactgctcccggcgtgcgccgccccgcaccgagcgcacaaagcggcgccccaccgccgcgtgcacccgcgtgcgccgggtcagccgccgtacatcgaggtcctcggcgtccaccgcggtgcccgccgtccagtgtgcgagcgaggtcgtgctcagccacagggggtacgggggatcggcacgccgcacctggtgaccggccccggccagcaactcggcggcctcccgggcggcggacgcgtacgggcggccgacggcgacaccggccagcggactgcggaccgagagggctatcgtgcgggtgccgggcccggacgggcgtatcgcctccgtctccgcgaccgccgtgaccgtcccggccagcaccgcgaacatcagccgggcgtcctcgaccgtggtcgcgagcgggccgttctcggacatgccgaaccagtcgccgtttccgatgcccgccggcaccgtcccgtaccccggcttcaggccgacgagaccgcagttggcggcggggatgcgcagggagcccatcccgtcgttgccgagcgcgatcggcaccatcccggcggcgaccgcggccgcgctgccccccgaggagccgcccgccgtgcgcgaggtgtcccacgggttgcgggccgtgccgtgcacgccgtccgtggtgccgaacacgcagagctcgggcacgttcgtcacccccacgacgacggcacccgccgcacgcagccgggccaccgtgacatggtcgtggtcggccggggtgtcgggggtggccgcggagccgtggcgagtggactcgccccgtacggcgagattgtccttcacggccacgggcaccccggccagggggagttcggccaggtcggtgcgggacgccacctcgtcggcctcggccagggccgcgtccgcgcgcacccggcggaaggcgccgacgcgggcgtcgagccggtcgatccgggcgaggtgttcggcgaccacctcacggggcgtggcccgcttctcgcgtacggctgcggcgatctcggcggcggaaaggccgacccagctggtcacgggcgctccctgtcggtgtggtgcctgaggtgtgtggtgccttgggcgtggcgcggtgcctgaggtgcggtggcgggtcgtactcgtgagtacgaggagcactgtgccgtgccggcggcgccacgtcgagagcggcgacccgtagcacggagtccgggctgtaccgctcgcgggccggacggcaggcgctggggacaggcggcgcacgcaccgtccacccccagcgcccccgtcaagccccgcagggccccgtgctgtcccgttcgatcagccgtggcaccggcacctggaccgtgcgcgccgggccgccgtcgagcagcgcggtcagttccgtcgccgccgtacgcccgaactccaccgtgtcgcgggagagcgcggacaaccacggcttgaccatgcggcacagcgcggagtcctcccaggacaccaccgagacgtcggccggcaccgagaagcccagttccgtggcggcggccaccccggcgagggccatcacgtcgttgtcgtagaccagcgcggtcgggggagtgccgctctccaggacgcggcgggtgacggccgcgccctccgcgtccgagtagtccgtgggcaccgaccgcacctcggccagtccgcgccgcccggcctcggcccgcagcgtacggatccggcgctcggtgtgggcgaggcccggcagacccgcgatgtgcacgatccggcgatggccgagggtatgaagctggtccacgactgacgccatcgcccccgcgtcgtccgcccacaccgtggacagccccggatgcagggcgtccgggacgccgccgatgaccaccgcgggcagccccagttcgtcgagaaggccggggcgcggatcgtccgtacgggggtcgacgaccagcacgccgtccacgcggtgctcggcccaccagcgccggtacaccgcgcactcgtcggccacgtcctcgaccacctggaacagcaggccgagatgacgctccgccagcacctcctggatgccggagatcagctgaaggaagaacgagtccacgccgagcgtgtcggcgggccgcgccacgaccagaccgacggtggcagacccctcgccggacagctggcgcgccgccgtgctcggccgccagcccagctgctcggcgacccggcgcacccggtcgcgggtgacctcggagacccctggccggccgttgagcgcgaaggagacggcgctctcggagaccccggcgcgctgtgcgatgtccttcatcgtcggccgacgcgcgggagaccgcttggctgacaaacttgctctccattccctggagccggtgcactaatgcgcttgagtgccagcactctaaagcgcattagttgtccctggcaagaggctgatgaaaagcccctgacctgcgcattcaatgcgctcaagaatttagctcgaccgaatccattgacttccaaaggggcgagcctgcaaggtctgcgacggcacccgttcaccccgccgcagaggagcccatccgtgcgcatctcccgcagaaccttcgccgccgctgccgccgtagccgtcgtcctgccgctgagcgcctgcggctcaggggacgacggcggcggctcgacggacgcctcgggcaaggtcgagggcaccatcaccttccagacctggaacctacgggccaacttcaagtcgtacttcgagggcgtggtctccgacttcgagaagaagtacccggacacccaggtgaagtgggtcgaccagccggccgagggctacgccgacaagatcagcgcggacgcggccggcggcaccctgcccgacgtcgtcaacgtctcgccggacctggtcgcgccgctcgccaaggccgggctcgcgctcgacctcgacaaggcggccgcgaagtaccggaaggagtacctgcccggcgcctgggccagccaccggataccgggcatgaccggcacctacgccttcccctggtacctcaacaccggcccgctgttctacaacaagagcctcttcaaggacgccgggctcgacgcctcgaagcccccgaagacctacgacgaactgttcgccgacgccctccggctggcgaagaagagcaagggcgaggtcgccacgctcgccaacgtgcccaccatcgaggacttcggccgctacggcgtcgagctgatgaacaaggaaggcaccgccttcgccttcaacgacaccaagggcgtcgaactcctcaccaagtacaaggagttgtacgacgccaaggcgctcgacccgcaagtactgaccgccaccccggagtcctccggcaagaagttcctcaccggggccgtcgccatgaacccgggcagcgccctggacctcggaaacttcaagaagcaggcgcccaacctgtacaagaacatcggcatcacggaccagatcaccagcaccggcaaggtgaacatgtacgtgatgggggtgatggtcaactcccgttcccagcggaagccggccgccgtcgccttcgcgcactacgtgaccgacgcgcagcggcagatgtcgttcgccaagaaggtcgcgatcttcccgagcaccgccggctccctcgacgacccgtacttcaccaaggaggacggcacggacgagacgcgggtgcggatcgcggccgccgcatccctgaagaacgcggtcaattacacgcccgtactgttcagcgagcagatgaagaccgcgctgcgcaacgaggtcgccaaggcgctccagggcaaggagagccccaaagcggcccttgacaacgctgtcaaggcgtgcgaccggcttcttcagcagcagggctgacgcgccatggcgagttccaccgtgtcgagggtgcggcgccatctccccaccagcccctggctgttcgccgcccccgggctgctggtcgtaggcgtcttcgtcctctatcccttcgtctccacgctggtcaacgccttcaccgaccgtcggacgctgatccccggccggttcgtggggctcgccaacttccgcgagctgctgcacgacgacatgttctggatcgggctgcgcaacagcgcactgtacgtcctcggggtggtccccgcgctcgtactcctgccgctgctgctcgccctgctcgtccagaagaacatccccggcatcggcttcttccggtcggccttctacacacccgtggtcgcgtccatcgtggtggtcggtctgatctgggtgtggctgctggacgaacgcggcctggtgaactcgctgttggagacgatcggcgtcggcagggtcggctttctcagcgaccagtggctgctcctgctgagcgccatggccgtcacggtctggaagggcctcggctactacatgatcatttacctggccgcgctcgccaacgtaccgcgtgagctgcacgaggccgcggcggtggacggggccggggcggtacgccgcttcctcaccgtgaccgtgcccgccgtccgctccacgatggtgctggtcggcgcgctctcctcggtcgccgccttcaaggtcttctccgaggtgtacctgatggcggggcccgacggcggcccggcgggcgaggacaccacgctcgtgatgctggtccagcgcaccggcaccggcctgaccggccgcgtcggctacgcctccgccatgtccgtcgtcgtcttcgtggtcaccgtcgggctgatgctgctcgtgctgcgtgccgaccggaaggaggaggcgtgagcgtcctggagaaggtacgacccgtccggacaccggccgccgcccgggaaccccgggccaccgacgagcacggacgccggatccgcgtctgggaactggccctgcgctacctgctgttgctggccgtcctcgccctcaccgtcggccccttcctgtggcagctgtccacctcgctcaagggcccgaccgaggacatcttcagctccccgccgaagttcctgccgggcgatccgaccctgcacaactatcagcgggtcgccgacaccatccccgtctgggactacgcgttcaactcgctgaaggtggccgcggccaacgtcgtcaccaactgcgtgggctcggcactcgccggctacgcgctggcccggttgcgctaccggggccggcgcgtggccaccctggtcttcatcctggcgatgctcgtgcccgtggagggcatcatcatcgcccagttcacgaccatgcgggagctcggcctgaacaacacgctgatcggcgtggtgctgcccggctgcatcggcgcgatgaacgtcctgctgatgcgcaacgccttcctcaaccttccccacgagatcgaggaggccgcctacgtcgacggcgcgaacgcctggcagcggttcctgcggatcgcgctgccgtcggtgaagggcaccctggccgtcgtcgcgatcttcgccttcatgggcgcctgggacgacttcctgtggcccctgatcgtgctcagcgacccctcgaagttcaccctgaccatcggcctcaactatctgcacggcaccttcgccaacgacgaacgcgtggtcgccgcgggcacggtcatcgccgtggcacccctgatcgctctcttcgcctgcctccagcggtacttcttccgcggcgtgggcgagggcgccgtcaagggctgaccccgccagaccgggccgaaccccccgtcatcccgattcgctaggaccccccatgccctctgccgtgcgcttcggcgtcaactacaccccgagcgtcgggtggttccaccactggctcgacttcgacctcgactccgtgcgcgccgacctcgactcgatcgccgcactgggcctcgaccacatccgggtcttcccgctgtggccgtacttccagcccaaccgcacgctgatccgcccgcgcgccgtcgagcagctcgtcgcgctcgccgacgcggccgccgagcgcgggctcgacgtcaacgtcgatggactgcaaggccacttgtcgagcttcgacttcctgccggcctggacacagacctggcaccggcggaacatcttcaccgatccgacggtcgtcgagggagaggcggagtacctgcgcaccctcgccgccgcgctcgccgaccggccgaacttcatcggcatgacgatcggcaacgaggtcaaccagttcgcggccgggccgcatcccgacccggaccgcatcacccccgagcaggcgggcgcgtggctgcggcgcctgctcgccgcgtgcgcgcagggcgcccccgggaagctgcatctgcacgcctcgtacgacgccgcctggtaccaggacgaccagcccttcacacccggacactccgcccgtctgggggacatgaccgccgtgcactcctgggtgttcaacggcacggcccagcgtcacggccgcacgggcaccgccaccgagcaccacgccgcctacctcgtcgagctgtccaaggcctgggcggacgacccgcgccgcccggtctgggtccaggaggtcggcgcgcccgccccgctgatccacgccgagcacgccgccgcgttcaccgaggcgaccgtcgcgggcgtcctcgactgcacggacgtgtggggcgtgacctggtggtgctcgcacgacgtggcccgcgacctggccgatttccccgaactcgagtacagcctcggcctgttgaccaatgaccggcagcccaagcccgccgggaggaccctcgcccggatcgtcaaggagcagcggccgtacgcacccgccgtacgcaccaccgcgctggtcgtcgacaccacccccggccgctccgtctgcgcccccggcggcgccgtcttcgaggccttcgcccggctcaccgccgacggggcccgccccaccaccgttctcgcgagccgcgccgacgacaaggaacacctcgcggcccgtggcatcaccgctgtcgtcacccccgatcaggtcaccgagtagcccgtccccacgacgatacggagcacacagtgaacctcagcagacgcaccgtcctgctcgccgcgaccggagcggccgccggactcgtccccggcctgtccggtacggcgggcgcggccacccgcaacctccagccgtacgcctcctactggtaccccgactcgctgccctccggcaccccgggcaccggcatcacctggcgcagcctgaaggcctggcgcgccgagaacgacacggacctggcgttcaacgccgccgccgtgccgctcgccgcccgcttcaccccgacccccgccaacaccacggcccgctcgggccaggcccgcatccagtccctggtctccttcggacccacgtcgagcaaccccgcccagggcgcgccgaccgccgactactacgccctgacccactggtcgtacgtcgacgaactcgtcttctggggcggctcgtccggttagggactgatcctcgcccccaacgccccgatcgtggacgcggcccaccgccacggggtgcccgtcctcggcaacatcttcctgccgcccgtcgcgtacggcggacagttgcagtggacgcgcgacctggtccagaaggacgcgaccgggcactacccgctcgcagcccaactcgtcgcggtcgccgacgcgtacggcttcgacggctggttcgtcaacgcggagacgagcggcgggaacaccgccctcgccaccgacatgcgtgggttcctacaggagctgaaggcgctcggcacggcgaagggacagcgcgtcacctggtacgactcgatgaccgcgaccgggtcggtgagctggcagggcgccctgaacagccagaaccaggcgttcttccaggccgccgactcgatgttcgtcgacttccgctggtcgaagagcacgctggcctcctcaggcacgctggccgggcaactcgggcgcagccgatacgagttgtgggcgggcgtcgacgtcgaatccaacggaacgagcacctcggtcaactgggacgccatcgtcccgtccgcctccgcgcacgtcgtctcgctcggtttctacaggcccgagtggacccgcaaccacctgcccgcgaaccgcacacccggcgacttccacgcggccgacgacctgttctggacgggcgcgtccctcgaccccgcgaagccgaacacgaccgcgagctggcgcgcccccgcgctgcgcgtcgccgaccgctcgaccgtcgactcgctgcccttcgcgaccgtcttcaacaccggccatggactgaagtggtacgagggcggcgaggtcacctcggacacggcctggaaccacctcggactccaggaccgcctgccctcccgccgctggatcgtccggacgagcggcgcgcggccgtccgtcaccttcgacttcgccgacgcctggcgcggcggcagcagcgtgctggtcgccggcaccctcggcgcgccggccaccctggacctgtacgagacccggttgccggtcggttcctccgagacggtcgtcgagctgacccatcgcaccgacgcgggcagcgcccagatcgagctggcggtcgccaccgccgagccgagcgcccccgggcaggcgccgtcgtacacctacttcccggtgagttcaggcgacggctgggggacctcgaccgtacggctgacgggtctgtcgggcaccgtacgcacgctggccgtacggctcaccgggagcggctccccggtgagatggcggctcggcgcgctcgccgtcaagaacgccccggcggagcctgccgcccccaccggtctgcgcgtcaccgacgccgacggcggcagcctgcgcttctcctggcagcccgcggccggggaggtacgccactacgagctgcaccgcgtcctcgccgacggcacacgccgcttcctcggcggcacctgccagtgcgcgtactacgtcgccgggctcgcggccgagcagggcgagagcgccgcacggttcgaactgcgcgcggtaggggagctctacaccgaatcgaccgccaccacgaccacccacccctggtagccagcaccctcaccccacggagcactcccatgcatgacgaccgcaccctggtcgaagcccgcctccggcgcgttctcgacgagcgcatccgccccgccgtgtaccccgagtccgtaccgctggaggtggcggtgtggcacgcgccggacgagccggtgccggtcgccgaagggctcgccgccccggtcggcccgatcgcggcgggcgcacgctggggtgctccctggggcaccagctggttccgcgtcaccgggaccgtccccgaggcctgggccggcaagaccgtcgaggccctgctggacctcggcttcgacgagaacatgcccggcttccagtgcgaggggctcgtctaccgtcccgacggcaccccggtgaagggcctcaacccgcgcaaccagtgggtgcggatcggcgcacccgtcgagggcggggaagaggtccggctgcacatcgaggcggcgtccaaccccgtgatcctcgactaccacccgttcaggccgacccagttgggcgacaaggagacggcgggcagtgagccgcagtacaggctggagcgcatggatctcgccgtcttcgacgagacggtgtggcagctcgtcatcgacctcgaggtcctcggcgagctgatggccgaactgccggtggagtcggcgcgccgctgggacctcctgcgcgcggtggagcgggcgctcgacgcggtcgatctccagaacgtcaacggcacggcggcagcggcgcgcgcccggctcgaaggggtgctcgcggaacccgccgtgccctccgcgcaccacatcagcgccgtcggccatgcgcacatcgactcggcctggctgtggccgctgcgcgagacggtgcgcaaggtggcgcggacgacctccaacatgaccgcgctgatcgaggacgagcccgacttcgtcttcgccatgtcgcaggcgcagcagtgggcctgggtgaaggagcaccggcccgaggtgtgggcgcgggtgaagaaggccgtggccgagggacggttcgtgccggccggcggtatgtgggtcgagtcggacacgaacatgccgggatccgaggcgatggcccgtcagttcgtgcacggcaagcggttcttcctcgacgagttcggcatcgagaacgacgaggcctggctgcccgacacgttcggcttcgcggccggactgccccagatcatcaaggcggcgggctccaagtggctgctgacgcagaagatctcgtggtcgcagaccaacaagttcccccaccacaccttccggtgggagggcatcgacggaacgcggatcttcacccacttcccgcccgtcgacacctacaactgctccatgaagggcagcgagatcgcccacgcggcacgcaacttcaaggacaagggagtggcccggcactcgctcgcgcccaccggctggggcgacggaggcggcggcacgacccgcgagatgatcgccaaggcggccaggctccgcgatctcgaaggctcggcgacggtcgcctgggagacacccgcgaagttcttcgagcaggccgaggccgaatatcccgacccgcccgtctgggtcggcgagctgtacctcgaactgcaccgcgccacactcaccagccaggcgaagaccaagcagggcaaccgccgcagcgaacacctcctgcgcgaggcggaactctgggcggccaccgcggcggtccgcaccggattcccttacccgtacgaggagttggaccgtatctggaagacggtgctgctccaccagttccacgacatcctgcccggctcgtccatcgcgtgggtgcaccgggaggccaggaagacgtacgagaaggtcgccgaggagctgaacggcgtcatcgacgccgcgcagcgcgcgctggccggcgaggggacgacgccgctcgtcttcaactcggcgccgcacacccgtgacggggtgcccgccggcggtgcgcggaccccggccgtcgggggcgagtgcgcgctcgtgccccgcgcggacggcggttatgtcatggagaacgggcggctgcgggtcgagatcgacgcacacggactcgtggtctccgccttcgacctcgccgcggaccgcgagaccgtcgcaccgggccggccggcgaacctgctccagctgcaccccgacttccccaacatgtgggacgcctgggacgtcgacgagttctaccgcaacacggtgaccgacctggtcgacgccgacgagatcgcccccggtgaggacggcgtctcggtgcggatcgtccggaccttcggcgcgtcccgtgtcacccaggtgctgtcgctcgcgccgggggagtggcggctggacatcgataccgaggtcgactggcacgagaccgagaagttcctgaagctcgccttcccgctcgacgtgcacgcggaacgctacgcgtccgagacccagttcgggcacttcttccggccgacgcacaccaacacgtcctgggaggccgccaagttcgaggcgtgcaaccaccggttcgtgcacatggaggagcccggctggggtgtcgcggtcgtcaacgactcgacgtacggccacgacgtgacccgtaccgtgcgcgacgacggcggtacgaccaccacggtgcgtgtctcgctgctgcgggccccgcgcttcccggaccccgagaccgaccagggcgtgcaccggttccgacacgctctggtgcccggcgccgggatcggggacgccgtgcgtgagggctggcggatcaacgtgccggagcggaaggtcaccggcgggcgggaggtgacgccgctgctggccgtcacccaggacgcggtcgtggtgaccgcggtcaagctggccgacgacggcagcggtgacgtggtcgtccgcttccacgagtcccgcggcggccggacccgggccacgctcaaggccggcttcgaggtcgcggcggtctcggtgacggacctgctggaacgcccgctggcggacgcacgggagccggccgtggacggcgaccgcatcacgctgtcgctgcgtcccttcgaactggtgacgctccgcctccggcgcgcctgacactccctcggtgctgcggacccactttcgcaacaggccctacggcccgatctgggtccgcagccactcctccacctcgcccacatgcgcggccgccgccgcccgagccgcctccgggtcgtgggcgaccagggcgcggtggatcgcggtgtgctcgcggcgggtgcgggcgaaggcgccctcctcctggtagccgcgccagacccgggcgcggaacgtgcgggaggagaggccctccagaatcgccgccatcgtgtcgttgcccgcggcggccgcgatctcgcggtggaaggccagatcgtgggcgaggatctcctccggatcgtccgtcgcgttcatcgccgccaggtgcttctccacctcggccagctgatcgggcgtgatccgcgcggccgccagcgccgtcgccgtcgactccaggatccggcgcacttcgagcagctcgaccagctgcggaccccgcgagagatccgccacgaccccgaaggtctccagcaggtcaccggcgtccagctgcgtcacatagatgcccgaaccgtgccgcgcctccagtacgccgaggaccgtgagcgcccggatcgcctcccgcatcgagctgcgcgagatacccagctgcacggccagatcacgttcggtgggcagccgctgccccggctccagacggccttcgccgatcatcgccttgatccgctcgatggcgcgctgcgtcacggtgcccttctgcggggccgactcgtccacgccgttcctcctgtcgccgggtgcgccgcagtctaacgagcaatgtggtccgaccactacggctggaaacagcgaaaatttggctccgaggggtgttctggcgtggaagtggtctgataaatattcgggcacccgctcaatctcgctcgatgaggagccgacagatggccggtagaaccctctggaaggcggcggccgcggccgcctgcgccaccctcgcgctctcggcgtgcggcagcaccaaggacaccgccgcctccggcggcgcaggcggcggcaccggcaaggtcggagtgatcctgcccctgctgacctcgccgttctggcagtcgtacaacgactacgtaccgaagatggcgaagtccgagggcgtggacacgctcaagaccgtcaactccaacagtgacccctcgcagcagatcaccgacatcaacaaccagctcaaccagggggtgaagggcctcgtcgtggcccccctggacagcgccgcgatcgaggccgggctcgaccaggccgaccgcaagggtgtccccgtcgtcgccgtggacgtcgccccggagaagggcaaggtcgcgatggtcgtacgcgccgacaacgtcgcgtacggcgagaaggcctgccagtacctcggcgaacaggtcacctccggcaaggtcgtgcagatcatgggcgacctcgcctcggtcaacggccgggaccgctccgaggcgttccgcacgtgcgtcaggaagaactacccgaagctgaaggtcctggagatccccgccaagtgggagtccgacaccgcggcctccaagctcgacaccctcctcaacgccaaccccgacatcaagggcatctacatgcaggcgggcggcgtctacctcgcgccgacgctgcagaccctcaagtccaagggactgctgaagaagacgggcgagaagggccacatcacgatcgtctcgaacgacggcatcccgcaggagttcgacgccatccgcaagggccagatcgacgccaccgtctcccagcccgccgacgcctacgccaagtacggcatgtactacatcaaggccgcgatgcaggggaagaccttcaagccgggtccgacggaccacgactcgacgatcgtgaagctgcccagcgggatcctggaggatcagctgcccgcgccgctggtgaccaaggacaacgtcgacgacgccaagctctggggcaacacggtcaaatgagcacaccaccactggtcgaggcgcgggggatcgtcaagcgctacggccccaccgtcgcccttcaggacgggcagctcaccgtcctgcccggcgagtcccatgccctcgtcggccgcaacggcgcgggcaagtcgaccctcgtcgccgtcctcaccggccttcaggtccccgacgccggctcggtccgcttcgatggcgagcccgcgccgccgctcgccgaccgggacgcctggcgccgcaaggtggcctgcgtctaccaaaagcccaccgtcgtacccgacttgacggtcgccgagaacctcttcgtcaaccggcagcccaccggccgcggcggcttcatcagctggcgccggctgcgggccgaggcgagcgaggtccttcagacctgggatgtgcgcgtcgacccggacgcccgcacggccgacctcaacgtcgaggaccgccaaatggtggagatcgcccgcgcgttgagcttcggcgcccgcttcatcgtcctcgacgaaccgaccgcgcagctcgacaaccgggagatcgagcggctcttcacccggatgcgcgcactccaggagtcgggcgtcaccttcctgttcatctcgcaccacctccaggaggtgtacgaggtctgccagacggtgaccgtgctgcgcgacgcccgctggatcaccaccgcacccgtcggcgaactcccgcgcgcggcgctcgtggaggcgatggcgggggaggtcctcgcggcgcgggaacgggcggccgtgcgggacgcggtggcccctgacgcgccggtggccctcgaagcgcgggggctcacctcaccggcgtacgagaacgtcgatctcaccgtccgccacggcgaggtcgtcggcctcgccggctccagcggcagcggcaaggtccagctcgccgagtccttcgccggactgcacaccccgacgggcggcagtgcccggctggacggcgaacagctggtcttcggcgacgtgcaggccgccctcagggcgggcgtcggctgcgtaccgcgcgaccggcacgagcaggggctcgtgtccgggatgagcatcggcgacaacgccaccatgagcgtcctgggccggctcgggcggtacgggttcgtcggcaccgaacgcaagcgcggtctcgccgcccagctgatcgatcgcctcgacatccacaccgagggccccgaccagcccgtctccgacctgtccggcggcaacgcgcagaaggtcgtgatggcccgcgccctcgcctccgatccgcggctgctcgtcctcatcaaccccaccgcgggcgtggacgtgaagtccaaggagtccctgctggcccgtatggacagcgcccgcgaggacggcaccgccgtgctggtcgtctccgacgaactcgacgacctgcgccgctgcgaccgcgttctcgtcctcttccacggccgtgtcgtcgccgagcacgcggcgggctggcacgaccacgagctgatcgcctccatcgaaggagtggaccatggccacggcatctccccgggggacgacccccggacccccggccgatcagagcgcggccccggtgagtgagaccaaggccgggccgctctcgccggtacgggcccccgacccgcgcacggccaagaccgtgctgctccgccgcgcccgcgaactcgccctggtgccagccctgttgctgctcctggtgctcggtgcggtcgtcaacgactcgttcctcaccgagcgcaatctgatctcgatcctcggcgcctcggccgccctcgccatggtcgtgctcgccgagtcgctcgtcctgatcaccggcaagttcgacctctccctggagtcggtcgtcggtatcgcgcccgccgtgggcgcgctgctcgtgctgccggccgcccagtccggctggggcaccgagttccccgccgcgctcgccctcctcgcgatcctcgtcgtgggcgcggtcatcggcgccttcaacggcatcctcgtcgtgaagctcaagctgaacgccttcatcgtcaccctcgcgatgctgatcatcctgcgcggactgctggtcggcgcgaccaagggcaagacgctgttcgggatgcccgacgcgttcttcaccctggccaccaccacgttcctgcgggtccccatgtccgtgtggctggccgcgatcgccttcggtgtgaccggcctggtcctgcgctaccaccgcgtcggccgcgccctgtacgcgatcggcggcaacgcggacgcggcccgcgcggccggtatccgcgtcgagcgcgtcatgctcggcgtcttcgtcgtcgccggtgtcctcgcctccgtcggcgggatcatgcagaccggctatgtcggcgcgatcagcgccaaccagggcaacaacatgatcttcacggtgttcgcggcggcggtcatcggcggcatcagcctcgacggcggcaagggcaccatgttcggcgccctgaccggcgtactcctgctcggcgtcgtacagaacctgctgaccctcgcccaggtgccgtccttctggatccaggccatctacggcggaatcatcctggtcgccctgatgatcgcgcgggtgacgacgggccgcgcccaggactgacgccgaccgcgatcccgtacgcccccgtgtcccggaccgaaaggcctcccgtgtccccaactgccgcccgtatcaccgcggtcgacacccatgacatccgctttccgacctcccgcgagctcgacggctccgacgcgatgaacccggaccccgactactcggccgcgtacgtcgtgctgcgcaccgacgcggccgacggcatcgagggacacggattctccttcaccatcgggcggggcaacgatgtccaggtcgccgcgatcgacgcgctgcgcgcgcatgtggtgggccggtccgtgggcgaactgtgcgccgacccgggcacgctgttccgcgacctgatcggcgacagccagctgcgctggctcgggcccgagaagggcgtgatgcacatggcgatcggcgcggtcgtcaacgcggtgtgggacctggcggccaagcgcgccgccaagccgctgtggcagttcctcgccgacgccgagcccgcgtggctcgtggaccagatcgacttccgctacatcaccgacgcgctcacccccgaggaggcgctggagctgctgcggcgcggcaggcggggagccgccgagcgggccgcccgcctgagggagaagggcttccccgcctacaccacctcaccgggctggctcggctacgacgacgagaagctcacccgcctcgccacgcaggccgtcgccgacggcttcacccagatcaaactgaaggtcggcgcggacctcgcggacgacacccgccgctgccgggtcgcccgctcggcggtcggccccggcatccgcatcgcgatcgacgccaaccagcgctggaacgtcgccgaggccatcacctggaccaaagccctggccgagttcgacccctactggatcgaggagccgaccagccccgacgacatcctcggccacgcggcggtccgccgggccgtcgccccggtcaaggtcgccaccggcgagcacgtccagaaccgcatcgtcttcaagcagctcctccaggccggcgccatcgacatcctccagatcgacgcggcgcgcgtcggcggcgtcaacgagaacctcgcgatcctcctgctggcggccaagttcggcgtgcccgtctgcccgcacgcgggcggcgtcggcctgtgcgaactcgtgcagcacctctcgatgttcgacttcgtcgcactctccggcaccaccgacgaccgcgtcatcgaatacgtcgaccatctgcacgaccacttcctcgacccggtggtgatcagagagggtcactacacggcacccgccgcgccgggcttctcggccaccatgcggcccgagtccatcgcccggtacacctatcccggcggcaccttctgggccgccgacctcgcgcagcagaagggggaagccgcatgaccgacttcgagggcctcaaggcgctggtgaccggcggagcgtccggcatcggccgcgccaccgccgaactcctcgccgcccgtggcgcccaggttgccgtgctcgacctcgacccgagcggtgtcgacaagccgctgttcggccatcgcgccgacgtcaccgacgacagctccgtacgcgaggccgtggccgccgccgtcagcgacctcggcggactcgacgtactgatcaacaacgcgggcatcggagcccagggcacggtcgaggacaacgacgacgcgcagtggcaccgggtcctggacgtcaacgtcctcggcatcgtgcgcacgacgcgtgccgccctgcccctgctgcgcgcctccgcacacgccgcgatcgtcaacacctgctccatcgccgccacggcaggtctgccgcagcgcgccctgtactccgcctccaagggcgccgttctcgccctcaccctcgccatggccgccgaccacgtccgcgagggcatccgcgtcaactgcgtcaaccccggcacggtggacaccccctgggtcggccggctcctcgacgcggcgcccgaccccgccgccgaacgcgcggcactggaggcccgccagcccaccggccgcctcgtgagcgcagccgaggtcgcgggcgccatcgcctacctggccggcccgctgtccgacgccaccaccggcaccgcgctcgccgtggacggcggtatgcaggggctgcggctgcgcccggtgggacagtgaccaccctcggccgcagcggcgtcgaggtcagcgaactgtccttcggcgccgccggcatcggcaacctcttcaccgcggtcaccgacgagcaggcgtcacaggccgtgcacgccgcctggacgagcggcatccgctacttcgacaccgcgccgcactacggcctcggcctctccgagcgccgcctcggcgccgccctgcgcgagcacccccggaccgcgtacacggtctccaccaaggtcggccgccggctggaacccacggacgcgggcggcgacgacctggccgacggattcgccgtgcccgccacccatcaccgcgtctgggacttcagcgccgacggggtacgacgcgctctgacggccagcctcgaacggctcggcctggaccgcgtggacgtcgtctacctccacgaccccgacgaccatgccgaacaggccttccgcgagggctgtccggcgctggagaaactgcgttccgaaggcgtggtcggcgcgatcggcgcgggcatgaaccagaccgcgatgctgacccgcttcgtccgcgagacggatgtcgacgtggtgctgtgcgcgggccggtacacgctcctcgaccagcgcgcactggccgacctgctgcccgccgcggccgaccgcggcacctccgtcgtcatcggcggcgccttcaactccggcctgctggccgacccgaaaccgggcgccacctacaactatgccgctgcgccgcccgagttgctggaccgcgccctgcggctcaaggcggtggccgagcggcacggcaccaccttgcgcggcgccgcgctcgccttctgcgccgcccacccggccgtggccagcgtcctggtcggtgcccgctcgccgtacgaagtccgtgactgcgccgagcagttcgccgcgcccgtgcccgccgacttctggcaggagctgcgcgccgagcggctgctgcccgaggacgccccggttcccggcgaggagggcccatgaggatcgcgctgcacaccaaggtccgcgccgaccgcgtcgccgcgtacgaggccgcccaccgcgaggtccccgaggagctgaccgccgccatccgcgccgccgacgtcacctcctggacgatctggcgctccggcaccgacctcttccacgtcctggagtgcgaggactacggccgtgtgctcgccgagctggagaagctgccggtcaacatcgcctggcaggcgcgcatggcggagctgctcgacgtcgtgcacgactactccggtgcgggcgcagaagcgggcctgcccgtcgtatgggagctgccgtgacggtcgacgcccaccaccacgtctgggacctgtccgtccgcgaccaggactggatcaccggcccggaactccagcccctgcggcggaacttcactgtcgcggacctcgaaccggaggcacgggcggccggggtcgaccggaccgtgctcgtgcagacggtcaccgtcgccgaggagacgccggagttcctcgccctcgcggcggagagtgagctgatcgggggagtgatcggctggaccgacctgacccggccggacgtggccgacgagctggcgcgcctcgcggagctccccggcggcgcgtatctgcggggcatccgccaccaggtccagggcgagcccgaccccgactggctgctgcgccccgacgtccgccgagggctcgccgccgtggccggggcggggctcgtccacgacctggtggtcctgccgcaccagctgccggcctgcgtcaagtcggccagagacctgcccgaactcattttcgtcctcgaccacttgggcaagccgcccatcgcgtcgggcgcacgcgaaccgtgggcgacgcacgtccgggcgctcgccgcgctccccaacaccgtctgcaaactctcgggcatggtcaccgaggccggccccggcacctggacggccgacgcgctgcgcccgtacgcggacacggtcctcgacgccttcggccccggccgtctgatgttcggctccgactggccggtgtgcacgctcgccgcgtcgtacggccaagtcatcgacgtcgccaacgagttgacggccgcactcggggccgacgagcgcgaggacctgttctccggcaccgcgacccgggtctacggcctctgatcccccgggtctacggccgctgatcctcggcgcggcggtgcgcccggacctcgccgccgcgccaggcccgtgggcggagcgactacgggtcccgcagctcgaccctcgtcgccagccgcgtcgccggcagatactcgcgcacatacgtccgctgccagtacgcgcccgtctcccgcagctcgcgccaggtcgtgtactggtagcggtacagccgggcccggacgaaccggggcggggcgtccggcgggaacggcgagcggcgcagcagccgaagcgtgtcgcggtcgttctccaggagccgctccaccagaccgccgaaccatgaaccggcgtacgcgggggagagcgccgcgaaccacatcatccagtcgagccgcaggtggtacggggcgaactggcgcggccaccgccgtggatcacccggcttgcccttgaactcgtactcccgccagtccgcgtcctcgcgcggttcgtcgtcggcggtgccctcgatcaccacctcgtgccgggtgcggctgacgctgccgaacgcgccgtaggtgttgaccaggtggagcgggtcgaaggagcggttcatgacctgccgccgggagagcatgttgcgggccggccggtagctgaggcccaccagcccggcggcgacggccagcaccacgatctcgtaccagagcggtgcgccgggcacgtccggcggggtgccggggaacgccaccgcggacagggccagcacgatcgtcagccagttcagccaggcgaagttgccggacaggaccagccacagctgggtgaggatcatcagcgcggcggcggccgtggcgatcggctgcggggtgaacagcagaacggggacgaccagttgggtgacgtggttggcggccacctcggcccggtggaggggcttgggcaggtggtggaagaagcagctcagcgggcccggcatcggctgggtctcatggtggtagtacaggcacgtcagcttccgccagcacgcgtccccgcgcatcttgatcaggccggccccgaactcgacgcggaacagcacccaccgcagcaggaagaggaccacgacgggcggaccggcctcgtcgttgccgaggaacacggcgaggaagcccacctccagaagcagcgactcccagccgaagccgtaccaggtctggccgacgttgacgatcgacagatacagcacccacgggaccagccagagcaccatggcgccccagagcggcaggtgcgagtcaagacccgcgacgagcgccgccgacaccgcgcagccggcgcccgcccaggccgcgaagaagcggtccgagtagtggagttggaagacgctcggcgcccgacggaacggcacctgtgccacgaagcgcggaaccggcagcatcccccgctccccgatcagcgcgcggaactggagggccgcgccgaggaacgcgacgagatacacgacggccagcgcccgctggaagaccagccggctccaccagtagtcggttgccgtgaaccactccacgtcgagcgctcctctcccctccattgtgacgctgggtgaccggcgccgcgagaacgtggtgcgcgtacccgtcagaacgcccgtcacgacctgcacgctcgcttcaccgactccacggcggcctccaccgcgaccgcggctcccgtcacccggacgccgcagtcggcgcccaccgggagcccttcggcgacgcgggagcgctcccgcgccctatcccgacggttcggcgtgcggcgccctgccgccgggccggccgcccggcggtaggctccgaagtcgaggaataggacaaaccctggcaaggtggccccatggttgatcggggagcgagcgccctgtcactcccggacgactggaccgcccacccggatccgatcctggcgctcaaccgcatgggcagcttcgactgggacctggacaccggtctgatgcacatggacgcccaggcccacgagatcttcgacgtgcgccccgacgaatacgaaggccgccccgagaccctgagcgaccgggtgcccgccccggaggcccgccggctcgacgcgctggtctcccgggccctcaaggacggcagcgagaactacggagcctacttccgcctccgccgtcgcgacggctcgctgcgctggacccacacccagggctacatccgccgcgacgagggcggccgcccgcgccggatcgtcggcatcgtccgtgacgccacggaggaactgcgcgagagcgaggcacgccaggaagcgaggggccgggacgaagtcaggcgccggcagacgaacgtcgtccaggccatcacggcggccctggcccacgcacggaccgtccaggacgtgatcgacgtcctcaaggacacccacggcctcacctatctcggtgcgacgagcctggtcatgggcctggtggaggccggccgcatacggctggtcgccgaggggcccgcggggagcttcgtgcccggcaccctggtcacacgcatcgacgagaagtatccgatgagcgaggtcgtgcgcaccctcaggccgatcttcatcgagtcgcccgaggagttcgccgaccgctatccgatcctctggccgaacatcatcgacctgaacatcacctcgtccgcctacctgccgctcatcgtgcaggcccggcccatcggcgccatgggcctgctctacaacgaccggcgaggcttcaccccggaggagcgcaacgtcctcgtcgcgctcggcagcagcatcgcgcagagccttcagcgcgccatgttctacgagcaggagaaggatctcgcgcagggccttcagcaggccatgctgccccgctccatacccagcgtgcccggcgccgacgtggccgtccgctaccgctcggcgaagatcggccgggacatcggcggcgactggtacgacctgatccccctgccgggcggccgcgtcggcgccgtgatcggcgacgtgcagggccacgacacgcacgcggcggccgtcatgggccagctgcggatcgtgctgcgcgcctacgccgccgagggacacacgcctgccaccgtgatggcccgcgcctccgtcttcctgcacgaactcgacaccgatcgcttcgcgacctgcctgtacgcggaggccgacctgtccaccggggtgatgcagctcgtccgggccggccatatcgaccccctggtgcggcacatggacggcacctgccgacggctgcccgtgcagggcgggctgccgctcggtctctcggcggagttcggccgcctcgaatacccggtcgacaccatagagctcgatccaggcgagaccctgctgctgtgcaccgacggcctcgtcgagcagcccggtgccgacctcgacgagggcatgcagaccctgctggagctgctccgctcgggtccggacgacgtgcgcgacctcgccgacctgctgatcgacgtggccgaggaacgcggcggcgacgacgacgtggccctgctcctcatgcgccgccagggccttggccggcagtccggcgggcgtctccagcagcacgtcgcgcccggtgacccggaggcgctcaccgaggcccgccacatgatccgcgccgcggtccgggcctggggcgcccgcgagcgcgccgacgagatcgaactggtcgccgacgagctgatcaccaacgccctcatgcacaccgagggctccgcgatcgtcaccctcagggtcctcaccggccccgaccacagactgcgtgtcgaggtcgaggactcctccagcgccctgccccgccgccgcgaggccggtgagtgcgaggtgtcggggcgcggtctgctgctcgtggaccggctcgccgatgtctggggcgtggaggcccggggcagcggcaagtgcgtgtggtgcgagttcatcgtcccggagcggagctgactgctgctccgcatggcgttgtcggtgccgggtggcactctggaggcatgccggaactgcccgaggtcgaagcgctcaaggacttcctggccgaccatgtcgtcggccacgaggtcgtgcgggtgctgcccgtcgcgatcagtgtcctgaagacgtacgaccccccggtcaccgcccttgagggccgggagatcacggcggtgcgccggcacggcaagttcctcgacctggaggcggacggcctgcacttcgtgacgcacctggcccgcggcggctggctccattggcgggacaagctgcccgacgccccgccccgccccggcaagggcccgctggcgctgcgtgtcgcgctggagacgggagagggcttcgacctgacggaggccggcacacagaagagactggccgtccatgtcgtacgggacccgggtgacgtcccgggcgtggcccggctcggcccggacccgctcgccgacgacttcgacgaggcgcgcttcgcgcggcttctggagggcgagcggcgccggatcaagggcgcgctgcgcgaccagagcctgatcgcgggcgtggggaacgcgtacagcgacgagatcctgcacgccgcgaagatgtcaccgttcaagctcacctcggccctgaccgccgaggagatacgacagctgtacgcggcactgcgtacgacgctcaccgaggcggtcgagcgctcccgggggctggccgccgggcggctgaaggcggagaagaagaccgggctgcgggtgcacggcagaacgggggagccctgtccggtgtgcggggacacgatccgcgaggtctccttcagcgactcctcgctccagtactgcccgacctgccagaccggcggcagacccctggcggaccggcggatgtcacggctgctcaagtaggcggctcaggcgggagcgggagcgagggcgggcccgacgtgcctcagtgggacctgagcgtcagcaggagctgcccgttgccggtgcggatgtcgtagtgctcgatctcgtcgggccgcagcgcggcgccgccctgcatggtggtgggaccgccgtcgtgcgagggcgccatccacgtcgtcacggtctgctcggaaccgtccttccccaccgcgatgagccgacaggagtggggaccggaggcgtccttgaccgtcacgtcgatctcgctgccccagacccgttcctgggtggtgacctgcgcccacaccccggtcttcgcgccggtcgcggtcagttccgtcgatgcggagccgtgcccggcgaccatcgccaccacgggcccgcccaccgcgaacaccacggcggcggcgaccgcgtacagccagcgcctgcgcccgctgcggtgccgtgtcgccacctcgccgagcagccgctccatcaggcggggtccgggtgccgcgaagggatgcacggctcgcggcgtcgcccgccggtacagcatcaactgccgcgcggcgggccggaattcggtcacctgtgccgtgcagctggggcactccatgaggtggtcctcgaagcggaaggcttccgcctcgtcgagcacgccgagcgcgtaggcgccgacgtcgcgatggcgttccagggacctcataccaattcctcatgccggtgaagcggggtgggggtggtgttcgtgttgctgttgcccaccggtacggaccaggccgccgaatcactcaaggctgttggaataacagtcaagatattcggagcggtcgggcctgcggattggtccgaatctaaaaaagatggatggcgaggtgtccgagcggcagccccagctgccaggcgggcgtccagaccttgggtccgtcgtcctcgcccaagaccgagccgccgccgggcaccgcgtccaggtcaggggcgagcagctcggtctcctccagccagcgccaggccgcggacgccagatccaggtccggcgacgggccgcccgactcgacggcctcggcggccagcgcggccatccgtgcacacacccagtcctgccacggctggtcgtacgccgtcagcgaaagccaggtctccagctgcgagacgacccggataccggagagctcaccgctggtgtcggagaggaagatggtaagcgccagggcgtcgcgcccggcgcggaactcgaaggacgtcggcggcatcaggtcgccggtccgcagcagttcgtccgcgatgtactccgcgtacaaccatgccatggggacggtgagttcaccgccgccggcgccgtccgtgctctcttgacctctgtgcagcatcccttcctgccttcctccggtgcgtgcgcgtcgcccgaccccggacttgcccgaccccggactactgttccggaacacggatgaggacagcagattgctcaaccatggtcctcagcaaggcgctttacggaggtttgactcggccttcggtttcaccgcaggtcggccgcgtatcccggaagaacccggcgcagggcgcgcagcgcgtagtacgcgcgggacttcacggtaccgggcggaatccccagggcctcggcggcctccgccacactcgccccccggaaatacacctgcaccagtacttcacgatgctcgggagtgagtgtcttcacagcgtcgcgcacatcgagcgtcgcggcggaccgttcggcgtgatcggcgcacacccgggcgttctccagtacggcgtccccgacctcggcgggccgcgcctggcgggcccgtcgcgcgtcgatggcgagccgccgtgcgacggtgagcagccaggggcgcacggaggtgaaatcgtgcgcgcgcagcgcctcggggtgttgccaggcacgtacgaacgtctcctgcacgaggtcctcggcgcgctggcggtccccgtcgcagagcctgagcagcagcgcgaagagcggtcggccgtgctcgcgctgcagctgcgccagctcgtgctcggcggtcgtcccgcgcccgatggtggtggttacggccgtcatggcggctatggcagcgcaccgcgctccgccgggacagggagcgcgcacgggtctgcggcggacggtcgaacccgtcgttgaacggtacgacgaacggtccggccgccgccggacgtgacgccgttgcggtgacgtggacggtgccgcggcgactcgggcggtgcggctgcttgactcccggcaaggcgcgcaggtggattcacatcagttcatatgaacatcagaaccatcggacccaccggaaccgatcgggactgccggaaccagccgcatcggagcgagtcgatgacaccacacgcccgccgggccgccgcggccctgaccgccgccctgctgaccgccggcgcggcctgccaggcccacgacccgtcgtcacggcaagcgggcgggcccgcggccgcgcccgcgacccgtggcttcaccctcgtcgcgtccggcgacgtcctgccgcacgccccggtcatcgagcaggcgaaggccgacgcgggcggcatcggctacgacttccgccccatgctcgcggctgccgaacccgtcgtgtcccgggccgacgtggcgatctgccatctggagacggtgttcggcgaggacggcgactactccggctattccgccttcgtgtcgccgccgcaggtcgccctgggcctcgctgccatcggatacgacggctgctccacggcctcgaaccatgccctcgactacgacacagccggcatccacagcaccctgaacgccctcgaccgggccggcgtgcagcacacgggctcggcacgcctggcgccggaggcggccgccccggccatgttccacgccgacggcgcccaggtcgcccacctggcgtacacccacgacatcaacggccgtccgctccccgcaggagaaccctgggccgtcaacctgatcgaccgggaccggatcgtcgcggacgcccgggccgcccgggcggcgggcgccgacgtggtcgtcgtatccctgggctggggcaccgagtggcaggacgagcccgacgcgcagcagcttcggctgagcagggaactgaccgcgtcgcagacgaagggccgccccgacatcgacctgatcctcggcacccgcgcccacgtcccccagccgtacgagaaggtcaacggcacctgggtggtctacggcctgggcgaccagatcgccggggagatggccaaccgggaaggcttccgcgacccgcgcggacaggagagcaccatcggccgcttcaccttcgccccgcccgcccgcgcgggagagcgctggcaggtgacgaaggccgagttcattccgcagcgattcgacctcggccgggtcgtggacctcaacgccgcgatcgcgcagggcgccgggacggcacccgtacgcgaccggatccgcgacgtcgtgctgcgccggggggccgccaaggacggcctcgtcatggggagttgacgcccttggccagttccgagcgcttgtacgagtagccgaagtagatgaccaggccgatcacgagccacacgccgaaccgcacccacgtccgccactgcagaaacgtgatcagccagatcgagaagatcacccccagcgccgggacgtacggcatccacggtgtgcggaaggtgcgcggcagatccggctgccggtaacgcagcacgatcaccgcgacacacaccacgacgaacgccagcaggatcccgatgttggtgagttcggccgcctggccgatcggcaggaacccggcgatggcggccgacgcgaaccccacgatccaggtcacccgggtcggcacgtgccgcgtcggatgcgtcttggcgaaccacttgggcagcagtccgtcgcggctcatgctgaaccagacacgcgtgacgcccagcatgaacgtgaacatcacggtgaggatgccgatgatcgcgccgaccgcgatcacgtccgcgagaccgccgagacccaccgacttgaacgccgtcgagaagccgctctccttgtcgatgtccttgtagttctgcatgccggtcaggaccagacaggcggccacgtacagcaccatcgagatggccagcgagtagatgatcgccttcggcatgtggcgctgcgcgtccttcgactcctcggccgccgtcgacatcgcgtcatagccgaagaccgcgaagaacacggtcgccgcgcccgtgaacgccccgccgaccccgtacgggaagaaggggtggtagttgcccgtgtcgatgtggaagacaccgacaccgatcaccagcagcacgaccaggaccttcagagcgaccacgaccgtctcgaaccgggccgcgctcttgatgccgaggttcagcagatacgcgatgagcaggcacaggatcgccgcgaacaggtcgacccggtgcccgccgcccgtgcccggcgcgcccagcatccacgccggcagatcggcgcccagctcgccgaccaggaagccgaagtacccggagatgccgatcgcgaccaccgccacgatcgccgtgtactccaggagcaggtcccagccgatgaaccagcccgcgagctcgccgagcaccgcgtagccgtaggtgtacgccgagcccgccttcgggatgaggcccgcgaactccgcgtacgacagcgcggccgcggcgctcgcgaagcccgcgatgaggaacgagacgagaacagccgggccggccgtaccgttcgcgaccgtcccggcgagggtgaagatgccggcgccgatgatgccgccgaccccgatcgcggtcagctgccacagcccgagtgtccgctcgagctgtgtgccggcctccgtctcctcgatctgttcgatgggtttgcggcggagaacaccctcacccattcggatcccggccatgagcctcacctcttcgcagacggcaatcggctgacggcggatcatgatggcccagggacagcggggacggaagatgccacgcacggcatggccgacggcgggtgcgttccggccgcgtccggcgctctcccgcgcaccgcgccgagggtgcccgtccgcgggctacggcacgaccgtgaccggccagcgccccgccttgaccaggcggaccgccacggacccgacgatccggtgccccgcctgctcggaggcgcccaccacgaccgcgtccgccttcagttcgtccgccgccgtcaccaggccgttgtaggggtcgccgcggaaggtgtggaactcccagcgcacctcgaatatgtccttgacccgctcggtcgcgtcacggatgtactggaccaggtccgccgcgatctcgtcggtggtgtcggcgaccggaaccccgagcgccgctcccgccgccatcaccggctgcacgtacacgacggcgagcagcgcgtgctgccgtctggccaggccggcggcatacgccgccgcgtggagcgaggagtcggagccgtccaccccgacgaggatcaccttgggaccgtccgtgccacgctcgaactggtgggagtgctgttccgtcacggctgtgaggctatcggaagcggcaggtcccgagccgggcgggagcccgcggagccgtctcggcgacgggtgggggcaggaccgtggcgggaagggcgggaccggcgcccgagaggcggggtcgcggcgctcgacgggcggggcgggcccggtcttcctacagtcgaaaccatgagtgccaccgtggaggccgccggacccgggcacgccaccggcccgacacggccgtcctggggcggcttcctcagcaaggtgcccgagggcttcgcgaccttcttcggcgccctcggcctcctgtgcgtcctgctggccttcatcgcgccgctgcgccgtctgctgggcccgttcgtgcgcgacctcgacaggttcgtggtcccggtcagcgccaacctcgcctacggcgtcttcctcttcctgctcgccgccgcgaccgccgcccgcaagaaggtcacctggtggctcgtggtcgtctacctcggcctggtgaccctcgacgacctgctcggcctcgccctcggccactacgccgagtcggtcgtctcgctgatcgtgtgctcactcgcgctggcgctgctgatcgcggcccgcaaggagttctacgcggcctcccggcgcggcgccgcgtggcgggccctcgccgtgctgttcgccgggctcggtgtggcgatcctggtcgggtggggcctggtcgaactcttccccggcacgctgccgcgcgaccagcggctgctgtgggcggccgaccgggtctgcggcggactggtgtccggacgccggttcgacggacgcacaccacgccccgtgtccttcctcctcggcctgttcggcgcactcgccctgctcaacgccgccgccaccctcttccgctcccagcgcatggagtcggccctgcacggcgacgaggagccgcgcatccgcgccctgctcggggcgtacggcgccgacgactccctcggctacttcgccacccgccgggacaaggccgtcgtcttctcgcccagcggcaaggccgccgtcacctaccgggtcgaggccggtgtctgcctggccagcggggacccggtcggcgaccgcgaggcctggccgcacgccatcgacgcctggctcgacgtggcccgccgccacgcctgggcgcccgccgtcatgggcgcctcggaagagggcgccaaggcgttcgcccgctccggactcggcgcgctccaactgggcgacgaggcgatcctgaacaccgccgacttcgatctcgacggccgcgacatgcgggtgaccaggcaggccgtcaaccgcgtgcggcgcaccggcgccacctgccgggtacgccggcactccaccctcagcgacgaggagatggaggaggtcgtcggccgggccgacgcctggcgggacaccgagaccgaacggggcttctcgatggccctggaccggctcggcgaccccgcggacggcgactgcctcctcgtcgaggccctgggagaggacggaaaactcctcgccctgctctccttcgtgccctggggcggggacggcgtctccctcgacctgatgcgccgtgaccgtgccgcgcccaacggagtgatggagttcatggtcgccgagctgtgtgccgtggccggacggacgggcatacgccggatctcgctgaacttcgcggtgttccgctcggtgttcgaggagggcgcccgtatcggtgccgggccggtcctgcgtctgtggcgccgactgctgctcttcttctcgagatggtggcagctggaggccctgtaccgctccaacgccaagtaccacccgcagtggtacccgcgcttcatctgctacggcgacaccgcctccctcgcccggatcggactggcgtcgggcatcgccgagggcttcgtctccgtgccctcgctgcgcaagctgtggggcaagggccactccaaggggatcaccgagccgacgacgaccgagggtctgccgtcgctgtcggcgctcggcctcgacaagggcgacgagaccgggccgggcgcgccgggactgcccgaacaggtccgggtgcgcctgagcaagctcgaccggctgcgcgcggacggcaccgacccctaccccgtgggcatcccaccgcgcacccacaccctcgcccgggcccgtggctctccggcgggcgagcaggtcaccgtcgcgggccgcgtcatgctcgtacgcgacttcggcggcatcgtcttcgccgtgctgcgcgactggtcgggtgatctgcagctcgccctcacccgatccgggtccgggcccgcgctcgaccggttcggcaaggacgccgacatcggcgaccacatcaccgccaccggccggaccggcaccagcgaccgcggcgagccgacggtcttcgtcacggactggcagctcaccggcaaatgcctgcgcccgctgcccgacaagcaccgaggcctcgccgaccccgaggccaaggtgcgccgccgctatctcgacctggtggcgagccccgacgcccgcgcggtcgtacgggcccgctccaccgccgtccaggcgctgcgccaggggctcctcgaccgcggctatctggaggtcgagacgccgatgctccagcagatccacggcggcgcgaacgcccggcccttcaccacccacatcaacgcctacgacctcgacctgtatctgcgcatcgcccccgagctctacctgaagcggctgtgcgtcggcggtctggagaaggtcttcgaaatggggcgcaccttccgcaacgaaggcgtctcctacaagcacaaccccgagttcacgatgctggaggcctatcaggcgttcgccgactacgacgtgatgctcgacctcacccgcgaactgatccagggcgcggccaccgcggccttcgggggaccggtcgcccgcaagaacggcaccgagcacgacatctccggaccgtggccggtgaagacggtgtacggcgcgatctccgaggcactgggggaggagctggacgccgggacgagccttgaggccctgcaccggcactgcgaccgggcgggcgtgccgtacaccgcggacgacggccgtggtgacgtggtcctggagatgtacgagcggctggtcgaggagaggaccggactgcccaccttctacaaggacttcccgaccgacgtctccccgctcacccggcagcaccgcgccgatccgcgcctggccgaacgctgggacctggtcgccttcggtaccgaactgggcaccgcctactcggagttgaccgacccgatggagcagcgcagacggctgacggcgcagtccctgctggccgccgggggagaccccgaggcgatggagctggacgaggacttcctcgacgcgctggagtacgcgatgccacccaccggcggcctcggcatcggcgtggaccggctcgtcatgttcctcacgggcctcacgatccgggagaccctgccgttcccactggtacgccgccgctgagccggtgcggtcggctccgccgactcggcacaggacgggctccgcccactcggctcgttcggcacttcgccgggcggatggtcccaacgggtgctttcccgcgcccgtcccggtgttgcgcggcgggggcgcctctcgtccgggcgactgatgaaatcatgaaaaaggatcagctgctcacgcggcgccgggcgttgctcgccggtgccgctgtcctgggcgcggccggggcggcaggcacggcccggctgctcaccgccgacgagccggccgggagcccggtgcggaacaccgcccccgtcgcgggcccaccggtgcgccgcgcgctcaagccctccgcctaccgtctgcggcccctcaccggttatggcccgccacgcagcgcgcccgcgcggaccgtcgtccggcacgagccgttcctgcgcatctccgggcgcggccgcagcatggtgctgaccttcgacgacggccccgatccgcgctacaccccggacatcctgcgcaccctgcgcgagtacgacgtacgcgcgatgttcttcgtgtgcggggagatggccgtcgacaacaaggacctgctgagtgagatggccgacgacgggcacgtcgtcggcaaccacacctggacgcacccccggctcaccgagctgtcgcggtccgggatccgctccgagatggaacgcaccagcgaggtcatcgagcaggcgtacggcgagccgccgcagtggttccgcgcgccgtacggtgtctggaaccgggcggccttccagctcggggccgacctgggcatggagccgctggcctggacggtcgactcgctcgactggacgaccccgggcacccgcaccatcgtgaaccgggtggaggacggtgccgcccccggcgtcgtcgtgctctcccacgacgccggcggcgatcgctcgcagagtgtgcgggcgctgcgcgactatctgcccgcgctgctggattccggctatcacctcacggtgccccgacggcagttcgcataacgcgggaggcccgcccggccggggaacgctcagcggacctcgaccaggcgggcgaacaccaccacgttcccgtcatagccgttctgcttggtgaagcctcctccgcaggtgatgacgcgcagctccggggcgcccttgctcgcgtagacgcggtcgctgggaaagctgctcttcgcgaagacctcgactccgtagatctcgaacacggcgaccttgtcgtccttgcgctcgacctcgacccggttgcccttcttcagcgcccccaggccgtagaagacggccgggcccttcatgttgtccacatggcccacgaccaccgcagtcccgttctcaccgggcgagaccgcgccggtgaaccagccggcgagattcgggtcgtcgggcgacggtgcgtccacccagccggacatgtcgagacccaccggagtgacgggggcgtcgacctggatcgccggaatgcgaacgcgtcgggccgcggagtacggcaggggccggggcagcttggcggtggggggcttcggggtgctgcggctgtccgcggccgccgccgtcgccggctgcggggggcccacgtcgaactcccccgaaccattccgaatgagagcgaggccggtcagcagaacaagcgctatcacgccccacggggcccgcttcctccgccgctcctcctcttcggccagctcggacacggacattcgcaatcccctctcgacgtggccgtcgccatgtccgtcgcgcatatgagcacactaatcgcagcgagccccgagagcgacgaggcacgggcgaacggggggcgcggaacctctgtggtgagccatccgagttgccgcggggcggaaaacttctgacagtccgtgacctgcggcaataaccgattgcgcggaatccgcccggcgtgtcctctcaccaggacggaccattctcgaaatgcggccctgtccccggcgtctgagggtctatctggaggcgctttctcgccgatcgaccggggacgggtcccgggggcgtctttcgcggaggatcacatgcgtacttctcgtgccctggcggccggtgccgccgtggccctggccgtcgggctcgccgcccccacggccgcggccttgagcgacccgagcaatatcgtcgccctgtccagagtcatcgcgcggggcgggcagctgacgatcaccgtggaagggtccaggtgccaggtcaacggcagcacggtctcctcgccggtcttcccgacgacccggctgagccccgcggggcacaactcggcgagcgcccgcgtcaccatcgaccgcaacgcgcgcccgggctcgtacgggattacggcccgctgcggcaatggcaccggagtcgtgaacggcgctaacggcgggcccggtaacggggtcgggaacgggaacgggaacgggctcggcaacggattcggcaacgggttcggcaacgggttcggcaacggatttgggaacgggctcggcaacgggttcgggaacggattcggcaacgggttcgggaacggattcggcaacgggttcggcaacggtaacggagtcgggaactgcaacggcttcgggaactgcaacggagtcgggaacggcaacggcttcggtaacgcgaacggcaatgggctcgggaacggcaacggtcacggcaacggcttcgggaacggcaacggcttcgggaacgggaacgggaacggaatcgggaacgggaacggcttcgggaacggtaacggcctcgggaacggcaacggtcacggcaacggcctcgggaacgggaacggattcggcaacggcaacggcaacggactcggtaacggattcgggaacggcaacgggctcgggaacggtaacggcaacggattcggcaacggcaatggacttggtaacggattcggtaatggcaacgggctcggtaatggcaacggcctagggaacgggaacgggctcggcaacggcaacggcaacggtcacggcaacggtctcgggaacggcaacggtcttgggaacggcaacggtctcgggaacggtcacggcaccggacttgggaacggcaacggcaacggcaacaacgcccagtccctgacccggcccaacgcgttcaccgtcatcggcggcgtccgcggcggtctcggcggtagcagctccatcggcgccacgcccaccgacatggcgatcggcggcggactcgtcgcggcggccgtgatcgccggcgggttcttctggatgcgccgccggaccgagaacaagagctgaccggtggccgccggcccgaccgccggccttcttcggagaccgcacgcgacagccctccgccctggaccctgaccggatccgggcggaaggctgtgcggggtgcgtcaggcctcgccgtcggcattgcggcggcgcgcaaggcgcccgatggtgaggatccgtcacccgtgaaggtgcgggaagagcgccaggaagggctccgcggaggccgcgacgccccggctgtagggcgcgtcgaagtcccagatcaggaagagcaggaaggcgatcagggcggagaacagcccggcaaggaccagctcccgtttcgtacgccggatctgcagggcgaacaccatcccgatggtgaccaccgcacccgtgatcagcccgaaccacaccacgcccggcatggtcgcgcccgtcgagtcggcgcgtgaggcccgggcggtgtcggccgcggacacctggtcgacgagcggctgataggcctgagcctcgaagtccgtcttcggttggtagtcggtcacgtcctggcggatgcgctggaagagctccgcgccccgggcggtcacccggcccttgtccgccatggtcttccactcggtggtgacgacctggccgacatacgcgttgacgtcgtcgcggatgcggtcgcggacgtcgggcgggtagacccgcacccgttcggagatctcgtgcagcgcctgggcctccgtctgcacgtggtcctgggcgacgctgcgcgcctcccagacacccgcgatggccaggcccaggacgatggcgtacaccacgccgatcatcatcgtcatgtactcgatcacgtccggggtctcggacggatcgtcgtcctcggcggccgtgcgatgccgtacgagggtcacgatgaccaccacgacacaggcggccgccatcgcgagggcgagaacaagccattccgacaaggagtgcctccagggatcagcgcggacgcagcgcggcgacggcgagcaccgcgggcgcggtgatgagcagggcgagggtgaccagcggcgggccgccgcgcggtggccgctggtgcgccgaggcgtggtaccgcggatagctcaccggggacgcctcgggcggcgggctcggcctcggagcgcgagtccgcgtgggtgtcggcgtgggggtgggggtgggcgtcggagtgggagtcggccgcggcgccacggcgacgggcggtggcggcgccggccggggtggcggcgggtcgggtctcggcgtcggtctcggccgctcggtgggcgtcgggctgggagtgggcgtcggggtgggagccggtggaggtggcggtggaggtggcggtggtggcggtgtgagggtgggggtcggtgtcgggcagggcgggggagtcgacgggacggggcagcggagaccgtcgccggcggccgccaccacctcgatgccgtccgggccggtcgagacgtacgcgcaggcgtcggcgaccgccgtctcgggcggcacgcccatgaggatccagaccaacgccaccagggccaacacccttatggcgacggcggatcgagtccgttcgggtccatacacgacggagatcatgagccacggcgcgcccgtacaggcccgagcctcggtgaattgctccgaacgaaggacatacccctatgcgtggtttgaccgaccgggagtgagacgtcatggcatgggtacatctgcgcgatcgatccggacgggcgtcacagggtccggaaagaaagttgcgatgcgcttgaacactttggccgcctccgcacgtacctatggccataagcggcgcactaggacgctgcaacacccaggctaattaacgggagttgacatgaagacctcctggcggagcgcctcactcgtagcggcagctgcggccgtgctggcgctcacgacggcgtgcggtcaggaatctggcacccagtcgacaggcagtcagaacgtgggcgcagccgcgcctgccgccggttacacctccagccccggtgccgctgctggatccggaaatggttacggcgcggattccaaggaggagcagaactcgtcttccacggaatccgcaggtcagttgacggttgccgagaacgtgaagatcggcaaggtgatcaccgacgccgccggtttcactctctaccgtttcgacaaggacacggcggaaccgccgaagtcctcctgtgacggcgactgcgccaaggcctggccgccggttcccgccgagggcgcctcggccgccaccggcatcgacaaggctctgctcggcgaggtcacccggtccgacggcaccaagcagctgacggtggccggctggccgatgtaccggttcgcgaaggacaccaaggccggtgacaccaagggccagggcgtgggcggcacgtggtacgccgcggcgcccgacggcaagaaggcctcggccaccgatctgcccggactctccgtccgcaacgatcccaagctcggcgacatcgtcgtcgacaagaacggcaagacggtctaccgcttcctgaaggaccaggcctggcccacccccaagtcggcctgcgtcggcgcctgcctggagaagtggcccgtcgtcgcgccggtcgcggcggacgacaccaagggcgtccagaagaagggcctgatgaacttcgcccgtccggacggcgccaagcagcagaccatcaactgctggcccatctacaccttctccggtgacaaggccgccggggacaccaacggacagggcgtgggcggcacttggtacgccgtcgcgcccgacggaaagccggtcggcgcgccgaagtagagatcatctccccagggttgatcgcctcacccgaacggcaacagtcgcggaagggagggggacaccgaagcaagagtgccggacgaacggtacagcgcgtacgacccggcccgccccctccgcaccgcaacggagggggcgggccacttcggcgttcccgcgtttcgcggggacgcacgggacgtgttcgagaggcgtcggcggaacgtcaactcggcacgtgacggcggcaatgagcctgagcggacggtcaatttccgtttttgctcgctcctttggcgggcgatcagtagcctcagctcgaacactggatcgtctcagccgtcgcctacgccttggagagctagatgcagcgtcccgcctgggccccacggagcatcgacatctcggtgccgagcgtgtcccgcatctacgactactacctgggcggttcgcacaacttcgaggtcgaccgggaggcggcccgcaaggcgatggagttcatgccgggactcccgaagatcatgcaggccaaccgggcgttcatgcgccgcgccgtgcgctacgcggtcgacgagggcatcacccagttcctcgacatcggctccggcatccccaccttcggaaacgtgcacgaggtggcgcaggcggccgaccccggcgcccgggtcgtgtacgtcgaccacgacccggtggccgtggcgcacagccaggccgtactcgcgggcaccgagggcgcggacgtcgtcgcgggcgatctcctcaagccccgggagatcctcgcgagccccgaggtggaggggctgatcgacctgaaccgtccggtcgcgctcctcctcgttgccatactgcacttcgtggaggacgcggacgacccgtaccgggcagtggccgagctgcgcgacgcactcgcgccgggcagcctgctcgtcgtcacgcatgcctcgtacgagggagttccgctccctcaggagcgggccgaaggcgcggtcgacgtgtacaggaacatccgcaacccactgatcatgcgctcgcgcgaacaggtcgcgcggttcttcgaggggtacgacatggtggaacccggactggtgccgatgccgaactggcggcccgacacggcacccgaggacgaggatccgtatgccttctccggattcgccggcgtggggcacgcggcgtgaccccggagccggacggaccggaggacagactgcgcaggttcgcgacgatctggagccgggcggtcttcccggtgacctcgacgccgctgacccgtccggagctggagaaccgactcctgccgctcgcccggcggttgagcgaggcgctgcgggccagggcgttcgacgcggccgaggccaaggcggtcggcgccgcgctgatcgacgcgcactgcaccgaccccgacgcgctcagcgccacgctcgactgcgtcgacgcctacctggtgctctactgcggcaccccggacgcgtcccccggggaccaggaggccctgcgcacccgtgcctcgcggttgcagcacgccatggcggccggcttcgcgcaggcgctgcgggagcggacgctggccgagcaggaggccatctccgtcgccgcgttgcaggcccaaggggtggtggggcaggcgctccacgcgagcgaggcccgcttccgcgcggtcttcgagggcgcggccataggcattggcatcgccgacctcgaagggaacatcctccagatcaacggcgcgctgctgcgtatgttcggcggttccgagcaggcggtgcgcggccgcaacgtcaccgactggacgcaccccgacgacgctccacaggtctggcggctgtacgaggagctggtccgcggcgagcgcgagcactaccacgtcgaaaaggccttctaccggcccgacggcaccgtcctgtggaccaacctgacggtgtccctgctgcgtgacgcggacggccggcccgagtaccagctcgcgctgatggaggacaccaccgagcgccggctgctgaacctccggctgcgctacgaggccacccacgacgcgctcaccggactgcccaaccgcaccctcttcttcgagcggctggagaaggcgctgtcggcgggcggggggcagcggttcgggctgtgctacctcgacctcgacggcttcaagaccatcaacgacagcctcgggcacgcggccggggaccggctgctcgtcgaggtcgccgaccggttgcagtcgtgcgcgaccgcgcccggcgagatggtcgcccggctcggcggcgacgagttcgtcgcgctgaccaccggacccgacaccgagcgcgaggtcgacgaactcgccgggcgcatcatgaacgcgctcgtcacccccatcagcatcgacggccgggagctggccgtgcggggcagcatcggcatcgtcgagggcccggccggggaacgcggtccggcggaggtgctgcgcagcgccgacatcaccatgtaccgggccaagtcggcgggtggcaaccgcttcgagctggccgaccccgaggccgacgcccgcgccatcacccggcacggtctcaccacggcactgcccgcggccctggaccggaacgagttcttcatcgagtaccagccgctggtgcacctcggcgacggcagcgtccgcggtgccgaggcgctggtgcgctggctgcatccgcagcacggtgtgctcggccccgaccgcttcatcccgctcgccgagcacaccgggctgatcgtgccgctgggccgctgggtcctggagcagtcggtgcggcaggcccgggagtggcaggagcggcactgcgcagaggcggcggccccgctgcgcatcaacgtcaatctgtcaccgtgccagctcacccaccccgggctggtgtccgacacggtcgacatcctggagcggtcgggtctggaacctggcgcgctgtgcctggaggtcacggagtcggcgctcatcggggccgacgacgatctgctcaaacccctgcgccgactggccgagatgggcgtggacatcgccctggacgacttcggcacgggctactcgaacctcgccaacctgcgccggctgccggtgagcattctgaagctggaccgttccttcacccagggcatgcagcagtacccggcggaccccgtcgacctcaagatcgtggagggcatcgtcaccctcgcgcacagtctcgacctcgcggtcacggtcgagggcgtcgaaaccggcgcgcaggccgagcagctgcggatactgggctgcgacacggcccagggctggtactacgcccggccgggaccgccggagcggttgcacgagctggccctggtggacgccaccggctgacctgcggacgggccggggcatgaccctctgatgtgctttccccgggggccgggctccggcaccgtgaccgtagccgaggccggacctcccggccgccgcggccctcgccacgaccgacgaggcccgcggcggccggacccgcgttcgaccgtgccgtacatgtggctgtcgccgtcggccactcctttggcggactgatcgcccggaaactgccgggtgccccgcgaagcggcgccgtccggtctaccggacggcggacccggtaccggtacggcctcgtcgacgtgcgggagccggccgaggccgacgccccgcacgagcacctcaccgttccctcgccgggatcgcgggccgggccggccacaccgtcccggacgtcgtgacacgctcggtgtacaagctctacgcagactcgccggcgggcaccgagctcaaacacttcccgcgccgcggacccgtccccgacgcccgaagcgtgccgccgccaacgaatccgccgtgcgaaggagtcgagaaccatgagcaaggaactcgagggccggaccgccgtggtgaccggcgccagcaagggcatcggactggccgtcgtgcaggcgctggccggggcgggggcgcaggtcgtcgccgggtcccgtaccacgtccgagggcctggacgggctggtcgaggagggctccgtcacctgggtgcccgtcgacctcgccgagcccgagggggccggacgactggtcggggcggcgggcgggcgcatcgacatcctggtcaacaacgtcggctcggcaccggcccgcaccggcgggttcctgtcggtgaccgacgaggactggcaccgcacggtcgacctgaacctgctcaccgccgtacgggtcacccgggccgccctgcccctgatgctggaggccggccagggctccgtggtgacgatcagctcggtcaacgccaccctgcccgacccgctggtgatcgactacagcgcgagcaaggccgccctggtggccttctccaaggcgctgtcgaaggaggtcggcccgaagggcatccgggtcaacacggtgagccccggtccggtggagacggaactgtggctcggcggcgacggggtggccgccacggtgtcggccgccgccgggatcacccccgacgacgtggtggcacgggcggcgggcgcgacggtcaccggccgcttctcgcagtcggccgaggtcgccgacctggtcctgttcctcgccggggaccgcgcccggaacatcaccggcagcgacctggtcatcgacggcggctacatcccgacgtggtgaccgacggctgccctgcgcgtcctatgtgccccacgtgcccaccgcgccccgccgtggaccgggactgactgaggccgaccagtcgcggcagtccggcgctcaccgttccagcagcatccgctggagctcgcgggccgcccgcggcggggccacgtcgctgcggtgggccagggcgatcgtacggtgcagaccggggcgggccagcggggtcacccgcaaaccccgacccgaccgcgtcgccaccatgcgcggcacgaccgccacccccagccccgcccgtacgaagcccagaacggcgtccatctcgccgccctccaccgcgaagtccggctcgaagccctcggcacggcacgcggcgacggtcagttcgcgcaggtcgtagccgtggcggaacatcaccaggcgctcgccctccagatcggggatccgcaccgtacgccggccccggcccggtgccggggcgtccggtgacgacaccaccaccagatcctcgcgcagcagctccaccgtcgtcagcgcgggcgacggcgtaggcaggggaagcacgaccagcgcgagatcgagcgcgccgcgggcgagttcccgtacgagatcgtgcgagccgccctcctcgatcagcagccggatgccgggatagcggtcgtggaaggcgcgcagcacgtccgggagcaggcccgtgcacaggctcggggtcgcgccgaggcggacgcgcccgctgcgcagctgggccagttcctgcacctcgtgccgggcggtgtccgcgtcggccaggatgcggcgggccagcggcagcagcgcctcgcccgcgtcggtgagcgtgatgttcccgcgcgcccgcaggaacagatccgcccccagctccttctcgagggccttgatctgctgggagagcgagggctgtgcgacatgcacgaggtcggcggcccgggtgaagtgccgggtctcggccaccgccacgaagtactggagctgttggaactgcacccaccccacgatagggcattcctatggaatccagccggaccatgtcttggactgatcggcatcccggccctagcgttctgagacatggctctggcaacacggacggaccgacggtcgtccatggcacgcaccgtctgggacagctccgtcggcaagaaaacggtcatggcggtgagcgggctcgtcatgctgctctacctggtcgtccacatgatcggcaatctgaagatcttcttcggatccggtgagttcaaccactacgcccactggctgcgcaccctcggcgagcctttcctccactacgagtgggcgctgtggatcatccgcgtggccctcgtcgccgccgtcgtcgcccacgccaccgccgcctaccagctgagccggcgcgacatcagggcgcgccccagcaagtacgtgcaccggaaggcgcgggccagctacgccacgcgcaccatgcgctggggcggcgtcatcctcggcctcttcatcgtctggcacatcctcgacctgacgacgggctccgtgcacccgggcggattccagtccggccacccgtaccagaacgtggtcgacaccttctccacctggtacggcaacatcatctacatcgtcgcgatgctcgcgctcggcctgcacatccggcacggcttctggagcgccgcccagacgctcggcgccggcagccgcacccgcgaccgcgccctcaagaccgtcgccaatgttctcgcgctgctgctcacggcgggcttcgtcgccgtacccgtgggcgtcatgaccggagtggtgagctgacccatgcattcctacgcggactacgcgaccggtgagccggtcgtcgacagcaaggccccgcagggcccgatcaacgagcggtgggacacccgccgtttcgaggccaaactggtcaaccccgccaaccgccgcaagcacacggtgatcgtcgtcggcaccggcctcgcgggcggctccgccggcgccacgctcgccgaacagggctaccacgtcgtccagttctgctaccaggactccccgcgccgcgcccactcgatcgccgcgcagggcggcatcaacgcggcgaagaactaccgcaacgacggcgactccgtccaccggctgttctacgacaccgtcaagggcggcgacttcagggcgcgggagtcgaacgtccaccggctcgcgcagatctcggtcgagatcatcgaccagtgcgtggcgcagggcgtgccgttcgcccgggagtacggcggtctgctcgacacccgctccttcggcggcgtacaggtctcgcgcaccttctacgcccgtggtcagacgggtcagcaactgctgctcggcgcgtaccaggcgctgtcgcggcagatcgccgcgggcaacatcgagatgcatccgcgcaccgagatgctcgacctgatcgtcgtcgacggacgggcgcgcgggatcgtggccagggatctcatcaccggccgcatcgacacgtacttcgcggacgcggtggtgctggccagcggtggctacggcaatgtcttctacctctcgacgaacgccatgaactccaacgccaccgccgtctggcgggcgcaccggcgcggcgcctacttcgccaacccctgcttcacccagatccaccccacctgtatcccgcgcaccggcgaccaccagtccaagctcacgctgatgagcgagtcgctgcgcaacgacggccgcatctgggtgccgaaggcgaagggcgaccagcggcccgcgaacgagatccccgaggacgagcgcgactactacctggagcgcatctacccctccttcggcaacctcgtaccgcgcgacatcgcctcccgcgccgcgaagaacgtctgcgacgagggcaggggagtgggccccggcgggcagggcgtctacctggacttcgccgacgccatcaggcgcatgggccgggcgaaggtcgaggagaagtacggcaacctcttcgacatgtacgcgcggatcaccgccgaggacccgtacacggtccccatgcggatctaccccgccgtgcactacacgatgggcggcctctgggtcgactacgacctgcagaccacgatcccgggcctgttcgcgatcggcgaggccaacttctcggaccacggggcgaaccggctgggtgcctcggccctgatgcagggcctcgccgacggctacttcgtgctcccctccacgatcaacgactacctcgcgcgcaacccgcaccccgaggaggtgacggccgaacaccccgtcgtccaggagatgctggccgacaccgaggaccggctgcggttgctgctcgccgtcgacggcgaccgcacccccgactccttccaccgcgaactcggcgaactcatgtgggagttctgcggcatggcccgcaccgagagcggactgcgcaaggcgctcgaacgcatcccgcagatccgcgaggagttctggcggcgcatcaaggtccccggcgtcggcgaggagttcaaccagtccctggagaaggccaaccgcatcgtcgactacctcgaactcgccgagctgatgtgcctcgacgcactgcaccggtccgagtcctgcggtggtcacttccgcgaggagtcccagaccccggacggcgaggcggcccgcagggacgaggcgttctcgtacgcggccgcctgggagttcaccgacaccggcgacgcgcccgtcctgcacaaggaagacctcgtcttcgagtacgtccaccccactcagcggagctacgcatgaagctcaccctgcgcgtctggcgccagcagaacgccgacgccgacggagcgatgtccacctacgaggtggacgacatctcggccgacatgtccttcctggagatgctcgacaccctcaacgaggagctcatcctcaagggcgaggaccccgtcgccttcgaccacgactgccgcgagggcatctgcggcgcgtgctcgctcgtcatcaacggcgacgcccacggacccgagcgcaccaccacctgccagctccacatgcggtccttcgaggacggcgacaccatcgacatcgaaccgtggcgcgcctcggccttcccggtcgtcaaggacctcgtcgtcgaccggtcggccttcgaccggatcatccaggccggcggctacatcaccgccccgaccggcgccgcgcccgaggcccacgccacggccgtgcccaagccggacgccgacttcgccttcgagcacgccgagtgcatcggctgcggcgcctgtgtggccgcctgcccgaacggcgcggcgatgctgttcacctcggccaagatcaaccacctcaacgtgctgccgcagggcgcgcccgagcgcgagacccgcgtcctcgacatggtgacccagatggacgaggagggcttcggtggctgcaccctcgccggagagtgcgccaccgcctgcccgaagggcatcccgctggtctccatcaccggcatgaacaaggagtggctgcgggcgactcgtaaggcggccaagcggtagcactttgctggtagggcggtgtcggccgcgggtgcccggatggttgtcggccgccggtggtacggcggtcgtcggccgcgggcccgctgtggccggccgcgcggttccccgcgcccctggtcggggcgctcgttcaccgaacgttcgccggaaagtgcggacgggcggggccgggagtggtgctcatccccggtcccgccaggcacccctggcattcaacaacctcacaccccgcctctcttcgcgggtcacgcgccggtcagccggcatcggaagaacaggagcgggcaggccgtaccccaccggtctgcttgccccgggctctcacctgcgttcgagcagggggcgcccccgttctcgccgaaccggcccgtgaccaggagtgagccatgaccggcgtttccaccctcgacagcccgccgcagccgacggcccccgcccgctacaccgtcaccctcgcccgcgacgaagccgacgtccgggccgcgcagcggctgcgccacgacgtcttcgccacggagatgggcgccctgctgtccaccccgcagccggggctcgacatcgacgccttcgacgcgtactgcgaccacctgctcgtccgcgacacggcgaccggtcaggtcgtcggcacctaccggctgctgccgcccgagcgggcggcggtcgccggccggctctactccgagagcgagttcgacctcggcccgctcgccgtagtccgctccggactcgtcgaggtgggccgctcctgcgtccaccccgaccaccgggacggcgcggtgatcgggctcatctgggccggcatagcccgctacatggtcgacggcggccacgagtggctcgccggctgctgctccgttccgctcgccgacggcggtgcgctcgccgcggccacctgggaccgggtcgaggccaagcacctggcgcccgaggagtaccgggtacggccgcggctgccctggaacccggagggcgtggcccggccggcgcgcaccgaactgccgcccctgctgcgcggctatctccgcctgggcgcctgggtgtgcggccgccccgcgcacgacccggacttcggcgtcgcggacctctacgtcctgctgccgatgcgccgagtcgacccgcgctatctgcggcacttcctctcgctcgtaccggcgtgatgagcgcgccccgcatcggagcgccgcgacccccgctccccggcgtgccgctccctcgtccccgtcccacggtccgaccgtgcccgcgccctgccggggcgacgccgcccggcccgagcgcgccggtccgaccgacgaccgcggctgtgccggcacccgggtccgtgccgacggccgcggctgcgccgggggttgcgccggtgtcgggggtcgtgccggttcctggtcccgtgtcggtctccggggccgtgcccgtccccgcgtccgcgtctgccgctcggcggccccttcccgcggggtccgccggggggcgttccgccgcgcgggtcagcgcatggctgcccaccgcgccgtgcactgcgcgtggatgcgtggagagcacggcggcctggaccgccgtgccgcgcgcggtactgcggctcaccgcgctcctgctcctggtcctggccggtgtcctgctgaccccggccgtcgggcggatgcgcgcggcggagcgcgacccgctgatccgacgatggtgccgggccgtggcgcgtgccgccggtgtgcgggtgcgcatcaccggggccgccgcccccaccggcggcctgctggtcgtggccaaccacatctcgtggctggacatcccgctgctcgccgccgtccgtccggcacggatgctcgccaaggccgaggtccgcgcgtggccggtggcgggcgcggtggcggcacgagggggcaccctcttcatcgagcgcgaccggttgcgggccctgcccgacacggtggggcggatcgccgccgccctgcgcggcggggcggccgtcgtcgccttcccggagggcagtacctggtgcggccgggcccagggccggttccggcgggccgtcttccaggccgcactcgacgccggcgtgcccgtccagcccgtgcgtatccactaccggtccgccgggggagcggcgagcaccacgcccgcgttcgtgggcgacgacccgctgctcgcgtcactgtggcgggtggcgtcggcgcgagggctggtggccgaggtcgaggtgctgccgatgccggcggccggtgaccgcgccgaccgccgggcccttgccgacgcggcgcaggaagccctgcgcagggcgagcacagggccgcagtcgacgtcgcatccctgaggcccctccttcgccgcccgccgacggtacgcggacgtgcgcatccagcggatctacggcggcacctcggagatcatgaaggaaatcatcaacaggtccatggaccagtgcacgggatggaagccactgccgtcatcacggccggtccgctgtgctgctgttgcacacggccgcgccctgggctccccgcgggttgcacacgaagacctcggtgggcagcttgtccatatcggtgatgtcgtcgacgcgcaggagcgaaagcggcttgttcttcggctcgcccgagcccatgtcgtaggagaggtggccggtgacgccaggccagccacccttcgcgttcccccggaggatctcggtgtggacggccgccgggtcgatcatccgcccgtcccatggctggggccacacacggatgcgtccggccagctgctcgacggcctggctgaagagcatggtggcgtcgtacgcgagaccgacctgttcgccgatccactgctgagggccgggcccaccgacacacctgggcgggctgagcaggtccggtgactgcaccgcggccaggaactgaccgacgtccgggtcggggcggcgcagcgaggagcacgtcgccaggcccgacttggacacgtacagcatggtcaggttgtccggcgccgtcttgcggagcgtcttgttggccatgtagcggttgacggagtcgtcggccacgaggtgccggggccagtcgttgttctggcaggcttgccgcagacccgccaggaagtcgccgtattccgaccaccggccggcgaagaagagcatgccgcggtaatcgcactcgcgttgcatcgaccgtccgggatgccacttggtggaagtgagatcgctggtgcccttgaactccttcttcaagtcgtccagaagcgtggcgacgtagaggtcgtccttgcggctggacttctcgccgaaggtgacgtaaatgtgcaggcccttccagccctttcggcgtgcgtaggcggagagcagatggacctggtcccggttgggcggggagatctggaagtacaggttcgagttgctgtcgatgtggtcggcggagagcgccggtgcgatcgcggggagacccacccgattgaggtggcgcagggcgacggcgctggcggtccggctctcgacgggtccgacgacaccgatcaccggggcgtcggacggttggcgtgccagccgggcgatcatgtcgacggcgaggtcggcgtgtttcatctggaagccggcgttggcgatgacgatgcgcagcaacgggacggaggaggtgttcaccgtggcccgcaccccgatgtactgggcggcggccatgccttccaggccttcgcgttcagcggcgtacgcctcctcaccggcctgggtggcacgaccggtcagcgtgcccaggtacacgacggtgacgtacgggcggcgccggccgctctcttcccaggctctcctggcatcccggttctgggcgaagatgcgctcctggatgtagtgcagattctcctggccgggctggttgttgaaggtgagggcggcgccgtcgctgaagccgatgcactctccgccgacgtcgcgcacgacgacgtcggcggcgaacggccggtgcaggcagccgggaatccccagataccgcccggaccagaccgcggcgggcacgaagagcaacaggcaggcggcgacgatcacgacggggcggctgaaccacggcggagccggggccgccaccacggcggaggcgggcacccgctccgcgtccacctcgccatcggcccacagccggcgccgcccgcggacccgggccgtcggcgcggaggtccggcgcgccagacggcttcggtacgagacgggagcccactggttccggtcgatcgcgtgcagatccgtcatgcgcagcgcgtgggcgggagcggacggtaccgggccgccgtcctgccggcctgcgacgtgtaccaggaggacgggcacgagccgcccggtctcgtcccgcacctgttccacgagccggagcagtgtccggctcgtggtgggtgattccccgctgcggatctgcaccacggggtacgccgtgtgccgccagccgccgggccgccagggacggcgccgcaacgagcgacgcaggtcctccagaaaggcgtgcaccagcagcttcgccacctgttcggagggctcgtcggcccggtaaccggcggtcagccgttcggcgaggccgaggaagttcccggacagttgaggtctcaggtagggctgccgcatgaaccaccggtaggtgcgccccagtccgggaacacggcctccggccaccacccggaagaaggccgggggcacggccaccgtcagtacgttccacaggaattgaaggacgggatcgagcgcgccgccgaggcccgtgaggtcggccgcggggcggtccgctccgcgtcgggtcgcgcgcaggtcggcggcgagcacggcgggatactcgtccgtccgggcacccgcgggcagccgggtgttcatggcccactgcaccagggagaagtgccggaaacgcagccgcggttggccgcttcgctgccgtgcgaggccgtggcagacctcgtccagcaggacccgcagcgcctcgacgtcctggtgatcgagggcgtgaccggcgggatcggcctcctcggccagcgcggttcccccgcggtccgcccgtcggccggacacttccgtgtcggaggctgggtcgtccgtcccgtccgtcccgtccgtcccgcccgtcccgtccgtcccgcccgtcctggccgtgccgttcgtgggctccggaccgtgaccgacccgggtttccgtctcgggcgacggcaccgcgcagtacggggtcggccgagcggcggtgaccagacggctgttgagcacgtcgtacacggctcgcgcgtgcgggccgtcgatctccaacgcgggcagccaccgctcgccacgccgcggcctgggcaccagtgcccgcacgagatgcaggaactcggtcgttcctggcggcgcgttcagcaggccgttgtcgtccgcccgcaccgggtcgtgctcgttcaccaacggatgttcccccgaaacgtacggtgtgccttcttccccttgtgcctgtatagcagcgaagagtcaccggatgtgtgcgttccgcgacgatgcgcaggtgtgcgcacgtcgatgcacgcccggtcgggtcctgaccggtgggcgtgcgggtagatcccagccgtgttccactggaaaccgccggttccactggaaaccgctggcctgcggagaccccggtccgcggaaagccgcttgcctcgcagtcgacggatccaaggagaaaagcgcctacctggatttcttcgcggtatcgctcgggcagccgtcgtcgccggaacagcaactgccgtgtcgaaccgtggtgtcccggtggcaagccggccggtgggcggcacaggatgagcaacaggccccggtgcagcccgatcagccgcccgcagcgccggctgcgggcatggacaactggatcgccccgctcaaggagtcaggcccgccgcgggaccagggtgtcctcggcgacgccgagttcgcgagggccgaagccatgggcctcctgagcccctgaggcccgagcgaggacctggtcacaccggcggtcttcggccaggcacgcccatcgagcgggctcctcgatcggagggcacgcgtggttctcgacctcgtcgtcattggcgtggccatcacgttggggccgctgcacaacaccgccttcatcctgcttttgtccgcgcccaagggagtccgcaaggggctcgcgttcattctggcgtggctggcctgtctggtcctgctgatcgccgtcgtcgtcctgctcacaggcggcagaccgccgccccacaaaagcgcgccttccaccgccgttctggtcctcaagctgatcctgggcctggggatggtgttctacggggaacgcaagcggcgccgggggagccggccccgccagtcccccaagtggatggcgcgactggaccacgtctccgtgtgggcggccgccgggttcggcgtccttctccagccctggggcgcggtcgccgcaggcgcggcgacggtggtggaggcgaacatgtcgtccgccgccacgtacttcgcgttgacggggtactgcctgctcgccacttcgagcctgctggcgatggagctgcacgccacgttccggccgctcaccgcccaggtcagactgaggaagctgcgcgcatggatcgacggccaccaggaccaggcgatcgtgtccatctccctggcactcggcctgtggctgatggccaagagcatctaccagctcgtggggtgaggctcgagcggtctctcggaatcagcgcgaccggcaccggacgaccacggggtgccggccgctgccgtcggcgggagcgcgccggcttgacctggcggaacgcgcgcgggcccgacgcagggtggggccaacccgaaggccgattcgggggacagccccggtgatctccgacccgaaggacggtgagatctcctcatcactctttcccgaggagatctctgatgcattcagcaaagccgcgtccgcccaggacgacgggacgacgaggcatgctcgccgccgtcacggcgctgctcaccgcgctcgtcgtctcggcggccgccgtggcgcgggaggacgcgcggcagcaaccgcgcgccaccggggggccggtgtggacgggggcgtggggcaccgccgtgcagcggcccgtcgaggggagcgaggacaaggggcccaactggtcgcggcagggattcgccgaccagtccgtacgccaagtggtccgcgtcgccacgggcggatccacggtgcggatccggctgtcccacacgtacggcaccacgcccctgcggatcaccgccgcgaccgtcggccggtccgccggagacgcccaggtctggccgggcacggcacgcgagctgaggttcggcgggagtcagggcaccaccatcgcccccgggcgggacgccgtgagcgacgccgaggccctgagcacctctccgctggagaagctgacagtcaccctgtacttcgccggccgcaccggcccggccaccttccaccggttcaccaccgccacgtcgtaccgtgccgccggacgccacctgtccgactccggcggcgacgccttccaggacgccacgaacgcctggtacttcctgagcggggtggaggtgtccggccccgccaccccgcggcgcggcaccgtggtcgtcttcggtgactcgctcgtggacgggacaggggccacgcccggcgccgacaaccgcttcacggacaagctcgccgaacgcctggtcgccgaccgtcgcccgctggacgtcgtcaacgccggcatcggcggaaaccggatcctcaacgactcgccctgctacggggacaaggccgaagaccgattccggcgcgacgtactcgaccgccccggcctgcgcacggtgatcatccacctgggcgccaacgacatcggtgcgcccgagatgggggacccctgcatgggctccgcgccccgtgtgaccgcacgtcagctcatcgagggtcacaagaagctgatccgcgccgcccacgcccgcggcgtcaaggccgtcggcgcgaccatcctgcccatgaagggcgccctcttccccgtctacagcgaacggggcgagaaggtccgggccgccgtcaaccactggatccgcaccagcggcgcgtacgactccgtcctcgacgtcgaccgtgccctcgcgagcccggccgatccggccctgccgcgccccggctacgttgtcgaggacggcctgcaccccaacgaggccgggtcccacgccatcgcctccgccgtggacctgaacgccctctgaaactcccaccggaccgcagcaccatgacgtcggccggttacggggccgccgcgcggaagagggccaggagggcctgagccggcggggtgtccgcgtcgaagaactgcgtgcccagcgcaggtggcacggccgttccgtgcataaggacctcgtggcattgggcgaccgtcctgccggggtacggggcgccccgcttggccgggagggcggagatcctcacgacctcgatcagcgcggtggcggcaacggcttcggcggggagctgcatgtgcgcagtctgcccgccgggccggcagccggccaaggcgccaggcgtcgcccggcggacgggaatgcgacgacaggggcctaggactggcggtgcgcgaaaaggactgctcctggaatgtgcccgtcgaggccgagcagccattgagcctcgacagtgaacccggcatcgcgcagccaggctgtcacttggacaggctggcggtggtggacatggaccttcatcgggtgaccgccgtagccctccgtcttcagtcgcgactcgtcgccgatgtgaaagccgagcagcagcggtccgccaggacgcaccacccgccggaaatggccgaagaccgcagggatcgcatcgtcagggacgtgaatcaacgaccagaaggcgagcagggcggtgaccgacgcgtcggccaggttgagatccgtcatcgagcccacctcgaaccgcaggtcaggatggtcacgccgagccacgtcgatcatcgcgggtgaaaggtcgataccgaatgcgtcgacgcccaacccatgcaggtgggcggtgacgtgccccggtccgcagcccacatccgccactggcccgccgccggctgtgtgaatcatgccggcgaacaactccagcgccgcccgaaggtacggcgtccctgccagggccccgcgcagttggtcggcatagctgaccgcgaccgtgtcgtaggagctccgggtgtccgccaaccatccgtccgcgttcatgccccaacacggtagttgatcaactgctcgatcaatcggatgatcaaaaaatgcacgtcagttcttcctcatcccccggcctcggccgcgagttcggtggatcgtgctgtccctccagggctgaggagctcttgcagacgtcagtcggcgtatcccggagaaccgatgaaactacccgtcaccatccatcaagcacgcctcggatccgcggagttcaaagtgatccggccggcccgcccactggaccgcgccgtgctcatcgatcacgaccggcacctggacgcctacctcgatcaggacgcggcgcggcgaatcggcgggctgtgggagcttgccgcctcctcaccgcacgcgctgatccacctgccgatacgaggcaacccggccccttcccgcgacctccccgcagccggcacacgccagcttgacctcgtgctgctgcatcactcgcggcaattcgcgccttcgcgctggaaggaagtacgcgggcgactgggccgagggcgcccgcagaccgtgacgctgcccggggcgggccgcggtgacggagccgtggtcgaccccggggcacggcaccaccgggagaaccgggacctgttccatcagcatctccacgcggagactctgttcatgacgggcagcgcgaaggtgttcagggagaccgcccggcacttcctcgatgtcgcccgcaacggtcctggctacgtccccgtccatccgagctacccgtacttctgcacagaactccactccaacgacggcattctcggcgacgcccgcgagatccacatcgagtactgcgaccagtgggactcatgacccgacacgacaccgccgactctagagggcggtcagtcccgcgagccgggccagcccccggtaggagtccagcagcgcgtcccggtcgtacgtgctggtggtgaccagcacctcctgcgcgccggtctccttgatcaccgtctccagttcgtgggcgacctggtcctcggtcccggcgatgtgaccggtgaggcccgactcgtagaagccgcgctccctggcggtcatccgcagggactcgacgcgctcggcgggcggcaggggcgggaaggtgccgtgcgtgcgtgagtacgccatcgaccaggcttcggggacgaggaggcggcgggcgttctgcggggtgtcggccaccgcgatcgtgccggagatcacgacgtacggctcccgcgcccagggggaggggcggaacgtctcgcggtagtggtcgatgccgcgccgcatcttctcgcggttcctgaggtcgccgatcaccatcggcagcccggcgcgggccgcgatcgtggcgccctcgcccatggccagcacgaagggcggcacggtccggccctcggcgggccgcgcgtgcacgccggtcggggacgtgccgaggaaccagccgaggagctcgtcgagctgcgccgcgaagtcgtcggcatcgtccttgtcccggcccagcgccctgcgcaccccgtcggtgaagccgacggaccggccgagccccatgtcgacgcggcccgggaagagggcatcgagtacgccgaactgctcggccacgaccagcggttggtggttcggcagcatcaccccgccggtgcccacccggatggaacgggtggccgcggcgacggccgcggccagcacggtcggcgcggaaccggcgactccgggcacgccatggtgctccgagacccagatccggtggtaaccgaggcgctccaggtcccgcgcgagccccaccgtgtcacgcagcgccgccgcaccgtcgtgcccttcgcgggtacgggagcggtcgagtacggagaagcgggttgccgcgatcactgagctcacacggtgttcaacgcgtaccgggcgccaggattcccgggcctcactccgccgcgggggccggggccggggcgcctcaggcctccagcctgcgcagccgttccgcgtcgcaggtgcgggggcaggtggcgcaggcctcggccgggcggatcgtgtagtagaggcagcagccgatgcgggtgcgggtcgggtggtggcggccgtcgccgccggtgaggtgacggaagtcggcgccgccggggaagggggccttgggggagggcaggagcgcggtggcggcccggatcgcggcggcctcccggccgagtgtgcggccgaggtaccagatcccggagaccaggtcgtcgccgaccatgccccacagggtgcgcggtccgcgccggacgtacggggcgagcgcggtcagcagcggacgcatgtggtcggcgaccgcggaccgcagcgcggcgcgcagggcctcttcgtcggccagggggagggcgccggggagggcggccgccgggtcgtcgggcaggcaggccaggtccgagcccgcggtgatcgtgtacgtcccggacgccaggtccaggcgtacgtcctcggggcgtatgcgcggcacccgctgttccaggtaccagaccccgctcatcagcagaccgaccgaccacgcgtagtcgtggagggcgcgggacgcggcgacgtcccggcgcggggtgtgcccgtggcggtcgtggatccgggccgcctcggcctcgatgaacgcttcgagggacgcttgactgtccgtcaattcggctccggaacaacccgtttgggcaggcgccgcgcgggggtcgtcctggacgcgcacggtcagtgcctcgcagagatcgcccaggcgtcggtagccggcggtgagcaggccgggcacgccggtcgtggcggcggtcggcgggaactccacggccacggtcatgggatcactcctgagcatgaggcttcgacgcatgaggcttcggcgcatgaggcttcggcccaaaaaaagtaggtaagccttaccttagtggacggatcgtagtcgcgatccgcgcgagccgccgcgtcgtcgatcaaggggtgtccatgtcgcccgcgtgtgacggcggtttggaaactaaaccaaggctaccctaagctcacgtttcgtgaccgcgaccacgaccgaacgggtcgcacccacgggtgtgcccttccgtgccctccggcacgttcccctgtcacccgccgacgccgcgtcgagcggatgcccgccgacctggccgaggccaccggcgcggaccttccggagacgtaactcccgtcgccctgggcggggccgcatctgatccgcgcgtccgcgcctcaactcctcaccccagagcggaagtcatccccccaccatgcggctctacctgctggccctgaaccccaccgactccgtcaccgaaggcttcctgcccgccgcggcccgcctcggcctcgacgtcacggtcctcaccgaccagccggacccgcaccggcgcgcgtatccggaggtcgaggtccgggagtgcgacgtgcgtgactaccgcgccgtcatcacccggatctccgcccaccacccgcccgacgcgatcttcaccaacagcgaccacctccagacccaggccgccctggccgccgactacttcgggctcccggcgaagaactggcgggccgcgctgcggaccaaggacaaggccgagatgcggcgccacctcgccgccaccggcgtggacaccgtctggtcggccgaactcaccgaaccggtcgccctcgacgcgccgtacccctgcgtggtcaaaccccgggaaggcgtcgccagcgaggacgtggtgctggtcgacgggcccgaggaactcgtcgcacgctgcgcggacatcctgacgcgccgtccgggcgccgctctggtcgtcgaggagtacctgcccggcgagctgtacaccctggagaccctcggcgacggccgcgtccggcacgtcctgggcggcttccacaccgaactgtcgccgctgccgtacttcatcgaggagcggatggccttcgtgcccgcccacccggaagcggtgcgcgcgcaggtcctcgcccaactggacgcgctcgaggtcgggttcggcgcctgtcacaccgagttcgtggtgcacggcggccgggcgcggatcatcgaggtcaactaccgtgccatcggcgaccagtgcgacctgctgctcgcccagctcctggagatcccgctcttcgagcacatcctccgcacccacctgggcgaacccctccccgccgaactgggcgcccgccgcgacggcgcagcccgcctcgagtacccctgcgccgaccgcgccggcaccctgaccgcggcccccgccgccacagaactcgccgtcgacgacgtccggttgacctaccgtccgctacggagcatcggcgaacgccacgagctgtacggcaccaaccgcgactacctcggcgtcctgcgcgccaccggcaccgaccagcaggccgtcgacaaggcgacggccggcttcctggccgcccagcgctgggagatcgggccgtgaccgccccgacggccaccgacccggccgaggccgagctgctgacccgggtcctcagcgccctgctgcgcgaggacgtcgtcggcctgcgcacccgcagcacgctcgtgcaccgggccgacggcccctggctgcggctggcccaccccggcgacgccctgctgctgcccgtgaccgaggacgggttccagagccgccatgccgcccggctgccgttgctcgtcagcgagacggacggcgagctgaggaccgtctcgaccgtcctcggggcgctgcgcacccgggccgagccccccgaccgcgacggcttcgacgccttcgccgaggaatgccgccagacgctggccaccctgcggctgcactccggaacccggcaggagatcgcccagctgctcaccgcacgccacggcgccgaccccgccgactggaccggcctcgccggcggcctggcccacgacacgctcgccgcccgcctcgaccaccccgtctacccgaccgcgcgcggccgctcagggctggacgcgcggcaactacgcgcctacgcacccgagttccacccacgcttcgccctgcgctggctcgccgtaccccgccgggcgctcaccctctcgacgggcgtgctcccggaccgctggcccacgccggccgcgctcggcctgcccgaggccgagcacacgcatgtcgccctgcccgtacacccgctgaccgtcggcgccccgctggacgccgccctgcgggccacggatctggccgactccgcgatcctcgcgagccgcggccacctcgacgtcgtaccgaccctgtccatgcgtaccgtcgcggtgaccgccgatccgtccctgcacctcaaactgcccctgcccaccgcgacactggggctgcgcaaccggcgcaccatcaagcccggcaccctcgtcgacggagccgccggccaacgcctgctggaggcggtgaccgcccgcgagccgcgctttcgggacaccgtcctgcacgccgacgagaccggctacgcgcacgccgggcacgagctgctcgccgtactgtgccgccgccagccggccggactcgacggctcggtcgtcgtacccatggccgccctgctcgccgaggcgccgggcggccggctggtcgtcgaccacctcgccgaccgcttctacggcggtgacccgctcgctctgctggacgccttgctgaccctgctgttcgactggcagaccacgctgttcggctacgggatcgcgctggagtcgcaccagcagaacatctccctggtgctggaccggcaggcggacggccggacccggccgcggctgctcctcaaggacaacgacggaccacgcatcaacgccgtacggctgcgcgagcggctgggggacgcggcgcccgggcccgcggacttcgacgacgcgcgcgtcttcggcgacggtgacggaccggtcgccgacctcttcaccaccatcacgctccatctgtgcgcgggcgcctacgcgttcggcctcgcccggcacggtcgcgcccggcttccggcagtcctcgggctcgtacgcgaccgcctcgccgaggccgtcgagcggctcgggaccggcgtgggcgagcccggtgcggttctgcgcgcccgggtgctggacgcgccgcggctgccggtcaaggcgatggtcaccgccggaacgctgctcagcaaggaacgttcgggtgcggccgacatcaacaagcactacaccagcggccccaactacctgctacgagccggtgatccggcatgagcgccggacgtccttggacgcccgtccatgtccttcggcccccggcaggtgcgcgcgaggccggtacggccgcgaccgccggagccatcgtcctgatcaccgtatgcgtccccaccctgccctctctccgcccccgctggagccgctgatgcccgcactgaccgactcgctcgatgccgctccccgccgcaccgccccggtccgaccgcccaccgccgaacaggcagtgacccacaccctgctcaactgcctgctgcgcgaggtctccggacccgagcggcagaccgccgtcgccgacggccacctgctgctgcgcctgccccgccgcggtgtgctgctgcgcatcgccctgcgccgtacgtcccttgtgggcgcgcaccggttcagcgggccggtgtgcgaggacgacgaccacggcggctggccggaggtcgactggcagcggctggccacctacgtgcacgacgagctgtcccttcgcacgggggtacgcaacgaggagttcctggagcaggtcgactccagccatcgggccgtcgcggccgggctcgccgcacggccggcggacgacaccccggccgccatgctcgccacggacgctctctccgcctacgtggcctcggaacagtcgctggtgttcggacaccgcttccaccccaccccgaaggcgcgcaccggcagcgccggctcctggtcctcgtacgcgccggaggccggcgcctcgttcccgctgcggcacctcgcggtccgggcgcacctgatcgccgaggagatggccgaacccgcggccgccgcgtcgctggaccggcagcgcgcggacgtgccgcacggccaccggctgctccccgtccacccctggcagtacgagatgctgcgtgaacaccccacgctgcgcgcggccctcgaccggggtgacatcgtcgacctcggcgagggcggaaggcccttcgccgccacggcgtccgtccgcacgctctacgacggcgagacgttcctcaagttcagcctgaacgtccgcatcaccaactgccttcgtaagaacgccagttacgagctggccggagcggtcgccctcacccgcgccctgagcccggtcctggccgacctggccgaccgcttccccggcagcgccgtactgcgcgagcccgcctaccgcagcctcgccctccccgggcccgacggcacgccggaccgcgagctgctcgaaggcttcggcgtcatcgtccgcgaaggcctgcccggacggctcctgccccgcatcaccccgctgctcgccgccgccgtcgccgacgagtacccgaccgggcccgcgcacatctcccgcctcctcgccgccgcgggcccggggaccgtcctcgactggtgggcggcctacctcgacctcctagtaccgcccgtactggccgcctacttcgaccacgggctggtcctcgaaccgcatctgcagaacgtgctgatctgcgtcgacggcgacggcatgcccacccaggtcctcttccgcgatctggagggcaccaagctcgtccccgaacgccacgccggcacactcgccgcgctgccgcccgacgtggccggagcgatgacgtacgacgcccagcgcggctgggaccgcgtcgtctactgcctgctggtcaaccacgtcgccgaactgctcgccgccctcgccgacctgcgtccgcagacggaggccgcgctgtgggcgcaggtccgcgccaccctccaggcctacgccgaccggtacggctgcccaccggaactggccgctctgctcgccggagtcccgctcccggccaaggccaatctgctcacccgctggcagcgcaaggccgaccgcgacgccggatacgtccggctcgcctcaccgctcgccgaggacatcctgcgccacacggcccggagcgcccgatgaccgtacccacgcccgcggtgcgcgaccgcatccggaccctcgcccccggcgaactgcccgcgtacgtctacgacttggcggagctacgggcacatgccgcaggtgtgcgggcggcgcttcccgagcgcgtcgagctgtactacgcggccaaggccaacccggagccggagatcctggccgcgctcgccccgtacgtcgacggctacgaggtggcctcgggcggcgaactcgcccatgtcgcccaggcggtgccgggccgcccgctggccttcggcggccccggcaagactccggacgaggtggcggccgcgctggctgggggcgtgcagcgcttccacgtggagagcgagtacgaactgcacatgctcgccgagcaggcccgccgcgtcaccccgggcacgcgggtggcggtcctgccgcgtttcaacctccccgtgcgggacggttcgctggccggcagcgccctggcgatgggcggccggcccacccccttcggcctcgaccccgcgcaggccggtacggtgctccggctgctcaccgacggcacctacccgcacctcgagctgcgcggcgtccacgcccacctggccagcggactcgaggcgcccgaacagctggcggtggcggagacggtcgtcggctgggcgacggacatggcgggggagcacggcgtcgggctcggcgaggtcaacgtcggcggcggcatgacggtggactacgcggcccccgagcgccgcttcgactgggtcacgtacgggaagggtctggcccggctcgcacacgcgcatccggaactgacgttgcgcatcgaaccgggccgggcgctgaccgcgtactgcggctggtacgccaccgaggtgctggacgtgaagcgcagccacggcgaggagttcgccgtggtgcgcggcggcacccaccacctgcggacaccggcgaccaagggccacgaccagccctgttccgtgctgccggtggacggctggccccatccgtggccccggccggcggccgaggccgaacgggtcacgctcaccggccagttgtgcaccccgaaggacgtcctggcccggcaggtaccggcaggcggactgcgggccggtgaccgcgtggcgttcgcactcgcgggcgcctacgcgtggaacatctcccaccacgacttcctcatgcacccccggcccgggttccacttcctgctcccggacaggggtgacggcgagccctgacggtcctcggtccgcgctcgacgtccctcgcgtgatcacgcatgcgccgggactcaccccgggtcgaccggaacggtggcgtccgtacggccgccgagttgttacggctccggtatgggatcattctggggcacatggagcgtgtcgctgctgcggcgatcgtcgacgaccacggcgtcgtgacggcgtggagcgaaggtgcccggcagctgacgggatacggctccgaggacgtcgtgggccgggcggcggccgacctgctcgtcgaagcggcgctgcgggagacggccgccgcgctgaccggtgtgaccgtgctgaccggtgtcgccgtgctgcgacaccgcgacggtcaccccgtggagatcgccctgactgcgtgccccgtcctcggcccggacggcggaccgcacggatacgtcatcaccgcggagcggcccggcgggccggagccgaccccggagggccgggcgttccagcaggcttccgtccccatgtgcgccttcggcacggacctccgcttcctgcggctcaacgacagcgcctgccgggggatggggggcgccgaggagtccctggtgggccggttctacggggacaccgtcccggcggacaagaccagccgcggcttcctgctgaacctgcgcaaggtggtcgagaccgggacacccctgcgctacgagacgtacaccagtgcccccgcagggggaccggcacgcgcctggagcatcgagatgtggccggtacgcggcgacaccggcgccgtggacgaggtcgccatggcggcgttcgacagcagcgagcagcacgaggcccggcagcggctcgccctgctcaacgaggccgcggccgccatcgggaccactctggacgtggtgcgcaccgccgaggagctggtgaacatcgccgtaccgcgcttcgccgacttcgtcagcgtggatctgctcgactgggtgctgggcgcggaggaaccggccggcgaccacggacccggcgtcgtactgcgccgggtcgcgcacggatccgtcacggagggcaccccggaggcggccgtcaggctgggccagacggacacctaccccccgttctccccgcccgcccgggcgctgacgtcggggcgggcggtgcgcagccgtgcgggcgacccggatttcgaccggtgggtcggcgagcgcaacgcgcggaacgtcggaacccgtgcctcccgcgaaggcgcgcactcgctggtgacggtgcccctgctggcccgcggcaccacactgggcgccgcggtgttcatccgcgtcaagaaccaggacgcctacgccgtcgacgacgcgtcgctcgccgaggaactggccagccgcgccgccgtctgcatggacaacgcccgccgcttcgcccgcgagcagtcgatggcgctggccctccagcacagcctgctgccccggggcctggccgcacacgcggccacggaggtggcctaccgctatctcccgacggattcggcggcgggcgtcggcggcgactggttcgacgtgatcccgctgtccggcagccgggtcgccctggtcgtcggcgacgtggtgggacacggcattcactcctcggcgaccatgggacgcctgcgcacggcggtaaggaccctcgccgacgtggacctgccgccggacgaactcctgacccacctcgacgacctggtgatccacctggcgacggaggggagcggcgaggaggtggcggagctcggcgcgacctgcctgtacgcggtctacgaccccgtctcccgccggctggtcctggcgtccgccggccatccgccgccggccgtcctgctgcccgacggcaccgcgcaggtcgtcagggtgtccgccggaccgccgctcggggtcgggggtctgccgttcgaggcgacggcacgggaactgcccgagggctcgctgatcgccctgtacacggacgggctgatcgagggccgcggccgcgatctcgaccgcggcaccgccgagctgtgccgcgcgctggtccttcccggcgcctctctggaggccctctgcgactccgtgctgaagtcggtgctgccggacagtcccagtgacgacgtggccctgctgctggcccgcacccgcgcgctcggcgcggaccaggtggccacctgggacatttcgccggaggccgcctgcgtgtccgcggcccggcagtccgtcctcgagcagctgaccacgtgggggctcgacgagatggcgttcgtcaccgaactggtcgtcagtgagctggtgaccaacgcgatccgctacggcgaaccgcccgtccagctgcggctgatccgcgaccgttcgctcatctgcgaggtctccgacgggagtgccacgtcaccgcacctgcgtcgggcgcacgcctacgacgagggtggccgcggcctgctgctcgtggcccagctcacccggcgctggggcagtcggcagaaccctccgggcaagacgatctgggccgagcagccgttgccgccggggtgaaccggggtgaaccggagtgaaccggggtgcggagcgatgggggcggatgcggtcaagtggccttcgggccaccggagttcgagaggtcggcgcgttcctgttcggccagccggcgtcgggcgtccgcccagtcgacgggcagctcgccggccggtgtccgccagaacgtgaagaccgagccgctcatcgtggaccgcagaccgttcatgatcgtccggtgtggttcggtcttcacgtaggtgtacagcgcctccttgtcctcccaggcggacagggtccagaaggtgcgtttgagcggttcggcgacgagcgaggcgccgaacgcgccgggcgcgctcttcacctgcttccacgtggcgagcgagcgcaggaagaagcgcggcacgtcggcgaacctgcggacctccaggcgggacgccatgacgaacgcctcggcgcccggtgcgggttcttcgacggtggtccaggggagcgtgggcatggcgacggccttcttccggaagcggcgcgggacggcgtggagggcatattggataccttcactatccatgttagacagtgaaggtatccaatgaccagagcggagccgtcccgatgcgcatgtccgagctgagccgccgcagtggcgtctccgtcacgacgatcaagtactaccttcgcgaaggtctgcttccggccggccgccggctgtcggccacccaggccgggtacgacgaggaccatctgcgcagactgcgtctgatccgcgcgctgaccggcgtacgggggctgcccgtgagtgccgcccgggacgttctcggcgccctggccgagcatgcgggcgacacccattccctgctgggtctcaccctcggctcgatccggctggccgaggagtccgccgacgactccccggagccggccgaagtcgactcgctgatccaggagttgggctgggacgtccacaagtcggcgccggccaggtccgcgctggcagagaccctgacctcgctgcgcacgctcggcgccccgctggaccggcgcgctctgctgtcgtacgcgcatctcgcggaacggaccgcggtcctggacctcgaccaactggacggcatcgaggacccgttggaggtggccgaacgcgcgctgctcctcacggtcctgctggaacccgcgctgctggcgctacggcgcctggcccaggagaacgagtcggcgcagcggcacgccgagagctgaggcgcgggcgggttcgtacaggggaggcctgcgacgggctgtcccccgaacggcagccggaataccgttccgctggctgctggctgctggctgctggctgctgaccgttgaccggcggccggcaaccggcaaccggcaaccggcaaccggcaaccggtctaccgattcgtaccgcccgagtcgcccgttcgggcgagtcggggcccgcctagggtggtcggtgtgacgcagaagagcaggccactggccgtattcgacctggacaacaccctcgccgacaccgcgcaccggcaacggttcctggagcggaagccgcgggactgggaggcgttcttcgccgccgccccgaaggatccgccgctggcggcgggcgtggcgctggcgcgggagagcgccgaggagtgcgaggtcatctatctgaccgggcgtcccgaacgatgccgccgcgacaccctcgactggctcgcggcccaggggctgcccgaggggcgtgtgttcatgcgcggcaacggcgaccgccggcccgcccgcgtcaccaagctggagatcctgcgcagactcgcccgggaccgtgaggtccgcgtgctcgtggacgacgacgaattggtgtgcgtcgacgccgagcgcgcgggcttcaccgtcgtacgggcccgctgggcatcctcgtccgaggcgctcaaggaggcgcaggagggtgaggggcggacctgacgggcgccgtcgggccctgggggcgaaggggtcagtcgccgtcgtccaggcggaagcccaccttcaggccgacctggtagtactcgatctgcccgttcactatctggcccctggtctgggtgacctcgaaccagtccaggttgcgcaaggtctgggcggcgcgggcgatgccgttgcggatcgcctggtcgatgccctcggtcgaggtgccgacgatctcggtgacccggtaggtgtggtcggacatgcgggtgctcctctcggccgtgacaggtgtgtcacgcgtcactcaacggtgccgcaaggtgcggcggagcgcgagacgtcggcccgtcaccccgctcccccttgacctccgcattggtccataccaaaatccagcacacccgcacgagcgccacgctcgtcccccacgccgggccccctgaccctgtccgcaagacagaactggacccctcgtgagacgtcgactcctcgctctcctctgcgtttttgcctcgttgctcaccgcctgcggcgccctgcccggagaggggaccgggcggcggaccgtcaccgtatggctgatgaaggacagcgcgtccaaggagttcctggcccggttcaccaaggagttcgaacgggcccacggcgatctgcggctcgacatccgcatccagcagtggaccgggatcggcgaaaaggtgcagacggcgctccgacggcagggcggcgacgggcccgacgtcatcgaggtcggcaacacccaggtcgcccagtacgtcgacggcggcgggctgctcgacctcaccctcgagtcgttacgcgactggggcatgaacgactggctgcccggtctcgccgaacccggcaggttcggctcccgccagtacggcatcccgtggtacgcggccaaccgcgtcgtcatctaccgcaaggacctgttcgccgcggccggcctggccggtcccccgaagacgcgcgaccagtggctcgccgacacccagaagctcaactcccacgatgtccagggtatttacctggccggacaggactggtacaccctcgccggattcatctgggacgagggcggcgacctcgccgagcagccctcctccggcacctgggagggcagcctggacacgtccgccgccctgcgcggcatggacttctaccgcaggctccaggccctcggtacggggcccgcggacgccgacgaggaacacccgccgcaggccggggtgttcgcgcgggggcgggtggcgcagatcgtcgccgtacccgggctcgcccaggccgtcgtgcgcaagaatcccgacctcagggacaaactcggctacttccccgtccccggccgaaccgcggcacggcccggtgccgtcttcaccggcggctccgacctcgtggtccccaagaacaccgacgaccgccgtggcgccacggcggtcgtcgcggcgctcgccggcggcaagtggcagacggatctcgcccggacgatgaactacgtgcccaacaagacgaccctcgccgacgcggtcgagggcgaggagggcgtcgcggccatggcggcgggcgccgcgcagggccgggcgaccccctcgtccccggactgggccgccgtcgaggccgacaacccggtcaaggactacatgacgaaagtgctgaccggcgccgatcccgcgacggaggcccgccgcgcctcacgccggatcacccggacactgtcgtgactccggcggccaccctgctcggaaggtcagagcgattcggccgggccggtgccgggggacagcgcctgctcggtccagatcgtcttgcccggcggcgtgtaacgggtgccccacgcctgtgccagctgcgcggtgatgaacagaccacgaccgccctcgtcggccgtaccggcgtggcgcagatgcggtgcggccgagcctgcgtcccgtacctcgcaggtcagggtgcggtcatggatcaggcggagctcgaacggcgcgcttccgtatctgaccgcgttggtgacgagttcgctgacgatgagctgggtgttgaaggcggtctcgtcgtccacgtcccacgcggcgagctgcccgcgggtacggcggcgggcgacggccacggacgccgggtcggcgtcgagcggccacgcggcgaaccggtcggggggaaaggcccgggtgcgcgcgacgatcaccgcggcatcgccggcgcccagacctgccgggcgtgcgtagacgagggcgtcgcagaggtcctggagcggacggtcgtggtagtccggcgccgtggacaacggttctgaggattcggcgagatacgaggtgaggagcggatcactggcgaacaccaggacgcttccgtgcggaacctcgacgccgacggtcgcgaagggcgcgccctccgtcgcgcccagccgcggcccggccggtatgccggggacggtgaccgtgcggtcggggcacacgacgagggggaccagggggccggctgccgccatcgcgcacgtgccggtcagagggtcgtgtaccgcgtacacgcagtcggcggtgagggattcgcggcgcagcggatcgccgagcgggagccgggcgcgttcggcggcgagctggcccgccgtgtagtgcaggcgggcgagcagctcgtcgggggagaggtcgaacgccgacagggagcgtacggcggtgcgcagttgccccatggtcgcggccgcgttcagaccatgccccgacaccttgccgacgacgagggcggtgcgggcgctggacagggcgatggtgtcgtaccagaccccgggatcggcgccggtgacggagaggtaggcggtgtccagtgacgcgtgggtctccgggctgcggggcagcagttgacgctggaccgtggcggcgaccgtgtgctcccgtgtgtagcgccgcgcgttgtcgatgcacagcgccgtgtgggtggccagctcgaccgcgaggtcccggtcaccttcgtcgaaggggggcgactgtccggtgcggtacaggctgacgacgccgagggccgcgtcgcgcagcgccaggggaaccacgaggagcgaatgggctcccgatgagtggatcgcctcggcgcgcgggggatcgacggacagccacggggcggtcggatggagcgcgaccacgcgcgggctcaagtcggccagggcctgggtgaacggggtcggagccggcaggcggcggacatcgcccaccggatgggcctgcggcggccgcgtacgggtgctgcggaacgcggtgcgcatcaggggcgtgctcgcgggcggcggggcctgcggcgggtcgtcgccgcggatcacggcctccaccacctccacgatcgcgatatcggcgaacgcggggaccacggtcgggacgagttccgcgccggtcacgaccggatccagggtgcgtcccacgtgccggcgcacggcgtcgagcacctcggtgcgggtgcgggcccgctcccgctcggtgacgtcgatcgcggtgaccgccaccccgagcacggaccggcgcggattctccaggcgcagcgcggtgatctcgaagtgccgctccggcggcgggtccccgttgcttcgcgcccggacgatgcgctgcaccacagggaccccggtgtccagcacctcgcgcaggagcgcctccaggtcgacgccttggacgaggttgtagacgtcgcggaccgggcgccctttcaggtcgtccaggggcacgccacgcatgccgggggtggcggtgttgatgcgcaccacccgcaggtcggtgtccagcaggtggagcccgatcggtgactgcgtgaacagcgcctccagcatcgaggcggttgtctcgtccactcgccggccgggatcgctgtgcggcacagggaccacctccgaactccgtcctgtgcttgctccggcgcacggctaccccgtatcccggcgtgtttccagcgtgctccgccgtcggcgcgaccgcacccgaagaacgcccggcccactgatcacggcccccgtgggagggctggacgccatatggcgcgcacgagcaggaacactgggatgctgaagggggagcgctgcccatgtcctgacgaacagtggtggtgagcgccatggcagggctggaagagaacggctcggaaccgaccgcgccacgcgccgatccccagggagacccgtttctgcgcacccggttcgccctgccgacgcgccccgggacgttcctgcggcgggagcggttggtcaggcacctcgaccacgccctccggacaccgctgaccatggtcaacggagccgcgggtgccggcaagaccctgctggtcgccgactgggccgcggggcaggaccggtccgtcgcctggctcaccaccgacgcggcggaccaggggtgcggaacgttctgggcgtacctgctccaggccctgcgcgcctgtgatgtgccgctgcccgccgaggtcggcttccccgcggacgcgaaccgcgtggaccacacgctgctggcgcgactcgccgccgacctgagtgtccgggaccggcccgtggtggtggtgctcgacgaatacgaccgggtgaccgacccggagatcgcggaccagctggagttcgtcctgcaccacgcgggtcggggcatgcgcctgatcttcgtcacccgcaccgagccgttgctgccgctgcaccgttaccgggcggccggcgacatgacggagatcagggacgcggagctggccttcacccccgaggaagcggccgcgctgctcgaactgcacggtctgcgcctttcggtgcacgcggcgcgcggcctcgtcgaacgcacccgagggtgggccgccggactacggctgtgcgccctggccgcgcaggagcgcccggatccggagacgtatctgaaggagttcgaggccgaccgcagcaccgtcgccgacttcctgctggcggaggtgctcaaacggcagcccccccagacgcaggacctcctgctgcgcgtcagcgtcctcgagcgcttctgtcccgagctggcgaacgcgctgacggaccgcagcgacgcggaggccattctggccgggctgcaccgcgagaacgcgttcgtcgagcacctcgggcacgcgtggtaccgcctccacccgctgttcggggagattctccgcgcccatctgcgggtgcgccttcccggcctggagcccgaactccaccggcgggccgcgcagtggctgcggcgctccggatccctcgcggagacgctcggccacggtgccgccgccggtgactgggagttcactgccggtgccctcgtcgacgacctcgccatcggtcagctcttcaccggccttcgctccgacgacctggccgagctgttctcccggatggggcccgaagccacgagccccgcgacggagctcgtacgcgcggcccgtgacctgtcccggggtgacctcgaccgcggcctgacccatctgcggcacgccgagcagagcctggccggggaacggatgccgacgggggatgactcggccggcctggcggcggcccggctgagctgtgctctgctggaagccctggcggcccgcctgaccggttcgccgggcagggcggaggcggccgcggaggcggccgggaaactccaggaggaggtgtcctcgcatctcctggacgagcatcccgaactcaccgccctcctgctgacgcaccttggttcggcgcggctgtgggccgggtgcttcaaggacgcgcgtgccgccctgaccacggtggcagcctgctccgggggagcttcgacggcgctcccgcgcgaggagtccctgggccacctggccctgatcgactacctgaacggctggctcggcagggcggagcgcaaggccctggcggcgctgggcgagacggagcgattcagcctgccgcaggcgtccggctccggcatcggactgctggtcctggccgccgtggccgtcgaccgcaacgaactgggtgaggcccaggccctcctcgacgcggcggccgacacgcaccgcgcgatgcgggacccggtgagggaagcggggcgggccatcgccaccgcacgtctgctgctggcccgcggcaacccgcacgccgcgatcgaggcggccggaccggccgtcgccgcggacgtggtctccccctgggcggaggggcacacggcgctggtggcctccgccgcacacctggccgaaggccggccggaggcggccgcggagttgctgcaagcggtgcccgacgaccagccggcgtgtgcggtgggggccgcgcgggcccagctcgccgcgggcaatcccggcgcggcgatcgacctgctcgaccggttgcaccccaagggccgtatcggcccgggggtgaccgtccgggcctcgctggtgcgggcgcaggccgcggacgcggcgggggactccgccacctcgcgcaggctggttgcccaggccctccaggaggcacggcgtgagcggctgcggcgccccttcctcgaagccggaccgtggatccgtccgttgctgggcacggcgccactgcgcgggctggccgcgggctggctcgcccccggcccgccgccacacggcgggccccggcccgtggaccaaccgccggcgccggtcgtggaggagctgagtggccgcgagcgcgaggtgctgcaacggctggccgagatgatgtcgacggaagagatcgccgccgatctgtatgtgtcggtgaacacggtcaagacccacctcaaaagcgtctaccggaagttggcggtgaaccggcgccacgacgcggtgcgccgggcgcgcgagctgcggctgctgtgaccacggccctgtgggggccgggccgcatgacggaccgccgaggcccccgcggctgggcaggcgccttcgcggctcgtccggctcgcccgtggcgggtgaggcgcagggggagttctgcggatgcgatgggggtggcggcagggcacgcgccggccgctgcccggccggccgcgccggcgcgccgggccgactcggcgaggtggacatcgtgacgcactggcgggcgctgatcgtcctgggcacggcccagttcctgatggtcctcgacacctcggtcatgaacgtgtccatcagtcaactggtcgaggacttcgacaccgaggtcaccgccatccaggccgtcatcacgctgtacgcgctggtcatggcggcgttcatgatcatcggaggcaggctcggagacatcttcgggcgccgccgcctcttcctcctgggtctcgtcgtctacggcgcggggtcggccctgaccgccgcggcccccaccctgtgggtcctcgtgctgggctggtcggtcatcgaaggactcggtgccgcgatggtgctgccggccatggcggccctcgtggccgagtcctaccgcgggcgggaccgggccgtcgccttcggcgtcatcggcggactcgccggcgccgggatcgcggtcggcccgctgctgggcggctgggtgacgacgtacctcacctggcggctggtgttcgccggtgaggtcgtggtcgtcctggccgtgctgtgcttccaccgggtgatcacggaatccccccggaccggtccgcgcccccggctggacggggtcggcgccgcactctcggcggccggcctcgcgctgggcgtgctcggtgtgctccagagcggcacctggggatgggtggagccccgcaacccgcccttcaccgtcctgggcttcgcgccgacgctgttcgtgatcggcgccggagtggccgtgctggccggcttcctgcgctgggagaggcgccgggacgccctcggtgccgagcccctcgtacacctgcccctgctgggcaagcccgcactgcgctccggcctgctgtccctgctgtgccagaacctcatcctgctgggactgttcttcaccatcccgctgtacttgcaggtggttcaggggttcgacgccttccagaccggactgcggctgcttccggtgtccgtcaccatgctcgtgacctccatgtgcgccgcccgcctggggcgggtggccgggccgcgccgggtggtccgactggccctggtgaccctggccgcctccatcatgtggctgctggccaccatcgacccggtcatcgacgacgcgcagttcgccggggccatggccctgctcggcgtgggcatgggcctgctcgcctcgcagctgggcaacgtcgtgcagtccagcgtcggcgaggaggaacgcagcgaggtcggcgggctgcagttcacggcccagaacctgggctccgcgctgggcaccgcgctcatcggatcgctgctcatcggcgccctggccaacgccttcaccacgcaggtggaggacaacccgagcctgtcgcgggaagcccggcagcagaccggtgtcgccctcgaagcggggatcagcttcgtgcccaccgagcaggtgcgctcggcggccgagcgtgccgggctgccgccctccgaggccgacgccctcgcggagtcgtacgcctcggcgcagctcggcggtctgagggcggcgattctcgccaccgggggaatcaccctcgccggcttcctggtcacaccgcatctgccgagtcgtccggccggccgtccgaagcgacccgactcgggcgctccggccgacgcgatcgaccggacccgctgacttcgagggaggccgcgatggccgagaccgggcacgtcacggaccgagcgcgcgccgagcgtcgggcccatgccgactacaccggtggcgtctacggatccatgctcgccgcctcggtggtcgtcggcgccgggaccctgggctcgttcccgtacgtggagctggtgctgctgctgttgctcacgggtgtggcgttctggatcgcgcatgtgcacgcccagttgttcggggcgcggatggcacagcagggcctggaccgccggatcgtgctgcatgtgtgccgcgacgagtggccgatcgtcaaggccgctgtcccgccggccgccgccgtggccgtcagccccctgctgggcctcggcgtacagggtgctctctggctggcgctctcggtcgccgtggcgggccaggtcggctggtcggcggccgcggctcgacgggccggcgcctcgtggggcctggtggctgtcagtgcctcggtgaatctggtgctcggtctgctgatcatcgcgttgaagatctccctgacgcattgacaccgatggcgcccgagccgggcgacgcgtcaccggcgacgtatcacctccacggggtgaggcagggacggttcgccgaggcggacgatcgcagggaagggcgcagcccgcctgtccccggccacccgggagagagcagccaatgcgctacgagatccgcgtcgaaggacacatgtcggagacgctgaccagagccttcccggagctggaccacgtggtgatgtccggtcagacagtcctgttcggctccgtcgtcgacgaggcgcacctgtacgggctgctggcccgctgtcagtcgctgggactacgggttctggagatgcgccagctgccggagtgacgtgccccaggaagacacaggacgaccgcgtgacgtgccccaggaagacacaggacgaccgcggtgaccgggtgtcctgcggtgcccgccccatcgccccggcggtgcgcacggatcacccgccgggggtgacccggtggccggactcgggcgggacgctggcccggtgagatccccgcacaccgccccgtcggcggtccgggacgatccgctcgagcgcgcgaggaggagccatgaccgtgccgcgtggtccgacaccgcataccggaccggaacagatgtccgaccgggcggcccccgggccgtcggacggcgatcccgcggaagtgctggcggcactcgggcgctcatggacgtggatcctgggttccgcggtcgccacgctcgtgccgggcgtcctggtcctggtctggccggacgagaccctgcacatcctggcggtcctcatcggcctgtacctgctcgtgatcggggggttccggttcgttgcggccttctcccgggacgagcacggcgaccggctgcccggggtgctcctcgcggtggcgttcgtgctggccggggtgctgtgtctgaggaacccgttgcagaccattgccgggctctcgctgatcgtcgggatcgtctggctggtgtccggcatcctgaccctctacacggccatcgccgccaaggacctgccccaccgcggtttcgtcctcggcgtcgcggtgatcgccatcgtcgcggggatcgtggtgctggccctgccgaccgagtcggcccgggcgctgacccggctgctgggtctgtggatggtcctgctcggcctggccgaggtggccctcgccctggcctggcgagcggcactccgcaggtcccgaggcgcggggccgcacggacccggcgggacggtctgagaccccggcgaccgggagccgcggggaccgtccgttcacccgtctcgggtgatccgcacggaccttgccgtgggcacgctgaaggcggcagagaacggctgccgggcgagcgcccgggacggaggagaagaaatgagtgggcagatgtatctcgcgtacgactatccgctgctgagcgtcttctggtccatgctggtgttcttcctgtggatcatgtggttcatcctgctcttccggatcatcgtcgacatcttccgtgacgacgacatgggcggctgggccaaggccggctggctggtgctggtcatcgtcctgcccttcctcggcgtcttcatctacgtgatcgcccgcggcaagggcatgggccgccgtgaggtggcgcaggcgcgcgcgcagcaggagtccttcgaaagctacgtccgggagaccgccaagggcggcggccggtccagcagcgtcgatgaactcgccaagctgtccgagatccgcgcccgcggtgacatcacggacgaggagttccgcaaggcgaaggaactggtcctgagcgactacggcccgtcggcaggcgcaggcgcaggcgcgggtactggcaccggcgccaacgccggcccctccacttccggtcgctgagcgcaccgcacgagacggaaacgaggcagcaggatgaccgcgacacacacagcgcacgggcagacggtcgaccggccctgggccgaaggcctgacgattttcgcggcagtcatgctcatgatcgccggcatactcgatgtgtgccggggcatcatggcgctcgccgaggacgacgtcttcttcaggacacggaactacgtgttcgcgttcaacctcactggttggggctggatccatctcattctgggcgtcgtcgccgtgatcgtcagtttcggactcttccagatggcgctgtgggcgcgcgtcgccggggtggccatcgccgcactgatcatcatcgccaacttcctctccctgccgtactacccggtctggtcggtcgtgatgatcgctttctcggcgttcatcatctgggccctgtgcgtggtccggcaggacgagtccgccgacccgttcgcgagcccgccgcacggcatgtgaacgagacctggccgagccctgaccggcttgcggccgccgtacgcttcgccgtcggccgcaagccggtcatgatgacgctggtcagggtgacgccggtcaggatgacgccggtcagggtgacaggggaacgatcctcaccgcaccacgctcagcgacagtgcgaaacgcccctcctcgtccgtccaccagtgcgtcaggtccaggccggccgccgccagttcggcccgtacgccgtccttgcggaacttcgcggagacctccgtccgcagctcctcgccgtccgcgaagtccaccgccagatccagcgccggaatcttcacggtctgcgccgtccgcgaccgcagccgcatctcgatccactccttctcggcgtcccagacggccacgtggtcgaaggcgtcggggtcgaagtcggcgcccagctcacggttgacgaccgtcagcacgttcttgttgaactccgccgtcacccccgccgcgtcgtcgtacgcggcgaccaggaccgactcgtccttcaccaggtcggtgccgagcaggaacgcgtccccgggcgacagcagggtccgtacggaggcgaggaacgccgtccgttcggcgggcagcagattgccgatcgtgccgccgaggaacgcgacgagccgcggacccggcgtgccgggcagcgcgagaccgccggtgaagtccgcgatcagcgcgtgcacgttcagattcgggcgctcggcgatcagcgcctgtcccgcctgggtcagcgcgctctcgctgacgtcgaccgggacgtaggtgtgcagcccggtcagctcgtccagcaggtgccgggtcttctcggaggagccggaacccagctcgaccagggtgcgcgcgccggtcgcggccgcgatctccgcggcccgggcgatcaggatctcccgctccgcgcgcgtcgggtagtactccggcagttcggtgatcttctcgaagagctcactgccgtgcgcgtcgtagaaccacttcggcggaagcgtcttgggcttggcggtctccccaggtcgagcggggccggcgccccgggggacggcgaggccgtgcaggacgtcggcgcgcagggccgcgtccgtggtgtcctcgggcagggtgcgggtgagaaggaacgggctcacgtacggggctccttcggtggtgcggatgccatgtgggtgtgcggttcaccgtgttccggcgggcccccctgttcccgcgggtccttgagcggggtgagcaggacgtcggtgcggctcgcggcgagcagcgtgcggtccggcacctcctgccagtgcggatcgtcgtcgtacggttcggaggccacaacggtgcggcggccgggctcggcgaggtaccagagcgtgtcgccccaggcggtcgccgcgatcgtctcgccgctcgtgagcagcaggttgagccgggagccgggggccgccgcggcgacctccagcacggtgtcggccagcgcctgcccctcctcgtcgccgccgcgcagccggttcaggaccagggcccagacgagcgccgagtcgcagcgcgcctccagcgacagcagctcggtgggcgggagcgagcaggccaggggggccagcgagtcgggccagccggcgacggccccgttgtggctgaacagccaggggccggcggcgaacggcgccgccgcggcctccccgtccgcccccgccacggtcgcgtcccgtacggcggcgagcagcgcggtggtccgtacgacacgggccaggtcggcgaaggactggtcgccccagatgggcacggcccggcggtaccgcgccggcaccgggtcctcctcggcgtaccagcccaccccgaaaccatcggcgttgacggtcccgtaccgctgccgccggggcgcccacgactgccggaagaggctgtgcgcgggttccacgagcagcctgccgagcggctccgccggccccaggtaggccaggtgacggcacatcaggaagctcccgagcgagcggtgcggaacccggagaatatctgccgccggatcggatagtcccagttgcggaacgtaccccggcaggccaccgggtccacggcgaacgaaccgccgcgcagcaccttgtgctcaggcccgaagaacacctccgagtactccttgtacgggaacgccgtgaaccccggatacggctccaggtcgctcgacgtccactcccacacgtcgccgatcaactgccgtacgccgagcggagaggcgcccgccggatagcttcccgccggagccggacgcagatgccgctgcccgaggttggcgtgctcgggcgtcgggtcggcgtcgccccacgggtagcgggtggagcggccggtgaccgggtcgtgacgggccgccttttcccactcggcctcggtgggcagccggcgccccgcccagcgcgcgtacgcgtccgcctcgtaccagcacacgtgcagcaccggctcgttcggcggcacgggctcggtgacgccgaaacgccgccgcagccactgcccctgctcgcggcgccagtacagcggcgcctcgatggagtgggagcggatgtggtcccagccttcggcggtccaccagcgctcgtcaccgtagccgccgtcctcgatgaacgcctggtacgcggcgttcgtcaccggtgtggtgtccaggtagaaggacggcaccaggcgctcgtgtgcgggccgttcgttgtccagcgcccatggttcggccgaggtgcccatcgtgaacgggccgccgggaacgaggacttcggccggaccggtgaacggcggcgcgggcgcggggtccggtgccgtcagtgccgcggggcccttgcgcagctgatgggtgatcagcatcgtctcgtcgtgctgctgttcgtgctgcgcgatcatgccgaaggcgaagcccgcctccgtcagcggggtgccacggaacgccgtgctctccaggacgtcgagcgcccggccgcgcacctccgacgcatagcgccgggcctcgtcgggcggcagcagcggcagcgagggccgttcggcgcgcgggtgctcgaacgcgtcgtacagcccgtcgatctcgggccgcatcgcgtcacgcccggcgaccgcgcgcagcagccacagctcctcctggttgccgatgtgcgccaggtcccacaccagcggggacatcagcggcgagtgctgcgcggtgaggtcgggctcgtccacgcacgtggtgaggagcgcggtgcgctcgcgggcggtggtgagcgcgtcgagcgcgcgggcccggagcgtgtcggggtcggtcggggacccggggtcggtcatgtgcggaggtccttcccgtggagctggagcagcagatcgtcggcggggcagcgaccccgggccacatagcggtcggtgaactccgccacggcgttctgcacctcggcggtggcgccgagccggggcagcgcctcggccgcggccgcgaagcagatgacggcggcctcgtgcaactcggggtcggccagaccctggcgtgcggcctcgatccacagcggattgcacggagcgggcagtgaacggccgtgctccgcgaggggtttgaccgtccggtaggcgatctcggcggcctcggggtcgtcgaagagggccgccgtcaccgccagcggcacgatccagccgtcgtcacccggctgggcgtcgatcatgcgcagttcgagatggccgcgcgggcgcaccggcgggaacagggtcgagacgtgatagtcgaggtcgccgcggtccggcggggtgccggaccgggtccactcccggaaactcattgcctccggtacctgccaggggccgctgtcggcccgtatgcacatcaccggcgcgtccagcacgtgccgggcccaggtccttcgtgggtcgccgtcgaggggcggggcactcgaacgccccgggtccatggcggcccacaggtactgccgggtcgagcgccagcccgtggcccgcccatgggccatgggggagtgcgcgaacgcggccacgaggaccgcgcccagctggtgcgccagccaccagcgccgcccgtgcccgagcggccccggctcctcgtgcccggcgtccaggcacacctggacggacgcggaggagcacatcatggcgcggccctcgggtccggcgcggtccaggtaggactccatggcgtcgtagcgcggctcatggagatagcgggtcggggggctccaggggtcgtggccgtatccacggaggccgagacccgcctcgcgcagcagcgcgcgtaccgcgtcgaggtcggcggagacggatccgatgcactccatcagcgaggcggcgggagcggagctgagctccagctggccgccgggttcgacggtgagcgccgaacgcaggggcacggtccgcaatgcggcgtaggccgcatcgagtcgttcgggtgctaccgggagctgcggccgccgcagctcgtggactatccattccagttcgacaccgagcgtgcggggcggtccggtcttgaagcagataccgcggaccagagcctccacatcggcctcggtgacggcggagcggggctccgtacagtcactcaccgaatcggacatgtcgggatcctcctgagattccaccatgtcgccggacccggcttcggttgagccggaccggcaatgactcgtcccacccaaaaccctcgcgccgcttcgcacaagggtgcacatcgttgtttttcggaccgtttcataaaccgagaaccgttgtgtcggggacagggaaactctgttgcggcgtatgtccagcatcgctcaccattcgttcatgagcacgacgggggagatcgcggcaggggaaatcgcaggcgggggcctcacagcgtccacgggggtggtgctgtgagcgcgcgcctgcgcgcgatcgcgcgggagacggaggagatcgtcgcggcgggccggtaccacgcgtccgacgggcgtgcggtgtcgatcgccgcggcggtcgaggccgcacgggccgcgacccgggtgtatgggccggaccctgtggagatatcgcaggtcggcccggtcgccacgctcttcgaggtgaccggtgagagcagcctggaggcggcccggcgactgacggagcgggcgggcgatccggtcgccgtactgaacttcgcctcggcccgcaatccgggcggcggctatctgaacggcgcacaggcccaggaggaggccctgtgccgggcctccgcgctgtacacgtgcgtgctgggggcccgcgcgttctacgagcaccaccgggcgcaccgggatccgttctacacggaccgggtcatccattcgcccgccgtgccggtcttccgagacgaccgcgggcgcctgctcgacaagccgtatccggtcggcttcctcaccgccgcggcgccgaatgccggggtcgtgctgcgcagcgcgccggagcgggcccccgagctgccgcgggccctcgcggcacgcgccgagcgggtgctggagacggcggtgacgcacggctaccggcggctggtgctgggcgcctggggctgcggagtgttccggaacgaccccgcgcaggtggcgggggcgttccacgggctgctgggtcccgggggccggttcgccgggcacttcgagcacgtcgtgttcggcgtcctcgaccggacgccggggacggcgaccagaggcgccttcgagcgtgcgttcgatggcgaggtgcggggcgctcagcgccagccgtagcgctcccgcagccggtgcaccaccaggttgaaccgcatccggtccagggcgcaggcctcccgccgcatgccgctctcgtgcagccgcagcacgcggtccacggccacccaggagtcgcgtcccgacctgtcccagggcccgctgccgatcggcacccactcccggtcgccgtcgtgccgcttgctggagagctgcaccgccagcagcgtgccggccgcctcccgggcgacgacgagcaccgggcggtccttgccgcgcccgtcgttctcctcgaagggcacccaggtccagacgatctcgccggggtcggggtcaccgtcgtgcgcgggggagtactcggtccgcacccggcccaccgtgcggggttcggcctcggtggtcgcggaagggccgtggcggccgggaatgtcttcatcggtaaaggcagtcacgcgggtcacggtagagcctgctcggcacggctcgccgaacgggtacggcacttcgggcgtacgggggacaactcccgtacgcccgaagccttaccgtttcacccctcgtccttctccaccggcaccttctccgtacgcgcgggcacgaacccgttgagcccggcggcgccgccgcccgccgtcccgttctggttcatcgacgccagcagctggcgggccagacccagccccgtgccgcccatggtgagcgccttggcgaacatgtcgcccatgccgtcggcgccgttgagcagcaccatgtgctcgacgttgttgaaggcgctcgcgcccgcctggactatctccggccagttctcggcgagttgctgcgcgaccaccgcctcctggttctcggcgagtgcggccgcccgcgccttgatggcctccgcctccgcgagacccttcgcccgggtcgcctcggccaccgcgagccccttcgcctgcgccgcggccgcctcggcctcaccggtggcccgggtcgccgtcgcggaggcggcaccgcgcgccttcgtcgcctcggcctcggcgctcgccgccgtcttcacccgggtcgcctcggccgcggccgccagctccgtctccttggccttggcctgcgccgcggagatgcgcgcgtcgcggtcggcctcggcgcgggcccgggtctcgtacgccttcgcgtcggccggcttgcggacgtccgcctggagctgttgctcacggcggtgcgcctcgagttcggcgacccgcgtctcctggacgacgacgtcctggcgcgcggcggcgtcggcgagcggaccggcctgcttggccttggcggccgccttgtcacgctcggcctggtacccggcttgcaggatctcgctgtcccgggtcgcctccgacatccgggacgcggccaactgctcggcctcggtggcgagacggttcgcctccgcctgcgcgatccgcgcgtcccgctgcacggcggccgcgtgcggcatggccaggttcttgatgtacccggtcgggtcctcgatctcgtggatctggagcgagtcgacgatcagacccagcttctccatctccgtaccgcacgcggcacgcgtctgcccggtgagcttctcgcggtcgcggatcatgtcctcgaccgtcaacccgcccacgatggaccgcagatgaccggcgaacacgttgtgcacccgctccgccatcagcttctgctggtcgaggaagcggcggcccgcgttggcgatcgacacgaagtcgtcgcccaccttgaagatgaccacgccccgcaccttcagcggaatgccctgcgtggtgacgcagtccacggacagctcggtctcgttgagatcgagcgacatcttgcggaccgcttgcacgcccggcagcaccagcgtgccgcgccccgtcacgatgcggaaacccatgccttcttcaaggccttcggtccgatgcttcgaaccggagatgatcagtgcttcgttgggctccgcgacgcgccacatgagcttgaagaccacaacgatgaagatcagtgcgaggactgctgcccccgccacgacgccgacaatcatcggcatacgccccctttggatggtgccctgacggcaccgaacgaacgggagtgtgctcctgtgcaaggccgaaatacagacgctgacgcgtccttgtcgcaatcttgacgcgtacggctctcacctgggggacgggcggctcaactgtcgtacgccgcagccacgtagacggtccgcggcggcaggtactcgatcaccatcaccaccgtgcccggctcgatccggtcctgcgcggacgccggatacgccaggaagtgttccgcgccgccgcgcacccggacgatcacctcgccgacgagcccggggccgatcgtgccggtgacccgccccatcaacccgaccatcgacgcatcgtccatggtcacagcgtacggcccgaactcctccgggtcgccgccgagtcggcgtccgtcgaggccggaggccactgttcgtgccatcgccggtccgcctccagctgggcggcgagcgagacgagcaggggttcgctgtgcgccgggcccagcaactgggcgcccacgggcaggagtccgccgtctcggccgccctcggccggggaggggccgccgtccacgaaaccggcggggacgttgacgcccggccagcccagcacgttccacggccaggcgtaggggcaggcggcgatcatggcgcggtcggtcccgaaaccgttcaggttcaccatcgagccgatgtgcggcgggggagcggcggtcgtcggcgcgaggagtacgtcgtacacgtcgaagagcgccccgacccgccggtgcagcctggcctccgccgcccgtgccaggcgcaggggtgctccgccgagcagtcggccgaggcgggcggcgtcgcgggtgcgccggtcgaggaggtccggaaacggcgcgtcgcgcacccactccgccaggccggccgtggcccgcgggacgaacgtcagtccgatccggccgtagcgcggctccgcctcctcgaccacgtgcccgagcgccgccagccgctccgccagctcgaggacccgcgcccgtacccggggatcgagccgggcgggcagcgccgtgaacgggggcttgagcgagagggcgatccgcagccggcccggctcgcgcccgacggcctccaggacgccggtggcgggcgggcggtgcaggtcgcccgcgtggttgccgctcgccgcgtccaggagcagcgccgcgtcggcgaccgtacgggcgagcgttccgttgaccgtgatgccctggaaggactcggggcgcggccaggtggagatccggccgcgctgcggtttgatgccgaccagatgcgtccaggaggccgggatgcggacggaacccgcaccgtccgagcccagggcggccgggaccaggcccgcggcgaccgcggccgccgagccgcccgaggaaccgcccggcgtgtggtccggatgccagggattgcgggtggcgccgaaagcgggcccctcggtgaacggccactggcccagctcgcaggtgttggtcttgccgacgatcaccgccccggccgcccgcagccgccgtaccgcctcactgtcctcggcccgcggcgggaactcgccccgacagccgaacgcggtcggttcgcccgccacgtccatgtcgtccttcaccgccaccggcaccccgagcagcggccgccgcgcccccgccgccagctcccggtccgccgcctgtgcctcggcgagcgaggcctcggcgcgcaccagccggaacgcgttcagcgagggctgcgtcgcctcgatccgggccagcgtccgctcgacgagctcgcgcgaggtcacctcgccgtcggccagggcccgggcgcaccgggcgaggccctcggcacgctcgggaggggtgtcggcgcgttcggcagccatgcgggacacctccgggtggacgacgtctaccgaacggtaaccgcccggcgcccgacgcggtacgggatctcgaacttccgccccggaaacgggtgttcaggggtgcatctggccgatgaatgtcgggaaagcgcttgttccgagcggaagttgccccggtacggagcgccgccgccgtcttctgcaaagatgccgtacgtcatggtgcacataccgaacgagcccgtcccttcgccgtccgcaccacgctccgtgccgacgagcgccgatgtggcacgcctggcgggagtctcgcgcgcgaccgtctcgtacgtgctcaacaacaccagcgccgtccggatcagcgagcccacgcgccgccgcgtccacgaggccgccaaggaactcgggtacgtcccgcacgccgcggcccgcagcctgcgcgccgggcacagccgtatggtcctgatcccgacgccgaacgtgccggtcggaccgctctacaaccagttcttcaacgaactgcagtgggcgctcagccgacttgagtacaccgtggtgcagtacggcgacctgtcgccgcacggcgacgaggcggcccgcgcctgggccgagctgcggccggtcgccgtcctcgtgcccggcggcgggctcgggccccagggcctggccgtgctcaagcgctccggcgcccgcgccgtcgtcaccctcggcgccgaacgcgtcgagggcgcccacgcggtgctgctggaccacgagggggtcggccacagcgccggccggcacctgctcgcccgcggccgccgcgcggtaggggtcgtggtacccgaggagcccggcttggagatgttctccaagccccggctcgaaggcgtccggcgggccctccagggcaccggggccaccgtcaccgaactgccgctcgcctacgaggaggaggccgcggcccgcctcgccgcgcgctggcgcccgctgggcctggacgccgtcttcgcgtacaacgacgagtacgcgatgctgctcatgcgcgccctccaggacgagggcatcgccattccgcgggagacggccgtgatcggcgccgacgacctgatgctcggccggctgctgcggccacgcctgagcacggtccacatcgagctgccgtcggggcgcgacctcgcggagctggtcgatcgcgcggtacgcgatccgggcgtcgcacccgaggtgcacgaggtgctcggcacgagggtcgtacagcgggaatccagctgaacgtccgggcccggctcacgggtcacgggtcccggggaacgccctcgggcgattcggacccgactccccgaccgctccccggagttgcgcctgccccgggcccggggcaggcggcccgttcctcatcacggcatgccgcgaacgccgcacgctcgaccggggcgatgcctgatcctgagcgggtgctactcgccctgctgtgcctgagcctgcgcctgctgtgccgcgaccgccttgcggacctcgtccatgtccagcttccgggcctgtccgatcacgtcctccagggctgcctcgggcagggcgcccggctgggcgaacacggcgacctggtcgcggacgatcatcagcgtcgggatcgactggatgtcgaaggccgcggccagctcgggctgagcctcggtgtcgaccttggcgaacaccaggtccggattggcctccgccgccttctcgtagaccggggcgaactgacggcacggcccgcaccaggacgcccagaagtcgatcaggacgaactcgttgtccgtgaccgtctggtcgaagttctccttggtgagctccacggtgctgctcatggcgtgtttccctcttcctggtgtcgggggctcggggcaagccgctgtccacaacgccaccctccggcgccgtattccgcgcgcgtacccgtgtggccagcacgcacaccagctaccagactgaccccatgacggaaacggaatccatcgcgtacgacgtcgtggtgctcggggccggtccggtgggggagaacgtcgccgaccgcacccgcgcggccggcctgtccaccgcggtcgtcgagagcgagctggtcggcggcgagtgctcctactgggcctgcatgcccagcaaggccctgctgcgcccggtcatcgcccgcgccgacgcccgccgcgtgcccggcgtgagccacctcgcgcagggccacctcgacacggcagcggtcctcgcccaccgggactacgaggtctcgcactggaaggacgacggccaggtcggctggctcgacggcatcggggccgacctgtaccgggggcacgggcgcctgtccggaccccgcgaggtgacggtgacgggccccgacggtgatcgccgggtactgaccgcccggcacgcggtcgcggtgtgcaccggcagccgcgccctgctgcccgacctgccgggcctcgaccaggtcgaaccgtggacgagccgcgaggccaccagcgctcaggccgcccccggccggctgatcgtggtcggcggcggtgtggtcgccgtcgagatggccaccgcctggcgggcactcggctccgaggtcacggtcctcgtccgcgggaagggtctgttgccccgtatggagccgttcgccggggaactggtggcggaggcgctcaaggaggcgggcgccgacgtccgcaccggcacatcggtgtcggcggtgacccgcgagggcccgaccgtggtggtgctgacggacacgggcgaccgcatcgaggcggacgagatcctcttcgccacgggccgcgccccgcgcaccgacgatctgggcctcgacacggtgggtctggagcccggctcgtggctgtccgtcgacgacagcctccgggtgacgggcagcgactggctgtacgcggtcggcgatgtgaaccaccgggcgctcctcacccaccagggcaagtaccaggcccggatcgcgggcgcggccatcgccgcccgggcctcgggcgtgcccctgctggaatcggatccctggggcgcccacgccgccaccgccgaccacgcggccgtcccccaggtcgtcttcaccgacccggaggcggcggccgtgggtctctccctcgccgaggcggagcgggccgggcaccacgtccgcgccgtcgacgtcgagttctcctcggtcgcgggcgccggtctgtacgccgacggctaccgcggccgggcccgcatggtcgtcgacgtcaaccgcgagaccctcctcggcgtgaccttcgtcggccctggcgtgggcgaactgatccactcggcgacgatcgccgtcgccggcgaggtgccgatcggccggctgtggcatgcggtgccctcgtatccgacgatcagcgaggtatggctgcggctcctggaggcctaccgggacgcctagggcctgtcgtcggacgcgtcggtgtcttggaccggcaggacgcgtcggtctgttgggccggcccggtccgcgacgtcgcggcgacatcagccgcggcgtccggggcggcccctcgccgcgttggcgcacgaccggagtacggcccggtacgcgggtcgtactccggctcgcgacgcaccgccccggagaccgcggcctgaccctgcccgagccggaactcaccatggggcaggccctttggacacggcagcgcgggcaccgcgtcgggcgcccgcgattctgagccgaccggcgttctcggtcgggcggcgcgcactcagtcgggcagcgcgaaccccagtgccgccgccgcccgttccggcgtcggctggctccaccgcagtgccatcgcctcgttcgacgacagcgaccgcagctccgcccggtcgagatagagcatgccgtcgaggtggtccgtctcgtgctggacgatgcgggcgggccagccggtgaactcctcgtccacggcgcgaccgtgctcgtccagcgcggtcagccgcacccgggcgggccgggccaccacagcctgccagcccggcacgctgaggcagccctcgaagaacgcggcccggtcgctgccgacggcctcgtacgacgggttgaccagcacccggaagggctgcggcacccgcccccgcaccgcccccacctcctccggcaccggcgccgggtcctcgatgaccgcgatccgcagccccacccccacctggggcgccgcgaggccgacgcccggcgccgcgtgcatggtcaggcgcagggcctcgacgaagcgggcgaggagcccgggtccgagctgcccgtcgtagggctcggcgccgcggcgcagcaccgggtcgccggccgcgacgatcggcaacgggccgccggtggcgaggagttcctcgacacggtcggcgagcgggcgggaggcggagcgggtgtcggggaccgtgcggtcactttcggatgccatcgcgtcagcatgccaggcagatcgagcggcacgaggcccgtccccgcggccatgtggcccaggtcacgtacatccgcgggaactcacccgcactccgccccgactactgaagcgccacggccctcccgggtcccgtgccccgaggttgtcccacgtccccattccccattccccgtcccccggagaagcccgccgatgaccaccgctccctccgccccagacgctccctcgaccacgacggacgagcccccgcagtccggtacgcccgggcccgccagatgggccccgctgcgccccctggtcctgcgcctgcacttctacgccggcctgctcgtggccccgttcctgctggtcgccgcgctgaccggattcctctacgcggcttcctaccaggccgagaagatcgtgtacgcgcatgagctgaccgtccccgtcggcgacaccgagctgccgatctcccagcaggtcgccgccgcccgcaaggcccaccccgagggcacactcacggccgtgcgcccctccccggaggcggacgcgacgaccagggtgctgctgtccggcgtcaagggcgtcgacgagggccacaccctcgccgtcttcgtcgacccgtacaccggcaaggtgcggggctcgctggaacagtacggatcgaccggcgcgctgcccctgcgcacctggatcgacgagttccaccgcgatctccagctgggtgagaacgggcgcctgtacagcgaactcgccgcgagctggctgtgggtgatcgcgggcggcggcctcgtgctgtggttcgggcgtcggcgcgcgcagcgcaaggtgcgcgggacgagcgggcgccgccgcaccctgggcctgcacggcacggtcggcgtctgggccgcggccggcttcttcttcctctcggccaccggcctgacctggtccacctacgccggcgccaacatcgacgaactgcgcacctcgctcggccaggccaccccgtcggtgtcggcggcggcggccggcgagcacgcgggccacgacgccgcggcgggaaccggcggtaccgagcacggcgtgggcctcgacaagatcctcgccgccgcccgtgccaaggggctcggcgatcccgtcgagatcgtcccgcccgccgacgcgtcgtccacgtacgtggtgaagcaggtccagcgcagctggcccgagaagcaggactcggtggccgtggacccggcgaccggcgaggtcaccgacacgctccggttcgccgactatccgctgctcgccaagctgacccgctggggcatcgacgcccacaccggcgtcctgttcgggctcgtcaaccagatcgcgttgatggccctcgccctgtccctggtcctgctgatcgtctggggctaccgcatgtggtggcagcgcggccgggcctccgccttcggccggccgatcccgcgcggcgcctggcagcaggtccctccgcagatcctcgtaccgtgcatggcggtgatagccgtcctcggctacttcgtgccgctgctcggcatcccgctggcggtgttcatcgccgtggacgtcgtcctcggcgagatcgcccaccggcgtgggcagcgcacttacggaaggcaggtagcgtagccggacacgcggatgccggagggagtcggacatggcacagcgcgaggccaacagcccgcaccgcggttcccggcgccgcgggcagggcgagctggaggtccaggtgctcggcgcgctgcgcgaggcggacggcccggtgaccgcgtcctgggtgcaggagcacctcggcggcgacctcgcgtacaccaccgtggtgaccatcctgacccggctgctggccaaggacgtcgtctcccgcgagcggcaggggcgttccttcgcctggacgccgaccgccgacgtcgcgcgcctcgccgcgctcaagatgcgccgcctcctcgacggtgaacgcgaccgcgaagccgtcctggccagctttgtcaccgcgctgccgccggacgacgaacaggtcctgcgcacactcctggacgcggcggacacggcggacggcggtacggaaggctgacgcctcgtggaggttttgtcttcctgccgctggtctcgccgctggtcctgccgctgagcgcctggccggtggcgcgcctggccgagttgcacgcggccgcacccctctgaggcccgtacacggaaagaggctgagccccgttgccaccggggctcagcctctgcgtcattgcgctacggatacgtcgtagcgctacggatacgtcgtagcgcgacgggtacgtcgttgcgctgcggatgcgtacggcgctacggaacgagtgaacgcttctcgtgcggacggatcaccgtgcctcgaagtcgcccgcgagcgccgaggcgatccgcagctgcgagtccgcctcgtcgtcccgcccctggcgctggagcgtgcggcccagcatcaaccgggcgtagtgctccacggggtcgcgctcgacgaggatgcgcagctcggcctccgcacggcccaactgggccgagtggtagtaggaacgcgccagcagcagccgcggcccggtctgctccggcacctcgtcgaccagcccgtccagaatccgcgcggcgacggcgtagtccttggcgtcgaagaacatctgcgcgcgctcccagcgctccgcggccgtcccctggtcgtagtacgtcgtttccactgctgacctccttcgacgctcacaacggcccggtttggttgaatattccacgactgggtcggggggcggtgccgcccttacagggccgcaagctccgcgttcgcccgctccgtcaccagcgtcagcacacgcccggccgtctccagatcctgggccgggatgcccgcgtacagccgggtcgcgatctccttgccgccggcctggatgctttcgaacagctcccggccgctgtccgtgagcgacacctgaccgggtgccggttcgtccagcagcttcgcggcgatcagctcgtcgacggcctgccgggcgggtgtttccccggtcttcagcgcaccggtcaggcggtcgacgagccggtcgcgcgcgacagttccgccggcggccgcggccgcgtgcagggccaccgactcctcgaacgtggtgccggtgcgggccagtacggtctccagcaggccgcgaccggcgtagtgggcaaggcctatgacctgaccgttgacggtggggttggtggtgaggttggtggtggggttggtggtggtcacgactgctcctctgcggcaggtgtgccgagttcggtggatgtgccgggttcgatcgatgcgtcgagtggtgcgtcgagcagagttctcagttcgtgcgtgaatcgcgtcgtgcgcgggctgtcgaggccgcccaagggctggaggagctgctccagcagccggtggaccaccttgatcgcctgctgggcgacctcgtgtccccgcggggtgagcgacagctggatcgcgcgcgggtccgccgggtcgcgggtccggtcgacgaggccgccggactccagcgcgcgggccagcttcgagacgtagagcgcttcgagtccggtgtggtcggcgagctgccgctggttgggcctgagcccggtgcggtgcatgccgaccagcgtggcgaccagcgaatactgcgcgtgcgtcagccccagcggcgcgaccgcccggtcgaccgcgacgcgccatttcatcgacagtcgccagaccaggaaaccgggggtcgcgccctcgggggccgtgtcgctcaccgtgttgctcatgacggatactgtacatagatactatagccatagctactattttctcgtggtgcgacgcaccgcatcccgaagggacggggccgatccggccaggggaggggggatggactgacggaccgtcccggccggggctaggtttgccacatgagcaatcttgatcgcgaggcagtgcccacgctgtgcggcggccgtgggttcgtggtggccgagccggtgcgcgaactcctcagcccccgcaaggtcaagctcggtgagtccaccgaagtccgccgtctgctgcccaacctaggccgccgtatggtcggcgcctggtgcttcgtcgatcactacggtcccgatgacatcgccgacgagccaggcatgcaggtcccgccgcacccgcacatggggctccagacggtcagctggctgcacgagggcgaggtcctccaccgcgactcgacgggcagcctccagacgatccgcccgcgcgagctgggcctgatgacgtccggccgcgcgatcagtcactccgaggaaagccccaagtcgcacgcgcggttcctgcacggagcacagttgtgggtggccctgccggacagtcaccggcacaccgatccgcgcttcgagcaccacgcggaactgccggtcgtcacggcgccggggctccaggccacgctgatcctgggcgaggtcgacggcgcgacctcgcccggcacgacgttcaccccgatcgtgggcgccgacctgtccctcgcgagcggcgccgacgtacgactgccactggagccggacttcgagtacgccgtcctgtccatgtcgggcgaggcccacgtcgacggcgtaccggtcctgccgggctcgatgctctacctcggctgcggccgcagcgaactgccgctgcgcgcggagtcggacgcgggcctgatgctcctgggcggcgagccgttcgaggaggagctggtgatgtggtggaacttcatcgggcggtccaacgaggacatcgcacaggcccgttcggactggatggcaggctcccgattcggtgaggtggtggggtacgacggcgctccactgcgcgctcctgaactcccgccggtgccgctgaaaccgcgcggaagggtgcgctgacctggggctccagctcaagcgcaggcccctcgcgggacgtggctgttcccgctcgacaccccgttttcccgaggggccgaccgctcctgcgaagtccatcgacggacagtgctgcgttctcgtgtctggacatctgtaggcgggtttggtcagcccaatgctgggctgccgctcgcgtgtagggccaggcccatgctgacttcggtgacttgtgctggggcaaggtgccccaagtgcgtgggcgacgaaggggagaagaagtccgtgacgagggggcttttgtgagaatcccccaatgccccggcgtgccgctgctgccgtactcaccccttgggcggaccgccatggggagagtgtggctacagtgacggccctcggaagcggcttgtcggcaagccgggctctgcttcagaacggggaacggcagtcagcaggttctcgccgacccaccgtcaccgagtacagctctcactcagccgccgtagccgcgctgcgccacagtggcctgctccggcgggcgccactgtccggccccgcccgcgccttgaagggcgcgacgtgccgctcctcagcccacgccacccacacattggttacacaccgtgaccgtccagtaggatcgatccacgcgcatgtgacctcgctggtgtgggggtgtgcgtgtcgtccggactcggttcacgcttcgtcgtggtgggtgaggtggccgtcggtgagccgccagtagtgctggtgaggagttagttgccaggtctcgtcggcagcgatcacctgcgtgatccactcgtggagttgcgggagggcatgcgctcgtagaacagcgcgggttgcagcacgttcagtggcatcgactgggtggacgtctatgcggaagccaaccatgtccgggtggatgccgcggccgtagttgcgggggttcggagcgacccattcggctcccaggacgatggtcccgctgtcatgcccagtgaggaactgcaggtccgtgacacgggtcatgtaagggccaagacgctcgttgatgtcggtggtggtcagtggccaggcacggtgccggggcagtcttcgatttcgtgcggacatggcaagcagaatggcagaaggtcactgtcggccctcatgggtgttctgttcggcggcggtttccagaagctggcgagcggagttcgcgcagcggatcgcggtctacgagtgtgctgtccggacggcagatgctcgcgtggccgtcgtactggacgtagaaccgtcgttccgatacagcaccagattcccgtccttctggtacgtgaacgtgtaggagccgttctgggagaccaggtactggtcggccacgagcatgtcaccgggcagcatgcggtcgccttgggccgcgggccgttccgtgtcgtatatgtagccgagggcctggtggttgagtgtgctggcgatggtggtgttcccgaaccagggatccatggcgtcgggctcgttctgcccctgtggcgcgccccgtgctgcggcatgtatgtcaggtcggagtgctcgtactgccattgggcccacaggcggtcgatgttggcgtggtgcagccagaacaccgggtcgttcggggagctcagcggcctcatgtggccaccgacccactcgtgcacccggttgtggatgttcggcccgatccagccttcgagctggttccggaagctcgggttgctcgtcgtgtcccagggcgcgctgtcatagggcgtgatctgaaggcagtcggccacgtcctgagcggtgggcagcgagccgatgtgcacccccagttccctggtcaaatagttcgcgccgatgtcgatctttaggcagacccatttgccggcatcgaaggcaaaactgatgtaaccgtcgtaaatgccgcggcgcttgagttccagcagggcgtcgacgaatgccgatagctcggctgtgttcatcattgcctggtctctgcggacgagagccatcattgcttcaagggtcaggtgttcgccccctacctttcagcgtctgaccggatcaggcatccggcaacatatggacggagaagttgaaaaggctacggacggcgccgacgccgggggacggacgacatgtcggtgccgaggccttggggcgcgcaacgagccttgccgtgcggtgcacttgaacaccggcgacgacggcacgccgttggtcgcccacccccgagcggccctgggattcccgctgtcggtgcttgcggccctcggcgcggtgggcggggcgttcgacgtcggcctgccggttgacaccgcgccaggtcgagccgtcacgccgggggctcggccgccaggagctgggtcgcggccagttcgcggtagaggtcgtcgtcgtcgaccaacgagtggtgggtaccgacggcgcggacgccgccgtgctccaggaccacgatctggtccgcgtcggtgaccgtggacaggcggtgggcgatcaagaggaccgtgcaccggcccgcggcacgggcgacgagttcgctcagggcctgttcgttgcgggcgtcgagctgggccgtcgcctcgtcgaggaggagcacctgagggcggcggagcagggcgcgggcgatggcgaggcgctgtcgttcgccgccggacagggtcacgccgcgcgggccgacgggagtgtccaggccctggggcaggcgggcgacgagcgcgtcgaggcgcgtgacggccagggcctcggccaactcctcaggggtggccgagggtgccgcgtacagcaggttctcgcggagggagccggccatcaccggggagtcctgctcgacgtacgcgatccgccgccggacctcggcacgcggcagtgcggagatgtcctggccgccgatcctgatcgtgcccgcggtcggctcgtagaagcgctggaggagggagaagagggtggtcttcccggcgcccgaaaggccgacgagcgccgtctgcgtaccgccggggaccgtgaagccgacacctcgcagggcgggggcgcggcccgggtaggcgaactcgaccccggtcagctcgacggcgggcggcgcggcgtgggcgggggcggcggcgggcggtgcgtcgatgtcgtcctcgaccggcagcccggcggcctcctggatcctgcccaccgcgcccagcccctgctggagttgggcggccccgccgaccagctgggagaccggactcgccaggaagaacacgtacaggaggaaggcgatcagctcggagaccgacatcgtgcggttcgccacgaaggtgccgcccacgccgagcaccaccaggaacgcggtctggatggcggcgccgccgaccatggtgaccagcgcgctgtatcgggcgccgaccaggccggccgcgtacgcctcgtcgaccgcgtcctcggcggccagcgtctcacggccctcggcgccgttggccttgaccgtacgggccgcgccgagggtgcggtcgagcacggcgccgaccgcgccgacggagctctgggaacgggccactgcggccttgatccggggcaggatcacggtgatcacgacgccgaccagggtgagcaccagcagggtgaccccgagcagccgggcgtcgagcgccgccatcatgaacagcgccccggcgaaggtcagtacgccgttgaccgtcatgatcaggccctcggtggccgcgctcttgagcagggtgctgtcggaggtgacgcgggcgatgaggtcgccgggggcgcgccggtccagttcggcgacccgcagccggatcagacggtgcacaagaccgcgccgtacctgccggaccacccgctccgaagtgcgttgctggagccaggcgttgaggccggtcagcagggcgcccgcgaccaggaacacggcgagcagcgccaccggggcgaccacgccggcgccgtcgtcgaggcggtccaggatcgcctgcgcgaacttcggctgcaccagccccgacacgctggccagcagagtgaggacgagggagagcagcagcacccgccagtgaggccgcgcgtagccgatgagggcggacaaggagccggggggagtagtgggcgtgggatcgtcggtcatgagcctcgtactccgggcacggccgactcggccgtcagtgtttcgaggcggtcggcggcggactcgctgccccccgcggcccggaaggactccccgacggcctcggccgccttccggtggccctgagccggatcgaggacggcctcgacggccgcgccgatcctcgccgcgtcggcgcggccgaaccgcagccgtaccccggcgcccgcgtccacgacctgggcggccacgatcggctggtcgtcacggatcggcgcgacgacgagcgggaccccgtgccacagggcctcgcagacggtgttgtgcccggcgtgacagaccaccgcgtcgagccgttccagcagggcgagttgaggaacgtaccggcgtacgaggacggtgtcgggcaccgggtgctcgaccaccccgccgggatcgacgagcacggcccgcacccggtccgcgatcccgcccagcgcctcggcggccgcgttcaggaaacgggcgccggcgtcgttgttggccgtgccgaggctgacgaggacggtgggcagcgcggaggcctccagccactcccaggggaagtcgtcggggcccgccgggcgggcggcgacggacggccccaccagccagacccggtccggcagttccaccgggccgagcagcgcgcgcgtggtgtacgcgagcaccccgtgcggagagaaccgcggatccgcggcgccggcgccgcccgtgatccggcggcgcagctccccgagcagaccgtcgagccaggccgcgactttgggcatcccggccagcgggtcgaccagttcggcggacgtggtggccgaggtcacccagggccgcccgagcgactcggcgaccagcgcgcccgccaccgcctgctggtcgcagacgacgacatcgggatcgtacgcctcgatcgccgcccgcaccccgggcgccatggcgtccgccaacgggacgaggaagctctcccagaggaactggaaggcggccggtcccttcaggccggcgggccgggaaagaccgtcctcgggcagcgcgcaggggaagacgacggcgtccgcccccgcgagaccgcggaccagttccggatggcccgcccaggcgatgtcgtgcccgcgggccgcgagggccgccgcggtgcccacggccgggttgacgtgcccgaccagcgggggcaccacgaacaggaatcggcccatctagcgggcctcccgcagcgcgagcgcctcctggccgagcagccagtcgcgtacgagggcgtacgtctccttggtggcctccaccagcaccgagtggccgagaccgggcagcacgaccgtacggcagcgcgccagggacgcttccagcatcccggtctgcgcggcgagcttggacgcgccgccgaacacggcgaacaccgggcagcggatcgcggacaggtcgtcgtcgaggagagagctgagcgggatctcctgggcgagggcggtctcgtccagcacccggccggccgcccggaacggccgggcgttgcgctcgcccgggttctcccgcagccactccttgacctctcggaccaccaggccgccctcctcgccgaccaggccctcgtacatgctctgcgcccaggcccggcccggcggctcggcctcgatggcgatgacgctggcgacccgctcggggtgggcggcggccatggcgtacgcgatcgccccgccgaaggagttgccgacgaggtgcaccgggcggttcaccgccagtgcgtcgagcagtgcgtcgaggtcgcggacgaagtcctccatgcggtagccggtcggcggccgggaggtcttgccgtgcccgcgcaggtcgtacatgacgacgtccatgccgtcctcggcgagctgcggcgcgaggctgaagtagtagctggcgaggctgtcgatgagcatgccgtggatgagcaccacgacggggcgcgggacgtcacccggcccacccatgcgctggacgtgtacgtcgatgccgttcacccgcagggtcgccaccgtcagcccacctccgcgacggcgagcgaccccaccacatagccgacgaggtcaccgacggtcagcgcgatgatctcctcgagaccgcggtcggccatgaacgcggcgaagttgacgcgctcgccgtagaactcgcgcagctgggcggagagagtgacgaggtcgatgctctccagctccaggtcgtcgtggaaggacgtgtccagggtgatctcggagtcgtcgagcccgtactcctccagcacggtgcgcaggatggccgagaggtccgcgagcacggtcgcctcgtccggggccgaccgcggtgcggggccttcgagttcagtggtcatcttcgctctcctgaatcgttgacggccgtccaggccacgacgtactccttgccgggctgtccggacggccgggggatggtcagcgaggagtgccgcacgcggtactcctcgcccgcgacacggacgctcaccacggcgccgtccgccgccgtgatctcgaactgcttgggcgcgccgcccagtccggtgccgcgcgccttcgcgacggcctccttggcggcccagaagcgggtgaaccagagtcgttcgggggctcctcgcggagcctgggcgagggctcggagcagctcgcgttccggcggggcgagggcgacggcgagggtgccctcgggacggtcggtcacttcctcgatgtcgatgccgcagggcccctcggtcctggccatcgccacggcgctctcgccgcggtgggcgatcgagacatgcagggcgggcagggtccggccgtagccgccggtcacgaaggggcggcccgtcgggtcgttgccgacccgcacttcggcggggaagacggggcccgcgccgccgtcccacatcagatgccgtacggcgtccttgacggcgatcctgccgagcagccactgccgtcggccgcgcggtgcgtgcgccgcgtaccgctcgcgctcctcgcccgccaggatgttccgcatgatcagctcgcgggtggccagatcgggccactcctcgtggaccagcgcccagccgcccggctgcatccgggacagggtgtgccgctcgggctcccggtccaccgcgcggatccgcgggttgctgtcgaagcggcggtcctgccagccggtgaactccgcccacacccggccccggtacaccagctgcatatcggcttcgagcgtggcgtcggtgaccgaggtgatccggatcaggcactccaaccgctccccgggggcggggtgcgggccgtggaagcggatctccttcatgccgaccgggaacaccgtggtgcgcaccggcagcctggacatgatccagtagccgaggagctgtcccacgttgtccagcagggcgcccggcgcgggcgggcagacgagcaccccgcgcacatgccgttcgccgaccgccgtcagttcgcgcacgccctggaagcgcggtccgtggaacatccagcggcgcgagtacagctccgcggccgtcagctcgggcttctcctccgccgcggccgggaaggtccagggctccgccggggccgggaaggcccagggcgtggcaggcgctgaccgcccctggtcggcggcgagttcgaccacggcctgcgcgtacgagccgagcgacgcggtgacccggtccgggctctcggggacgatccgtaccgggatgtcgaccgccggagtggccgtcacccactggtgcagccgtacgtcgtggacggccaccgcccggcggccgggggcggcccgttccgcgaagtccatcagatgggcgatcacggtggtgccggggaccacgggccagctgtcggcggggtcggcccggtcgggctgcttgaagaagcagtggtcgaggaggtacggcatggtgtcgacggacacgtgaagggtggtgtcgagggggcggggcgcggggggctccgtcgtacgagggccgggcaccgcggtcgtacgtgagccgggcgtggcccgggtgtggtgggtcgccgccgcggccccgggcctgcggcggcccgccgacaccacgtccgaggcgagcgccgtcgcgtcccgcagcagcgcggacaactcagctcccagcaggccctgttcgccgagggtgccgtggtcgccgtggtcgccgacgtcccggggtggtggggtggccggggcgcggcgcggggccagcgcggcgctcacccggtggcgggtctccgcgtccagggagacgttcgctccgccgaggtccagccggaccggccggcggccggtgcgcgcgggtgcggcggccgccctgcccagcagcggggagaggtccgaagccgccccgtccgcccacaacgcgctcgcgacacggtggagttggggcaggcccgagcggttcggggagtgcgcggcgaccacgaggtgcgcacggccgtgcagggtgtcgccgatgagcgagccgaggtgtccggcgccgagctggacgaaggcgcggaagcccgccgcgtacatcgtgtccaccagcggccggaagcggaccggctccagcagatggcggacgaacaggtcgcggatcgccgccggttcctccgggtacggggctacggtcgtcgcggaccacagtggcagcgcggccgggtggagggtgtaggtctcggccgcctttctgatcgggccgaggtagggctccagcatcggggtgtggaagccggagcggaacggcaggatctgcgagatcagtgcccgggaccggaacacgtcgacgagtgcggcgacggcgggctccgggccgcagatcatcgactggttgggcgcgttgtcgtgggagaggaccacgtccgtgcgcccggccagctccgtcagcacctgctcggcgggggcgccgatcgcggcgaaggcgagcccgggaacgctcagcgcgtcggggtcgaagccggcgaggaaggcgtcgacctcgtccggtgcgtggatttcggcggcggccatcgcggtccactcgcccaggctgtgtccggccagcgcgtcgggtgcgacgccgagccggcgcagcgccgcgtcgaggagccggccgagttcgaagacgccggtgccctgccggcccacgtcgcccacggtggcgtcggcgacggcccgcgaccagggcagcccgaagtgccgggcgacgtcctcggagttgggcacgaactcggcctccaggccggggaagacgaaggcgagcttgccgccgccgggccccagcagcgggctcggcacgaaccacacgtcgccccggccccgccacccgtcgcccttcgcgaccgccttgcgggccagcgccagccgtttcgcggtgggcccgacgacggcgagccgcaccggatcggcggcgggcgccggcgcgcgttcgtcgagaccggcggcgaggatcgcggagtcgtcgcggtccagcagcgcggccatcgcctcgggtgtcggcgcggtcagtcgcagcacccgctccggctcgtagacctgggccgccctcgtgaccgccacctgttccagcaccacatgcgcgttgatgccgccgaaaccgaaggcgttgacggcggcccggcgcacgggctgccggtcgtcggcgggccagggccgggcggcgctgatgggggcgaaccgggtgcgggccagcgccggatgcggctcgtcgcagtgcagggtcggcggcagcaccccgtggtggacggcgagggcggccttgatcagcccggcgatgcccgcggcgggcatggtgtggccgatcatcgacttcaccgagccgatgacggcgcccggttcgtcggcggtcgcgtccttcggtggcggcccgaacacctcggcgagcgtggcgagttcggcgccgtcgccggccggggtggcggtgccgtgcgcctccaggagcccgatcgagccgggtgccgccgggtcgagcccggcggcctgccaggcttgacggaccgcgcggacctggccgccggagtccggcgccatgagactggtcgtacgtccgtcggaggcgacgccggtgccggtgatcgcggcgtagatccggtcgccggcgcgctcggcgtcggcgagccgcttgaggacgacgacgccggtcccctcgccgatcagcaccccgtccgcgcctttgtggaacggccggatgcgctcgctcggcgagagcgcgccgagttggctgaacacgctccagaaggtgatgtcgtgacagtggtgcacaccgcccgccagcatcacgtcacaccgtccgtccgcgagttcgcgcacggcgtggtcgacggcgatgagcgaggaggcgcaggcggcgtccacggtgtacgcggggccgcgcaggtcgaggcggccggccagccgggaggcggcgaggttgggtacgagcccgatcgacgactccggcgcctcggggccgaggcggtcggtgaacgcctgccgtacggcctccagtcggtccgcgccgaggtcgggcagcagctcgcccagggtgcgtacgagctggctcgcggtccgcactcgctggtcgagcctgaccaggccgggggtgaggtagccgccgcggccgagcaccacaccgacccggtgccggtcggcgggcagccggtccgcgccgcccgcgtcggcgagggcctgcgcggccacccgcagcgcgatgagctggtcgggctcggtggccggcaccgcggccggcatgatcccgaactcggtgacgtccacctcggccagctcgtccacgaagccgccgcgccggcagtagacccggtcggcgcggggctcggcgccgggcgcgtagtgctcgtcggcgtcccagcggccgggcgggacgtcggtgatggcgtcgacgccggagaccaggttgtgccagtacgtggcgaggtcgggggcgccggggaagagcaccgacatgccgacgatggcgatgggttcggcgcgtccgggggtggtcatggtcaccagcccgaggcggtgtacacgacggcggtgtcgccctcggggccccaggccagctcgcgcagcaggctcatggtgccctcgtcggggtcgatgagccggatgccgcgggcggcgtagtgccgcatcagctcgggggtgaccatgccgtggttgccgtcgccggtcggtgcccacgggccccagtggacggtcagcccgcggcggcccgccccggcgtccgcccagcgggtgccgagggtctccagggcgtcgttggcggcggcgtagtcggactggccgcggttgccgagggtcgcggcgatgctgccgaacagcacggcgaaccgcggcccgtccggcaactcgctgatcgcgtccagcagttcacgggcgccgtcggccttcgtacggaacacccggtcgtacgaccgcgggcttttctccgcgatcagcttgtcctcgatcacgcccgccgcgtagacgacggcgtcgagtctgccgtgctcggcgtggatctccttcaccgcccggcgcacggcgtcgccgtccagcgcgtccacggtgcggtagcggacctcggagccgagtgcggcgagccggcgcagcgtgccacgcacctcgcgctcggcctggatccggccgatcgcccgttcgatctcggcgggcacccgcaggccgcccgcgatgagcgcggcgcgcagttcgcccgtggtgaccgcgggggcgagggcggggtcctcggcgccctcgggcagggcggtgcggccgaacagttcgatccggcagcggcaggcggcggccagggtcgcggcgaaccgggcggtgatcccgcgggcgccgcccaccagcagcacgaccgagtcggtgtcgaggccgagcgcggcggcctcggccgcgccgtcaccggccgggcccgcgcccgttccgccgagcaggcccaggccctcctcggccatgcgcagtccgcgacgggtgcccggggaacgtagcaccaccggctcccggtcgtcggcggtgagttcggcgacgagaccggcggcgatgtcctcgggcgcggtgccgggggcgtgctcgacgacccgggccaccgtgtcggggtactcgcgcgccacggagcggaagaagccgcgcagtccggcggaggtgcctgaggccagcacccagcgtgggttgcccgccagcacctgtcggtagacggggaaggtgtccggcaggacgggtggggcgtccggcgcgacgaggtggatgaggccgtcgaacttctcgtcggccgggggctcgtcggcggtgagcgcgtgggcgccgtgcgcggtgaggcgggcggtcagcgcgtcggcgacgggtccggtgccgaggagcaggaagttccggcccgtcagccggtcgccggtgggcgcgggctcggcgggggcgaggtcgaactcccgcatcaccaggcgcttgggcgccacgaccaagggctctgcgccggccggggcggactgcggggtggctgccggggtgacttccggggccctggcctcggctgcctcccctcgggcacccgccaccagctcggcgatgctcgcggcggtgcgtgccttcgccagttcttccacgtcggtgtcggcggtggtggtgaggccgagtcgggcggcgagttcgccggcgatttcggctcgtttgatggagtcgacgctgaggtcggcttcgaggtcgaggtcgggttcgatcatgtcgacggggtagccggtgcgttcgccgatcacgtcgagcacgagtgcgaggacggactcggcggtcggtgcggggcccgcggcgggagcgggggcctgggcagccggggccggggtgggaacggcgcccggtccggtgacccgctcgaccagcgcggtgatggcggcggcggtgcgtgccttggcgagttcttccacgtcggtgtcggcggtggtggtgaggccgagtcgggcggcgagttcgccggcgatttcggctcgtttgatggagtcgacgctgaggtcggcttcgaggtcgaggtcgggttcgatcatgtcgacggggtagccggtgcgttcgccgatcacgtcgagtacgaccgagagcaccgagcccccggcgggctcggccacggcagccacggcagccggtgcggcgggcggcgcggtcacggtgacgggggcgtcggcgtacgtgaccggggcgtcggcgtacgtggccggggcggcggccggggccgggggccgtaccgccggatccgcaccgagataccccagcatcacatcccgctgagccgcgatcatctcccggctcgtccgcaggaactcactgatcagggcctcggagccggtggctgccaccggtccggccgaggtgctgtgggtcacgagggcctccgggacgcgctcggcgggatggagtgcggcggcggggatcgcgccgtccgccgtgcggatcagatggccgtcgacggtccacgcggcgcgcacccggcgaggtgcccgggcggcgtcgaccgcgccccggccctggaagagccacgaggtcctgacgtccacaccggcgacggccagttgggcgagcgcggcgaggaatccgacgagaccggtgtgccggcccttctccagggcgaccgtgcggtgcggccggtcgccgaggaccgtgcccaccagccgggtcagcaccgagccggggccggcctcgacgaagacccgggccccggcctcgtacatcgcctcgatctggtcggcgaaccggaccggtgcgccgatctgggcggcgagttcggcccggatcgcctcggggctctccgggtagcgggcggccgtacggttcgaccagaccgggaagtcggtcgcgccgaccgggacgtcggcgagcaccttcgcgaaggcctcgcccgccgccgcgaccagcgggctgtggaacgcgcaggcgaccgggatgcgcttggcgcccaggccctgggcgcgcagccgctcgacggcggtgagcacgtcgtccgtggggcccgaaatcaccgtctgacggggcgagttacggttcgccgtcaccactgagccgtcgagtcccgccgccgccagggccgccgcgacctccggttcgcccgcggcgacggctgccatggtgccgggatcaccgtcgccggcggcgcccaggacggcggcggcccggccgcggctggtccgcaccagcgcgtcgggggtgagggcgcccgccgcggccagtgcggccagctctccgtagctgtgccccgcggccatcgccgggcgtatcccggccctggtgaggagctggaacgcggcgagtccggtgagcccgagcgcgggctgtgcgacggtggtgtcggtgatccgctcctgctgctccttgcggctcgcctcgtcgaaagccgtcggcgggaagaggacgcgggccgtcgtctcgtcgagccgcagatggcgctggagttcggggaaggccacgaacagctccgcgaacatccccggccgctggctgccctggcccgggaagagcagcgccacctcgcccgtctccgtgtcgtcggcggtgaacaggccctccttcggggcgtgttcacccgcgacggcccggcgcagcagcgccgccagctcctcggccgactcggccacgagggcgatccaggtccgggcgccacgcgtgccggcggactccgcgcggcgggacgcgccgagcgcgaagtcccgcagccgccacggctcgtggggtccggggtccgcctcgacgagggcgagcagctcggtggcggcgcgcacggccgccgcccggtccgcgccccggaaggtgaacagctcggcgggccactgctgggcggcggtgaccggcggtggaccgtcctcgtaggcccgcagcacgacatggaagttggtgccgccgaagccgaaggcgctgactccggcgacccgttcggccggcgcggcgggccaggggcgggcctcggtgtggaaggcgaacgggctgctctgcgcgtcccaggccgggttcggttcggcgaggtgcagggtcggcggcttcactccggtgtggagggcgagcgaggccttgatcagtccggccagcccggccgcgcacttggtgtgcccgatctgcgacttgaccgagccgagcgcacacctgccgggctcggcgccggcctcctcgaacacccgggtgagcgagccgagttcggtgcggtcgccgacgacggtgccggtgccgtgcgcctccacgagcccgacctcggcgggcgagacgcccgcgttgcggtaggcccgggtcagcgcgttgtactgcccctcgggccggggcgcggtcaggcccagcgcccggccgtcactggcgctgccgacgcccttgatgaccgcgtagatccggtcgccgtcgcgctcggcgtcggcgagccgcttgaggacgacgcagccgacgccctcgccgagcgcgatgccgtcggcggcgctgtcgaagggcgcggagcggccggagggcgagagggcgtgggcggaggcgaagagcaggtagtcgttgatgccgttgtgcagatcggcgccgccgcacagcaccaagtcgctggtaccgccgctcagttccttgcacgccacgtcgacggcggtgagggaggaggcgcaggcggcgtcgacggtgtagttggcgccgccgaggtcgaggcggttggcgatccggcccgcgatgacgttggcgaggatgccggggaaggagtcctcggtgagccgcggcagctgctccgccagcgcgggcggcagagtgccgagataggcgggcagtacggaccgcagcgtcatggcgttcgacaggtcactgcccgcctccgcgccgaacaccaccgacgcgcgggcccggtcgaaggaccggctcccgtaaccggagtcctccagggcccggcgcgcggcctccagggccagcagctgcaccggctcgatggcgggcagtgaggcgggtggaatcccgtaccgcagcggctcgaacgggatctcggggaggaagccgccccagcgggacggggtcttctccccggcgccgttcaggtcgtggtagaggtcggcgtcccagcgggtcgcgggcacctccgtgacggcgtccgcaccggcgagcacgttcgcccagaaggcggcgaggtcgggggcaccggggaacatgcaggccatgccgacgacggcgatgtccagcggctcgggggaggcggcgatggccggttcctcgatgccgagggcgtccagccgggccgccaggaagccggccgccccggtggtcaccgaggcgtgcaggtcggcgacggtggtgatggccgagcgcaggacggcgacctctccggccatgaacatgccctcggcgagctgtctctcctcaccgacctcgtgaagttcgcccccggcccgctccaggcccttgctggccagccgcaaccggccgacgttgagctgctccagccgctcccaggcctcccggccgggtacgtcgcgggcggccagctcctccttgacggcggcgaactcgtcggtgaacgggctgcggacacagcgggtggcgtgcccgggagcggtctccaggagatcggtgcgctcggctgcgatcacctgccgctggaacaggggcagtaccgcgcccgcgctcacggcctcctcggtgaacagatacgccgtgcccatcagtacgcccacggcggcaccccgggcgctcagcggcgcggcgagggcggtcaccatggcggcggaccgctcgtcgtgcaccccgcccgcgaacagcagctgcaactccgcggccgtaccgttcttggcgcccgccaggaagtcgtcgagcacgcagagctgcgcctcccacagcgggaagctgccccgcgggccgacatggccaccgcactcggcgccctcgaagacgaacttgcgcgcgcccgcctccaggaactgcttcaggagccccggcgacggcacgtgcaggaaggtggagatgcccaccgcctccagtgcggccgcctgcgcgggacggccgcccgcgatgatcgcgtgggaggggcggatctcccgtacgacctccagctgggcggccttgatctcctcgtcggcgaatccgaggaccccgactccccagggcgcgtgcccgagggcgtccctggtccgctccaggacggtgcgggtctgctcggcgccggagagcgcgagcgcgatgaagggcagcgctccgtggccgctcacctcggcggcgaacgcggcctggtcgctcacccgggtcatcggcccctggacgaccggcagttcggtcccgagcgcacggctgcccgcgctgtcggggccgagggcgggacccgcgctcttgagggcgtcgaggacggcgtcacgtacgccccggaccgccgcgtggacggtgccccagcgctcatggaagcgtgccgcgaggaaaccgtcctgaccgatctcgggcgccggggcaccgtccggggcaccccggcgccgtacgacacggcggccgttctccacggtggtctcggagccgtcgagcccggtgaggagtacggaggtgccggcgggcagtccggcctcggcctcggtgagcagggcgagctgggtgtccaggacgacaccggcaccgccgcccgcgacgacggccgccgcggtgtgcgggcccgcgccgccgcaggcccagaccggcaggtccaactcccggtcggcgagcagctgttgcaccagcacgaacgtgcccagttcgcccacggggccgcctgcctcgtggccccgggcgatcagtccgtgcgccccggccgatagggcccgtaaggcctgctcatggccggtcacctcgacgagcacgcggtggccggggaagtcgcccggggtgcacgaggcgtcgctggtcagcaggacggtgtgcacgcgggcggggaggtcccgcgcgggaaaggcatcgttgtcggagagccgtacgccgaagccggcggccgaccattcctcggcgagcgcgagttccgccgccgcccggcgcccacccgaggtgaggtcgagcacgccgagaccgccggcccgtacggcggccgcggtgacccgtgccgaggggacggcgagcgggctcacggcgatgacgatgtcctcgacagcaaacagcccggaagtatcgaaattcgacacaggcacgcgaacgctccaaatcacacgagagtgaggaatggtgggggagagcgcttgtgcttcacaaggcactgcgaagcacgctcatggttattgcgcatcctcgcgaaagtcaaactctcaatgagacggtccttgccggatgtaacactgccgacacggctgcatcggattcctgtgtgaacgggcgacagcggcctgacccgagggcggttgagggggcgccgaccgcaggccgcgcgcgtcctccgccccaactcatcctgcgcgtacgtgtcctgacggcgcgtcaggatggtgtcccgattggatcaagcggaaacgcattgtttccccaggtgtaaattgaatccttaaacagttccctttcatataatcaaaattcacgctgggcaaaagggttggattcggcacttgagtgtgaatagccacgattcgtactcgccggtagatggctcgtttaggacgcacgttccatgggatcaagcccgctcggtagcgccttccggccgcgtggggcggtcgggccgtggccgaatccaaaaggtctcggggcggtggcgcaggaggcgtacggggctttgcggcaggggaaggggccgcaggatgtcttcggcatcgcgaggcgggccgatcagatcaacaggcgttcgtcgctgtcctggtcgccctggtcgtcccgcgtcggctgcgtgcccgaggcatcagcaccgggtgttcgccgaattccggccaggaaccggcggacttcactggatcagcggcagcgcggggaaggtgtggcgctcccagaggcgccgggaggtttcctcggggtaggggatgacctctggggccgcgtcgaggacttggaccagccgccgctcggtgtcgtacgtgggccagccggggtcgcccgtccgtgcgaacgccgtccaggacgcccggaaacgggatgacagcgcctcggcctccggtgagggttccgtaccggcgaacagcaggctgccgaggtcggcgtcgaacgtgccgaacagcagcgggatgtccaggccgtggcaggcgcccagtacgccgccgttgcccggggccggccaggtcagctcgtagacgtgggcgcgtccgccgccggtgagctgcgcctcggccaggtgcagtgagggcatgtggaacagccagtcggacatgacgcgttcgtacagctcgcccggcgaggcgtcggggaagccggtgcggtaggcctgttcggcgtccggtccgggtccgaacctgcgcagtgctgcccgcgcctccccgtcggtgatctttccgagctgtccggagaggaggacgaacagccggaattcctcgctgttgtgaccgacgatcagttcgacgtcccgggcggtgccggccgccagcgcctgccagggggtggtgggcaggacctcgccgtcgacgacgggggagaagggggtcagggtgtggacgaccggcccccaccggtcctcgtactggcgcatcgtggccgccaacgcctcgcctgcggcgggtagttgacgtgggtcgacggtggacagatcggcggccgtggggcgcaggcccgcttcggcggcgatcgcggccgcgatgtccttggccagttcgtcggagaagtacgtgcccggcacgctctgggcgatggcccgccggaagaggccggacgcgctcggcatggccagcagcgaggcgattgatccggcgccggccgactccccgaagacggtgacccggccggggtcgccgccgaacgccgtgatgttctcccgtacccattccagggccgcgacctggtcgagcagaccgcggttggcgggagcgccgtcgacccgggcgaagccctcgatgccgacacggtagttgagggtgaccacgacgacgtcgccgtcgcgggcgatgcggcgagcgtcgtagccggggctgccggagtggccgagcttgtaggcaccgccgtagatccacaccatcaccgggcggcgggcaccagggtccgggtcgggtgtccagacgttgaccgtcagccagtcgtcgcccgtgggcgcgtccagcagggcggcgcggccctggatccccgtctcctggggcggcggcggaccgaaggcgaacgcgtcccgtgtcccgtcccaggcgcgtaccgggcgcggcgcggcgaaccgcgcgtcccccacgggcggttcggcgaacgggacaccgcggaagaccgccaggccgccctccaggcggccgcgcaccgtaccggcggcggtggggaccacgggctcggcggaccccggcgccgacgcgcgggaatcggctgtcgtcatcgttgactcctcagtggttgccggtggagcgacctgtcagtggctgctggtggagcgacctgtcagtggctgctggtggagcgacctgtcagtggctgctggtggaacgacatggtgcacccgcgggcccggaccgctcgacctcacccccgccgagtactggctcctgggccgtctaccggccaacgcggagcgtgtgctgtcgacagacccctgccgggtaccgcgcggcgccgctgaggtccggcatgccgacggggccctctcaggacctcgcctcatacgggccgccccggaagtacaggcttccgtacggtcggggacggtcaccgcgctcatgcgcggcgtcggagcggtcggcaggtgccgaccgctcggccagagcgcgcagcgtctccagaccggccaggacctcagagcgctggtccgccctcttcatccacgccggcagccgcgcgaacatggcccgcgtcggccgcaccccgccacgctcgcgcacccgggcgcccacgtaggccgacaactcgtcgacatgctcctcgttgtaggcccacaggatccggccgacgcaacgggtctgcagccacagcggccgccggaaaaacggatcctcactcccgcccggcaccgcgccgaccagccccgcaccacgcatctcgggttcccggtcggcgacggttccgcacccaccgcaagccagacggcgtggctggaacaacagctcgctgaagtacctgggcgcgggaagaccaggccggggaaccacgagcgcacggccgccgcatcgtggacagaccaccagcatgcggccggtgaactgggccaactggcggccggggtcgtagtggcgggcaggaccggtacccggctcggaatccatgacggacaccctcgcaggttcgcgacgccgcccgcgaccgggttctcgcgcgccctggccgcccacgccgtcctcgccggcgcggaagccggggccaaggagttcatgacgcggccgcgtcgaggccggacggtggatcggcgcccgctttcggatgacgtcacagcctgtcgccggggcggaccggccggcatgcctgacgatcgcagtcggccggtcatccctgcccgcccctcgtccgcccggaggcagctgtgcacatcctgctcgtggccagcgcgttcaacagcctcacccagcgcgcccatgccgaactgcgggaccgtggccacaccgtggcggtggaactcgccctgcccggcggctcgttgccggaggccgtgcggcggcacgccccgcagctcatcctggcgccgatgctgaagaccgcgatccccagggaggtgtggtcggcgcacacgtgcctcgtcgtccatccggggcccgtgggtgaccgcggaccgtcctctctcgactgggcgatccacgagggcgccgaccagtggggtgtgacggtccttcaggccgacgaggaaatggacgccggtgacgtgtgggcgtccgttccgtgcctgcttcctccggtgtccaagagcgacctgtaccggggcgaggtcgccgacgccgcgctcgcggccgtcctgctcgccgtggaacgctttgccaccggaaccttcgttccgcgcaaacaagccgaccaagccggccaaggcggcggccaaggtggtggcgaagccgaccaagtcggccaaagcgtggcacgcccggaaggcgcccacccgcgcacccgtccgtacctcgaccagagcgtccgacggatcgactgggccgaggactccacacggaccgtcgtacgcaagctgcgggccgcggactcccagcccggtgtgctggacgtgctgctcggcgacgcgtggtatctccacggcggccacccggagagcgtgttgcgtggccaccccggcgagctgctggccaccagggccggggcgatctgccgggcgacgaaggacggcgccgtatggatccccgagctgaggccccggcgtgcgcccgggcagccgccgacgttcaaactgcccgccgtacaggccctcggcgaccggcttcctccactgcgagagcacaccgtgcccctgttcccggacgcgcggcaccctacgtggacggacatccgctaccgggaggaggggaacgcgggtttcctctcgttctccttccccggcggcgcgatgagcaccgcgcagtgccgacgcctgctggacgcctaccgggacgcgtgcacgcgacccacatcggtgctggtgctgggcggcgaacgggacttcttctccaacgggatccacctcaatgtcatcgaggccgcggacgaccccggtgccgagtcctgggcgaacatcaacgccatcgacgacctcgtcgaggcggtcctgacgacgacggaccggctggtggtctcggccgtcgcgggcaacgccgcggccggcggggtgatgctcgccctggcggccgacgaggtgtggtgccgcgcgggagccgtgctgaacccgcactaccgtctgatgggcctgtacggctcggagtactggacgtacaccctgccgcgcagggtggggcccgcggcggccgaacgactcatgcgcgaggcgctgccggtgagcgcggcaagcgcccggcgtacgggactcgtcgaccgggtgatggagtgcggcccgcaggagttcgccgcggaggtcggccgcctggcggctcgcctggcggcgctgccgggaaccgcgtcacggatcaccgcgaagaagagggagctggaccggcaggagagcgtcatcccgccggccgctttccgcgagcaggagctggcccggatgcgccggaccttcctggacccggacgccccgtatcacgcgctgcgtcgcgcgttcgtccgcaaggagcggcctcggcgcaccccgccgcatctcagccccgccgcggttgcgccatcgggccagatcccctccgaggctcacgtcactggaacggccccccacggcgtctcaccgcgaccggatggctggtacgaagaaagctgacggtcgaaatacggactttcaccccatacctccctaggaggcggtcccatgactgcggcaacgccggacacggtcggcgctgcggacgccggaggtgcgcccgccgacgagacacccacgatccacattctctggatcaacgcagggctgagctgtgacggcgactcggtcgcgctgacggcggccatgcagccgagcatcgaggaaatcgtgctcggcgttctgccaggtctgccgaagatcgccgtccattggccgctcatcgacttcgagtgtggtccggtcggtggctcggacacgttcatcgagtggttcttcaagggggagcggggcgagatcgacccgttcgtgctggtggtcgaggggtccatccccaatgagtcgatcaagccggagggctactggtgcggtttcggggacaacccggagaccggccagccgatcaccaccagcgagtggatcgaccggctcgcgcccaaggcgctcgccgtcgtcgccatcggcacctgcgccacctacggtggcatccacgccatggccggcaacccgaccggggcgatgggcgtgcccgactacctcggctgggactggaagtcgcaggccggcatccccatcgtgtgcgtccccggctgtccgatccagcccgacaacttctccgagacgctcacctatctgctctatcaggcggccggcgccgccccgatgattccgctggacgacaagctgcgtccgacctggctcttcggggccaccgtgcacgagggctgtgaccgtgcgggctattacgaacagggccagttcgccctgacgtacgactctccgaagtgcctggtcaagctcggctgctggggccccgtcgtcaagtgcaacgtgcccaagcgcggctggatgaacggaatcggcggctgcccgaacgtcggcggtatctgcatcgcctgcaccatgcccggcttccccgacaagttcatgcccttcatggacgaaccccccggcgcgaaggtgtcgagcagcgccagcggcgcctatggcgcggtggtccgcaagctgaggaccctcacggcccggaccgtggacaaggagcccaagtggcgccacaccggagaccggatcaccaccgggtaccggccaccgtggtgaagccccgccgcacctgacccgcccccgagattcgtgcaactccccacacttcccgcgcaacgaagggcacggcacaaacgatggcatcgacgacgaaggcggccggcgacggcagtggcctggtggagatggcctgggacccgatcacacggatcgtgggcagcctgggcatccacaccaagatcgacttcaagcagaagcgggtcgcggagtgctacagcacctcgtcggtcttccgcggctacagcgtcttcatgcgcggcaaggacccccgcgacgcgcacttcatcaccagccgtatctgcgggatctgcggggacaaccacgccacctgctcggtgtacgcgcagaacatggcctacggcgtgaagcccccgcacctcggtgaatggatcatcaacctcggcgagtccgcggagtacatgttcgaccacaacatcttccaggagaacctggtgggggtcgactactgcgaaaagatggtcaaggagaccaaccccggtgtcctcgaactcgccgagcgcaccgaagcgccgcacgccggggaccacggctaccgcacgatcgccgacatcatgcggtcgctgaaccccatcgagggcgacttctaccgcgaagccctacaggtgagccgctacacccgggagatgttctgcctcatggagggacgccacgtgcatccctccacgctctacccgggcggcgtcggcacgatcgcctccgtgcagctcttcacggactacctcagccgcctgatgcgctacgtggagttcatgaagcgcgtcgtgcccctgcacgacgacctgttcgacttcttctacgaggcactgcccgggtacgaggaagtggggcgccggcgcgttctgctcggctgctggggagcgctcaacgaccccgagtactgcgacttcacctacgccaacatgacggactggggccgacgcatgttcgtcacccccgggatcatcgtcgacggcaaactcgtcaccaacgacctcaccgagatcaacctcggcatccgcatcctgctgggcagttcctactacgaggactggcaggggcaggaacagttcgtcacccatgaccccctcgggaacccggtggacccgcggcacccgtggaaccagcacaccatcccggccccgcagaagcggaacttcgacgacaagtacagctgggtcatgtcgccccggtggttcgacggcaaggaccacctggccctggacaccggtggcggccccatcgcccgcctgtggtccaccgccctgtccggcctcgtcgacaccggctacgtgaaggccaccggccacagcgtggtcatcaacctgccgcgcaccatgaccaagcccgagaccaccttcgaatggaagattccgcgctggagcaacgcgctggaacgcaatcgcgcgcgcacctacttccaggcctacaccgccgccgtcgcactccacttcgcggagaagggactggaggaggtccgggccggacgcacccagacctgggagaagttcgaggtgccggacgagagcatcggcgtcggattcaccgaggcggtacgcggcgtcctctcccaccacatggtgatccgcgacggcaagatcgccaactaccacccgtacccgcccaccccctggaacgccagcaccagggactccttcggcacgcccggcccgtacgaggacgccgtgcagaacacgccgatcttcgaggagaacacgccggagaacttcaagggcatcgacatcatgcgcgccgtgcgcagcttcgacccctgtctgccctgcggtgtccacatgtacgtcggcggaggaaagacggtgcagaagatgcatgtgcccaccgggctgagcggactgggcggatgagcgcggtatcggcgacgaaccgcgtgaccgccgagcagaccgggcgccgtatcgaggacgtactggaccggctggccgccaccggcgacccggcggccggcgcggcggccgaagaactcgtccggaccctcatggagttctacggctcaggcctggcccgcatcctccacctgctgtcctccgcccccggcggtccacggcccccgggcgaccccctggcggccctgctcggcgacgaactggtcgcgagcctgctcgtcctgcacgacctccaccccgaggaccgggacgtccggatcgccagggccctcgacagcgtccgcgaccaggctctggaagtggtggccttcgacgagacgagcgggaccctgcggctgcggacccgggcgggcgcgggctgcggctgcgccggcaccggcacggccgccgtccaggccgccgaggacgcgctcgcctgcttcgcaccggaggtcacggccgtcgagatgcagcccgccgccgcccccggggagcccgccctgctccagatcggcaccggcccgaattccggcgccgtggcccgtccggcagcggcgaagaccgcatgagcgggacccggacacccgcccgggcccccggcccgggcccgcgcgcccccggcctgcgcaggttcctgacggagcgtccaccccgccaggagcggtgcgagctgtgcgcggtggcggtggccgaggccgaccaccgccacctggtcgacatcgagaaacgggccctcgtctgcgcctgcgtctcctgcgcactgctgatggaacagccgggagccgccgcgggccgcttccgtgccgtcccgaaccggtacctcaccgacccggaccaccgcctcgacgacggtgcgtgggaggcgctccagatcccggtcggtgtcgccttcttcttccgcaacgcggcgctggaccggctggtcgccctctacccgagcccggccggagccaccgagagcgaactcgaaccgtccgcctggacgacggtgctcggtgacagccgcctcgccgtgctgctcgaacccgatgtggaggcactgctgctgcgccgcaccgacggccggtgcgagtgctacctcgtaccgatcgacatctgctacgaactggtcggccgtatgcgcctgctgtggcagggcttcgacggcggcgccgaggcccgggccgccctggagacgttcttcgagcacgtcgtgcgacgcgccaagcccgtacgcgaggtgggcaggccgtgacggagttctccttcgagtgcaccggcgtacgcgccgaccggtacgccgccggaccgaccctcctgttccggctgcgcgtcaccgcggccgacaacgcccgcgtgcacgcactcgcgctgcgctgccagatccgtatcgaacccgcccggcgcggctatgagtccgccgaggccgacggtctcgccgacctcttcggcgagcgctcacgctggggcaacaccctccagccggtgcagttcgcgcaggtctccctgatggtccccggcttcaccggagagaccgaagtcgacctcgtcgtgccctgcacctacgacatggacatcgccgcgacgcgctatctggccgcgctcaagggcggcgaggttccgctgctgatgctcttctccggcacggcgttcaccggagccgccgggttccgggtcgagccggttccgtgggaccgggaggcggccttccggatgccggtctcggcctggcgggagatggtcgagcagcacttccccggctgcggctggatccggctgccccgcgacaccatggacgccctgctcgcctaccgctcacagcgggcgctgccctcctgggaggcgaccgtgcgggctcttctcgaggagaagggcaccacggacccgccccggaaggacccctacctcgcgctcacccgaacgaccggagggacggatctgtgaccgtgaccgcgttcgccgcgcagaccgaggcgcggttcgccctcgcccggcaggtggccgacgccgttctcttcgagggctatgtgctctacccgtaccgggcctcggcggccaagaaccggctgcgctggcagttcggggtgctggtaccgcccgagtggggtgccgactgcgaagagcacgacttccagcacaccgaatgcctgatggaaccgaaggcgggcgcgacgctgtcggtcgagctgcgcttcctgcgcgcccggcggcggaccgtgcagcggatccgcccggacggcggcttcgacacggttcccgaactccggctcgacgaccgggtcctggttccctgggacgagggagccgaggagcgcgtcgaagtggtcgcggcggtggacgagctcctgggcgacggtgtcacggttcccttcacccgccccgccctggaggaggacgagccggttctcgacgcgacgggccggcccgtcggccgcctggtccggcgctgcgaggagatcagcggcgccgtgcggctgtccgcccgcgaactcgacgggccctaccggacgctgcggctgaccgccgtggtcgagaacacctccacctggacacctccacagggccgcagcgccgaccgggacgcggcgctgccgcactccctggtggccacgcacctcctcatggccctcagcgccggatcgttcctgtcgatgaccgatccgcccgagtgggcgaagggcgcgatcgccacctgccgcaacctgcacacctggcccgtactcgccggcgaacccggccgcgcggacctggtgctgtcctcgccgatcatcctggaggaccacccggcgatcgctccggaaagcccgggagcgctctacgacgccaccgagatcgacgagatcctcgcgctgcggaccgccgccctcaccgacgaggagaagcgcgaggcccggggcaccgacgagcgggcggccgccgtgatcgacctcgcggactcgatgccggccgaggttctcgaacgcctgcacggggcggtgcggagcctgcgtgaggtgaccgccccgccgagcgccgccgggccggccgccggagggttcccggacgagtacggggtgcggcgcccggacaccccgtggtgggacccggcgagcgaggccggcttcgaccctcagcacgaccgggtcgtcgtggacggccgctcgttgggcgccggaagccgcgtactgctgcgaccgggcctgcgccgcaccgacgcacaggacctgttcctccagggccgcagcgcgcaggtcgaggcggttctgcacgacgtcgacggcggggtgcacctggcggtgacggtcgagggcgatccgggcgccgacatccgccgtgagcaggggcggttcctgtacttccagcccgacgaggtcacaccgctggaggacgacgcatgagcggtccccgggaggtgcccccaaggaccctcgtcgccggcatcgggaacatcttcctcggggacgacggcttcggtgtggagaccgcgcgcaggctcgccgagcggcaactgcccgcacacatcgaggtcgtggacatcggtgtgcgcggggtgcacctcgcctatcagctcctggacggctacgacaccctcatcctcgtggacgccacggcacgcggcgaagcccccggcacgctgtacctgatcgagcacgacagccccggtggaggcgagcccgagggagcccccgtgctcgacggccaccggatgacccccgacaccgtcctggcactgctggacacgctctgtgccggtaccggcggacagccgccgcggcgcaccctgatcgtcggctgcgaaccggcctcggtggaggagggcatcggtctcagcccgccggtgtccgacgccgtaccggaggccgtccggctgatcgacgagttgctacgggccgacgagccgggagagtccgcgccgcgggccacggccgacggagccgcgaagtgaggagagacgcgatgaagaagaccatcatctgcggcgtggccggcgccgtcctggccgcgctcgtcaggctggcacttcccgacgtcagacgctactggcggatccgcaggatgtgacacgccgcccgttcgagcgcgccgcgccgttgcggcgaacggcgtaccccggcggccgacgacggcgtgccgggctgtcgagccccgacagcccgcctctaatggaggccggcgggccgagcacggcacaccttcccgcgcggaccgggcggcccggtgccgcccgcgacagcggtggtggaagccggcccctgggaggacagagaccgatgcacgagatgtccgtcgcgctggccgtgatcgaccaggtcgagcaggccgcgcagcaggccggcgatgtcacggcggtgcgctcggtacgactccaggtgggtgaactggccggtgtcgtacccgattccctctccttctgcttcgaactggcctgcgccggaaccgtgctggagggcgccgacctggtcaccgaagaggtgccggggcgggcccgctgcgcaccctgcgcgcgcgaatggtccgtcggcatgccgccccggctgagctgccccgagtgcggcggggcgagagtcgacctgctctccggccgtgaactacagatcgtcagcgtgcactgggaggacggccggacgcacgcgcaaacccgcgaaccgatctccgaggagcgctgaaccatgtgccgtgtggtcgacctgcaccaggccgtgctcgccaagaacgacgcgagcgcgcacactctgcgcgccgaactggcggctcgcggcaccgcggtggtcaacctgttgtccagccccggcagcggaaagaccgcgctgctggaacgcgaactgctgctggcacgggagcggtcggtgcccgtcgccgcgctgaccgccgacctcgccaccgagaacgacgcgagacggctggcgcgttcgggcgtaccggtcaagcaggtgctcaccgacgggctgtgccatctggaggccgggatgctcagccggcacctcgacggatggctgcccgacaacacccggctgctgttcgtggagaacgtcggcaacctggtctgcccggcctcctacgacctgggcgagactctgagagtcgtcctcgcctccgtcaccgagggcgaggacaagccgctgaagtaccccaccgcgttcggtctcgcccacctggtcgtcgtcaccaagaccgacatcgccgaggccgtcgacttcgacgaggccgcgttccgcgcgcacgtcgagcaggtcaacccaggagtcgaggtgctcctgacctcggcacgccggggccgggcgatcggcgcgctgctcgacagggcgctggcggccgcggacggcgcgccgctccacaggcctgtcatggcccgacggacggatgtcctcggacccgccggccccgcgcacgaccacggccacggcgacggccatgagcatgcccacaccggccccgcgcacgatcacggccatgcccacccggacggtaccggcgccatggcccagacccgctcgtgagtggtccgcggccctcggccgtcgtccccggtgacatgccgcggcgccgtcgggtcaccgttcggggcgtggtgcagggtgtgggcttccggccgtacctgtacggcctcgccaccgagctcgccctggccggacatgtgaccaacacgccggagggcgtcgtcgtcgaagtcgagggaacaccctcggccgtcgaccggttctgcgaccggatcgccgcacaggcgcccccgctggcccgcgtggagtccgtccaccaccaggacctgcccgccacgggcggcggcgcgttcaccatcctcgcctcccgtgccgacgggccggtacgcaccctggtctccccggacatggccacctgcgccgactgcctcgacgaactggccgactccgccgaccggcgctaccgccatcccttcgtcaactgcacccactgcggcccgcgcttcacgatcgtcaccggtgttccctacgaccgcgcccacaccaccatggccggcttcgcgatgtgccccgactgcgcccgggagtacgccgatccggccgaccgccgcttccacgcccagccggtcgcctgccccgcctgcggtccgagcctgcgtctgctcgttggccggcagccgctcgacggacggccgcagagcgtcgccggggcggacccggtcaccgaggcccgcacgcttctggcgcgcggcgcgatcctcgcggtgaagggactgggcggctaccacctggcctgcgacgcctcggaccccgcagccgtcgccctgctgcgccgccgtaaggcccgcggggacaaaccgttcgccgtcatggccaggagcgcggacgacatcgagcacctcgtccggctcggtcccgaggagcgaagcctgctggagggcggcaccaggcccgtcgtgctgctgcgtcggcgtacggacccctcgtacccggcaggagcaccgcggccggccgaggccgtcgcgcccggcagccccgacctcggcgtgatgctcccgtacacgcccctgcaccatctgctgctcggtctgcccggcgacgccgaagggccccggctgctcgtcatgaccagcggcaatgtggccggtgagccgatcgtcaccgacgacgcggaggcactggagcggctggcgccgctggccgatgcctggctcacccacgaccggccgatccaggtgccgtgcgacgactccgtggtccgcgtcagtgacggaaagccgctgatgatccgccgagcccgcggctacgccccgctgccggtgcccctcccgctgtccgtccggccggccctcgccgtcggcggggacctcaagaacgcgttttgtctcggggaggaccggcgggcctggctgtccgcgcacatcggcgacatggacgacctcggcacccagcgagccttcgggcgcgccacggcgcaactggagtccgtcaccggcgtgcggcccagcatgctggtggccgaccggcaccccggctaccgctccgcccgatgggccgaccggaacgcggccgggcggcccgtcgtacgcgtccagcaccatcacgcccacgtggccgccgcgatggccgaacacgggctggagggcacccggccggtgatcggagtggccttcgacggcacgggccacggcgacgacggcgccgtgtggggcggggagatcctgctcgcggactacgacggtttcacccggttcgggcacctcaggtacgtcccgctgcccggtggtgacgccgccgtgcgccggccgtaccgcatggcgctggcccatctgcgcgccgccgggatcggctggtcggacgacctcgcctgtgtggccgcctgcccgcccgacgaacgccgcgtgctggaacgccaactggagcgagacctgaactgtgtccccacctccagcatgggccggctcttcgacgccgtgtcctcgctcgcgggcgtgtgtcaccgggccgggtacgaggcccaggccgccgtcgagctggaggccgccgcgctgaacgcgcccgtcgaggacgtcaccgcctacgcgttcgccctccgggcgtcggagccggacgggggcggcgcggtacgggccgacccggcacccgtcctcgcggcgatcgtcggtgacctgcgagcgggcaccgaaccggctctggtcgcggcccgcttccaccgggccgtcaccggtctcgtgcaccggatctgtgtgcgggcccgcgagcgtcacgggctggacacggtggccctgaccggaggcgtgttcgccaacaccctgctctcctcggcctgcgccacggccctgcgcgaggacggcttcacggtgctgcggcaccacctggtcccgccgggcgacggcggtctggcgctcggccagctcatggtggccgcccgtgacacggcccggaccgcgaccaccggctgaggactgtcccggcagcaccgggcgacgcgcgacccacagcaagacagcaaggagaggcccatgtgcctggcggtacccggcagagtgctggacatcgaggaacgtgacggcacccgaatggccaccgtcgacttcggcggtgtggtcaaggaggtgtgcctggagtacctgcccgacctccaggtcggcgagtacgccatcgtccacgtcgggttcgcactgcaacgcctggacgaggaatcggcgaagcagacgctcgaactcttcgcccagctcggcatgttgcaggaggagttcggcgacccctgggaacaggcggcggaagcgggcggggccaccccgcccgtgggcgacgccgtcatcgaggaggtgcggaagtgaagtacatcgacgaattccaggacccggaactggcgcgccggctcctcgacgacatccactccacggtgaccaggccgtgggccctgatggaggtctgcggaggtcagacgcacaccatcatccggcacggcatcgaccaactcctcccggaacaggtcgagttgatccacggcccgggctgtcccgtgtgcgtgaccccgctggaggtcatcgacaaggctctggagatcgcctcccggccggaggtgatcttctgctccttcggtgacatgctccgtgtgcccggcaccggtcgcgacctgttccaggtacgcagcgaaggcggcgatgtacgcgtcgtctactcgccgctcgacgccctgcggatcgcgcggcagaacccggaccgcgaggtggtgttcttcggcatcggcttcgagacgacggcaccccccaacgccatgacggtccatcaggcccgtcggctcggcatcccgaacttcagcctgctggtgtcccacgtccgggtgccgcccgccatcgaggcgatcatgtcggcgccgaactgccgcgtccaggccttcctcgcggccgggcacgtgtgcagcgtgatgggcgtgggggagtacccggaactggccgaacgcttccgcgtcccgatcgtcgtgaccgggttcgagccactggacatcctcgaaggcgtacgccgcaccgttctccagctggaacggggtgagcacaccgtcgacaacgcgtacgcccgtgccgtccgcccggagggcaacccggccgcgcaggccatgctcgaggatgtcttcgaggtcaccgaccgggcctggcgaggcatcggtgtgatccccgacagcggctggcggctgtcacccaagtaccgcgaccacgacgccgagtaccgcttctcggtcgacgggatccagacgcgcgaaccggccgaatgccgcagcggcgaggttctgcagggaatgctgaagccgcacgagtgcgaggccttcggcaccgtctgcacaccccgtacccccctgggagccaccatggtctccagcgagggcgcctgcgccgcgtactacctctaccggcgactggacatcaccaccgccgcccgggaggcgagccccgttgtctgagaccaccgatctccgcgggccggcgaccctcgaggcctggacctgtcccgccccgctgcgtgaccggccgcgcgtcgtcatgggccacggcggaggcggggcactctccgccgagctggtccagcacgtcttcgcccccgccttcgggggagaggtgctcgcccagatgggtgacgccgccgctctctcgctgggcggtgtccggctggcgttctccaccgactccttcgtggtgcggccgctgttcttccccggcggcagcatcggcgatctcgccgtcaacggcaccgtcaacgacctcgccatgagcggcgcccgcgccgcctacctctcctgcggattcatcctggaggagggcgtcgaagtggaggtggtcgcccgggtggccgaggcgctgggggcggcggcgcgcaccgccggcgtcgaggtggcgaccggcgacaccaaggtggtggaggcaggacacggcgacgggatcttcatcaacacggcgggcatcggcctcatcccggcgggcgtcgatctgcgtccgcagcgggtcgtccccggcgacgtcgtcatcgtcagcggtgccatcggcgtacacggtgtggcgatcatgagcgtccgcgaaggcctggaattcggtgtggagatcgaaagcgactgcgcggcgctcggcggcctggtcgacgccatgctcgccgtcaccccggatctgcatgtgctgcgcgatcccacgcgaggggggctggcggccgcgctgaacgagatcgcggcggcctccggcgcgggggtggtcgtccgggagcgcgacgtcccggttccgccggccgtggccaacgcctgcgccattctgggcctggaccccctgtacgtcgccaatgagggcaagctggtggccttcgtgccgcgcgagcacgccgacgcggtcctgggcgcgatgcgggcccacccgctgggtgccgacgccaggatcatcggcgaggcggtggaggcccacccagggatggtggtggcccggacgggactgggcggcaccagggtcgtcgacctgccgatcggcgagcagttgccgcggatctgctgagacgcggctccgcccggcgaggagaggaccgggacggccggggtggcgccgagcgggcggcgctaacccggccgatgcctggacggcgggtccttggggtccacaccggtgtaggaggaagcgtccttgctgccgctgggccgctgggagcgacccctgcggccggtgtcctgcctgccctcttcggactcctcggcgtactcctcgccgcgcgcgctgccgctcttcgcggtctcaccgggaacggacttcgtctcctccgcggacttcgtccggccccggcccctgtcgccggcgtgttcggctgggtggaaggagcggtgagcgctcgggttgtcctgctgacgggtctcatccacatcaggtgaccagccgtgctgcccggtaccccggtgacgactcgggccctccccgtgcgacggctcggacgaatgtgatttcttcggcatgggccgacctgcctgttcagtgtgggagcgccggctgcgcgtctccgcgatggggaaattctcccactatgtgatgcattggtcacattgttgtccggtgcggacgggttccggacaggccgggatcggttccggattccggttccgtttcgggttcgacggtgcctcgtccggcgcgggcggcgcggtcacccgcgcgcgggcatgtgtcgccggccggccctggggtactcgcggcgccggcggaagacagggatgaccggtaggccggtaccccgacggcgcaggaaagcttggtacccccgtgctctcccggggcgggggcaccagcctgcggcgcggcggtggacaccggtgtacggtgtccaccgccgcgccggatgccagggcctcagccccggcgtcgctacggggttcacgacctcccggggccgccgctgccgaacgaaccgccggcgccctcgtcccagcgtggccgctgctggttctcgctcggtttgcttccggacgcgtggaggtcgtgcggggtgagccgttcgctctcgttcgccgccctggggacctcgtcgggctcccgcctctgtcgcgtctcgtgaaccggcccggactccggcagcgtgggctgctcctcgcgtcggggcggtcccggctcgcggcggcgcaccttggtgccgaagcgcaccgcccacaccaacgcgccgacgatgaccagaccgccgacgaaggcggcgaacattccgaaagcggcattcgaagcaattgcctcatagtgggtcgtgttcatttctgtcgagtaccccggacctcggcggcgataccccacagccctccgatggtggacaggcgcacgcgagcggtccggtgcgcgggctccgggacggcggctccggcacggacggtgatcgtgcgggttcgcacagcgcgcgtcctcgtcggcgccgggttttttcacgatgtccctgaagtgcgcgaacgtgtggacgggctcagcctggacaggcgggccgcacggcatccagtcatcccgaaaggcagcgaacagatgggcagccagaacggcgacgacctcatgggcgacgaggtgtaccagcccgagggccccgaggaccgggaggacgagggcatcctcgacccggaggacaccctcggcgaccgcggatcggacccgtacgacgagggatggtcgccgcccgagcgtccgctcggcgtcgagcacgagggcacgaccgcgcgcgagcagcgggagggcgagagcctggaccacaggctggccgaggagcggcccgatcctgcgctggaggagttcggggatcccgcggacgccgacgatccgggtgacctgcgcgacggcgagggagagcccctcgacgacgaggtcggcgacgagccggcgggccgtctcgtcgccctcgacgagggtgtacgcgaggaggcggagaaggacctgctcgccgaggacgacgcggagaaggatctgctcgccgaggacgtcggcatcgacggcggcgcggcttccgcggaggaggcggccgtccaccgcgtccccgacgaggacgactatccgctgtagggccggtggcccctgtccggaggtgttccatggattcccacaccgagcccggcgtcgcggcgcccgaccctcaccgctccgaggtcactctgcgggtcaacggcaagctgtacacgctcaccgtggaccaccgttccgtcctcctggacgtcctgcgggaagacctcgacctcaccggcgcgaagaagggctgcgaccacggccagtgcggtgcctgcacggtcctcgtggacggccgccgggtcaacagctgtctgctgccggcggtcgcccaggacggccgcgacatcaccaccatcgaggggctcgccggcactggtgaggtcgtcggcgaggagggactcgccggcggcgacggtctcgtcgagggcggcggcgccggactccatccgctccagcgggcctttctggagcgggacgccttccagtgcggatactgcacgcccggacagatctgcagcgccctgggcgccctggcggaggcggaggcgggccacccctcccgcgtcaccgaccccgccaggccctccgggcagcccgtaccgctcggcagggacgagatccgcgagcggctcagcggcaacctctgccgctgcggcgcgtatacgcacatcgtcgaggccgtcgaggacgtgatccgatgaagcccttcgcctacgtacgtgccggcagcgtccaggaggcggccgacgcccatgcctcccggcccggcgcgcgctatctcgccggcggtaccaatctcgtcgacctgatgaagctcggcgtggagcagccggccgctctcatcgacgtcagccggctgccgctcgacaccgtggaggaactggccgacgggtcgctgcggatcggcgccaccgtccgcaacagcgacctcgccgcccaccccttggtccgtgaccgccatccggtgctctcgcaggccctcctcgccggggcctccgggcagttgcgcaacgtggccaccaccggcggcaacctgctccagcgcacccgttgtccttacttccaggacgtgaccaagccgtgcaacaagcgggcgccgggcaccggttgcggcgcccgcgacggggtccaccgcgatcacgcggtgctcggccactcggagcactgcatcgccacgaacccctccgacatggcggtcgcgctcgccgccctcgacgcgcgcgtggagctgtacggcgccgacggcgaacgctccgtcccggcagccgagttccaccggctgcccggcgaccgccccgagcgggacacggagttgcgccccggcgaactcatcaccggtgtcgtcctccccgccgcgtcggccggacttccctcgctctaccgcaaggcccgcgaccgcgcctcgtacgccttcgctctcgcctcggtggcggcggtgctgcaggtgcgggacggcgtggtcgagcacgtggggatcaccttcggcgggctggcccaccggccctggcgggcccggcgcgccgaggaggcgctgctgggtgccgccccgacccgggccgcgttcgagcacgctgtggatctcgaactcgacgccgcccggccgctgcgcgacaacgcctacaaggtggacctggcccgcaatctcgccgtcgacgtcctggcccggctcacaccgcccggcggggcctgaaccggcgccccacaggcaaccgtccggcacacctcagacacccctcaggcaacccgtcaggaggaccccatggccgacgcacccaccgccctgggcgcacccgtcgagcgccgggagggccgggacaaggtcaccggcaccgcccgctacgccgccgagtatccgctgccgggccgggcgcacggatggccggtgcccgcggcgatcgggcgcggtgcggtccgcgcgatcgacgcccgagccgcgctggacctgcccggggtgctcgcggtgctcacgcacgagaacgcgcctcggctcgccgaaccggaggaccccacgctcgccgtgctccagaacccgcgcgtaccgcaccgcggttggttcgtcgccctggtcgtcgccgagaccctggaggaggcccgggcgggcgccgccgccgtccgggtcgactacgcggccgaggaccacgacgtgacgctgaccgagacccaccccgaggcctacacgccggacacggcgaacggagggtatccggcacaccgcgaacacggcgaccccgagtgggcgttcacctcggcgccggtccgcgtcgacgtcggctaccggctgccgccgctgcacaaccaccccatggagccgcacgcggccaccgcctcctggcagggcggcagactcgtcgtgcacgactccagtcagggcgccaccacggtacgtaccgtcctcgcgggcctgttcgagctgcccgaggaccgtgtcaccgtcgtcgccgagcacgtcggcggcggcttcggctgcaaggggacgccccgcccgcatgtcgtgctggccgcgatggccgcgcgcgagaccggccggcccgtcacggtcgccctgccccggcgatttctgcccgccgtggtcgggcaccgcgcccccacactgcaccgcgtccgcctgggcgccgcggccgacgggaccctggccgccgtcctgcacgaggtcaccacccacacgtcccggatcaaggagttcgtcgaacaggccgcgacacccgcgcgcgtgatgtacgcggcggcgaacatcctcaccagccatcgcgtggtgccgctcgacgtgcccagcccgtcatggatgcgggcccccggcgaggcgccgggcatgttcgcgctggagtcggcgatggacgaactcgccgtcgaactcggcatggaccccgtggaactgcgcatcgccaacgagccggacgcggagcccgacagcggccggcccttcagcagccgccatctcgtcgagtgcctgcgggagggcgcccgccgcttcgactgggccgcacgccccgcggccccgcgcgccagaacggcgggcccgctgctgatgggcaccggagtggcggccgccacctatcccgtcctggtctcgccggccaccgccacggcgcaggccctgcccggcggggacttcgtggtacggatcaacgccacggacatcggcacgggagcccgcaccgtcatggcgcagatcgccgcccatgccctcggtgtcccggtggatcgggtccgctccgaggtgggaagcagcgacctgccgtcggcgccgctggccggcggctcctcggggacggcgtcctggggctgggccgtgcacgaggcgtgcacacgactgcgcgcacgactggcggagggcacgggtcccgtgccggaccagggaatcgtcacgaacgccgacaccgcgggccacgccgacgccgaaagcgcctacgcccgccacgcgttcggtgcccacttcgccgaggtcgccgtcgacacggtcacgggggaggtccgcgtgagccgactgctcggcgtgtacgcggcgggccgcatcctcaacgcccgtaccgcccgctcccagttcatcggcggcatgaccatgggactgggcatggcgttgaccgagggcagcacgatggaccccgcgttcggcgacttcacggagtccgacctcgcggcctatcacgtgcccgcgcacgccgacgtccgcgacatcgaggcgtactgggtcgacgaggacgacccccatctcaaccccatgggcagcaagggcatcggggagatcggcatcgtgggcacggcggccgccatcggcaacgccgtgcaccacgccacgggcgtccggttccgcgaactgcccctgacgcctgaccgggtgctcggcggcctggcgacgccgggctcggtgagtggaggttagggcccactgctcaggatcccctatggaggggaggagaggtttgcccgaaacgtcggcggggactcgaacggcagacaacgggaacgcaagtgcccgaagtgctggaagtgcccgaagtgccagaggtgcaggacgtgccgacagtgccagaagctccagaaagaagatgaagcgttgtgaccgcgcagaccaaccggaagtccgtcgtctctcgccccaggacggggtgggcgaaggcccgccacctgcggggagacggcgtacgtacctgtgtctcggcccgcgatgacggcgaacgctcctgctccccggagcagggggccgaggagaacatcgtcaggggcgaggactgagcggacccgtggccctgacgccggtgagcccggccgcggccccggacaggagcgacaggtgcggggatgaggggacggccgtatcaggggctggccgggtcgtagccgtaggtgagcggctcgtcctggctgccgagtgcacgccggtagatgtacagcgcctccacgcgtacgccctccgcgggggcgtcgagcgggcaggggtaggtcacttggagcaccgagggccggtcggcgacccgcatgcgcaggccgtccgccggtccgccggcgagtaccgccgtctgcgatttcgtcgagatgcgaagatccatgcccgcactttagatgttgcgcaatctgtgaagttgtgtgagctctgtcactcccaagcttcacgagttgcgcgccccgatggaaccggatgaggtgttccggcgttcccacggggggacggccgatcatcggagcagtggaggaacaccgtgggcgtaactctggccaagggcggcaacgtttcgctgagcaaagaggctccgggcctgaccgcggtgacggtgggcctcgggtgggacgtgcggacgaccaccggtgccgcatacgacctggacgcgagtgcgctgctgtgttccggctcgggccgggtcgtctccgacctgcacttcgtcttctacaacaacctgacgagcccggacggttcggtccagcacaccggcgacaacctgaccggtgagggcgagggcgacgacgagtccatcaacgtcgaactggcccaggtgccggccgaggtcaccaagatcgtcttcccggtctccatccacgaggcgcagtcgcgcggccagagcttcggccaggtcagcaacgccttcatccgcgtggtgaaccgcgccaacaatgtcgaactcgcccgctacgacctgtccgaggacgcctcgaccgagacggcgatggtcttcggcgagctctaccggcacggcggcgagtggaagttccgcgcggtcggccagggatacgcatcgggcctcgcgggcatcgcgtccgactacggcgtgaacgtctgacggggagacgagggagacaagggagagcggaagggggaggagggccgaacgccccggcggagtgcgggggcggtgtccggctttcccggggtgttgcgcatggcgaagcgaaaggtacggcgacaagcccgccgcctcctgggcgaggacccggtggctctcgtctggtgcgaggttcaccgccgcatcccccggccgccggaggaggtccaccgggcggcggggaaggggcggctcaagcccggacaccactggctgctgtacgtcggagccgtactgttcttcttcgtcgtcgtcccgatgatgctgatcgacaggctgggcgggaggctcgaccgggcgcaggcgcctccccggaggcaggggccgacgcccggcgggggccgtgaccgcgaccccggccgggaggccgcgaacggtgtcttcgacggcgactggagcctgaccgcgggccagttgctgctgcgctggtacggacgctcgcccaaccccaagcggctcgtcctgctgacccgcgaccgagtctgcctggccgcgtccccgcgccgtcggctgtcgcccaccagggccggcgacttccggatcgtcgccgagttcccggcgcgcgaggtgagcgtcgagggtgaggccggacagccgcgcggtttcgccactttccggctgtgcttcagcgacggctcctggctcgaggtcggcaggctgggcgagcccgaggacgcggaccacttcctgcgcacgatcgacgactgaccgccacgggcgccgaccgcgtcctgctcggttgggcgacgcccccgccgccttcagtcgccgaccgtcgtctgtgctcgcgtgtcgccctccggttccgtcggcaccggagcgtcccggtgttccgggcggacacggccggagcgggcgttcagccgggcgatcaggggctcggtgtagcgggcggtgagcgggccgagtacgaccaggagcagcacgtaagcggtggccagcgggccgagcgagggctcgatcccggcggtgacggcgagtcccgcgatgacgatcgagaactccccgcgcgccaccagcgcgccgcccgcccgccagcggcccttcacggagatcccggcccgccgcgcggcccagtacccggtcgcgatcttcgtcacggcggtgacggcggccagcgcgagggccggcagcaggacaggcgggatgctggccgggtcggtgtgcagtccgaagaagacgaagaacacggcggcgaacaggtcccgcagcgggctgagcagcgtgtgcgcgccctccgcgacctcgccggacagggcgatgccgaccaggaacgcccctaccgcggcggacacctggagctgctgggcgatcccggcgaccagaatcgtcagccccaggacgaccaggagcagcttctccgggtcgtcgctggagacgaagcgggagatgagccgcccgaagcggagggccacgaacaggacgaggcccgcggcggccagcgcgacggccagggtcacgctgccggccgccagcccggccccggccaccagtgcggtgacgatgggcaggtacaccgccatcgccaggtcttccaggacgagaatgctgaggatgaccggggtctcccggttgccgacccggcccagatcgcccagcaccttggcgatgacaccggacgacgagatccaggtgacgcccgcgagcaccacggcggccaccgggccccagccgagcagcagcgcggcggccgcgcccggcagggcgttgcaggtgaagtcgaccaggccggccgggtagtgggccttgaggttggagaccagatcgccggccgtgtactccaggccgagcatcaacagcagcaggatgacgccgatctcggcgccggtggcgacgaactcctcgctcgcgccgaggggcagcagcccgccctcgccgaaggccagtccggccagcagatacagggggatgggggagaaccgcagccgggcggccgcccggccgagcagcccgagagagaggatgatggcgccgaactcgatcagcaggaccgcggagtgcacaggttcactcccgtccgagtatcgccgcggcggcgtcgacgccctcgcgggtgccgatgacgatgagggtgtcaccgcccgtgagccggaagtccggggccggagacgggatcgcctccgctcggcgcagtacggccaccacggacgcgccggtctcggtccgcatccgggtctcgcccagtacccgtccgttccaacgggaggccgcggcgacctcgacgcgctcggcgaccagcccgaggtccgtggtgtacagcaggctcgcactgtggtgggagggcttgagcgcatcgatcagcgagcccgcctcggaactcgtcagccgcagcgactgcgcacaggagtcggggtcgtcggcccggtacacgctcaccgtgcgggcgccgtcgcggtgcgccaccaccgacagatggcggtgttctcgcgtcatgaggtcgtactggaccccgatgcccggcagcggtgtcgccctgagacgtggtgcagacacgtttcttccccttgctgatggtcttgctgatcgccttgctgacgtcttggtgatggacgttctgaaccctgcccaaaaccgtcatgctgccatcactccgtacggtggcgacatgggtgtcatgacggatggacgcgggcggcggcgagcggagaggctggtcggggcggcggcatggccgcggtccgggaaagagggaacgccccgggagcaccgggggacgccgaccggaggggacggaaagaggagcgtgtcgctgttccggcggatcttcctgctcaacgccgtcggcctgaccgtggccaccgcgttgctgctgggtccggtcaccgtgtcgacccccgtgctgcccggcgaggcgctggtcgtcctcgcgggccttgccgtgatgctcgtcgtcaacgccgtcgtgctgtggatcgggctcgccccgctgcaacggctggggcgggccatggccaccgccgatctgctgcacccgggggcccgtgcggtcgtcaccggtccggcggagatggccgatctgatctccacgtacaacaccatgctcgaccggctggagaccgagcgcgccaccagcgcggcccgggccctctccgcccaggagcgcgaacgccaccgcgtctcccaggaactccacgacgaggtcggccagaccctcaccgccgtcctccttcagctcaggcgcgtcgccgaccgggcgcccgaggggctgcgcgcggaggtgaggcaggcacaggaggccacccgcggcagcctggacgagatccgccgcatcgcccgccggctacgccccggtgtcctggaggaactgggcctgctcagcgccctccgcgccctcacgaccgagttcaccgcccacggactgagcgtgcgccaccacttcgacggcgaactgccacagctgagcgaggagacggaactcgtggtctaccgggtggcgcaggaagggctcaccaacaccgcacggcacgccggtgccgatcgcgccgaactccggctccaccgggtcgccgacggagtcgaactactcgtacgcgacaacggcacaggagccggccgggcgccggagggcgccgggatccgcggtatgcgcgagcgggccctgctgatcggcgccggcctcgcggtggagcccgggcccgaccggggcaccgacatcaggctgcgcatcacgagcaccacgagcacgacgagcacgacgagcgtgatgaacgcgacgagcaccggcgaccggtccgggccccgcaccggaacccctccccacggagcgcgctgatgtctcttcccccgcccgcccagcgcccgacccgcgtcctgctcgccgacgaccacgcgctcgtacggcggggcgtacggctcatcctggacggcgaacccggcctgagcgtggtggccgaggccggcgacggcgcggaggcggtcgccctggcccggacgacggacgtggacctcgccgtcctggacgtcgccatgccccgcatgaccggactccaggcggcccgcgaactctcccgccgcctgcccgagctgcgcatcctcatcctgacgatgtacgacaacgagcagtacttcttcgaggcgctcaaagccggtgcctgcggctacgtcctgaagtccgtggccgaccgcgacctggtcgaggcgtgccgggcggcgatgcgcgacgagccgttcctctacccaggggcggagaccgcgctcgtacgcacctacctcgaccgcgtccaccggggcgaaggactgcccgagcggaccatcaccgagcgcgaggaggagatcctcaagctggtggccgagggacacacgtcgaaggagatcggcgaactcctcttcatcagcgcgaagaccgtcgaacgccaccgcgcgaacctgctccagaagctgggcttgcgtgaccgcctggaactcacccggtacgcgatccgggccggcctcgtcgaaccgtgacccgtcgcgacgcggtgccgcacgcacgcgctgcgcgcccgccccgacccgtcgcaggaagactgcggccgggtaggaggacggcacggccgcgcgggaccggcggtcggcagggcacggcgccctgacggcgatcagcgccgacttcggtgcctcgccgcccggcttcgcgccggcgcactcgccgaccggccgctcttcgaaactcgccgaccggcgctcgtcgagccgtccgccgcgcctcggtgcggcctggccgcgcaaggttcggccccgtcgggtgtcggccgcgacggggccacgggagaaccgtccggtgacagggccaccgggaacctccggctaggagacagccggctcgggcacccgcgggaggggttcgggcagtgcgcggggaaccgggcgtgcctcgcgcagcgtgggccacggagccgtcggaaccagtggggcatggtcggcggccagagcccggcgcgagaaccaaatgatcttgccgccggtattcgtggcacaacagccccagccgtcgctcatcgcggcgatctgcgtcaggcagccgcgcggcgcgtagtgcgggcggacgtcctggtcgctgtcctgcaccgcggtgatgaggtgctgaccgttccaccacatctcgagggtggtgttcttgtccgccgcgtgctcgtcgatcgtgtgcagtagcacttcggcacagtggcagaccggctcgacgagtgtctccagattccagtaccggagatgggcggccagaatccggcggacgtgtccgatccgttccggactgacctccacgtcgaggtggtagtaacagggcgctgcggtcttcattgtcgttggctcctcaccggcgaagctccagcttctcctcgcccttgcaggccgagccccgaacacgaagcgtgagcagtcatcgcttctgagtcagtctcagggtgagcggggtactccattcgcgcaacccgagcggaccggtgaacagctggttgaaatccgaacaggacgctcggtggtcttccgtgcaccatgggtaaaagtttttgaatccgtaacgggtcgacgccgatccgttacggccatcacctgcaccacggtccccctgtgcttgcacgagaaagtaggaggtgactggagcgatgctgctgcctgccagaaccgaggtcgccagatatctccagcggtaccgggcgtgggagcgcctgatgctcgctgctcccgacaacctcgtggtacggggaaatttcgagaacacgggttacaccctctgcgtgttgatgggggaacggtgcgcccgcgaggccgcggacgccgccgaacactttctgcgcaccggctcggcggcggcaccgcacgagcggaggacacgcaccggctctcccgcgcgcacggcaagcggttctcccgcgcgtacggcaaccggttctcccgcgcgtacggcaagcaacgcctgaggtccgtcggtcgcgtcggcccggtgcggaccggcccgaccgaccgcacaccaccccatcgcagaccggatcgaccacggccggaggaggcgaaacccatgaaccggaatcccgtcatcggccgcataccgatcctggacgtccaccccctcgtcgagggcggcagacgtcccgcgaaggccgtggaaggggagacgttccaggtcaccgccacggtcttccgcgaaggtcatgacgcggtcgccgccaatgtcgtcctcacggatccgcagggccgcagcggcccctggacgcccatgcgtgaactggaccccggggccgaccgctggggcgccgacgtcacgccatggacggtcggcaactggacgtacctggtcgaggcctggagcgatccggtcaccacctggcgccatcacgccgggatcaagatcccggccgggatcgacaccgaactcgtcctcgcggagggcgccgacctgttcgagcgcgcggcgtacggcgtgccggaggggaaggggcggaagatcctgctggccgccgccgacgccctgcgcgacaccgagcgccccgccacgtcccggctcgccgcggcgctcactgtcgaggcggacacggtcctcgcgcggcatccgctgcgtgaactgctcacgtcgtcggagccgttgccgctgctggtggagcgggagcgggcgctgttcggttcctggtacgagttcttcccgcgttcggagagcggccgcgtggacccggtgcacggcaccttcgccacggcggcggagcggctgcccgcgatcgccgggatgggcttcgacgtcgtctacctcccgccgatccaccccatcggaacggcgttccgcaagggccccaacaacaccctgtcggcgagccgccgggatgtcgggtcgccatgggcgatcggctcaccggagggcggtcacgacgccgtgcacccagagctgggcacgatcgaggacttcgacgccttcgtacgtcgtgcggcggccctgggcctggagatcgccctcgacttcgcgcttcagtgctctcccgaccatccgtgggtggagaagcatccggagtggttccatcaccgtccggacgggacgatcgcgtacgcggagaacccgccgaagaagtaccaggacatctatccgatcgcgttcgaccgggacatgccggggctgatcgcggagacggtgcgggttctgcggttctggatgggtcatggggtgcggatcttccgggtggacaatccgcatacgaagccggtggtgttctgggagcgggtgatcggggaggtcggccggacggatccggatgtgatcttcctggcggaggcgttcacgcggccggcgatgatgcgggcgctggcggcggtcggtttccagcagtcgtacacgtacttcacctggcgcaacagcaagcgggagctgacggagtacctgaccgagctgtcgggggaggcggcggccgttatgcggccgaacttcttcgtcaacaccccggacatcctgcatgagttcctccagcgtggcgggcggccggccttcgaggtgcgggcggtgctggcggcgacgctgtcgccgtcgtggggggtgtactccggctacgagctgtgcgagaacaccccggtgcgcgccgggagcgaggagtacctcgactcggagaagtaccagctccgcccgcgggactgggcggcggccgagcgcgagggacgcagcatcgcacccctgatcacctcgctcaaccggatcaggcgggagcacagtgccctgcgccggctcaggaatgtccacttccaccatgccgacaacgacgctgtgatcgcgtacagcaagcgctcgggccgggacacggtcgtggtggtggcgaacctggatccgcaccacacccaggaggcgacggtctcgttggacatgccgcaactcggtctggactgggccgcgttcgtgccggtgcgcgacgagctcaccggggagagctaccactggggcagggccaactatgtgcgtctggagccggggcaccggcccgcgcacgttctcaccgtcctgcgaccgtcctcaccgcagatcggagggtcacccacacgatgatcgtcaacgagcccgtcccggacaccttcgaggacacgcccgccaaggaccgcgatccggagtggttcaaacgcgccgtcttctacgaggtcctggtccgctccttccaggacagcaacggcgacggtgtcggcgacctgaagggcctgaccgccaagctggactatctgcagtggctgggcgtggactgcctgtggctgccgccgttcttcaagtcccccctgcgcgacggcggctacgacgtctccgactacaccgcggtgctgcccgagttcggtgacctggccgacttcgtcgagttcgtggacgcggcccaccagcgcggcatgcgcgtgatcatcgacttcgtgatgaaccacaccagtgacctgcatccgtggttccaggagtcccgcagcaaccccgacggcccctacggcgactactacgtgtgggccgacgacgacaagcagtaccaggacgcccggatcatcttcgtcgacaccgaggcctccaactggacgtacgacccggtccgcaagcagtactactggcaccgcttcttctcccaccagcccgacctcaactacgagagtgccgccgtccaggaggagatcctggcggcgctgcggttctggctcgatctgggcatcgacggcttcaggctggacgccgtcccctacctgtacaacgaagaggggacgaactgcgagaacctgccggcgacgcacgagttcctgaagcgggtgcgcaaggagatcgacacgcactatccggacacggtgctgctcgcggaggcgaaccagtggccggaggacgtggtcgactacttcggcgacttcccctcgggcggcgacgagtgccacatggcgttccatttcccggtcatgccgcggatcttcatggcggtgcggcgtgagtcgcggtatccggtgtcggagatcctggcgaagacgccggcgatcccgtcgagctgccagtggggcatcttcctgcgcaaccacgacgagctgaccctggagatggtcaccgacgaggaacgcgactacatgtgggcggagtacgccaaggatccgcggatgcgggccaacatcggcatccgccggcgtctggcgccgctgctggacaacgaccgcaaccagatcgagctgttcaccgcgctgctgctgtcgctgcccggctcgccgatcctctactacggcgacgagatcgggatgggggacaacatctggctcggtgaccgggacgcggtgcgcacgccgatgcagtggacgccggaccgcaacgcgggtttctcgtcctgcgacccggggcgtctgtatctgcccacgatcatggatccggtctacgggtaccaggtcacgaacgtggaggcgtcgatgtcgtcgccgtcctcgctgctgcactggacccggcggatgatcgagatccgtaagcagaacccggcgttcggcctcggctcgtacaccgaactccagtcctcgaacccggccgtcctcgcgttcctgcgggaggccccctcgaccggggggaacggggacgacctggtgctgtgcgtgcacaacttctcccggttcgcgcagcccacggagctggatctgcgggcgttcagcggccgtcatccggtcgagctgatcggcggtgtccgcttcccggccatcggggaactcccgtatctgctgaccctggcaggccacggcttctactggttccggctccgcaaggacgtcacccaggtcaccaaggtgagcttgttcgtgagctcttgatccatggcccggaaaggaacgcgacgccatgccgaagaccgcaccgctccgcccgagccgcctcagccccgggccgctgctgacctcgctggccggtctgctgcgggagtggctgccgacgcaacgctggttcgcgggcaagggccggccggtcatggatctcgccctgctgtcggtgaccgaactgcacccgggctgtctgcacctcctgctccaggccggacacgccgagcaggccgccggcagcggttccgacgagcattccgtccacgactgctaccaactcttcctaggtgtgggggagacggtcccggcccagccggcccgtgccgtcatcggccgggccgacgagggcccgctggccggcctgatggtctacgacgcccttcaggaccggaggtcgacggcgctgctcctggagcggctgcgcaccccgggcgtcgtaggacccctgcgtttcgagcgggacctcggggtgacgctgcccgccggtctcgagccgcgccttctcgacgccgagcagtccaactcctcgctggtgtacggggaccggtacatcctgaaggtgttccgccgcgtccagcccggcatcaaccccgacctcgaggtgccctgggccctggcccgacagggctgtgaccgcgtacccgcgccggtggcgtggatccgtacctcccttccatggggggcgaccctcggcgtgctccagccgttcctgcccgatgccgccgacggctggacacgggcgctccaggctctggactcgggccgggacttcatcgacgaggcgcacgagctggggcgggccaccgccgaggtgcatctggcgctggccgcggccttcccgctcgagttccagcagcggcaccacaacggacggctcgcggccgggatgacacggcgcctggaggccgtggcccggtccgtaccggaactcctgccgcacgcccccgccctgcgctcggccttcgacgcgctcgccgccgtcgacacaccccgtcccgcccagcggatccacggcgacctgcatctcggccaggtgctgcgcaccggccgacgctggcacctcatcgacttcgagggcgagccggcccgcccgctccccgaacgccgtcgtgcccagtcgcccgtgcgtgacgtcgcgggcatgctgcggtccttcgactacgccgcgcacgcgcgtcacccgtggcggccggactgggcccggcgttgccgggacgcctactgcgggggctatgcggacgaggcgggctgggatccgcgcgaggagcccgaactgctccgcgcatacgagacggaccgggcggtgtacgaggtcctgtacgaggcccggcaccgacccgagtggctgccggtacccatggcggcgatcgcacggcttgccgaccggcagccgctgggcgcaaggaggccgcagtgaacgcacatgctgttccccccatctccaccccggccccgccgtccggcgctcggccggccccggtggcaccgggtgaccgcgaccggctcctgtccgggacgcatcacgacccgcactccgtgctcggcgcgcatcccgtgcccggcggggtcgccttccgggtgctgcgcccgtacgcgctgtccgtcaccgtcgtcaccgacgacctgcgcaccgagctgcacgacgacggcgccggcttcttcaccggcctgctgccgctgcgcgccgtaccggactaccggctgcacgtggcctacgagggcacggtccacgagaccgagacgcctaccgcttcctgcccgcgctcggcgagctggacctgcacctcatcaacgagggccggcacgaggagctgtggacggcgctcggcgcccgggtgatgacccacgcgggggtcctgggtacccgcttcaccgtctgggcgccgaacgcgcgcggcgtcagggtctgcgggaacttctgccgctgggacggggccgcgtttcccatgcgctcgctcggctcctccggtgtgtgggagctgttcgtgcccggcatcggcgaaggcgaactgtacaaattcgagatcacccgccccgacggcacacacaccgtgcgcgcggacccgatggcccgccgtgccgaagtgcccccggcgaccgcctcgatcgtgacggagtcgtcgtacgcgtgggcggacggggcgtggatggccgcgcgcggcgagcgtcccgtgcacgagtcgccgttctccgtgtacgaggtccacctgccgtcctggcgacccggactgacgtaccgccagctcgccgaacagctccccgcctacgtcgccgacctgggcttcacccatgtcgagctgctgcccgtcgcggagcaccccttcggcggctcctggggttaccaggtcaccggcttctacgcccccaccgcccgcctgggcacccccgacgacttcaaatacctcgtcgacgccctgcaccgggccggcgtcggcgtcctgatggactgggtgcccgcccatttcccccgcgacgactgggccctggccgaattcgacggacgccccctctacgaacccgaagacccgcagcgcgccgcgcatcccgactggggaaccctcgaattcgactacgggcgcaaagaggtacgcaatttcctcgtcgccaacgccgtgtactggtgcgaggaattccatatcgacgggctgcgcgtggacgccgtcgcctcgatgctctacctggactactcccgcgaggaagggcagtggagcccgaacgagttcggcggccgggacaacccggacgcggtcgccttcctccaggagatgaacgccaccctctaccggcgggtgcccggggtgatcacgatcgccgaggagtccaccgcctgggacggcgtcacccgcgccacacatgacaacggcctcggcttcggcctgaagtggaacatgggctggatgcacgactccctcggctatgtgcagcacgagcccgtgcaccgcaagtaccaccaccacgagatgaccttctccatggtgtacgcctacagcgagaactacgtcctgcccatctcccacgacgaagtcgtgcacggcaagcaggcgctggtgtcgaagatgccgggcgactggtggcagaggcgtgccaaccaccgtgcctacctgggcttcatgtgggcccatccgggcaagcaactcctcttcatggggcaggagttcgcccagggcgcggagtggtcgccggagcacgggccggagtggtggctgctggacgacgagtaccactcggcgggcgaccaccggggcatgcgggacctcgtacgcgatctgaacacgctctaccgcgccgagccggccctgtgggagcgcgacaccgacccctccggcttcgcctgggtcgtcggtgacgcagccgaggacaacgtcttcgccttcctgcgccacgccgccgacggcaccccgctcctcgccgtcagcaacttctccccggtcgtccgccacgactaccgtctcggcgtccccgacgacatccccgcctggcaggaagccctcaacaccgacgccgcccgctacggcggcagcgacctcatctgtcccgaccccgtcaagcccgagtccggcgagatccggctgaccctgccgccgctcgccaccgtctggctccggccggcctgagccgttcccagttccccttcggagaaaatgggcccgcgggaaattcggtccctgggaaactgcgggaatttcccagggccgccgtcgccgttacgattccgattcggccgaatgcgcggtgtcacatcaccaaagcaattgttttgacggcgaaccaggggggaatttcctccctagtgcttcggacaggaggcacgtccgatgggagctgcccgtcaggcccccgggtgtgtcccgagagttgcgtgcgcgccctcccatggcgactgtccactcagcaccgcttgagggagttgcaagcacccatgcgcaccacgactggaacgaagcagcacccgcatgacgacgcccccgacacggccgcggacttcgagcggctgttcggattgccggacgggcgcgagcggcaggcgctgcgcgacgagatcgtccgcgcctggcttcccatggcggagcgcatcgcgtggcgctaccgggggcggggcgagtccaccgaggacctctgccaggtcgcggcagtcggtctggtcaaggcagtcgaccgctacgacccggcacgggggaacgcgttcgagagctatgccgtccccaccatcacgggcgagatcaagcggcacttccgggaccacatgtgggtcctgcatgtaccgcggcgtgtccaggacctgcgcaaccgggtgcgggtggcggcgaaggagctgtcccagaccgtgccggggcacgagcccaccgtcacggagatcgccgagcacgcacagctgagcgaggacgacgtacagatcggcctggaggccatggacaccttcaccgccctgtcgctggacgctgagctgcccggaagcgacgacggctacgcgctgtcggacgccttgggcggccccgactccggctacgacctcgtcgtcgaccgtgaggccgtcaagccttccctgcgagcgctgcccgaacgcgaacgcaccatcctctacctgcgctacttccgcggcatgacccagagcagcatcgcggagcagctcggcatctcgcagatgcacgtctcgcgcctgatcagcggctgctgcgccaggatgcgcgaggagacgctggccgatgtcgcctagcgaaggagccggaacgcatgcggccgcccggacgagtccgtcgatccgggcggccgtatgcggcgagctcactgccgaaccctcccgggggcggtttgccagcgtgccgtcagttcccggagtagccccggtgggccattcgaaactccgctttcccggcgagacgcgaacggcgcggggcgacggcgtcaatcagccggcggaaccggcggtgcccccggcaactgtgtgggcccgcagcggtcgagggtgtcctccagggtggcgcggacatcgggcggcaggtcgtccccgctgtgtccccagatgaggatcatctccgcgacgcaccgcagcttgatgttcgtgtgctgcgagacctcccggagcacggcccagccctggtcgggtgtcacccggcccagggcgaccagcacaccgatggcctggtccaccaccgcatgggaggtgacggcctccttgagctggccgatctcctcctccagctcgacgatgcgatccggttcggcagcggtggcatgcggctcgtcaggacctgaacggggcttcgaaatcatcgtcccctccgcgggcgtcacgccgttcggcgatgtctggcgtcccttccatcctcaccgttggggccggtgtgggcgaaccgggccctgagcggacctcgaacgggccttgagcgagtcgtgagtggccttgactgggttgtgagtgggtcttgacaagtgagtctatctacacaactttggaggtcgaagcccacatgggcgtgggtgatgcgatggcggggaggtccttggtcgtggagtggacgggtgcgaggtatgcggacgggccgacggtcgaagtgccggtctggatcgatgctccgccgcagcgggtgtgggaactggtctcggacatcgcgctgatgccgcggaccagccccgagcttcagtcggtggaatggctcgacggccgccgcgggcccgccctgggcgcccgcttcgtgggccgcagcagccacgaggcactgggggagtgggcgaccacctcccacgtcgtacggtacgagccgccacgggtgttcgcctgggcggtggaggaccccgaactcccctcctcggtctggcggttcgagctggaggagcgggacggcggcacgctgctgcgggagtggatgcaactcggccccggccgctccgggctctcgtacgccatcgaccggatgccggacaaggagcagaagatcgtcttcgtacggatgcgggagttcgagaccaacatgggtgccaccctcgatgtgatcaagaagctcgccgagggcggccgggacgaggtggaggcgtgatgcgtacgtcgaccacgatcgaggcgtccggcggcacctggcgggagacggtggactacgtcaccgaggcggagaagctgggtctcgacatctgctgggtggccgaggcatggggctccgaggcgccctcgcccctgggatacctcgccgcacgcacccaacgcatgctgctcggctccggcatcatccagctcggcacgcgcacccccatggccatcgcccgggcggcgatcacgctgtccaacatctccgagggacgtttcctcctcgggctcggcccgtccggcccgcaggtgatcgaggggctgcacggcgtgccgttcgcgcgtccgctcgcccggatgcgggagaccgtcgagatcctgcggtgcgcggcgaccggggagaaggtctcgtacgccggacgggagttcacccttccgctgccgggcggggaggcccggcccatgcggctgtccatgcgcgccgagcacgacattcccgtgtacctcgccacgctctcgccgaagatgctggagctgaccggccggatcgcggacggctggctgggcaccagcttcgtgcccgagggtgccaaggaggcgtacttcgaccatctggacaaggggctcgcggcagcggggcgcacgcgtgcggacctcgacatctgccagggcgcggaagtcgcgttcgccgcggacgaggaagcactgcgggtgatgatcgcgggccggaagaaggaactcgccttcagcctgggcggcatgggctcggccggcacgaacttctacaaccaggcctacagccgccagggctgggccgccatcgcggccgaggtcggcgagcgctggcaggccggcgaccgtgccgcggcggccgccctgatcaccgacgagatggtcctcgccaccaccctgatcggcaccgaggacatggtgcgcgagcggctgcgcgtctggcggaacgccggcgtcgacaccgttcgcctctacccggcgggcgacaccctcgacgcgcggctcaccacactcgggcgcgccctggacctcgtacgagcgacggactgaggagcggcgtacgggtgcggggtcggggagcggcgtacgcgtgagggaccgaggggcagccgccgacgcggccgcccctcggtccggtggcgctcctacgcggccagcgtcaccgactccaccgccggtgtccgcagcgttcgccgggcggtggccaggctcgtgcccagcgtcaccgccgcggccaccgaggcgatcgtgagccagatccccaggccttggtgcggccacggcgaatccgtgcgcacgacggtgaagggaacgatcccggccagcccggcgacggatccgaggaggacgccggtgaccgtcaggatgacgctctcgactccgaccgtccccagcacctgtcccggggtcgcccccgccagccgctgctgcccgaactcccggccgcggtaggtcgtcgccgcgtacagggagttgatcagcatgacgcaggcgaagaccacgatgatgccgacgaccacgaggttcagggtctccaggttcttcgcgtcgatcgacttcgggacgcccgaggccttgatcgcgtcgttctcggccgcctgcatgcagagcgtcgccgtcgccacggcggtgaagaggaccagcggcatcagcacggcggacgcctcggcggtgcgctcccgcagggtgcgtacggcgagccagccgctcgcgccggccggcgaaagccggtcgagcaagcccttcagcagccggggcgagaacagcgcgagccccaccgagatcaggatcgccccgtaagcgggcggcgccatcagggcggcgtccttcgccgagaaggcgaaggtggagcagaccgccgccccgccggccgccagggccgcgtaggcgaagaacttccgtgccccggcccggggttcgcgccgccgtgtcgcccgccgcaccgccaggaacgcggcgcccgcggccgcgaggaccgtgatgtcgataccggacatcagggcgacggggccgaaggagtggtcgacggagccggcgacctgtccgctgtcctggaagacgctcagcagcgcccgcccgccgagcatcgccggaccgatcgccagcaccgcacccaccagggccacgaccaccgactcacccaccaccatccgtttgatctgcgccggagtcgccctcgagcagcgcaacaggtcgatctcggcgccgcgttggcggacgttgaccgtcagcgtcgaggccacggcgaagaacaccagcagggtgccgtagccgccgacgacgctcgccgaggtggtcagcgactccgcgctcaccgggtcgacgccccgctgcccggcggtgtcgtacatcgagttgaacgtcatgatgatcgccgccccgaggaacgcggacagcagcgtggcgaggaagcgcccggggcgctgccggacggagcgcacggccagagcgaacacggctcacacccccgccgtcacgtcgtcgcccaggtgcgccagacgctcggcgaccgcgtcgaccgtcgggccgtgcagttcgcccgcgaggcgcccgtccgcgaggaagacgaccgagtcggcgtacgaggccgccaccgggtcgtgcgtcaccatcacgaccgtccggccgtgcacccgcaccgcctgctggagcagccgcagcacctcgcgcgcgctgcgggtgtccagcgcgcccgtcggctcgtccgcgaagatcacgcggggttcggtgacgagcgcacgggcgatcgcgacccgctgacgctggccaccggagagctggtcgggccggtggccgaggcggtcgccgagccccacggccgtcagcgtctcccgcgcccgctgccggtcgacgcgccggccggcgagcttcagcggcaggatcgtgttctgcgccacggtcagcgtcggcagcaggttgtactgctggaagacgaagccgacccggccgcgccggaacctcgtcagcgcggcctcgctgccgcccgtcagctccgtgccgtccaccctcacgatgccgctgtcgggacggtcgagtccggccgcgcactgcaacagcgtcgacttcccggaacccgacggccccatcaccgcggtgaacgtgccgcgggccaggctgagggacaccccgtcgagggcggtcacggcactgtcgtcactgccgtaggtcctggtgaccttgaccaggcgcagcgcctccgcgctcggggcggaccccgtgtccttgcggcgaaacatcgtcatcactctccgtccggcacgccctgtgccctgcccaagacgctacggagagcgcggccccgccacatggggcgcagaacccgtattgccgggtgtacccagcgacaccccgtacgggtcaccagaacgagccgacccccgcgcccgcccggtgcaatggacgggtgaccgcgcccccggacgactgcctcgcgcgcaacgagtggatctgcggggagtacctgagcagccgccgccagatcctcctcgacgcggtggtgcagcacctccagctgaccgcggtctcggtgctcgtcggcctcgtcatcgccctgccgctggccgtgctggcgcgccgctggggctgggccgccgggccggtcctcgccgtgaccacgatcctctacacgatcccgtccctcgcgatgttctcgctgctcctgcccgtgtacgggctctcggccgccctggtcgtcgcggggctcgtcctctactcgctcaccctgctcgtacggaacatcctcgccggtctgcgcgccgttcccgaggagacccggcaggccgcgcgcggcatggggtacgggcccgtccggctccttctgaccgtagagctgcccctcgccctgcccgccgccatggccgggctccggatcgcgacggtctcggccgtctccctggtgaccgtcggcgcgatcgtcggcttcggcgggctcggcaacctcatctacgcgggcatgaacacgtacttcaaggcccaggtgctgaccgcgtccgtgctgtgcgtggtcatcgccgtggcggccgatctgctgctgctcggtgtgcagtggctgatcacgccctggacgagagcgcagcgcggatgaacaccctgaccggcgcgtgggactggctcaccgacccggcgaactgggcgggcgccgacggcatctggcaccggctcgtccagcacctcgtcctgaccgtcgtctgcctggtcatcagctgtctgatcgccctgccggtcgccctcgtcctcggccacctcggcaagggcggtgcgctcgccgtcaacatctccaacgtcggccgtgcggtgcccaccttcgccgtgctggtgctgctgctcctcacaccgctcggcaagtggggggaggggccgacggtggtcgccctggtcctgttcgccgtgccgccgctgctcaccaacgcgtacgtcgggatgcgggaggtcgaccgcagtgtggtgcgggccgcccgcggcatgggcatgaccgggcgacagatgctgttccgcgtggaactccccctttccctgccccttgtcatgaacggggtgcggatcgccgccgtacagctcgtcgcgaccgccaccatcgccgcgctggcgggcggcggcgggctcggccggatcatcaccgcgggattcaatctggcgagcacgccgcaggtggtggccggagccgtactcgtcgccgtgttcgcgctgatcgtcgagggcgtcttcgaggccgccgagcggctggcaccgtactgggcgcgaggcccgcggtgacgtggcgcccggcgctggcgggcctgctcctgctcacggggtgcaccaccggcccgtccctggagaaccgcgacgaggtcaccgcgccgcccggcgacagcagacacctcaccatcggctcggccggattcaccgagagcgacctgctggcccagatgtacgcgctgctgctggagcgggccggatacaagacctcgatgctgaccgtcgccaaccgtgaactctacgaacccgcactggaatcggggcagatcgatgtcgtcccggagtacgcggccaccttcgcggactggctcaacgccaagacccacggtaccgacgccccggccgtgggctcacccgatcagaacgccacgatgagcgccctgcgcaagctcgccgcgccccgcgggctgaccgttctcgacgcgggcagggcggtcgaccagaacgccttcgcggtgacgaaggcgtacgcccggcagcatcacctcaagacactgagcgacctcggcgggtccgggctgaaggtgcggctcgcggcgggcgacgagtgtgtgcaacgcccgtactgcgaaccggggttgaagaagacgtacggcatcgacatcaccgccgtcgacccgaagggcgtcggcaccacgcaggcgaagcgggcggtccagagcgggcaggaccagatggtgctgaccaccacgacggacgcgaccctggacgagttcgggctcgtcctgctcgccgacgaccggcatctccagaacgccgacagcatcgtgcccgtggtcaaccgtgcgcaggcaggcagcgagcgggtcaccggggcgctcgaccggctcaacgacgtgctcacgaccggtgacctggccgccatgaaccagcaggtggacagctggcggcggctgccgaaggacgtggcccggtcctacctgacggagaagggcctgctgaagtgacgggccggtgctgcggggcagacgggagtttggcgacaggccctaggcatccgcgaccgagtcgaacgacacctgcccgcgcggcacacccagcgcgtccgcgtccaccgaacggcgcagcgcctcatggagcttggccggggtcagcacgcccaggaaacgtgccccgtccaggacggcgacccagcccgcgtcgtgctggagcatcacaccgaaggcctccttcaggggggcgcccaccggcacccaggagttcatccggtgggcgagatcgcgcacggcgccgccggcgccgagctcgtcgacgccgacccagccgtgcaggtcgcccccggcgtccaggacgaccgcccagcgggcgccctccgcgttcagccgggcagccgtccgctcggcggcctcgtcgaggcgggcgatcggcggctgttcgagatcgtccgcctcgatctcggtcaccgacagccgcttcaacccgcggtcggcgcccacgaactcggcgacgtacggcgtggcgggcgttccgaggaccgcccccggcgtgtcgaactgctcgatgcgcccctgcccgtacaccgcgatccggtcgccgagccgcaccgcctcctcgatgtcgtgcgtcaccagcagcaccgtcttgcgcaccgcctcctgcattcgcaggaactcgtcctgcaactgctcccgcaccaccggatcgaccgcgccgaacggctcgtccatcagcagcaccggcgggtcggcggccagcgcccgcgccaccccgacacgctgacgctgaccgcccgacaactggtccggatagcgggcgccgtacgtcttcgggtcgaggcccaccaggccgagcagctcggccgcgcgcgcccgcgccttcggcttcttccagccgatcagcgagggcacggtcgccgtgttgtcgaggatcgtccggtgcgggaacagacccacctgctggatcacgtagccgatccgccgcctcagccgcacggggtcgaccgccgcgatgtcctcgccgttcacgaagatccgccccgaggtcggttcgatcagccggttcaccatcatcatggtggtcgtcttgccgcagcccgacggacccacgagcgtgacgagttcaccctcggcgacctcgaaggacaggccgtccacggctgtggtgccgtccggatagcgcttggtgacctgttcgaaccggatcatgacctcacgctaaccgcgccggtcgcacgccgctacgccgtgaccgccccgggccggccgctcaccagcaccacctccaggatgcgcggaccgtgcactccctcgacccggtcgagctcgatgtcactggtcgccgacggaccggagatccaggtcagcgggcgcgtcgggtcgaggcgcaaaagggcctggggcaccgaggagaccacctggtccggcacgcgtacgacacagatgtggtggtccggcaccagagtgacgcggcggcggccctgctccgggccgccgtccagcacgagggtgcccgtctcggcgatcgccaccgtgcacgccgtgaccacgctgtcgacccggtccagctcgtgcgcggtgctgtcggcccggtcggggacgcgcgggaccccggtcgccgccagccattccccgtccagaccgggcggcacgagcaccgacgtcgagccgcggtccgcgagcagcccggcgatcaccgccggcagtccgtcggccgtgcagcggtgcacgatcgcccggtagtccgccaggttctcggccagcaggtcgaccgtctccgcgacgctccgggcaccgtgctcgcgcagatagctccggtcgaccgcctgctcgtacggcgtgtcgtccgatacgtcggcgagcgcgcgccgcacccggccgaggatcacgtccctgctgctcacttcgcgtcctttccaccgtgcgtacgctgccaccagtcgcggaacggctccgcgggcacctccggcaggtcccggctcgcgctccacgccttgcccgggccgggcaaggtacggggatggaagcggcgcgtccgggacgcgagccgttgcccggcgcgcagggcgcccgggtggctgaaggcccagcgcgccccgcgcatcgcggcccgctcggcggcgtgccccttcgccggcttcagtacgaccttggcgccctcccgcgtcacggggccgccctccacgatccgctcgcgcagatgcaccagcacctcggggatgtcgatggcgaccgggcacacctcgtagcaggcgccgcacagcgaggacgcgtacggcagtgacgcgtcgatctcgctcgcggtgccccggagctgagggctgaggatggcgccgatcggacccgggtagaccgatccgtaggcatggccgcccgcccgctcgtacaccgggcagacgttgagacatgccgagcagcggatgcagcgcagcgcctggcggccgacctcgtcggcgagcgtgtcggtgcggccgttgtcgaggaggaccaggtggaaggttcgcgggccgtccccgtccgtggtgcccgtccaggtcgaggtgtacgggttcatgcgctcggccgtcgaggagcgggggagcgtctggaggaacacctccaggtcctgccaggtcggcacgatcttctcgatgccgacgaccgagatcagcgtctcggggagggtgaggcacatccggccgttgccctccgactccacgaccaccagtgtgccggtctcggcgaccatgaagttggcaccggagacgccgaccttggcgcgcaggaacttctcgcgcaggtggaggcgggcggcgtcggcgagctcggcgggcgtgtcggtgaggccttcgggcgccggacgtccccacgcgcccatctcggagcggaagatgtcgcggatctcgccgcggttgcggtggatggcggggacgaggatgtgcgaggggcggtccttgcccaactgcacgatgagttcggcgaggtcggtctcgtaggcgcggatcccctcggcttcgagcgcttcgttgagggcgatctcctgggtggccatggacttgaccttgacgacctcggtctcgccggtttccttgaccagccgggtgacgatccggttggcctcgtcggcgtcggccgcccagtgcaccgtgcccccggccgccgtgaccgactcctccaactgcaccagataccggtcgagatgacggagcgtgtgatccttgatctgcttgccggcctcgcgcagcgcggcccagtccgagacttccgcgaccgctttggcacgcttggcgcggatcgtatgggtcgcgtggcgcagattgccgcgcagggtccggttgttcaccgcgtcatgggccgcctcagggaaggccggcatcccgacgaacgtcccgctcatgcgctcggctcctcttccgtgctcgccaggatctccgcgatgtgcaccggccgcattgcggtgctcagccgggccatcgtgccgccgatgtgcatcagacacgagttgtcggcggcgcacagcacctcggcgcccgtcgactcggcgctgcgtaccttgtcggtgcccatcgccgcggacacgtcggggttcttgacggcgaaggtgccgccgaagccgcagcactcgtcggcgccgggcagctcccgcagctccagccccttgaccgcctggagcagtcggcgcggccggtcgccaagccccaggctgcgcagaccgtggcaggtcgggtggtacgtcaccgtgtgcgggtagtacgcgccgacgtccgtgacacccagcacgtccaccaggaactcggtcagctcgtacgtcttcggcacgaccggcgccaaggtcttcgccagtgtgtccccgcggccctcggcgcgtgcccgctcacccatccgcggatacagctcccgcaccatcgcgccgcaggacccggacggcgtgacgattgcctcgtactccccgaatacatcggagaaatgccgtgccagcggctccgcctgatgccggtagccggtgttgtagtgggcctgtccgcagcaggtctggtccatcgggaagtcgacgtcgacacccagcctggtcagcaacttcagcacggcgcggcccgtgtccggatacagcgtgtcgttgacacaggtcaggaacagggcgacacgcatcgcggctccttgtgctcggtcatcggatgagtgcagcgtacgcggcgcgaaagccggaggggagacccgttcacctgccggtgagccgcgcctcggccgcctgccaccgcgcggggtcgccgcgcggctcgtaccgcgccaggggctgggtgcgggcgacgagttcgcgcatggccgcacggtcgccgaccaggccgcccgcccgggcctggacgaggacgttgcccagcgcggccgcctccgccggaccggccacgaccgggagcccgcaggcgtcggcggtgagctggcacagcagtgcgttgcgggtgccgccgccgacgatgtggacgacgtcgaccgggtggtcggccagggactgcgcctcggcgacggccctgcggtgggcgagcgcgagcgagtcgaggatgcagcgggtgatgcccgcgggggagtcgggcacgggctggtccgaggcgcggcaggcgtcggcgatgcgctgcggcatccggccgggggccaggaaggcggcgtcccccgcgtccacgaccgaccgcaggggcggctgctcggcagcggcggacaacaactgcggcaggtccgggtccccccactcccgtacgcactcctggagcagccacagccccatgatgttccgcagataccggaccgtgtcgtcgaggcccagctcgttggtgaagttggccagccggctcgcctcggtgaggacgggtgcgtccagctccaggcccgccagggaccaggtgccggtgcagatgtacgcgaagcgttcgcgcacggcgggcaccgccgccaccgccgacgccgtgtcgtgcgaaccgaccgtcgtcaccgggaccggcccggtcagcccggtctccgccagcacctcgggccgcagcacgcccgccgggtcaccgggccggcgcagcggcgcgaacagcccgaggtcgatgccgagccgccgggcgatgtcgtacgaccagtcgcgcgtccgcgggtcgatcaactgggtcgtcgaggcattggtgagctccgtgcccgcctcgcccgtcagccagtacgtcaggagatccgggacgagcaacagacgctcggcgtgcgccagttgggccgaggagcgggctgccgtcagctggtagagcgtgttgaagggcgcgtactggagtccggtcgccgcatacagctcggcggcgggcacattggcccacacctgctccgcgatcccctcggtgcgcgcgtcccggtagtgcaccgggttgccgagcagcgcgccgtcggcgtccagcaggccgtggtcgacggcccagctgtcgatgccgaccgagtcgacccggcccgcggcccgcagcccgtcgaggacgcccgcgtacagcgcgaggatgtcccagcgcagcccttcgggcacgcggacgggccggttcgggaagcggtgcgcctcggtgagatccagtgagccggggcccacgcggccgaccatgacgcgtccgctggacgcgccgaggtcgaccgcggcgtacgtgtgcacagcggtcaccgcaggaacgcggcggcgacgccggcgtcgaccgggacgtgcaggccggtggtgtgggtgaggtccccgccggtcagggcgaagacggcgttcgccacgtgctccggcagtacctcccgcttgaggatggtccgctgggcgtagaactcgccgagcttctcctcctcgatcccgtaggtcgccgcccgctgggcaccccagccgcccgcgaagatgccggagccgcggacgaccccgtccgggttgacgccgttgacgcggattccgtgctcgcccaactcggcggccagcagccgtacttggtgggcctggtcggccttggtcgcggagtaggcgatgttgtcggggccggcgaagacggcgttcttggaggcgatgtagacgatgtcgccgcccagcttctgctgtgtcatcacccgggccgcctcgcgcgagacgaggaaggagccgcgggccatgatgtcgtgctggaggtcccagtccttcgcggtggtctccaggaggggcttggagatggagatgcccgcgttgttgacgacgagatcgactccgccgaaggccagcaccgccgccttgaacgcctcggcgatctgctcctcggaggtcacgtcgacggtgacggccacggccttgtcgggaccgcccagcgcggaggcgacgtcggccgcgttctccgcgttgaggtccgcgaccaccacgcacgcgccctcggccaccagccgctcggcgatcgccttgccgatcccgctccccgcccccgtcaccagcgccacccgggtcgccagcggcttgggcttcggcagccgctggagcttggcctcctcgagggcccagtactcgatgcggaacttctccgactcctcgatcggcgcgtacgtcgagacggcctcggcgccgcgcatcacgttgatcgcgttgacgtagaactcgccggccacgcgcgcggtctgcttgtccttgccgaagctgaacatgccgacgccggggacgagcacgatcgccgggtcggcgccgcgcatcgcgggggagtcgggcagggcgtgccgctggtagtaggcggcgtactccgcccggtactcggcgtgcagttccgtcaggcgcgcgaccgcggtgtccaggtcggcggtgggcggcagatcgaggaccagcggcctgaccttcgtacggaggaagtggtccgggcaggacgtgccgagggccgccaggcgcgggtgtccggcgctcgcgaggaagtccaggacgacctcggagtcggtgaagtgaccgacctggggccggtcctgggcggcgacggcacggacgtacggcgccagcgccgccgcccgctcccggcgctcgggggcgccgagcgccgcgtacccctcgatcaccggcccgaagggctcggccttcccccgctcggccaggaaggcctcggcggtgcggatgatgtgcagcgagttgcgctcgcactcctcggccgtggcgccccacgccgtgatgccgtggccgcccaggacgcacccgatcgtctgcgggttggcctccttgacggccgcgatgtccaggccgagctggaaaccgggccggcgccagggcacccacgccacgctgtcgccgaagcactcggcggtcagcttctcgccgtcggcggcgcaggccagcgcgataccggagtcggggtgcagatgatcgacgtgggccgcgtccaccagtccgtgcatcgccgtgtcgatggacggcgccgcaccgcccttgccgtgcaggcagtagtcgaacgcggccaccatctcgtcctcgcgctcgacacccgggtagacgcccttcagcgcgtgcagccggtcgagccgcagcaccgcgagaccggcctcggtcagcgtgccgaggtcgccacccgaccccttgacccacatcaactcgacgtcgccaccggtcacggggtcggtggcggtgcccttcgcggaggcgttgccgccggcgtagttggtgttgcgaggatcggcgccgagccggtgggaccgggcgaggagagcggcggcttcggggtggggtgccatggtgtgatcagtccttcgggaagagatgtacatgtactgaggcgccctgagggggcccggggcggtgtccgaagcgcggctttgccgcgtgggcgcggccggccgcagtggcccgcggcccgccaccggcctcacccggtggacgcggcgctgcgatcacgctccccagcccgcctgctgaccacccacccgctcctcggcgatcttcgacgcccacccggaccgccggtacgcggcgaccgggtccgggtcgagccccgtctcctcgcgcagctcggcgagcagcggccgtacatcggtgttgtacgcgtccatgaggaccgcgttcgcctccagcacgtccccggaccgctgcgccgaccgcagcgcctcacgatccacgagcagcgccttcgccgtcgcctcctggacgttcatcaccgagcggatgatcgccgggatcttcgcctcgatgttgtggcactggtcgagcatgaaggccacgtcggacgtgaggccgccgccgcggatcacctcgtacatgatccggaacagctggaaggggtcggcggcgcccaccatcaggtcgtcgtcggcgtagaagcgggagttgaagtcgaagccgccgagcttcccctcgcgcagcagtgtggccacgatgaactcgatgttggtgccgggtgcgtgatgcccggtgtcgaccacgacctgcgccctgtcaccgagcttgaggcagtgcgcgtacgccgtgccccagtccggcacgtccgtcgtgtagaaggcgggctcgaagaacttgtactcgagcagcatccgctggtcgtcaccgagccgctcgtacaccgtggccagcccttcggtgaggcggtcctggcgctcacggacatcgtcctggccgggatagttggtgccgtccgcgaaccacagcttcaggtccttcgaaccggtcgcgtccatgatgtcgacgcactcgagcaagtgatcaagggctttgcggcgcacggccgcctcggggtggcagatgctgccgagcttgtacgcgtcgtcctggaaggtgttggagttgatcgtccccagcttcagcccgcgctcctcggcgtactcggcgagcttcgcgtagtcctcgacccggtcccaggggatgtgcagtgccacggtcggcgcggcacccgtgtacgcgtgcacctgcgcggcgtcgtcgagcttctcctggggcgtgcgggggactcccggctgcgcgaacaccttgaagcgggtccccgagttcccgtacgcccatgacggcgtctctacggcctgggtcttgagggcggccttcaccgcggcgagctcggtcacgtcaaggctcctgtgacttcgggggtggaagacttacgtatgaaacgattcaggaggcgaagttatgagtcgcccgaggggctgtcaagccctcgggaatgagtcatttcccgtgactctttggtgacctccgagtatcgaaaaatttcgacccgtacccattgacgcgacctggatggcttgtctaacgtcccggcaatccagttgaaacctttcacgacgcggtgagggcagtcccgccggcgtcgtcgaggagcccccatgacccacccgtccgacacgggtccggcccccgtgctggcgctcgaggacatctccaagtccttcggcgccgtgcgcgccctgcgggacgtctccctcgagctgttccccggcgaggtgcacgcgctcgccggtgagaacggcgcggggaagtcgaccctcatcaagacgctcgccggggtgcaccgaccggacgccggccaggtgctgctcgacggccggccgaccgtcttccacggtcccgccgacgcccgggacgcgggcatcgccgtgatctaccaggaaccgacgctcttccccgacctgtcgatcgccgagaacatctacatgggccgccggccccgccgctccttcggccgtatcgatcacaaggccacccgggccgcgaccgccgcgctgatgcggcgcctcggcgtcgaactcgaccccgaacgccccgcgcgcggactgtccatcgccgatcagcagatcgtcgagatcgccaaggcgctctccttcgacgcccgggtcctgatcatggacgagccgaccgcggccctgaccggcagcgaggtggcgcgtctgttcggtgtcgtccgcacgctgcgcgagcagggcgcggcggtgctgttcatctcgcaccgcctggaggagatcttccagatctgccaacgggtcaccaccctgcgcgacggtgccctgatctccagcgaaccgctggacggcatgacggaggacgacctcgtacggcggatggtcggccgcgacctcgacgagctgtaccccaagcaggaggtgcgggcgggcgaggtggcgatgagcgtgcgccgcctcaccagggagggcgtcttcaccgacgtctccttcgacgtccggcgcggcgagatcgtcggcctggccgggctcgtcggcgcgggacgcacggaggtggcacgggccgtcttcggcatcgaccgctgggacgcgggcgaggtcgaggtcgagggacgcaggctgacgaacggagccccgtccacggccatggccgccgggctcgccctcgtccccgaggaccggcgcgcccaggggctggtgatgaacatgtccatcgagcggaacatcgggctcaccggactgcggactaccgtccgggccgggctcgtggaccggggcgccgagcgcagccgctccctcgactgggccgccaagctccaggtcaagtacgcgcgcatcgccgacgccgtctccacgctgtccggcggcaaccagcagaaggtggtcctcgccaagtggctcgccaccggtcccagggtgctgatcgtcgacgagccgacccgcggtatcgacgtcggtacgaaggccgaggtgcaccggctgctctccgcactggccgcggacggagtggccgtcctgatgatctcctccgatctgcccgagatcctcggcatggccgatcgcgtgctcgtgatgcacgagggccgcgtcaccgccgagatcccgcgctccgaagccaccgaggaatccgtgatggccgcggccaccgggagggccgccgcatgaccgccatcgagcgggctgcccctacgacgccgacagccgcctggagggccgccgcatgacggtgaccgcgcccaatcccgcccccgccgccgaggtgcccgagtccagtggcacgcggctggtcgaccgtgtcttcaagatgcgcgaactcgccatcctggccgtcttcctggtgatgatcgccctcactcaggcgggcaacagcgagttcctgtccgaacagggcatcaaggacctgttgctgaacgcgaccatcctggtgctggtcgccaccggccagtcgctggtcgtgatcacccggaacgtcgacctgtcggtcggctccacgctcggcatcagcgccttcgcggccggtacgtatctccagggcggcggaaaccccgtcgtcgccatcgtgctggccgtcctgctcggcgtcggcttcggcctgctcaacggactcctcgtcagcctcggccaggtgcccgcactcgtcgtcaccctcggcaccctctacatcatccggggcatcgactccatctgggtcggctcacgccagatcacggcggccgacctccccggcggcttcgtggacttcggctccggcggcatctcggccgtgccctggctcgcgctcatcgccctggccgtgctgatcgcgaccgcctactacctcaagcacttcggcagcggacgcgagctgtacgcgctcggctccaaccccgaggccgcccgcctcgccggcatgcccgtccgcaagcggatcctggccgcgtacaccttctgcggaggcctcgccgggctcgcgggcgcgctgtacctggcccggttcgggaacgtcgactccggtacgggcaacggctacgaactcaccgtcgtcagcgcggtcgtcgtcggcggcatcgtcttcaccggcgggtccggcagcgtctacggggccgctctcggcgcgctgctgctcacctccgtcaacagcgtgctgccggccctcggcgtcagctccgtgtgggtgctcgccatcaacggcatcctgctcatcctcgccatcgcggtcgaccggatcgtcgccctgcgcgtggcggccgccctgaagaagaggaacgcccgtcatggctgactccaactggacgcgggccatccgctgggacacggtcgtcggcgcgctcctcgtggtcgtactgctgctgtccttcggcttcgtcgacggcttcggcaacggcctcaacctgtcgttcctcatcggcaacaccctgccgatcgcgctgatcgccctgccgatgaccctgctcgtcgtggcgggtgagatcgacctgtcggtcgcgtcgacggccgggctctccggttccgtgctgggcgcgctgtggaaccagggcatggcgatcgagacgatcatcccgctctgcctcctcctcggagtcgtctgcgggctggtcaacggcctgctggtgacccggctcgggctgccctccctcgccgtcaccatcggcacgctcgccgcctaccggggcatcgcgcagatcgtgctcggctcggacgcggtgaccgacttccccacccagtacctggacttcgcggccggacgcatcggcgacaccttcctcccgtacgccttcctgcccttcctcgtgctgctggccatcgcggtggtcgcactgcacgccaccccgttcgggcggtcgctgttcgcgatcggcgcgagcgaggaggccgcccggttcgcgggcctgcgggtcaagcgccagaagctgatcctgttcaccctgaccggcctgatggcctcgctcaccggcgtcctctgggccctgcactacgccagcgcccgctacgacaacgccaccgggctcgaactctccgtcgtggcggccgtgttgctcggcggcatcgacttcgacggcggcaagggcacgctcggcggcgcgatcgcgggagtcttcctgctcggcgcgctccagaacgtgatgagcctcgtcaatgtctccgcgcagtcgcagatcgtcgtcaccggcgtcctgctcgtcgtctccgtgctcggcccgcgggtcgcacggcagatctccgtcgcgagggcggggcgcagagccccctcaactccgaccccgactccgtaaccaggcaccctcgtaaaggacccccgccatgcgcaagtcatccctccgccgcacctgtgcggccctcgccgccgtcacctccctcgccctcgccgccaccgcctgcggcggcaccaccaaggacgacgtgaaggacgacagcggctccgccgccacggccggcaaggccgacccgaacgccgccaccaagaagggcctgacggtcggcttcctgcccaaggcggtcaacaacccctacttcacctccgccgacaagggcggcgagaaggccctcgaggagctgggctccagctacaaggaggtcggcccgagcagcgccacggacacctccgggcaggtcagttacgtcaacacgctcacccagcagcaggtggacgcgatggccgtctccgcgcaggacccgggcgccctgtgcaccgcgctcaagcaggccatgaagaacggcatcgaggtcgtcacctacgactccgacaccaagaccggctgccgcaacgccttcgtctcccaggcgagcgccgaggacctgggccgcaccgaggtgcagctgctcgccgagcagatcggctacaagggcgagatcgcgatcctgtccgccgcgcagaccgcgacgaaccagaacacctggatcggcttcatgaaggacgagctgaaggaccccaagtacaagaacgtgaagctggtgaaggtcgcgtacggcaacgacgacgcccagcagtccttccagcagacccagggcctgctccaggagcaccccaagctggccgggatcatctccccgaccaccgtcggcatcaaggccgccgcccagtacctgtccggctccaagtacaagggcaaggtcaagctgaccggtctcggcaccccgaacgacatgcgcaagtacgtcaagaacggcaccgtcgagggcttcgagctgtgggacccggccaagctcggcgagctcgccgcgcgcacggccgtcgcgctgtcgtcgggccagatcagcggcaaggagggcgagaccttcaaggccggggacatgggctcgtacaccatcggcaaggacggcgtgatcagcctgggcaagcctaccgtgttcgacgcgaagaacgtcgaccagttcaacttctagccgcggaagggcttttgatgcagcgcgtgtgctttctgctgaaggtccgggcggaccgcctcgacgagtaccgcgagcggcacgccgccgtgtggcccgagatgctggacgcgctctcggccaccggctggcgcaactactcgctcttcctgcgcgaagacggcctgctggtcggctacgtggagaccgaggacttcgcggccgcccgggccggtatggaagccaccggtgtcaatgcgcgctggcaggcggagatggcgccgttcttcgagtcgctggacggcgccgggcccgacgaagcgatgaaacccctgaccgaagtcttccacctcgcctgaccctggagccatggacatgagacgacgcaccctgttggcaacggcgctgctgggtgccgtggccgccccgggcaccgcccgggcggccgatcccggcccctcggtcaccctgaccggcagcaccctgctcgacgcccgggccgtgtacttcgtgtcgtacgacgggctggtcaacaacaacgcgttccagaagaacggcctgctgacgtacaagggccaccagtacgcggcctggtacaccgccgaccgcagcgcggtcgtcgcccgccggacgctcggcgcgtcgaactggtcgacgctcaccctcgcgcaccggctcaagagcgacgactcccacaacgtcatctccatgggcgtgtcgaagacggacgggcgtctgcacctgaacatggactcgcacagcgacggcttcttctacgtgaagtcggcggccggactgctcgacaatgcccccgcgtggacgtccgccgccttcggctccgtagggaccacactcgacggactcgccctcacctcgcagttcacctacccacagttcatcgccacgcccgagggcaggctccagctcagctaccgcgcggggatctccgggaacggccgcaacgcgctggccgagtacgacggttcgtcctggaccgcgctcggcgagtggtccggctcgaccggcacgtacaccagcgagcacggctccagcacggcccggaacatgtatctgcacggcatcgactacgacacgaacggcaggctgcactccttcttcacctggcgcgagcagtccgcctccgtgatgtgcgacagcggtggcatcaccaaccacgacacgggctatgtgtactcgaccgaccgcggccggacctggcgcaacgacgcggggacgctcgtcggcaccaccggcggctccgaccgggtcgccgtcaccgacaccggactcgtgatcgacccgctcaaccccgaccactccctcatgaaccaggagagccaggccaccgactccaccggcctgccgcacgcgatcatcagctacgtccccgggcgcttcggccagtgcacgacgaactacgtcaccgaccggaccgcgaacggccgtgccttccacctccgcaagaacgcctccggcggctggaccaagaccgagatcccgatcgccctcaactccagccagcgcaccaagctggccctcgaccggtacgacaacgcctacgcgatcatgccgttcggccggatcgccgccgcctccaagtcctccgggtacacggactggaagctcctgtacgacggcggcggcctgaacgccttcggcgaggtggtgatcgacgagacgcgggccggccaggacggcgtgctgtcggtcatgtaccaggagaagtccagcggtacgacgccctcggcgctccatgtcctcgacttcgggctgcccgcgtgaggggggccggcgcggccgggcgcgcatgtaatgtgagggcttgcctgccgtttcccgttttcgtggaggtctccgcctgatggcccagtcggtgggtatcaaggacgtggcccgcgccgcgggggtttccgtggggacggtctcgaacgtcatcaaccgcccggattcggtcgcctccgagacccgggcccgggtgctgtccgcgatcgaccggctcggctacgtccgcagcgagtccgcgcgccagctgcgcgccgggcgcagccggatcatgggcctgctcgtcctcgacatgggcaaccccttcttcgtggacgtcgcgcgcggcgccgagcgggccgcgcgcaaggccgggctcggcgtgatggtctgcaacagcgcgcagagcgccggcgaggagtccgactacctgtcgctcttcgccgagcagcgggtgcgcggggtgctgctgacgcccgccgacgcgacgggccgcaacatccaggcgttccggcgccacggcatcccgttcgtcctggtcgaccgggtcgccgagggcaccaccgagtgttcggtctccgtggacgacgtggcgggcggagcgctcgccgtacggcacctcgtcgacgccgggcaccgctccatcgcgtatgtgagcgggccgccgggcctgaaccaggtcagcgaccgccggacgggcgcgctcaacgcgctggccgaggccgggctggggccggactgtctgcgcgagctgcccaccgaacgcctggacgtggcagccggccgcgacgccggcgcccgcatcctcggcctcgccgaccgcccgaccgccgtgttctgcgccaacgacctgctcgcgctcggcgtgctccaggccatgtacgcggccggggtcggcgtccccgacgacctcgcgatcgtcggctacgacgacatcgagttcgcggccgccgcggccgtcccgctcacctccgtgcgccagcccgccgtgaccatgggcgcgctcgcggcggaactcctcctggaggagacggaagccgagacggcgccgaccccgcacgagcacaggcgggtcgtcctccagccggagctggtggtgcggcgctccagcctgtcggcgcgctgagcggccgttcagttgccgtactgagcgcccggtcagtacggatttcttgatccccgggctcggccgcctgcggaacctgtgttcaactgggacgcagcctggaatccgtacgtctcgggagccctgttgaccgtcacctatcgccagcccggtgtcgtcctcaccgaccaccacttcaccgtgcccctcgaccacgacgacccggcgggggagtccatcgagctgttcgcccgcgaggtcgtcgcgagcgacaaggcgcaccaggacggactgccctggctggtctacctccagggcggccccggcttcggcgccaaccgcttcgtcggcacgcaggcctggctcgggcgcgccgtcaaggagttccgggtcctgctcctcgaccagcgcggcacggggcactccacaccggcgaaccgtcagacgctccccctgcgcggcggcccccgggaacaggccgactacctcacgcacttccgcgccgactccatcgtccgcgactgcgaggccatccgcccccggctcaccggcggcgccccctggaccgtactcggccagagcttcggcggcttctgcacggtgcactacctgtcgacggcgcccgaaggactgcgcgccgccctcatcaccggcggactcccctccctcgacgcccacgcggacgacgtctaccgggccgcgtacccgcgcatcgaacgcaaggtcgccgcgcactacgcccgctacccgcaggacgtcgagcgggcccggcagatcgccgagtacgtgctccggcacgagccggtcctgaacggcggctaccggctcaccgtcgaggccttccagtcgctcggcatcctcctcggcggcggcgagggcagccaccgcctgcactacctcctggagaacgccttcgtccgcaccccgcagggtccggccctctccgatgccttccaggaggacgtccagagcctcctctcctacgcgggccacccgctgtacgcactcgtccacgaggcgtgctacgcccaggacgaccgccccaccgcctggtccgccgagcgcgtgcgcgccgagttcccccggttcgacgccggcaagacgctcaccgaggacgggccgctgctgttcaccggtgagtccgtgcacccctggatgttcgacgccgaccccgccctgcgtccgctgcgcgagaccgccgaggaactggcctcccgcacggactggcagccgctgtacgaccccgcccgcctcgcggccaacgaggtgccggtcgccgcggccgtctaccacgacgacatgtacgtcgacaccgagcactccctgcgcacggcccgcgcgatccggggcctgcgcacctgggtgaccgacgagttcgagcacgacggggtgcgcgcgggcggtccgcgcgtcctggaccggctgctcgccctgacgcgcgacgaggtctgaggcccggggccggtgcggtcgcggcagaccggccgcgacctccggactcttcagcgcggggagcggatcgtgatttgatcatcacggccctgaaccgccgaccggaacgcggcagggctccgcggacgagtgggggagcgatgggcgacgggggaacgatgagcgagagcgatctgctggcgggccggttcgaggaacaccgcaggcacttgagggccgtggcctaccggatgctgggctcgctcagcgaggccgacgacgcggtgcaggagacctggctcaagctcagccacgccgatgtgagcgaggtcaggaacctcgccggctggctcaccaccgtcgtcagccgggtctgtctcaacatgctgcgctcgcgtgcctcgcgccgcgaggagcccatggacaccttcgtgcccgaccccgtggtcagctccctggagcgcatcgatcccgaacaggaggtgctcctcgcggactccgtcgggctggccctgctcgtggtcctggagacgctggagcccgccgagcggctcgcgttcgtgctgcacgacatgttcgcggtgcccttcgacgacatcgcgccgatcgtggaccgcagttcggccgcgacccgtcagctcgccagccgcgcccgccgccgggtccagggctccgccccggcgcccgatcccgacctcggccggcagaagcaggtgctcgacgccttcctcgcggcctcgcgcggcggtgacttcgaggcgttgctgtccgtcctcgacccggacgtggtcctgcgcgccgacgcgggggccctcgccgggggtgtcgcggtgtccaagctcgtccggggcgcggcggcggtggccgagcaggcgctcatgttccggcagctggcgcagttctcgcggctggtgctggtcaacggcgcggtgggcgtcgtcaccgtgctcgacgggcagccgatgggcgtcatgggcgtcaccgtcgcggacggcaggatcgtcgacatctgcatcctgtccgaccccgaccgactggcccgcctcgacctcccggccggctagggcctggccggccgatcacgggggagggaagcagcggcgcccctgggcggtgcgggtgccggtaccggtgggcggggccatggggggtctccctgcttgagtgaagccgagagcttgggggagtgcgtggccccccggggggtctccgccgtagtcggccggatcggcgggatcggctttcgcgccgggcggtcgggtggtcgggcggtcggttgggtcgggatcgggcttcccgacgggcggcgtgggtggggcggagtccgtcgtagggtggccggtatgcgagacaccccggttgacctctccgaactgcgagccgactgtgcgcagtgcttcggcctgtgctgcgtcgcgctgcccttcgccgcctcggcggacttcgcgatcgacaaggacgccgggaagccctgccgcaacctccagggcgacttccgctgcggcatccacctggaactgcggccccggggcttctcgggctgcacggtctacgactgcttcggcgccgggcagaaggtctcgcagatcaccttcggcggccaggactggcggtcgggcacccgggagcacgcccggcagatggtcgacgtgttccccgtcgtacggcagctccaggaactgctctggtacctggccgaggcgctgaccctgcccgcggcccgccccgtccacgccgacgttcgccgcgcgctggaggcgaccgagcggctcacccgccagaccccggaagaactggagcagttggacgtcggcgcgcatcggcaggaggtcaatgtgctgctcctgcgcaccagtgaactggtccgggcgggcggtggccgccgcaagaaggaccgtcgaggcgccgacctcgtcggcgcccgtctcaagggagccgatctccgggcggccagtctgcgcggcgcctgcctcatcgccgccgacctcaccggcgcggacctgcgcggcgcggatctgatcggtgccgacctgcgcgacaccgatctcacggacgccgacctcaccggcgcgttcttcctgacccagccgcagctcaacgcggccaagggcagtgccggcaccaagatcccggcgtcactcacccgccccggtcactggacagcggggacctgaggacacctccgggttcgcgaccgggacgtcctcgacggcgggcacccgccggtccagccgcagccgcagcccctcgggcatcagcgtcagccgctccgccacccgcagccggtacccgggctcggcccgcagctcgtaccggcgcagcagcagtcccagcaccagcgtcgcctcgtgcagcgcgaactggcgcccgatgcaggcccgtgcccccgtcccgaacggtttgaaggtgtgcgcggcccgggaacgcaccgcctgcgcgtcgaaccggtcggggtcgaaccgctccgcgtccgcgccccacacccccggatcccggtgcagcatcgccgtcaggaccagcgcccacgcgccttcccgcatcggatggacgccgccgaggaccgtgtcccggcgggcctcccgggcgaaggcgggcgcggtcggccacaggcgcagcgactcgtccagaacccgccgcacgtagcgcagcttggcgacttggtcgtagccgggccgggccgtgccgccccacacgcggtccacctcggcgcgggcgcgcgcggcgacgtccgggtgccgggagaggtagtgcagggcgaaggagagcgcgcccgaggtggtctcgtggccggcgaccaggaacgtgatgacctgccgccgtatgttctccggggcgagccgctccccggtcccgggacgcgcggtgtccagcatccggtcgagcaggtcgccttcgccgctcgtggtccggcgggcgcgcaccagggcgtcgaccgtgcggttgaggtacgccagatcggcggcgttgcggcgggtggcggtgcgcagcagcagcggagccagcggctccggaacgacgttccgccgctgggcgtacgtcagggtgcccaccatcgcggtgacgaagggatgcggccgggcgcgttcgaacgagccgaagtcgtgcccgaacccggtgcgcgcgatcgtctccagcgtcagcttggtcatgtcgcccggcacgtccacggcacggcctgccgtctgctcccggtcccagtggtcgatcagccgctcggtcacggccagcatcatcgggtggtaccccgccatggcctcacggctgaagcccggcgccaggacgtcgtggccgagctgccagttcggctcgtggttgtacgccgtgaacaggccgtcgccggcgaccggccgcagattggcgacgcccaggcccacgtgcttggcgaaccgcgactcgtccgccagttcggccgcgaggtccgcaccccccacgaagacgatctccttgccgaaggccttgcgccggaagaccgggccgagccggcggccgatgcgcagcgaatcctgcacgggagtacggacgttgacgcccagcacatcgccgacgactggaagccggtggggcggatgcgggatgcggtgcagctccggccagcccagctccgcgctgcggaaccccttgggaatcacggtccgcgtcgactgcgccatgacgccatctcccttgtgtccacggtgaatcgagactgttgtacgtgggttcaatagcggggttcagtgtcgtcccgctgttgaaccgacgtcaagtaaggtgcgggcatggccgctaaccagggcgagcgcacccgtcgcaggctcagcaccgaggagcgcagggaacagctgctgtccgtcggggcgcggctcttctcggagagtccgtacgacgaggtgtggatcgaacaggtcgccgagatcgccggtgtctcgcgcggactgctctatcactacttcccgaccaaacgggacttcttcgcggcggtcgtcgagcgtgagagcgggcggatgctgcggatgaccgcggccgtccccgggatccccgtgcgcgaacagctgggtgcgggcctggacgtgttcctggagtacgtcgaggcgcacgcccacggctttcgcgcgttccaccgtgccgacgccgccggggaccaggccgtacggacggtctatcggcaggcgctggccgcgcaggagcggcagatcctggcggcgctcgccgcggatccggagatcggccggtcgcccgaggaggagcccgagctgcggatcgccgtacgcgggtggctggccttcaccacggccgtctgtctggagtggctccgcggggccgagctgacccgggagcaggtgcgcgatctgtgtgcacgggcgctgctcggtgtcatcgcgctctgaccggaagcggctgcggtggtgaagcctggttggcgtacgccccgatcttcgataggttaggcaagccttacctaaggaggttggaatgggtgaccgtcacacgtggacggccgcgcctgccgcggcggaacgcgcccgctccgtgctcgctgccgcatggtcctgcgcggtgaccgcggagggcggccgggaagagttcgtcggcacgcacaccgtggccgcggacggcgtggtgctgctgcccgtgcccgaggacagtgcgctgcgggtcgccgcgatctgcgcgccacgcggagagccgtccgccgtgctggagttcgccgatgtggcccccgtccccgtacggaaccggatccgtgcccggctctggatggccggctggttcgccctggaggaggggcacttggcgttccggccgacgcgcgtggtcctgcgcggccggcccgccggggcggtcgtcgtcgacctcgacgagttcgccgcggccgagcccgacccgctggccgcggccgaggccgggctgctgacccacctcgccgacgcccacccggacgccgtcgaacggctcacccgcctcgtcgaacacgacagcctgcacggcgccgtacgcgtacagccgctcgccgtcgaccggcacgggctcaccctgcgcgtcgagcgggcgcgtggcgacgtcgacgtacgactgccgttccaccggcctgccgacgacgtgggacagctcaccgaacgtatgcacgtcctgctcgcccaggccgcccaggccgcgcgcccccgtgcgctacagcggcagcgcgcagacggcgacgggtgacgcgaacggctcgcccgcgaggcggagttcgccgctctcgcggtcgacgtggaagacgctgaccgtgctcgaccgctggttcgccgcgaacagcagcccgccgtccggcgagaacgcgatgtgacgcgggaagtcgccgcccaccggaacggtgtccagcagcctcagtcgcgcgccgtccgcctcgaccgcgtaccgcgtcaggctgttgtggccccggttggcgagatacgcgtacgacccgtccgaggtcaccaggatctgcgccgggtagctggtgcctgcgcccgtgccggtggactgcgggtcgcccggggtcagacggccggtggccgggtcgtaggcgcagacggcgaccgtgttgtcgacctcgttggccaggtaggcgaagcggccccgggggtggaaggtgaggtggcgcgggcccgcccccggccgggtgtgcgcctgggaggcctcggtgagcgtgcccttcgacaggtcgaggcggtagctgtagacggtgtcggtgcccaggtcgacggcgagcacgtggccgccgtcggggctggtgaggaactggtgggcgtgcggcccctcttggcccggccctggcggcggaccggagtgcgtgaccaggtccatgcgctcgccgagcgctcccgaggagccgatggggtgcacggccacgctgccggaggagtagttggcgctcagcagccagcgtccgcccgggtgcacggacagatggcagggggccgctccgccggtgccgcgcgcgccgagaaccttcttgtccgccagtcgtacggcactcacgccgccgtcctgccgctcgttgacggcgtagagcgtacggccgtcggggtggaccgccagatacgacgggtcgccgacctgggtgacggtgccggttccggtgatcttgcccgtcttcgggtcgtaggtcgccagaccgatgcccgcgccgccgccgtcgacggaggtgtaggtgccgaggtacagcgggcggggaccggaaggctgtgactcagtggtctcgggcgtgggcgccggggcggggcttccgggtggggtcgtcctggggctgtcaccgggggcgaccggcgccgggatcgtcgtcaccgcggtggcggccgtgacggctccgaggaagcggcgcctgctccagccgccgctccgcgggccccgcgtcggttccgcaccactgctcatgcctgcacctcgggtgtcgatcgtctcggctgcgacagccaccttgacgtgaagcgaccaccgagtgcaagaagggcaacgggagttgcgcagggtgcaacgcccatccgggtggtgtgcggcggctaccagtcgccgtccccgaccggcttgcccggtgcgtcgcccagcggcttcacctggtgcggtgagggctcctgccagggctcgtggtcgtcgccgagccagtcgcccaccggccgcaccttgccgagcgtgtccgtgggggcgaggtccgcggcgtcctggtcgtagtagtcgaaccaggggagtcccgcgcgggtgtaggccgcgcggtccacgggggagggcgggggcgcctcgccggtgatgcggcgccactcgggaggcgtcacgagatgcacgaacacccgaccggccggcttctcggcccaggccccgagcggccggtcgtcccggtagacctcctggcgcatcgagccgccgacaccgagacccatcgccgcggcgccgcgcgaccggcgcgagggcgcaccggccggtgcgggcgcggcgcccggtgcggcgggtgccgccatgggcatcgcggtgccgtaccccccgggcgccgggggcatctcccggcgtgcctgagcctttcggcgctccgcgtcgcgccacgcggccagttccccgtcgttcagcgggaaggactggagctgtacgccgccccacacctcctcgccggtgacctggccctcgacggtggcgccgaggccgaggggcaccgccacgaactgacggaccgtgcccttcccggagttgatgccgtccagccacggctggcgcggcagcaccacgtagttctgcgggtcgcgggtcagccgggaactccacggcttgcccgacacggcacacaccttgcccacgccgacctggagcgcggccggctccgaggtgcccgcgaaactcagccacatggcttcccgcagatacaccggcagcatcacaccgccgcgcgaccgccatgcggcgggcaccgtgtcggggtagtcctcgacgcggcgcaccggaaactcgccgagccccggaggcagctcgtgcgtgcccgtctcgggcagccgcagggtccggatgaaccggacctgtactccgcccggcagtcgcagtgtgtttccgtcgatccgcacggtgccctcggtcatgaacgcccgctcccctcgtcgtcgccgtcgtgctcgctcggtgattcctcaggtagaacgacccgaagaggcccggtggttccggcgcggcaggcgcacgacccccatacgctgccgcaggcgggtgaggcgtgatctgcgctcgcgctgctcgcgggtgctgcggtccagttcctcgaacagccgccgggagcggtgttcgatgtcgagctcgtccaggatgcggttgacctccgtgagaatggcgccgcgcaactgccactggctcgcatcccgttggatctcctcgagcagcagctgggccagcttgtcccgggtcgccgccgcggtcgtcagctccgcggcgagccgggactccgcgttctcggcgctgcgactgacatcggtggtgaccagcaccgcgaagctgacgatggcgttcccgatctcggagaggagctgttccagcaccgcgccggtctccggctccagccaacgctgcagatcgcgcgccttggcgaaatcggcgagggtgcgggcgaggacccgcagcacgaccgtgcagatctccagcgtgtccaggccggtgcgcagcacgatccggtacagcagcccttcgcggacccgcggattgagcttcaggctgtcctcggcctgtcgcagcgccgcgtcgacctgcacgatgtcgtggtcgaggcggcgcgcctcgtacagccgggccgtcgcctcctcgatgggcgcgcggcccgccgcctcctccccgatgcgcagcatcaactgacggatccggcgcgccaggtcctcgatggactccgcggcttcgctcacccagaccgggggagcgaagagcacattcgtgccgagccccacgaccgcgccgatcagcgtctccaccacccgcgcccaggcggtgtccccgacccgggtcacgcccaggacgagcatcgcgctgatcgccacctcgggcacgaactcgctcacccggacgagatgtccgacggccagcgaggcgaggatgatcaggcccagactccaccaggtcagtcccaccagcacgctgaagccgatggcgatgacgacacccgtcaccacggagttcaccctgcgccaactggtggtgagggtggcgtagagcgtgacctgaacgacgaggagggccgtcagcggcgcggtgagcggtgcgggttccgggctcaggtgaagggcgatgacgtacgcgacagtcgcggccgccgtcgaacgcaccgactggacgaccacgggctggcgccacttcccgacctgcgcggtggccgccgcccacgcatcacgtacatctcgcatccttggccttttcccgtttcacagctgcaccgaacgtatctattgaggaccgaaactgtccgtaagtgagcctaggttgttcccgcctgccggaaatcagggaggggatcgcccctgggcaacgtcaaggggcatcgaactgctcgtacaggcacacgcgtacctgcgcgggacggtcgcggccgggccggagcaggcctggggagcgccgacgccgtgcggagagtggaccgtacgccaggtactcagccacgcgcgactcgatcagcaggcgtacggcgccgccgtcacgggggacgggcggccggagtcggactccttcgcgcccgcggacgcgctgtccggcgacgcgcgggccgagctggacgcggtgctgcgccgggtggcggacgtgtacaccgcactgcccgccgacgccgagcaggtgccgaccccgctgggcccgctgctccagccgccatggacgccggcgtgcacgcctgggacatcgccgtggcgacgggcctggacatgccgttggacgaggagatggccgacggcatctgggccgccgcggagcgtctcgcggatcatcttcgcgacgcgtacggggtgttcgctcccgtgcgcgaggtgcccgaaggtcccagccgggccgaggcgttgctcgcctttttgggccgggatccgcactgggcggctcccgcgtcctgacccggcgcttccgggtgagccgcgtcggccggtcagcgcggctcaccggggcacggtgccacgtggtgggcatggccgtacggccgcgtggccgcatggtcgccgtcgtgcatgctcgcggtcgctgaggcaggcctcagtctttgccgccgggttttccccacccccggcggcaggcctgccggatggtccgggcccgggccgggacgagagccttggatcatgaaacggcatcggactggattggccctggccctgctcctcactctggggaccgtggcggccggcgtggcgccggccgcctccgcgacgacgagcggaccggtcgtccacgccctcgaaagcggcgcccaccccctgcggaccgtcgaaccgcagggcgacacgagcgatctacggcctctcgacggcatgatcggcggcgcccgggtcgtcggcctcggcgaggccactcacagctcccacgacttcttcgccctgaagcaccgcgtcttccgccatctggtcgaggagaaggggttccgcaccttcgccctggagggcagctggagcaccggacagcggctcgacgactacgtgctgcacggcaagggcgacccgcggcgcatcatgcgcgaggagttccaacgcgactacctgtggtggaacaacaccgactatctggcgctcgtcgagtggatgcgcgcgtacaacctgcggcatccgcacgacccggtccgcttcatgggcgacgacatcggctgggtcggacccgagctgtacgacgccgtcacggactatgtggcccgcacccggccggagctgaccgcccgcttcgacgagctctaccgcggactgcggcccacggtggcgacgggcacgtacatggagcagtacctgaacaagccgtacgccgagcgcagggagatggcggaccgcaccggccaggccctggagctgctgaaacggcagtcaccgggcgcggaccgggcggcgtacgaacgggccgtgcagaacgcgacggcactcgaccaggtcgcccggcagtacgccttcgacttcacggacccgcggcagatcgccgcgagcatgcgctaccgcgactccgcgatggcggccaacgtgctctggtggcagcggcacaccggcaccaaggtgctgctggcggcgcacgacgcccatgtcgggtaccggacgtacgatccggccaactacccgaagatgcagggcgcctttctgcacgaccgcctcggctccgggtacgtgagcgtgggcctcaccttcgaccggggctcgttcaacgccaccggacaggacggcgccatccaccgctggacgctgggaccggccggccccggcaccaatgagcggaccctcgaccgggtccggtaccgcgactacgtactcgatctgcgccgggtcgccgcaccggcgcgggagtggctggacagggcccggcccacccgcagcatcggcaccgactacccggacggcccgcacgacatcgcgctcgcgtccacccacgacatactcatccacctgcaccgggtggaggcggcgcggctgcgggaccaatagggaccgacaagccgcccgcgcgtcggctctacagcttgtccaggaaggcggacagattgcccaccatccgggcgatctgctcctccacggtgaggctctcctcgaagcgcgtcccggactccgggaccttcctgccgcgcacgtacagggaacaggcgaggtcggcgcacatgtagacgccgaccgagtttccctcgcgcccggccgcgcccgtcttgcgagccgtcatcagggacaccccgttgcccgggtgggtcgtcacacacagcgagcacatgctgcggtgcaggaagccgcgtcgcgaggacgggaaacgcagtgtcacgccgaccaggccgtccgcgcgctcggtgaccagatagctgcgatcgggcgcccccggatcccgccagccgaggaagtccaggtcgtcccaggggcgttcgtccagatcgcggggtatcgccaggcgcttggcctcgcccttcgagcagttgacgaaggagtcgcggatgtcctgctcggtgagtgctctcatggggaggttctcctgggggtgcgggcttcggcaaaacctaggggttctaggttttgccgaagttacccagtcgaaggatggagatccaatggttttgagtgccggggcgcgcctcagtccgtgaccgcctccggtggccacaccccggagctgagcacgcccagcgcgtaggcgcgggcgaccagttccgtacggttcgccgcgctccaccgctcggacagccgccgcaggtgacaggtgacgccgtccgtcgtcagtcccgtctcccgggcggctcgggccgccctgaacgagccggccgcctggcgtccgccggtctgccgggcctgccgccccgtcgccccccccaccggcgccccggtcgggggcgggtgcacttggcgaacgcctcttatggcttaatttaggacgtgacaggccggaagggggccatatggcggcgcggaacgggcggacggtgcgtgatctgcggcggggcaatcgcaccgccgtgctgcaacggttgtatttcgagggcccgatgagccgcttcgaactggggccggccaccgggctgagttccggttccatcagtaacgtggtcgccgagctggtcgccgacggactggtcgaggaggccggcagcgtcgactccgacggtggccgcccgcgcatcctgctgcgcgtcgcgcccggcagcggccacatgatcggcgtcgatgtcggcgagacccgggtacgtgtcgagctgttcgacctcactctcaccgaactcgcccgcaccgaaaggccgttggagcgtgggtgctacgacgtcgaggtcgtcgtcgggcacatccgcgacggcgtcgacgaggtgctgacggccgcggacatcgcgcccgaacggctcctcggggtcggtgtcggcgtccccggcatcgtggaacgcacgccggggcagggcgcggtcgtccacggccagacgatcggctggaacgccgtccccctcgaatccctgctccgctccaccggccgcctgccggacaccgtcccgtacttcacggacaacggggccaagaccctcggccaggccgagatgtggttcggcgccggacgcggtgcccgcagcgccgtcgtggtgctcttcggctccggtgtcggcgcctgtctcgtcacggaggaggtggacagcggccgggcgctggagtggggccacctgaccgtacgggtcaggggccgccgctgccggtgcggcgccctgggctgcctggaggcgtacgcgggtgcggaagcgctgctcgaccgctggcgggaggagggcggacgcccgccggagcacaccgacgaggagaccgcgctgaccgcgatgctggccgcggcctacccgcccgggggcgccgaccccgacccggccgccctcgccgtcctggaggagaccgcggaatacctgggcgcgggtctgtccgacctgatcaacctcttccagcccgagcgcattctcatcggcggctgggcgggtctccagctcggctcccggttcctgcccgcggtgcgccggcacgcgacgtcgtacgcactgcgtcacccggccgagcgcgtctccatcgacctcggcaggctcggccccgacgcggtcacggccggcgcggccatcctgccgctcgccgacttcttcgcccggggcgggcggcgcgcggagccggcgagcgaggggccgtcgcccgcgtggcgtacggcgctggaggagcggccgccgcgctgagaccggcggggctcggcggaccgttcacctcgctgtgtcgctctgtgcctcgctgcgccgggatcacgcggttggcctgcggtttccgggacgacgggtgtttcggctgccgtgcccgaggtactcgcgcggcgcccagggggccccgcgagctctgcgcggggtccgccgccctcccgcagaatggagcatgccgtgaccgagcaccgccaagaggctcccggcgagaacggtgacccgatcccgcgggacctgccggaccagcaggcccgcgagagcgaggatccgtgggacgccgcccccgcaggaagcggcaaggacgacctcgacgacgagcccgacctcgacgtccccgacacggacgaggcgggcacgggccggcagggcgctccgcacgcggccgccgtgaacccggagcaccccgtgccggacgagcccgccgactgacccgaacagggagatctcatgggcctgaccgaccggttacgtgactggcccgtccgcagcgggagcgagtggacgagagggcgttgggcggagccggccgggcacccgccgtcggtcgcgatgcgggcacccgtcgtcggccgcgaggcgagagacgggcgctgggagaacgggtgcggtcgggggtggccgggcagtggggcgcccttgccgggggagtcgtgacgccggtgagaacggcgtggccgttggccggcccggcttcgcggcgtcgtcccggccgccccggcccgcctcaggcgcgggacgcgaacgcgttcactccggtgagttccgccgagaggtcccacaggcgggccgcctgctccgggtcggtcgcccagtccttcacgccgccccgctcgccgtccgcggacgccggctcggcgatgtcgcagtcctcgcagtacaccccgcccatgcccgccagctgcggagaggtcgccgcccacacctgggtggccgcgccttgctcgggcgtcttgaaggcgtcggggtgcacgaggtcgccgttctcgtcgatccacccccgctcgaccatctcctccttcgcgagatgacgctgcaacggggtgaggatgccaccggggtgcagggagaaggcccgtacgccggactcccggccgagcctgtcgaggtgcacggcgaacagcacgttcgcggtcttggcctgcccgtacgcctcccacttgtcgtagtcgtgcgtccagtgcacgtcgtcccagcggatccccgagaggtggtggcccccggacgacacggagacgacacgcgccccgcccggctcgacagccggccacagacggttgacgagcgcgaaatggcccaggtgattggtggcgaactgggcctcccagccgggcccgacccgggtctccgggcaggccatgatcccggcgttgttgatcacgatgtcgatcgtgcggcccgaggcgaggaaccgttcggcgaagccccgcacactctcgaggtccccgagatcgagctcgtccacctccaccccgtcgatgcccgccaccgcctcccgggcgacgtcggggcgtcgtgcggggacgacgacccgggcgcccgccccggtgagcgcgcgtgtggtttccaggccgagcccggagtacccgcccgtcacgatcgcgagctgtccggagaggtcgatgccgtgaagtacgtcgaccgcggtgctcgtggcaccgaaacccgagccgatcttgtgctgtgcagtgttcatgggacgcacgctacgaattggagagcactcgaagtcaagtggacctcgccgggcaaagaagagccccgaccggatgggggaatcacggtcggggcggtctgtggtgggtgcgcggggcggtcgcctctcggtggacggctccacagggcttcagccgaacgatcgtccctgtgagcactaggtgaggcccggggacactgtcccctccacacccacagtttgttcaaagaaaaactaccggagggtgttcccccacgtcgacgcaggtggggtgacgtgcgtcacgccgctcgggacggtccatgccacggcgcctcacgccttcggcgccagcgcgctgtccggcagtagcgcgagcagatgctccggatcccggtagatcgcgtccgcccccgcctccaccagatccgcccgcgggatgcccccgcacaggacgcccacgcaggtcaccccggcccggctgcccgcgcgcatgtcccagaccgtgtcgccgacgaacaccgcgtgctcgggcgggatgccgaccaggcccagcgcgtgctcgacgggctcgggcgcgggcttgccggcggacacgtcgtcggcgctcgccgtggccttgatggcgtcgtccgcgtcgatcgcccggcgcagcgcggacagttcggagccgcccgccgaggtggcgagcacgaccgtccagccgtcgtcgtccagccgcttcagcagccgcccggcgtccttcagcgggtgcagccggtcgaagtacgttccgtacagggtcttgtgggcggcgctcagcgcgtcgacctcgtcctggtcccggtcctcccccaggagatgggcgatgaggtcctgggagcccaggcccaccgaccggtggatgtcgtgcatcggcacctggtgacccgcctgccggaaggcctcccaccacgtcgtgacatgcagatggttcgtgtcgacgagagtgccgtcgacgtcgaacacggcggcgcgttccatgagctgtcctctcctcctcctacgccgtacgagtaccacgtcagacggggtccacgcccgccggtgtctcccggtcgcgggcccaggcgagcagttcctccatggtccaggtggtgatcacccgctcggcgggcaccccgcactcctcggcccgggcgcagccgtggatctgccagtcgagctggccgggcgcgtgtgcgtcggtgtccacggagaacaggacacccgccgcgaccgcacggcgcagcaggcgccgcggcgggtcgagccgctcgggccggctgttgatctccacagcggtgccggactccgcacaggcggcgaacacctcgtccgcgtcgaactccgactcgggccgtccgcgcccggtcagcagccgtcccgtgcagtgcccgaggacgtccgacagcgggtcgcgtacggcggcgaccatacggcgggtcatcgaccgtgcgtccatgcgcagcttggagtgcacggacaccacgaccacgtcgagccgggccagcagctcgggctcctggtcgagcgacccgtcgtcgaggatgtcgcactcgatgccggtgagcagccggaacggagcccagcgttcgttgagcgtggcgaccaccgccagctgctcgcgcagtcgctccggagacaggccccgggccaccgtcagccgcggcgagtggtcggtgagcaccgcccactcgtgcccgagccgcgccgcggtccgccccatgtcctcgatcgggcttccgccgtccgaccagtcggagtgcagatggcagtcgccgcgcagcagcgcccgcagctcctcgccgccctgcgcgagcggcgcaccggcctcccgctccagcttctccagatagccgggcacctgcccggccagcgcctcccgcaccacctgcgccgtcttcgggccgatgcccttcaaggactccagcgacccggtgcggaccagctcggccacctcgtccgcgggccgtgcggccagtacggcggcggcggtgcggaacgcgcggacacggtaggtgggagcctgaccccgctccagcaggaacgcgatccggtccaaggcctccagggggtccatgaccacctcctccggccttccagacttgcccagacgcggcatgtccgcacaacgggagcggcgggcccgtccgtacgatcgcggaacgccgacgccgaccgccgcaccctgctcacccggctggacgaacccggcgacggcggtcgcccgcccgcacgccgggccggggcggcggcggtcctcgaaccgcttcggcggctcacccacgcgaaccgctctacgctcgagacatgaccgaaatcgcatgcccctacgtcacccacccgcggatcatggtgctcggggtacagccgggcaagccgccgttccggatcgtggagatcgacggtgaagtggtcgccgaggcgagagcgatcaccgacgtcctgacggtcgcggcggaggccggcatcacggtccacgacctcgacgacccggacgtggtccgctgggtcggcggcgacaaacaccactggacgctgcgctagggcctgtcggctccggccggctcccgcgcgtcgtcgcgtcgccctcgtggtggtggaacacgcggtgagcccggccggcaccgacgccggccgggctcaccgctcgcctgcccggcggtctgctctctatggctcgctgtggccggggcgaggcttgttcagccgaccttccacttctggttcgccgcgcccgagcaggaccagatctgcagccgggtgccgttggccgagttgttgccggtcacgtcgaggcacttgttggcctgcgggttgacgatgtcgccggccgcggtgaccacccatttctggttggcgctgccaccgcagtcccacagctggacggtggagccgtccgccgtgccgttctccgtgacgtcgaggcacttgcccagcgcgcggagcgtgccgtcggaggccaccgtccacttctgggcggtggtgccgttgcagtcgtagagctggacgggggcgccgttggccgagctcgaaccggccacgtccacgcacttgccggccagtccggtgatgggcgcgccgcttgagctgtcgccggtcgtcaccttcacgtcgtccaccacgagctgctgcgggaaggccgtggagctgttcggatcgccgggccagtagccgccgaccgcgaggttgaggatcaggaagaacggcttgttgaacgcccaggtcttgccgcccaggtcggcgggcgtgcgccgctggtagacggtgccgtccaccgaccaggtgatggagtcgggcgcccagtccacggcgaatgtgtggaaggcgtccgcgaaggcctggcccccgggcagcgagtacgcggcaccgatgccgcccgtgccggagtaaccgggaccgtggatggtgccgtggatggtggagggctcgaagccgacgttctccatgacatcgatctcgcccgagttcggccagccgacctgtccgatgtcagtgccgagcatccagaacgcgggccacatgccctgcccgcgcggtatcttcatccgcgcctcgacccgaccgtacgcggccgagaacttccccgaggtgttcaggcgggccgaggtgtactcacaacggccgtaccagcactggtagttgccgggattgtccttgcgggccgtgatgaccagatggccctggccgtccagggccgcgttgttgttgccggaggtgtagtactgcctttcgtgattgttgacgttgtcgccggtctcgacctgccatttcgaggagtcgacggccgaaccggcggccccgtcgaacgtgtccgagaaggtggccgcggcagcggccaccttctcggacgaggccgccttgggggcggcgtcggctgcatcggcgggaccgatcgcggcggaggcgatgagcgccgcggagagtgcggcgaacagacatcggcggagcaggcgtggggagtccacgactctcccttctgtacggctgcccgggggacgggtgtgccgactggggtggggggtgcatgcttcgcctcttgatttaaggaatgaggtaaggggttgtcaagtcggtggtccggaccagtagttgctcagctcttgcccttgccgccgctcgtgtcctgccgccgcctccggcgcggatgcacggcccgcccgagtcgccgccccagcagcagataacccagcagcgcgcccgtcgtgttgaggatgacgtcgtcgatgtcgaaggcgcgcccggtgatgagcgccccctggaccagctcgaccagcagcatgaccagcgcggtcagtaccccgacccgcaccaggccccgggtgcgcggagccaccatcggcagcagtaccccgaacggcaccccgagcagcagattgccgccgatctgcttgacggcgtcgcgcaactcgggccggctcagataggcgtgcagggagcggcccggatgcaggttgttgtgggtcagcgcctccgaagcgggcgacggctccagggtcagccgggccagcaccgcggcgaacgccaccatggtcgcgaaggcgagcaccatcgccagcagtcgcacgggaagcggcagtggccggtgctccggcggtggtgccgtcgaggtgcgacggcggccgaggccgaatttcgaggtgccggtgcgtagctcggtacgggccatccaaccctccaggttcaacttccctctgtcgcatggcggctacccgctgtccggccgctgatgtccggtgcccggtgcccgacggccgggacgagccgttgtcggtgccggtccccgtcccctcttcggtttccgctaccaccggtggggcacttggggcaccagcccgtcgcgcgccgccgtcgcgcggagccggggcgatgcttggatggcggaaccggcaattccatgcaaagcggagaaaggggacggcagatgaacccgcgtacggcgctgtgggcctggcttgaagtactcgcctggtgggccgtcctcgccctcctctggctggtgttcatcagcgcggtcgacacactggagctgatcgtgggggcctcggcctcgtgcgccggagcggtcgcggcgcgcggagcgcggcgggcgatgagcgcgcggtgaacggctggaccgtcgcggccacggtcacgatcgccggcggagtcggggccaccgtgtggggcgtcgccaccgggccgttgagccgccgggtcgtcgcccagaacctgtcctgcgcactcgcctgccccggactgctgctgctcgcccagggatacgagaggcccgcgtacgtcgatctcgccctggtcctcgccctcctcggcccggtcggcaccctcgtcttcgcccggctgctcgccgacgacctcgcgcaggacccgccgcgtgcccgggccgtcacggtcgccgtcgcgtgcttcggcggcgtggtcgtactggtcctgtgcgcggccgccggacccggccgggccatgatgaaactcctggtgaccggggcgctgctgatcggcggaaacctcctcgcctcccgcgccctgtccggaggattctccgggggccgccgtggatgaccccctgatcttcgtcgccctgctgctggtcgccgcctccgcgaccgcggccgtcgccgtccgcgaccccgtgcgccaggccctcgtcctgtccgtcctcggtatcaccctcgccgtcctgttcaccgtgatgcaggcgcccgacgtggcgctctcccagctcgccgtgggcgccgcgctcaccccgctcctgttgctcctgtccgtgcgcaaggtcggacgccgggcccggcaggggaaccggaaggggaaggggaaggcacggtgacgcggcgcgtacggctgatcgtcctggccgtcggcggggcgggcctcgcggccctgctcgtcgccgcctgtctgcggctgcccggcttcggcgggacacggcacccctacggagaccgggtcgtccgcgcctccctggcccggcacaccgccaacaccatcgcgtccgtcaacttcgaccagcgtgccttcgacaccctcggcgagatgggcatcctcttcgcctccgtcctcggcaccgtcgtcctgctgcgccagacccgcgacgagcgaagcgcgcgaccggaacccgaggacgtcgcactccccgtacgccggtacgccctcgtcgtcctgcccgtcgccctgctcaccggcctctacgtcatcgcccacggccagctcagtcccggcggcggcttccaaggcggcgtcatcgcggccaccgccctgcacctgctctacctcggcgccgactaccgcgccctggagcgcatccggcccgtcggcctgtacgagatcggcgacgcgctcggcgcctgcgcctacctcgtcctcggcctcacgggagtcgtcgcgggcacgtccttcctcgccaacacactgctcccgtacggcaccttcaacaccctgtcgtccggcggcaccgtccccctgctgaacgcggccatcggcgtggaggtcgcctgcgcggtcgtcgtcctgctcgcccgcttcctcgaccaggccgtcgagatcgaggagggaagcgggaagtgaagaaggagagtcaggagagaaagggcagacggggcacgcgggaaaggcaggaaaggcagggcaggcgggaccgacaggacagacagggcagacaggagaggaaggggagcggcacgtgatgtccgtactgccgtatctcgtcgccgtgtggatcttcctgaccggctgctacgggctcgcgaccagccgcaatctgatccacgccgtgggctgcctcgccgtctgccagtccgccacctacgtcctgctgctgaccgtcggctaccgcgacggcgccaccgcccccgtctactccgacatcaagcccggctcgcggcccgtcgtggaccccgtcgtgcaggccctcgccctcaccgacgttgtcgtcggcgccaccgtcaccgccctgctgctcgccctcgtcctccaggtctccaaacgccacggcacggtcgacccggacgaactgcgggagctgcgcggctgatgaaccacctgctgccgctgctcgtcgccctgccgctgctcggggccgccctcctcgtcatggccggccgccggctgccgcgcgtggccgccgagtcggtcggctgcgcggtctcggccggtacggcggccctggccgtcgtcctgctgctgaactcctcgccgccgctggtggaatgggtcgggggatggctgcccagggacggcgagagcgtcgggatcgtcctggtgggcaacggcgcgggcctcggcatggcggcgctcgcctccctgctgaccgtgtcggcactcgcgtattcctggcgctacttcgaggaaccgccccaccacgcgggttccttcccggcgctgatgctgctcttccagggcggcatgtgcggcttcgcgatcgcgggggacctgttcgacgcgttcgtgttcttcgagctgatgagcgtcgtcgcctacgcgctgaccgggcaccgggtcgaggaggcgaaggcggtgcagggcgcgctgaccttcggcgtcgtcaactcgctgggcgcgtacgccatgctgatgggcatcgcgttgctgtacgcgcgcaccggcgaactcggactgacacagatcggccgcaagctcgacgcgcacggcgggcccgacgccctcaccctcgccgccttcgttctcgtcctcaccgcgctgctggtcaaggcggccgccgtgcccttccacttctggctgcccgacgcgcacgcggtcgcgccgacaccggtgtgcatgctgctgtccggcgtgatggtcgaactcggcgcgtacggagtctggcgcgtctacgggaccgtcttcgccggccccggcggcatccccgcggccgacctggaacgcgccctgctggtgctcggcgtactgaccagcgtggtcggcgcggtcctgtgctggtaccagcggcatgtgaaacggctgctcgcgtactcgacggtcgcccacatggggctgttcctgatcggcatcggcacgctgacgccggaggcggacgacggcgtcgcgctgtacgtcctcggacacgccggggtgaaggcggccctgttcgcctgcaccggaatcctgctcgaccggtacggcagcgtcgacgaacacgccctgcacgggcgtgcccgggagctgcgcggggtggccgtgctgttcctgatcggcgccctgggcctcgccggactgccgcccttcggcaccgcactgggcaaggcgatcacggaggaggcggtgggcggaccgctcaccgtcctgttcgtcgccgtctcggcggtcaccgcgggcgcggtgctgcgggtcgtggcgcgcgtgttctacgggctcgggccgaagccgcggaaggagtcctcgtacgagaccaccggcaccggcgaggaacccgagacccggcaccggctgcgccggatcccggacaccatgaccaccgtccccgcggtgctgctggccgcggcgctcgccgtgggcgcggtgcccggcttcgccggtgtggtggcacgcgccgtgaacgaggccggatccggtggggcggtcacctcaccccactggaccctggccggcgtcgtcctgggactgacctcgacggccgtggcagtcggcctggccgccctcgccgtgacccgcccgaagctgctcggtgagcagcgctggaccgaaccgctgcggcaccttcagtccgggtacatcggggactacgtggcgtggctgctggcgggggcgacgctgctgggtgcgctggccctgcccggcgtgctcggcggctgagccggctgacgcggccgctcaggcaccgtaggtcacgtgcacctccttgaagccgagcgaacgcagcagcccgtccagcatgctggtggtgttctcctcggcgcgttcggcgagttcgctgtccttggcggcctccccgatgtgcttgaccgcgagcttctgcacggcgcgttcgctgttggggttgtcggagaagaggtcgccgagccggtccagcagaccgcgctgcttggagacggcataggagcggtcggcgtcgagcgcgggcttgcccagcaccgcgtgcggcagcctgatcgtcgcggacgtgcggtcgccgttgaccttcacgtcgtccttgccgagcccgccgaggttcacatacgcgtccacggtgcccgcgcccacatacagcgtgcgggtgccgcggatcgcgtccggcaggagcttggcgtccttctccaggtccacgaccacctggaagttgcccgaggccgcgtcgtaacggctcatgtcctggatggacttgaggagtgtgggcccggaccggtcgtgggtgtcttccccgaacaggtcgcgcagccccggaagcacgctgagccgcagcccggcgaacagcaccacgagtaccaggacgagggcggtgaccgccttcaaccagccgggcatccgtttgcgctcactggacgtcgagccgggcgtctgcttgatggacgtcgtcatgtcgacagtcctcccttctctacccgagtgcccgccacatcccccgacagaacgcacggttggccaattgatgacgcgggctactcgatcagcgcagtgcgcggtcgcccgaaggcctggaccaccacaccccctccccgtgcgtcagccccggcagccgcagctcgacgtcgcgcacgcgccgggccgggagttcaccggtgatcagccaggccgtgcgcccgcccgtcgtctcccggaactccgcgtcgtacgcggccagttgcgctgtcaccggggccggcgcgtcgagggaagccctccacggcggagagcggcagtaccgccccgtccagcacctccagggcgcgctcggcctcggcgatgaagtcggggtgcttcggggtgtcgatggggttgatctgtacggctccggcggtgaaggcggcgacggccgaacggatggtgatgccgcgccgccgctcgatctccccgtcgtccgtacgggtgtcgccggcgtcgatgctgccgaggcggtcgatcgcgccggggttccgaggaatcggcgcattccggtcccctgaggtcgggcgtgtggcgaggtcgtgacgcggcacccgccacggccgaccgcaaatgaatttcccgggggtccggtcagtagcatgtggcgcgcagcccggattcgatcatgcgaggagcggaccgtgcgtgacatcgccgtgttcagcggtagtgcccatcccgagctggtggcggaggtctgtgcgcatctcggtgtgcccctcagtccgtcccgggtgagccggttcgccaacgactgtctcgaggtgcagcttcaggccaactgccgcgagcgggacgtgttcctggtgcagccgctggtcgcccccgtgcaggagcatctcgtcgagctgctgctgatgtgcgacgcggcgcgcggggcctcagcggggcggatcaccgtcgtcatgccgcactactcgtacgcccgttcggacaagaaggacgcgccgcgcatctcgatcggcggacggctggtcgccgatctgctggtggccgccggggcgagccgtgtcctggcgatgacgctgcactccccgcaggtccacggcttcttctcggtgcccgtcgaccaccttcacgccctgcgggaactggccgcccacttccgcggccacgacctctcccggacgacggtcgtctcgcccgacctcggcaacgccaaggaggcggccgccttcgcgcggatgatcggggcgcaggtggccgcgggggcgaaacagcggttcgcggacgaccgggtcagtatcagcgccgtcatcggcgacgtcgtggaccgggatgtcatcgtgctggacgacgagatcgccaagggcagtacggtgctcgaactccttgaccggttgcgggagttggggccgaggtcgatccgagtggcctgtacgcacggcctgttcgcggccggcgcgctcaagcggctcagcgagcagcccgacgtgctggagatcgtgtgcacgaacaccgtgccggtcgccgccttggagcgcaccgggaagctgcgggtcctctccatcgcgcccgccctggccgaggccgtgcggcgcattcacaacggcgagtcggtgagcgccctgttcgacgcgccccagggcgaataggtggcgtgcggtcctcgaactcggcgcgtgcggagctgagttcgagggcttgggctcgccctccgtgagggcggcaggggggggcagggcggcagggtggcagggctgtggggcggcgggacggcgggcgctgggcgcccggcaggtcaccaggatccggacgtggcctcggcctgccgcagggcctcgtccagcgacgcggcggggggtagcagcgtccgcaggccggtcaggcgcaggatgcgcagcgtcagcgcgtgcgtgcagacgagccgcagctgtccgccccgtccgaggacccggctcctggcccggtacagcaggcgcagccccgagcagtcgaagaactcgacggggccgaggtcgatcaccacgcgcgctgccgggcgtcccgtcacggagtcgagcacggggatgatctccagggccgcggcgatgtcgatctcgccgcggaactcgaggaccgtatggccgcgtacccggtggacgtgcagatgccgggtgcgcggtgcggggtcctgcggcatgacggcatcgcctccaaccggctccacatggcggggcttcaggtcaccggtccggggtgacgacgtccttgagtgctaggacgcgacaccggggcccggggatgctcaacaccgctccccgcactgcaagttaccctcgatggagtgaatttgagcatgttcgattgacatatgtcttcgaattgagactacgaccgtgcgcgccgggcgtccatggcaacgcgtgccgggcgcctacgacagtgcgtgccaggcccgggtcaacgcccggcggaactgatcggcctggtgtgcgctgaagtcccggatcatccgctcctccaactcctgccggccgccgtcctgacacccgcgacgactgtcatcgtcgtcgacgaggtcgccgaacggctcccctcggcacgaggactgggcgccacgcacaccgtgaacgcgggcgacgccgacgccgccgaggcggtgctcgccctcaccgacggcaagggcgccggcgggtcgtggagacgaccgacggcacgggcgcccgcggggtcgtggagaccaccggcggcgtcgccgtgccgcgcaagggtgcccgacgcgctcgccgcgcgcggcaccccggtcgtcgtcggcgccccgcccttcggtaccgaagggcggggcgatcaagccggtgctgacgttcacatggtcagcacgagcttccccgtggtgcggccggtgtcgccgagcgcgtgcgccttggcggcgtcggccagggggaaggtctcggcgatggtcgcgcgtagcttgcccgcctcgacgagctccgcgatcgccttcatgccggtgtgcgaggcgtccacgagcatcctgagcgcccgtacgccgagccgctcggcctcctcgtagaagtcgtccgacccgaccggcaggatcgacaccacgatcccgcccgggcgcagtacgcgcagtgagcgcagggagtggtcgccgccgatcgtgtccaggacgatgtcgacgtcccgcacggcctcggcgaagtcggtctcccggtagtcgatcgtctcgtccacgccgagcccgcgcaggaagtcgtgcttaccggcgctcgccgtaccgatcacatacgcgccgcgggccttggcgatctgcacggccacgtggccgaccccgccggccgccgcgtggatcagcacccgctggcccggccgcacgtccgccgtctcgaccagggcctgccacgcggtcagggaaaccagcggcagcgcgcccgcctggatgtggtcgaccccggacggcttgtgcgcgaaggcgcgggccggggcggtgacgtactcggcgtgcgagccgtggccgaacgggtaggacagcatgccgaagacctcgtcacccggcttgaagcgggcgacgccgatcccggtcgcctcgacgacgccggagacgtcccagccgaggacgaagggcggctcgccgaggaagccgccggtggcgcggtgcttccagtcggtcgggttgaccccggcggcacgcacccggaccagcacctcgttgggccgcggcgcggggcgttccgtctctacttccttgaggacctcgggaccgccgaggacgtcctgactgatggctcgcatggtgttcacagtgctcatggtggtccagcctgccggggttcgcccgtcaggagaatggcatgattgccaatattcgataggatcgtgccatgcggcatgtggaacgcgtggtcgtcctggcgctcgacggcgtctaccccttcgagctgggcatccccagccggatcttcggcgcggccgacggccggtacgaggtggtgacctgcacggtcgacgggaagccggtgcgcagcaacgcggacttctcggtcatggtcgagcgcggccccgaggtgctgcgtacggcggacaccgtggtgatcccgcccgtcacaccggcctcggtcaccgcggaactcccggccgaggtcaccgccgcgctcgcgcagatccggcccggaacccgcatcgtctccatctgcacgggggcgttcgtgctggcggcggccggtcttctcgaagggcggcgggccacgacccactggcagttggcggaccacttccggcgcatgttcccgcacgtggcactggacccggacgtactgttcgtcgacgacgacccgatcctcacctcggcaggcgccgcctccggggtcgacgcctgtctgcacatcgtgcgcaaggaccacggcagcgcgctggccaactcggtcgcgcggcgctgcgtggtgccgccgtggcgggacggaggtcaggcgcagtacatcgagcacccggttcccgggcccaccaccaccggcacggccgccacccgccagtgggcgctcgaacggctgggcgagccgctcgcgctggccgatctcgccgggcacgcccggatgagcctgcgcaccttcgcccggcgcttcggcgacgaggtgggcatgagccccggccgctggctcatccagcagcgcgtcgcccgcgcccgccagctgctggagtccagtgacctgccggtggaccagatcgccggcgaggtcggcttcgcgaccggggcctcactgcggcagcacctgcacgcggcgatcggagtctcaccacaggcgtaccgccgtacgttccagacggcccgctagtgccgcaacaggcaacgttcgccccgtcgcgacgcccggcacgcgcccccaagcttgacgggcaaacgttgcctgccgcggcactagagcgcgccgggaggcggcggtccagctcggtcgccgggcccgtccatggcagggcagggctcagccggcggagccgtccgcgtcgagcaggatccgggccagctccgtcggccgggagagcatcggccagtggccggtgtccagctcgaccagccgccagtgctcgctcttgagcagctcggccacgtcgtcggtcggctcgggaccgtcgagcaggcacttgatgtacgtcgccggaagttcgccgagcggacgtgtcagcaccgccggctcggacagggtggcgcccgggtgcggggtggcgcggccgacgaaccgtgcgatctgctcctcggtgaggccctggccttcgaagtcgggcgcagtcaggggcggccagacgtcgccgttcgcggcgagtacggcctcgaacttcgccggcccctcccaccaggtggagacgaacgactcgtcgacggccggcacgttcgagtcgacgaacacgacgcgcgtcagccggtcgccgatccgctcggcggcctgccccaccgggatgcccgcatagctgtgtccgacgagcaccacctcacgcagatcgaggcgctcgacctcgtcgacgatgtcccgcacatgcgtctgctgcccggccggcacaccctgcttgtcggcgaggccggacagcgtcagcggatgggcgccgtgcccggccgcacgcaggtgaggcaccacctcgtcccacgcccacgatccgagccacgcgcctgccaccaaaacgaattgagtcatggcggcaacgtaacgcgggggtctgacatcgccgccccaacacctcggcgggtgcgcccccttggccgccgggccgcccgaacgttccccgccccaagtgcgtcggaggagggacgggtacggcgttcggcggacaggagcgggaatgcgcaaggggatcgcggcggtggcggtgctggtcgccatgacggcgtcggcagggtgcgacgacgggagcggggccgatctcgtggtcaccggaacgccgccggcgacgccgtacagcgggccgctgaaggtcccgtccaagaacctcgacgaggacagcgcccgggcggtgcggctcgtggcgggggcggccgggcgagccctggagtgcgacggcgagatctacacgggggcgtcggacggctcgtggagccgggacgacggcggggcgacgcccgaggaggggctccaggcgtacttcgacctggagcaggccgaggatccgcactacggctatcgcgtcgagcgcgaggaacgggaccgggtcctgtactccttcgacgtccacggccgtaccaaggtcgccgtcgtcgtcgccaaggaccagaaggggcggcccggttggggtccggagtcgagcgcgtcctgcgacccggccgaacttccggcgagcttcacggactccaagccctacgagatctggaccgaccgggacggccgtcgcgtggcaacgacggtggtgagcagcaatgacggcccggagcactgcggctggcagtccgccgtcttcctgtacaccggccggggtgagggcgtgaggcactacgtgcgtgatccgcacggggtgctgggccgtcagctgctcacctccgcgtacgacggtcatgtccgtatgcccgccgacgcccacgacacgggataccgcctgaacgaccgggaactgtggttcaccggcgacaggtcgaaggcctacgtacgcacgtccgacggggtggagctctggccggccacgaaggagagtgtgggctgcaagtgattgacgacgcccaggtcagcggctgcggtgcaacgcgaccagcaactgccaggcctgatcggcgatgtcgtccgccgtcgcgtcgaggaggccgtgcagccagtcggccagcacccccgcgaaggtcgccgccacggcggaggccacgagcggggcgtcggccgcgcccgcgagggtgcgttcgctgaggctgcgggcgcgcagatcacggtgcagtacgcggccgagcgggccgccaccgcccgggctgagcagggcgcggtacagggcggtgtgcggggcgaggccggcgaggaacgcgcgcagtgcctcgggtgcgcggaccgggtcggggcggccgcgccaggcgtgcagcgcgtccaccgcgtcgcgtacgacatcggcacaggcgtcgaccgccagcgcctccaggtcggcgtagtgcacgtagaacgtggcgcggccgaccccggcccggcgtaccagcgcggccacgctgacctcctccagcgggtgcgcggcgcactcgtggaggagggcctccctcagcttcgcgcgggtgcgggcggcccgcgggtcctcccatggcacggggctcaccgggctcagtgcgcgatgagtacggcggccagggcgagagctcctggcagggcctgggcgaacaggatgcggcggttcgcggtgagcccgccgtacacgccggcgatcacgacgcacaccaggaagaagacctgcacacggaatccggtcgggtcgccggcgatcagaccccacaccaggcccgccgcgaggaagccgttgtagagcccctggttcgcggccagcggcgccgtggcccgcgccatctccgggtcgaatccgtgcagcccccgcccgggcttcttctcccacaggaacatctccatgaccaggatgtacgcgtgcagggcggcgaccagcccgaccagcacgttcgcgaggatctccatcgtcgacaggctccgttgttcgttcggccacttcatggacaggtgtccactatagctggacgggtgtccatgaaaatcccggggtgcggcgggtgacggccgtggcggaagcccggtgacggtcacggcggtgcggtgactccctttacggtgatcttggcgctcgtgcgacttcccatgtcgtcccgcgcccctgcgtgccgttggtcacgtggccgtgttctgccttggtgaagggggagttgacgtgtcgggcagcatcgcgccggtcggctggagcgagagtgaacgggggatgtgggccgccttccgccgtggcgagtggtacgcggacgggggcgaggtccgggcctcggccgtgcgcaggctgctgctcgccccgccccaggccgagcccggccatccggcccgcctgcgactgcgggacgtgctcgtcaccggacgcctcgacctggaggaggccgtcgtcgcggcagcgctgcgactgcggaactgccgcttcgagcacgcgccccgtctggacggcgcgtccctgggcgccctggagctgcgcgactgcactctgccgggcctgtcggcggtgggcgtgaccatcggctggaagtgcgagatcagaggctgccgggtgcagggcgccctggacatgcacggggcctcgatcggcggcaccctgcatctggaggacagccggctgaccggcggtgccgacctgcgggacagctcggtgggcggcagcgtcatcctccggcgcgccgcactcctcaacccacggggcacggcgctgcacgccaaccggctgcacataggcggcgacctggactgccgcggcggactcgtcgcggagggcaccgtcgacgtgtgcgacgcccgggtgggcggcggcgtccgcttcgaaggggcctcgctcaccgccgagcacgggcccgccctgcgcgcccacggcatcgacgtgggggccgagttcaagtgctgcgagggcttcgtcgcgcacggcagactgtcgatgagcagcatcaccgtacgcagccagctctgcttcaagaacggttccatcgacgtaccggccggacagccggcgctggtcagccgccgctccaccgcatccgacctcgacctgagcttcagcggccccgtgcacggcaccgtggacctcagccacacccggttgaccctcctgaccggcgcgccgggcgagtggcccctggcgctgcgcatggaaggcgtcgtctacgacagtctcctgccccaactcccggccgcggaacggcttccgctgctcgcccgtgaccccgagggcttcaccccgcagccctacgagcaactggcggccgtgtaccggctgcacggccgggacgccgaagcgcgcaccgtactgctcgccaagcaacggcggctgcggaccaccctgccctggccggggcgcgtatggggagggctgcaggacctcaccgtcggatacggctaccggccgatgcgcgccgtgtggtggctgttcgcgatcatgctcagcggcaccctgctgttcacggcctggccgccacaggccgtcgaaccgggcaagccgccccacttccaggccgccatctacacgttcgacctgctgctgccgctcgtcgacttcggacaggaacaggcgttcagcccgcgcggcggcctccagtgggcggcggtactcctcatctgcctgggctggctgctcgcgaccacggcggcgacgggcgccaaccggatgctgcgccgggcgtgagccggccgggggatcgtaaccggtcacctttgcaggctcgggcgtgtcatctccgtaggacgcgggacggtcttcgtgcagcggggcggtccggtccgaacgacgctcactcacaaggaggctgtaccaggatgacgaccccacccgcccgcaccgcgaagcagcgcatacaggacaccctgaaccggctcgaactggacgtcgacgcctgggtgtccacggccggagccgacggaggagcgccgtatctggttcccctgtcctacctctgggacggtgagacattcctggtcgccaccccggcggcgagccccaccggacgcaacctcagcgagaccggccgggtgcgcctgggtatcggacccacccgcgacctggtgctcgtcgaaggcaccgcgctgccgctggagcccgccggcctcccggacggcgtgggcgacaccttcgccgagaagaccggcttcgatccgcgccggctcaccacctcctacctctacttccggatcagcccgcggcgtgtgcaggcctggcgcgaggccaacgagctgtccgggcgcgaactgatgcgggacggggagtggctcgtgaccgactgaatccgtgggacggggtatccgggagcgtagagacggcggctggtgccgccgtccgcgccccggaacccgtgacggaggaagcatggcactcgtagtggcaggcgtcgtggtcctggactgcgccgagcccgagaagctcgccgcgttctacagggaactgctcgacgccgaggagacggacgcgaccgcgaaccgggtggagatccggggagccgacgggatgcggatggcattccgccgcgatgtgatggcgacgccgccgagctggccgcgccccgagaactccctccaggcccatctggacttccacgtcgaggacctcgacgcggcggaacgcaaggtcgtcggcctcggcggccgcccgctggacacgaaggacgcgcagggcccgttcgaggaacgcggttacgccgacccggccggccactccttcaccctgcgctgcgcacggccgacagcgccgaagcaggggtgagcggcgggccgggcggctgcggccgggtcagtcccggccgcccttgttcccgtccggccacacccccgtggaccgttcgacggccttcgcgcccgtgcggtccaccgcgctgcggactaccgcgaagatggcgccctggacggccgcggcgaacaggatctcgccccagccgcggtcctggtccagcgcgtcgggggcgttgtcctcgtggcgaatcgccttccacgcctgctggaaggcgagcccggccagcgctccgctcgcccagctgagtgcgaaccccagaggcttgtatacgagcgggagcttcatcttcttctgcttgttcctggccatccctgtctcctgtgtcctgtcttccgtcgtagcccgtcagggtcgtccctgagccgggatctcctcgtcctcgcgcaccggcccgggcggtgtcccgtcgccgaacggccggccgcccagccgctcccggtgatggggcgtgagccagcccgcgaggtccggcccgagcggcacgatgccggtcggattgatgccggtgtggacctggtagtagtgccgtttgatgtggtcgaagtcgacggtgtcgccgaagccgggcgtctggtagaggtcgcgtgcgtacgcccacagcaccgggtgctcggtgagcttccagcggttgcacttgaagtggccgtgatacacggcgtcgaagcggacgagcgtggtgaacagccggatgtccgcctcggtgatcgagtccccgacgagatggcgccggtccgccagccgctgtccgagcagctccaggcggtggaagactccggcgcacgccgcctcgtactccttctggccggtggcgaagccggcccggtagacgccgttgttgacgtcctcgtagatgtccgccatcacctcgtcgatctcgtcgcgcagcccggccggatacaggtccggtgccccctgccggtgcagggccttccactcggtggccagatccagggtgagctgctggtagtcgttcgtgaccagcttcccgctcggcacgtccacaatcgccggcacactgacgccgcccggatactccggctgccgtgcgtcgtacgcctcactgaggtaccggatgccgagcacggggtcgcggccgtccgggtcgagggtgaaccgccaactgcggtcgtcctggaccggatcgacgacacccaacgacagcgcgtcctccagaccgagcagccgccgcgacaccagtgcccggctcgcccaggggcaggcgcggctggcgatgagccggtagcggccggcctccaccggccggccgtcccggccgtcggccgtgatccggtccgtgaagtggctcctggaccgcttgaacgccttccgtccgtacgcgctgttgccgttgccctcgctcatggcgtctcaccttcccgctgtgcccggatacgagtgccccgctgagcgccccccgattcgccgagccggtcaccgtgtgagacgagccgacgggggaaggcggcgaaagtgagcaggacatcctcttcggactcttcgaaccacgcttcttcgacccccgcggactcttccgcggattcctccgaggacccttctgcggactcgtccgcggacgcctcggaccgcaagacccggatcaccgtgctggtggcgctgggcgccaacctggtgatcgccgtggccaaggccgtcggcggcctcctcgcgggctcgccggcgctgctctcggaggcggcgcactccgtggcggacagcctgaacgaggtctttctgctggccgccctgcgccgcagccgccggccggccgaccagcggcacccgttcggctacggcaaggaacggttcttctggtcgttgctcgcggccgtcggcatcttcgtgatgggcggctgcttctccttcttccagggcatcgaggcgctgcggagcggagccgaggaatcgcacagcggttatgtggcgggcctcatcgtgctcggtgtggcgctcctcgcggagggcgcgtccctgctgcgggcgctgcatcaggtgcgcgggcagcggggttccgcggcggaagggctgcgggaccccgcgctgcggacggtcgtcgccgaggacggcaccgcggtcctcggcgtcacgctggcgatgatcggcatggcgctgcacatggtcaccgggcaggtggtctgggaggcggcggcctcgatggggatcggcgcgctgctcgtctacgtcgcctaccggctcggccgcgacgcccgtgaccagctcatcgggcaggccgccgaccccgagctgagcgggcggatccgggccctgctggaggcacagcccgagatcgacagcgtggagtcgctcctcaccatgcaactgggcctccactccaccctggtcgccgcccgcgtcgacctggtcccgggcctggacagcgaggaggtcgaggacgtcgcggtgcgcatcaaacgctcggtcgcccatctgatcccggaggccgaccagatcttccttgacgtgacggacgcgcgagcgctggcggcggaccgggcgggggaaacagaaagccccgccgcgacgggggagcgcggcggggcctgaaggacgggtgcccggcggccaggggttcatgcccgcggattcggaggcggtcgcgaacagctggaagccggaagatgtgaggtcgtcctcccgtcggtacggcgaggagaggcggcccataccggaacgggggagtgcggtacgggccgccgccgtgcccggtgtcagccggccggctccagcacgaagacggggatctcgcggtcggtcttctcctggtactcggcatacgggggataggcggcgaccgcccgctcccaccactgcgccttctcctcgccggtgacctcacgggccgtgaactccttgcgcacggccccgtcctggagttccaccgcgggagtccccaagacgttgtagtaccagaccgggtgcttgggcgcgccacccagcgaggccaccgccgcgtacttcccgtcgtgctcgacgcgcatcaacggcgtcttgcggatcttgccgctcttggcacccagggtcgtgaggatgatcacgggcagccccgtgtccatgagcgtcgttcccttggtgccgccggagctctcgtacaactccacctggtcacgtacccactgcgtcgggctgggttcgtactcgccctcaagaggcatgacttccgtcccatcgtcgcgtacgactgctgtctcgtcgcgcggcctcacgagccaactcccaagaccgcgcacccaggattcaacaccagcgggcagcggattcatccgcaacggcgagtcgcggcgcacctgcccggcgcggacggtcactggttttccggtcacgccggcgacatcagcatgcgcaccgccagccccaggatcaccgcgctggacaggagcgccgtcaccagccgaccgcgccgcccggtcagtgcccgcccgagcagcgcaccacccccggccagcaacacctgccagctggccgaggcgacgaaggcggcgaggacgaagacgccctgctccagcggcagtaccgcctgagcggcccggctgccgagcacgagtgcggcgaagtagatcacggtggtggggttcagcagcgtgatccccagcagcccgaggtacgcccgggccgggctcggcggggtccgccgggccgcggcggcgtgccgcggcgagcggtagtggcgaaccgcggccgtcgcgccgcggaccgccagcgcgatcagcaccagccccgacgcccagcgcagtggtaccagcaccggctggagcgcggcggcgagcgccgagccgccgagcgcggccaccagggcgtagagcccgtccgcggtggcgacgccgagcgcggcgcacaccccggtccgcagggacgtacgggcggtgagggagacgagataggtcgcgaccgctccgacgggcacggcgatgccgtagcccgcgagaagccccgcgacgagcgcggcggtcacgaccgcggaagcgtaggcctccgcggtcggccgggctgctgctggacccgcaccggacgagcggcggtgggggtcggcggcagcaaggcttcgatggtggacatgcgcagatgctggggccgcggggctgtccgcgcaagcgaattacggggatcttcggtgtcccgtcgggtgggccgccgtcgtcctgtcgggtgggcgcggacgtgtcaggtcagcgtcgtcggatcgacggcgccggccagggccgccatgcccgcgtcattggggtgcagtccgtcgccgctgtcgtagccgggggcgagggcgcggggatcgtccgggtccgccatcacccgctcgaagtcggccacaccgtcgaagtgccggccggtgcggatccactcgttggcctcctcgcggagggcgttctgggcgtccgtgagcgtgcgggagggcagcagggtcccgccgatgacgcgtacgcccgactcgtgcgcctcgcggatcagggaacggtagccgtcgacgaggtcgcgtgcggtgagcgggcgtccggcgtcgttctcgccgccgaggatgtcgttgatgcccgtcagcacgatcaccgcgcggatcccgggatggccgagcgcgtcgtgtgcgaagcggcgcacgcccgcggagtcggtccagtccgacagcagcccggttgccgccggtgccggcgttgacgacggccagccggggcgcgtccacaagatccggccagcggcggttggcgccggtggtcgtgttcgcgccgtccgtgatcgagtccccgaaggcgaccagggtgccgtccacctcgtccgtggtgacggtcagcccggccaggaagtaccaggaggtctccgtggcggtgaacccgtcgaggccgtcctcggcggtgagatcgccggagcgcggcgcggagacgtatgtcgtctcgaaggcgtcccggtggtgggtcgagggcccggtcgagcccggcagatacacgctgaccagcagattttgcccgcgctcgacatcgaccggcagcacgtccgtgagcagttcccggccgcggccgatcaccgccttcgtggcaccgtcgaaggagaccggccgcggcggccgaccctcgggggccacactgacggcgcccacggtcagctcggccgggccgtggaggttcgacagccgcaggcgcgcacgggttcccccggcgctcggacgaaccaccatacgcacggtctggtcgcggaaggaccggccgaagggcaccatgctcggagcccatacggcgacggtctgttgtatgccggtcatggtcacccttcttcccggccgtcgcgttcgtaccgcgggggcttcaggcttcacggcggtggacgacgggtgcctgcccgcatcggtgcgacggggttcggccagttccggcatcccgtggacctggccgaagttcgagtggcactaaaggtgccttgggcatctaatggagatcggcaagagcaagtcttcgcctgcgaggtctttcatgacagagcccggtacgtccgtgtcagcgcccgtcgccttcccccaggaccgcacgtgtccctacgacccgcccacagcctacgacccgctgcgcgaggggcgtccgctgtcgcgggtctccctctacgacggacgcagcgtgtgggtggtcaccgggcacgccgccgcccgtgcactcctctccgaccagcggctttcctccgaccgcacgctgcccaggttccccgcgaccaccgagcggttcgaggccgtacgcacccgccgggtggcgctgctcggtgtggacgaccccgagcaccgcacccagcgccgcatgctggtcccgagctttaccctcaagcgggccgccgccctgcgcccgcgcatccaggagaccgtcgacgggctgctcgacgccatggaggcacagggcccgccggccgagctggtgagcgcgttcgcgctgccgctgccctcgatggtgatctgcgccctgctcggcgtcccgtacgccgaccacgacttcttcgagtcccagtcccgcaggctgctgcggggccccgggatcgccgaggtccaggacgcccgtgcccaactggacgactacctgtacgcgttgatcgaccggaagcggaaggaacccggggacgggctcctggacgatctcatccaggagcagctgaaccggggcacggtggatcgcgccgagctggtctccctggcgacgctcctgctgatcgccggacacgagacgacggcgaacatgatctcgctcggtacgttcaccctgctccggcatcccgaacagctggccgagctgcgggccgagccgggcctcatgcccgccgccgtggaggagctgctgcgtttcctgtccatcgccgacgggctgctgcgggtggccaccgaggacatcgaagtggccggtacgaccatcagggccgatgagggcgtcgtcttcgcgacctccgtcatcaaccgcgacgcggccggcttcgccgagcccgacgccctggactggcatcgctcggcccgccaccatgtcgccttcggtttcggcatccaccagtgcctcgggcagaacctggccagggccgagatggagatcgccctgggcacgctcttcgagcggctgcccggcctgcggctggcggcgccggccgacgagatccccttcaaaccgggcgacacgatccaggggatgctggaactccccgtgacctggtaagaggctgcggtccatgcacaacgacagcaacaacagcaacggcaacaactcccacagcaacggcaacgtcaacagcaacggcagcaacagcgacgacaacgtgatcgtgatcgaccgggacctctgcatcggtgccgggcagtgcgccctgaccgcgcccggtgtcttcacccaggacgacgacggattcagcgaactgctgcccggccgggaggacggggcaggcgacccgatggtgcgcgaggccgcacggtcctgcccggtgggggccatcacggtcccgcggtcggcaagctgacgcctgagggggccgcgggcccgggccgctcgcccgccctggacggccaggtggagccggcgcgggtgtacggggccggcgacgatcacctcgtacgacgtgatcgggtcctcctcgaccggcggggtgagcgcgacgcgcggtcgtccgcccggcgccatgaggactcccacggcccgttcacgagcgccgtccccgcgacgcgcgaccgtcggcggagcagcggtacggtctgctccgccacggcccgcgcacccttcagctccgtcgccgcgcccggcggcagggccgcggtgtcgggggccgacgctgcggcggccccgctgccgacggctcggaagggccggttagcggcaggcctccaggaggacccgcgcggcctgcttcgcctgatcggcggggtccgtcgtgccgttgatgccggcggtgaccatggcgccctcggccagcaggtacagctggtcggccagggacgcgggcaggccggcgtcggagaccaggccggccagatagccccggaaggcctgcttgtgggcgcggacctgggcggccacgcggggtgagacggcgcccagttcgccgtacgagttgatccaggcgcacccgcggaagtcgctctcggcgaaccactgtcgcagccagtcgaacaccgcgaggatccgctccccggcgtcccggtggtggtcgacgtgcgccgcgagccgctcccgccagtggatgtcgcgtcgctccagatacgcctcgaccagctgttccttggcggggaaaagctggtagagccgcttgagcgagacgccggacgcgccgcggatgtcatccatgccgacggactggatgccccggccgtagaacagcttctcggcggcgtccagcgcctgctcgcgggcgactgcgatctccatgaacgggccactccttggcgttcccaggtgctcttgacgtagagaaccatcgttctctacgttagcagccagggtcctgagaacgtacgttctccatgttcggcccgtcagacggagaggcatcccatgaccgacgaccgcccgcccctgccgcccttcacccgtgcgaccgcggcccagaaggtccaggccgcggaggacgcctggaacacccgagacccgcacaaggtctcgctcgcctactcgccggactcggtctggcgcaatcgcgacaccttcgtcaccggccgcgccgccatcgtggaactgctgacggccaagtgggcgcgcgagcgggagtacgccctgcgcaaggacctctgggccttcgacggcaatcgcatcgccgtccgcttccagtacgagtgccaggacgccgacggccagtggtggcgctcgtacggcaacgagctgtgggagttcgacgagcacggactgatgacgcgccgggaggccggcatccacgacgtgcggatcgaggagcgggagcggcggatcctcgggccccggccggaagcggagcgagggcggtccttccccgttcagtagggttcccgcgtgactgaacaggccgagaagcccttcctctacctcgttgtctgcgccgccggaatcgccgcggacgtcggtgagttgatcaccgcggcacaggagcgccactggcaggtcggcgtcatcgcgacgccgctcgccacgggcttcttcgacaccgccgcggtcgaagcgcggaccggccgcccgcttcgctcggcctggcgctccccgggtgacccgcgccccttcccggcacccgacgccgtggtcgtcgcgcccgccaccttcaacacggtcaacaagtgggcggcgggcatatccgacaccctcgcgctgggcaccctgtgcgaggcgtacggactcggtgtcccgatcgccgtcctgccctgcgtgagtgcggcgctgacggcccaccccgcataccgggcgagcctggagcggctgcggggcatgggggtgcggttcggcgacccgtactccggggacgtgggggaggacggccggcgcccggagttccggtgggagcgggccctggatctgctcgacggccgatgacggtgcccgcggcccccgacgccgcggcgaggacggccggttgccgtcagtggccggagcatcgcgcgctgctccggccggaggtggtcaccgtgggcgcgtacgacctccacggtcttcctgcccgcctcgctccggcccggtcgcggctccacggtgacccggccgtccacaccggcgccgccgcgcagccagggacggcggccggcgaggccgccccgagcagcagccgacggcgtacggtcgcccgcgtcgtcgcggcctgacgtcagcgggtccggcggatgtagtccgtgctgccgggcgtcgacaccagcacgtcccggcgcacgatgctcaaccggccgccgtagcccgaacgggccttgcgcagaccgctgtcggtgtactcgatgacgagcacccggtcgtcgaacgccttcgcgtacgccccgcactcgtcgtacgcgccgcactcctccgccaccgcgaagtcgagccccgccttctttctcaccccggccagctccaccgtgttcttctgcgcgatggccaggtgccgggcgtgcgcgtgggccgagagcaggcggacgaaagcggtggcgtcctgggcggtgagcaggtgccgggagcgggtgtagctgtcgtagttgtccggttcgaccgcgtcgaagcccttggcggcgcagccgtcgatccagcggttgacgcgcgccgccacccgctcgcgcttggccgccgtgccgatgtcgagcagcggctcgtcccagtcgcggtcgatgaccaccttgccccgcgcgtcccgcagcaggagatcggcgggccacttcccccgctcgctcggctgggcctggaaggcgttgacgtagcagacgttgtagaggccgggcgcgggcgaggccgcacggtcgcggctgacgacgcggacgccggacggcgggcggtaggcgccgccgatctggtagtcgaaaccggcgtggagcggggggagccggacggaggtgggcgcggtggccgtggcgtccggcttcggtttcggggaggcgtcggtggggcctccgtcggcaccgcagcccacgagcgccgtgagggccatcagcgcggcggccgtgccggctcctgcggcacgggcaacacgcttgacgggcatgtccgctccatcaatcgcgagtacgaccccgcctcggacgcttcggcgttcctggcgactctggccgggcttggacgtgactccgctaccggctgggcgcacctctgtgtgccggagcgcgcggcccggcacgccaagatcaaagccgttcgcgacggcccgcgtcaaggccgtgccgccgtcgtggtcacgatcacgccaccgcgcgggcggccggtcgcccgacgggggcgcgacacggcgacgccccgccggcgctcggtccgctcatggagccccgcgccccggccgggtgaaccttcccgtggaaccctgacccgcggtctattgtcaggacatgacaggagaccgcatcgcgctggccgtccacgaccacgggggcgacggctcacccctgctccttctgcacggcgcccggcgcaccctcgccgactgggccgccgtcgccccgctcctcgtaccgcggcaccgggtgctgtccgtcgatctgcgcggccacggtctgtccccgtccgggccgtggagcctccccgaggtgctgggcgacatcgaagcggtcatggaggagtacgggatccccggcgcgctgccggtcggccactccctcggcggcatgatcgcggtgctgtacgccctggagcacccggaggtgacacccggcgcggtgaacctcgacggatacgggtgggggcgaccggaccagtacgtcgggctcgacgcggagtttgtggcggaacaccgccggcggctgccgaaactggccgccgcgacctggggacagcccctgctcgccggcggactcaaggacctgctcgcccgggagcgggcgacgtcggaccggctgggcatcccgtacgagctgctggaggcgggcgtactgcgctccgtccgcgaacggcccggaggcggcctcgaggtgcgccccgagcgcaggcacgcgctggaaatgctggacttcatcgagtcgttggacctcttcgccctgttccggcggatgacccgccccctgctgctcggctgcgctctgcggcccgcggcgtccgtcccgggactgaagtggttcgacgacctgatggccgcctacgcccgagggctcgcccgcgacctcgccgaactggccgcccagcgaccagatgtgacgctcgctcagatcgacagcacacatgacatgctgctggagaacccgagggcggtcgccgacgccatcctcgacttcgcctcctgacgccggccgtaccgaagcccgctggacgggggcgccgcccgaacctgccgagccggctggcggcggcgtgtcgctctcgccgtcccgtctcgcgcacctcgtcgccgagccgctcggccggtccccgatgcgggcgctgcgcgacgccgggctgccgcacgccgcacggctcctggaagccaccgagctgtccgtcgagcgcgtggccgccgcctccggattcgccgacccgttccccttcggccgggcattccggcaacgctacggaagcccgctcggccgtctaccggaccggcctcgaacgcaacggtccctgaattccgggcagaagggggacgggacgttacccgaattcccgccgtagggcgaaccggctgacctttcgtcaacttcatggcccccgcatgaattgtggaaagtgaggagggcgcttgttgactctcggtgacctgtgcaaaagtgtgatcgtcagcgcgcggtcaattgatttttccgctgcgcgtctacggcgttcctgttcgccgcccgcttcgaaagagccgtccgggacgggtgttcgggatgtcggacccccacaaggatgctgcctccgtgttgccggtcgggcagtgcgtccaatggtctggactatttcctgcggaactttggaggaaagtggacgtgaatgatggggtccggtcgaattcccccgaccccgccgcgtcgcacgaggtgacggacgagcaactcgcggccgagctgaagaagttcgccgggaagcggaccgtgcactatccggtgagcgaactcctcgcccggcactgggaggaggccttctcctacgcgcgactgtgcacggacggggcgcaccccgccggaatgctcaccacggccgcgttcaccaggctgttcgaggaagccgcacgccagggcggcccgacggccgcctggcgtccccaactgctcgtcgcgatccgccggatcgcggcggaatgggactccgaccaccgccggccactgctccatcccgaactgcgctccgaccccggggcgacgggccgggccgcggcccggctcctgccgccggagaaccgacggctcgtgtcccgcgcgttccagcgactcgccgaacccgcccgctgcctgctgtggcacacccaggtggagggcgaggccatcgacataccggccgccctgctgggcctcgacgccgacggcgcggccgtgagactggaacgggcccgcgaacaactccgtgagggctgcctcgacgtccaccgggaattcgccgccggggacgagtgccgacgctacgcgcgtctactcgacgtctcgctgcggcgcggcgacgatgccctcgaccccgatctgagcgaccacatggccggttgcgcgcactgccggtgcgccgcggaacagctcaaccgcttctacgaccggctcccggtactgctggccgaaggagtgctcggctggggtgcgcgggaatacctcgactcacggggcgaacgcgcgcccgggaccgtggagaaggcggcgggccgcccgaccgccgcggcgccgccggccgtcgtggccgacgcccgcatggacttcacggccgacacgggaccggatcccacggccggcatgcccaaggacttcgcggcccacgcggcaccgcgttttccggcgggccgcacatcggcgggattcggaccggacgcaccgcgggacttccaggccggcacgggacagggccccacggccggcacgggacagagccccaccgtcggcacgggaccgggtcccacggtcggcacgggaccgggcatccaggctggcgcgggaccgggcatccaggccggcgcgagaccgggtctcacggccgacacaccggacttcgagtccgacaggccggatttcgcagccgccacgggtccggacggcacggagggcacggccgagacagccgacacggcacaggacttcacggccggcatgccggaggacttcgcggcccacgcaacacgcgagttcccggcggccggcacgtcgccgggcttcgggacggacgtaccgccggacgtcgtggccgacgcggcgcaggacttcgcggtcgcggccgacgcgcggctggacttcgccgccggtcccgacgaggggctcccgcacgcgccccgggagaacaggagcccgcaccgctcggcggacccgcacgcacccggccacggcggcaccgcgcggtacccggccgacgcgaacgcaggtgcgggcccggcgaccgataccggcagcgcgcgtcacgcgtccgacgcgggcgcgggcgcgcgcccgtcgaccgacaccggtgggagtgcgcgtcacgcggcggggccgggtgacggctcccgttcggcgcgcgccgtgccgcccgcgggtccccgttcggcgcacaaggcacgtcggcgcgccctgcgccgccgtcggcacgtcgccctcgccgtgctgacggtgagcgcgtgtgtattcgttccgctggccctgtggtccggttcctggtcgggcgggggcggcacggccgccggccgctcgtccggcgaacccggcaccggcacggagtcgggcagctccggctcgctgccctgggtcggcgccgccgccgccgcgccgagcggcaccgtccagggacggatccgcaacgcggacagcgggctgtgcatcggcatcggcaagaacaaggccgtcgccggggcggaggccgtgctcgtcgactgcacgtcgtccgcgacccagcgctgggagtacgagacggacggcctgctgcgcagcctggccgcgcccgaactgtgtctggactcccacctcggctactcggtccaactcgcggcgtgcgcgggggagtcccagccagggacgaagaacgtgcggtacgacttcactctccagggctcgctcgtgccgcgctggaaccaggacctggccctgacctccgcctccggcggccgcggggccgcgctcgtgctgaagccgcgcacggacagcgagtcccagcgctggctggccgacacctccaacgatctggagatgcagtcggtcaactggggcatcggcagtgagtccaccgctccgacgaccaggtccgcgaagtcgtcagcgacgcccaccccggccggcacgcccacgaccggcacgccgaagtcgtcccgtacgccgtcgaccggttccgtcacctccgggggcgcctccggaggctggtgctattacccgtactgctcgtcgaacggacagggtggctggccgacctccggaggctccggcgactccggcggaggttacggcggcggcggaggctacggcgattccggcggttccggcacggggaacggcggaggcggcggtggccggggatgaccctggtgtcaggcgccgaagagctggagtgacagccacagtgccgtcacggccgggacgagtgccgccggtacggcgatcaggccgagccgggtgaattccctcaggtcgacgccgtgatcgtgctggtgcaggatccgccgccacagcagggtggccagggatcccgcgtacgtgaggttggggccgatgttgacgccgagcagcatggcgagcaccggcccggaccccgcgggggcggtcagcggcagcagcacgagcacggccggcaggttgttgatcaggttcgccagcacggcggcgagcgcggcgatggccagcagggcgggcagcccggtcccgtcgggcagcaggcggccgagggcgtcggagagcccgttgtccacgaccgcccgtacgacgatgcccagcgcgaggacgaaggcgaggaagccgggtgccgcggcccgcaccacggtgagcggggtggcgcgccgccggaccagcgcccggccggcgagcacgagcgcaccggccagggcggaccaggccgggtcgatgccgagcgcggaggccacgacgaagcccgccagggtgcagaccacggtgaccagcgcgaacagtggcatcgcgggcggtgcctcgtcgacggccgccgacgaggcggccgtgccgaggtcgcggcggaagaaacgccggaagaccacgtactcggcgccgatggccaccagccacggcagtgccatcagtgccccgaagtgggtgaagctcaggcccgcggcgctgaacgccagcaggttggtgagattggagaccggcagcagcagcgaggccgtgttcgacaggtgggtgcaggcgtacacgtgcggcttcggccgggcgcccatgcgggctgccgtggcgaacaccacgggtgtgagcaggacgatggtggcgtccaggctgagtacggccgtgatcgccgaggcgagcgcgaagacggcggtgagcagtcgcccggggcggcccgccgcccaccgcgccatccaggctccgcaggcccggaagagaccttcgtcgtcgcagcagcgggcgagcacgaggaccgcggcgaggaacccgatcaccggccccaggtgctcggcctcctcgcgcacgtggtcccaggagatcgctccggtggccatcgcgatcccggcggcgggcaccgcgacgaccgcctccggccagttgaagggacgcacgacggcacagacgagcacggcgacgagcaggccgatggacagggtctcggcgaacggggtgttcaggtctcggtcctcccggacacagtcggctttcccaccccatcgaaccaggtacgccacgaaccaccaccgacggggtcgtcccatcggccgaccggccccggcccctcactcgtacgtcagcgggagctccgcccagatcgtcttgccgtcgggcgtgtgccggctgccccagcgctgggtcagctgggcgaccaggagcagtccgcggccgccctcgtcgaaggtcctggcgcggcgcagatggggggcggtgtggctggcgtcggacacctcgcagatgagcgtggtggcgtcgtggatgaggcggagccggatggggtggtcgccgtaccggatcgcgttggtgacgagctcgctgaccacgagctccacggtgaacgcggcctcgctcaggtgccacgtgtccagctgccccaccacctgcttgcggatcgccgcgaccagcgccgggtccgcggggatgtcccacgtcgtgacctgggacgcgggcagcccgtaggtgcgggcgagcaacagcgccacgtcgtcggccactccgcaggccgggagcagggcgtgcaggatccggtcgcaggcctcgttcagggaggagccgcgggagccggacagggcgtcgcacagcagctggtggctcgcgccgacgtcccgctcccggctctcgatcagaccgtcggtgtacaggccgagcacggtgccctcgggaaggtcgaccacggcggactcgaagggcagcccgcccaggcccagcggcgggccggccggcagcttgatctgccgcggccgcgctcccggcgtcatcatcaccggcggcggatgcccggcccgggcgatcgtgcaccggcgggagatcgggtcgtacaccgcgtacagacaggtggcgcccacctcgccggtggtcccgtcctgcccggcctccgcggacagccgtacgacgaggtcgtccaggtgggtgaggagctcgtcgggagccagatcgatgtcggcgagcgtccgcacggcggtgcgcagccgccccatcgtcgcggacgcctggatgccgtggccgacgacgtcgccgacgaccatggcgacccgcatccccgacagcgggatcacgtcgaaccagtcgccgcccaccccggcgcgggcggccggcaggtagcgggacgccgcctccagcgcggctgtcagcggcagggtccgcggcagcagactgcgctgcagcgccagcgcggtctcgcgctcgcgggagaaccggcgcgcgttgtcgatacagacggcggcccgggccgtcacctcctcggccagcaggacgtcgtccgccgtgaacggatcgggccgccggaaccgggtcaggacggccaccccgagggtcgccccgcgggcctggatcggtaccgacatcgaggagtggatgccgtactcgtggatgcgctgttcacgccgccggtcccagccgagccactcggcgagcgtggcccggtcgtccggggcgacgatcgtccggccggccaccagtgagtccgcctgcggcgaggaggcggggtagacgtccacctgtccgggcctgaccaccgcctcgggggagccgggattcaccgactggtgggcggcgcggcgcagcgagaccggtgcggtgagcgacctggggtagggctcggccccgtcctgcgacgggtccagcagatcgacgctgacgaagtcggcgagcgccggtacgcagacgtccgccagctcctgggcggtgcgggtgacgtcgagggtgctgccgatacggacgctcgcctcgttcaccagctgcagccgctcccgggccaggtactggtcggagaagtcgtgggcggtcacacaggcgccgtgcacccggccggcgtcgtcggtcagcggggcgagccgggcgagccaggcgtgtgcgcgctcctccccgccggagcgcatgtacgtctgcacatcgcgtctctccccgctggcgagcacctcgcgcaggtgccgctccatctcctcgttctcgggcttgccgccgatctccgagagccgcagaccgcggatgcggtcctccggaagtccgatcatgtcggccatcgcgtcgttgatgccgtgcagccgcaggtcggtgtcgtagaccgcggtcgcgcacggcgacatggtcagcgcgctcctcatcaacgggtcgtcctgcgggcgcgggccgaggccgcccagcggggtgaccagcagccagtccccggcgccgttggcgggggcccgctgtctgtggtgggcgagcagccacacggacagggtgcggccgtcgcggtggcgcagctcgagggtgccgctccagcggtcgccggacggccgcggcggatgtccggcaccgccgaggaccaacaggtccgcgaccggacggccctcgacctcctccggcgtgtagccgaggagccggcgggcgccctcgttccagtcgaccaggacgccgctctcgtcgatgacagcccgagccgtggcggcctcgccgccggaaggcaggtccgggctcatcgtcgccactcccttgcgcacactctcagtgaacaggcgcgtcacacgggttccagcctagtgcgtgccccgattccgcacccggaacatgacttcacggcccgcatccgggcgccgcgggccggcgcccgtccgtcccgtcctgccgcggtggcgatccggccgatgcgacgcgagagacagaagtgagtggacggacccttgacgcgcataagtgttcctccgtcagaatctgtttgttcacgatcagttgtgagtacttttgagccgttaacgagggagagtcgccatgacggtcactcgcagatcggttttgatcgccggtacggccgctccggcggccggcgcactcacgggcatcgggggcgcgccggccgtggcctcggccggcgccccgggccgccacaccgtcgccctccgcgacggctggcgcttcgcgctggtcaaccccggcgggatcaccgacccgaccggcgcgtacgccgacgccgccgaccccggccacgacgactcgggttggcgcgaggtcgccgtcccgcacgactggagcatcgagcagacgcccaccacgcagtacggcaccacgagcggcaccggcttcctgccgggcggcctcggctggtaccgcaccgccttcaccctgccgtccgccctcgccggcaagcggatctccgtcgagttcgacggcgtctacatggactcgtacgtctactgcaacggcacggaggtcggccgccacccctacggatacaccgggttcgcgttcgacctcaccgacctgctgcacaccgacggcaccaccgagaacgtcatcgccgtcaaggtgcagaaccgactccccagcagccgctggtactcgggcagcggcatctaccgggaggcccggctcgtggtcaccgagccggtgcatgtgcggcgctggggaacgtacgtcacgacgccggacatcaccgaggagcgggcggtcgtacgggtgcggacgaccgtcgtcgacgcgtcgggtgccgggagcgaggtccaggtcgtctcccggatcgtcggccccgacggccgtaccgccgcccgtacgacgtccacggtgaccgtcgctgaccagggcacccagacccatgaactcaccgtgaagaagccccagttgtgggacttcgcgcacccgcaccgctacaccctggagaccgaactccgggtcggcggcaagcggaccgacacccaccgcaccaccttcggcatccgccgtgtcaccgtcgacccggacgagggcttccatctcaacggcacccacgccaagatcaggggcgtcgatctgcaccacgaccagggcgcgctcggggccgcgatcagcatcgacgccgtacgccgccagatgaccatcatgaagtccatgggcgtcaacgccttccgcacctcccacaacccgccctcgccccagatgatcgaggtctgcgaggaactgggcatcgtgatggtggtggaggccttcgactgctggcggaccggcaagacgaggtacgactacggccggttcttcgacgagtggtgcgagaaggacgccaccgagatggtgctcgcggcccgtaactcgcccgccgtggtcctgtggtccatcggcaacgagatccccgactcgacgtccaccgccgggctcgccatggccgaccgcatcatcggtgcgatcaaggcggccgacgacacccgcccgctcgtcatcggctcggacaagtaccgcaacgtcccggccaagggctcggcggccgacctcatgctcgccaagctcgacggactcggcctcaactacaacaccgccaagtccgtggacgccctgcacgccgcctacccccacctcttcctcttcgagtcggagtcgtcgtcggagacctcgacccgtggcacgtaccaggagcccgagcacctcaacacgggcgagaaccacacgcccggcaagcgcgcgacctcctcgtacgacaacaacctcgcctcctggacgatgagcggcgagtacgggcacaagaaggaccgggaccggaagtggttcgccgggcagttcctgtggtcgggcatcgactacatcggggagcccacgccgtacgacgtcttcccggtgaaggcgtccttcttcggcgcggtcgacacggccggcttccccaaggacatgtaccacctgttcaggagccagtggacgagcgagccgatggtccatctgctgcccatgagctggaaccaccaggcgggcgacacggtcgaggtctgggcgtacgccaacgtcgacaccgtcgaactgttcctcaacggaaagtccctgggcaccaggacgttcgacaccaagaagaccaccgacggccgtacgtacttggagacgacggaggccaccggcgacgacaagacggtcaccgacggcccccaccccgggagttacaccagcccgaacggcagcgcgggcaagctccacctcgtctggaaagtgccctacgaacccggggagctgaaggcggtggcccgccgcaacggcagggcggtcgccaccgacgtcctgcggaccgccggtgcgccccacgccgttcgcctcacccccgaccgctcggcactggccgccgacggccgggcgctgtgcttcgtgaccgcggagatcgtcgacgcccgcggtgtggtggtgcccgacgccgagcacctgctctccttcgccgtgagcggcggctccctcgccggcgtcgacaacggccgggaggagagcgccgagcgctaccaggcaagcacgcgaaccgccttccacggcaaggcacttgccatcgtgcgctccggtacgaaggcggggaccctgaaggtgaccgcacgctcggaaggcctgcgtacggccaccgcgaccgtgcgcaccacccccgcgcgctccacggcgaccacccccgccgccgagttccggcccgaccacccggcggcccccgactcgccctcggccgacgcgagttactccggccgccccgacaccctccccgcggccatgctcgacggcgacccgaccaccggctggtccaacgccttcgccaagtcggccacggctctgctgcccgccttcagtggcgcccggcccgaggactgggtgtcggtcacctgggcccgcgcccgcgccttcgaccgcgtcgaggtgtccttcaccgtcgacgcgacgcacacccggcccgcctccgtcgaggtccaggtcggggacggtgaccgctacacgcccgtgtcaggcgccaccgtggactgggccaccgggtccgacgcgccgaccgtggtcaccttcgacgcggcacgcggcgcacggctgcgtctcgtcctgaccagcgcacaccccggcgccgccgacggagcggtacggatcagccggctggaggtcccgcccagctgacggcagcccccgctcgcgcgcggtcggcgtgtaccgcccgcgcgagcggctgccgcacggtgacgtacgcggtgtgcggcagccgctctgaaggcaccgccgccgggcggccggcctcgccccttcggccccgtccaccagctcgcccgggccgcccgcgttctgcgggcccacctcggagaggcggacctcgcggcctgggccgcaccgggggcctggccctgctcaagcccctgccgagcgccaacgcccgcttcgcccgcgccacggcggtcacccacatgttcgtcagcggggtggggttcgacccgccgtacggcgcgctcgtcgacctcgtccgcgatccgatgtccggcgaggcggacgtctatggcgcggcggaccggctgcgttcctggcagatccgagcggatgcggcctcctcggggccgccgaccgagggcggaaggatcggggtcggcggcccgtttcgcgcgggagagccgccgtcctgcgcggggcctccgagaagggccgctttcagtggactacggagttccgcgcgccgggagcgtgcgcggggcgtcggcgcgtgcgcccggttcacacggggcgcatggaatatcgaaagccggtgcgagcagcgcgagttgctccgtggacctgaccatttttcaaatggtgtggatgttgttcaagtgccttgttgggcgtcagtcacgtgtgcaagggttaccttcctgcgcatgggaaacggtcgggtccgcatctctgttcgctattccgggctgtcgacgagctcaaaaggctcatcggccgacggcccgccgcgtggcctccgccctcggacgttttcctgacgcttccgtcaagaagggccgcatcaaccggactcttttcgacgaacagaactttgtgtgccatcttgcgccgtggaaggaaacccctccgtgcacaccccccaccctcctcgcccgctttatcccccgcgcccggccatgcctcccggagaatcggacgagagtctcggcggccagctgagaggccggccggagggcgcggccccccatcccgtcgcgctgctgatggcgcggcactgggagtcgacgtacgactacgccgtcatctgcctcgcgtcttcggcgaacgtcgcgtccatcgtcaccgccggcgcctttcagcaggtcgtcgggcgcctgatgcggtccggctccgccgccgccgtgcggcccgcgctgctcgtggcggtgcgggacacggtccgggagtggtccgccgaagagcggatatccggcgttctgccggagctgaggaaacccgccggggggcgtggtatgcgggccgcgaagtccctgacacccgagaatcgggttctcgccgagcgctctttcctgacgctcccgggcctctcccgatgcctgttgtggcacaccgaggtcgaagccgagagcatatccgtaccggccggtttgtcgggcatcggcaccgacaccgcgacggccgctctggaacaggcccgcgaacaattccgtgaaggctgtgtgcgcgcccaccgggagctggcgccgaccaaggaatgccgcctctacaaccggctcctcgatgtgccgattcgccgtggtggcgccttgcttcccgatgtccagcggcatcttctggggtgccgcttctgccgtaacgccgccgagcagctcagccatttcgagggcgcgctcggcggtctgctcgccgaagcggtactcggctggggtgcccggcgctatctcgagtccagaccgggacgcaccccgtacggagggcgcgctcggggcgtgtccggctcgggcgggcgcccgggcagcggcgggcgccaccggctgctggcccagatccccgccccgggccgccgcaccccggtgggggagcgcggcgcgcgggcagtgctcaccggcgtcggtatcgcctccgccgccgtccttgccaccttcctcgtcacgggcctgtggtcgaacgacgacgggaacgtcgacccgaccgcctccacgagcgcgagcggcggccgtacgaccgtcttgcccacccccggctcgcagatcccgcccacggtgtcgtcgccccccgactcggccggcctgcccaccacgccccggcagacccggctgcgcaacctcgccgccgacctgtgcctcgacgtccggggcgaggcgaaggccggcgcgggaaccaagctcgcggtgtgctcctccgcatggacccagcagtggacgtacgagaaggacggactgctgcgcagcgtggccgaccccgaactgtgcctggactccggtgcggtcgacggggtcgcggagctcggccgctgcgtcgccgagagctccgcccacggcggcgacgtgcgttacgacctgaccgtgcagggcgaggtgctgtcccgccgcaagggcagcctcgccgtcacacccggcaacaccgatccggacgccgacatcgtcgtcaaggtacgggacggttccgacaagcagcggtggctgaccgactccccgtcggaccagcccgagtcgctgtcgatcgccggtacgacacccccgtcggccacgcccgccaccgatgcgcctgccgccacccccgcgcccacgcccgtgcccgcgtcaccgggcacccggctcacggacgccccggtcgcctcgtccgcgcccccgtcggagaactacggggaacgccggtccctgacggtcacggacacctccacccccgagccggtgctgccgctgaccgttcacctgcccgacctgctgggcgagatcggcgtcggcctgtagcggccgaacgcgtggctgccgccccacggcgacagccacgcgccgccggcccacaacggcgaggcgacgttgccgcgcggcaacaggacctaggacacgaggtcgcgcggcgtctcgccggccacgaagtcggcggcgttctggacggcggccagtgcgatccggacgagcgtctcgcgggtgacgccggcgacatgcggcgacaggaccacgttcggcgccctgagcaaccgcagggcggacgtgggcggttcggggtcgaagacgtcgatgcccgctccggcgagcgcgcccttctccagtgcgtccgcgagggcgtcctggtcgatcagggcgccccgggcggtgttgatcacgaacgcggtgggcttgagcagcgcgagccggtcggcgtcgaggagatggcgggtcgcctcggtgagcggcgcgtgcagggtgacgtagtcggcggtgcgcagcagctcgtcgagcccgacgtgacgcgccccgccgagccgggcctccctctccgcgccgacgcgctcccggcccgcgtacacgatgcgcatgtcgaacgcgacggcacgccgggcgacttcctccccgatgtgcccgagcccgacgatgccgagggtcttgccggacagctccgtgatggaccgctggagcctcggcagcgcccagtcggcgtcgacgagcgcggtgtgcgccgggaccagctgcttggccagggccagcatcagcgcgaacgtctgctcggccacgttctgctgctccgcgccgctggagccgatgttgcacacgggcaggcccctggcgcgcgcggcgtccagatcgacgtagtcgaagccgtggctcgcgcactggatgagctgcaactccggtgccgcggcgatgtgttcggcggtcaccgggccgaggcccgtgatgatgacgtgggcctcgcgcagtgcggcggggtcctcgtcggtcgcctcgacgacggtgacgcgggcctggccggggaagaccgaggcgagcgcggcccccgcgccgcggccgccgacatggggcgggacgacggcgaggacgttcttggtgacggtcatacggtttcctcgatcaggtcgtcggggctgagcgtccccggcccggcgtgcccggacagcgccagggtgaggtcgaactcggcgagcagacagcgcacgacgtgctcgacgcccgcctgcccgtcgagtccgagcccgtacgcgtacggtcgtccgacgagcaccgcccgcgcgccgagcgcgagcgccttgaagatgtcgtcgcccgtgcggatcccactgtcgaagaggacggtcagccggtcgcccgccgcctccaccacacgcggcagcgcgtcggccgccgccacggaaccggcgacctggcggccgccgtggttggagacgaccacaccgtccatcccggcgctcgcggcccgccgggcgtcgtccgggtgcaggatgcccttgaggacgatcgggccgtcccagttctcccgcaggaactcgaggtcgggccaggtcttgccggggtccgcgaacatgctcacgaagtgcatcacggcagcgttcggatcctcgtgcaccggcttggccaggcccgcccggaacgccgggtcggtgaagtagttggcggtgcccacgccgtgcaggaacggcagatacgcctggtcgagatcccgcggccgccaggccagcagcggcgtgtcgagggtgacgaacagcgcggtgtacccggccgccttcgcccggttcaggaagctccgggtgacctcgcggtccttcgcccagtacagctggaaccagcgctccgcgtcgcccatcgcctccgcgacccgctccatgggggtgctggaggccgaggacaggatgtacgggacaccctgcgcggcggcggcccgcgcggcggcggactccgcgtccgggtgcatgatcgacagcacgccgaccggggcgagcgccagcggcgcgggcagcgtccgccccaacacctcgacggacaggtcgcgttcgtgcacatcacgcagcatccggggcacgatccggcgccggtcgagcgcggaccggttggcgcgggcggtgctgccattgcccgcgccgcccgccacatagccgaccggaccggggccgagccgctgctcggtgagttcctccagccgagtcagatcggtgggcagccgcggtacggcacccgtcattccgttcagatagatctcgtactggaagtcggcccagtgcttggccatccgtacgtcccgcctctcgtccgtgagaccgcgctgtacgccgtcgatcctggcgactgcgacaagatccgtccactgtggtgcgcacatcgcccggtgggaaccctcacccggtgacaggcgagtccgcagacctcggagaacgcagccggcagcggacggtcgccgagccgcggctgctccgcctctgagcgatgtggcgcggagagaaggatggccggtgtcgccgccggggtgtgcggcgtgggcgaatgccgtccttacggggtctgccgaaatccgtccgtcgccggggcgtctcgcgcaccgttcagccggtcgggtcggcccccggcgcggcgcgccagccgtgccaccggtgcacggtgatcgcgatcaccggaccgcccggcggccgctgccggtacggcgcgtacttctcccgcagcacggcgagcaccgcggcgtactcctcccggacgcggggctccggcgcgtcgggcggcaggatgcgggcgcggccgtccgcccgcacccaccacagccggtcccagtcctcgtcgtacgcgtccacgagcaggcagacggccgggtgggcggcgatgttgcgcagccgcttgaggcgcggcgacctcttgggcttccagtcgacggcggtgacgacctcggcgccgtgccgagcgaacacgaccggcaccaggtgggggcgtccctcggtgtccaccgtcgccaggcgtgccacccgcgccgccatgaaccggcggcgcgcctcgtcctcgtccatgtccggcacggtgcgctccgaatctccggccgccggaagccggtacaggcagccggatgcgtaggccgccggaagtcggtacaggcagccggaagccggcgcaggccgccggacgctgtcaccggtaggcggacacggcctcggccagctcgtccagcgtgcgcagcgtctcgtcctccggctgggtcggcagatagagcaggacgcgctcgacgccgagttccgcgtaggtgtcgagcgactcccggtcgtgctgggccgcgtacaccaccacggccggccggtctccggccgtcttgcgcatgcgctcgatctgcgcgcccagctccttgggcggtactccgctgggcatccacgccgccccgtactcggcgacacgggcgaaggtgcgctcgctgccgccgccgacccagatcggcgggtgcggccgctggacgggcttgggccaggagtagacgggggcgaagtcgacgaagtcgccgtggaactcggcctcgtccttggtccacagttcgatgatcgcgcggatccgttcgtccatcagccggccacgttcggtcggatccgtccggtggttgcgcatctcctcccggttccagccggcgccgacaccgaacacggcacggccgccggagaccagatcgaggctggccacttccttcgccgtgtggatcggatcgcgctggaccaccagcgcgatccccgtgcccagaagcagctcgctggtcaccgaggcgaccgcgccgagcgccacgaacggatcgagcgtgcggtagtacacgcgcggcagctcgccgccgcccgggtacggcgtctcccgcttcaccgggatgtgcgagtgctcggccaggagcagcgcgtcgaacccgcgctcctccagggccggccccagcgccgccggaccgatgccctcgtcggtgaggaacgtcgacactccgaacttcatccgcgaccacctcgtctcgaattcgccccctgttgacagtgtggtgcggtacccccgaggggcgcagtcatacgtacgccggacggacgtgggcctcacccgtgccccgggtgcgtcgctgcgtcggtgcgacgtccggcgtcgcgtggatcactcctcggcggcggggctgtcggcgctgtcctgggggtcggcgtccgggccctgcgcccgtacccgctgcacatgttccagcgagtcgcgcagctccgcgagccagtcgtccgtgtggcgctggaccagtcgtacgcaccaggcgagggcgtcgctgcggctgcgggcgactcccgcggcgatgagggtgtcgaggacctggcgctcgggctgccgcagccgggtcatgacgggggcggcgacctgcgtgaacagggcgcgctcgcccccgcactccaccccccaggagaccttcctgcggaaccggtgctccgcctcacgtgccaccgcgacccgctcgtcacgggtgcgctcgcggaactcctggacccgggactggaccgcggcctccttctcggcggccgaggcgccgtcggtgagccggggctcgggaatgcggccgacaacggtgatctcctcccggtcgaccgccacctccaccaggctctcgaacagatcgtcgggcaggcggccggcgaaccagccgcgcagcttctcgcgttgctccgaagtaatcatgtaatgaccattactccatcgtgaggcaaacgcaaggggtccggtcggggtctgccatgagctgaaccggaatgtttcaggcctattgccgaaccgtggagatccggccagcgggtcaccccgggtgagcggcaaccgctcagttctggggatcgggcgttcgaactctgtcacttcacgccactgattcaatactcaaagttaccgaaagctgtggggtcgatgtgtgtttcccgcccggactcggcagactcgcgctcgccgaaccggcaccggaccggcctgacttcgcctcatgtgcgagcggagcagaaacggttcaccaatcaagcggaaggatgcacacaatgccgaacaccgcacgctgggcagtgaccctgaccctgaccgccaccgccgtctgcggccccctcgccggggcttccctcgccaccccgaacgccgccgcctccgggctctacgccccctcggccctggtgctcaccacgggccacggccagagcgcggccaccgccacccctgagcgcgccgtcacgctgaactgcgccccgaccgcctcgggcacccatccggccgccgtctccgcctgtgccgaactgcgggcgacgggcggcgacttcgatgccttgagtgccagaagcgatgccatgtgtacccggcagtacgaccctgtggtcgtcacggtcgagggcgtgtggcagggcaagcgcgtcgcgtacgagcgcaccttcgccaacgagtgcgtgaagaactcctacgggacgaccgtcttcacgttctgaggaccgggatcgcgcggacccgtgaacgtggaccgaggcccgtagctggggagtgcgagcctcgtcgcggtgcgccacgtgatctcgcataggggccggccggacggagtggggccgtccggccggcctcctgcgtcagtcggacgtgagggaccagcgccccacttcgcgatagccggagtcgtatacggcggagccgtcgccgggcttcatctcgtagtggtggagattgccgccccagtagcgcaggatccgccccagctccgtggcggtctcctcgccccaggccgcgttctccaggtcgacttcgagaacgaacttcacgtacgtgcctccgcttccggatcgtcgggtgccgaccgccatcgtgccatcacctcaactcccggtccggtcagaagtgttggcccggtttctgaaaacgttcgcctccggtgcgctgaagtacttcgccgagcccggggtgtccgacgagcgcggcctgttgggcctcggctggtaccggccctgtctcggctgaggtattgacaggtgatggcagttgcgggagccgaagcccccgcacttaatgcatatgatgtgcaggtgcatgaatgcagcatcagggcggcgacccccggcgacctcgacggtgcgcgagccgtgatgctcgacaccgtctaccgcgacttcggcaccggctacgttccgcgctggcacggcgacatcatcgatctcgcgggcgcctacctggcctcgccccgccacactctgctggtcgcgctcgatggctccgacggcgaggtcgccgctacggccgccctcgactcccgcggcccggcccatccgcccaacccccgcccgctggcccggcgttacccgtcgggggagacagcgcagctgcggcgcgtgtacgtccgcccggggcaccgcagacgcggcctggcccgccgcctggtcggcgagctcctcgccttcgcggccgcggacggcggctaccgctccgtctatctgcacacggatccggggatcccgggcgccgaggccttctggcgctcgctcggaaaggccgtgtgggacgagcgcgaggagccaggcggttccggtgtcgtccacttcgaagtccccttcgcctgaggcgcgccctgcccccggtggtcgcactgcgccgcccggagcagtcgcgtcaccggttggagtcgtccggaatgccggtgcgggtccgctccggtagccgtggagcatgcgctttctcggcgagctggaccagcggctgttcacccgggtggccgccgcgcggctttccggcgccgatccggcgctcatccggctcagccgcgccgccgaccacgggcggctgtggttcgccgcggccgccgtgctcgcgacggccgacgggcgcaccgccagacgcgccgccgtgcgcggtgtcggctccctcgcgctggcctcgctcaccgtcaacaccgtcgccaagtgggccaccaggcgcccccggccgctgctcgacctcgtaccgcagatccgccacctcacccggcagccgcacaccacctccttcccgtcgggacactccgcctcggcggcggcgttcgcgaccggcgtcgccctcgagtccaccggctacggcgcactggtcgcgccgctggccgcggcggtcgccttctctcgggtctatgtcggcgtgcactaccccggggacgtcctggccggtatggcgatcggcgccggcgccgccgcgctcacctgccgctggtggccgccgcgccaaggggtcccggaacgggtgcgtcccaccacccacgcacccgcgctgccgggcggcgaggacctggtcgtcctcgtcgacgggcgggccggaaccggactgcccggcgcggtcctgccggccgtcgagcgcctgcgcgtcctgctgccccgggccgaactcgtcgagttcggcccggacgacgacttcgccgcgctgctcgccggggcggccggccgggccgcgcggcgcggcggcgcgctgggcgtgtgcgggggcgacggcagcgtcgacgcggcggcgcgcgccgcggcccgccacgggctcgcgctcgccgtgttccccggcggcaccctcaaccacttcgccctggacgtgggcgtcccggacttcgacgacaccgccgtcgcggtcgcccggggcgaggccgtcgcggtggacttgggagtggcggcaccgaaggaggggcacgacgtgctcttcctcaacgccttcagcatcgggccgtatcccgaactcctccggctccgcgagcgactggaggggcgatggggcaagtggtccgccgaggccgtcgccctcgcccgggtcctgcgcaccgcgacccccgtggaactgcgtatcgacggccgcccccgacgcctgtggctgctcttcgccggcaacggccaccacgtccccgacggcttcgcccccgccttccggccgcgcctggacgacggactgctcgacctgcgcctgatcgacggcgaccgccgctacgcccgtacgcgcgtgatcgccgccgcgctcgccggcacgctcggccgttcccgggtctacagcgccgcccctgtgtcccgggtccggctggagggcctcggcggcacgcggaacctcgcctacgacggtgaagtcacctgcgcgccggatcagttgacgctggagaagcgtggtcgcggactcgccgtgtaccggccggccgtgccgtgcgccgaaccggcccggcgggcccgcctcgccaccgcgatggcccaccaccgaaagcggaagaggggccgccgtctccctgcggacggcggcccctcggtctagtcggcgctcacatgtggacgaccggtgcggcgtccgcggcctgctcaggcttcccggggcgatagagcaggaacgcgatcaccgcgcccgcgacgaagaagaccgccgaccaccagaacgcggtggtgtagctctcgatcgtcgcctgtgcccggaccagcttgctggtcgcgtccttgccggacagatagccggtcgcggcgctcgcggccagcgtgttcagcagcgccgtaccgatcgaaccgcccacctgctgcatggcgttgaccgtcgcggaggcgacacccgcgtcctcgggccccaccccgccggtggcgagctgcatggccggcggcatcaccatgccgaggcccacgccgatcacgatcagctgcggcagcaccgcggtcgcgtagtgcgaaccggttccgatgccggtcagccaggccatgccgaccgtggcgatcgcgaagcccagcgggatgacggccttcggcccgatccgcggcagcagcaccgtggtgccgagctgcgccgtcaccatcagcgccccgaccatcggcaggaacgccacaccggtcctggtggggctgaagcccaggttcagctgaaggtagtaggtgaggaagaggaatacaccgaacatgcccgcgccggtgatgagcacggcgaggtacgaggcaccgcggctgcggtcgagcaggatgcgcagcggcagcagcgggtgtgcggcacgcgtctgccaccaggcgaaggccgtcagcagcacaccgccggcgatcaggaagccccaggtccgcggcgaaccccagtcgtgcgtctcggcgttggagaagccgtagaccagggcgaagagacctccggcgaccagcaccgtacccggcacgtccagcttggagttcgtggcgtcgcggtggttgctcagcgacaaccagccgccggcgaaggcgaccacggcgatggccacgttgacgtacagcgtccagcgccagtcgaacgcgtcggtcaggatgccgccgagcaacaggcccaccgcgccaccggcgccggcgatggcgccgtacacgctgaacgccttggcccgctcccgcgcgtcggtgaacgtcgtgttcaggagcgagagcgcggcgggcgcgaggagcgcgccgaagaccccttgcagggcacgtgcggtgaccagcatctcgaagctcgtcgcggcgccgccgagcgcggaggccagcgcgaatccggtgacgccggccaggaaggcgggcttgcggccgaagaggtcggcgatgcggccgccgagcaggagcagcgaggcgaacgccagcgcgtacgcggtgacgacccactgccggttgccgtcggagaacccgaggtccgcctgcgccgacggcagagcgatgttcacgatggtggcgtcgaggacgaccatcaactgggctatggcgacgaccgcgaggatccaccaccgccgggacgaggccgcgggcggcgcctgcgcggcacccgtccgggtgctttcggtcagagtcttctgggacatgggggaaccactccagggaagccgttcgaagagaaacgtaaacgaaaccgtttcgtacacatcgaggctagaccactcccagcgaaacggcaacgtttcgctgggagtgagccgcgacgcccccccgcccaaggaccgaggcaccatgtcaaccgaactcaccggtacccacctcaccctccccgacggccgccccgccgtccgtttcagccgtgtctacgaccatcccgccgaccgcgtctggcagttcgtgaccgaccccgacgagctggcccggtggttcccctcccgcgccgagatcgagctgcgccccggcggcacgatcacgttcagcggcgacccgaacatggagaactccacgggccgggtcatcgccgtcgacgtgcccgggcacctgtccttcgagtggggcggcgacgaactccacttcgacctcgaacccctggacggcaagcgcacccgctgcacgctcaccaacgtcctggcggacgcgaaggccgccgcccgcaacgccgccggatgggaggtctgcctcgccgccctggacgcgagggcgcggggcgagcggctcgaaggcccgcacgcgggtgccacggcgccctggaaggagatctaccgcggctacgtcgaggcggggttcccctccggtgctccggtcccgggcctggactgaccggtcacgccagctgccgccgcaccagctcgtgcagccgcccgcccgtgtccgcgagcagctgcgcgggcggcccctgctgggcgacccggccgtcctccatcacgatcacgcggtccgcgtccatcaccgtggacagccggtgggcgatcacgacacgggtggcgttgagggccttcgtgctctcgatgaccgtgcgctgcgtctcgttgtcgagggcgctggtggcctcgtcgaagaagaggatgcgcggtcggcggatcagcgcctgggcgatcatcagccgctgccgctggccgccggagatcgccccgctgccctggacgatggtgtgcagccccatcggcatccgcttgatgtcctcggcgagccccgccatctcggccgccgccatcgcctcctcgggcgtgtacggctcggtgccgcagatgcagtccaggatcgacccggtgaagggctgggcgtgctgcagtacgacaccgcactgccggcgtacggccgactggtcgagggcgcccaggtcctggccgtcgtacaggacacttcccgagaccggcttgtcgaagccgatcagcagccgcagcagcgtggacttgccgcagccgctcgggccgacgatcgccacgaactcgcccggcttgatctcgaaggacacgtcgtcgaggacgagcggaccgtcgtccgcgtaccggaaggagaggcgccgcgcctcgatgccgccggacaggacgccggggcgggtgctcgccgtgcgcacctccggagtcgcgtcgagcaccggcttgatctcctcgaacatcggcagcgcggccaccgccgagacgaaggcgccggtcagctgggtgaccgacgtcagcagcatggtcaccgaggtgttgaaggtgaggaacgcggccgccgacatcgccccccgcgccgggcccgcgagcagcatgaacatcagcagcgagcagagcggcagatacaccgcgcccagcaccgtggtgaggttcttgatgcggccgaccttctgctggagctcacggctgcgcgcgaactcgcccgcccaggcggcgtacgcgtagttctcggccgccgcgacccgcagcttgggcagaccgcgcagagtctggaacgcctggttgttcagcttgttgctgagcacgacgagacggcgctgccagcgcacctgccacaggccgagccccaggaacacaccggcgatgacgaccagcatcccgatcgccgccagcgccatcggcgcgctgtaccagaacaacagtcccaggttcatcgcgccgacggtgaccgactgggcgaccgtggggccgacgcccgccagcagccggcgtatcgagctgatacccatcgccgcgctggccagctcgccggtggagcgggaggtgaagaacttcgtcgggagcctgagcagccggtcccagacggccggctggagcgtcgcctcgatccgcccctccatccgcaggagggtgaggttctggagcagcatgaacgccgccgacacgacgctcgtgatcatgatggccagacagacctggacgatcagaccgtgctgggccttcggcacgtactcgccgagcaccttgccggtggcgatcggcacgagggcgccgaccgccaccgtcaccagaccactggccaggagattgcgcagatcgccgccggtgccccgcatgctgaaccgcatcagccgcagcggacccagaccccgctcgggcagcgggcggtagaacatgacggcacgcggctcgaactcctccgcgttggccttctcgatcggcgtctcgcggccggacgagggctgcacggcgacgtatccgccgcgccgccacagcagcgcgaccggcgcgccggacagggcccggtggcccaccagcgggcccgtgttgtcgcgccaccagcggccgtcgagccgtacggcccgggtgcggacacgcgaggcgatcgcgacgcgctccaccgggtcgagccggtcgctctcggtgccgctctgcgcgggctcggcgagcgcgatcccggccgcgccggcgaccagcttgcaggccgcgtacgtggcatcggcgtcggccgcggtggtgcgcttcgccgacgacttcccgatggacgccagcagcgtgcggtcggcctggacgcgcacggcctcgcccgccttgatacccgccgccgtacggtgctcgtggctgcgctccaactgctcgatccaccggtcgagggtggcgagcagccggtactgctggtcgaccatgccctgccagacgccgggatccatcagcaggtcggccgccgcctcctcgccgtacagcgagccgtactgcacgctacccggcgggacctgcatccagaagacgtcgtcgtcggtcggcgcggcggcccgctcggtggccatcggcgcctggaagaggatggagaggccgcggccgacgcccagggcgagggcgtactccagcggactcgtggtcggcggaacgtactgggcgttgccgtactcgtcgtacgaccaggtctgggtgcccccggactcgtacagctcgcgcagcgagatccggcgcatcacgcactcccgcagcggcctggcgaccagggtgtgctgcggtcccgcgaccgggccgagcagcagcgagcccgcttcgagacggccgaggtggtgccactggccctgctggacggcgtccaccgcgaacaggtccatggcgccggccgccaccagccacagcacctgcggcccttccagatcgaggcggccgagccccgagcagtcgtacggggtgcccatcgaacccagggcaccgaggacgaggtcgccctcgtgaaccgccgtcatctcaccgctccctgaccagctgggcatacgcgccgccggccgtcaccagggcgtcgtgccgcccccgttccacgatcgtgccgtgctggagcaccacgatctcgtcgctgtcgcgcacggtgctgagccggtgcgcgatcaccacacaggcacagccgcgcttgcgcagattgtcgatgaccgtctgctcggtctccgcgtccagcgcgctcgtcacctcgtcgaggaccaggatgctggggttgcgcaccagcgcccgcgcgatctccaggcgctggcgctgaccgccggagaagttgcgcccgtcctgctcgacccggctgtggatgccgcccgggcggcgcgtgacgacgtcgtacaggtccgcgtcctgaagcgccgcgaccaccgcgtcgtccgggatcgacgggtcccacagcgccacgttgtcgcggaccgtcccctcgaagaggaacacgtcctggtccacgaaggagaccgaagccgcgagcgccccgcgcgggatgtccgccagccgctgcccgtcgatgcggatcacgccctcccagggggcgtagagacccgatatcagccgggagaccgtggacttgccgcttccggaaccgcccaccagcgccacctgctgtccggggccgaccgtcaggctgaacccgctcagcagcggctggtcgagcgggctgtagccgaacgtgatgttctccagttcgacatggccctgcagccgccgggtcgactcgccaccgccggggcgggcgtagagcgggtcggcctggaagttctcgacgtccttgagacgtgccacgtcggccgcgaagtcctggatgcggcccgcgacaccgttgaggcgggtgatcggcgcggtgaagcgggtgacgagggcctggaacgcgacaaggagaccgaccgagatgccgccctccaccgcgcgcaggccgccgatccagagaatcagcgcgctgttgagcgtcgcgagcgtcggcgcgaccacgcccagccaggcgctcggcaccccgaggcgctgctgctcctccagcgtggtggcgtgctgcccggcccacttgcggaagtagccgtcctcgccgccggtcgccttcatcgtctcgatcagctggagaccggtgtaggccgtgttggtcagccgggcgctgtcggcgcgcagcttcgcggtacgcgtcgcccgcagccgtatgacgacccgcatggccacgacgttgagcagtgcgacgccgatgccgacggccgtcagctgcgggtcgtaggtgtagaggaggaccgcgtagagcacgacgacgatcgcgtcgacgccggccgccgcgaggtcacgggccagggtctcggcgaccgcgtcgttcgactggagccgctggaccaggtcggccgggctgcgctgggagaagaaggtgaccggaagccgcagcaggtgccgcaggaagcgggcactggagagcgtggaggagatgacgcggccgtgcagcaggttcgcctgttgcagccaggtcagcgcgatcgtcagcgccacacaggtgcccatcgacgcgaacagcacgccgagcagcgaggtctggccgccgatcaggaacatgtcgatgtaggtacggctcagcgcgggcatcgccgcgcccaccgccaccagcagcaggctcgcgaggacggcggcgggcatggtgcccgaggtgccgcgcagccgggccggcatggcgcccaggacacccggcctgcggccgcccttctcgaagtcggggcccggctccatgaccaggacgacgccggtgaagctggtgtcgaagtcctccatgggcacgaaccggcggcccttgccggggtcgttgatgtgcacgccccgccggccgaagcggcgccccatgccgtcgtacacgacgtagtggttgaactcccagaacaggatcgcgggcgccttcacctcggcgagcgcggccgtgtccatctgcatgcccttggccgtcaggccgtaactacgggccgccttgaggaggttgctggcccgcgagccgtcccgggagacaccgcaggcgatgcgcagttcctcgagggggatgtgccggccgtagtggccgagcaccatggcgagggaggcggcgccgcactcgacggcctccatctggaggacggtgggggtgcgtacggtcttctgccggctcttggggaccgtgcgcttcggcggggcggcccgccgtctgccgcgcgccgacggcggcagggtgtcctggggagcggtcacgggagcagccaatcgacgggacgctgatcggccagccggatcgaacccgtggccagggtcatggaagcgagggtgtacggcggcccgtccgctgaggaccactggtagccgctcttcgtgccggacgaccggtcgagccggaccaggacggccaccggccggcccttcttggtgaactgctcgcccagctggctgtcgccgaggaacgcggcgatctgctgccgggtctggacggtccggtcgacggacttcacatggccgtgcagcaccccgtactgctgggtcggcaccgactggacggtcaggtccaccgccgcgttcgccggaatcgaggaggcgttctcggccgggacgtacaccgtcgcgtacagcgggtccgaggcgtgggcgaccttctccacggcggcgacgttcgcgccggtctggatgatcgcgccgatcgtggcggcgagcgcggtgatccggcccgcggcgacggtgcgcaccagagtgtcgccgtcgtccgtacggaccttgaggacgggcgagttcgccggcagccgctcgccctccttggcgaggaccgcggtcacctgccccgcgacggggctttgcaggacgtaactgccctcgccgtgcgtgaggacggcgggtgcgccgaccgtggaggcgacggagcccgtcacggcccacacggaggcggccgccatgacgacgaccgtcacggacaggacgagccagccctgggggcgtgcgaagcgcaccgggaggtcgagctcttcgggcgactgcagcttggcgagggcctgttggcggaactgcacggaacttccctcacctgtcggagagatttacggcatccgtgagtcccggaaccgccaaggcggttcccaaggaaatacagagcatacggtggatcagaaatcgctggatgcgatcaagatcagagaccggcgaccaggttggtgaccggggcggtgttcaggccggtcacaccctcgaccgtgccgacggccgtgccgacgacggcggagaccggggcaacgccgtcgaccaggccggtgacggtgccaacggcgttcagggacagaccgcccgagacggcgtcgaggtcggcgtcggagatctcggcggtcacaacctggggggtggagttcatgatggaacttcccttcgtatgggtattcgtaagggggagagcggcccccctctggggacagacggtcggccgcgaccgcgggcgccgggcacccgttgccgggaaccctggggcggcccccgcggtgcaatggatcaaagcacggtggcgtggcgcgcatccaatcaaccgggcctctcacctgcgcacttgcactccgggagcggtgatccgtgcaggcgtgcgcacgtctcggcggcgacttcttcacatgctgcgcgacatcggctcgtgcctccccttgccgccccgaccccgaatgggacactccggtcgcaatcggttggacgtcgtgcgcagggctgtgcaaatgcgccgcctgccgtgacccgcttgcgcattcgatgtgcagattcgctgaagccgggattccgctcggcgtcggcaactgaccgtcatcgcccgatggcgctgcgtacttctcagtccagaagcgcgtacaccgtgctcgcccgggccgcgatctcgtcgcggccctcggcggtcatcgtgatgtcggcgaaggccatccggcggcccaggcgcgtgagtaccgcctcgaccagcacatcggcctccgtgaccgcgcgctggaagctggtggactgctgaaccgtcgtcatggggacgaagccgccgcgcgccgccgacaccgcgatcaccgtcgccgtgtcggcggcggccagcaacgcctggcccgacaacgcgccgccctcccgggcgagtcgcgcggaccacggcagccggagcaccacccggcggtcgtccacctcctcgaccgacaggccgagatcgagcacccagggcgcgaagttgtcggcgaggatctttccggcttgggcaggggtcaccgtcatggcgtgatggtgcccgccggcccacacgggcagacgtgtatgccgcgtattccaccctttcgcacgagccaatctcgtgaatcgcaaaggcagttgaacacctcgcgtggcacgtgcgtatcaacaggcatccaggcgccccccagttcagctgccggacggcggcaacggaccccgtccccaggaggtcaagagttgagtcacaaacgcatacccaagcgcaaggccgcgatcgcagcgggaagcgtggcggcgctcggagcggcggcacttctactccccaatgccaacgcttcccagacggactcgggggactccaccccgaggacgttcaagtcggccgatgtctcggacctcgcctcacagctcgcctcgcagcttggtgacgccttcgccggttcgtactacaacgccgacaagcagcagctcgtcatcaatgtcgtcggcgacgacagcaacgtgatcaaccagatcagaaaggccggcgcggtccccaaccaggtgcagaacagcacctccacgctccaggccgcggccaagacgctcaagaccgatgccaccatccccggcacggcctgggcggtcgacccgaagacgaacgagatccgggtcaccgccgactccaccgtcaagggcgccaagtgggacacgctgacggcgacggtcaagagcctcggctcgggcgtggcgaccgtgaagaagtccgcgggcacgttcaagacgttcgtatcgggcggcgacgccatcttcggcggcggtgcgcgctgttcgctgggcttcaacgtcaccgcgggcgacggcagcccggcgttcctgaccgcggggcactgcggtgtcgcggccgccgcatggtcggactcgcagaacggccagccgatcgccaccgtcgaccaggccaccttccccggcgagggtgacttctcgctcgtcaagtacgacgacccgaacacgcaggcgccgagcgaggtcaacgtcggcaacgggcagaccgtccagatctcccaggccgcggaagccacggtgggccagcaggtcttgcggatgggcagcaccacgggcctcaacgacggcaacgtcaccggcctcgacgccacggtcaactaccccgagggcacggtcaccggtctcatccagaccgatgtctgcgccgagccgggcgacagcggcggctccctgttcacgcaggacggcagcgcgatcggcctgacctccggcggcagcggggactgcaccgtcggcggcgagaccttcttccagccggtcaccacggcgctggaggcggtcggcgcgacgctcggtgcgggtggcgccgcgggcgccggcgacgagtccgccgcgcccggcgatgaggcgaccgaccccgcgggcgaggcgaccgacccggcaggcgaggcgaccgacccggcaggcgaggccaccgacccggccggtgaggcgaccgatccggccgaccagtcgggcaacgacggcgccgagcagtcgggcaacgacggcgccgaccagtcgggcaacgacggcgccgacgacggctccggcctggtgtcgagcaactgacccggacgtaaaagcggttctgtccggactgtggaacggtccggccctccggcgggagggccggaccgctccgcgttcccgtccggtcaggaagcccgcgccctcagcaacagcaacgcgatgtcgtcgagccgttcctcggccgtcgcggtgtgccgcacgagccggtcggccagctcgtccagcggctcgtcgccgctctcggcgagccgctcgccgagttcggccagggcgtcctcgatgtcgattcccggggactcgatcagcccgtccgtgtagagcgcgagcacggaacccggcgcgagcgcgaactcggtcgtcgtataggtggcgtccgcgtcgatcccgagcagcgggccaccggccaggtccagcacccgcacctgtccgtcgggcttcctgagcagcggcggcggatgccccgcccgggccatgaccacccgctgccgcgcggggtcgagacgcagatagacacagctcgcgaagaggtcggtgcccaggtcgatcatcagccggttggtgctgcgcatgacctgccccggcgcctgcccgaccgtcgtgtacgcgcggaccgccgtacggatctggcccatcagccccgcggccgtgacgttgtgcccctgcacgtccccgatcaccgcggcggcccggccgacggtcgccaccaggtcgtagaagtcgccgccgatctccatgccctgggtggcgggaagatagcgggccgccgcttcgatgccgggcagcgacggcagggagtgcggcagcagcgccgcttgcagtccgtgggcgagctggtgcttggcgtcgtacagcagcgcccgttccagcgcgagcgcgatgagcccgctgaggctggtcaggatcgcccgttcgtccgccgggaacgcatgcggctcggcgtacgcgagaacgcaggtgccgaccggacgtcccgaggcgatgagcggcagaaaggcccacgcggccatcccgtcaggcgtcgtgcgccgtgccggatacaggtgctccaactgcctgcgggactcgaagaaggcgggcactccgctggtcaggacgtgggcgccggggatctgcgcggtgagcggttcgccgtcgaagcgctccgcgatcgcggcgtccggatagccgcggtgcccgagcacacgcagccgcccgccccgcgatccgagcaggatcagggcctggctgcccacggtgggtgcgaactccgacgcgatcagctgcaccacgtcctgcacccccaccgcctcggtgagggcgccggccaggctcagcacatgggagatcgtcaccagccgcgtcgtggcctcgccgtgccgcggctccgcccgggccatcgcggagaccgcccgggcgcgggagatgcgcacgctcagcccgttggtgctcgggtagaggcggaaggagagccagtcgcccggcgggcgcagcgccacgaacgacgtcacatgctggctgatcagcgccgcgcggtagcagtcctcgtacgcggggtcgttgagccagggcagcgaagcccacagctgggcgccgagcaggtcgccgaccggcatgccgagcagctcgcaggccgccgcgttggcgtagccgacccgcccgtgcagatcgagcgcacacagcccgtacggcagccgggccgccatccggaccgcctccccggcgcccagcgtgcccgccatcgccgccgtggcgcccggggtcggcagatcaggttcgggacccaccgggtggcccttctcgacggcgtgtgccagccgggtcgcgagccggtcgcaggccacgcctagctggtcgcgctcgcggctcgacagctcgggcgggtgcgagtccggccaggtcacgaagagcgcgccgtacacggtgtcggcgcacgccaagggcagcgccgccagcgcgaacgagtaggggaggaccaccgcgacgcgcggatagcggcccgccatctgctcctcgccgttcacccagaccagccgccgctcccgcaccgcctcggcgaccgggagcggcgcgctcaggcccacccgctcccagggtgcggcgaaggcccggggcagccccgccatgaccgccatctccaggaccggctcgtcgggggccagcagatacaccgccccggagtgggcgtgcacgtcttccatcagcgcggccagcgccagcgacagcagtggaccgccgaccggcgccagggcggacggctcccgccgggacgcctgcccgtcggacacgccgaccacctcctcgcacggccgcgcgacggatcccagggtcaaggctccctcctggcggcccttcgcgcacggcgggcggcacggcgccggagcccggcgccggggtggcccgggcatcgcgcagggaaacggcaccgggaatcggcaccggcccagggaatcggcaccgggaatcggcaccggcccagggaatcggcaccgggaatcggcaccggcccagggaatcggccgcgggaatcggcaccggcccagggaatcggcaccgggaatcggcaccggcccagggaatcggcaccgggaatcggcaccgagaacccggcacggaggagaccccctttaccccgggagcacgtactcatgcccccgcagtggaagcgtggcgcggcgcgcgagcgctccgagtgcgcccccgcgcaccctgatggctggttatccgcgcccacacctggtcgcatccgccaacaatgggcacgcgctcaggacgggtggagcggctgacggctgacggggagttgagggcggacgtgatccgggtacttctggtgcacgacgcgtgtctggtgcgatcggtactggcggagtggctccgccgggaaccggatctcggggtgtacgacacgacgtggcgcggcgcacccgggcgggtgcgctcggtgcggccggacgtctgcgcggtggacctggactgcgcggactcccacggcgtgccgccgctggccgacgtgtgcggccggggcgcgggcagcctgacggccccccggcttctggtgctcgcccatgcgaacagaccgggcctgctgaagcgggcggcggaggcgggggcgctcgggtacgtggacaaggagggctcgcctgagcggctggtgtccgggatccgcagggtcgccgagggggaacgtttcgtcgacgactcgctgggcttcggcttcctcaaggccgcggagatgccgctgaccagacgcgagctgagcgtcctgtcactcgccgccgggggcgcctccgtcgcggagatcgccggaagtctccatctgtcccacggcaccgtgcgcaactacatgtccgccatcacgcgcaagaccggggcacgcaaccggatcgacgccatccggatctcgcagggggagggctgggtctgaggcgggccgccgggcgggggccgggaccggcaccgaggcggcgccggaggaggcggggacggtgggcgaccatgtgcccaccaggtcgcggtacagggctgagcgccgcagcaactcgtcgtggtcgccgtactcggtgcgccggccgtccatgacgagcacgcggtccgcgcgcagggcggagctgatgcggtgggcgaccaccacgagcgtggtgccggcacgctcggcgaacgcgcgctccgcgcgctcctccgccgcggggtccaggtgacaggtcgcctcgtcgagcagcacgaccgaggcgtacgagagatacgcccgggtcagcgcgatcagctgtcgttcgcccgcggacagcgccgccgggtcgagccgggcaaagggcccgcccagccgctccagcagcggggccaggccgaccgcctcggcggcggccagcagctccgccccgggtacgggatcaggccgcagttgggtgaggttttcctcgaacgtccccccgaagacgtacgcctcctgcgggatgaggacccgaagtgcgctcgctgtgtgtccgggcaccggatgcccgcacaaacggaccgtgccgcgccgcggttcgaggagtccggcgatcagtcccgtgagggtggacttgccgatgccgctggggccgacgacggcgagccgggtgccgcgcggaacggtgaggtcgaggtccttgatgacggggtcactggcggggccgtaggcgaaggtgagggaggagagaacgagtgcgggtgtgtcggagggcacggcggccggcggcacgcggattccaccggtggccggcggtggtgccgcgatgcccgggcccaggcggcgcagcaccaccgccagccgggagccgctcgtgcccaggccgtgcaccaggttctgcagggcggggagcagggactgggtgacgtaggcgagagcgccgacgagcgcgcccgcgctgacgccgcgcgcgaggagccagggggcggtggcgagcagcagcacgatcgggagctgtccgccgacggcgagggccgccacgcgcagcacgccccggtgggccagtgagcgggcggcgcgcacctcggcgtcgatgcgctgtccggcgtcggcggctacgtgctcctccgcgccgccggccgtgatgtccctgaggccggggcagacggcccccaggtgggcggcgaggcgttcgtcggcgacgaggaactcctcctgccggcgggccagtggccgcagggtcgccacaaagagggccacccccgcggcgagcgggggagcgaccacgagcaggagcagcggcgcgagcgagaacagcccgacgagggcgccgaccgtggtgaacacgaacgagcgcgacaccatcaccagaccggcgaacgtgtcgcgggcgatctccacttgctgtgtcagcccggagagcgccccgccgtcggcctcccgcacccctcggtcgaccacacgtcgcaccagtcggtcgcgcaacggctcgacgagcgcggcgacacccccgtacacccgcccggtcccgaaggccccgacgagaaccgccgcccccgcgatgcccagccagcccagccccacccccgcccgcccggacaggaaaccctcgtcgagggcccgcgccagggcgtaccccagcagaaacgtctgtcccgtctccagcaccgaccacgcggccagccggacgaccactcgccaccgttcgcgcaacaggagcgtcagttccttcaccccgcgccgccgttccgctcggtgccgctcgacccgaacacctcccggtacgccgccgaccgccacagctccgcatgcgtgcccaccgcgcgcactcgccccgccgccagccagaccaccgcatccgcgcgtgcggccgtggacacccggtgggcgatgatcagccggctgcttcccggggtgtggcgcaggagtgcctcggtgatgtggcgctcggtgaccgtgtcgaggctggacagggcgtcgtccaggacgagcaggcggctgtcgtgggcgaacgcccgggcgaggccgaggcgttggcattcgccgcccgacagcggggcctcggcacagggggtggcgtagccgtcgggcagccggcgtacgaagctgtcggcgcgcgccgtggcggcggcctgccggacccggtcgggcgggggagaggggatgccgaaggcgatggtgtcctcgatggtgtcgcccagcagggcggggcgctcgaaggcgtggccgacggctcggcgcagtgcggtcctgtccaggtcgcgcaggggcacgccgtccagcagtacgtgcccgtcgtcggggtcggcgagccgtcccgcgagggccgcgagcagggacttgcccgagccggagcggcccaccacggcgaccgtgcggccggcgggcacgaccaggtcgacgccgtcgagcacggtacgcccgcctcgccggacggtgaccgagcgtagctccaaccttccctcgccgggcgggagttgacgcgtgccgtacaccggtgcgggctcggtcagcacctcgccgaggcgccgggccgcggcccgcgcccggatgagccccgagagctgcccgaccagcacaccgacgccggtcgcgagcacggcgtaccgcgaggcggcgagcaactcgccgacggacagccggtgatggacgaggagcacgccccccacggccaccacacccagctggagcagcggtgccacggcgaccgcctgtgccgcggcgcgcccttgcacccgccacatccgccgcccctcgcgggagagttccggcagcggccgcaggatgcgggccacctccttgtccgccgtcccgccggccgcgatggtgcgcgcgccgccgatcgcctccgcgagcgcgccggcgatccgcccctggacatcctggtaacgcgccacgcactgggacgagtcgcgcgcgaaggcacgcagcagcagggtcaggaccggtgctccgccgaggaacacggctgccagcaggggatcgatcaggccgagggccaccaccgcgcccaccggcccggcgagggcggccagcagcgtcgcggcggtggcgggagcggttccggcctgtgccgcgttgccgacgagccgcgccaccagctcaccggggccgaagcgctcaccggcccggggacccacggcgagcacatgcccgaccagtcgctgcctcagccaggcggtcgcccgggcgtcggtcgtgcccgcgagcacggtgtggcaggcgtcgagcagggcgatcaggaggaccaggccggtgcaccacagcacccagtgcgttcccgccgcgtcaccggggcgggtcagcagcaggtccagggcccggcccagggcggccggcagcagcaggctcgcgcccgaagcggccgcggtcgtcagacacagggccacgcagcgggaacggctgtgccgggcggccgagcgcagcagcgtgcgggcggccgcctcgtccgcggcaccggtgccgtccggtgccgctccgtgaccggagggagtcttcatacggctgtggcctcgcatcccgagccgtggcccgcgcgttcaggaccgcgggcggcccctccccgaagaggggagcggaccgcccagggccgtgcgtgcaccgtgttgtcagagacagagcagaacgctcgccgcggagacgcaggagagcaggctcacggtgctcgcgccgccgccgccggtgtgctcgtcggactccatcgtctgcaggtcgagaagtgccatctcggtgtcctttcctaggtggggacggggtgttgaatcacgactccggtagtggagccgcgtctagtgggcgccgcgaagcggcgggaggaacggcagccgggcccgcgtctgtccgtcgagggccgcgccgagcgcgagcaggcaccctgccgttccggtgcccaggtccatggacagacgcatcatctggtgtccggggaaggccagttggccctggtaggacatcgcgaaccagccgagcccggcgacctgttcggcgagccgctcgggggtggcgccgggcgcgctcgtgcggctgaggtggaggatcatgcccgcgcggccctggaagagcccgggctgcgcgtagaagcgggaggtggcggcggtgaggatgcccgaacgcgccccctcgaacgtgccatggccgtcgtccccgcccagcgcgagaaagtcgtcgacgaccatcccgaggcccacgctcccgtccccgaggtacggcagcgtgcgccagccctcgtcgacctccaggccgccgcctttctggacgacgcagcactccaggtcctgccgcagtgcctcggcggccgcgtcgcgcagctcgggggcgccggtctcctcgtactccctgagcaggaagagggcgatcccgctcgcgccccgcagcagcccggcgcgccgtcggggaggggcgggccgcggctcggcgagtcgtcggacgagcaggcgcgcggcctcggcggcccgctcgcgcagttgtgtctcgccggtggtgtgcgcgagccggccgaggaccaggccgagtccggcgaggcctccgtgcaggtcggaggagaggttctgccagcgctcccggaggatcccgtcgaccaggtccagggcgcgctgccggtgcccgagcaggtcgaggacgtaggcgacgcccgcgagcccgtcgtacaggccgaggggcgtcccgaccggcgccgggtccgtgtggtcgagcagccagcgctcgccctcctcgtaccggtcggctccggtctgttcgaggacgtacagcacgcccgcggctccgtgtgcgagcccgagcccgccgccgtcggagaactgggcgacgtcgccggggaagagccggtcgtcgcgctccggggtggccgaggcgaggatggccttgaccatcgagtcccggctgtagggccagtcaccggggtcgaccggtgcggtgtacgaggtggtcggcctgaccggagacgggcgcgaggtggccgaaggggagaccttgtccccctcggggtccggtgcctgcctgcgcccggtgatctccgccaccgcctcgtccaggaactcccgcggaacatcggggaactgtccggcgacgacctccgccagatgcgcggccttggcgcggtcgaccacgaagagcgtggtgaccggcaggaacagggcgaggcgcagacacgcgagcgcgtaccggtcgacgtccgggcccgtgcggtccggcggcgcgaagaagcccggatgggcgacgacctggcggccgttctcctcgatcggggccgccgcctcgaagtcgagcagggacaccgactcctcgtccggcgcgaccatgatgttgaacacgtgcaggtcgttgaagacgatgccgcgcgcgtgcaccgcgtgcacggcctgctcgaccgcccggtggatgcgcagcgcccaggccgtgtaggcggcgacggcgtccggctcgggatccggcgtgagcagcgggtgccgctcggcgaagaaggagttgaggggccgcccctccagaaagtccatgacgaggaagcggtggtcgccgagtgtgaaccagtcccgcacctcgggcaccacaccgagccccgacacctgctccagcgcgtacttctcgcgctccaggcgggcgatcgcgtcggccccgtccgaggcgagccccgcgtgcggccggccctccttgaggaccaccttgcggccgtcccgggtgtcggtgcccgcgtacaccccgccgccgttggagaagtgcagggccttctcgatgcggtacggcaggtcgccgaccgtcgtggtgttgcgcgccgcgagctgcggttcgaggaacgcgggcagcgtgacccactccggaacctggaaggagggctgccgccggtccggcaccagcgtcccctcgccgtcgcggaccgccgggacgagtgagccgcgctcgtccaccacgaaggagcgggcgaaggcgccgtaccgcacgtacaggggaccgtcgttccagcgcaggtccgtgaggatgtacggcccctcgcacccgtcgagccgctcgcccagctcgcgcagcacgaggtgcagctgctcctcgtcggcgggatagatggtgacgaacttgccgctggtgtcgcggcccgcgtacttggcgttgcgtaagtgcagcagatggggccccggtacgaacttgaaggggatccggcgcgggacgcagtactcccacacgtccgtggcgatccgctccgcgttcgcccgggtggccgaggcgtggatcttccatccctgggccggccccggcagcgcggtcccggcgtcgtcgaccggcgtgaacgtcagccagtcgccgatccgcgcgctccgccacccgtcgggcacctcgcggcacgccggcccgtacagcggagcggcaccggacgctcccacggacagccggtcgggcgtctcgtagaagtgtctgtccgccagcgcgtacacctcgtaccgcttgtccatcccatccccctcggtctcgtgtcaccgagccttccagcccgtgcgggggccggacagtcacgcctgtcacgagaactccgtgaggaacgcatgcgtaaagtcatgttcggcacgtttcgagcggagaggctccaccacgggcccggcaggccgggcggaggggttccaccgcgggaccggcggaccggccggaggcgctccgccaggggtcttccggaccgagcggacgggctccgtcgcaggccccggggatgccggaatggtcacaggggctgcgcccacgtcccggaagcgctgtaattgcggacgtggccagtgagcgcgttgcgggacgcggagcgagaacgtcgcgtgccgaacttgccctcaaatcgctcggcccggacctggaaccccgagaacgactgcaccgcatcctcgaacaggtactcgtttttgcgggagcgatggttgccgcggcctacacgcacagcgaggacggggaccagctgtgcctcgccgagtcggccggggtgccgaggagcctgtacgggctgcgcgactcctacccgctgaccggcggcacccccgcggcggacgtccaccgctccgggcagccgctctggctcacccccgaggacctcggccgctgcgccgatgcccgccggctgccgaacggggacttctccctggccgtgctgcccctgggcgacggcggttgcctggccgccgtcagcgagcgcgccggaggcttcgacgccgacgaccgcgagtgcctccggttgctggccgggtccgtcgcctgcccggccccggcggccccggccctgaccgggtccaccgactccggcgagccggccgacagctccttcagcctggccatggactccgggcggatcacggtcgacgacgaggtgctggagctgttcgggatcggcccggacgagttcgacggcaaggtcgagaccctgctcgcgctgaccgtgcccgaggacctgccgtccctgatgtcggtcgtggaacccggccacatgtccatcggcgaccgcgagctggagttccggatcctccagccctcaggcgggccgaggtggctgcggctgcgtggccgcctgctgcccgccgagcagggccgtccggcgctgctcgtggggtcggtcgcggacgcctcccggatgcgggcgggtgtcagcgacgtgacccgcgtccagcggctcgccgcggccctcgccaccgcgggcaccgtccgcgaggtcggccgggccgtggtgaccgccctgcgcaagccgctccaggccgaccggatcgcgctcgccgaactggagggcgaccggctcgtcgtcaccgtcctcgacccgcccgaaccggattcctggcccgaactgtggcgcagcgagtggcgctcggagtggcccgacgcgcccgtacgcgccatgccgaccctggcgtccgccctcagcgaggggcgcgccgcgatctggcccgccgggaccccgttggagccggcggtcgcggacgtcggccccggcggtctcgccgtgctgcccctggccgcgggcggccggatggccggcatctgtctgatcggctgggacgccccgcacgacttcggccccgacgaacgtgccctgctcaccgccgccgcgaatctcgcgggccaggccctgatgcgcgcccacgccttcgacgccgaacacgagctggtcggcatgctccagcgcagtctcctcccgcgccggctgccccgcctgcccggcgcggtcgccgtggcccgctatctgcccaccacggcgggcctggagctcggcggcgactggtacgacgtcatcccgctgcccgacaaccacgtcgccctcgtcatcggcgacgtccagggtcacaacgcccaggccgccaccctcatgggccagatgcgtacggccctgcgcgcgtacgccgtcgaagggcaccccccggacgtcgtcgtctcgcgcgccaaccggctcctcatggacctggagaccgacctcttcgccacctgctgctacgtcgacgtcgacatggaggagggctccgcctggtgcgtacgcgccggccacctgccgcccgtgctgcggcacccggacggcagtaccgaggtcgtcgagtccgagggcgggccgcccctcggcgtcgtcgcccaggccgacttcccgatgagtccgctgcggctccagcccggcacactgctcgccctgaccaccgacggcctggtcgagtccgccgagctcgacatcgaggtcggcctcgcccggatggccgccgaactcgccgcctccgaccccgcccacctcggcctcgtcgccgacgccctgctcgcgggcgccaaccgcagcgacgacgtggcactgctcctcatgcgctacgagggcatggcgctgcgcccgctgcgcgagagctggacggtgtggcgcgtcccggaggcggtgcggcacgcccgccgcttcacccggcgcaccctgcgttcctggggtgtggcggaggaagcggacgccgcgctcctggccgtctccgaactcgtcaccaacgccctcgtgcacaccgacggccgggtacgtctcgacctcaccctcatcaaccaccggctgcgcatcgccgtcgccgactcctcaccccgtacgccgatcaagcccaccagcatcggctgggaggccaccggcggccgcggcatcctcctcgtcgaggccatgtcggcggcctgggggagcgtcccggtcagcggcggcaaacaggtgtgggcggagatcgtcctggagtccgctccccgcgtgcgcgacgcgaccggcgcggcaccctgaccctgcggcgcggcaccctgaccctgcggcgcggcaccctgaccctgcggggcgggacacggacgcgggggcgtcccggaaccgcccatgacaccctgagggcgtgcgcctcctgctgatgtccgacacccacctcccacggcgcgccaaggaactccccgcgcgtctcctcgccgaactcccccgcgccgacgcggtgatccacgccggcgactgggtggacgccgccacgctcgacctgctggagagccgctccacccggctgatcggcgtgtacggcaacaacgacggccccgacctgcgcgctcgcctcccggaagtggcccgcgccgaactcgacggtctacgcctcggcgtggtccacgagaccggcgccgcccagggccgcgaacgccgctgcgccgaccgcttcccggacctcgacgtcctggtcttcggccacagccacatcccctgggacacgacgacggacacgggcctgcgcctgctgaacccggggtcgccgacggatcggcgtcggcagccgtactgcacgtacatgacggcggccgtgacgggcggcagactgacggacgtacagctgcaccggttgccgccacggagttgacgcgccgcgacgctccggcacctggaaggcgggctctccgtctcctcaccgcggcttgggcggatggatcgccccgccggtcgcggtcagcggcgtcccgctgccgccccaccgcagcgcgacgatctcggcggcgacggacacggccacctcctcgggcgtacgcgccccgaggtccagcccgaccggtgagcgcaaccgggacagttcgtgccgcgagagccccgcgtcggtcagccgcttcatccggtcgtcgtgggtacgacggctgcccatcgccccgatgtacgcggcgggcctgcgcagcgcttcctccagcagcggcacgtcgaacttgagatcgtgcgtcaggacgcagatcaccgtgcgcgcgtcggtggtcgtcccccgcagaaagcgctgcggccagtcgacgacgacctccacgcccgccggaaagcgcttcggcgtggcgaagaccgggcgggcgtcgcacaccgtgacccggtagccgaggaagtcgccgatgcgggccaccgccgccgcgtagtcgatggcaccgaagaccagcatccgcgggggcggcgcgaaggagtgcagaaagacggtgacggagtcctcgcgccgctcgccgttcggcccgtagtgccgcagccccgtggcacccagcgcgagttcgccgcgcgcgtccgcggtgaccgccacatccagccccgtcgaccccagtgaccccgccaccccctccggccacacggtgagcgaggccccgcgcggtgcgggtccgtcggtcaccgtggccaccgtcgccggccggccggcggccacggactcggccagcgcaccgaacgacgggtcctcgtccggcgtcacccggcgcaccagcagggtgatctcgcctccgcaggtgagtcccacggcgaacgcgtcctcgtcgctgtacccgaacgtctcgagccgcgccgcacccgagtccacgacctcctgggcgagctcgaagaccgcgccctcgacgcagccgccggacacgctgcccaccacctcgtcgtccggccccacggccatcgccgctccgggatcgcgcggcgcgctgcggccgaccgccaccaccgtggcgagaccgaagggggatttcgccgcgtaccaccggctcagcgccgggaggatgtcccgcatacgtgctccagcactcaaggccctgctcctgtcaccagcgtcgcatccggccgcgagcggcgccggatcgccacgctcccagccgcgcgtgccgtgcacagggacttgttgagcgttaatcctttgccgtgtgcgtcgggcgcctgctgcactacgcaagacaagccgtcgcagatcgaggagcagcacatgcgcgcaccgttcgtgtccacccaggaaggaatgaccccctcttcaaaggacatgacacgcggtgcacacgctgaacctcggaattctcgcgcacgtagacgccggtaagaccagcctgaccgagcggctgctgcacacggtcggggtgatcgacgagatcggcagcgtcgacgagggaaacacccagaccgattccctcgcgctggagcgtcagcgcggaatcaccatcaaatcggccgtcgtctccttcgcgatcaacgacaccacggtcaatctgatcgacaccccgggccaccccgacttcatcgccgaggtggagcgggtactgagcgtgctcgacggagcggtgctcgtcgtatcggccgtggagggcgtgcaggcccagacccgcgtgctgctgaggacgctgcaacggctgcggatccccaccctgctcttcgtgaacaagatcgaccgtggcggggcgggggaggagcgcgtcctgcgcgccatcgcggcacgcctgaccccggcgatcgtccccatgggccgggcggccggaccgggctcgcgcgacgcccgcttcatcccgtacgaggcccatgacccgggcttcggcgcgcggctgctcgacgtcctcaccgagcacgacgaggaactgctggccgcgtacgtgaaggacacggtgtcgtacggccggctgcgcaccgccctcgtcgagcagacccggcaggccctggtgcacccggtgttcttcgggtcggcgacgacgggtgcgggcgtgcccgaactgatcgccgggatcaaggagttgctgcccgccgccgagggagatcccgacgggccggtctcgggcacggtcttcaaggtcgagcggggaccggcaggggagaagatcgcgtacgcgcggctcttctccgggaccgtacgcacccgcgaccggctgctgttccgcgacggcgaggagggcaaggtcacggccatcagcgtcttcgaccagggttcggccgtccgggaggcgtccgtggccgccgggcggatcggcaagctctgggggctcgcggagatccgcatcggcgacaccttcggagaggtgccgaaagcggcggaaccgtcccgccatttctcaccgcccaccctggagacggtcgtcgtccccggcggacggagcgacggaggagccctgcacctcgcgctcacccaactcgccgaacaggacccgctgatcaatatgcggcaggacgaaatccgccgggagatctccctctccctgtacggagaagtgcagaaggaagtcatccaggcgaccctcgccgacgcgttcggactcgacgtcaccttccgcgagacgaccccgatctgcgtcgaacggccggtcggcaccggtgcggcggtcgagttcaacggaaagggcccccatccgtttctcgccaccgtggggctgcgcgtcgaggcggcaccggtcggctcgggggtggaattccggctcgaggtcgaactcggggcgatgccgtacgcgttcttcaaagccgtcgaggacaccgtgcgggaaaccctcggtcagggaatccacggctggcgggtcaccgactgcacggtcacgatgacgcactcgggatactcgccgcgccagagccatgcccaccagggattcgacaagagcatgtccagtacgggcgccgacttccgcgggctgaccccactggtcctgatggacgccctgaggcaggcgggcaccagggtgcacgagcccctgcaccgcttcggcctggaggcccccgcggacacgctgggagcggtgctgcccgtcctggccgggctgcgcgccgtggtgcgtacgacgcggatgcgggaggccgtctgtgtgctggagggtctggttccggcggcgcacgtgcatgaactcgggcaggtgctgccggggctgacgcggggcgagggtgagctggagaccgcgttcgaccactacgcgccggtggcgggaggaacggtcccgaaccgcccgcgtaccgaccacaacccgctggaccgcaaggagtacctgctgaacgtcacgcggagggtgggcacgtgagggagtgacacaggtcaggtcgaggggagagcggtgcgcaaaaacgcgaaacttactcatgagtcagaggtgttgacgttccaccgaagtgcccggactgtagtggacatgtcgaagttacgcgcgcgtctgctcggcgttctcgtgtcgctcaccggcctcctcggggcaacgggcgcccagcccgcggccgccgactcccttcccgactccctctggttcgacgcctcggcgtcggccgccttcaccgtccagaacgggcgcttcagcgacggcctcggccgcgaggtcgtcctgcgcggctacaacgtctccggcgagacgaagctggaggagaacagcggactgccgttcgcctcggtcgccgacgccaggaagtcggcgaccgccctgcgcaccctcggcggtggcaactcggtccgcttcctgctctcctgggcccacgcggagccggtgcgcggccaggtcgacacggcgtatctcgccgcggcgaccgcccagatgcgcgccttcctggacgccggcatccgcgtcttcccggacttccaccaggacctctactcccggtacctcttcaactcgggcagctggtacaccggcgacggcgcccccgagtgggcggtggacgcgggcgactacccggccgaatcgtgcggcatctgcctcttctgggggcagaacatcacgcagaacggggcggtgacgcaggcgtcgcacgacttctggcacaacgcgtacggggtgcaggacgccttcctcgccaccgcccaggcgacgatggcgtacatccagcagaacctgagcgccgacgaattcaacggcgtggtcggcttcgatccgtacaacgagccgcacgcgggcacgtacgactcgggtgagacgagccgcacctgggagcagaacgtcctgtggcccttctacaagaagttccgggcccggatggacgcggcgggctggcagaccaagccggccttcatcgagccgaacctgttctggaacgccaacatcgacttccagaagcaggagggcggcctgctggacgcgggcacgctcggaccgcgctatgtcctcaacacccacttctacgaccagaaggcgatctccggcgtcctcatgtggggcaaggcggcggacgggcagtacgcgacggacttcgggaaggtccgcgaccgggccgccggggccggcaccgcggcggtggtcagcgagttcggccacccgctgtcggggtcggtctcggacaaggcgccgacggtggtcaaggcgatgtaccaggcactcgactcccgcctccccggctccacctggtggtccgacccgacggggtccgggcccgtcctgtccggcgcgcagtggcagtgggacatctacaacggccgccaccacgagctggagaacggcaaccccgacaaggtcctcacgagcggcgacgcctggaacgacgaggacctctccgcggtgagtctgaacgactcgggcaccgcggtcctcaggcaggacgcccgcctgctggaccgcctctacccgagcgccaccgccggcgcgacggtggcgttcacgtacgaggaccgttcccgggacggctcgacgaccctgacctggaacccggtccccagttcgctcccgaacgtctcccgactggtgggctcgggccagtacggcctgctcgtgtggcgttcgaacggctccacggcccccacggagctccacctcccggcgtccttcccggccgcttccacgacggtggtctccgacctcggtacgacgtccgggctgcccgcgtacacgaggacgaccccggtcggacacgcggccgagccgggcggcaccggcagtcaccgcctgctcctgacggcggcggactcgggcacggtgcactacgcgctggtcacgaacggagcgacagccccgtccgcgggcctgctgagcgcggcacgggcggagctgtcgtcctgggctgcgacgaaggtcggctagcgggacgcgaatgagccgacgggcccgttgggggaggtcaactcgccgacgggcccgtccagtccgccgggacatgggccagccggacccgctgcggatggtcgcccaccggcaccgacaccgtcttctgtcccgtcgcgaaatcgatcgccgtgacttggtcggcgccgctctccgagacgacgcagtcctttccgtcgccgctcaccgtcgcccagtacggcttggaggcggggacgagcgggccctcctggagggtggagcggtcgacgacactcgtgtagtcgtccatcgtgccggcgacgcacagcttggtaccggacgggttcatcgaaatgccgtggtggcgcgagtcgttgacccaggtcgtgcggtcctcgctggtcgccggattcttcggcagggtcttcacccgggtgatccggtcggaggccacgtcgtactccaggaacccgttgaagaacgacacctggaagtagagcttggactcgtcggggctgaagacggccggacggaccgcgtccgagtagtccgtgaggccgatcgcgtccagccgctgccgcatgtcgaccaccttcacctgctggaaggtggtcgcgtcgacgacggtgatgcgccggtcgcccttcgtccagtcctgccacggggcgtcgagcgaggtgttgacatcgccgatggccatgttccagatgtacttgccgtccttggtgaagatgttctcgtgcggcttgtcgcccgtggcgaacgagcccagctgcttgccggtgtcgatgtccagcacatgcacggtgttggccgtcgaggccgacaccgcgacccgcgtgccgtcgggtgacaccgccatgtggtcggagcggtaacccgagacggggaaacgccagttgaccttcccggtggcgaggtcgatggagacgacatcggcgaagctcggccgggagacgaccatcgacctgccgtccggcgtggagtacatgtcgtccacgagctggtcgtggccttcccctacgccgttgcgaatcgccatgaagtagatccatttgatcggatcggcgttgatctgcgccagccgctgctccttgtcggggacgacgttgatccggccgatcttcgcgaggtccccggtggacttgatgacgtcggcggtgccgtcccagttgttgcccacgaacatcacctcgcgcagcgcggcggcggagtcctgtgcggaggcggtggtcgcgccggcgccgacggtcagcgcgagggcggcggcgatcgccaggaggtgcctggatctgaggacagacatggcgggtccctgtctttggtgggggcatgacaacagagtgttgacgtgcccgcggctcggagaatctgaatacgcctgcgttcagagtggacttactggaaagtaaggagggggtggctctctccacaagactccgggcacgacaaaatcgagcgacaggcgaacacatcggcgagcgaacgaatggccgaacgggtgtgggaggacgtgtgacgggcaggctcaggcagccgaccggccgctacgggggcaagtccgcggaggagcggcaggccgaacggcgtgggcggttcctggacgcggccctccagctcttcggcgacacgccgggcttccgcgccaccacggtcgccgcgctcagcgaggcggcgggcctgtccacccgccagttctacgaggagttccgcaccctcgaggacgtgctggccgccctgcacctccaggtcaacgactgggccgagaccgccgccctcgccgctctcgccgacgcccggcacctgccgctcgccgagcgtgccgacgcgatcttccgcgcgtacgcggcgaacgtcaccgcggacccgcgccggatccgcatcaccttcgtcgaaatcatcggcgtcagcccgcggctggaggagcagcggctgcaacgccggtcccgctgggtggacctcatctgtgccgaggccgccgccgcggccgcgtgcggtgaggcggcaccccgcgactaccggctggcggccgccgccttcatcggcagcgtcaacggcctcctgcacgactggcgcgccggctgggtggacgcgaccctcgacgaggtcgtcgacgaactcgtccgccagctgctggggatcctgcgcccggccgggtggcagccggacgcctgacccgtctttccggctctccggcacgatccgccggacggacatgtcctagtgagctggttcggagatgcgtgagcagtaacggcagatccggtcgaggatctggtcggcggtcttggtccacttgaacggccgggcctcctcgttccagaccttgatccattcctcaagcgcggccttgaggctgtccagcgagcagaacactccgcgctccaggcagcgccgctctaattcggcgaaccaccgctcgacctgactgatccacgacgagtacgtgggggtgaaatgcaggcggaaccggggatgcgcgagcagccacttgtgcaccaccggtgccttgtgggcggagaggaagcccctatgtttcgtcaagccgcagaggggacctggttggtggctcggggctggatgtgtcggtagagctcgcgggcgacgtaccgcttgaggcatcggatgatctcgcgcttggacatgccctcggcggtgcgtcgccgcaggtaggcctgggtgcgttcgtcccagcgtatgcgggtctgcacgatgcggtagagggcggcgttggcctggcggtggccaccgcggttcaggcgccgccgttgtgtcttgccggaggactgctcgaccgggctgacaccgcacaacgcggcgaaggaggcttcatcgacgagcctgtcggggttgtcacctgcggcaatgaggaggaccgcggcgctgtcgggtccaacgccgacgaggtccagcatctggggccggcaggcacgaacggccctggtggtgcggcgggtgagctctttgacctcgtcggacaggtgctggacacggcgggcgagcaggcgcatcgtgaagacggcctcgccccggtaatccgcgtcgagggccgcgcaggtggcgaccagcgcagggttgctcaggcgggtgaggagttcgcgcagatccgggtcgatggacatgaggacagccttgagctggttcagcgcctgggtgcgggccttgaccgccgattccttggccagccgcaggacccgcatgtcctctacgggcccgtccgcgctcttcggcacggtggtggcccgtccggacagcaccgcacgagcggccgcgtccgcgtcgatggcatcggtcttgccgcgcttgcgccgggtggcacggtcgggctggttgacctcgatgacgtcgatgctttgcccacgcagcatcttggtcagtgcggctccgaaggagccggtgcattcgacaccggcccggcgcaggacaccgaacgaccttgcccaggtgagcagttggcgatagccgatggcggttgccgggaactcctgctgagcgagcgaggcacccagggtcgtgatgaccgcagcaacatggacatccttgtgggtgtccacccccaggatcacgtcctcggcctccttggccggggcggggacccgctgcgcgggcagcgtcggctggggcatgctggtgacggtcacgaggctccttggactgggtctggtggctgacaccggtccggtgggcggtcagaactgtgacggtgctttgtgcagcaaagcccctatcgggacacgttcaccgggccggcggcagtacgcaccgcaggaggccggggccgacagttccactccaaggcagctgtggccagttgtcgcacgggtcaggctccggccccccctgcggcacaccatgatcctcacagttgtcgcagatcacgtggacccccaggccgggctcggtctggcggtcgatctcgtcgaggaagtcccggaagtccacggcccggtgctgcgcggacagcttcgtgatcaccctgcccgtcgcggtgttcagggcggcgaacagatcgaccgtgccatgccggacgtagtcgaagctgcgccgctcgggcactccgggcagcatcggcagcaccggtgccgtccgttccagagcctggatctgcggcttctcgtccaccgcgaacaccgcagcgttggccggcggggcgaggtagaggccgacgacatcacggatcttgtcggtcagaagcgggtccggagagatcttgaaggtctcggtccgccatggctgcaagccgaaggcgtgccagatccgcagcacgctcgccggggagatccccacggccctggccagctcccgcttcgaccagtgcgtcgcgccctcgggggtctcctccagcgtgcgcaccaccacctcctccacctgggcatcggtgatggtgcgcggcacccccgggcgcggctcgtcggccagcccgtccaaccggtcgcgcaggaatctcgcccgccacttggtcaccgtgccccggttgacgcccatccgcgcggccaccgcggtgttactgccgccgtccgcgcaggccagcacaatccgtgcccgtaacgccaggccctgagcagtcgtccggcgccgggcccatccctgcaacatccgccgctcggcatcggataacaccagcggcgcaagcctgctgtcgcccatccccacagcagaccgcaaaccaccagccccgtcaccgcccaagccccgatccgaaacggaacacgactcaagtggcgacggcagaactcaaaaccagctcactaggcgacgccggccaggaggcggggcgacgtcgcggtgctgctggatgggggtgagtgacctgcgggggcgtggcatggggccgttaaggtcgcggtccatgcggacgatgcggtcctgacgcacggtgagcggggtatgtcgggcggcttcgcgtcgctcgcgcaggcgccggtcgtggtcggcgaccacggcggcccagtcgctgccgaggcggtcggccagctggtggcgtagcgcggtgcgctgccgagggggggtggcagcccagatcccctcggtcgtcagctgggggttcgcgagggcccacttgaggcatgcggtcgcgatggggcaggcctggcaggcggcctttgcctgttcggcgcgtgctgtgtcggagtcgccgatgtcgtgggcgaagagctgtggggtggcgcggcaggctgtgggggtgggggagcaggggaaggggatgcgggagtcggtctcggtggatcgcctcatggcagggctctcccgaagggtgtgggtggggtgatcagggcgctggcaggcgtggtcgtcgtagtccttgccgtgcttgggctgcgcgtcggaggcgaacctgccgaggcgcgcctgggtggggttcgcggtgatccagccctcggcgcaggatggacgggctcgccgtggtgggagcgcatcggggtgggctgttcgcacagcgcgcacggcagatcttgccagcggtcgaaatgccgggcgtcccgccagtccaggaggccgcccggggccgggatgaggcccggctcccatagcggcgccctgttgcggcgccgggcgggcgcgctcatccgacggtcaggtgggtgccggggcggcccgggcggcgtccgtggaccgtgggtgtgtaggcgtcctggcgggtcgccacgtagccggacggcttctcacgggtcttgacgcggtacatggccatatccgcgccgcgcaggaggcgggaggcactggccgtgtcgggcaggtcgacggcgcgggcggcgccgatggacacggccgggcgcagggtctgcccgtcatggtcgacgggctgagccagcagctcgcgcagcaccgcgatttcccggactgtcgcagcgggtggcaggaacagggccgctgcgaattcgtcgcctccgagccgtgcggcgagtccgccgcggacggctgcccatgccccgatgcggtgtccgatggccgcgatgagggtgtcgccggcggcgtgcccgagggtgtcgttgatggacttcaggccgtcggcgtcggcgaccaggacgtgcaagtgctcgcggtgggtgcgggcgaggcgtgcggtgcggtccatgaggacgtcgcggccgggcagtcccgtcagcgggtcctttcgggcagcgtccagttggcggcgcacgcgcacgtcgtcggcgagcagcgcggccagcgcgagcggcacggtggctgcgacgatcaatgtgcgggaccgctgacgtaatgcggtggtggcaggcatcatggttctcctgttctcgcccctcggggcggaatcgagagaggcgcaccccgagctgtgcaggccgtggggtgcgcctcttgctgtgatcattcgtgtccggtcgggccttgtggtcgggcatgctgggtggtgcttccgtctcgtgacggggataggaagtacccgggtcggccgactgcgccctagccgatgctgcggccgtcctgggacccacccggcgcggaggggatcacgccgccaggtcgtggcgctcctgcacgtggcgggcatcggagaggcgggcggccccgaaacagccacccctgctccttcgtccgcatgagcgacaccaaagtcacgggcatcgatcatgcggaaccctccgaagcggctccccgagtcagcttgaaacggctcccgcagaaatgacacagccacgcgtcacagcgcggcgccagcggcggccacggcgagcaatgccatggcggtgaggctgaggtcgaccgcgcggcggaggtggcggtacttgcggaccgcgaggctagacagcacgcggacgctggaggcgcgccggtctccttccatgcaggcgcggatctcgtcttcgtcgagtcgcgcccagtaggggaaggaagcgcggtcgtcgccgcggaggcggggacggacgaccaggagcaggagtgcggctgcgatgccgagggtgaggactgcgagtgcgccgaacgtcttggtcggctgcggcaggtccttgtcggcgacggacgcgagtccggcgagcacggcgccgttgaaggcgaggagtaaggaggccttgctgtcggtgcgtccgatctcgcctgcgactgcggcgcaggcggcgtccagattcttgtcggtgagcgaagccgggaccacggtggtcatgggcggtcgttctcctttatgcggcgggttggcgggcgggtgcggggatgtagctgagcgggtcggcgggggtgccgtcgtggcactcaaggcagcttcctaggctgcgcaaaggtgttggcggagtgcacttgttccgtagccgcggtattccagtgccaagtcgccgcgtgtcggcgtcctcgtcgaagtgcccaaccgggtacggatgaacgtgctcaggcgccaagccgtgggcattctgtgcgggaggtctcggaagggctcgtggtgcgatcccgagacagggatgatcacctcatgatgcgaggtgccttcgacgacgtccccgtgaccgcactcttccctctcctggaggctgcggatgtggactccttgaatcaggcggctggcacggtcgatacggctcgtgcaggtagagacacggcggattgggagtgggccctggaacacgcaggcttcccaggcacacagctggggactccggtcgtccttgggctggatgtcatcgagcacgccgagggaggcgaccagctggaatttttgctccaggtggtgtggaccgacctaggtcggctcgcggtcgacacggcggtgaacgtggcctgctggtgcgagaccgatcacgccacccatgacatcgacgccctgaggctcgtggttggcgaggagacctcgttgcccgaagcattccgtgccggcgctgaacgtctgaccggctggctggccgatcctcacgacgccgaccactggcgtgccaaagcgggattgcctccccggtgggtcccctgagggtccggcgccgagcacgttcgtctgtaccggactgggtacgttcacgtgcacgccgacaccgcggaagccgcgtgggccatcgcctgtcctcggacaagcagggcaaggaacgggctggctgcgttccttgcaaggcaagatcggtcgtgtgatacgcgatcctcgtgacgatgccgagttgctggccctggttcgccgctatgtcacgcccgagcggcgttatctaaagctcggcggcggcttgctgcgcatgcaaagtcgagggcgggctacagtccgcgggcgtcggcgaggctcgcggcctgttcgagcatgcgcatcgggacacggccggtgccccaggcgtcgttgaagccgggcaccgagtcgacgtcgtcgccgaactggcggcggatcgcgtccaagagcacggtggcggcgtcggcttccaggtggcggtcgccgccggcttcgatgcggatggctccgagcatgcagcgggcgccgtcggcgtcgaccagggcgtccttgcaccaaccgccgctgacgagtcgctggtgggcgcgctgcaggagggccgcgaccggtgtcgggtacaggtcgggcagcggggcgggtcctgtgttgagggggccggtgacaacgtcggtcaggtcgatgggcttggtctcgatgtgggcggtgttgacctcatacgcgatggccgcttcgtcgaggcgtgccgtcatcgctgcgttgacgagagtgaggcgttcctcgagggacagcggtggggcggctgaaggcgccgcggtggtcggatcagggcggccgagggaaggcaggcgggtggacatcggcgctccgtacgctcgcaggcgctgccgtcattcgggcagcgcctgcggggtgtggtggtggggatgggcgggccgtgggcgtcaacgtggttggcgcgcggggctgttgcccgcctgtagcgagggcgggcagcctgtaggcagggcggccaaggggaggcgcggcgtgaaattcgtgttcgtgtgcggctggtgcagcgaggaatgcgtggtgttctgtcggcgggctggattttgggggaaccagttcgaagatcctgaagagttcgactgctggtcctgcggggggacgagcacgacgccgtacagcccctggactccggctgattgaggtcaccgacagcagctggtgccgcgtcttttcttcgccgggggtcctggtctacaggctggagatgagtccggcgagtgaggtgagcgcgctgttgatgaggggcgccaggccggtcgcggcgagggtgaagccgagcagggtgcaggcgagcatggatccgaacctcacgtagccgcccttcatcaggacggccacgatgacggccagcagcacggcggcggacacggaaaaggccacgatcggtctccttggtgggttggtccggccggggcgtccagccgtcagctgtgcgaacggggcccgggccaggggcgcgggccgctctacgtgcgtcagtcctggaggaccggtccgaggtcggcgcgcagttcgcggagcacgtcctcgtcggctccgaccggcaccaggacctcgcgggccttgctgccgtcggccgggccgaccagtccgcgctcttccagcgcgtccagcaggacgccggcgagagcgaacccgacgcgcagcttgcgctgcagcatcgactgcgatccgaaccgggtggtgaccaccagatcggcggccaacatcagcagctcaccgtcgactccttcgggcagctgctcgctgtccgggctgtcccggtcgggggcggcggtgacgtcggttgcggccggggcgtacaggccgtggtcaacctgcttgaggcggccgtcggcgaccaggtcggacaggacgttgcggatggtgccggcggccgcgtcgacctggtcgcggacctccttggccgtcatctcccggtcgacgaccgcgaggatcttgtctttgacggtggtcttcttcggcttgcgggccgccggcgggggcggggtgaacgagccgatgaacgccgcgcccccgccgtcagcgtcgtcgtcttccttgccggtgggcgggggcatcgtccactcgtgccacagaccgagcgcgctgagggcctcgatctcgcggtcagtgagcgtgttgatggcgccgctctccgggaagatctcgtcgagtccgtcgggggagccgtcgtcgggcaggtgcacgtacagggtgcgcatcatggtcgcgtcggagccggtgacggtgtgccccatgccctgcgtggtctcccctgggacatcggtggcggtgccgagcatgcggtccatcagcgacatgtgcgcgccgagccggtcgggaatcggcgggaggtctgtgtctgcggcgaggccgccggtggcctgccgggcggcgatcccgccggtgatgcgcaggacgacaccgatgccgccctggacctggtcgcgcagcgagctgctgccgccgagtttgtcgaggttgagggactgcccggcgaagatcacgccgatgccgaacttgcgtccctcgcgggcgaggacgtccgtcatctgcgcgatgtcgtcgccgaacaggtcgtccccgacgaggctgttgaactcatccaggaccagcgtcagggccgggtagggggagtgcggggagtagtcgtggccggcttcctcgttcatctggccgcggatgtccatcagggcgaccgcggccttcagcagccaccaggtgaagatcgcgccggagccctgccggtcgacgtgccggccgaccgcggacatctgcgcgtcgggccgggcggaggtcacccagctcgccatcccggccagcgcccacgccgcgcacatcagcgccagcgagacggtcttgccggagccggtgacaccgaccaggaagccgtggaaggtgccggacgcggagcgcatgtggactttggcgtcggtgccgtcgtgggcggtgccgatggtgtagcggccgtaggcgtccagggtgagcagtgcgcgggtggcacggcgggccacccgcagcggcgcggcctcgtagagggtgacgaggacttcgttgccgcggctttcggtgaccagccgcatctcttcggctttgacgccgaacgcggagcacagctggtcgtagttgacgcgggcgacctcgccgggctcgacctgggcgaggatcatgccgcgggcggggagctggccgcgggcgggctggcgttccacacggacgatggtgctgccggggatagcgccgccgggccgggagatgagcgccgaccagaggtcgtcgatgctgcggccgccttcctgggtgggggcgacggtgagccggatgcggccgggcccgtgctccgtctcgcgcagcgacacggccagcgtcggcacaccgaagcaggcggcgatggcgtcggcctcaatccggccgacgggcttgccctgcggagcgacgatgtcgcagctgaagtccgggtggctggccgacacgatctgctgcacattctccagccgcgtctggggcgccacttcgtgctggtcccacagccgcatcaccagcccggcgaacccggacgggtagacggtggtcaggtcgccgggcggagtccaggtggagcggctggcgggcagccaggcggacatcagggcaccccatccgagggcgagggggatctcccaccagctgttgccaggggcgacggcggccgcggtgtagaccgcgctgccggtgagcggtccaaggagccgctgccccgagcggatcgccttgcggaagtcgccggccttgacgcgctggtacagccaccaggtgctgacaccgctgatcgcggcgacggacgcgtgggcgggcagcagctccatgctgggcagcaccgcgagggcggcggtggatgccccgtaggcggcgagttctgttttcgcccgtgtgggcatcctgcgcatcacggcagatcagtcctttccgcattgagggcaaccacgtgggggctgcacccggatcgggtgcagcccccacgaggtcgtgcgagtcgttcggtcgggtgctggtcagatgggccggtagaagccgggcttggcctgtcgggccctcgatgcggtggcggcggcgtggatgggcccgtactccgcctggtgggcggccttgacctcgattgcggcctggtgagtctgctcggccgagctcagcagccgcttgcagccgccgacgacctgcccgaacgcttcgccgacctcggcgacggccgcgacgtgccgggcatcggcctccgcggacgcgcacaactccgcgacgaccaccgccgaatcggcgttgacgcgcatccgctgcgcgagctgctcggcgtgctcgaacaggccggctgccgccttctgcagcgccgtgaacttggtgacgatggacaggtagccgttggcggcgccgtccgctgcgacggcaggggcaatctctcccatgcgatgtctccccggtcagttctcgttgtggatgcgggcgctgggcgcggccaggcctgcgtcgagggccgcggtctgggtgggccggtagtcccgctccatcgcggtctcttccgcttcggcgagttccgcggcgttcaacgcggccttggccatgcggttggcgttgacggcgagcatcccgacgctctccatcagcacgcccatggcgcgcacggtgcgtgctcccgtgatgttgtggttgttggccaggtcgttggccatcacctccagctcggcgaacaggcgccgggcctgcctggccaggttctggcagtcgtcgtaggtctccatcccggcggtggtcagcagggtcagcgctttcacagcaccgtccaggctgatctccgtggcgtgccggccgaccatggcgttcgcgggcgggggcgtcacctggatgacgggcgccgagctggatgcggatgggggcatagggatggggtcctttctgcgggtggttcccggccgggtgccggccggacgttgcggagcacgcgaaagggcgggcgggccctgcgcgggcagttgtcggcgaggtggggcgatggcgtccggctcccagcggcgggcgtgcgttccgggcgggtcgacctgctccaccgtgatcgtgatttccggcccggagctcgtgtcgaacggcgagctacggggaccggcgtagcgggggcccggtccctttcctgcaccgggaccggaggtacccgaggggccgccgccgttgcctgaaccgggcgggctgggcgggctggtcgggccgttggcgttgggggagcggcgtcggccggtgcgggggcctgcctgggccttccaccggtcgcggcgtttggcccaccgctcattgaccgcctcgaacacagccgagcggaaggtgacccgcccgttcggcgaccagccgtcgttaccgcccttggtaccggccgccccgccgttcccggtctttcccgccgcgtccgtggatgcggggttgcgggcctggcggttcttccaccggtcctgcagccggtcaccggccgcctcccagaacgtcggcgccgtagcgccgccgcctttgccagaccgggtcttcttcagcgcattctggatggcagccgcccggtcgtgggcagctcccttctgctgcgacccgccgccggcgcctgctgggcgagggtgtttgcccttgccccaccagtcggcgacggcctgccgcggcgagcggcgccccgccccgccaccacccttgctgcccccggtgccgccgctcgtgccgcccgggccagggcttccctgacccttgccgctgcccttgccgttggcattgccgcggccgccgccggcccccgggccgcgacccccgccgccgaacagcccggcacctgcccggccgcccccgctgccgcgtcccgccgtgccgtccgaacggccacggtgagcaccgtttcgggagccgacgccgaacaagcccgctccggaacggccttggccaaaccggccggaggaaccctgcggagagccgttgaacagccctctgccgccaccccgggagccgcccggaccgacgccgccgccccgtgcggggccgccggagccccgtccgagcgcgctgcggccgtagtcacggctggactgcacgcccccgccacgatgggccttggcgcgtgccgcgtcggcttccgcgccgtgccgggtggcatcggcgccggccttcgcggccagcagctccatctcccgctggtgcgcggcggcttccgcgcggcggggcccggattcctggatccaggtctgcagcccctcgaacgcggccagggcgatcgcgaggatcgcggccagcgacagcgcgccggcgcgcggcgcccccgcatcggggggctgctcgccctcgttcaggccctcactgcgcagcgccgcccccgccgtcgggggcggcgcgtggggtacttcgggggcgtcgaacgcggaaattcgaacaggcccggggtcggtgacgctgtcctcgtcggtgccgcccagggtgggtgcgggcggcacgggcgggggcggcggggagccgatccggggcagatgacgcaggttgtccgggggctcgtcgtcggacacaggccctcctctcacggtgactgccggtgagggggaaggggcgcctcgcacgtgtacacgtacgcgtggttgggagccccgtcaaccctcatttcggcggtgatgatgatgacgatgacgattactggcagtgatcccggtagatccgttccagctccgccgacagcgcgttgaacacgccgtggtcgccggtgcggcgggccttctggatggcggagaccttcaccagatcgagccagacgcggaagaactcctcaggcccgcgctcgccttgagcgcgggcctgttcgaatcggctgttccagtgggccgccttcctcggggacagcggcggccctgccatcaggcgccccgccgctgctggcccgggccgaagaagtcacccagcagccgggcctggcccgccggttcgccctcctccgtgccgggggcgagacgctgcagggtctggttggcgctgttgtaggcggtgacctgcacgttctgcttacgctgcgccttcttcagcgccttgtcctcgcgccggcgcagcaccacgtcgggctgggtctcctcgtacgcggcgaccacgctgttgatggccttcgcggccctgcgcatggcgcgcgcggtgtcccgcagcggcttgacccgcttacgggcacgggacgctgccgacaggccccagggcaggtcaccgtccaggcggcggcccttcaggtcggcctggacggcgtcggcgagagcgtcgtaggcctgcgcgtcggagagcaggctgccgcggtgctgggcctgccagccctcccgctgcccgggcaccgccagcgcctgcacgcccgtcgtcacgcgggatgcaatgtccttactcatcaggggttttctcctcaggtggggtggtgcagggatccggatccgggtgaaagtgggggtggcgtcacggcgccttcaccgcgtccccgagttgtcatcagcagctcggggggccggtggaaccgtcggacggtcgttgtgccaggtcagggccggtagccgcctgccacaagctcggcggcctcctggcggtactcggaggcggtgccgggcgaggtgaccacgagttcgcgctggatctcggcgagcggcagccggtcggccatgccgtcgacggcgaggatcatccgggcgaccttgcggaccgcgcgctggcggggcgtgagcttcgcggcgtcctcgatttcgaccgcgcgccgctcgatttcggcggcagccagtcgcgtttcggcggcggccagttcggtttcggcttcccgtcgccgggccgcctgggtgttggcgtcggcgaccgcgcgccgctctgtttcctgcgccgcgagtcgctcggcttcggtggcgcggcggcgcgtttcggcagcagcccgctctgtttcggcagcagcccggtcagcttcggcagcacgctggcgggcttctgcgatctccaccgtctcgactgcctgagcctccgccacggcgacccggtcggcctccgccgcgagcttccgcttctcggctgcctggcgctccagttcggccgctcgggcgtccgcagcggccttcgcctcgcgctcctgggatgcctggcgctctgcggctgcctcgcgggcgcgggcttcggcgatgacggccgtctccagtgcctgctcttccagctctgcggcgcgctccgcggcactggcctgggctcgggcgtgggcgcgggcctgggctgtggtgccctctacgcgggcgcggacggtctccagctcgccgtcggcctccagccgcctggcttcggcctgcttctgcgcgagctcccggcgcgtctgcgcgtccaggcgccggcgctccgcctcctccgcccgagcctccgcctcgcgttcctgctgctcaggcagcgcgagcgcctgagcgacggtgtagccgtgagcggccatcgtcatcggcagcagctcatcctcactcgccttgctcaagtcgccatgcttccgcttgagccactgctcgtaggcggtgaggtcctgctgacggcggatcatctccgggtacgaccggatcccgtgcagcctcatccggcggtagaagcgcggggtggcgaccggggcaaggatccagcggtgcagcgggatccggtcagccgccgtacccgcttcgagctgcgttttcttgatgaacagcctgcgcgcggcttccacgccgatcacgaagagcagcggcatgacgccgtgcgaggcggccctgaccgggtcgcctgcaatgtggccctgcgaactggcgttgaaccagatcgtcgcgaacgtcatgccgtgggcggccatccgcagcagcggccacggggtgtccttgcgaatgaggtacaggtccagcgcgaggaacacgatgatcgacgcgtccacgccgaccgggaaccagggcgccaaatccgcactgaatccccaggtcaatgccttcttcgccagggtgctgtacgacatcgcgaagccgatggcgccgatcagcggccccccgatcgcagcggcgaccgacaggacggtcatcagccggtcatgcgcgggcttgatcgcgttccgcttctgtgtccgcgaaacgttggacgccgctcccgaaacggtcggcggcgcgtccgaaacggcggtcggcgggcgcgaaacgggggtgtcgggtgccgcgcgctgcggcacttcagtgatcgtcacgggggcctccgggagagggggtcaggggtgtgcgcgaaacggcgagggctgcccgcgaaacgcgggcggctgctcccgaaaccggggtggctggagccgaaacagccgacggcccgcggtgcgggccgtcggctgaggcgccggcgcgagggcccggttcagaagcggttgggggcgagctggcggccggtgtcgtggtcagcggtcaggtgcgcgacggccgcgagccgggcccgctgctcgtcgatcgtcttgacgagccgggccacgagcggggtgtcgtgctggtagtacggggtggcccggtaggcgctgacgtggtcgaccagccagccctggatgtcgaccccgagttcagcggcgacgaccgccaggtccacctcgtcggaccagtcgtcgacggcgctgtgctggtcgtcgacgacgaccgagagttgctccgcgatgtcgtcccagtccgcagccatctgccgggcgacgcggtgcgcgtccagcagccgcagcacctgcgagcgccaccggtcgtcggggagcgtcgcgaactccgcgaaccgggacatcatcgtgtcgtgggcgatcgtccaggccgaccaccgtaaggctgcggtctccagcagcggggcggcctgctcgcgcatccggcgcttggaccacaggacgcgggccgcggtgtactggtggccgatcatcgtgcgctgctcggaggtgagcgcaggatcgcggtacatctccagcggcgaggacggttcgctctcccggccggtgaactcccggaagagaaaacgcacctggtcggggccgttctgctccacacgcaggtagtgcgggtggtggtaacgagcggtgccggccgccaggagagccgccgcgtcaacgggggccggggcgaccggggccggggcggcgggggagaggtgcgagtcatcgagcgcgtgggcgagcgggatcgtgtgcaccatgtgctgctctccttgttggagtgtggtccgggctgtccggctcccctggaccgcgcacaggccggccctcgcatgaagcggagggccggcctgtgcgggtcaggcaaccgacagaggtggcggtgtcagttgaggcagggtcagcgccgttgctggcgctgaccgttgaggtaggcgtcctggagccgggtgaacgactcgtacaggcgctgtcccgtggggcagcggctcgtgtccgtacaggcggtgcaggtacgggcgtgctgccggtgcgtggtgtgcgcgtcctggtagcgccggtagaggtcgtcaggcatgcgcggcacctagcgcttggcggcgcaggcggcgcacgtaccaccgggccagttgtcgaaccagccactgcactgatcgcactgtcccgcgttgcggcacacgtgcaggcaccggcgtaaccgggcgagctggcgcctcaccgggtgaccgcctcacggaccaggtggtccgaggcagtccacacactgccgatcgcgaacggctcgccgtccggccgcagcacgtcacggacgatcagcgcccactgcgcgcagcggcggtggaggagaccgcgggcccgctcggggtcacggatgacggcgagaacctcgaacgccccgtccgtgttctggtagatcgctcccgcgcggcgagggccgatctggtcgtcgaccacgcgccgcagtgcttcgacgatcaccgggtcgccggtggtctgtgcggtccgcgggtgcggccggccaccggacggggtgggccggtccggtgtccgctcgtgcgggatcggccgccgcggcaacgggggccgggaggtgctctcggcaggagtgatcagagctgtcatgctgggcatgcaggtcagtcctttcgcgagggacctgcgacaaagaacccccaggggtgcctccctgggggttcgtcgcattttggccccgccggtagggcggggagtgcgtcctgcgcactccgccgtacgccgctcctgccgcgagggcggagcggtgtgcgacgcgcagcgcaggctgtatctcagctgctctggtcggtgagggttgtcgtacgagtagccacggccccggcctcccctctgtgagatggccggggccgtggtcgttcgtccggggcggttcagcgcttggggtggagcgtggtcagcgggaccgcggggcactccgtaggggcgtcgccggcgggcgtcgcccagcggttcttatcggtggctgccacgcggggcaacaccgcgtcccagtcggccacgcgcccggccagtgtgcgctccgcacgagcccgcagggtccgatcggtctgcggactgaatgctttgggcagcaccgtagtgctctggcggctggaggcttccgtaacggcgtcggccaaggcctggcgccattcagggatcgtcatgtcccactcgatgcggcggttgctgctgcggcagcggatcgcatcggcttcctccgccttaccgatgtggtgcgggaccagcttctgaaccttgctctgcatgccggtgacgggcacccaggtcttgcagtcctcgcagacgagaaccgccttcagcggctcgcgcaggtcgatgtgcgagggcaggagctgggagagcttgagggcagggcggctactggcccgcttcgtacgggtccggcggggtcgttccttggcggtgggcatcgcggacgtgatggtcatgcgggatctccttgcgtgcggaggggtttgggctgcgtcgcggtgctctctccgcccgccaggcgcacgggaagcccggcggcctggaggacggacagcgcatcagcgctgcgacgtgcacgcagatcagtcgagacacccgggggatttggtggagccatcaaccccggccccctcttgcgaggcggacgacttcctgcggtcttgcggtggtgctggtgcatttgttggtcgcccaaaaccttgaggtgcggggccaacacactgaacggtagtagcactacaagtgcgagtcaacagtctaagtgctacctagcactagggctttggatgtgagaatgtgtccatgactacgcgacatgaagatggaggggccctgtgtccaccggatttgcactgacagtgcggttctccttgcgagacaccgaggctgcccagcagttcgacgccctggtggccaggaccgcggaagggatccgtacggaacccggcaccctcgtctacgtggcgcacacgcccgtagacgagccactcgtgcgcgtcttctacgagctctacgccgatcgtgatgccttccaggcccatgaggagcaggcccacacgcgacacttccttgagacgcgcgagcagttcctgaccagcaccgacgtggtgttcctgaacgagctggaggagctcagcaagcgccctggaacggaggggccatgaagccaacgggcaaggacgtcgatccacaagatcgagtctttggccagcgcgtccagaagctccgcaaggaacaacggcgcacccaggccgagttcgcggctgctctcggaaagacgagcagctggatgtctcaagtcgagcggggtatccagcccgtccagcgcatggacctgctgcaacagatcgccgatgaactgggtgtgtctgtacagcagttgcgcccgagcgtcgccgacggaagcggaccatcacagcaccccgccccgctgtcgctgtccaacgacttggacgagacgcggagactgatctccggtcacccggcacttcgcgccttgctggccagccccggcaccgagggcgcaagatccgtcgaggcgctgcgcaaagacgttgacgacctctgggagctgacacacgcggcacgaatggcgcaggtcagcgtcctggctgtagagctgctccctgagcttgaacggaccgcccgcatggcgccggacgagactcgatcggagctgttcctgctgctctcccggacgtaccaggccctttcggcggcgttcgttcggcaggatgaagcagacgctgcatgggttgccgccgatcgtgcgatcttcgccgccgaacggtccggcgacccgctgcacgtctgcgctggcgttttccggatgacgcaggcgtttgtacggttgcgcagcctcggccaggccgaacacgcggctcggaccgctatcgacgccttggaagagcaggggggcaggtcgccgcaggctctgtccgtcctcggttcgctccatctggccctcgcgctcgttcacgcgcgagccagcgctcgggccgaagccaaggaggagatcgccaaggcccgcgctatcgcggcgcagcttggcgagaaccggaacgacttcaacctggagttcgggccggtcaacgtagagatccaggccgtcagcactgctgttgacctcggcgacgcaggtgaggccctcgatatcggcctcgccatcgacgctgagggtctgtcgcccgaacggcagggacggttgctgatggacctggggcgagctcacgcgcagaggcggcacggaggcgaagccctcgactgcctgctgcgcgctgaggccgtcgcgccggaaactatccagacgcaccaggctgctcgggcagccatccgcgagctggtgctggtcgccggcgcgaacgcatcgcgtgatctgctggagctcgccgaacgggctgatgcacttgactaacccgacgctgcaccgacctgcgccctgacgatcgatatccactgatctgcctcccacccgtttcctcgtgtgggggccatcacaccggccgtaacagcggcacagaatcacagcggcttgtcgaagcctgtacacgggctcgttcacacgttttcaacatccgcgtacacatgggatttcgggcttcggccatagggtccgggatcatggcgactacggaggcaagcggcgtggggaagcacctggggtggaggcccgagcggctgcgggagcagcgggaggctcacgggctgacgcttgagcaggccggcgagcagctacgagctctcgcggagcaggccaagctcaagggcatcccggcggcgaatccacagacgctgtggcagcacgagcagggtgaggtctacccgggaccgcactaccgccgggcgtactgcctgctgtaccgggcgaccgaccccgagctgggattccgcaacgccctgccgggcgaggacacccagttcaagctgacgccgatggacgaccagcgcaacggctcgcacgtcttggccgtggagcgcgcgctgttgcagatagggggcaccgctgaggcggatcctctgaggctgcagcagcggatcctggatgcctggaagcgtcgccacaccggcggtgacccgcaccgcccctcggtggtgctggtcggcgggttcgccggcagtgggaaaaccgagttcgcgaggttccttacccagctcaccgggtggccactgctggacaaggatccgctgacccggcctctcgtggagcagctgctggtcgcgctcggaggcgatgcgaacgaccggcataccgatctgtaccgcgagcgcgtgcggccggtggagtacgactgcctgatgcaggccgcctacgccaacatcaactgcgggatcagcacggtgctgactgcgccgttcataggggagatgacttccgaggcgtggatgaaccggctgatcaacaagtgcaacgccctgggcgtggacgtgtcgccggtctgggtgcagtgcgacgcggagtccatgcgggagtacatcggcttccgatcggccgcgcgcgatgcgtggaagctccagcgctgggatgagtacatggcgaccgtcaacctggagctgcgcccggtcgtgccacacctggtcgtcgacaacaggctgggcacagcgatttcgctggccgaccaggctcggcacgccctcagggcggtgcacggatgagcagtaagaagctgggcgtcatcctgtacgggccgccggcctcaggtaaggacaccgtcgcgcaggccctaagcgaactcgatgcaaggtacggccagttcgcgcgtctcaaggtcggctcgggccggaccaccaggtaccgaatgggcacggcggagcagctgcacgacctagaggccgcaggcgccgccatctacacgaacagccggtacggcaacacgtacgtcatcgaccgaccggggatggactccgcgttcgaggccggggtgccagtggtgcacctgggccagatcgacggcatccgcgccctggtcgacggctacacggccgactgggcggtggtgctgctgtggtgctcgcaggaggtgaccgcgcagcggtccgctggtcgcggcgacagtgacaccacggcccggctcgcagcgtggcaggcgacccgcgaagaccttgacgcgcacccggacatgcgatgggacctcacagtggacaccgaggccacggcagcggaggagtcggcacggctcatcgaccagctgctgcacgcgcgggcgggagtgacgacggcatgacctacggctgggcgaggcggttgagggcgtccgtgagcgtgagctcgccgtcgtcctttgcgtcgtcccaccgggccagcgtggccgcggccgcgcgcagcatctccggagggaggcccgcggcctcgagcatgtcggccgcttcttccagctctggcccccaccgccaggcgcgtgccgccgtcttggcgatgtactcagtctcagcgaggtatgagtcgctgcgctgcgaggcgatggtgatgagttcctggtcgactccgtgctggcgggccaacccggtcgcgagggccacgagcaccctcgacgtcttctggaacgacgcgtacgcgagttttagcgcggatgcctgcccgatctcgctgcccagcgtcttcgtacgtacggccgtgccggtgaagagtgcttcgacgcgctcaatcgcggcggccggccccgacaggtacagcgtgggcgacttgccgccgaccggcggtgagccgaccacgccgccgtcgatgacggctttggcggatggggtgagcagggccttaatgcgcagcatgcgttcggggttgatggcgttggcgtcgacgtaccagccgccgaagccgtgcgaggcgacttccgcggcgaggtcttcggcggccgcgggcgggcagaggctgatcacggtgtcggcctggtccaggagctccggcagtgtggcgaccggctgcagcccgtgccgctctgcgcggacgatgctcgccgggctccggcctgctgggcaccacagcaccgtcgccgcgttggtcgcggcgcacgcggcgacggctgcgcccatgctgccggggtggaggatgccgacggtgggctggtccacagagctactccggtgggtgggtgagcaggtagtcgattgcgtcggtgacgtcgtccacgctgtggtgaggtacggagagactctcgggccaggggcggcctcgtacccagacggtcatcagtccggccttgtgtccgccgacgatgtcgttctccgggttgtctccaatcatccagtcgccccgcgatatctgagtcccgcagcgggcggccgcgagctcgaaaagccgcggatcgggcttgcggacgtcgatgtcgcccgaggctgcgatcccgtcgatcaggtcagcaagacccgtcgcgcggatctttgcgcgctggatgtcggatgcgccgttcgtggcgacgccgatgctccaggacgccgctttgagtcgggccaggctaccgaggacggcgggccggcacgtgaccgcagcggccatccggtcgacgtaggcgcgccagagctctccggcggattcatcgatgttgaagatctcgcgcacacgggcgaagtcctcggcactcgcgcggtcggcgagttcagtgagcagccagtgctcaacatcgggtccgaggccgtggcttcggctcagggcggctacggcatcgccgaacgcggagtggcggtcgaccaaggtgccgtcgaggtcgaagagagccaggcgcatgccggtgaccctatctctcctggtcgggatggcatctcctgcgtggacggctccaagcggcgtggaatctgcgctgtgatcgggcgtcagacttatgtccgacacgtcatcagcgctcggcactgcacagcgcgtcggcggagtagggtgtcgtccgactcgatctatacagaaaaaagcccccaggaccttaggcaagtccataggggctctcgaccggagaaactccggtccggcgaaccacctttgagcaagaaaggcggacgcgttatgcagggtacccgtacccgcacgcagacacacagcaccccgccgtggtgccagcagcgcgtgagcgcccgctggcccttcggcggggtgttcgtgctctctgccgcggcccgcacctctgatgttgagggggccgcgatgacgtaggccgtcaggggcggcgcctgccaatgcaggacttctagccgccctgggcgcctgactccgaggtgatgccagtcgcctcgatcagcgccccacctgctctccgttggcctgccagggcttgccggaggagctgcccgccccggttccagccggctgcgagcggttcgaacttggttctcccagaacccgaagcaccccaaggggacttcgttgtgcccaccttcagagaaggaggtcgtcgctattctgcacgacgtcttgggctttcgccagcccacttatgcctgtttcatgcacatttgcggacctgtgatgtcccgtctcacgcaatctcacagcccgattcattcggtatgccccactgttcggggcgctctccaggcactccgtgtcatgttgtggccactggatcctggagtggtccgcgacggcagcatgctgcctcgggttccgtgccgggtgatccggtgagcggggtggcggcggccgccgtggtgatgcctcgggtgccggggccgcggcatcgtgtgctgcggtcggtgccggagcaaccgggtttggtgccggtgcgtggtccgggtcgtccgctggctcttggccgtgatgcccggggccggctgggtggtgcggtgcgcgcgctgctggaggcgccggggctggagggtgcgaaggacccggtacggctagcggtgatcgtgctggcggcgcggacgccgtcggcgacgggcgtggtggagatccgtacgggtgagctgggccggtggctcgggctgtcaacttcccacgtcgcctccgaggtgctcccggcgctgcgccagtccggcgtggtctccatcgacacggcggagggcgagtacggtcaggacgacgggctgacctgccgtgtgctgccgatgtgggatgcccagaacaaggttgggcacccgctgtcattgaagaagccggagcttgccaccttgctgcggctgatggaggccctgatggcgccgggctgggtgcacagggatggacgggtgaccccggccggactgctgggtgcacgtgcgaggcatggtgcggcgacggaccggttggctctgctactgctagtgctggaggcggcggagaccggtcgggtgcggctgtgcggtggccgggtcgagaagcgctatgggcggccggtggcgactctggcacggttgctgcggtgctcgctgtcgcggtcggagcgggtgctggcgcgactggagggttttgggctggtggagcgcccgcggcggcagaccgtgtccgggttgcggcaggtgtcgcggctggtagtgcctgccgtggcggccgcgcacgctgaaggacgcgctgcatccgggagcggcggccgccagggaagcactgatgctactagtgccgatgttgcagaccccgcaggtacggcatggcgtggtaaggactccctgctgccggaaaagcagcaagtcaagggctcactcgagtgctgcggcgccgatgggggagacctcgcgcctacggcatcccttcacactgatcactcttctgtgtttactcccggtggttctgctgagctctctggtgggttttccggcgaaggccgtggtgaggaccctggtcggccggatcacgtctgcgcgcacgaggaccgggccccggaagctgtcgtcgctgatcagctgcagctgatcgacggcaaaggcggcccgctgcacggggaaaagcagtccaagtccccggatggtgcagggtggtcggcggctcgcactgctggcccttctcggctgacggttgtggacgatggccgcgggctgcagcaggggcggggggtagctgacctcccggatcttggtctgcgggccgggctggccccgatcgcggatctgtgggcccggcttagccgcgggcagcaggccgtcacccgccgggctgccctgcagtcgctggaggcgttgtccgggatcgtcgacgaacaggtagcgccgcagctgctggccggccgtctcgccgaccggctggcggaagtcggcggcgaggccctggtgcgcgagcccatgggctggctgctcggccggggcctggtccagcgccctgcctgcccggacctgaggtgcgacgacggcatccgcctggacaccggcgctgactgcccgacctgcgagaatatcgtccatatccggcgcacgctgcggacccgagtctcggcccgggtggaggccgagatgccgcacagcgactccgccacgcgccgggccgagcttgagcgccgcctgcgcgaggagaccgccatagaggagcagcgggcgcagatccgtcgggcccgggcctcgcgtgaggccgagcagcgtcagcaggcgatcgagcggcgccgcgctctcgaggaggaggcggatctggctcgcaggcaggcctcgtgcgcggactgcggtctgcccgagtgcgcaggcctgtgcccggcgtgctcctaccggcggcgtaccgaggaactggtgcgggaggccgtcgacctggccgtcgccgtgcgggccgatctgtcggacgcggccgcggtcgccgagctcacccagcggtgcgaaacggacacccgcgccctgttggcgtcggcgtgcgagcgggcctgcggtccggacgccgatccggctctggtcgcgttctacgcgccgcaggtggcgcaacagatccgggacgaacggcgcgcggcggcgctgcgccggctgctgggggcggaggatgtggtggtcgaggccgacgccgcgtatgaggcgtgcctgcggcaccgcggccgcggtgcggaagaggctgcagacgcggcgggccgccgtaccgtcgagttcctccttcgctggcgcttgggcgaactgcacgctgtccgcctgcggccggccgcaggcggggtgtcggttgacgcggcgtaagcgaggtcgctacgtcgatgtccgacgccactagaggcatcaactgccttgcaacttgggcagatgagcgcatgaccttcgagtggaggacaccgccaggcagcggcatgaggactgccagcccggccgatggcgtccctggcggagctgcccctgtgggcgcggggacgacttgccgcggatctcttcggcgcccttggccatcgaactacccccgctcgcgcggagagcacgcccgcttcccgccctcgctgatcgggaagcacgaccaacttccgcttgcgcggagagcacggccggccgaacgaagaagccacggcgcggcgcgatccacctccgctcgcgcggagagcacaccctgagttcggtgtcgactggcacgcactacgacccacctctgctcgcgcggagagcacgcggctcagggcggggcctggaggcgggactacgacccacctccgctcgcgcggagagcacgaagtgagcttccggttcgtggtggtgacggccgacccacctccgctcgcgcggagagcaccatggcgaagtcggcgccttcggcttcctcggcgacccacctccgctcgcgcggagagaacaacgggtcgcgccgcaactgctggccgaccgtcgacccacctccgctcgcgcggagagaactggacctcaccgcgctggatccaggggaacggcgacccacctccgctcgcgcggagagaacctcatcctcggcatcgacgagagcatcacccacgacccacctccgctcgcgcggagagaacttcgtcgctgtcagctctgcccgcagctccgtcgacccacctccgctcgcgcggagagaaccttctcgtcttgcaggaacgccagcgcgccggcgacccacctccgctcgcgcggagagaactgcggcaccgagacctcgaagccgtcggcgagcgacccacctccgctcgcgcggagagaactggccgttgtcgtccctggagacggagccccacgacccacctccgctcgcgcggagagaacgaccgcttcctcgtcgagcaagccgtcctgcacgacccacctccgctcgcgcggagagaacggggtgtccggccgcacgagaagctggtgcgtcgacccacctccgctcgcgcggagagaactactggcaccagagcctcggccggaacccgaacgacccacctccgctcgcgcggagagaacccctggcacctccagcgcatggccgccctcgacgacccacctccgctcgcgcggagagaactcccgtttcgggccccgccgtgtagctgcgagcgacccacctccgctcgcgcggagagaacacgaagacctccgcaccgaagccgcccgccaacgacccacctccgctcgcgcggagagaacagccagtccatgccgaagcctcgcgggtcgaccgacccacctccgctcgcgcggagagaacatgggccgctgctccgtcgagggctcgcagatcgacccacctccgctcgcgcggagagaacgacagtgagggctggctagacaagaacggggacgacccacctccgctcgcgcggagagaacagccagtccatgccgaagcctcgcgggtcgaccgacccacctccgctcgcgcggagagaacgtctcggtaacgggcggaaccaatttcatcgacgacccacctccgctcgcgcggagagaacgccagccgccacgcaaagaaggtccgtgacgacgacccacctccgctcgcgcggagagaaccccgcttcagctcgcgaggggctcggacagtgcgacccacctccgctcgcgcggagagaacaccgacagtgtggtctggccgagacctgaagccgacccacctccgctcgcgcggagagaacggtcgacaggcggtaggtgtcgacgccgaagccgacccacctccgctcgcgcggagagaacgccaagctggccagcgccaagggcttcggtggcgacccacctccgctcgcgcggagagaacccgacgacggccgagctcaacgcgggcagcgacgacccacctccgctcgcgcggagagaaccatccatcccgtgcacggtcctgccggtggaccgacccacctccgctcgcgcggagagaacctgtaccggacctagagcagcagatcgcccagcgacccacctccgctcgcgcggagagaactcgatctgcgactgccagttggagatgttcagcgacccacctccgctcgcgcggagagaacgagacggtgacccagatcagggtgatggccgtcgacccacctccgctcgcgcggagagaacgttcgcgatgccgtggacgttggtggtgtccgcgacccacctccgctcgcgcggagagaacaggtgctaaagcggtagcattcacgggagctccgacccacctccgctcgcgcggagagaaccgatgcccgcattccagcctgcgtagtacaggcgacccacctccgctcgcgcggagagaaccaccgagcaacgcttctgccagttacggaccgcgacccacctccgctcgcgcggagagaacgctcacggcccgctcggctgctgctgccgccgcgacccacctccgctcgcgcggagagaacccttcctgacctgcgtttctacagggggtttgccttttctttatcttctcgattgaaggcgatcagggtgaggccgtcgaattcgacggggtggcggcggcgggatcctgcagtgcggagctcgaagccttgctcgttgtcgctggggtaggcaaggaccgacatgccgtcaccagtgcatgcggcgaccgcagtccataattcgtcgcggacacgggcggacacggttccgatgtacagctctggggtggcttccaacaaccagcgtgtgagtgctccgcggaggtggtcggggacggcggtggcggagagcacgatcattgaggccactgagtgtgttccctcttctgtgtggtcatgtatccgtcccgtggttcatgccaccggggactggtccggaaatggggtcccatagatcgacgagctgttcttccggatcggggatgtcgtaggcggagccgaggccgaggagctcctggatgtcgccgacgatgcgcgggaggagtttgaacagacgtagtccgtcgcgaaaggagcgccgggcttcggcttcggggttcgtggaggcgtggagggaaaacgcgagggggattgtcaggtcggccttgtacaggtcggcgatgtcgtagacaaaagcctgttggttgccgttgtggacgaagccaagggcggcggagcagccgagggcaaggatggcggcgtgcacgatgccgtagaggcatgtgttggcggcggagagggcgagattgactgggtcttgggtgtcccaggaggccgggtcgtaggcgcgacggaagcggccgatcttgtactgctgcgcgagcacgcggtaatgcgctttgacgtgttggccttcgaacccgcgcagttgggcgagtgtagtgccgggcgggacggtggcctcgccgaagcgtttctcgtacatggcggtggcgacggcgagtcgtcgggtgtcgtctgcccaggcacgggtttggcgttcgagccacgtcgtggtgagggagtcgggaagggcggctgcgtagcagcggactccgccggcaccggtgatcaggacggtcgtgccgtggcgggcgaaggtggccagggcgcgggcggtgatggatgtacccgggccgagcaggacgcagccgagcgcggcggtgggcacatagaccttctcagtgccccggcgctcgctggttacttccgcgcagactccggtgtcgtcctggtggatacggacgatgtccaggtagaggaaggacagcgaatcggcgatgcgcggcagcatggcgacggtaggggaggcgagtttgcgccgggcgcgggtggggttgggctgtgctcctggtgtggctgcagtgttcactgggcctcgcgtgtgggggcgatgctgaggagaccgcagccgtaggcctttccgcggccgatgccttcggtgatcttctggcggagcaggtcggggtcggtgatggtggcggagccgtcgaagcggatgcggttgtggcggatgcgctgtttgtcgccgttgccggctcgtacgccttgggcggcgtcgagggggtgggggtggagggcgaggggtttgagtccggcggcgtcggcttggcgggtccaccattcgtcggcggcggcgccgttgagggggacgacggcggggaggttgtagagggcgcgggtgttggcgccgggtttgcggacggggcttgcggtgcagcggtagcggatggtcaggccgggtttgagggcgtccaggagggggtccagggggcgggtgatggcttggccgtagccgtcggggaggcgggtgaggtcgggttcgtgggcgctctgcagcaggatgtgcgccccggctggggtgtcctcgatgcggaagagcacgccgaagcgggcgcgcgggtcgggtccggcgtcgcaggggtagagcgacatgaggcggcggtgcagtcccatggctgagtcgttgccgccgaggtcacgtcgggcgtctcgggagcgcgggtcggggacgatgcgggtcagccagacgctcaacggtggctcccttctgggtggttgagatgctcgtgcaggtaggtggcgaggctggtgaggtggtctgtgcccagcccggtgaactggtcggcgggcaggtggagggtgcgtcggtacagcgggcgggctcggtaggcgcgctggcgtgggtggaagttcaggggctggtcgttgacctcgccggaggggtggctgccggtctccgcgtccggtgggcaggtgtcctctggcgtgggcaggtggtccagggggtggtcggagaggaactcgatgccgtgtgggccgtgttggggcggtggtgcggcgatcggcaggtggacgaggtggtggagggcgtcgtcgaagcggccgagcaggagggggccttcgggtgggcaggagcgtcggcccaggtagggcggccactgcggagagctgagggctgtggcggtgcgggtgagcaggccggtgttgtcggggatggcggtgagggcgatggtgaagacggcgtcggcgaggtaggtgcggtgggtgaggagggtggtggtgtcgccgctgcgtttcttgccctcggcggtggtgacggtggcttttgggggcaggccgccgccgacggtgtgcaggtcgcgcaggagcacgccgggacggtcggcgcggacggtgagtgacagccgggccaggtcgtcgatgttctccccgcggcggcgcccgagcgcggcggcgagcaggccgatgacgccggaacgggtggggaagcgggcggtgtcgcgttcgttgaagtggctgcgctcgccccaggactgcagtggcccgctcagccgcagcagcagtccggccttggtggtgtcgctcacgcgttcgcctcggcggtgtgggtgagggcggtgtccagggcggtggtgatcaggtcgtcgaaggagtcgcggcgctcgccgagtccggtgaggtccttggtctccaggctggcccagccggaggtgaggatgccggttgtgcccaggagcgtgttggcggcctgggcgtaggcggcgagctgggtgcgggagacgtcggcgaagccgccctgggggctggcctggacgggcttttcgaaggcggctgcgtaggagaggggccggtcggtgcggacggaaaggtggaccaggtcggggatggtgtgcggggcggtggagttcttcttggcctgggggagcgaggtgatgaaggaggccaggaatacggtggtcagctcccgtgcggcctgcgggtcgtcgccgatgttggcgaccaggttgcgcaggtcgagggtggcgtagcggtagaaggtgccggcgctgaactcggcgtggcccatgtggccgctgccggtggcgtcgttccagacggcggtgacgtcgtccacggcggagaagtagtcgagttcgacgtcggtctcgtgagtggtcagggcgtgtgcgacctggacggcgccgtccacgcccgcgtcgttgatttcggcgagcatccgcccgaagaggttgatgacgccgttgcgggagcgcagcacggcctccaccgtgctgacagggaggatgctcttgtccgcgggcttcttgatgtccttggcctgctgaagttcttcacggtgctgttcggcgaggtcggccagctcggcgactgcggcctccggcacgtacaccatggcgttggtgagcaccttgttggggacggtctgcttggcgtcgccggaggatttggcgagttcgaacttgatgccgctggccgccgcggtgtggccgccggcgcgctgggctagctcggcgggccagccgcgctgttccagttcgcgggtgacgcgttcgccgatgcggcgggttcgcagcgcggcctgtccgatgcggtcttcgaagacggatcggatggcacgtttccaggactggctgctgacacgggtgcgcagggtgttgccgtactggacggtcttcacggagttggtgtcgtcccggttgaggttggcgaaggggacggactgcaggacgtggatgtcgatgaagcgggccggagtgagcacaggggtgcctctttcctttggtgggtggatgtacggatgcgggctgacgtgatcgccgggtgccgtcaggcgctggtgctggggtgttcggtctcgtcctggtcggcgcggtcggcctgctcgtggagggtctggctgcgctggcggtagtagtcctgcagccagcgccgggagatccgcccggagtggaggggccaggcgatcaggtcggccagcagctgggcccagtcgatgggaacgcccagctcgcgcaggtagccgacggcggcgggcaggtggcggtgcaggccgttggcgctctgccgggtcagcagattcagccgggactcggcggtggactcccgcatctcccgctcccggccggggcttgcggtcacggcgagtgcgaaggccaggccgaggctggtgccgtaggggggagcgggtgccggctgcggactctgcgaggccccgtccgcttccagtgcggcctcggggctggtgtgggtggtgcggggctgcgcggcgatcatcgccgcgacggcgtagtaggcccgctgctcggactcaggtgcctgcctgtcatgggggagccagggggcgacgaagcggtgcatgcggggcacgtcgtcgagggtgcggcgcagtccgctgcgcagtgcggtgcgggcgccgggatcgtcccggcagatctgctcgatccagcaggtgtaggcgacgaggcgctggcgccgggcggtagttggattctcggtgacgctctgggtggtcattcataaccttcctcggacaggtggtgggcgggtcgggacgggtcatgcggccggtgtgctcgtggcctttttgcgtacgccgccgtacaggtcgatccgtgcgtgggccaccgcctttgcgccgcgctgggtgcgggtgacggaggcggtgacggtgtcgtatgcgtcggtggccagacgcaggaatgcggtgcgggcggcggccgggtcgaatccggcgccgagggtgtggccggtgttgtccaggtggcggaagcggtcccagaactcggcctcggcgccaggccagtagcgggcggcggcctcggccgcccaggtgtcgccgttcgccttcgggtcgttcatgtactcggcccaggcccgcttgaccgcgcgttccaggcggcgcccgtacatctcgccgagctgccgcattcgccccaccgcgggcgcggtcgcgggggccttctgctctgtgaaacccatgaccgggggtgtgtcggcgtcgacgaactgggtgtccttggcctggccttcctgctcgaaaccgagtgcccgcacgcgcaggtcctcggagacctcgctcgcgtagtcgaacaccttcgggcgctggggctgtgcggtgccgggcggttcgtgcaggagcagagcgtccaggtcgcgccacagcgcgcgccgggagtcggccgggcgcgggtagcggttgccctgctggctgatctgccagatcagatagttgtcgtcgcgggggatgcgtccggtgcggtacgcccaggtgatgtaggcatcccgcaccaggcccggactgttttcgtcggggacgaggagcagggcgtgctgggagcaagcggtcagccgtgagcaggggccgcagggcaggggcggggcggcctccgggtcgggcagttcctcccgctcccaggggcacagatcgaaggagcgtcgtaccgtcacttccggcgggaccaggcctgccaggagcgtctcgaagagggtgtcaccctcggggtggtaggacagcgcggtgcgcagggggccggcggtggcgctggcggtcttgaccccgttgacctcgcgggccgagcagcggcccgacggcccgtagtagtgccacaccagcaggctcagcaccgcctccgcggcgctcggcaggtcggggcgggcgtcgctgccgtgccgaaaccacgcgtgggcgttgcctgccgggcgcgtcacgatcagtttgttcaccccggcggtgttgccgccgtcgcactggccggtcagccgggcgtcctgcatccacgggcggcccccgtcacggtcgtagaggaagaaccgctgccggtagcggccggcgtaggcggtgatcccctctggggggagctgtccggcatccaggatgttcaggcgccgctccccccagtcgccgggccccgactcgtccagacccgtcacccgggcggtgagcgcgtacaggatgcgcagcagtgcggagtgcgcggggggatcggcaatcgtgagggtggcgatgtcgccgctgcgcagcagcaggtcccgtagccccacccgttcgggatgggggaggggcgcggcatgggtccagcggacggggatccacggttcgtcgaacaagttgtacgtactggcgggcatcggactcctatcgccgggtcgccggtcacaatgaggtggggtctccgcaggcgcggaggtgagccgtgtgttgcccgcagagcgacgcgagcctctccccgtgcctgcgcaagcaggctgagctggcccccaccagcaccaaggccgaacaacttcccctggaagacggctgattgaggacgctagccaagtgtgttgcccgtagaagcggttcttcgtgaagtgactggtaatgatcagctggtttcgagtccgacaccggagatccggatcgtccgggtgccgtggcggcagctccagaccgctgctgcgccatcctggcccgcgggctgcatccgcagcaggaccagatcacgcagcaccggatgcttgccccagcccggcggcgccgggtgtccctcggcgccgcgcagccaggcgcccggcaccggcgccatgtgtgccatcacctgccgcaactcggcatgaagcagaccgttttggtttcctgtgggcaaggggagggtgccgccctcatcaagggtgagggtgttgtcctgctgctcgtacaggcacagaacgcgcccgctgtcagcccccagccgagtggtcagcagttcctcggtgacccctgcctcccggcggctgagccgctgcaggtcaccggccacgtcggcgggcgcgcagatggcaaccatgtcggccaggtgcgcctcggccgcctcgtccgcctgccgcgcggagtccatccgcgccagttcccgctgtacggccccctcgagtcggtccacgaagtcctccgcgtacacggcatcgataagctcctgcacgtcccccgggaccgcgatcccggacgcggcccgctcgcgcagcaggtgcgctgtgcgctgcagcagcccggcgtcgtacacgcttccccaggtgcgcggcacctgggtggccccgctctcgccgaccggttccaggacgaccaggcgcggcgcgtcctccggcagcgcccagggcgggcgcccagaagcgccgcgcgcgtggcggcgtccccggccggcccgctgcagcagctgggccagcggcgcaagatccgtgacaatcaggtcgaagtcgaggtcgagcgactgctccacgacctgggtagcgaccaggacggatgccggccggggcagagcgacatcctgcggcgagcggggtttgccgtaggccctttcgcacgcggacgtgatgtgctgccgggtgttggccgggtagcgcgagtgcagcagccgcaacccgccttcaccggtgctgagttccgggaacgcggcgcgcaggtcacggaaggtctgctgggcttcggccaccgtggtgcagcaaaccagcgcggtcccgctctgcgcgacgacgggctcaagtgcctcgcgcagggcctggcggcgacctccggcgcatacgggactgccggcagcgggcgccgtgtcccagacgacaggcagcatccgcacgtccagggtgcgacggcgctcactgtccgtctcccgtggcacgcagacttcgccggtcgcggcgccggtgaacatccagcccgggtagcacggttcgacggcggacggttcgaggaatccggccccgcggcggtaggcatccaccaaagacgaggctgtgcggccggacagggttgcggacagcaggaccaccggggcaccgaacgcgccgagccactccaggagccgggacagcagctgatgcatccacggcccgtaggcatgcgcctcgtcgaccacgagcaccttgtcggacagcccgaacagccgcagcgcgttgtgcgtgagcggcagcacggcgctcagcgcctgatcaatggtccccgcccccaacggggccagcagcccacgccgatgtccgcgcagccacaccccggcctcggtcacggtggccgggtccgcgctcacgtcgcccgctgccggcggcgggccggcggactgcccggcccctgcgtaagcggggctgagccaggccatggaatgcagcaacgtcaaggcccgctcaccgctcagggcacgctccgtgaaggcgctcacccgcggatacatggcgtcggcggtggccatggtcggaagcgcaaaaaacagcccccgagccccagccgcatgacccaacaccgacgccgcgtacagggccgcctcggtctttccgtcacccgtcggcgccgtgaccagcagcagtcccggccccttctcctcgaccatccgcggcagacgggcgacaaggtcggcctggagagcgttgggtgcgaacgagaacatctcctcgaacccttcagcgtcgaaccgcgcccgccccagctgggctcccgccaccagccccggagccgccttctgcgtacgctcccagtgcatatcgacctcttccggcgtcgcacgccaccccttcggcggcagcagcgggatgatcgcctcctcctggctggccagccagtccgcgacgaccaccagcccggcgacgatcaccgccagctcggccggtagcccccgctccggcaccgcccaccccccggtgacgcgccgcaactccccgaaatgcgcccggcgttgcaccgcccagccgtccccgcccagcccgggctgataggcactggcgtgcgccacttctttggctttgaggaccacgccgaaacatccgtgatggccaccgagcaattgcgccacctgatgactcaccgcagaccgcatcacccggccgccaccgggataccccgcttcgccgagcaactgcaccagcgcccagtgggtggccatctcatgacgaaacgcacgctcccgttccgcccccggagcgaacacataggccggatcgttccgtacggccgcgaacgcctccggaacctgggcctgaaacggaggagtgatcttccccagatcgtgcaaccccgcccagaacgccagcacccgccgagcctcggccaccgtcagccccagcgcccgtgcgaccttctcacgcatttgatcactcagcagcacatcccacagggcaccgaacactcccgcggtgtccagcagatggcagagcactgggtacgggcgcggaagaccatgctccttgccccaaaaccgggtgtcgaccgggacatgtcccggcgagacggactcacgcttcatcatgacagccatgcataacagcccccactgacaacgcatcctcacctgcacggataccagaacagatcccaagcagggccgtagaatccaagccgtggaacctcagccgacgcgcgggcagaccaattcaaggcgagtccattcggataccgtaaagaactcgcaaagcacctgaaggaggccaggtcaggaagggtgctctccgcgcgagcggaggtgaaccgacacggctgttgagccggacggcgccgagaccgtgctctccgcgcgagcggaggtgaaccggcccgatcgagggcggtgtgagcatgagtatcgtgctctccgcgcgagcggaggtgaaccgacgtcgtgggactggttggccgccgcgttgaagtgctctccgcgcgagcggaggtgaaccgcaggtcgccagccgctgcccggtgtcgcagtcgtgctctccgcgcgagcggaggtgaaccgccccatgatgatttggccaggcacccgaaccagtgctctccgcgcgagcggaggtgaaccccactaactcaagacgcaatgatcacaatcggagtgctctccgcgcgagcggaggtgaaccggcgatgatgccggcgtcgacggcgatggggaagtgctctccgcgcgagcggaggtgaaccgtcgttgaagctcatgccggtgcgcttctccaggtgctctccgcgcgagcggaggtgaaccgccgcccgcgccgcactcatccccgaccaggcggtgctctccgcgcgagcggaggtgaaccgcccgtgagcagccgacgttcggtgaccggggggtgctctccgcgcgagcggaggtgaaccgccgtcgatgagcgcctagccttgctggaacgagtgctctccgcgcgagcggaggtgaaccgtccatgcagcaccgcggcgaccgccaccccccgtgctctccgcgcgagcggaggtgaaccgttggggcagtaggtcagcgaggatgccgagccgtgctctccgcgcgagcggaggtgaaccggagaactacgacgagatggccaagaagaccgtgtgctctccgcgcgagcggaggtgaaccgaacgacacggccgccttcagcccgccccagacgtgctctccgcgcgagcggaggtgaaccgccgcccgcaccactgacgtgcgacgagtgcgggtgctctccgcgcgagcggaggtgaaccggcgcgcgggtccaacgtccaggtcgtcctcacgtgctctccgcgcgagcggaggtgaaccgtccaccacgcgctccaggaagctggtcccctcgtgctctccgcgcgagcggaggtgaacctgggtgttcgtcggcatcccggtgctcgtcgtcgtgctctccgcgcgagcggaggtgaaccgctcggcaagtccggcgccgacgccctctacgagtgctctccgcgcgagcggaggtgaaccgcgcagcgtcgggtgctgccgcttcatcaggacgtgctctccgcgcgagcggaggtgaaccgcaagcgcggtgtacacgatgtgggggtggatcgtgctctccgcgcgagcggaggtgaaccggtccgcgcggacccgggcgtcggtgtcgacgcgtgctctccgcgcgagcggaggtgaaccgcagttcggcagcctcctcggcgacatcttcgggtgctctccgcgcgagcggaggtgaaccgtgtgacgcctgccccatcgccaacgcgacgccgtgctctccgcgcgagcggaggtgaaccttcttcgccccggccgtccccgccgccgccttcgtgctctccgcgcgagcggaggtgaaccggcccgcacctgcagacgtacgtccagtccaacgtgctctccgcgcgagcggaggtgaaccgtcctgggacgccctcaaggtcccgaacgtctggtgctctccgcgcgagcggaggtgaaccggtgggggaggctgcggaggcgcagaccacgttgtgctctccgcgcgagcggaggtgaaccgtacgcgtggggcggcatcctggtgcgcacctcgtgctctccgcgcgagcggaggtgaaccggctgccatcgagtcatcccctgcgaccccggggttctctccgcgcgagcggaggtgaaccggtttcgtacccgagggccgggccgatgatggtgtgctctccgcgcgagcggaggtgaaccggacatgatcgcagcccgattcctgcggcaggagtgctctccgcgcgagcggaggtgaaccgtccacggacggcaactgatccccggcatgaacgtgctctccgcgcgagcggaggtgaaccggtcaaccgcgcgttcggccgcagccggctggtgtgctctccgcgcgagcggaggtgaaccgcctgaccggctggcgttccaggcgacgtcgacgtgctctccgcgcgagcggaggtgaaccgtacgccatcgcctggcgtaacgcgctcctcacgtgctctccgcgcgagcggaggtgaaccgaccgtcacgttcgacacgcgggtcgggttgtagtgctctccgcgtgaacggaggtgaaccggacatccacggcaacccgctgaagctgacccggtgctctccgcgcgagcggaggtgaaccgaaaaccgggcgcgccgtgcaacctgacggcccgtgctctccgcgcgagcggaggtgaaccgatcagcagcatcgccaaggccatcgtggcggggtgctctccgcgcgagcggaggtgaaccggagccggaggcccggcagaccgccgtcgccgagtgctctccgcgcgagcggaggtgaaccgtccgcccgaagaaggaccgcagtaccgccccgtagtgctctccgcgcgagcggaggtgaaccggccctcaacaggccgtcaaccgagcacgccaagtgctctccgcgcgagcggaggtgaaccgacggacaagggcatcaccgtccttttcacctcgtgctctccgcgcgagcggaggtgaaccggagacccttgcgaagaccaggcgtgccagtgcgtgctctccgcgcgagcggaggtgaaccgtcgcggtgccgccacagcgacggtcgggcgccgtgctctccgcgtgagcggaggtgaaccgctgatgctcgacatcgcgaagggcatgcaggcgtgctctccgcgcgagcggaggtgaaccggccgagaacgagcggctgaaggcggcgaagccgtgctctccgcgcgagcggaggtgaaccggccatggagtagccctgcttgaaggcgtcgtagtgctctccgcgcgagcggaggtgaaccgtcggacaccgaggtcagcgcgtggctgctgtcgtgctctccgcgcgagcggaggtgaaccgccaccggggacgtagccgacgtccgccgccccgtgctctccgcgtgagcggaggtgaaccgtcggagctggccagggagctgaccacccgggtgtgctctccgtgcgagcggaggtgaaccgcttccaggtcagcgggaactggccaaggctgagtgctctccgcacgagcggtggtgaaccgaagccggagaccgagcagcaggaccagcctcagtgctctccgcgccagcggaggtgaaccgtactggatcttccccgtccgtgacgagcacggggtgctccccgcgcgagcggaggtgaaccgccatggtgatctaccacagcgaacttgcgggcgtgctctccgcgcgagcggaggtgaaccggtccgcctcgacggtctgcaccgggcgaagatgtgttctccgcgcgagcggaggtgaaccgtacccggttcagtgaaggtcagctggggccgtgtgctctccgcgcgagcggaggcgaaccgacgaagacgcttgtcggcgacgcttgaaatgtggctcagtcaagatttccgtgaagccgatcgtgcgcctgtgcgccggtgacgctccgtcacaggccgcgtgatactcgccgagtgtggggagctgctgaagaccatgtttccgcacctcgaaggggtgctggtggaagaagtgagccccgagggtggggtgttgcacattgtggcaagaaccgtggagtcggttccggtgccgtgcccggactgcgcaacgccctcggtgcgacggcacagcggataccagcgccgtctcgccgacggtgcggtcggcggccgtcaggtgtccatcgagctgaccgtccgccgcctgttctgcgacgaccagagatgtgcacgggtgacctttgccgagcaggtcgacgggctgaccgtgcggtatgggcgtcggacgccgcagctgcggtgcttgttgagcgcgatcgcggtggccctggccggccgggccggagagcgcctcgcggcccggctgccggtgcctgtcagccgcactaccctgctggccctggtcatggccctgcccgatccgtacgccgagacgccccgggtgctaggggtcgatgagttcgccacccgcaaaggccacaagtacggcaccgtgctggtcgactgcgagacccatgctcccatcgacctgctgcccgaccgggagtcggcgacgttcgcagcgtggctgaccgaccaccccggagtggagatcatctgccgtgaccggggcggcgccttcgcagacggtgcccgcaccggggccccagatgccgtccaggtcgcagatctctggcacctctggcacaacctcgccgagaccgtgaagtccctggtcagcaagcacagttcctgccttcgtgaacccgccctcgcctcggagtcaccccctgaagtcctgcacccgccgctctcccacgcaggccggctggccgagcgggcccggcggcaccacgccgccgtgcacgatctcctcggccagggcctcaccatccgggccgtcgcccgccgcctggagctgtcccgcaacaccgtccgccgctatgcccgcgccgtcacctgggaggaactggccaccggccgctggcagaacctccccagcactctggacccctacaagtcctatctgcaccagcggtggcacgagggccacaccagcggtgccaagctccacgccgaactccgtgagcgcggcttcacggggtcctactccgtcgtccgcgactacctccggcgcttccgccgaacgtcgggcgaccgtccgcccccagcgcggccgcccggggtccgcaaggtgaccggctggatcacccggaaccccgaccgcatgaacgacgacgaccagcagaaactcaaggccatcctggcccgctgccccgaactcgaagcggccaccggacatgtccggtccttcgccgcgatgatggccatccgcagcgcgagccgactgcccgaatggatcgccaccgcccgcgccgacgagcaccacggcctgcgcggcttcgccgatggcctgctggccgacctcgacgccgtcatcctcggactgagcacggaatggagctcgggctgcgtcgagggcagagtcacggacatcaagctgctcaagcggcagatggcaggccgagccggactccccctgctccgcaagcgcgtccttctcgtcgccgccgaccgccgacaacacagagttacgaaccagacggctcactgatcggcttcacggaaatcttgactgagcctgaatgtgagccgattccggcgggtgaaaaatgaccccccgctgcgtcagttgatgttggtcattccccggtgttggcggcgggaacccgtccgaggtcgcggccgcgcatgcgatagctgtcgcccttcagcgagatgacctcggcatgatggacgagtcggtcgatcatcgcggcggcgacggtgtcgtcgccgaagacctcgccccagcgcccgaagggcttgttgctggtcacgatcaccgaggcacgttcgtagcggcccgagatgaactggaagaacaggttcgcggcctcgggctcgaaagggatgtaacccacttcgtcgaccacgatcagcggaatccgtcccagccgggtcaactcgtcgctcagacgccctgcttgatgggcctcggcgagacgggcgacccactgggcggcggtgccgaaggcgacccggtggccggcctggcaggcccggatgcccaggccagtggcgaggtgggtcttgccggtgccgggtggccccaggaagatcacattctcctttccggcgacgaagtccagcgtcccaagatgggcaatgacctcgcgtttcacggaccgctggtggtcgaagtcgaagtcctccagcgacttgcgagagggaaaacgggccgcccggatgcgtccctcggcgccgtgggagtcgcgggcggcgacctccctctgcaggcatgcggccagatactcctcgtggctccagccctcgtcgcgagcccgctcggcgagcctggcagcagcgtcccgcagggccggggccttcaacgccttggtcagatagatcagttcggagccgacgtcgcggctggtcctggcctggttcgtgccgttcttcgtgctcatcacgctgccccttcacccgtgctcagcccgccgtcgatgacgccgaagatccggtcgtaggtgtccagcgaccgttcctcgacctctgtcacgtccactggcgccggtttcgtgccggcggccgccttgcgggcgaccgcggcagcggccgcgtggtccgggtcggtgatggtctggtggcgggcccagctgcgggcatggcgggcgacctcgacgccgtcgcaggtcaccaggacctggtccaggccggcggcgacctcgatgcggcggccgacggccagcgggtgaactgagtagtcgcaggtgtccaggcggacgtagtggtcccggggcagtcgcagagatgccttccaccagcccggcggggcgatcggcggcagggccagcatccgggaccggtccgcttccagccggtccgccgggcgggcctgcaaggtgcggtggatgcgccggttcgccctggtcagccagtctgcgagctggatgttgaagtcggccggcgaggtgaacacccggccgggaaggaacgacgtctcgagatagccgttggcccgctcgaccaggcccttggactcaggatcccgtggcttgcagagcaggaacttgatgccgagcagtccggcgaacgcagcaaattcgtctgtgagttggggtccgccggaccgccaggagccgacggctccctcgttgtcccagaccagcacccgggggacggcgcccagctctgtcagcagccgccagtgcccggcgatcaggtcggccgcagacctggaaggcagcattcgggcggtgatccaccgcgagtagcccgcgaccatgaccagcaccggcggccgcccgacctgaccgaagccgagcgggatgtctgccggcgggaaccacaggtcgcactggccgatctcgcccggctcatagaccgtccgcgaggccggatccgcaggccgataggccggccgcaggtccctgacccggtccttgagcaccgtcagaccccggtcccagccgatccgttccgcgatcaccgtcgccggcatctcaggccattgctcgagcagttcacgaatctgcggctcgaccgcgtccacgatcgagcctttcggcgcccgctgatacttcggcggcgcgtcgtccgcgatcgccctgcggacagtgttcctcgcgatccccagcttcctcgcgatcgcccgaaccggcatctgctcggcccggtgaagccgacggatctccgcccagtcctccacgctgatcaccactcctcccggcctgactcaacgagccagacccttggagggggtcaactttcaagcgccgcccctggtccacttttcaggctcagtcaagatttccgtgaagccgatcagtgagccgtctggttcgtaactctgtgttgtcggcggtcggcggcgacgagaaggacgcgcttgcggagcagggggagtccggctcggcctgccatctgccgcttgagcagcttgatgtccgtgactctgccctcgacgcagcccgagctccattccgtgctcagtccgaggatgacggcgtcgaggtcggccagcaggccatcggcgaagccgcgcaggccgtggtgctcgtcggcgcgggcggtggcgatccattcgggcagtcggctcgcgctgcggatggccatcatcgcggcgaaggaccggacatgtccggtggccgcttcgagttcggggcagcgggccaggatggccttgagtttctgctggtcgtcgtcgttcatgcggtcggggttccgggtgatccagccggtcaccttgcggaccccgggcggccgcgctgggggcggacggtcgcccgacgttcggcggaagcgccggaggtagtcgcggacgacggagtaggaccccgtgaagccgcgctcacggagttcggcgtggagcttggcaccgctggtgtggccctcgtgccaccgctggtgcagataggacttgtaggggtccagagtgctggggaggttctgccagcggccggtggccagttcctcccaggtgacggcgcgggcatagcggcggacggtgttgcgggacagctccaggcggcgggcgacggcccggatggtgaggccctggccgaggagatcgtgcacggcggcgtggtgccgccgggcccgctcggccagccggcctgcgtgggagagcggcgggtgcaggacttcagggggtgactccgaggcgagggcgggttcacgaaggcaggaactgtgcttgctgaccagggacttcacggtctcggcgaggttgtgccagaggtgccagagatctgcgacctggacggcatctggggccccggtgcgggcaccgtctgcgaaggcgccgccccggtcacggcagatgatctccactccggggtggtcggtcagccacgctgcgaacgtcgccgactcccggtcgggcagcaggtcgatgggagcatgggtctcgcagtcgaccagcacggtgccgtacttgtggcctttgcgggtggcgaactcatcgacccctagcacccggggcgtctcggcgtacggatcgggcagggccatgaccagggccagcagggtagtgcggctgacaggcaccggcagccgggccgcgaggcgctctccggcccggccggccagggccaccgcgatcgcgctcaacaagcaccgcagctgcggcgtccgacgcccataccgcacggtcagcccgtcgacctgctcggcaaaggtcacccgtgcacatctctggtcgtcgcagaacaggcggcggacggtcagctcgatggacacctgacggccgccgaccgcaccgtcggcgagacggcgctggtatccgctgtgccgtcgcaccgagggcgttgcgcagtccgggcacggcaccggaaccgactccacggttcttgccacaatgtgcaacaccccaccctcggggctcacttcttccaccagcaccccttcgaggtgcggaaacatggtcttcagcagctccccacactcggcgagtatcacgcggcctgtgacggagcgtcaccggcgcacaggcgcacgatcggcttcacggaaatcttgactgagccacttttcagccgtcgccgacagacgctggcactcgggactgagacggggtgctctccgcgcgagcggaggtgaaccggacgccgaccgaaccgtcatgctgaccgtggagtgctctccgcgcgagcggaggtgaaccggccaccgtggatatcaagctggccgagcggaagtgctctccgcgcgagcggaggtgaaccgtggcgccagccgatggccgtgcgctcaccgtcgtgctctccgcgcgagcggaggtgaaccggacggggacacgcttcgcgtgatgctggaccagtgctctccgcgcgagcggaggtgaaccggcggacaacgaggtgcgggacgggatccggtcgtgctctccgcgcgagcggagatgaaccgaccggccaggaagcagagggtgatgacattcggttcggtcctcgccaccatggccgtgctcgcggtggccgccgcaccgaacctgtacgcgaccagcacaacgagccacgccgccttggcccaggcgtagggcgtctcgaagacgaccatgggccgcgcgatccggcgcgagaactggaagcacgtggactgatccgctcatggccaagtcgtctttcgtgggcgctggtagtccacggagtacacccgggacggacgcgagagccggcctgggttgacggtggtcaggaacaggtcggccaggggcaggccggtgaggccggagctgtagagcagggttgggtccggcatctccatctcgacgccctgaggtcggacggcacctgcgggaactgcgcgaggacgtgcgccgggcgggcggggcgcgtgcggcggccgacgcggtggagcgtctgctgacgcgccggcaggccggggaggctcagccgctgggcggagtccaggatcctcccacggcctgacgccgggtgatccaccgtacggggagagtattcggcatgacgattacaccgaagcaacgggcagccctgacagacgccgtcaggggcggcaccgaaagtcttttccggcgggctgccacggccgctttcttatgggccctcgtgttcacggcttttcatttctactggttcgcgggaggtcgcttcggtctcggcgacggcccgaaaatgattccggagacgggaaccactaaggatctcatctgggctttcgtgatcacctcgatgttcgtggtcggaattttccttccggtggctctgacgcgtccgtgggggcgccggattccgcgctggatcaccgtttgctgtctgtggatcggttcggcgttgctcgtggtgcggggaggcgcgggactgctcgacaccgcgctgcgtgagacgggtctggcggatcggggactgacgggcctgacgtaccagcagatcaccggggacgcgcatccctcgctgaacacgaaggtgtcgggcatctgcatcgacgcctacttcatcctgggcggcctgctgtacggacgtacggtgctgctgcaccggcgcctggtccgcggcgccgacgagggatgacccaccggctcccggcgccctaagacggtgtcctatgtggtgatcgctcgttggtctgttcatggggcggggtacgtggagttggattgttccggacgggctgtgggagatcgccaagccgttgatcccaccgtcgaaggtgcggccgcagggcggcggcacgcaggacacgcctgatgagacgctgtttgcggcgatcatctacgtgctggtgagtgggtgcgcctggcgggctctgccaccgtgcttcggcatatcgaagtcgacggcccaccgccggttcctgatctggtccagggccggggtctggggccggctgcacgaagcggtcctgcaccgactcgacgacgccggtctcatcgatgtctcccgcgtcgtcctcgactccgcgcacgtgagggctaaaaagggggcgaacacacaggtccgagccccgtggaccgaggtaagccgggttccaagatgcacgtcctgtcggacgcgaacggactgcccctggtcgtcggcgtctccgccgccaacgtccacgacagcgagggcctgaagccgatggtggccggtcaccaaacgagacacgacccccaccgcggccgctgcttcaagccccagcgcctccatgcggacaaggcgtacgacattcctcacctgcggaaatggttacgcggcaagcgcatcggcgtgcgcatcgcccgcaaaggcatcgagtccagcgaacggttgggccgccgccgttgggtcatcgagcggaccatctcctggctgtccggctaccgccgaatcagcccccgctacgaacgcaatccccggaactacctggcctttctcggcctcgccgctgcactgtgctgctacaagcgactggtccgcctcaccacataggacaccgtctaagagctcgtaacacgatcttggcgaggagcttcggactggctcggtatgtctgctctcactggcggcctgatcgtctctgggtgatgcggcgtgtgcttccggtacggtcgcggcatgactggcgtgttcgacgtggcccaggctctagacggcggaatcaccgacatggagcgggcgtgggcattcgtccgcggcttcgccgctgcttgggacgagccgttgaccgaggacgacggcacgcctgcatcggaactggcgcgggccgaggcgacgctcggctgctccctgccggccgtgctgcgcgagttctacacgctcctgggtacgcggtccggcctgctcgccaaccaggatccgctgctgccgcccgccgagatgttcgtgcatgacgagtgcggcggtgtccttgtcttccgcagcgaaaaccagggctgcgccttctggggcgtgcgcctgcgcgaccttgatcaggacgatccgccggtgctcgtccaggcgcggcacggctgggtgccgttcttggaccgggtgtctctggcctgcgtcgagcttgtactgagcgaggcactgttcggcggtggcggtcagctgtacaacgcgtgcgagctgccggcggacctgcttggggcggtgcccgcacgcttccagcgggtcgcgctgcccgactatccgatgtggacgggtccggaggactttccagtgcgttggttctccgccccgggacagttgctacgccaggacggcttgggcgcccacagctggctgcacgttcggggccggacccgggccgacctggaggcgatctgcgagaccgttcccggacggtgggccctgggatacaccgagtcactggacgccgagccgctgcccttctgaaccgtcatgattcgggcctgttgagacgtcgccagcagatgaggctgcaggccagggatacgaaggcgtcgtggagttcggtgcgtcgttcccagcggacggcgagtcttttgaagtggtggagcagggcgaaggtctgctcgacgacgtagcggagcttgcccaggccctggatgttcggggcccccttgcgggagatgaccggcaggatccggcgtttgcgcagctcgtcgcggttggcaattggagtcttagcccttgtcgccgagcagggcctcgggtcgtttgcggggacggccggggcggcccgcgacgggcgggatgccgtcgaccagggcgagggtctgggtgacgtcgttgacgtttgccgcggtcgtgatgaccttgagcggagtgccgcgtccgtcgcagatcaagtggtgtttgctgcccgtcttccgccggtcgaccggcgacggaccagtctcggagccccctttttcgcgcggatgtgagagccgtccacgcaggccctcgaccagtcgaggcggccggccgcgttcagttcggccagcaggatccggtgtagctggtcgaagacccctgcctgctgccaacgttccaggcgtcgccagcaggtctgcccggaaccgaaccccagctccagcggcaggagttgccaggctatgtcgttgtagaggacgtacaggatgccctgcaagcagtgtcggtcagccaccggccgtggccctggtgacttctcgggccagggtggcagcagcggctcgatcagtgcccacaagtcgtcgtccacgatccacggccgagtactcacagcatcacgaacggccgaatcgtcacaccggtcacgcccgaccaggacatctcaccaagatcctgttacgagctctatgggactgtcggacgtggcaatcaacgacattgattacctggatctcgactactaattccggagccctttatggcgagcatcagttactgtgatgagccgaagcgcgatagttgtcacataggcgggatgttgtcaccgcccgcgggggctgtgcacatcgtgcccggcttcaagcacagctcgccggtggcctcgtcgacactgaaatacgtgtcgcacacacaagcgcgcgccaaagggctcaccccatcaggacgatgcgagcccggcccaaaaccagtggctatcagtgagcgttttcagcggggccactgatcgtgtgacggcaatgaggcttttccaacctggttgcgtggcacgtcggttggctgagggcggcgttgaggaaaaggtgaagctcctggtagatgggttgtcgaccaagatcaacctgcccgcccggagcttcacatgcttgtctacccatcggggatcgatctgtccacctcgaccctgcgctacctgtccgacctgctgagagcccggcggcgtgagcgcggcacgcgctggcgccgcctgaccacggaccgacaggctctgctcgcgctggcccatctgcgctgcgggcacacgtacgcccagctcgcggccggcttcgggatcgggctggccaccgtctaccggtacatcgtcgaggcggttgaggtcctggccgcccttgcccccaccctccagcaggccatgactttcgccgccaacaaggcattcgtgatcctggacggcaccctgctgcacatcgaccgcattgccgccgaccgcccctactactctggcaagcacaagcgccacggtatgaacgtccaggtcatcgccgacgcgttcggacgcctgctctgggcctcacctgccctgccaggtgccgtccacgacatcaaggccgcacgcatccacggcatcatcgaagcgctcacccaagctggcatccggacgtgggccgacaagggatatcagggagctcaggggacgatccgggtgccttaccggggccgctggagcacgctcccagccgggaagcgggcggtgaactcctcccacgccaagatccgagccgtcggagagcaggccaacgccaccctgaagagctggcggctcctgcgcaaactccgttgcagcaccacccgcatcaccgacatcgtcaaggccgtcctggccttgcacctcgccacggcagcctgagatcgctgcggccggaggcgtggacaaggacagcgccaccatcaacgacagcaagggagaccgctcaccatgacagacgtcagagtcacctacgacaagaccgtcaacgcagcgtacgtatacctcaccgaaccgcaggctcgcgtgaagtccgcgcgcatgtatccctgcgatccagtggacgtcgacggcatgatcaacctcgacttcgacgagcagggccgcctcatcggcatcgaggtattggcggctagttcgaaactgcccgagtacctgctccagtccgcggagcgacttgacaccgaaggtgcatgaccagccgagcaccacgctcgcggcgaacaggttggaagaagctcactgactgacactcccaccggaaggagatcaccacatgtccgtctccacggccactcggcgcacgtaccgtggcggtacgacctgccgccgggaggactcagctgatgagcgcgcagcccgaccacgcacccgtcacgccctacgccccccccggggctccggccgaactcctcgcccagctgcgcgccgaccggcgcgccgcacagtgggtgccggtcttcgagcgggagtgggcggcggcgctggaagagtcccgccggacgttctccctcgccgggctgtacgaggtcgtccaggtctggcaggcccgcgtcgtctccgccccagcggtcgacgagttcctcgcctccggccgtgacgagaccggggtcgtggacctggaggagatccggagcaggcgccggtgagaggtcggccgtacgcggtccggctgtcgccgcccgccgcgaaggtactcgccgcactgcccgagcacgcggagcagatggtctgggacgtcctggacgccgcggccgggaacccgtggggcttcccgcagtgggaccccggcgaccccgagggcgaggacgtgcgcatcgcgtccgtcggccagctgtccgtcatcttcttcgcgaaccacgcactcgggcacatgtccgtcctggacatcgtctcggctgagtatcccaacgaggttccgtcccattcggagcgatggttcattcctgatggcaggatttggccactcgagggtgttggccagcggtcaccatggatccaccccgtgcgggaccttctgcttggcctctcccttctgagcgcagaactgtcaggcactgaagatcacgaagacaccctcccgcggctggaagcgattggctgcgccgggcggccgcgaccgaagccacaacaaacaaccgctctaaatcccctcagaagccgctggtcgagccggtccctgaggacggcgccgggtgctcagcgaccagtcgtcgtatccgctcccgcacctcgcgcggaacgttgtcgaggccgcgcagcacccgggcgcgcacggtgtcctcttcgccgggcggcaggtctgctccgccgagcaacagcttcagcacatcgtgagccagagaagtggccggacctcctgctgatgtgaggaacgtggtgacggacggtccgagccatgtgaagaccgggtccatgacatgccgtacgacaccgtcgttcgtgccgccggacacgtccaacttgtgctgcacttcctcccaatacgtacgcgaccagcccgggccgtcgttgccccgggggtagcggtacagccagttcatgtccagcgggtccggcgattccactgcgccggactgcaggatgatttccagttccctgccctgatcggaccaggtgcggcgggccgagagggacacggcgaagtcggtccactgctcctcgtcgaacgaggcccgccacagcagaacatggcggtgccaggcactggcatggtcgttccaggacgggaacagctcgcccgcgctgacacggcccttcaagagcaggatcaccaggaccaggttggcgccgtagatgccgtgacgggccgaagtccgcagtcccggggaagcgggaaagcgggtgggccggtaggcaggatggggctcgtgcgtgcgttggccgtgctgctcgagtacgccgatgaggagacgtgctagctggtcgcgctcggcagcggggatccggcgcaccatcgatccggcgaatcgcagcatctggcgggaggacagtggcgcgtacgagagcagggtgtaggcgaggtcgtcgtcgacgctgctcttagctgcggacagggaagggcggtgcgtcagaaggctggtgagcacgtgcagggcgagccgtacgaccaagtactcaccgaaagtggcgtgcagaaactcgtacgtggccagtgcgcgcccgtcgcgcacagactgggcacgctgcacgaagaagaagcggccgagagccacttcggcggcaccgagcggcgttcgaaacccggaggcctccgcggatgccctgcccaggagcgccgtcaggtcctcgtcgagttcggcggccgacacccactggcggcggcggttgtgcagagcgaaggcgaccagggacagccgttgcagttctcgttcgccgcgggcccgcgtctcgtcgtccggtgcggcaggggcggggccgtccttgtcgatttcgcggcgggcgaaggcggtgagcagttcctcgtacagctcggcctggtcaaaagggccgtcgctgtcgcggcgcagagcgttgtcggcggcgtcgtatagtgccagcatcgtcagcagcagtggttgctcagcgagcgctaagtgtcgctcgacggcctcccagctcagcgggcgcagcccgcgggctgcgaagctgtcggcattggcctcgttccacactgcgagccagctgcggatctgctcgggtcggaacggctccaggcgcagggcgacgaggccctctgggtagcgggcccggtcggcgacggcgatgcggctggtgacgagggcacggatgggccggccctgttccgcctcgcgttgctggaagcgggcgacgcgggtaaggaagtcactgtggtggaccccggtggtctgcagcaattcgtcgaacccgtcgaggagcaggacgggaacggcagtgccggccgagcggaccagctccggccacgacgcccgctctccggtcgcagtgcgcaccgcctgctcgatttgggtctggaggtcgtcctcggcatgtacgtcccgcagcggcacgcgcacgggcaggaagccggcagagggcagtcgggcggcaaggactcgcgtcaggacagactttcccgcgcctggctgcccgagcacgaggaggggcgcatcggccggcccagcgaacgtcagcgttccggcgaggtagccagtgaggtcccggcggacttgggcctcctcccaccaggactcggtagccggcccgttcgatccggacacctcacggacccggaagtccgggtcgaggtacatctcccgcagcgtcggtacacggatgccttccgggccggacgaggcgtccaggacggtgcgggtcagcatggcctcggacgagcgggccagagccgccgcgacgtccacggggggacggactgtgcgggccaggccggcaagcagctcgctgatccccccgagggagcggcgcacctcggcccgggtcgcccggtgctcgatctgggtcgtccagaacccgaactccggtgcctcttgggccagctgggcatacagggactcgtactgccggactgcctcgcggggcagctcggtacggataatccgccgggcctcgccccgggatgtctccgtctgcgtgttccagacgcggagtccctcgacgaagtctagaaacctcgtcgacaggccctcgtaccagcgctgcagctcgtccgtgaccacctcgaagggccggtggggcgcggggctcggcgcgtcggaggcggcgagcgagcgggcgaacgcggcgccgcgctccgccacgtgcggcgcgcccgcgagggcgagctgttcgtggcgggtcagctccaagtcctcgaggtgaacgggcagatgctgtgcctccagggcctggaaccaggcgaggacgacgatcacggtgtgggcggcgtgcagcagctcggtgcgctcggcacggccgtccgccaggcccaggcgccgcccgataccccgcacggcgccacggccgagcgtcagcacgctgccccgggcgtcggcgatccgcacgagcccgtcagcgactccgcccgtcgcgatgtttagcactccaccgagcgcccggtccagcgcggcaacggcgggcgggtcgctacccagcagcgccaacgcgtccgaaaacgacagcagcctacgtgcccccaccacgcccccatggtccgcgcgtcggttgcgatggtctttcaacacactttggcacgtcggcccggtgggacgctgatgttcagctgcggcgagcggggcagtttggcgaattgccgctggagctcctccacccggtcggggcgctcttcgagacagaccaggttgagccggccgaagttccggtatgcggtgtgctcgaggaaggtcttggcgaccacgatgggggagccgggcgggccgtcggtgtagatgcccgggccggcgaaggcgtccacgatggtggcctcggggaacttctggaggatcttgcccatccagcactgcaggtagtgccggtacacgaggtgcttgacctgcgtgtgcggatcgctctccctccccctgacaccacaacgatcgggcacccagcgtcaccgctgtgggactcgttgtctataacaccaactcggccatcttcatcaggcacggctgacccacgcgtcacacggcttccggccgtgcggcaggagagacaagggagagtgatcctggttccggccctactccgttcgagtggccctcaatccgccccgttgccagacccgcaagtcgctgtccgctcgtgtgggaggggccccgacacggccggggcccctcccacacgagcggacagcgccgccgaccgtcagtaccagtgctggtacttgctgtcgttgcacttcaccagccgaaccccccgggagctgccatccaggcaggtacccagcaccgcgttgtgcagctcatctccgcgccacacccacgcctggtaccggctgccgttgcacttcaccaggcgcagcccccgggagctgccgtccaggcacgtgagggtggccacgttccggaaggagtagtcctcgggcgaggcctgccacctctggtacttgctgtcgttgcacttcagcaggcggatgccccgcgagctgccatccagacacttgagcgtcgcctcgttctgcagatcgcccggcgacagccagtcgtcggtcgctgttgccgggcttgccgcgatgccgagcgtggcggcggctgcggccgccgccacgaggagccgggcgccgcgggtgacggagcggaacatggagcacttcctccaggggtgtggcaggtaggccaacgtcgagacggcggccctttccccagcgtcctccccgtgtccctgcccgccgaagtgtccccgggggagccgccggttgcacgggcaccgcccgcacgcccctgcgcgtacatagcgccccccaccgcagaggccatcggcaccatcaccatcactgcgcgtctcccctttggaacccgcaagcaactgcaggacctcacgccgttcttcgcgtccgagcgggcgcgggccaagacgctttccatggcctcaaccgcaggattgaaccaaagggaggccgccgcccgccgatccttgtggcaccgggaaaaacaacaactgcgccgtgcaggccggctgacggacagcatccaagccctcgtcaccggagctgtcacccaggaggtcatcaagcgtgggtggaagcgcacctggcccgacatcccgcaccaggcatacgggcggtggcccggttccccggagggagcatggcccgaggcgctgacggtcgacctgcccgccgacctcgtgcaggcagtccgcgccgcatgctggcacacttgcaggaaggagatcggcctgctgtacggatggcgcgaacggcaccccgacgccaggccccgctgccccacgcgacccggatgcgacgccgccgccctcgccgaataccaggaactcgcagcgaaggtcatcacacccggcgaggtctggcgcgccgccgttgcacgcggcatccacgatgcgagccccagggattcgcctgcccgtgaacgccgccgcaggcatcgtcattgatcacttagccgacgcttccgagatcggaaggcggcggtctcgggcgcggtcaacggccgcgcccgctccacccccacaactcggtccgcagcggggcggcgccgccagctgccctcggaggtgcactcgttggcgtacagcacggtgccgtcgcgccgtacgacggtgacccggtcggagctgctcggactcgatcacgggcagcgtggacaccaggccctgcgcgcaggtgccgtggttctctcccacgacacgtaccggccccccgccgccggcggcttgggtgaggaagcggtccgcgatgccgagctgtctcagggcttccgcggtgaccagccgactacctcgatccggtggccggccgcgcggtaggcgtgggaggaggcgcggaagtcgtcggggtcggcgagcgcggactccaccacggcgtcgaagcgccggtcgcggacgtgggcttcgacggcggccttcaacgcgcggtgtcggggcggaccagggttccggccgtacggacgttggcggccaggaggctcgggtagtgccggtgcgcgggcttgtacaggtcgcggccgacccgcacgcagccgccgcggcggtccaggacggcctgcacgaggtcggcgacctgcgtctttccggcactgggcgacggcgctctgtgtcgcggtcgggaggatcacccggtgcagcacgtcggagctctcttgttcagacagcatgatgaagccggtgttcctttctgccaccgttcggccgcgtgggcggacatgctctccagcagacggtcggcttgagggctgcatcccaggaggcagctcacgatccagcgggggcacccgtggtgcccccgcctcgcattgggtctacagctcaggaagtgggactactgcgggttgcgtgactcgagttcacggcgcaggacatcgagcgtgcgtccgtcctccacgtgccacagcgtccatccgttgatcacgttgccggtcacagcttctgccgccttggacggcgaggggtacggagtggcatggccatcgacaaccaactggccgtcaggcgtcaccaccgcgcgcccagaccggttggctcggcgctggtgaaaggtcaggaccgtgcccgccttcagcaggtccgcttgcatgagatcggccagcggaccgtgggggaccacctgcctcggcgatgacggcttgcccccggtgccgagggtgagagtcacctgcacggtgtcgtcgccgctcgctttcatcaagtgcgcgatgacggccgggtcgaaattgatgctgagcgtaggcatgcggcctcccttgtagcagtccggccgacccggaccactcgtatacctctgatcgtatggcatccaggagactttttctaacttctgtcaccagtgatccaggagaaaaaaatgctgaggtcgctttttcgattagtacgcgatgtgtacggcaaacgtacgcacttcgtacgctccgtggggtagggtgttggtcaggaggtgttccatgtccgagttgtttgacgcggtcgacgcgctggtcgcgtcccgcgccacgctgccgccaccggcggagcgcaagcggctgcgtgccgcgcacggtctgacgattgacgaggtggcaggcgcgctgaaggtgcggcgggccacggtgtccggctgggagtcgggcaagaccgagcctcgcccgccggagcgcgacgcctacgctcggctgctggaccagctcgcggagctctacccggcgccctcagcactggaggagccggacgccccggcggtgccgaccaccttcaccgccgcgcccgccccggctgaggcccggactctgtctacaggcccggcgcccgaggctgcggacatgactgcaaccgagaacactcagaccagccccgcccccgtcgccgctgctctggaggccgcgccgcgtccggcgggcaccagcaggagcacgtcgacgtcgcgccgcccggccgtgcggaaggctgccccggcaggcaccccggctggcggcaccgacccgcggttcgagaacggtccgttggcggtcatcgacgtcgaggatgggcaggtcctcgcgtactgcactggcggtctggtcctggacgtgcccgccaagtcgatcccggccctggtggactggacgctgcgcgaggcgaagctcggccagccgaagctgtccgggccgggcaaggacgccgacccgctgatcgtcctcaccgaggccgcgctggagcgctacggcctgccggtcgccctcacggatgaggagcggctcgctgggcggattccggagggccacaaggtcatcaagcagctggtccgcgcggagtggaagctgacgaagcgcgggtttgggccgtgggcgcggatctaccgtcccgcacagggttcggagcgggcctgcgtgcagctgtgcattccgtcctggaacgcgctggacacccggcactggggcgaggccgggcagctcccgccggcggaactcgcccgtgtgctgggcgtgtacgcgtcccgggtgatgacgccgcgcggatcgacggcggtgaccggcctggagctgatgaccgcgctgcacccgccgacccgcgcctccgagcccgatgagagcgggaagcggcactccgagcacaaccccggctcgctggggaaggacccggtggactgcgccccgtgcgaggcccccgacgggcacccgctgctcaaggacctgccgcggttccacgtgcgcggcccggcggagaagctgttcgaggaggcgtacgactgggcgcggccgatgacggatgccgagtgcaccctgcggcacctggtcggcatcgacgtgaacatggccttcgccgccggcgccaacggcctggccgtcggcctcggcgcgcccacgcacgtcacggcgccggtgttcgacgcgaagctgcccggatcgtggctggtggacctctcgcacgtcgacctgtcgagggtgaaggtcggcaaggacaagtgggtagacctggacgcgagtctgctgcccagcccgttcacgccgaagggcgaccggcccgagggcccggcctggtacgcgacgcccaccgtcgcctacgcggcggaactcggctacgacgtcacgccggtcgaggcctatgtgcggtacgagaacggccgctacctggacggctggtacaaccggctgcgtgacgcctacctcgccacgatggccgacctcggcgtccacgccgacctctccccggccgacttcctcgcggcgatggacggctacaaggagcgtgatccggagctggcgatcgtcgtctcggccatcaaggcgacggtgaagggcgggctgggcaagctgcgcgagcggccccggggtgagggctggcggccgggcgagccgtggcgggcactgtcgcgtccgacgtggcggccggacatccgcgcggcggtcatctcccgcacccggatcaacctgcaccgcaagatcgtcaagcacgcggcgttcaccggccagtacccggtcgcgatcctgtccgactgcgtcgtctacgcggctggcggtgagggcccgttggacttcctgccctaccgggacggcaagccgctgcccggcggttttaagctcggcatcaaccccggcctggtcaagcacgagggcacccagtccgtcctatggggtgaagaggtccgcgagcggttcgacgcgccggagctcaacctcgcccggtacatcaaggacggcaccgtcaccgacgccgacaacggcgaataggagaaggcgacgatgagcatgttcggggacggcctggaagccgcagtgcacaaggcgttcacccggccggcgcccaagagcgcgggcacgcagatgcggtacctggtcaagcagtacaagggcaccaaggcggtcgcccagctgctgcggatctcccagcgcaccgtagagcggtacgtgaaggaccagatcaaaaagccccgcccggacctcgccgcccgcctggagcgcgaggtgaagaagcggtggcagccacagatccgcgccaaggcacggcagcaggcggcgaccaccggcggcatcgtcatcgacacccgcgcccgccttggctacaccgcccccatcggctccacggaccaggaccgcatccggcacctgaccatcgccctgccgccccgctacgccgcccaactcttcgaagcccaggaacagggtgccagcgaccagcagctccaggagatcgccgccgaagcgctcaaggaggtgtacttccaggacggcggccgccgcgctggaagcctggaagaggtccggttcacggacatcgagcacctcgagttcgacctgtaagcgcgccccaaacacgctgcgggccccgggctgcgctccggggccgtacacgaccggagcctcgagtgcgggatgcggcgcattagggagtgcctctgaatccaccaccttgtctgtaagtctgcggcacgatgactcgatgacagatggatggggggcggtcactgcagccgtggtgaccatcattggaacgattgtggtgggcatcctcgcgtaccgagctggtcgtgcccaagtgagtgatcaagcacgagttgagcacggtcagtggctgcgcggtcaacgccaggaggcgtacgtgacgttcctgaccgcgtgggatcgagtcgtgaagtcgctcaaagacgagatgaagaccattggggagagccagcaggcgacgccgcccaccgaacgtgaacgctttatggaggctgctggagaacgtgttctgtatgcacctgcaccagtccggggaccagcggagcaagtgctgctgctcggcccagacgacgttgctgacgccgcaggccgcatggtagatcacctcgatggaatgcaaaccgcagccttgaaccgaatcctaggtgcggccgaaccgacgtcgacagcgttctatgcggctcagcaggtggcactaaggcatcgccgggagtttcttgccctggtgagggctgtgctgcgtactccgccgaccccgcactagaagataaccgctcggcgttttcaagatgcgccaacagtctcagacggctgaagtggcgagccaagcgccgatccgcgcgaggttgatactggctgcggtaaaaccgatgccgaagatgcgcggcgccgcgcaggaagcagccgaacgcgaggctcagcgtccggtgtgcggggtgcgggcagaagcgcccacagggggcaggaagttcttcctcaccgcctcgtgccagccgtcgggcggggcccacggacgcggcctcgcgctgggtcagcgaggggcgactggtgctcatggccccgtatcctccgcctccgcactcgacaccccgacccgcagtgccgcccgcgctgacctgccggggtcgggctcatggtcgggcctgtggccggcgccctggtgcccgtggtcgggggcccgcgcgggctgggcaagcctcggcacagggcttgggcaagcctccggccgggcttgcccaacctcacgaggcaatacagctagggcgcgtccgcgggcggccgtcgtcgacagcttccatggtggggcccacagagggctggagggtcgaccccaccgttgcaccgatgggcgcagcacccccgtcgtgcaggcgcccaccgtgggcccacacacccgtcgcagttactgaccttttcggattggcttcgggggatctggggtgagggtcagtccggtttcggtgaggtagccgtcaatgagctcggggtgacgctggatgtgggcgagccctcggcggagggtgcgggtgaggtggtcggggtcggtgaatgcggtgttggccatcggcccgtgccgtaaccacgaccagatgccttccacgggattcaagtccgggctgtaggagggcagctggatgatggtgagccattcgtggctgcctgcgtactcccgcaatccggcagcacggtgggtgttcaaattgtcccagacgacaatgatcggggcgccgagctgcaggtgcgcgcggaccaggaggtcgcggtagtcctgccaggcgaagctcttgcgtgctcctttgaggagcaggtggaagcggggccggtagatcagccgggacctttcgccgggccggtagcagcacagtgcggcgaccgagatgcgtcgccgggaccgtccgcgcactctgactacgggagtctgtccgcgccggccccaggtgcgggcgtgtggcggcgtcatcgcgaacccggcctcgtcctcgaagacgatgtaggccccgagcgccgccgcggcacttccacctgcggccacacgtccttcttccagagctcgaccgcatgctcgtcgcgttccagcgcgcgacgggccgggctctgccaggaccagccgtggcggtgcagcagccgccacactcccgcgatcgagcaactgacctggaactggcggccgatcagcgttctgacgcgttccaatgtccaccgctggtcttcccagccatgcgcggccggccctttggccagctccttttccagcagggcgaaccgttcgtccgacagcttcggcagtttcgcaggtcccttcgacttcagaccctcgataccgccttcacgccagttgcggcgccattgctccaccgaacgctcgctcacccgcaggtctttggcgatgtccgaagtcctgtcacctcgtgcgaacctcaccccggcctccagccggatcccttcacgcgcagcccgccgctcagcggtcaggcccccaccatccgcgtaccgcatagcaccggcataccgcagggatcacccaacgtcaccacccgaaggcaacccgaaaaggtcagtagtgacctggacggtttcaccgagcaccgcctccagccggacggcagactgctcaccacctaccgccagtctgactacttcgtctcccgcaccctgatctttcaaggcagcaacgcgctaaagacggcccgccaccgcgcaaagcagtacctggccggtatggcaggccatcagtagaggcctacgtccagcgcattccgatggcggacagcttctccatccgctcgggcgtcagcgtcgcggccctgctgcgctgattcccgatccaggcccccagcttgtgctctcgctcctcctggtcttcgccgacggtccgctctatgtgcttcctcgggacctgaaggtggccttcgcgttcgtagaactgtttggcggcctcgtagttcatcgcccacttgtcggcctgtgtgcggcgcggtttcggcttttcgtcctcggtggcgggtgtgatgccgaggacgtgctcgcacatccactgctgcacggtcgtgagcttgtcccagccgagccgcaccgaccgcacccaccgccccagatcctcgccctggcccaggacctcgcccgccgtggtgggcagcgcctcgcccgcgtccaggtgcatccggaccaggtggaagcacctctgccacgtcaccggccagctcgggcaccacgacgcgtcgatctcctccagctgctcgcgccgctcgtccgacagtgccccggccgacgactccaccggcaggccctcggcacgccgccgttcgatctcggcagccttccgggcggcggtccgcgcgttcttcaaccagatgcccaccttcgcgccctggtaggtggcgtccagcggggctagaaggtgcccgtgttcggcggcccacccgcgcgcggcggccagtccctcctcccacgcgacgtcgaagtgcgaccacaccatgccgagtttttccagctgctcgacgcggtcggcgtccatgtccccgcgggcgtagaaccttctggcgtcggcgatccactgccccagtggaaacgcggcgagcgaggccggccagcccttggcctgcgtctcctggccggtgtggccgggcacgtggaacgtgaacgggaccttcaggtcgccgtgttcgcgggcgtagatgacggcggcttcgatgccgcggcgccagtgttggtgttcggggttgaggacgcgcaggttgatgaacgccgcgagggcggccgggtcgcgcggcgtggagaacttcagcagcgccttcgcggagaccgagacgctggagccgtccccgctgcctccctgctccttgctgatttcccgcgtctgcacgcctttggagcggctgggggcctgctgttcggccagctgctccacgacgcgggcgtcgtgtgccctgagggcctcaagcagtttcgccagtccgccgaacgcccgggaagtgagcatgttgtccgctgtctccccaggcccgagcagtaccggcaccacgagggaggccgtcttcccctcgcccggctgcatccgcagtgcccggccgacggcctggacgaggtcgggcatggagccgcgtacgtcggcgaagtagacggagtcgcagttcttggtgtcgacgccttcgcccaggaccttcacggaccccaggtagctcttctccacgactgtgccgtcggtggcgatgccgtcggcgaattccgtgaggacgcgccggcggtggagtggcttgtgctcgccgcacagccagttgacccagacggcacgcgggtacagctcgggatcggcggcgtgcaactgcgcggcgatgtccgggagaccggccgcgaacgcctcggcctccttcacgacgtggtggaagacgagcgtacgcctgaagccttcctcggccgacgccttgaccagcgccgtctgcagcgcggcgagccgcgcaccacgtacctgctcggaccgcgcttcggcgcccaggagctgcgcggcctggagctgggtgtcggtgatgtccacgcacaccacctggtagggggcacagatccgccggtcgatggcctccgacagcgtcagggtgaagcacctgctgccgaacggcccgtccggatcgtcctccatgctcgcgaccagctcgcccggcgcgcccggctcgaagtcctcgtccagctgccacagccggggcgtggcggtcatgtagaggcgacgcagggcggggatgcgagtgttgtcgtggacgaccgcccatggcttgccgatccggcccgaaaccctgtgcgcctcgtccacgacgatcaggtcccagcccggaaggccggcggcgtgcgcgcgttccagcgtgcccagcccgagcgaggcgtacgtggcgaacaccgtgaccttgtcgaacggccgcacccagtcgaccagctcctgcacgtccgtggtgttggggaagcccgcttcctccccgcgcagggacgagactccgatcatcgggcccctacggcctccctcgcgccaggcggtctcggtctgggcgagcagatccagcgaagggacgaggacgagcacacggcccgcacggagctcctctgcactccgggtggccacgagggtcttcccggccccggtcgccatgaccacctgagtccgcagaccccgctccggcacagtggatcttgcaggcaattcgagcgcccggagtaccgcgtccacggcttctcgctgatgaggacggagttccttcacagccatctggatctaccctcttctacgagccggacgaaaggccccacacgccaaacgcgggaaaccagcaagcaacgacgtgcgatgggccacgacacccccaccgaagccaccgggttcacgccctcatccgggacccagatgaccaccttgcagcggatcacagaccccacagcactggagtcatctaaatccagagtctatcgcaccttaaaaaagaagcaggcgttctagggaatcaacacgcaaaccacgggtactccacatccatcactgtccacccagtcccggagagtcatgacacacaagactgaaaacgagaagggcaaccggttctgcaaggcgtgcggcacgcccgccgaagacggaaagctgtgcaaccactgcagcaccgtcctggacctccccgacgatgcagggctgaccgaagaccaaggtgcagcagtacgacgcaacttcgaaggacgcaccgagcagcaaaagcaaaagtgagcgaaacggcagggacaaacccaacccactgaacagcatgcacgggggtacacgggccagcatggcaaccaagaccgatcgcatcatgtccctgcgcgccgtgcggcaactgcgccatgtccgcgccttctatgcggcaggagtcctgttgtgggccgccgcagcaatctggacgggatggacccatcccgcaagccggcagatgtgggtctccgtacttctcctggcggtcttcacaagcctgctgttcacgacttccctgtggctgtggcgcctccaagccggcacagcaggcaggccggcgcatcacgctgcaccgcgacaggtggtcgcccgacgccgcgcgaacgcctgagcccgacagtcgcgtagcccccttcgaaaccaggccctgcccgcctcaagcgggcccatgctcctggaggcgcagccggaaggaccgcggggcaccagagaagtgcagcggggccgccgagggggcgtcgcccgttacctgaggcggtgtcagggcattcggagatacatgaatcgagatgcggtaatgcaggccgcctccgacggcggcagtccagttttcatcccgatcttgtgcgccttgctgatcatggggctggttcaagtcgtacgtccgcaactgctctggaagatgaataggaacctgcagcggggatgggtgaagaacccggacgcgaccgagcccaccagcaagggatatgccatgcagcgagtgacggggctgctcttcctggcggtcgccacatggatgctggtgcagcagatctgactggaagccagacgagccgcaggctgcaacccgggggagtggacgctctggcggcagttgagggcaaggcgactgaggaagggaggtgcgcatggagcaacgcccggattctcgtgttccgccgtcatggacgagaccaggtaaccggtgggggccgcgggtttactggccgatgctctgtctgagcatcggccagctggtgtggcgggtgatcgacggtgacagtgctgtgcgcatcgttgtggcggccggcctggtcctcatatggatctgcctcatagctgccaaccgggctgcacggcgcaaggaggccagccgagagccgcccctgtagccagcctggcccgcgccagcgggccttaacggcctggaggcgcagccgaagggccgtcagggtggggagcgcagcggactcacccggagtctgaagcgaagcggaagacctcctgcggtggacatagtccaccgcagctccgggagcgcagcggacggagcgtcaccaccattgcgcagcaatggtggtgagcggggatgcgcagcatccccgccagcgttcccgcggagcgggaacgcaacacccgtgcgcagcacgggtgttcgcttgcacatcgcgcagcgatgtggtacccgctccgcggg

SEQ ID NO: 2 - DNA, 429 bp, Streptomyces avermitilis
  CDS (1)..(429)
atgaccgccgagtggtacgtcctcgtcgaagaggacacacgagagaccaagcgcgccgacggcgttgaactcagattgcaccgctggaaactggcggccactcagcacatcgcaggagatcaggaacaggccgccgccgcggccgaggatgcggccctgaactacatgccgggagtgctcgctcggcatgcccgaccgggagacgaaccggcccggcatgctttcctcacccaggacggggcctggctggtgctcctcaggcagcggcaccgcgagtgtcacatacgggtgaccactgcccggctcatgcatacacaggaagagaaggaggccccgccgaaaagcttcaaggagaaactccgcagcgccctggatggtcctcagccgcccgaaccggctggtaggccatggaagccgggcagcgaaacc

SEQ ID NO: 3 - DNA, 231 bp, Streptomyces avermitilis
  CDS (1)..(231)
gtgccccctcagggagcccgtggcacgatcgtgtcagctaccgggtccggcaaaacgagcatggccgccgcgagcacgctgaactgcttccccgaaggccggatcctcgtgaccgtgccgaccctggacctgctcgcacagaccgcccaggcgtggcgggcagtcggccaccactcccccatgatcgcggtgtgctcgctggagaacgacccagtgctgaacgagcggacc

SEQ ID NO: 4 - DNA, 543 bp, Streptomyces avermitilis
  CDS (1)..(543)
atggactggaacttccccgacgacgacatcttcttctgcggcgggtgcggcgacgacgacacccccgacccgcgggtcccgcgtcaggacaaggccctgtgcgtccgctgcgacagagtcgaacggcaggtccgccgataccggatcaccgtgccgcggaggaacgcgatcatgcgcttccagcgcgacgtctgcgccctgtgccaggaaggcccgccgaccgaccactgccccgatgccgtcagcttctggcacatcgaccacgaccaccgctgctgccctcccggcggctcatgcgggcggtgcgtccgcggcctcctgtgcctgccctgcaacgccacccgcctgcccgcctacgaacgcctccccaacgtcctccgcgacagccctcgcttcaacacctacctcaacagcccacccgcccggcaccccgaagcccgccccaccgccagggaccatgcaggcccccgcgacgcatccagctacctcatcgacgcctttttcaccgccgcggaccatcccgaggggaacgccctcagctcc

SEQ ID NO: 5 - DNA, 504 bp, Streptomyces avermitilis
  CDS (1)..(504)
gtggcacttaccccagggggaacccgagtgacgcagtggcaggaccgccaggcgataggcgacatgcacgaacgtcgggtggcggccgcgctgcgcgcccgcggctggaccgtccagccctgcggacagggcacctacccgcccgccgtacgggaagccctgcgccggacccgctccgccctgcggcacttccccgacctcatcgccgcccgcggcgccgacctgatcaccatcgacgccaaggaccgcatgcccagcaccgacaccgaccgctacgccgtcagcgccgacaccgtgaccgccggcctctttttcaccgcggcccacgctccgactccgctgtactacgtcttcggcgacctgaaggtcctcacgccggcggaggtggtccactacaccgctcacgccttgcgccaccgcagcggtgccttccacctcgtacgcacggagcaagcacactgcttcgacgacgtcttcggatcggctggcgcagcagctgcggca

SEQ ID NO: 6 - DNA, 936 bp, Streptomyces avermitilis
  CDS (1)..(936)
atgatgctcctcatggcggcatacgttgacccacgctttcgtcctacgctatggcctggaacgcccgtgccgacaccggagttgatgcctcttcgcggagcgcgggccgacggtgaatggatcgtctggaccccgcaggtccgctcccgctcgcacacggtccccgtgccggaggacttctacctgcgcgagttcatggaggtcgaccctgaggacctcgacgccgtggccgccctgatgggcgcctacggacacctcggcgggagcatcaacaccggaagctgggacgtcgacgtctacgagcgcctcaaggagctcacggagcgcgaacacccccgcgcgccgttcgccctgcacggcgaactggccacgctgttcatgagggaggcgcaggcggccatcaccacctggctggccctgcgccgcgagggcgggctcgacgcgctcatcgagcccgaggtgtccgaggaagaactggcgcagtggcaagcgagcaacgctgatcttgaggaagcgtggccgcgggacctggaccacctgcgcgaactctccctggagatcaggatcagcaacctcgtgagcgaactgaacgccgcgctgaagccgttcagcatcggcatcggcggcctgggcgaccgctaccccaccatcctcgctgtggcgttcctccagctctacaaccacctcgccgaggacgccacgatccgcgagtgcgcgaacgagacctgccgccgccacttcgtacgccagcgcggccgcgccgcatacgggcagaaccgcaccagcggcatcaagtactgcacccgcgaatgcgcccgcgcccaggcccagcgcgaacaccgccggcgccgcaaacagcagaccacgaccctccagcagccgccggcgcctggtcctcagtctcacgacacctcagagccgactgccgaagggcgc

SEQ ID NO: 7 - DNA, 2625 bp, Streptomyces avermitilis
  CDS (1)..(2625)
atgatcagcctgcgagaacaccaggtggaagcgaacgcgcgcatccgggcgtgggcgggattccccacgaggtcaccggtaccggcgcaagggctgcgcgggaccgtcgtctccgcgaccggctccgggaagacgatcaccgccgcgtgggccgcacgggagtgcttcaggggcggacggatcctcgtcatggtccccacgctcgacctgctcgtgcagaccgcccaggcgtggcggagggtcggccacaacgggccgatggtcgcggcctgctcgctggagaaggacgaggtcctggagcagctcggcgtgcggaccaccaccaaccccatccagctcgcactgtgggcggggcacgggccggtagtcgtgttcgccacgtacgcctcactcgtagaccgtgaggatcccgaggacgtcacgggccgggcgaaggtacgcggtccgctggaggccgctctggccggcgggcagcggctgtacgggcagacgatggacggcttcgacctcgccgtcgtcgacgaagcccactcaaccaccggtgatctcgggcggccgtgggcggcgatccacgacaacagccggatccccgcggacttccggctctacctgaccgcgaccccgcgcatcctcgcctccccccgcccgcagaagggcgcggacggccgggagctggagatcgcgacgatggccagcgaccccgacggcccttacggtgaatggctgttcgagctcgggctgtcggaggccgtcgagcggggcatcctggccggcttcgagatcgacgtgctggagatccgcgacccctcccccgccctcggggaatcggaggaggcgcagcggggccggcgcctggcgctgctgcagaccgcgctcctggagcacgccgccgcgcgcaacctgcgcaccgtcatgacgttccaccagcgggtcgaggaggccgccgcgttcgcgcagacgatgccgcagacggcagcccggctctacgaggccgaggtctccgccgaggccctggtcgacgccggggccctgccggagtcgtcgatcggcgcggagttctacgagctggaggcaggccgccacgtacccccggaccgagtgtgggcggcgtggctgtgcggtgaccacctcgtcgccgaacgccgcgaagtcctgcgccagttcgcagacggcctcgacgccggcaacaagcgcgtgcaccgggcgttcctggccagcgtgcgggtcctgggcgagggcgtcgacatcgtcggcgaacgcggtgtggaggcgatctgcttcgccgacacccgcggctcccaggtggagatcgtccagaacatcggccgggccctgcgcccgaaccccgacggcacgaacaagaccgccaggatcatcgtgcccgtcttcctccagcccggtgagaacccaaccgacatggtcgcctccgcctcgttcgcacccctcgtaaccgtcctccaaggcctgcgctcacactccgaacgcctcgtcgaacagctcgccagccgggcgctgaccagcgggcagcggcacgtgcatgtgaagcgggacgaggacgggcggatcatcggcaccaccaccgaaggagagggcgggcagcacgagagcgagggcgcagtcgagtcagcactgctgcacttctccaccccgagggacgcgacgacgatcgcggcgttcctgcgcacccgggtgtaccggcccgagtcgttggtgtggctggagggctaccaggccctgctccgctggcggaaaaagaaccacatcaccggcctgtacgccgtcccgtacgacaccgagaccgaggccggcgtcaccaaggcattcccgctggggcggtgggtccaccagcagcggcgcacctaccgtgcgggcgaactcgatccccaccgcacgaccctgctcgacgaggccgggatggtgtgggagcccggcgacgaagcctgggagaacaaactcgcggccctgcgctccttccaccgcgcccacggccacctcgcccccagacgcgacgccgtatggggcgacgccgacagcgaactggtcccggtcggggaacacatggccaacctccgccgcaaggacggcctcggcaagaacccgcagcgcgccgcaacgcgggccacgcagctggccgcgatcgaccccgactggaactgcccctggccactggactggcaacgccactaccgcgtcctggccgacctcgccaccgacgaaccccacagccgactccccgacatccagcccggcgtgcaattcgaaggagacgacctcggcaaatggctccagcgacaacgccgcagctgggcggaactctccgaggaacagcagcaacggctgaccgcgctgggcgtaacacccgccgaaccgcccacaccgaccccgtccgcgaagggtggggggaaggcagcagccttccaacgcggtctcgcggccctcgcacagtggatccagcgcgagggcgcccacaaggtagtaccaagaggacacgtcgaagccgtcgtcatcgacggccaggaacaccagcacaagctcggcgtatggatctccaacaccaaaacccgccgcgacaaactcacccacgaccagcgcaccgcactcgccgcactcggagtcgagtgggct

SEQ ID NO: 8 - DNA, 2070 bp, Streptomyces avermitilis
  CDS (1)..(2070)
gtgggcttagcagcagggtctgcctcagcggttggtgttctcctctcggatcatccgtcggaggctggtgcgtgctgccgccaggtctgtttccagggtgcccacgcgagccggtggttgtcgtcggtggcctgctggaggctgtcttcgagccgttggttgttccgggtgagttcgtcgacgcgttcggtcaggtgcccggtgtcgagggcgtcgagttgctgcccaagctggcgtttccgtgagcaccgacgcactcccccggacgcggccgtggcgccgtgggcggcgcagcagcccccgtatcttgccccgcaccagttcagtctcctgccgctgcccgaactgctgcgctgggaggtcctctacggtctgcagcaggtggacccgtggctgcggatcttcgaacctgcgcaggtccgccgcatggtgcgggacctggctgagaccggcacgctcatcgacggcatcagggaccagcagatgtgccctcgctccaccgttgcggtcttgcggatgctcggccgcgtgcgtacggcggtccgtgcgggccatgcggagtacaccggcaccgcgccggcacaggacgacgtcctggatctgcgtgcgctcggccagcgctcccgcaccccggccggtatccggcagcccaagaccgtcgatctgcgcaccatccggcagccgtggctgcgcggcctgctgcgtacctggaccgtccagcagcgcccgggagcggacgagttcgcccgcacgctgcgcggcgtggagctcgcctcccgggctctcgcgcagcgcccgggaaccgacgaccccgcaggcttgcgctacgacgacgtcaccgccgtggtcgacgcgatccgcacggcactgaaacgggacggcgaaccggccggctggaactaccgcatgtccatcgccagccactttttcgccttgatcgactacggccaccgctccggagccgcggacgacctctcggccgcctttgtccgtgaccccgccctccaccgcatccctgagcaggaggccaacgaggacgagatcggcaaggcgatccccgaaccggtgatccgccagctcgacgcccacctccacctccttggcctggggcgggcccgcggccagcgcaccctcgcccccgacgacctgcagctgatgtaccgcacgctgtacatcctgctcagagacaccggccaacggcccctggaagtcctctccctgccccgcgactgcctggagacccgcaacgaccagatctccctgatctggaacaaccacaaggcccgccgacaccgccgacgcctgcccatcaccacgtccaccgcccaggccatccgtacctggcaagaacgccgagaacagctccaggccagccttccgcccaccggcgccgactacctcttccccgccctcacccacctcgccacccgcccctacctgcacaccagctacctcggcgagaccctgcgcgactgggtcgactccatcccccacctgcacggcgaaggcaccgacacacagggcaacccactgcctttcgaccgctccctcatctacgcctacgccttccgccactcctacgcacaacgccacgccgacgccggaaccccactcgacgtcctgcgcgaactgatggaccacaagtccgtcagcaccacccagcgctactacaccgtctccctgaaacgaaaacgcgacgccgtcaccaagctcgccgcccacgtcgtcgaccaccacggccaccccagccccagctccgagaccgcctacgaactgcgctccgtcgccgtcccctacggcggatgcaccgaacccagcaacgtcaaagccgcaggcagctcctgccctatccgcttccagtgcgctggctgcggtttctaccgccccgacccctcctacctcccggcgatcgaacagcacatcaacgaactgcgcgccgaccgcgaaacagcccaggcgatggacgccgccgaattcgtcatcaccgccttcaccgcccagatcaccgcctacgagcaggtcaccgaccgtatgcagcgccgcctcgccgctctccccgtcgcagaacgc

SEQ ID NO: 9 - DNA, 747 bp, Streptomyces avermitilis
  CDS (1)..(747)
atgagcagcatctcgtccgcactgtcgcggctgcccgcaccgcgcgccgaaaacgcgggggatctcgacggcgggggatgggctgcgtggctgcgaggtcatctcgatcccgcctggcggaccagtgaatggcggcaggactgctggctgttcaccggcagtgtccacgagccgcgcagctcggttgcgctgtgccgtaccgaggcgtgcgacaccgtggtctcaccggccaacatcttctgccctttctgcaaggaggagcagaaacggtcgccgctgcccgacgcggagttcgcgcgggccttcgtgccggtgcgtaaccgcgttgccttcggtggtgttccggagccgtgcagtttcacgaaggacgggcagcgctgtgtccggccccgccactgcaaggaactgtgcgccacgcactacacccagtggaaaacccattccacccgcaagaccgccggccggtgggaggacaccgccgtcccgtatgctgatacccctgcctgcccggctcccgcctgcccgctgccgggcctgtacggccggggcctgtgccggcatcatgcgcagcgctggatggccttcctcatccggtctctgtcttccctcagggtccggatctcctgcctggcgagctcgagttctgtgcgcagcgtggcggtggtgctgcgggtgcgggcgggcgagggggtggtggggtgctggcgttgttgcgcggcttcgatgtgctcgcggatgccttcagcg

SEQ ID NO: 10 - DNA, 171 bp, Streptomyces avermitilis
  CDS (1)..(171)
atgctgcgtcactcggcggcgacccgctggctgcgtgacggcgtcgaccgcgatgtggtgcagcggctcctgggccacgcctccccgttgtcgatggagcgctaccggcacgtcaacgacgccgaggcacgggcagcggtcgaacgcgtcggttctctgaaggagcgccga

SEQ ID NO: 11 - DNA, 2394 bp, Streptomyces avermitilis
  CDS (1)..(2394)
atgctgcgttccctgaactgctggccgtcgcgcgccaccgacccgagccgtgttgcggagctggtacgaccgtatgcgggcaccacgccacagtggggacagcggcttctgcggctgattgagtgggcgctcacacccggccttattgacctcgccgtcgacctgatcgagagcggacatgcggacgaggcgcgtggacccatcgcggtgaacagtgacttctggtcactcctctacggtttggccgagaccgctcccgctcccgctgcgcgccttgtaggcgcctatctgtggcgtcaccttgcccgagcgcgcgccgatgactccggcgaccccttcgaatccgggcacttgtcaacgcattcccagtttgccgacacggtcctctcccgcatcgcggaggccgagccggaagcctacgtgagccaggtcctgccctttgtcatcgacgtggctacggcaggcagcacggggggcaccgacgcctatgcccccagcggccgttgggctcaccgccttgtgggcggccacggcgtcgacgctgcactgctgaccgccctcgacactgcactgcgctccctggctgccaactccccggctgccgctgcggacgccttgcagcaactgactccctcaccggttcaagagctgcgcttcctcgcctgccgtgtctacgccgtcatgaatcaggcagacgaggcgatcgcctggctcctgaacgatgaacgcaacctgcgcctgggctggctgagcagtgcgcgctgggcctcgcgtgaactcatcgaggcaaccacgcctcactgcagtgacgagacgttggaacgtctgaccgcgatgctgctcgactactacccggcgtgggaacaccgacggcagaaggggcagcacagcgcctggggctggagccagtacgagctgctgtcggcaatctgcccctcgcgccgtagcgacgcgggatgccgccgactcgccgaatgggaacgcaagttccctggccaggtcccgtcgccaccgacaccaatccagactgggttcgtcggctcgccgatcagtgaccatgcggcccggcacatgaccaatgaacagtggcaccgagctctgaacatgtacgccaagccccaggccgagcggttctggccgcctcaggggggcgttcacgaacttgctcagaccctgggcagccgcgcggagcaggaacccgagcgctttaccgacttcgccttcacgcttggcccggacgcaccagccacctacctgtgcgcgatcgtgggagcggtcacgcctcatctggacgccgaccgttgggagcagttggctctccacactcaccagatcctcggccccgccgccgcgcccacgatctgccgcgccctgcagtcggcgccgcagaacttcactgctgcttcgctgccagccctcgacagctacaccacggacccccaccccgagcaggacatccgcgacgccgatgccgagggaacccgaacggatctgctgaccgccggcatgaacgccacccgcggccaggcagcgctcaccgttgcagccctgctcttccacggcagtgagcacctgcacgccttgacacccctggtcacccgcctcgccaacgactctgtgctcgctgtccgagtctgtgccgcccaggccgtgctggccttgatgaagcatgaccctcagattgcgctggacaccaccgagcaactcctgaaccaccaggacgccaatgcctacaacgcctccaccactcaacggctgctcatcaacatactggtccgtgaaccgtcacgtttcgctgcccacctcgctcgagccctccaagggccgggcgatacggccgaacttgccggccagtcctgggctgttgccaccatccagggatgcctcacccctgaccttccgaacagcacggatgaactcaacgccctcgcccgccgtggggctgcatcggtcttcgccgacaacatcgaccactacccgcaccttgtcccgctgttcaacgacgatgacgccgacgtgcgaaagaacgcctcccagggcatgcggcaggtgttcgacctgtttcctgcgcaagccgacgaactcgtcagagcgttcctcgatggcaaggcgttccccgaccacctcgaacatctggccttcgctctctacgaccacgctggcccccttcccactgtcgctattgatgcctgcgaacgcatcgttcagcacgcgggcagggagctcggcgacctcagaacccatcgtgcggcggacggccaccacctggtctcggcagtcctccgcctctatcggcaaagccggcaggccgaacggatccgttgcctggacgtcatcgacaggctctcgcaagcaggtgcctacgggttgaccgctgctttggaaaacgagcgc

SEQ ID NO: 12 - DNA, 2145 bp, Streptomyces avermitilis
  CDS (1)..(2145)
gtggggctggcgggtggggctgcggataaggcgggtaaccggtacgaggactggtggaccgcgctgagggtggcggagttgctgcgggggcgggcgacggggattcgtctggaacccccggggccggcgggcgccgggatcgagttcgagctcgaggcggacgacggcacctggtgcgagcaggtgaaggacgtcccctcgaaggggccgtggaccctgagcgctgcgggcaagatcctcgaggcggtcacggggcatcttgcggggggcaagaaggtgcgccttgtgctgtccacgggggcccctgaactgcatgatctttctaagcgggcccggggcgccgacacactcgccgagttcgagggcatgatcaccaaggcccagattccccagtttgtacaggtactcgagaactggtccgacaacgggatgccggtcgaccgggaggtcggctggcggtatctgcaggccgtgcacgtggagcacatcccaccagaggcactgcgccgcctggtggtctccgagtatgagctgctgtttgtcggggacccggaagtgatcgtcaggcagctgagcggctatctcgacgagcacctgcaccagcgtctcaccggctcccagatccgcagccatcttctaaccgtgccgggggtgcgcccacgtctgctggcgggtgacaccgggacgctcacggccctggccgggacggtcgagcgctttgtgcggcgcgtgcgacgggacaagcccgcgttcgggatggccgctcgtccgcatgtggagcagctgtacgagcgcctggtggctgaggacggcccgcagatggtggtctgcgagggcagcgctggcttgggtaagtcagcggtcgtcaccgacgtcctggtccggctgaccgagcagggatggccggcggccgcggtccggatggacggcgccgacgcgagtgtgcagacggccaaggacctgggggtcaggatgaccctgccggactcgccggcggtgctgctggctggggtcgcggacgaagcgccggcgctgttggtgattgaccagctggatgcggtcagcacctacaacggcaggatgtcggatgcctatgaggccgtggaggacgtactcgcacagctggtcgtcgccccgaacgtcaaggtgctcctggtggcccgcaccatcgacatcgacaatgaccggaggctgtccgacctggtcgccgaccgcgtccggacagtccggttccccctcagcgtgctggacgtggaacaggtgcgggctgtgctgtccgccagcgggacggatcccgacggcttggggccggtgacgctggagctgttgcggactccgttgcacctgtcggtcttcagccgtctgtcgtcctccgcacgggccgcttcctaccggaccttgcaggagctgtacgcgcgctacaccgatgaacgacgcgaggagatcgagcgacaggtcgccgcactggactggcggggtatcacgggcacgctgtgcgcctccatgagcgaacgcgaaaccctccaggcacccatggctctcctcgacggttttgcccgccagcacatcaaggtgctcgaatcgcacggtgtgctggtgcgcgacggggaacagatcgggttcttccacgagacttacttcgatttcctcttcgcccggtccttcatctccgccggagaggacatccacgagttcctggccaactcaggtcagtacctgttccgtcgcgcccagacccggcagatcctcgaacaccttgctggcacagaccctgaacgtttccgcgccacagtgggccggcttctgggctccgaccggatccgcccgcacctgcatgatgtgattatcgcggtcctcgggcagttcgatgccgcgctgcctgactggaaggccgtcgaaccggtcgcttggggtcagacgcctgtggcgggcaaggtacgaggtctgctcgccctgccgcagtggttcgacgccgccgaccacgatcagaggtgggaacgctggctgggcacgccgcggaccgccgatgctgcgttccctgaactgctggccgtcgcgcgccaccgacccgagccgtgttgcggagctggtacgaccgtatgcgggcaccacgccacagtggggacagcggcttctgcggctgat

SEQ ID NO: 13 - DNA, 1884 bp, Streptomyces avermitilis
  CDS (1)..(1884)
atgccgtctgctacgccgtctacgccgtcgagcactccacctgcgtggccacactgtgcccatgacgccactccagaggatccggtcggctgccgtggcctccgcgtcggcagtcataccgcctgcctagcccacctggacgacaccgaccgtgccgcctacctcacagttctgtcacccggcgccgacatcgaccaccgaggcactcccttcacccctaatctgctgaaccagctcctcgccgccctgcgtgaccccaccactggtaagccccgcacaggcgaggcccggttcgacggggcaaccttctccggcgaggctcggttcaatggagcaaccttctcccgcgaggtccggttcgacggggcaaccttctcccgcaaggcccagttcagggaaacaaccttcacccaggacgcccggttcgacggagctgctttctccggcgagaccgagttcgagaacgcgaccttctcgcatggcgctcggttcgggaaaacgaccttctcctgccgcacatcattcgacgtagcgaccttctccgaccaagcctcgttcgccggagcaactttctccggcgaagcccggttcatcggcgcgcgcttctcccgcacttggttcagcgaagcaactttctccgctggcgcgcgattcgtcgatgcgaaattctccgaggacgcccggttcgacggaaccaccttctctcgcgatacctcgttccagggggcaactttctccggcgacgccaggtttcacggggcacggttcgagatgtcgtccttcctggggccactggtgtgcagtaagcaggtggtgatggacggtgcggtgttcgggcagccggtgacggtggagattgccgcccatcaggtcagctgtgtgcgcacccggtgggcatcgaccgccacgctgcgtctgcgctacgccgagctggacctgagggacgctgtcttcgagtaccccgtgacagttgccgcccgcccgaacgcccttcggagccgagtatctgtctcgctgtcggaggcagagctgtccggccgggagcccggagtgcgtctgatgtcggtggatggggtggatgccgcgcacctggcgctgcaggacatcgacctgagtgcctgccggttcgccggagtcgtccacctggaccagctgaaggtggacggctggtgcactttcgccggcgttcccgctggctggggccgacccttttcctggccgtcgagccagcgcaacacactggtagaggaacaccattggcgagtgcgtaccgcccgccgccccggccgggccgtcgcccggggctggacctcgccgcaggacgcccccgtgctgaagccggcaatggtggcggcgctgtaccggcaactgcgaaagtcgctggaagacggcaagaacgagccggacgctgccgacttctactacggcgagtccgagatgcgccgccatgacgtcacgcggccctggggggaacgggcactgctgaccgcctactgggccctgtccgggtacgggctgcgcgccatccgaacactggcctggctggtggcggccatggccgccacgatcgcggtgatggtgctgtggggcctgcccgccgatgacccgaagccgaccaccaccggccgccaggtcgcggtaggtcaggaggtcctcctgaccaccgacgtccccgccccggtcaacccctccggtccactgactgaacgcgtcaccaccgaacggctggagaagggtctgcgggtagtgatcaattcagtgatcttccgctcctccggacaagacctcaccgccaccggcacctacaccgagatgacctcccggcttgccgaacccgtcctcctcggcctggccgtccttgccgtccgcagccgcgtaaagcgc

SEQ ID NO: 14 - DNA, 1092 bp, Streptomyces avermitilis
  CDS (1)..(1092)
gtgcggtccgacaacaacaaacgtgcctaccgaaccgcccgccctgagataaaaggtcttcgggctcatgatgaagaggcaatcgaattgctggcgattccgcaggagccgcagaaggacgtcgcgcagccgtcccagcacatcggtccgccgcccgaggaaggcgaggacgaatcacggttgctgctccgtttcgcagccccgcgtgatccggtgatggtcgcggactgggtgtccttcaacgtgatcgacaccgagaagcaggactgggcccgcggctgggcggcactcaagaagttcaccgaacgtgagcagcacgccagagtcccctatgggtacaaagagggtgcttaccctctcgggcaatgggtcgcagaacagcgacgcgcatacggggcggggcagatgaccggccaacgcgcccggcggctggagcaattgggcatggtctggtcaccggccgatgagcgattccaggagaacctggaagcggcccgcgcgtacttggaggagcactggacgctgtgcgcgccccgctccgcgaccatgctggaccggccggtggggcagtggctgtccaacctccgccgacccggcgccctggaaggacaccccgagtggaagacggcgctggaggccgtggacgaggattggaacccgtcgtggccggcggagtggcagcggcactacgccgcgctgcgcgatctggtggccgacgaagagggccaggccgacgtcctgccgggcttcacggtccacggcatggacatcgggaagtggctggcccggcagcggaagcccgaggtctggcaggccctgacggacgggcagcgcgagcgcctggagcagctcggcatcgtgccgctggccctggagccggaggagcccgcgaagccgtccgcgacgcccgtgggggccttcgagcggggcgtggcggccctggcgcagtacaaggcccgggaaggctctgtgacggtgcccagggcccatgtagagcggctggaggacggcaccgaggttcggcttggggtattcctgaccctcgagctggtgcctctcccagcgccagtgggaccgcctgcgccctgtacc

SEQ ID NO: 15 - DNA, 831 bp, Streptomyces avermitilis
  CDS (1)..(831)
atgacctcccaaaacaccacagccgcgccctgcgcaccaaattttttgcctatcaggaaagttcaatcacgaactaatcacgttccgtaccttcgcggcaaccatgcaggtccttcaccggtcacccacgcgcaaacacagcagaaacccgtggggagcaccatgagccagcagcagtacccccagccccagcagcccggccgcaacggcctggccaccaccgcactcgtcctcggcatcatcgccgtcgtagtcagcttcatccctgtcctcaacgtcgtcgtctggccgctcgcgatccttggcatcgtcttcggcgccatcggcctctccaaggcgggcaaggtccgcaagggcaagggcgccggcatcaccggcctcgtcacgtcggccgtagcgatcatcatgttctttgccatgaacgccctgttcttctccgccgtggacaaggccagtgaggagctcgacaagtcgtacgactccaccaccgtcggcgacggcaagtccaagaccggcggcgccaaggagtccaaggtcatgaaggacttcaaggtcactaagtgcgacgtggtcaccggcgacttcggcatcaaggagatggccatccacgtcgactacgccaacaacggcgaccgccgatactcgtacttcgtagagggcgaggtcctggccgacggcaagaaggtcgacgacttcatgtcaaccgccgagaacctcgccccgggccagaagttcactgacaagaacgctggtgcgctggtgaacgcggacgagatcaaggacgccaagaagctcgagtgcaagaccatcaacgcgtcccgaactgacttc

SEQ ID NO: 16 - DNA, 516 bp, Streptomyces avermitilis
  CDS (1)..(516)
atgctgcccgccgatcccctgctcggcaccgatcagcaggaagtcgtggcgcggctgtggaagcggcagcaaaccgagacgggatgggcctacctcgtggggctgccgtcctaccgagatcgcgaggacggcgatgtggaggcggcggcgtaccgggtatgggtgcgcgctcccgaccacgtccggccggtcgacggcgtcgactacgaccaggtcgtcaccgagaagctggaacggtcaccgcagtcggcggtccgtgaggtcctcggggagcgccggccttcggggtgggtgcttgcgaagctgcgcgacggccgcggcccggcccgctccgtcctgcacgcaccggactgcgaggaagcaccggcgggggcgccgctgctcgatatggaccgcgcactggactcggcagaacacccgggcacccggctgtgcacgctgtgcggagccgcgcaggagctgacacctctgctgcgcggcttcgaccacatcaccgactccgcccccgacgactcc

SEQ ID NO: 17 - DNA, 525 bp, Streptomyces avermitilis
  CDS (1)..(525)
atgtcagaggcccgaccacgcccgtacggtgggggtgacctgcacggatgcggcggcgcccgtgaggctcgcgcaagagaagtcgcaagagatgccgcaggagaagacgcaagagttggcgcaggagattttgccgcgcgacagaccggagcgcggttcgaacagcagtacctttgcctggcggcttcgtacgacttcccccaggacctgaccgacgctcaggacgaactccgtcaggtccgcgctgatctgcagacggtctaccggcgggtgccgtggtcggccgaaccgctggacgcgtgggagacgcacgagaacgcctggcggccctcatcccgccctgcctcccccggctggggccctcaggacgcggcggagatcgcccggctacgggcgcgggaagtcgaactcgccacggcgaacgtcacgcacgcgtactggagcgagttcgctccggcccacgtcctcgcggcccgtaacgcgctcaagcgccaccaggagcagcagatggccgacgcctccagc

SEQ ID NO: 18 - DNA, 162 bp, Streptomyces avermitilis
  CDS (1)..(162)
gtgaactccgcccctaggacgaggtgtcctcaggcgctgcgtgatcggcgtgctgccgtcctcttcgtggccttcttcgccgtcgtcttcttggccgactgctgcttcgcggtcttcttcttcggcagctcgtggacgccggcgtccacgccgcgggaggcc

SEQ ID NO: 19 - DNA, 882 bp, Streptomyces avermitilis
  CDS (1)..(882)
atggggcggggagatctttcggatgaggagtgggctcgcctggagccgcacttgccggcgaatcgcgggcggggaggacgctggaaatgccaccgccgggtgatcaacgggattctgttccggcagcggaccggcctcccctggcgggatctgcctccctgcttcggtagctggaagacggtccacgaccgtcatcgacgctggtcggcggacggaacgtgggagagaatcctgcgggccgtccaggccgacgccgatgccgagggccggatcgactggagcatggtcagtgtcaattccacgacctgccgcgctcatcagcacgcggctggcgcctccacccgcgccccgaagatcccgggtcgacgcaggagccccgcgcgccaccgtcccgatgaggccctgggacgctcgcgaggcgggctcacaagcaagatccacctcgccggggaaggcgggcgccgcccgctcgggttcctcatcacgcccggccagtggggggatgcaccgcagatgattcccgtcctggaagagatccgcgtgccccggcaggctggtggacgaccgcgcactcggcccgaccatgttggaggcgataaggcgtactcgtcacgccgcaaccggcgtcacctgcgcagacgtcagatcaagcacacgatccccgagccaagagaccagcgggccaaccgtcggcgccgcggcagcggaggcggtcggcccacagggttcgacaaggcgatctaccgccgccgcaacgaagtcgagcggaccatcaaccggctcaagaacttccgagccatcgccacgcgtttcgacaaacgggcgtacgtcttccacggaacggtcaccgtggcggcgatccgcctatggctgcgtccggag

SEQ ID NO: 20 - DNA, 411 bp, Streptomyces avermitilis
  CDS (1)..(411)
ttgaacgaagggggccgcatgtcacgcgatacagccgtagcagaggtggggatgaggggaatcacgtttcctgcctggcacggagagcactacgtgaccctggctgaggtgctggttcggctcggcagcttcggcctggacctgacgtggcgcattgagttcgacgagatcgtcgatcctcgctgtgtcgagatggagagacggtccgccgacgccggcatggacacgttgacgctgttgtcgttgacgacccccttcctccagttgatcgacgccgaagcacgtgggttcgccggggacgagctggtgctcgtcctgaccgagttcgacagctcctcgtgggatgtcagggctgtcgacaagcgcgtactcagcgaacttcgccagcactacccgggtgccgaggatctc

SEQ ID NO: 21 - DNA, 522 bp, Streptomyces avermitilis
  CDS (1)..(522)
atgaacgagataatgctcagccttgccggtgccgagctgccatcggttcttccggacgacgttcctgccgcgtatcgtgcgatcgcggaggaaggctggaccgtggacgggaatggcgcctacctgctctccgcgttgcaggcggggtaccacggatccaccgctggagaattcgaggatattgttcacttcgaagccacggtgaacgggcgcggcatgatggactacgacctccccgcttcagggcccgaaaggcagaatcggcttttgcgacgctccatcgcttacgcctgcctggccttgcaggctgcccctgcggaaagcgagcacccactcctggggtacgtttccctctcggagggcggcctgtcggacgacaccctcacggctaatgtcaccttctgtacacgccgctcaggcatcccgccctacgtcagcgacattcaggattactccgaggaatcactgcttgagctgtccagagatgacgccgtgaacgccctcaaaggtgctgacggccgg

SEQ ID NO: 22 - DNA, 3750 bp, Streptomyces avermitilis
  CDS (1)..(3750)
atgacgctctccggcctggtctccaccgccgcacaccccgaacgggtcgtccaggccgccgtggacggcttcaagaaggacccctcggagttcgtcggccgcctcatcccggaactcatcggcaccaagggcgcgggactggcccgcggcgggatgcggctcgcgctgaaggagggcatggagggggttgcggagcaggggctgcgcaagaccgcgcggaacgcggtggaggacgcggccgaggacgcgtcgcggcagcggggcgcaaagatctgcgagaaggaccccgtcgatgtcgcgaccggccggatggtactgccacagatcgacgtctcgcttccggggcagctgcctctggtcgtcaagcgccagttcgagtcgtcgtaccggctgggcggctggttcggcccgacgtggtcctcaacgctcgaccagcgcctggaggtcgacacggcgggtgttgtcctcgtcggcgaggacggcctggtgctcgcctacccacacccggcccccggcgtgcccaccctgcccagccacggtccgcgctggtcactcgaccgcacggacggcggctacacgctgacagaccagaagtcgggccacatacggcacttcgtcgaccgctccgacactctggcggtgctggagcagctcgacgaccgcaacggcaactggatcacgttcgagtacgacgccgacggcgcaccccggtatctcacccacagcggcggctaccgcctgcgcatatccacggaggccgggcgtgtcaccgcgctgcacctggccagcgcggccgtggacggcggggaccaggatctgattcgctacggctacaccgacggccacctcaccgaggtcgtcaactcctccggccgcccccttcagtacgtgtgcgacgaactcggccgcatcacctcctggaccgacaccaacgacagccacttcagctacgcctacgacgacgaagaccgctgcacccaccagtcgggcgccgcgggccacctgcgctcaaccttcgcctacggggcagttgaccccggcaccggcgcacacacgacgaccgtcacggactcatacggtcaaaccacccactacctgatcaaccgacgctgtcaggtgatcgctgagacggacgcactcggcgcggtcacccgctaccagcgcgaccgctacaaccggctgctgtcccagaccgaccccctcgggcatacgacctcgttccgctacgacgacgcaggcaacctcgttgcagcgacccgcccggacggccgcgaggcacgggccgagtacaacgccctcggcctgccggtgaaactggtcaatccggatggcacgatcacccggcagaccttcgacgaacgcggcaacctcacctcggtcaccgacccgtccggtcagaccacccgcttcggctacgacgagggtggtcgtctcacgtcgatgactgatccgctcggtcacaccaccggcatcgtctgcgaccgggccggactgccgttgacagtcaccgaccccctgggcgcggtgacgcgatacgagcgcgacgccttcggccgcaccactgcgatcactgatccaaccggcgccaccacacggctggagtggacagtggagggccacctgtctcggcgcacagctcccgacggcacgagtgagtcgtggacatacgacggtgagggcaactgcaccagccacaccgacccggtcgggggcgtgagtctgttcgagtacacgcacttcgacctgcccaccgcccgcaccggcccggacggggtgcgctacgagttcgagcacgacaccgagctacgcctgtcccaggtcaccaacccccacggccttacctggaactacgcctatgacgcggccgggcggctggtcgcggagacggacttcgacaaccgaaccctcacctacgagtacgacttcgcaggccgcctcgcctcgcgcaccaacgccctcggccagatgatcgccttcgagcgcaacgaactgggccagatcgtgcgcaaggacgccgccggacaggccacgacgtacgcctacgacttcaccgaccagctggcgcaggccaccggtccggacggcaccgcgctcaccatcctgcgcgaccgccacggccgtatgatttcggaagcggtcaacggccgggcactgacctacgactacgacgagctcggtcgccgtacccgccgcaccacccccagcagcgccacgaccatctggtcctacgacgtggccgggcgccgcaccagcatgaccggctccggtcggagcatcgacttcgtctacgacgaggcaggccgcgagcttggccgccgcttcggccacatcaccctggaacactccttcgacgccctcggccgcctgacatcccagtccgtgctgggtccggccggtcgcaggacgcagcaccgccagtacacctaccgcgccgacggccacctgatcggcatcgaggaccaactctcgggcaagcgccgcttcgatctggacctggccggccgggtgacggccgtccatgcggtgaactggaccgagacctacgcctacgacgcggtgggcaaccagacgtcggcctcctggccggcgggtcatcccggccaggaagcgatcggcaatcgcacatacacgggtaccagtctcacgcgcgctggccaggtccgctacgaacacgacggcctcggccgcatcatcctgcgccagaagacccgactgtcccgcaaacccgacacctggcgctacacctgggacgccgaagaccgcctgacctccgtgaccaccccggacggcacccgctggcgctacacctacgacccgctgggccggcgcaccgccaaactccgcctcgccgaagacggcgaaaccctcgtcgagcgagtcgacttcacctgggacggcacggttctgtgcgagcagaccaccacatctcccgacctgccccaccaggtcaccctcacctgggaccaccagggcctacggccggtcacgcagaccgaacgtatcgtcgcggccgacgcaccccagcaggagatcgactcccgcttcttcgccatcgtcaccgacctcgtcggtaccccgagcgaactcctcgacgagcggggagagattgtctggcgcacccgtgccaccctgtggggcagcaccacctgggcgaagaacagcacggcatacacgccgctgcgtttccccggccagtactacgaccccgaaaccggcctgcactacaactacttccgtcactacgaccccgagaccgcccgctacgtcacccccgaccccctcggactcggccccgcgcccaacccggccgcctacgtgcccaatccccatatgtgggccgacccgctcgggctgaagtgcgagccgccggagggatacacctcccagcccgctttcaagaacgatccctaccaccccgacgcggtggagcgggggatcaacgagatgcgcgagttgtacgggatcaaggaacgtccgccgagcggcatgatcggagccaatgggacccaggtgacaagcaagaccatgtggaatcacgggccgtaccggatcgacgttgagaatccgaatccagggcagcgggccgggcagctgcatttccaggaccagagcaaccccaccgcgaagtatcagtacaatttcgacgaagggaagttcgacggattgccgcgttcggttgaacgggaagtcggcaagattcctggtttcgaagcgggtatccgcaaggggctcagggttctgggagaggat

SEQ ID NO: 23 - DNA, 570 bp, Streptomyces avermitilis
  CDS (1)..(570)
gtgagttcggggctgcggaaggtcgactcctccggctggcagggtgagggcggtgaggccttccgggagaagttcggcgtccaccccaccaagtgggcacaggcggccgaggcgtgcaacacggcggcgggggcgctggagttgtacgcggacaccctcaagtgggcgcaagggcaggcgaaggaggccgtcgagctctacaagaagggtgtcaaggcgtcccaggacgcggtcgacgcctacaacaagaaggtcgacgcctacaacgccaagatcaaggcgaacgaggacccgggcccgaaacccgagccgttccacgaccccggcaaggccgacatcaaggccgccgcccagaaactcgccgaggcccgcaagcagcgcaacaccgccgcctccgaagcacagggcaaaatcaaggccgccctggcgcacgcgcccgcggagcccccgcccctggaccgcatcggcaacgacctcaaagacggcttccaggcggccaacaccgaactcacccacgtggtgggcggcgccctcaagggcacggccggcctggtgacttcgcccccggcc

SEQ ID NO: 24 - DNA, 285 bp, Streptomyces avermitilis
  CDS (1)..(285)
atgggactcggcgatgtcaccaactcgcttctgggtggcgcggagaacctctacgacgcgggcaagaagaagctcggcgagggcgtcgactgggccacggacaaggtgggcgagggcctggacaaggtcggtgcgcacgactgggccgacagtgtggaggactggggcgacgaaatcgcctccgacctggggccaccccgggtgagcagcagctcggccagaccgaggagcccgacgaactcgtctacggccatccggacaagatccgcgagagtgccaagcacc

SEQ ID NO: 25 - DNA, 927 bp, Streptomyces avermitilis
  CDS (1)..(927)
gtggcatccgtttcatcctggccttctcggacgagcaggcgttggcccgttacgcggtggcacgcggtgaggcggcgcgtgagtggacgtaccagacgatcctcggcgcgcgactgctggatgtggcggtgcccgcggcaggggtgccctggggggtggcgctggactgcgcggacggcgaagagggcatggtcttcccgccggtgcgcggcatcgtgccggacgaggcagcactcgacatcgacgccgacagggacgcgggggcggggcatgagcggtgacggcaaggacctgaagaccgaggggctggcgctgatcgccaagggtctgaccgaggcgctgggcgagttgaaggagctgggcatggtcggcgaggccggagccgggcgcggcttcggcgacatcgccctgtccgggcttgagctcggccacgagggccttacgggtgagttcacgtcgttctgcgagcgctgggagtggggcgtgcggtcgctgatcaacgagggcaacggcttcgcgctgaagacgggcctgtcggcgggcacatactacgaaaccgacaagtacatcgagggcaccttcaaggtcgtcaccaacgcggccatcggcaatccgtacgcctcagaggagaacgttgagaagatgggctggggcgacatcgccacgtccggggtgtacggcggcaacgtggactacagcaaggagtccttcgatcaggcgatggccaacagcgggcaggcctggaaggacgcgggccgggacgtgatgacctcgcacacgatcggtccggtgccgggcgtgaacccggaggaactgcacggcgcgttcggagtgtccgacgacgagtacaaccagtacctggacgacaccttcgggccctctcccgaggctcgcgccaaggcggccgagcagcagggcggtgagggc

SEQ ID NO: 26 - DNA, 360 bp, Streptomyces avermitilis
  CDS (1)..(360)
atgcgtgagttcccgctcgacaagcacgagcggaccgaggccgacgaccgcctggaccagatcctcgccaccacccatgccgagctcgtcgacgccatcgcaacacaacaggaccacgcgcgcacgatgacgctcatccctggctccggtactgcggaggagccgacgaagacgatcgaccgggcgctgtggtcgtacaaggagatcgccgcgtacatcaacgtgcggcccgataaggtgcgctggtatcgcaagcacgggcttttgccggcgccggaccacgtggaaggcggcaagccgtactggtactccgacactgtccgagcctggatggcgtccaggcccagccgccgcgaaccg

SEQ ID NO: 27 - DNA, 570 bp, Streptomyces avermitilis
  CDS (1)..(570)
gtgatgagcgaaaccccggcccaagccggacggagggagccgctccctgaaacccggccagtcccgtcgaccgagttggtgaggcgcgacgacttctccgtcttctatcgcaccgagaagaagcgtctgatcgccttcctgatctacgccggggcacgtgtgtgggaggccgacgacctcgcacacgaagtactgtcccagctgctccccgaccggtggaagaccctggagtatcctcgcgcctacatgcgcaagtccgcaatccgcgcctatttacggcaaaacgagcgcacccgcgagatcccgacggacgaactccccgacctgccgggcgggatcgacccggtgacttgcgtggagctgtccgagcagacgaacgcaatcattgatgcgatccagcagctccccccgacccagcgcaccgtgatggcattcgtgatgagcgactccgacaccgcggagatcgccgaagcgctcaacatggcccccggcgccgtcaacacgaacatctgccgtgcacgtgcgcgcctgaagaccacgctcggcctcatgaagggagacaacaatgcg

SEQ ID NO: 28 - DNA, 288 bp, Streptomyces avermitilis
  CDS (1)..(288)
gtgatgcggggctcgggatgcgccgccgagacagaaatgggaggcaccatggacccggtgacgttcaccgcgggctgtggcgtggcgacttcggcggtccggctcggatacgtctggctgagcgcgtggtcgcacaggcgccgcgtcgagttggagatccatcgcgctgagttggaacgtgcgactctgatggagaccatcagctcgctgccgcccggcagcgaggtcactgaggttctgcgcgacggccggcgggtcacgatcaagctcccgcccagtaaggcggcg

SEQ ID NO: 29 - DNA, 1734 bp, Streptomyces avermitilis
  CDS (1)..(1734)
gtggcagaacagcgacgggcctacggggcagggcagatgagcggcctgcgcgcccgccggctggagaagctcggcatggtgtggagcgtcgctgacgaacgcttccaggagaacctggaggccgcgaaggcgtactacgaggatcactggaccctctgtgctccgaggtcggcaacggccctggacaggccggtggggcagtggttgagcaacctgcggcgcgcgggtgcgctggacggccacccggagtggaaggccgcgctggaggccgtagacccgtactggaacccggactggccggtggactggcagcggcactacgccgcgctgcgggagctggtgcgcgatgagggccaggccgacgtcctgcccggcgtgaccgtgcacgggatgggcgtcggacggtttgtcgcgaagaaccgtcagcacgccgtctggcagggcctgatggacgggcagcgcgagctcctggaggccatcggcatcgagaagggcaacctgacggccctgccggaactggcccgggagtacgccgaggacaacaccggcgcccgtatcgtgatcgtcgaccgcaccggccgactgctcaccgactccgcaggcaccaccgccaccgggaccacgctcgccggcgagccggacatcgccgccgccctgcgcaaccagaccacggtcgccacccgcaccggcactgatggtggtgacgttctggcggcaaccatgccgggctcctccggcaccacgatccgcggcgggctgcgggtgacctacccgatgaccatggtcaccgaccgggaacaccgcatctgggccgccctcgccctggccggcgcgtgcgtcctggccgccgtggcgctcgtggcgttcaccctggcccgctggatcacgcgccccctgcgcaccctggaacgcgccaccacccaactcgccgccggccgtctggacaacccgcccgacgccggcagcggaccgcccgaactgcgccgcctggccgccgcgttcacccacaccgccacccgcctgcagcacctgctccaggcccagcacagcttcgcctccgaagcctcccaccagctcaaaaccccgctgacctcgctgcggctgcgcctggagaacttcgagccctacctcgacccccgcgcccatcccagcctggaagagaccatcgcagaggtcgaacgcctcagccgcatggtccacggcctgctcgccctggcccgcctggaaaacaccgccaccacccccgaacccgtcgacgcggacgccgtcctcgccgagcgggcggccatgtgggagccactcgccgccgagcaatacgtcaccatcacggtcttcggcccagcggtcggccgggtgtgggcgattcccggcgcgctggaacagatcatcgacaacctcgtcgccaacgcgctgcgggtctctccgcccggcacgtccatcaccctggcccgcgctcccggcgccgatctccacgtcatcgaccagggccccggcatgtcggaggccgaccgggaacgggccttcgaccgcttctggcgcgcctccgactcccatcacgacggcaccggcctgggcctgcccatcgtccgccacctcgtgcacgcctccgggggcgagatcacactgcatgcagccaccggcggaggtctggacgcccgcgtccggctacgccccgccagccgggaacgccgctttcaggcaactgccataacaggcgcggcaggccgcggacga

SEQ ID NO: 30 - DNA, 339 bp, Streptomyces avermitilis
  CDS (1)..(339)
atgaccagacggaacccgccgttgacggaaccgcagtacttcatccttgctgcgctcatggatggtccgttgcacggttacggcatcatcaaggctgccgagcaggccaccgacggacggctccggatcgctgtcggcacgctctacggggcgctggagcggatggagcgggccgggctggtggccgccggccatgaggagatcgtggacgggcgagcgcggcgctactaccggctcaccgaggacggcaccgaggcgctcggccgggaagcgctgcggatgcagcaggcggcggccgtcgtcatcggacgcgcgcgggatgccggagcggccccggca

SEQ ID NO: 31 - DNA, 954 bp, Streptomyces avermitilis
  CDS (1)..(954)
atgaatcgtctgctgcttgcggcctatcccaaatcctaccgttcccggcagggcaaggagttgctggcctgccttgccgaggcgtatcccggccgctcctggccgccgccgcgggaagttgccgccttggtgcgcgccggggtgcaggcccgcgcccgtgccaccgttgacgacactactcggccgtggtggctggacggcatccatctggccgccctggccctcgccgcgctggcgctggttccgtacttgcaggatgtgtggcactgggcactgcacatcgaccccggacagcacgccatcgccttccacttctccggctggtatccgtgggccggaggtcccacgcggattcggctgctgccctacgggctgctcccgctgggcggcctgatcgctctgctgcgtggcagagcgtggatcgcgctgccggccgcggcatccatgatctgggccggcgccacgacccacggccgcaccctcttcggcgacgagggcaaggcgggcttgagctactacgggttgggcgccccgataacggcccgtgacctggcgctctcggggacactgtgcgccgcgtgcgccgtgctggcgctctgccgacccagccgtctgcgacgccgctcgtaccgttggctagcccccgtcgtgctcgccatgttcgtggccgggggcctgcacatcatctctgtcagtccgactttccagcgcggcttgttcgtcctcgaggtcgccgcgctgctcggcgcgtgggtggcgacggcagccaccggcgaccaccggtggctgatccccgtcgcagcggtcgcgatcgtccgcacgcaggcgatcgtcgcccagccggacgcgttcatgcagtcctttccggacctggtcgttctcctcctgctgatcgcacccctccctgccctggcgatcaccgcccagcgccgacagggccaggcactccccgaa

SEQ ID NO: 32 - DNA, 999 bp, Streptomyces avermitilis
  CDS (1)..(999)
gtgggccggccgagcccggcggcccacgtcgtgccacaagacgtgcgtgacctaactcccctcaacggaagaaacagagcgatgactcagcacgatcctccgaccctgcccgcgcaccgtccgcgggcctcaagacaggcccccgaggcccccgacgcacccagcctgtcgcgtacgacacggccgtggatgccggctctgctgtacaccctggggttcctgacggtctacctgctcgccatctgcaccccgtgggggcaacgagctgagaacgccctgtttggtctcggtaaacaaggcggcgaagaagcatggttctaccccctgtcaggagcggcctacggctcgacgcccctgccgccgctggaattgagtgccaagcccaccctgatggtgggcctggccgtcatcgtggtcctcaccctggtgcggcggtgctggtggccggggtgcgcggcgctcggggtcgtcattctcacgaccggaggcaaggaggtgctcaaatcgaccctgccccgccccgatctggtgggcgcgcccgagaatctccttgatcaggggttccccagcgggcacacggccatccccgccgcgctgaccctcgccgccgtcctcgtggtttccccccgcatccgcccctacgtcgccacggccggtgtgctgtggctcgcctgcatcgccgcctacagcgcgaccaacggcggccaccggcccagcgaagtgctgggggccacactattggcctgtgcctgttacggcctcgcaacctggctgctgccgccgtccgccgcgccgggcgccacgcggagccctcgagcgctgcccgtcatcaccctgacgctggcactggccgtcgccctcgtttccggcgcacgcaacgacaccctcacaaggtcactggtctccgcggcgacgggcttcatatgtgcggccctggtctggtacgccgcagtcgggcggcctgcacacaccgcacgccgcacacgccccgcactgggc

SEQ ID NO: 33 - DNA, 600 bp, Streptomyces avermitilis
  CDS (1)..(600)
ttgctgcggggaaggcgccccagaccggcccggcgttccatctcccgcagcggcatcgctccggctcgctggtacatctcgcgcagcgcggcacgcagttccgccgcgttctccaccagtcggaagggggctctcatggctgagcttgtccggcagcagcatcttgacgctgacgtgggctaccacggctttggttttcaggagtccgatgacggagacatcctggcccccttcccggatgacttcgccgacgaggtgttcctgaacgccttcccgggacggctcgatatctacagcgccggccacacgcacaccgcgtcggtcaccgtcgcggtatgggacggcccgccagccgcgcacgaccgggtgcagtgggacgagcaggcggaagccgactacgactcggccagcggcgaagtcgccgtgtggtcgatgagtctggggcgtgctgacgaggtgatcacgctggccgactcgggcgggctctggcgtgtgcgggtgagctgcaccgggcgtgccgtggccgcgcgtctgtcggaggaggagggcactggccacggggtcgagaagtatctggtgcagttctggccccgcacagcc

SEQ ID NO: 34 - DNA, 300 bp, Streptomyces avermitilis
  CDS (1)..(300)
gtgacgaaagaaagaaatgagccgtcagcgaatcccctccgggtcgggctgaaggctgccctcggcggactgaggacggtccttccctccggctcgcagtgcgacgagtaccccttcgccaccacctacgaaggtgccgccgagtacgactacgaccctgacgcgagaaagttcaacttctccgtgcgtccgatcgcgaaggcggacaacggggcaggcggcagcctgctgctcagcttctacgcgaagaaccgcctcattgacggcctcgaggacggattcggcgtgaagatcgtctcc

SEQ ID NO: 35 - DNA, 2034 bp, Streptomyces avermitilis
  CDS (1)..(2034)
atgggattcgtacatctgttcccacagagaggtcgcaggttgatatccctcaccgcaagaaccacaggaagacgtcgcttagccctcggcacgatcctcgcgatcgtcatcggatccggtgccaccggcaccgcctactcggccgacggctccgacaacccgccgcccgtccacggccccggggcacgggcagctgcggccgccgagccggacactcccaacggccccgaagtcggcccgccgttcacgaagaccaacaacgtgtggcagaccgacaccaccacaccgacgttacgcaacacggtcactgcccccagcggccacaagaccaccgcgaccttcgaagttcacaccaccgattccagcggcaaacccacggccacggtcgtcaagctgaccgacgagaaccagtggggcgtcctcgtctccggcgaggtgaccgccggcaaaccggcctccgtcacggttccggccggcaagctcaagaacggtgtcacctacgcggtccgctcttccgggtacgacgccaccagcaacgtgtacgagagcgactggtccccgtactccaccttcaagatcaacgtccccccggccgagaagccgtacgtcaccttcccggcaccacaggccacgtccggcatcgactcacttgcgcagactccgatcgaattcacgcgtaccgatcccggcccggtcacgggactgcgcggcgatgacaacggccggaaatgctccgccccggacgccgaggggcggaaggtgtgcatcgaaatcagtcgtgacgcgccgactcccgaagacgcggcggtcgccaagggagcgatgaggcaagctcttcggggcgccgatctcgtctcgtggtgcgccgcgaaaccggacggcaaggactacatgaaccggggcgaggcgtgtctgaagaaggtcggctacgcgaccctgatcttcgtcgacgccgatgacctgccgaggttcggcaccgccacgttcgcgctgtcccagcagatcaagctgtacaacaagaagtcggacaccggcacggaccgtgcggagttcgaccagcagctcaccgtggtcccgacgcagatcgacgacgcgaccgagggcgttcacctcacctggcagccgggcgacaactgcaaggactgcaccagctcgcaagtccagtggtcgagcaacgacggcctcaacaccacgccgcactgggcggtcggcgaggtcggcgcccagtacgccatgaccgcgaagaggcagacgatctggaacggcaccggcaaggagcagttcgacctcggctggagcctcctcggttccgtcgacgctggcaacgctcacgcgcagaccagcctcggcaccagcggcgacgtccgtgtccgggaactggcgccacgctgtgacgacatcgccggaggcaacatcaagaccggctgtgtcttcccgtacttcaagcccacctggacggtcgacaccaacctgtacccggcggccggcgcctactactggctgctgcaggagaaactcccctcccaccccggcagccggaagtgggattccctcgtcacctacctcggccccggcaacaacgccgatccggacggcggggactggaccaacgacgacagccgcggcatcgtctgccccacagggaccagcggtttcaagcccaaccctgccacgcccgacggatcgtgcgacgagtacgcgcccgcaagtacgtaccagagcggcggcatgccgaaggggccgaaccaggtcgcctccgggaaagaatgcgcacagctctacaccaaacccatgaccggcggcacgtggggactgcttgcagaaaaccgcgacggctacaccggcccgaagtggaacgaaaagtgtggtcgtgcctccgttcccacggatcagaacactggcgccttccgcgacctcggcatcaagttcgttccccagatgcggctgctcgacaaggacgggttcttcatcagtgatcctggcttcgagcactgcaagaacgccgacacggtctgcgcgtggaagaaggtcggc

SEQ ID NO: 36 - DNA, 849 bp, Streptomyces avermitilis
  CDS (1)..(849)
gtgagcggcttcgtacggacgggggcctgcgcctgttcgccgtcgccgtcggcttctccgacgtgctcgacgacctcgtcttccgggcgacacgcgccgatgtcaccgccgccgttttgtgcagggggagaggttcgtgaggttgccggagcgcggcacgagacccgtagagtcgcaggtatgacggacgatcagcagcaggagcaggccgtggcgggcgcctgggcgaggatcgaggagtggctggagcggcacgctccgcgctcctaccggatgcttcctccgcccgccccggaggccgacatccgtgaggtcgagcaggaactcgacctcaccgtcccgccgggcctcaaggccttctaccgcctccgcaacggcacgggtcaccccggtgacttcggctggacacccgaacccgacaccgggctccccctgcaaggacaggaaacagcctggctgttgccgaggaagcacgggatccctccggtgcagcatctgccgtactgggatgaaggcccacacacgatcggccggccggacgaccccatggtgcggtacctggccttcgccgcgaccgaccgcagcggtctgtacgggctgttcacggactgcaccccaggaaccggctacggacggatcggaaccttcgaagaggccggcatccccaagttgggcgtgtggtcgtcgtttgccgactacctcatcgaagtcgccgatgccctgtacgagaaccgcggcgtggagtacgcggacggacaccaggacacgaaggtgcccggtctcgtcgatcaggccctggtgtgggacggtccggcgcatccgcgggacccggaatggacacgcttcgca

SEQ ID NO: 37 - DNA, 270 bp, Streptomyces avermitilis
  CDS (1)..(270)
atgaacaaaacaattgcgtggcttctgacatgcgccggagccggcgtgatcctgtggttgctgaccagcgcgccagacatcagctcggcttacccccgctccgagtgccactccgtcctcggcaacgactcgagccccgcgcatgggtcgatggaggacggagtggaggcgacgtgcgccacgtaccagtcgcgccgcctgggctgggcggtcctggtgtcggtgccgacggtggtgctcgcctcagcgggcatgcgtagccgaagcgcc

SEQ ID NO: 38 - DNA, 1320 bp, Streptomyces avermitilis
  CDS (1)..(1320)
gtgtgccgaggcccgttgggttcttacgagagtctgacgcggccgtcgttcgctttcattgtcatctccccatccgcaactctgcttactcacgcccccggatcacaggagccacacgtgagcaggcacaacaggcgcaggtcgacgctgcacaagagggcgaccgtcttcggcggcggcacggtagccgtagcggcggtggtggccacggtcaacatcgcctcggcagaccaggtctcgcccaccccgcgcactgcgtcgaaggccgaccacgccgtgttcgtgcagggcaacgagctggccgggaacaccatccacgtcttccgccgcggcgacgacggcaagctgaccgccgcggggaagtacgcgacaggcggcaagggcggcgaccaggtcgacgcgcccaccgactcgctggcatcgcagggatcgctggtctacgacaggcgttccgggcggctgctggccctcaacgccggcagcggcaccctgacgtcgtacgctgtgcacggccaaaaactcacagaccgccagaccgtgcccacgggcggggacttccccgtcggcatcgccgtctcgggcgacctggcctacgtcatgaacgcgggcggcgcgggaagcgtccagggtttcagaatcaccacgatgggcctgaagccgctcagcggttcgttgcgcaccctggggctgaagaacgagaaggtgccgctgttcagcagctcgccgggccaggcggcgttcactccggacggccggaacctggtcgtcaccaccaagtcggccaacaccgtcgaggtcttccccatcggtcgggacggccgcccggcgcacaagccggtcgtgaacaagtccgcgggcatggtgccgttcgccatcgccttcgacaaaacgggccgcatgctggtcgccgaggccgccgagtccaccgtcagcacctacaaggtccgtcgcaacggggagctgcaagtcctccaaaagcccttgccgaacgggcaggacaccctgtgctggctggaacgcgccggtgacttcttctacggcggaaacaccggcaactcgaccgtgagcggctaccgcatggacgcccggggccggctcgcgctgaccaacgaggcaggcatcgccgccgcgccgtccgcgaagtcccagggcgtcatcgacatcgccgtcgccgccgacaagttcgtctacgtccagaacgcgacctccggcaccgtcgacggcttccgcgtcggacgcaccggcgccctcaccaaggtcacgacggtcacagacctgcccgccttcgccgaatccggcatggagggcatcgccgcggtg

SEQ ID NO: 39 - DNA, 939 bp, Streptomyces avermitilis
  CDS (1)..(939)
atgaccgacgccgccccgaaccgctctcccgagcagaacaacgtccccgggctgccgctgcgcaacctcgcgggcttcacgcaccgctgggtcgacgcggaaggcatccggcttcacgccgtggaaggcggccggtcgagcggccccaccgtcgtgctgctcgccggattcccgcagacctggtgggcttggcacaaggcgatgccgcgtctggccgagcgcttccacgtgatcgcggtcgacctgccgggacagggccactccgatcgtccccaagggggctacgacacgcacaccgccgcttcacgtgtccaggccgcgctgaccgcgctcaacgtgccgaagtactggctcgtcgcccacgacatcggggcctgcgtcgccttctcgctcgccctgaggtacccagaccggctgcacggtgtcgccctgctcgacgccggcattcccggaatcaccctcccggacgccatcccgacggatcccgaacgggcctggaagacctggcacttggcattccacctggtgcccgaactgcccgagacgctgatcaccggccgcgagcgtgactacgtgggctggttcttgagggtcaagacactgtccccgaacacgttcgacagcgccgatatcgaccactacgccgcagccatcgcagccgggggagggctgcgagcgtcgctcgcctacttccgcgacgccgcggaatcagcacgcaagaaccaggacactctcgctcgacgagggcacttgaccatcccggtcctgggcatctccagctcccacggctcgatccccgacatggccgccgccatcagcccctgggcagagaacgtgaccggcgtcgtcatcccacaagccgggcacttcattcccgacgagcagcccgacgccactgtggacgcgttgaccgcattcatcgatcacacgcgtgccggg

SEQ ID NO: 40 - DNA, 288 bp, Streptomyces avermitilis
  CDS (1)..(288)
gtgcccgggccgaagcggaaggcttcggcctccacatccgagcgcgcttcgggttcgcggctctggcgggggtcctcggacgatccgcgggtgcggtgggccacccagtccctgccgggagaggcggcccgtgagctgttcgccgtccgggacgtcggcgcgggcgagcagcagctggtgatcctcgcccgtgcactgggtcacgcctacttccgcgacgggggccgacgcggccaccgtctgcacatcgccttcaccgacatcgagttcgccggcttctcgaccgga

SEQ ID NO: 41 - DNA, 738 bp, Streptomyces avermitilis
  CDS (1)..(738)
gtgtacccgaatgcccgaggtgcggcgttcggcaccccgcggcgcccgccgccacacgacggccccggggcgaaaacaccgggcccactcctgtccgatccggcagccgggccgtcctgtcctcgactcggaggcggacgaggtggccacaagtgcgccttcggcacgagagccggaaccggccaagagcaaccgcatacagaccagaaaaggaagacacacatgaacaggaagtcctccgcacaccgtcgtccgggccgccgcgcggccgtcgccgccggcctcgtcctggctgtcggactcggtgtgtcgacacaggtgtcggcacaggcggccgtccatgcccccgcaaaggcgtccaccgcacagtcggtcagcggcacgcccggccaagcggtgacccgggtcgccgacttctacggcgcgtacatcgacgcgaagggcgactacacggacccggacgccacgctcgccacggccctccgcaaccactacctgacgcccgacttcgccaagcggctggcagcctgggagaagacgaacgcggcggacggcgtcctgcgcgcccaaaacatcccggcgcagtggacggcgaccgacaacggcaccgtgggcaacggccatgaggtcatcgtcaccctgaccttcggcagcggggagacgacgcagaagaccaagcttttcgtgctggtggagcggtacaaccacatcgtcgacatcgacaccacgagcactcgt

SEQ ID NO: 42 - DNA, 378 bp, Streptomyces avermitilis
  CDS (1)..(378)
ttgatgaagtccgtcatccgaaaggcagcaggcctcgcaggcgcgagcgtggccgtcgcagccatgtccgtgaccggcgcatcggcagcccaggcggagtcccccacccacggctgcccgtacccctacgtctgcttctacgtggacgaggacgcctataacgcgggcacaccgatcacgaagtaccgcgatgtcaccagttcctaccagacggtcagatcccggccgcactaccacgtcgtgaacacccggaacgacgacgtggcgtacctacggctccaggacgggaactcgatctgcctggtgccgaattccgaaaccgtgttcgcgaacgcttacagcgtcaccggaataaagatctccagcagttccacctgc

SEQ ID NO: 43 - DNA, 1389 bp, Streptomyces avermitilis
  CDS (1)..(1389)
gtgcctgggatacgggatcgtgggcgggacgacggaggaacggtgtcgatgcgggacgatgtcgaggagttcgcggcgcttctgcggcagctgaaggaccgcacggaccggagctacggctcgctggcccgccgcctcaacatgaacacctccacgctgcaccggtactgcgcgggcgaggcggtgccgcaggacttcgcgcccgtggagcggctcgccgccttctgcgaggcgacaccgaaggagcggctcgagctgcaccggctgtggttgttggcggtggaggctcggcagcgggtacgtacggccggcccggcggaagcggcggtgtcggcggaggcggcggtgccggcaccggacacggacggggcactcgccgaggacggggaacccgccgaggagagctgctccgcggagcagcccggggacggtcccggcccggacgagcccgctccctcccccgctccccgcccctggttccgccgccgacgggtcctggcgtccacctccgtcacctgcgcgctgctcgccgctctgggcaccacgtccgccctgtcggacgaccgctcctccgaggcggacggctctcgctccgcgggcccgcgggcggccgcccccggcgcatcccaccgttcggcgaaaccgtcggccggcggctccccctccccttcccggagctttgcggcgcccggcccccggcagaaggcccccgccccgtccggcaccggcagcggtcccaccccggccgcgaagcctgccaccggcctgcccctcgcatggagcgccgactccctggtctgggacaagggctgcgaccacgactacgtcatcgacaagccgcccgcgcaggtgcctccaccgccggtgcaacaggacgccggggcgtgggcggcgacgcagggcgcggtgcacgggcggcatacgatggtgcagatctccgtgcaggggcagtcctccacggccgtggtcctcaaagcgctccacgtccgcatcgtcagccgcggcaacccggccgccgggagcgcctacgccatgggccagggctgcggcggcgacctcacgccccgccgcttcaccgtgaacctcgacgccggccgccccatcgcccgcccgaaggacggcgccgacatcggacacaccatccccgccgtgcaattcccgtaccgcgtctccgccgaggacccggaggtgctgctggtcgacgcgacgacacaggcctacaacgcccgctggtacctcgaactcgactggtcctcccagggccgcaccggcacgatccgcatcgacgaccacggccgcccgttccacaccaccagcatcaagggaatgccgcgctactggtacggcacgaacaacgcaggcgggcgtgcctgggtcccctacgacagc

SEQ ID NO: 44 - DNA, 390 bp, Streptomyces avermitilis
  CDS (1)..(390)
atgccccgcgtcggagtcagcgcctcggactcgggacgcatctccctggcgggcgtggtctgccgcagggctggtcaacgcagccggctgccggtgccggcgtggctggccggcaggggcgggcagccggagggctactgccacctgcagatgatcgacgcggtccgctacctggtcgacaacggcatcgagtggccggcgatgcccgcggacttccccgcccgggaccgcgtctgcgccgtcttccgccgccggcgtgaccaccagctgatcgccgggttccatgaccggctgcgcggccgggtccgcgagagcgaggccggaacacggaaccgacggccgcgatcgtggactcgcagatcgtcgccctcggtgccgtcaccgcagtgc

SEQ ID NO: 45 - DNA, 1113 bp, Streptomyces avermitilis
  CDS (1)..(1113)
gtgcgcacgctgcgtgcggcggccgactacgcggtggagaagatccgtgctgtcgcgccaggcgtgagcgccttccctgtcgggacgaagttcgagaagtgggtctactcccaaaacggtgactgggtcggcgggttctggccgggaacgttgtggatggcctggctgtacagcaaggacgagcaactccgcacactggcgctcgagtcggcgaggaagctcgccccccgtcagcacgacaccagcacgcacgatctcggtttcctgttctctccgtcgtgggtcaccgcatggcgcctgacaggtgacgacgtctggcggaccggtgccgtacaggcggcggactcgctgatccagcggtacaacccgcgcggccgcttcctccgggcgtggggcgcactgaacgatccgaacaacgcagggcgcgtcatcatcgacacgatgatgaatctcgacctgctggcattcgccagccggcagaccggcgacgcgaagtacctcgacatcgcggtggagcatgcgaagaccgcccagcgggtgttcccgcggccggacggatcgacaccccacgtcttcgacttcgatccggccaccggcgccccggtcggcccgggcaccgtgcagggctacagccccacctcgtgctgggcgcgcggacaggcatggggcgtgtacgggttcaccacgatctaccgccggagcggggagcgcccattcctggccaccgcgtgcaaactcgccgactacgcgataggagcgctcggcgcggactacgtgcccgtatgggactaccgcgcgccgcagcagcccaacgacatcaaggacgcatcggccggcgcgatcatggcatgcgggctgctcgacctgtccgccgcgacgggcaggcagcagtaccgcacggtggcactgcggctgctgagcgcactgtcgcagacctgcctgacggacaagtccgcccgcgcgcaagcggtggtggcccgctgcacccgcaaccggccggccgaggacgggatcgagatctcgctcccctacgccgactactacctgctggaaggcatcttgcgcgtcctgcagccccaagatgtcgaccgggcgatcgacctgtctgctccc

SEQ ID NO: 46 - DNA, 372 bp, Streptomyces avermitilis
  CDS (1)..(372)
gtgtcgctgaccggcggaaaccgcaatgacgtcacccaacttctgcccctgctcgacaagatcccggccatcgcgggccgggtcggcagacctcgccgacgccccgatgcgctgctggccgaccgcggctacgaccacgacaaataccgccgcctgctccgggcccgcgggatccgccccgtgatcgcgaagcgaggcgagcctcacggcaccggcctgggcatcttccgctacgtcgtcgagcgcacgatcgcctggctccacggcttccggcgccttcgcatccgctgggaacgacgcgccgacatccacgaagcattcctcggactcgccgtctgcctgatcacccaccgccacgtacagcggctttgt

SEQ ID NO: 47 - DNA, 387 bp, Streptomyces avermitilis
  CDS (1)..(387)
ttgctgcccaagcctgcgccgaagctggtcgagggcagacctcgagtgcctgaccggcaggcgctgtgcgggatcctcttcgtcctgcacacggggatccagtgggagtacctgccccaggagctgggcttcggttcgggtatgacctgttggcgccgtctggcggcctggaacgaggccggcgtctggaaccggttgcatgtgctgctgctggagaaactgcgatcgaaggacaagctggactggtcccgggcggtgatcgactcctcccacgtcagggctgcccggcggggcccaaaagcggacccagcccggtcgaccgcgcacgtccgggcagcaagcaccacgtcatcaccgacggccagggcatcccgctcgcggtgtcgc

SEQ ID NO: 48 - DNA, 1188 bp, Streptomyces avermitilis
  CDS (1)..(1188)
atggccactcgcgtgaagcgggcgttcaagtaccgcttctgtccgaccgatgcgcaggcagcggagctgtcgcgcacgttcgggtgcgtgcggaaggtctacaacctggcgctcgccgcccgtaccgaggcgtgggcgcggcaggagcgggtcacctacaaccagacctccgcgatgctgaccgtgtggaagaagaccgaggaactggcgttcctcagcgaggtgtcgtcggttccgttgcagcaggcgctgcggcacctgcaaggggcgttcgcgaacttcttcgccaagcgtgccaagtacccgcggttcaagtcgaagcggaagtcccgcgcctcggcggagtacaccagctcggcgttcacgttccgcggcggccggttgaagctggcgaagatggccgggccgctggacatcgtctggtcccgccccctgcccgagggcagtgtgccgacgaccgtgaccgtgtcccgggacgcggccggccgctggttcgtgtcgatgctgtgcgacgacccgacggtgaagccgctcgcggccacggatgcggcggtggggatcgacgtcggcctggaccacctgctgaccctgtcgaccggtgagaagatcgccaacccccggcacgaacgccgcgaccgcgcccgcctcgccagggcacagcgcacctgtgcccgcaaggagaagggctccgcgaaccgggagaaggcgcgccgcaagtccgccaggatccacgcccggatcaccgaccgccgcagggacggcctgcacaaactgaccactcgactcgtgcgcgaaaaccaaacgctcgtgatcgaggacctgaccgtgcgcaacatggtcaaaaaccaccggctcgcccgcgccatcagcgacgcggcatggagcgagttccggagcatgctggagtacaaggctcagtggtacgggcgggacgtggtggtcgtggaccgcttcttcccctcgtccaagctgtgctcccactgcggcaccctgcagggcaagatgccgctgcatgtccgtacctggacgtgcgactgccaaacggtccacgaccgggacgtgaacgcggcgaagaaccttctggccgccgggctggcggtgacagtctgtggagctggtgtcagacctcaacggagaactccgggcgggcagtcggcgacgaagcagaaaaccccacggcgcgagccg

SEQ ID NO: 49 - DNA, 654 bp, Streptomyces avermitilis
  CDS (1)..(654)
ttgccgtcgaacaacagtagtcttcggcccatggccctgcgacctgacgagttctacgcccacgcacgtaccgctgcggatggtgagcgacggctcccgctagcccgtatgacggggtgggacatcagtccgttcgaggcggacggcctgcgcgtcgcgccgctgcgcccgccggttctacccgaaccggcgcggcacggcgaggaccccttggactgcaacgcgtgccgcagccgggacgaagggatctggctcgacgaccgttggcggctcacccggatcacgggagtcggcgtgccgctggtgctgatgctgcatccacgcgatcacttcgacctggcggacctgcccgacgaactggccgccgaactgggggtgctcaccacccacatcgcccgccatgtgcaagcactgccgcacatctctcgggcccacgtctaccgcatcggagacggtggcgcccatctgcacatctggttcttcgcccgtcccgaggggcaagcccaactgtacgggtcgtggatggtcatctgggacgacctgttgccggagtacccggcggacgcggccgaggcagacgcggcgatcgtggcagacgcgttggtcgcctcctacggaggccgtcgcccggccgtcagcgaactgccgcacgcc

SEQ ID NO: 50 - DNA, 291 bp, Streptomyces avermitilis
  CDS (1)..(291)
gtggagtggtggtggagacggacagggtgctggcgttccaccacacccggccgtcgtattccgttcacatcgtggtggttcccaagggaccatgcgccgtcgctgatcgacttcggggccggcggtgaggagctgctcgcagaagtcatccgggtggtgcgcacggtggccgcccaggtggagcagcagcacggcgcgtgctcggtgatgacgaatctggggctgtatcgggagtccaagcaccagcactggcacgtcgtccaccgcggcgaacccaggacggaggtcccg

SEQ ID NO: 51 - DNA, 2226 bp, Streptomyces avermitilis
  CDS (1)..(2226)
gtgccggccatgggccctgaggcggacagcggcagtaccaccgcccgggcacgtccgcgccccgccccggcactgcgccggaccgccacaaaactgcggcacggcaccggcgcctcggcctgcgcaggcaggcgcgccgtccgggtgacagccgcatccgtcgccgccttctacaccggcctctacggcctgcacgagcccgtcaccgccacgtacgccctcttcgcggcggtggcgatggccggcctctcccgcatccccggcaccgggcgccagcgcgcggccgtcgtcatccgggtgctcccggccggctggatcctcgtgacagccgggaccctgctcgcggtacacacctgggccgcggtggcggggatgctggtgatcggcttccttctggcgttcgcggcggcggccggtccacgcctggccggtgcggccccgggcctgcaactgctctacatcctgccctgcttccccccgtacgcgccgcagacactgggcgaacgcctgggcggcgccacgctcggcatcctgctgctcgtgctcgccgagagcctgctgctgcccgacccgcccaccacctcctaccggacccggtcggcaaacgcggccatcaccgcggcacgctgcgcgagcgaactgacccacccgccctggaccctttcggacgaaacccgcagcgcggcacggtcggccggcgaagcgctgcgccccttccacgtaccggagtcgcagcgcccggccggaccgggaccgcgggaacgggcgctcgcccacaccggcatggccgcccgtgtccttctggcccggctgcaggaggtcccgcggccgggccgtgggggcccgcacccccacaccctcgcactcctgctcgaggtcgcgtcgtcggcccggcggaccgccgccgcgctgcgcaccggccggccggccggcccgggacggctgccggacgccctggccgcctaccggcgtctgcgcaccgtgccggcagacagcgcgacacctgagaccaccagcacagtgatgcaccgtcaggcgatgctcatggaagccgcctacgccgcggtgacactggcgaccgccgccgatctcgccctggggcgacgccccgggcccaccgagacacaggacggcagcttctggtacgcgggacacagcacgatccgcctgtgggcgcaccgtctggtgggacacctgagcccccgctcggtgtacttccagaacgcggtgcgcatcagcctggccctggcggccgcccgtaccgtggccggcgtcgactccctgccgcacggattctgggccatgctggccgctctcaccctgatccgcaccacggccgcgcagacgggcgcgatcgtacgccaggccctcatcggtacgctgctgggcgcgctggccgccgccgccctgctggtgttcgtcaaagggaacaacacggcctacgccgtggcactgccggtgatcatgctggccacgttctggatcgggccgacacggggcgtgggctgggcgcagggaatgttcaccctggtcgtgtccaccgtcttcgcccagctcgcgccggccacctggcatctggccgagttccgcttcctcgacgttctcaccggcagcgtgatcggcctggtgatcgggctgctcgcctggccccggggcgcccaggaggaactgcgccgagacatcgccgcgctgctgggcgccatcgcctccactgtcacctcgaccacgtcgttcctcacccagggccatgcgcaggcacagcgcggccggccctcgctgcagcacgccctgacgctggcggagtcgtccttcgcgcagtaccagagcgagccgcgccgggccggcacaccggtggcggactggcaggcgacgctgatggccgggcatcacgccctgcgcggttccaggcgcctgctggagcccggggacccggccgcgtcccggtggcccgctcccgcataccgggcggaactggccagggacggtgccgaactggccgggcagtacgagctggtcgccaccctcctcgccggcacccgcccgccgccggcaccgtccggccgccccggcccccgcagagccgaggacacccggccgcacgccgctccgcctccgccggtctactacgacgccgaggcatggctgcagggactgaccctcgacctggaccgcatcaccgaggccacggccgaggccgtggcggggctgcccccgaaggacaaagac

SEQ ID NO: 52 - DNA, 507 bp, Streptomyces avermitilis
  CDS (1)..(507)
gtgcggactgcgagtcccggcgacctggacagcattactgacctgcatacgctggctcgcacggcgtactaccaggcaggcggagtgccagacgtggagctcgcctcccccggcgggcactccagccggcgggagagctggaggcgggccgtccactccagcgaccgcactgtcatgtgtgcggaccgagaaggtgagttggtgggcatcttgtcgatgggccctccccacgaagctgacatcgatgccgcaactgcccgacagctctaccagattcacgtccgcccgggcatctggggacaaggtaccggcagcgccctgcacgcggaattcgtgcgggtccttcgcgatgcgtcactggtcacaggcgtactggaagcatgggagcgcaacagccgagcccaagccttctacgcccggcacggatggaagccggacggacaccaccggcccggtccaggcaacgggaactacgttcgcatgcgcctgagcctggaccccgcggtc

SEQ ID NO: 53 - DNA, 375 bp, Streptomyces avermitilis
  CDS (1)..(375)
atgcacccaattggaggcgccggaaatgcaggagtaaatgactgcccgttatattctgtacctgtccgaatacactccgtaacggattcagacgcgcgcccagaaaaaaccggagaagtagtgaacaagatcaagaaggccgcggccgtagcggtcatggtcggcggcatggctctcggcggcggggccgcccacgcagccggcggccacgggctcgacgacccggccgacatcatcatcggcaacctgcaggccgtgaactgcgaccaggacttcgccggcggcgccgccttcgcacccgttcagggcatctccaccgagggcaacacccagaacatcggcagcttctgcacggtggtcggccccgtctacgac

SEQ ID NO: 54 - DNA, 870 bp, Streptomyces avermitilis
  CDS (1)..(870)
gtgccggcgaacatcaaccccaccgtcagaagacgccgcctgggagccgagctccgccggctgcgcaaggccagtgatctgacgagtgcgcaagtggcagagcggctgctggtctcccagcccaagatcagcctgctggagaacggccaccgcgccatcagcccccgcgatgtgcgcgacctgtgcgagctctacggagtgaccgaccggcaggtcatcgactctctgatgcggatggcccgggaatccggacagcagggctggtggaacacctacggcaacatccccaacagcgtctacatcggcctggagacggacgcctcctccattcacacctacgagcccatggtgatccccgacctgctgcagacacccgcctacgcccacgcggtcatcgagacaacggtccccccgatccccgcccaacaggccgacgcgcgcctcaaggtgaggctgcgccgtcagcaccgcatctacgacccggcccgcccgctgcgtctgtgggtcgtcctggacgaaccggccctgcaccgcgtcgtcggcaggcccgacatcatgcgcgaacaactcgagcacctgaacgcactcagcgccgaaccgcacatcaccgtgcaggtcctcccctacaccgcgggagcccaccccggccgccaaggccagttctccgtcctgaggttcgccgacagccccgaggcagggatggtgtacctggaaaggttcaccagcgacctctacctgaagaaaccctccgaagtgcagcagtacagcatgatgtacgaccacctccaggcccgcgccctcagccctgagggcacccgcgacttcgtcaccgacgtcaccaagtcacacatcgacgtggcgagccgtccc

SEQ ID NO: 55 - DNA, 105 bp, Streptomyces avermitilis
  CDS (1)..(105)
gtgtggccgggggcgcggggcatcggccgtggagcgggccggacgggccgtgggattgccccgctcctgccgcagggcgagcggcgcttttcggtgaccgggccg

SEQ ID NO: 56 - DNA, 411 bp, Streptomyces avermitilis
  CDS (1)..(411)
gtgacactgaccgcgaccgtgacctgtagcgctgaccccagcagagtccttctcggcctgacgttcttcgacgggggagacatcctgggtgaggtgtccgtcgactcgagcgggcacgcgcagtacacgaccaccttcgccaccaccggcactcacacgatcacggccgcgtacaacggaaacgcgaactgcttcgcttcgaacagcatgaccacggtccaggtctccgcggcgccggtacccccgactccgccggggcacgggctctgccgcgacgattgctgcggcctgatcaatattcatctcggtggcatcaagaccagcgtcggtgtcgaccgggtcaggtcctcgctggcgcggtggctgacgccccgtctgccgtacccggcccgcttgcaaggcctcacacgg

SEQ ID NO: 57 - DNA, 180 bp, Streptomyces avermitilis
  CDS (1)..(180)
gtgccaaggtgcacgagagagccgtcccccgtgaccgtccaggactctgcgaacaacgcttcccgcccccgctgtgcccgttggcccaagtgggttgactgggccggcgcctccctggggcgcgagagccctcggcgtagcgtgaggctcccggaccggttgcggcggacctttgtcctg

SEQ ID NO: 58 - DNA, 1053 bp, Streptomyces avermitilis
  CDS (1)..(1053)
gtgaaagacagccctcctgcggcaggagcagtccggcccgccgccgttgtcgccgccgttcctgttctcacctcggtcgtacccagtacgggccctgcggcaggcaacaacaacgtcaccctgaacggcagcggcttctcgggagtcaccgccgtcctgttcggcaccaaaccggccctcggatacacggtcgactccacgacgaagatcaccgcggtggccccgtccggcaccggcaccgttgccgtgaccgtcaaaacacccggagggaccagcaactcggtcgcctacacctacgcggcacagccctccctgacctccgtttcgccgagccaggggccgtcttcgggcggcaccaccgtcatcctcaccggaacgggcctgagcgcagccaccgcggtcaccttcggcagcacacccgccgccggctacaccgtcaactccgccacacagatcaccgccgtcgccccggcgggaacaggcgccgtgcccatcaccgtcaccacgcctggcggtacgaccggccctgtctacttcttctacgtcaacgcgcccacggtcacctccgtctcgccgggccaggggccggcttcgggcggcaccaccgtcatcctcacgggggcggatctgagcgcagccaccgcggtcaccttcggcagcacgcccgccaccggctacaccgtcaactctcccagccagatcaccgctgtcgccccggcgggaacgggctcggtcgccgtgaccgtcacgggcccgggcggcgtcagcaactcggtcatctatacgtatgtggcgtcaccggtcctcagctcccttgtccccgtccttgggcccaccggcgccggagccggtgtcacgctcaccggcagcggcctgaccaccacgaccgccgtccgtttcggtgccgtatctgcggccttcaccgtgctgtccgacaccacggtcgccgcgtacgccccggcgggggtgcccggccccgtcctggtcaacgtgaccacggccggcggcaccagcaactccctcacctacacacgtgtcgcccctcccgtgatc

SEQ ID NO: 59 - DNA, 741 bp, Streptomyces avermitilis
  CDS (1)..(741)
atgcccatctctccgaaccaaggatccagtggtggcggcacacttgtcaccatcaccggcaccaatctcaccggcaccagcgccgtgcgcttcggcacgcggtccgccaccaacgtcaccaacgtctcgcccaccacggtcaccgcggtctcgccctccggcagcggttcggtcggtgtcaccgtgaccactccgggagggacgagcaaccccattccgttctactacgtgggggcgccgttcaagcagaccctgagtccgacctccgggtcgaccgcgggcggcacgaccgtcaccatcaccggcaccggcttctccagtgccaccagcgtcgccttcggcgcgaacacggtggcgccgacggtggtgtccgacagccagctcaccgccgtcgcgccggccggtgcggccggctcggtcggtgtcagcgtcaccaccgcgggcggtaccaacaacgggctctcgtacacctatgtcgccgtcccgacggtgacgtcggtcgtcccggacgaggggccggtgtcgggcggcacctcggtgaccgtgaccggtaccggtctcaccagcaccagccaggtcaccttcgacggcaacccggcacccttcacggtgatctccgacaccgcgctgtcggctgtcacgcctcccggggccgccggtctcgtcgatgtcgtcgtgaccaacgacgcgggcagcgcgaccgccacggacgcgttcacctacctcgccggccccggcatc

SEQ ID NO: 60 - DNA, 264 bp, Streptomyces avermitilis
  CDS (1)..(264)
gtgcgcgaagaaaacggagaagtaatgaacaaggtcaagaaggtcgcggccgtagcggtcatggtcggcggcatggctctcggcggcggggtcgcccacgccagcgacggcccggacgtcgtcatccccaacctgcaggtcgtggactgccagcaggagttcgagggtggcgccgccttcctccccatccagggcgcggccgccgtcggcgacaactcccagaacatcggcaacttctgcacggtggtcggccccgtcgaggac

SEQ ID NO: 61 - DNA, 513 bp, Streptomyces avermitilis
  CDS (1)..(513)
gtgggatccactgatgacgcccgactgcaggcagtcctgagcgccctgtggtccgcagcaaacgtgcagggttgctttgggcagtcggaccgtgagcctgaggaacaggatgccgttccgtgcacggtcgcctctctggccgagttcggccacctttacggtcgtgtccgcctgccgacgggccaactggtcgtgtgcggttgcgtggcggtccgcggaggcgacgaaagcagcgactggctggacttgtacgtccctgtgggagcgctggatcacgcgggtgtcgcgtactgggacggccggccgttcttcagatccgctgccacggacgactggcttgccgcggtcggggccgaggctttcagaagcgcgtccttcagtctgggcgtcatcggcttcgaggcctccggctgcaccagcgcatcgacgatggcaggcaggctgccggaggagcgggacatcgggtacctgctgccccggggtgaggtcttgcactacggcgccgccaacacc

SEQ ID NO: 62 - DNA, 1200 bp, Streptomyces avermitilis
  CDS (1)..(1200)
gtgggcgtgaccccgggccaggtgaagcgggcgttcaagtaccgcttctgtccaaccgatgcgcaggcagcggagctgtcgcgcacgttcggatgcgtgcggaaggtctacaacctggcgctcgccgcccgtaccgaggcgtgggcgcggcaggagcgggtcagctacagccagacctccgcgatgctgaccgcgtggaagaagaccgaggaactggcgttcctcagcgaggtgtcgtcggttccgttgcagcagacactgcggcacctgcagagcgcgttcatccacttcttcgccaagcgcgccaagtacccgcgcttcaagtcccggaagaagtcgcggaggtccgccgagtacacggccagtgcgttttgctaccgggacgggaagctgacgctggcgaagatgtccggcccgttggacatcgtgtggtcgcggcctctgcctgaggcggcgatgccctctacggtgactgtgtcgcaggacagcgcgggccgatggttcgtttccctgctgtgcgaggacccgtccgtgaggccgcttcctgcgaccgatacggcggtcggtatcgacgtgggtctggaccacctgctgactctgtccaccggcgagaagatcaccaacccccggcacgagctccgggaccgcgcccgcctggccagggcacagcgcagccttgcccgcaaggccaggggtgacggagccaaccgcaggaaggcccggatcaaggtcgccaggatccacgcccggatcacggaccggcgcagggacggcctgcacaagctgaccactcgactcgtgcgtgacaaccaaacgctcgtgatcgaggacctgagcgtgcgcaacatggtcaaaaaccggaaactcgcccgcgccatcagcgacgcggcatggagcgagttccggagcatgctggagtacaaggcccagtggtacggacgtggggtgatcgccgtggaccggtggttcccctcgtccaagttgtgctcccactgcggcaccctgcaggacacgatgccgctgaacgtgcgcaggtggacgtgtggctgcggcaccacgcatgatcgcgacgtgaacgcggcgaagaaccttctggccgccggactggcggtgacagtctgtggagctggtgtcagacctcaacggagaactccgggcgggcagtcggcgacgaagcagaaaccctcacagcgcgagccg

SEQ ID NO: 63 - DNA, 489 bp, Streptomyces avermitilis
  CDS (1)..(489)
gtgggaaagctgacagtgcgtgcgctgcgcgccgtgctcgtggtggtgctcaccggcaccctgttcgtacaggcagggatggtgtgggcattggtcagcgggagcgacccggaggacggatcgctcccgctgaccccgctgcgcgtgatcacgatcctgggcatggtgtcggtccaggtcgccctggtctgcgtgtggcggctggtggcgatggtgcgacgcggaaccgtgttctcccacgccgccttccggtacgtggacggcgtgatcggcgcgatcgtggcggctgccctcgtgtggttcgcggtcacggtcatcaatgcgccgggccagcgggacgacccgggcgtcaccgtcatcatgggcgggattggcttggccatcctgggggtcgcgctcatcgtgctcgtgctgcggatgctgctcgcccaggccgtcgcgcgcgatgtccaagcggcgcacatgcaggccgagttggacgaggtgatc

SEQ ID NO: 64 - DNA, 219 bp, Streptomyces avermitilis
  CDS (1)..(219)
atgccgatcgccgtcgacatcgacgtgatgctggccaggcggaaaatgtccgtaggcgagctcgcggaccgcgtagggatcacgcccgccaacctggcggtactcaagaacggccgcgccaaggcggtgcgcttcgcgacgctcgccgcgctctgcgaggtgctcaagtgccagccgggcgacctgctgcgctgggaggccgaggacgccgcaggcgga

SEQ ID NO: 65 - DNA, 633 bp, Streptomyces avermitilis
  CDS (1)..(633)
gtgtcagcgtgcgcggtgtggccgcaggcgacgcagtggaacttctcctgtgcgggccggttccccttggcggtgtgcccgcattcggggcactctcgggaggtgttgcgggggttaacggcgatcacttcccgtccggcgctttcagccttggcgtgcaggatcgtcaggaacaccccccaaccggcatcgttgaccgacctgttgagcccggctttggcggcggccccgttgggcaggaaggcgcccgcccggccggggtcggactacggcgcgggggccttgctcatggtgcggatcttgaggtcttcgtgcgcgatgaagtcggcacttcgcactcagtacgatgcgccggtgatctcgcacagagctggcagtccggggcagctgctcgtcatcgcctgcacagtcgttgccctggtcactgcgccccttagttggtatgcagcacacaccgtgcgccccgactgcgtcgtcgccatctccaaagtcaccgacggcaacgggcaccatctccctgacgtgaacggccgagtgtggtcggacaatgaactcgccgatcgcgcctaccaacaggccgttgactcaggccgctgcgatccgccccatgcccgctggaggcagtggctcgac

SEQ ID NO: 66 - DNA, 420 bp, Streptomyces avermitilis
  CDS (1)..(420)
atgaccgacgacgcctatctcttcctgctggacgacccggccgtgccgctcggcgtgccgccgagcgtggccggtgagctgtcatgcatggacacccctgccgtgcgggcgtggctcgacgcgcagggtgtcacgacgacgtccccggcgctgcggatactgccgccggaacagaccgcggcgattccggagcaggcggaacggctgccggttccgctgagcgaggcggaactgagccgcttgcgtcaccacaacgcccctgaggccgtcgcccgcctcgaggaggagctcctggcctaccgcgactgcacggacggccgcgacaccctgctcaggcgggcccttgcggccggaattcccctggcgcgcatcgtggaactgacgggtgaggaaccggcggccgtggccgcctcctccggg

SEQ ID NO: 67 - DNA, 468 bp, Streptomyces avermitilis
  CDS (1)..(468)
gtggtccccactgaggtgcggccgctgccaaagaccagccgggtgctcggcgtggactggggcgtgaaggagaccgcgaccaccacctccaacgcccacgacctgccgcacgcccagcacggccgcaaggcgcaggctgggctgacccgttacgaccggatgagggcccgccgccggccgaagaaggggcaggccgcctcgaagggctaccgcgaggcgaagaagtggcgggcgaaaacctacgcgaagatcgcccgacagcggcaggacaccggccgcaagtgggcgaagaaggtcgtgaccgaccacgacgccatcgccgtcgaggacttcaggccgaaatgcggagcctgccagtgctggcggccccgcaccgtcttcacccggaggaggcggccacggccgccggttcctcacccgtcagttccacgatgcgcgccaggggaattccggccgcaagggcccgcc

SEQ ID NO: 68 - DNA, 1074 bp, Streptomyces avermitilis
  CDS (1)..(1074)
gtgcacgaccatgcaggtggggcggaagctgtgcctcgctgtgtatctgcgggtggctgccaagacgggtgggaccacagggtgatgacgctttgtagccgggatgtgccggcagccgagcggttcagctggttctgcgagctggtggcccgcgacatggcaccgcacgacatcgtcaccgagcacgtccaggacttctccgcttcggcgacgctgttgtcgctgggtgaggggatcggtgtctccagcgttgcgttccctgccatgcagtcgatacgttcgcggcgcctcatccggcgttccgaccccgaactgtgggtactggccctggtcgtcaaaggggccatgcagcgggagcagggccgcaaccaggtgaatccgcgaccgggtgacctggtgctctacgactcctcccagccgtactgggcatcgatcgccaccgacgacgtggcccagtccatcgtgctgcatctgccccggcgcacggtgcccgttccggagcaggcgctgcgccggatggtggccactgcgctgccgtccaggacgggcatcggtgccctgctgagccagttgctcggtgggctcgtcgagcaggggccgaagctggaggccggtcagaccggccgggtggcgtctgccgtggtcgatctgaccaccgcgttcctggcagggctgagcggtgctgacggaccgcagaccacagcggcacggcgggtggcacaactgcaccagatcaagtcgttcatccggtcccggctcggtgagccggggctcacccccacggccgtcgccgcggcccaccacatctcgctgcgcgctttgcagtacctgttccgggaggacggcaggacggtcggcgcgttcatccgcgagcagcggctggagcgctgccgggccggtctcgccgacccccgtctggccgggcacagcgtcgccgcgatcgcggtccgtgccggtttctgtgatgctgccgcgttcagccgggctttcaaggcacgttacggaatgcccccgggcgagtaccgtcggcactgcggaggaccgccgtcgcaaggccgcgccgggcacactggc

SEQ ID NO: 69 - DNA, 1464 bp, Streptomyces avermitilis
  CDS (1)..(1464)
atgaccgaccgtgttctggaactcctgcgcacccgccccgatctggccgaactggccgcgttccccttcggcttcgatgtgagccgggcgtaccacgtcgaggccgtgcacctggcgtccggtgcgccgctggagccgatcgccggcgacgacaccggcggcacgtacttcctgtgcggggcaacggccgtgctccacgcgtcctccgagggcgacgccgtgctgctcgccgacagcgtcggcgaggcgctcgagatcctcgtccggctgccctggtggtgcgagaacatctccgcggagctggacgaggaggacctgctcgccgaagtacgtgcggcggaccacgcagcgcgcgaggagttcgcccccgaactggacgcgcagcgagcggcgttgatcagcggtctgggtctgccggaccggccgctggccgaactccttgccatgtcgcagtcggctgccgggcgcaccgagccggaccacgtcctgctcaactcccgtgagctctgcgcgtaccggctggaggagtccttccgccagcccctgcgcgacgttgtccttggcccgggacgggaggtgctggagcggatgcgccgcggcggtctgggcgcgcgggaggaggcggctggggatccggtgctgcgggcgggggtgctgcgggcggcgcagtacgaccgccgtgacggcgacctgccgctgctgcgtttgctgctggagcacgagagtgccgcgcggaccgagcggttcgaggagcggcggctggctgcggtgctggtggcgttgcacgggcgggagggggacgtttcgctgctgcggtcggccaccggggggcaggtcaccgacagcgccgaagccgtggagtgggcccgcgccgaggaggcgaagcggtacgggcgggatgtggctgcggagagcgagttcacctggatcgagctggcccgccggcagggtcgcatcgagcgcgcccgggtcgcgctcatccgcatgctggacgacacggggccggacgcggaccggctgcgggagctgagccgcgcgctggagcgcatcggcgactacgcgcaggcggcccgcgcccagttcaacctcctctcgcttcaggacactgcatgggaccgggcctcggaggcgtacgtcctggcccgtctggagcgccgcaggggtgacctcgtggcagcggggcgggcgctggagcgggcacgggcggcggtcggcgccgggggcaccacgccgggcggggcggattgccagtggcaccgccgggggctcggccggctgatcacggagcagcatctggagctgacgctcgccgcggccgaggcgggtgacgcggaactcgcgcgtgcgacgatggggcacggcaggctcctgctggacacggtcggcaaggagtcggcgaaggcgctcagccggctgtccacgcgggcgaaatgggcggtggccgggcttcgcccgcccggcgcc

SEQ ID NO: 70 - DNA, 237 bp, Streptomyces avermitilis
  CDS (1)..(237)
atggccaccacgcacgccgacgccctccgctcccagcgcggcatctggatcgacgcgggcacccgcgacgagtggttcctcgacctgggcgcactggccttccgcgatgcccttacggaagctggagtggccgacgacatcgtgcatttcgagctgttcgagggtggccaccacgccgtcgagtaccggatgccgcccgcccttgcctggttggcgcaccgcatcgccgatcggcct

SEQ ID NO: 71 - DNA, 255 bp, Streptomyces avermitilis
  CDS (1)..(255)
atgaaccggtccggctcccgtgacgccttccgaagccccgacgcccaggaggtgccgtccggcggggtggacatccccgtcaggaccgagacctggacgtcctcgaacacacgttttggagccgcaccgggccgcaccgggccgcaccgggccggcctcggccccggcgcgctccgcaagggccggcaccgcggcggtgatccttcggagagcgttctggcggatctcgccggggtgtgcgctgagcggcggtat

SEQ ID NO: 72 - DNA, 423 bp, Streptomyces avermitilis
  CDS (1)..(423)
gtgtccgcatcactggtggagaccgtcgatatcgaagcccccgtcgccgtcacgtgggcactgtggagcgacgtgagccggtggccgtccttcctgagtcacgtgcgcctggtggagccactggacgagcggcgcttcgcctggcagctgtcgctgccgggagccgacaagaacttcgtcgccgagctgaccgaggtgatccccggggaccgcatcgcctggcagaccacggagggcgttcaccatgcgggcgttgtcaccttccaccggctcagcgacacgtcgagccgtgtgaccctgcagatcgagtacgacccgaagggtttcgtcgagcacatcggggcgctcaccaatttggactccacgctggcgaattacgacctcggcgagttccagaagctcgccgagacggcagccgccggc

SEQ ID NO: 73 - DNA, 1653 bp, Streptomyces avermitilis
  CDS (1)..(1653)
gtgactgacgtcccgaacggccgggatccgaacggccgggatccgaacgggcgccgcgccctggtacccgcgtccccgcccggcatgctccgccggcttcagcgcgcccgcctactcccacgctcggtacgggttcttcgctcgctgcgggttctcccccgctcggtgcgggcgcgttccgcgctcgccgccgccttcgccgcggccgtgctcttcacctccggggccctgctgatgcggcatcagctgtacgacgagcggctgcgggccacttcgtcggtggcccagcagcaggtcaccacccttctcagcgccaccgccaactcatccatcagcggcccctggggagcaccgtacgaaatcgtcgccggcgacggcatgctcctggcgtccagtcccgagctggagccgtacgagaaggacggccacgcgttcctcacgggcccgggccggggcgggagcctgcccctgtacaccagacgccggttcacgttccccgccgtggccgagccggcggcccgctcgctgtccggacagaccctgaccaccgtcgaggggacggtgcccgcctcctacctgcccggcgagacgcaggggcgcggagtggccgccggcgcccgggtccgggtgtacgtcctgatcgtcccggacgatgccgagcgggcggtcggcgaactcgaccgggaactcgtcgtggccgttcccctcgcgaccgcgctggtggccggggtggcctggctggccacgcggcgggcgctgcggccggtcgaggcgatcagggcgcgcaccgcctcggtgaccgcggcggacccccgcgaacgggtggaggtacccgacaccgccgacgaggtggcggaactggcgctgaccatcaacgccaccctccagcggttggaggaggcggccacggcacagcgccggttcgtggcggacgccgcgcacgaactgcgcagcccgctcgccaccctgctcgcggggctggaggtggccaccgcctaccccgaccgggccgactggcccgccgtggtgtccgcggccggccggcaggcgcggcggctgagcggtctgacggaggaactgctcctgctggcccggctggacgcgggcgccccgccggcccccgccgaacgggtcgacgtggcggcactggcgggccggctctcggaggagtacgcggagcgcgccgggggttccccgaaggtggatctcctcgtcgccgcgccggatgccgcgacgacggtgttcgcggcacccggtgacctcgaacggatcctccggaacctgctcgacaacgccctgcgccacgccgtcggccgcgtgctgctgactgtggcccgggactcggccgcacccgggtcggtgctgtgcaccgtccgcgacgacggggccggcgtcgcggaagccgacagcgaacggatatttgagcggttcacccgcctggacgagtcccgcacccgtacggacggcggcaccggcctcggtctcgccatagcccgcgacctggcggcccggcacggcggcctgctcgtgctggcggtgcagccgaagggttcgggggcgtgcttcgtcctccgcctgcccgcgggagacccgatgtcgatacggccccgccccttcaagggtcgggggcggtccgccaggtcgcagcgactt

SEQ ID NO: 74 - DNA, 744 bp, Streptomyces avermitilis
  CDS (1)..(744)
gtgaggattctggtggtggaggacgagcgcgaactggcgcagacgctgcgcctcgggctgacggccgagggctatcgcgtggacgtggcccatgacggccgcgagggcctgtggaaggcccgcacgggtgactacgcggtcgtcgtgctcgacctgatgctgccgctgctcaacggctaccgggtctgcgcccagctgcgccgcgagggcatcaccacccccgtgctggtgctcaccgcgaaggacggcgactgggaccaggccgaggccctcgacaccggcgccgacgactacgtcaccaagccgttcacctacctggtcctggtcgcacggctgcgcgcgctcatgcgccgggcgcggggagcggcctccccgctgctggcggtgggcgacctggtcctggacgtggcggccagaacctgcctcaggtcgggcgtcgccgtaccgctcacgccccgggagttcgcagtcgccgaggtgctcgcgcggcggccgggcgaagcggtcacgaagtcggagatcctgcaccacgcctggccggacgaggccgaggacctcaacctggtcgaagtccgggtcagcgccctgcgccggaagatcgacacggccttcggacggcagtccctcctgacggtgcgcggggtgggctaccggttggtcgacgaccgcggggagacggaggaagacgccgttcaggagcccccggccgggcggtgggacggtgccggacggaactccggtgac

SEQ ID NO: 75 - DNA, 1539 bp, Streptomyces avermitilis
  CDS (1)..(1539)
gtgcttggcgcgccggcccaccgcgcggcgagcgccgcaccggtgatccgccggacgaaaggccccgacatgccgacccgcctgaccgcgctcctctccccgtcccgcccgtcccgcccgtcccgcgacgacgcggccgggcccgtcgccggaacggcccggccagcgcggggcgccggctgggcgaccgcgctgtcgctcgccctggtgtgcttcgtgacgtatgcggcgctgtccgtgcggctgcaccagcggatgctgaccaccggctacgacctggggatcttcgagcaggcggtacggtcctacgcgcacgggcacctgccggtggccgagctcaagggaccggggttcccgctgctcggcgaccacttctcgcccgtgctggccctgctggcaccgctgtaccgggtctggccggcgccggtgaccctgctggtggcgcaggccgcgttgttcgcggtggcggtgatacccctggccaggtgggccgaggaggtacgcggccggcgggcggcgctggtggtcggtctcggctacggcgcctcctggggggtcgcacaggcggtcgggttcgacttccacgaggtgtgcttcgcggtgccgttgctggcgttgtccctgacggcggtgggccgtggccgggcgcgtgccgcggccctgtgggcgcttccgctgctgctggtgaaggaggatctcgggctgaccgtcgcggtcgtgggtctgctgatcgcgcgcaccggcgagcgcgacgaccgcaggagggggggtgccctggtcctggccggagtgctcgggtccttcctggagatgctggtcgtgataccggcgttcaaccccggcggcacgttcgcgtacagctccagcgtgcccggcgcggggtccgccaccccgggcgccggcgagttgctcctccactacacggtgggactggtcaccccggacaccaaggcgcagacggtgctggccctgctgtccgtgaccgggttcctggccgtgcgctccccgctcctgtgggcggccctgccgacgctcctgtggcgcttcgcgtcggacaaccaggcctactggggaaccggctaccactacagcgcggtcctgatgccggtgctgttcgccgccttcgtcgacgcgctgacccggcccggaccggtgcggtacgcgctggcggcgagcgcggccgtcacggtgctcctgctgccccagttcccgctgtggcagctgacgcagcccgccacctggcacaccgactcccggctcgcgtccgcccggcggctgatggaccgcatcccggacggcgccaccgtcgccgcctccaaccggctggtcccgcagctcaccaaccgcgcccgggtcagcgtgttcggcctggggggcagccgtcccgacgcggagtggatcatcgacgacagcgcgcagccgcagggctggccgattgcacccgacgacgaccgcaggctgctgtccgaggtccggaacaacggccgctaccggaccgtcgcggaccaggacggctacgttctcctgcagcggcggccc

SEQ ID NO: 76 - DNA, 387 bp, Streptomyces avermitilis
  CDS (1)..(387)
atgctcacccacattccgccagacggggtcgccccggggaacggctacagccatgtggttgtgggcgaaggccgactggtcgtcatctccgggcaggtcgcactggacgaaaagggaaatgtggtcgggaaaggcgacgccgccgcccaggcccgtcaggtcttcgagaacctgcggcgctgcctcgcggcaggcggcgcaacgttcgccgagatcgccaagttcaccttctacgtcaccgacgtcgccatactgccggaggtacgggccgtccgcgacgcgcacatcgacaccgcgcgtccgcctgccagtaccgcagtacaggtcgccgccctgtaccggccggagctcatgctggaggtagaagccctcgccatcatcccctgg

SEQ ID NO: 77 - DNA, 1005 bp, Streptomyces avermitilis
  CDS (1)..(1005)
atgccccaggacatcgacttcggcctccccgcgcccgcggggatcagccccggcctcgaggccacacgccggcacaacctcggctgggtgcgccgtctgggtttggtcggcgacggaccgtccctcgcctggtacacctcctgggacatgccgcgtctggccgcctgcggcttcccccacgcccggggcgccgcgttggacctgtgcgcggatgcgatggcgttcttcttcgtcttcgacgaccagttcgacggccctctcggccgggatccggcccgggctgcccgcgtctgccggcggctgaccggcatcgttcacggcgccggcccagggcctggagcggacgcgtgctcggcggcgttcgccgacgtgtgggcccgcagcaccgacggcgcccacccgggctgggtggcgcgtaccgcgcacgagtgggagtactacttcgccgcccaggcccacgaggcgatcaaccggctccgcggcacccccggcgacatggagtcctaccttcaggtccgccggggcatcgccggcaccgatctgcctctctccctgggcgagagagccgccgggatcaccgtcccggcggccgcgttccacagcccgcagctgcggatcatgcgggaagcggccatcgacgtcaccttgatgtgcaacgacgtgtactccctcgaaaaggaggaagcacgcggtgacatggacaacctcgtcctcgtcatcgaacacgcccggcgctgcacccgcgacgaagccgtcaccgcggcccgcggggaagtcgcccggcgtgtcatccggttcgagcagctggcccgggaggtacccgccctgtgcgcccagctcgggctgagcgccgtggagcgggcccacgtcgacacctacctgggtgtcatggaggcctggatgagcggataccacgcctggcagacccagacacggcgctacaccggcgcgccacacgtcctgcccagcaccggccccgggtacttcgacgaggtcctgcccacg

SEQ ID NO: 78 - DNA, 459 bp, Streptomyces avermitilis
  CDS (1)..(459)
gtgcgcgcgctgcgctccaccgcccgagcccatgagcgagccgcagcggtgacctgggtccgtcccttcccgctggccgaccagctggccgacgtcgtgctggacgtgttcgccccccgcaacccatccgagttccaccgggtgctgcgcccgaccggccggctggtcgtggtgcgccctaccggacggcacctggccgaactgcgcggccaggtccccgcgctggtcacgatcgacccggccaaggaacagcgcctgttcacggctctgacccccttcttcgagacctcccgtaccgaacaggtcgagtacgccacgttcttgaccaggacgcaggccctcgacctggtggggatgacgcccagcgcacgccacctgaaccgtgcagacctggccggaaacggcctcctgcccgaccaggtcaccgtctccgtgctggccaccgcataccggccccgg

SEQ ID NO: 79 - DNA, 558 bp, Streptomyces avermitilis
  CDS (1)..(558)
atgtgtggctggtcgactccacaccggtcggctgcggttgctcccgtgagactggcaggctgggcccagtacggctactgcgcatcacactcgcgatacttctgggggctgcgtctgcacctggtgtgcacactcggcggactgccggtcctgttcgcactcaccggggcggacgagcgcgaaacactgcgcgacatgctcgataccgcgccagacgtcctcgccgctcaccccgggcagacgatcatcggggacaagaactacttcggccgcgagttcgagcgcggccttgccgagcgtcacctgaagttgctgcggccagcccgcaagggggaagccgagctgaccgggtcacacctgttcaaaccgctgcggcaggtcatcgagtcgatcaatcagaccttcaaggggcagctcaacctggaacgacacggcggcaagagccctgcaggagtgtcagcccgggtcttgtgccggatcctcgcactcacagcggcgatctggcacaacgaccaaactggacagcccatcaaacgatcactcacagcctacggtcac

SEQ ID NO: 80 - DNA, 936 bp, Streptomyces avermitilis
  CDS (1)..(936)
atggacgttacgaccctctactcgatcggggagctttcccggcggaccggcttgtctgtgaggaccatccggttctactccgattcgggggtggtagcgccgaccacccgtagtcccgccggttaccggctctacgacctcgacgcactgctccgtctggaactcctgcgcacactgcgcgagctgggcatggacctgcccacgattcaacgggtactggaccgtgagctctcggtggcggaagtcgccgcggcgcacgccgacgccatggacgtccagatccggacgctgcaactgcgtcggagcgttctgcgagtcgtggccagccgcgggtccagtcccgaggagaccaagctcatgcacaggctcacgcagttgtccggcgaggaacgccgccgtctgatcgacgatttcatggatggcaccttcggcacagtggatgccgacccagccgcggtggccatggttcgcgctgccactcccgacctccccgatgatccgaccggcgagcaggtcaccgcgtgggtggagctcgccgagctggtcggcgacgaggatttccgtgcccggatgcgccggacggccgtacgtcaggcggccgggcgcccgctcgacatcgaatgcgatgccggcgaggaactgatggagttcacccgtcagaaggtggccgaggccatggaggcgggcatcgacccgctcaacgacaggggcgcacccgtcatcgacgacctcgtgcaccgcttcgccgaggtgctcgcgcgcacccctgacacggaattccgggactggatggcccagcagttcgaagagacgcacgatccccgggtagaccgatactggcagctggtatggatcgtcaacggctggcacgtagtaccgaacctgatcccggtgtacccctggctcatccaggccctgcgaaatagccgtgacgca

SEQ ID NO: 81 - DNA, 333 bp, Streptomyces avermitilis
  CDS (1)..(333)
gtgcccgtgtcgctgtcccctgccctcgaaccgttcctcgacctcctgcgctgcccaacgtgccgcaccggtctccacctcggccacggcgcactgcgctgcccggccggccacaccttcgatatcgcccgccacggctacgtcagccttctgacgggcacccgcgccaccagcggcgacgatgcggccatggcccgggcccgggaccggttcctgtccaccggcagctacgggcccatccgccaagccgtggcccgcctggcggccgacgcgatgcccgagcagggcacggtcctggacgtggggtgcggcacgggctactacctagatgat

SEQ ID NO: 82 - DNA, 768 bp, Streptomyces avermitilis
  CDS (1)..(768)
atggcgcggcatggcgggcggggatggtacggccgggtacttgcggcggcggtcggggtgacggcgctggcagccgctacctcggtatggaccgcacaggccggtcccgtcgacgggcagcactccgcgcgccccgccgcaccgggttccggcaccggccgggcgccggtgtcggcggacatcgcccacgcctcggaccacggcgcccaaggcgtcaacatcaccatcgacgacggaccggaccccatctggacaccgcaggtgctgcaagtgctgcgggagaacggcgtgaaggccaccttctgcatggtgggcacacaggcccaggctcacccggacctggtcaaggcggtggtggcggccgggcaccggctgtgtgaccacacggtctcgcacgacaccaccatggacaccaagtcccactcgtaccagtcacgacagatcctggacgccgaacgcatgatcaccaaagcctccggaggcgtccggccgctgtactacagggccccgggcggtgccttcaccccctacagccggcacctcgcggcctcccgggggatgcggccgctgggctggaacgccgactccaaggacttcgagcgccccggcgccgacgccatcagcgccaccgtcaagaacgagataccccacggcccgaccattctcttccacgacgccggcggggaccgctcccagaccgtggccgccctgcgcgagctcctgccgtggctgaagcagcagggatattccttcggcttcccagtgcgc

SEQ ID NO: 83 - DNA, 579 bp, Streptomyces avermitilis
  CDS (1)..(579)
atggcagggaccggacgggtaggactgaccacggagcgcctggtccgggcaggagcagaactcgccgacgagatcggcttcgagcaggcgacccccgcggaactcgcccggcggttcggcgtcaagaccgcgagcctgtactcgcacgtgaagaacgcccacgacctcaagaccaagatcgccctgctcgccctggaggaactcgccgaccaggtctccaccgcggtggcaggacgggccggcaaagacgccctgaccgccttcgcgaacgcctaccgcgactacgccctcatccacccgggacgcttcgccgcagcccagttccggctcgacccgcagacggcggccgccagcgccggcgtccggcacgcccagatgacgcgggcgatcctgcgcggctaccacctggccgaaccgcaccagacacacgcggtgcggctgctgggcagtgtcttcagcggctacgtcggcctggagagcgccggcggcttcagccacagcgcccccgactccaaggagagctggaccgagatcctcaacgcactcgacgccctgctgcgcagctggcccaccgcctcc

SEQ ID NO: 84 - DNA, 216 bp, Streptomyces avermitilis
  CDS (1)..(216)
gtgaccgagccggacggccgcccggccggtgtccggctgtgctcctccggcggcggcgccggcgccgggcagatgtgccgcagcaggtgctcggtgtgcgtggccaccggcaccgggggcgtctgcctgacggccgcggcgaggtccgggaaggccgggcagcagggcagctcggccggcatctgcatgggcatcgatctggcctgcctgctcctg

SEQ ID NO: 85 - DNA, 1191 bp, Streptomyces avermitilis
  CDS (1)..(1191)
atgaggctgctcccggcccggccccggctgctcgccctgggcgagcccacccacggcgaggacactctcctcggcctgcgcaacgaactcttccggcagctcgtcgagcaggagggctaccggacgatcgcgatcgagagcgactgcctgacgggcctggccgtggacgactacgtcacctcgggcaccggcactctcgacgaggccatggaacacggattcagccacggctggggcacctttgcggccaaccgcgaactcgtgcgctggatgcgcgcctacaatgtccgtgccgccaacgacggccggcccgcctgcgagcggctccgcttcgccggcttcgacggcccgctggagatcacccacgccgcgagcccccggcaggccctcaccgcactccacagctacctcgcgacccgggtggacacaaacctgctcccctgcaccgcaaccacactcgaccacctgctcggcaccgacgaccggtggacccatcccgccgcgatgacggacccggcccagtccgcggggcagtcggccgaggccggccggctgcggctgctcgccgacgatctggtggcgctgctcgacgcacagacgccgcacctgaccacggcgacctcgcgggacgactgggaccgggcacgcctgtacgggcgcaccgcgaccggcctgctgcgctaccactactggatggccgacacctcaccggcccgcatgacccggctggtgggcctgcgggaccagatgatggcccacaacctcctcgccctcgccgcccggggcccggcactcatccacgcccacaactcccatctccagcgggccaagagcacgatgcgcatgggcgggataccgctggagtggtggagcgccggtgcgctggtgagcgcccggctcggcgaggagtatgccttcgtggccaccgccctcggcacgatccgccaccagaaagtggacaccccgccgccggacaccgtcgaaggactcctgtacgcgctcccgcaggaccgctgcgtcatcgacgccccgcggctggccaccgccctcggcgacacgcggcccgcgccccgcgtatccccctggttcggctacgccccgctcgacccggcccacctggcggacagcgacggcatcgtgttcgtcaaggacgtcgtgcagagccggccccggctgttcagcaaaaccggc

SEQ ID NO: 86 - DNA, 765 bp, Streptomyces avermitilis
  CDS (1)..(765)
atggggcgaaaccttcaaagcggtgagcggctcaggccggttgatctggcgcgtgggcacggtctgtccacgcaggcggtcaggaattacgaggaggccggcatccttccggccgccggccgcacaccccacggctaccgcacctatacctcgctgcacgcgggggccctgcgcgcgtttcttgcgctggtgcccggccacggccaccggacggcggcgtcgatcatgcgggcggtgaacgagggcgcggtcgatgaggcgttgcgcctcatcgacgagagccacgcccagctcctcgacgaccggcggaccctccaggccgtggagagcgccctgcgcgacctggagcccaccacggggtccgggcccggtggggggtccgggccggccgcggggtccgggtccgggtccggcggcacgttcatcgggccgctggcacacaagctcgggatccggcccgcgacgctgcgcacatgggaacgcgccgggctggtgcgcccgcgccgcgacccgctgacggggtaccgcgtctacgacgaggccgacgtacgggacgcccggctggcccaccagctcaggcggggcggctacctgctggagcagatcgccccgctgatcgcccgggtgcgggcggccggcggcctggagccgctggaggccgccctgcgcgactggcacggccggctgtccgcccgcgggcgggcgctgctggccggggccgccgggctggaggcgtacctccacgagcgcaggaaaaccaggtcc

SEQ ID NO: 87 - DNA, 993 bp, Streptomyces avermitilis
  CDS (1)..(993)
atgctgaccacactgggtctggacacggccgctgagacggtctaccgcacgatgctgatgcatccgcaggcgggcgtcgccgaactcgccgtacacctggaggtaccggagggggacgtacgcgacgcactcgacatgctgagcgaactggcgctcgtgcggatgtccgccgaggacgcggggcggctgcgcgcggtctcgcccgacatcggcatggagatcctgatggcacgccagcaggccgaactcgccgcgcagcagcagcgcgtggaggcctcgcgggcagccgcggcccagctgatctccgagtactccgagctgcgcccggccacccgccaccccgaggtggaacaactggtgggcctggaccagatacgcgaccggctcaccggtctcacgcgcgaggtgagcgaggagctgctcaccttcgccccgggcggcccgcagaccgcggacaacatggccgcgtcccggccgctcaacggggacctcctcggccgcggggtgcgcatgcgcacgctctacctcgacagcgtgcgcaccgaccgggccaccgtcgaacacgccagatggctcacgtccctgggcggccaggtgcgcaccgtgcccgccctgcccacccggctgatcctcatggaccgcaagaccgcgctgatctcggtcagcagcgacgacaccgcggccggagcggtggtcctcaccggacagggcacgctgaccgcgctgcacgccctgttcgagacgacgtgggctggcgcgcagccgctgggggacaccgtccccgtggaccggcacggtctcaccggccagcaggccaccgtcgtacgcctcctcgccgagggccacaccgacgagacgatcgccaagcgcctgggcgtctcgccccgcacggcccgccgcatcgcctccgaactcatggaacgcctggaggcccgcagccgcttcgaggcgggcgtacgggccgtccagcgcggctggctgcccgcgcgggcc

SEQ ID NO: 88 - DNA, 330 bp, Streptomyces avermitilis
  CDS (1)..(330)
gtgcccgtgtgctgggacggtagaggcatgtacctcgtccacatccatctggagtttccgccccggacccaactccccttcggagcacgggacatgatccgggcggccctcacggcggacgacctcgtcgagcacgtggccgtgcatccccggtcgccgtcccggctcaccctcggcttctatctgctcgccgcccgcctggaggaggcggaggagagagccgcacgggtgagccgccggctggcggaagacgttcccgtcctgcgcggggcccggctgcgcggcgcgggggtcccgctcgtgccgctggcgttcgagcggacgccgggc

SEQ ID NO: 89 - DNA, 774 bp, Streptomyces avermitilis
  CDS (1)..(774)
atgaccacacaacccctacgcaccgagcgcagcggtccgcagaccgcttccctcgtgaccgacctgccgttcaagcctcagctcgtcaaagcggtgttcagggacgtgacctcgttgcacgtctcccggccggccgcgtgggccgccgcgtcggtgacgcggaccgtgctgacggagatcatcgacggcgcgagaagcgcggcggccgaggaggccaggaagaggctgattcccaaggacctcatctcggcgatcgaccggaacgtcgaggtggaggtgggatcggcgtggtacctgcacagcccgaccttccacggcctgatgggcgaggtgcgcaacgccgatggtgcgctcgtgtctcttcgtgagcgccgcggggcgcgtacaccgagtggtgtggctggcgcccaccggttcgaggccggggtgagaaggctgctggcaagccggggggtgagggcggtcccggcgatggtccgcgacctggacggaatcgtgagcgtgttcctgacggccctggcccgggacgcggccaaggtcgtccgcgagggcggggtcaagcggttcgggacggtcagtctggtggtgccgggcgagccagccccggccccgctgctcaaggaccccctcctcgccctgtccacccgccgcggggacgggcggactgttggcggggacgacgtcctggccgccgtcacgatgcagctgttcggcgatctcagacaacgcgccatcaccgaggcagccgagatgacacggaacacgtcggccaac

SEQ ID NO: 90 - DNA, 585 bp, Streptomyces avermitilis
  CDS (1)..(585)
ttgcgactgcatcgcgtagcgcccggcatcgccgcgggcatcctcgccccggccctcctgctcgccaccccgtccttcgccgccacggcggcaccgaccgcggtgacggtgcccgcggtgtcctcgtccgccaacgagccggacgccgacgacctgagggtggccatagtccggatcctcgccgacccggacagcggccagcgtgtgacacgagaagccaacgccctcctggacgccaacgaccccgaggccatgcgcgcctggctggagaccggctaccgcatcgcccaggccgaggacgaccgcgtcgccatcacgcgcctgctcgccgaccccgacagcggccggcgcgtcatcgccgaggtcaacgccctcctagacgccaacgactccgacgcgatccgcgcctggctggagaccggctaccgcatcgcccaggccgaggacgaccgcgtcgccatcgcccgcatcctcgccgacccgtccatcagcccggccctgcgcgcggcagccaacgccgccctcgacgacaacacacccgaagcactgcgccacttcctggaagtcggcaggtaccaggtcgcc

SEQ ID NO: 91 - DNA, 405 bp, Streptomyces avermitilis
  CDS (1)..(405)
gtggcagttgccccgctgcggtcgcagggcaccgtcgccgcggacgtggccggtgtttcatggcggcgcgccttcgagaagggcggccttgagcgcggctcgtggctgtcggggcatgatcgggcgagacgattcctgggggcggtcgtggtgtggtccgagcgtgtggtggggcgcgacggggttcggcttgtctgccgggaccggggcgggccgggggagccggtcgtgctgctgcacggcttggccggtcatgcgggtgagtgggaggtggtggcctcgcggctgattgcccggtatcgggtcgtcgcggtcgatcagcgcgggcacggcgcgagcgagcgtcatccgtacgcgccgacatccacctcagcctgctccaactcgcctgcagcatcatctgct

SEQ ID NO: 92 - DNA, 444 bp, Streptomyces avermitilis
  CDS (1)..(444)
gtgctggaagccgcgcagggcgcaccggcctcgtccgggcgccgcacgcgccgcccggggctctccgaagaggtgctgcgggcctatgcctacgcgtgcgctttttgcggatacgacggcatgctcggccgtaaccccgtcggcctggaagcggcacacatacggtggcacagccaggacggccccgacaccctcgccaacgcactcgccctgtgcgcgctgcaccacatcctcttcggcctcggggtcctcggcctctcccccggcctgcgcatccaggtctctcccctgtatgtcgcccgcagccacgccggacacgccgtcggcatcctccaccgccggcccctcgccccgccccgccccggccaccccagccccggcccggaacacattcactggcatcaccagcaggtcttcaagcacgcccccacgcccgtggcgcgg

SEQ ID NO: 93 - DNA, 612 bp, Streptomyces avermitilis
  CDS (1)..(612)
atgaccctgccctccaggcgcgccttcaccgccgcggcgatggcctcgttgctcgtgggctgcgccggccccggggccggccaggccacgacggccgcacgccctgggcgtacgccctcgtcttcgcgggccgccgcgaagccggcgcatgcgcttgggcgttcggtccccgtcgggttgcagatcccggcgatcggggtcgacaccccgctcctgcggctggggctggccgcggacggcagcgtgcaggtgccgccggtcacggcgcacgaccgggcgggctggtaccggcactcgccgacgccggggcagaggggcccgtcggtgatcctcggccatgtcacggtcggcgcttacggggacggggttttccgtcacctcgcgcggctgcgccggggcgagcggatcgtggcgcgcctggagaacggcacggcggcggtgttcgccgtcaccgccgtacggacggttcccaaggccgacttcccggcggacgcggtgtacggggacgtaaaccgtccggagctgcggctcatcacgtgcggcggcccccgcaacggtgacgggtacctcgacaacgtgatcgtcttcgccgcgctgagctccgcaagcccc

SEQ ID NO: 94 - DNA, 489 bp, Streptomyces avermitilis
  CDS (1)..(489)
ttgaaacggtcccgcgagagggcagcgtccgagctgttcgccgccctctacccgcgcctggccggctggtgccgccggctggtcgacgacgacgagacggctcacgagatcgcctcggaggcgttcacccggctctgggcccgctggacttccgtggcggagccccggggtttcctctacgtcaccgcggccaacctcgtgcgggaccactggcgcaagctcgagcgtgaacgcagagccgtgcaccgggtcaccgccgaagccgcgctccgcccgccgagcgaacaggccgatccgtcggtacgtctgctcgtgcagtcgctgccggagcgactgcgcgtcccgatcctgctgcactactacgctgacatgccgatccgggaggtgtccgtgctgaccgggcgcaaggaaggaaccatcaaggccgacctccacgcggcccgagaactgctccgtgcccacctcaggagaagccttgatcacacactc

SEQ ID NO: 95 - DNA, 486 bp, Streptomyces avermitilis
  CDS (1)..(486)
gtgcccacctcaggagaagccttgatcacacactctgacgacggtccggacttcgaacccgacgaccccctcgccgtcatcctgcggcccccttccgactatctcggcccaccggccggccgctacgaggcgatccgccgcggcgcggcccgccgccggctgctgcgcgccgcggccggggccggcctggcgtgcgcggtcgccgccctcatcgcgctgccgctgcacctggccacgcccggcgcgcccccctcccccacggtccctctcgccccgccgcccgcgagcagttcccccaccgcgcccgccccgccggcgtcgcccgagcccgtcagccccagcccctccgcagggagcaggacccaaagcgccaccaccaccccgaccagggcggccgtccccacccgcgcaccgtcggcgacaccggcctcggcgtccctcgcaccatcggccccggcagccacacccgaaagcagcacccgcccg

SEQ ID NO: 96 - DNA, 1551 bp, Streptomyces avermitilis
  CDS (1)..(1551)
gtgccggacggagacatgctccgttcacctgatggaagggtgcgtgtggcactcatacggacactcagaccgctggccgtcctcgcggcgacagccgccctgttcgccgggatcacggacctgcccgcggccgcggacggtaccgcggtgacgaaactgacgctcggcaccgaccagttcaagatgaccgacaccaactacgagtcggcgacgaacaacctctacaacaacgtcctgacaaaccacgccaacctcacggacgtcgtcaccaccgactacacgaagaactcgtccggggccaccgacgcctggatgaacctgcgttccatgcgcgcgtgcgccggcagcgagacgcaggcgctgccgccggtgaacaagaaggtcgcctggtgctggtcctcggcgcatgccgacgacaccacgccgcgctggttcccgcagggcatgagcaccaccggcaccgccgacgggggcgacggcgccatccagggcaagcacgtctcagcggtcgcctggcactacaagacgttcaagaccaactcggccggcgacctcgaggccaacgacggctgcaagacgaacaacctgctcaaggtctccttcatcgaccgggacaccggcaagtaccggcacgtcctgctcgccgagccgaccagcacctcatccagcgcctcgaacttcaagttcgtcaccggccacggcggcggcatcgtctggtacgcgaactacctctacgtcaccgacaccgccaacggcatccgcgtcttcgacatcaacaagctcgccaaggtcgacacctacggctccggcctcaactcctacggcgtcagcggcggcaactccagtgcctgcggctacccgtacgtcctgcccgaggtccactactacaagcaggcgtccacaccggcctcgtgctccacgaacgccgtcgacgggacccccgacgccgacgccctgtgctattcctggctctcgctggacaagaccggcgccggcccgttcaagctggtcacgggcgagtggtacggcaatgtcgccggcggccgggtggtgcgctaccagctcaacccgacgagcgcctcggcctaccccgggctgctgaacatgtccggcggcaagaccgtgatccaggacgcgtacgcggcctccggctaccagggactgcagggcggcatgacctggacggacgatgcgggcctgctgaacttcgccttcagcaagggctgcggcaccaagcccgccgtcttctcgcacacctgggcaggtgacacccgggccgtgaccagctgcgcggccggcggcaactgggcggtcggctcgccgcaggccctcagctactggcccaagctcgacacggcccaggtggacgagctgtgggggctgacggagggcatctgcgccggcacctcactgcgcgcctcgtacccgtacgagttcccggccgtctccgagagcggcaacgcctgcaccggctacaacagttcggacaatctgtcgctccgctcggtcttcgccgtcggtttcaccgacccggcggtccagaacctgcac

SEQ ID NO: 97 - DNA, 1098 bp, Streptomyces avermitilis
  CDS (1)..(1098)
atggacaagcaggtgcacgatccgccgtccgccgggcgccccgcgtctcccggctgcgcaccgggcgggtgcctccggtgcgccggcccgcgtctcgccgcgggcctgcacggcgcgggccgtccccggcgctgtctgcggccttgctgctcagggccttgtcgccggccgcgtcgcctggtcttctgtactccggccggtcggccacgcgttcgccgccaccgtggcgcacgcacccggcgcgggccggacagcaagaccagcaaggacaggagcggcgtggaatcagtggctgggcaggacgtacggggcatcctgcccgaggggctcggtgcggccgtacgcgataccgccgaggagatcgccgcgctgctgcgcgggggcgccgacatggggcgtggggtgcccgggtcgcagtggaccgtcgggcaggcggcggcgcatctggcgcaggcaggcgagctgatggccgatatcgcggcgggacgcgcgcgcagctggggggacggcacgccgcagagccttgccgcggccaatgagcgggcgctcgccgcgttcggcgagcggagggccgagccgctggccgcgatgatcgtggcgcaggccgatgcctgtgtgacggcgctggaggagagcgcggcgggggcagctcttgtctccccgctgggtccgatgggccccggtgtgctggggtcctacctcctgacgcacatgctcggccacggctacgacctcgcccgtgcgctggggtgtgcgcacatgatcgaccgtgcccgggtggagctgaccctgccgtttttgatcacggccatgccgcgggtgagcgagcccgcccgcacggccgggctgagcgcctcctacgcgatccgcctgtggggcggcggacggttcggtgtgcgggtggccggcggtgcggtggctgtggggccgcggccgccggaccgcccggactgcaccatcctcatcgagccggtcaccttcctgctgatggcactgggccgccgcggtcagtggagcgccatcgcccagggccgcatcctcgcctggggccgcaggccgtggctcgctccccgcttcccggctctcttcacagcgccc

SEQ ID NO: 98 - DNA, 534 bp, Streptomyces avermitilis
  CDS (1)..(534)
atgctcagtgatctctcgcccgtcatcgccgcctcggcgcgctggctgctgtcggcgttcccgccggccgccggcccgctcaacgatgcgctggccgaagcccaggcacagcacgcggccaccatcgccgccgccctgcgctaccccaccgcgctggacgccgaactgctgaacctgctcggccccggcggctccggggcgctggaccacgtcaccggcgccgccgcccacccgctcacggacgccgcacccgcctggcgcacccaggtggacgaaaccgtcgtcagctgggcggcctgcctgctggccgaccccgctctcgccgccgtggcagcggcctgcctggccgcaacccaccacggcgcgaacggcgtgggcgacgcgcgccggctgaccattcccagcccgcgcgatcaccgtgcggcgccgctgctgcgccacccggatctcctcggcccgatcgcggacctccaccgcgagagcctgctcggcctcctgcaccccggcccggccctcacctcacccgggcacagg

SEQ ID NO: 99 - DNA, 1887 bp, Streptomyces avermitilis
  CDS (1)..(1887)
gtggctgaagcgaggaacacgaccgaagccagagcgagggacggggcgcgcggcagtcccggtgtgcctttcggtgccggcccgctgcgctacctgccgatcgccgagcacggcctgatcggcgatctgcgcagcgcggccctggtcggcacgaacggcaccatcgactggtactgctgtccgcgcttcgacgcgcccagcgtcttcgcctcgatcctcgacgcggagcggggcggatccttcgaactggccgcggacgttgtggcacgcaccaagcagttctacttccccgacaccaatgtgctgatcacccgcttcttcgcggacgagggggtcggcgagatccaggacttcatgccggtcgtcgacgactcacgggaagccgaccgccaccgcctgatccgccgcgtggtgtgcgcccgcggagcgctgcccttccgcgcgctcatcgccccccgcttcgagttcggcaccgcaccgcacaccgtgcaggtccaggacggccaggcgctcttcgaatcgtcctcgctccggctcgccctgacctccaccgtgcccatcgaggtcgcgggccaggacgtgtggtccctgttcaaactgcacgagggcgagtccgccgtcttcaccatcgaccggatcggcggcgacgtgacaccacgcttttgcgccgtggccgaggccgaaagggaattcaacgcgaccgtccgctactggcggcactggctgtcccgctcgcgctaccgcggccgctggcgggagatggtccaccgctccgccctcaccctgaaactgctcacctacgccccgaccggcgccatcatcgccgcgccgaccaccagcctgcccgaacagatcggcggcgaacgcaactgggactaccgctacgtgtggatccgcgacgccgcgttctgcgtgtacgcgatgctcaggctcggcttcaccgacgaggccgaagccttcatgggcttcctctccgagtacgtccgcatcgaagaaacccaggcaccgcacctgagaggcccgctgcagatcatgtacggcatcgacggacgccgcgaactgcccgagcgcgagctgccccacctggagggctaccgcggctcggcacccgtacgcgtcggcaacgccgccgtcggccagctgcaactggacatctacggggcgctggtcgactccctctacctctacgacaaatggggcaaacccctgtccagtgcgcactgggacagcatcagcgagctcgtcgactgggtgtgcgaccactgggaccagcccgacgaaggagtctgggagacccgcggcggacgcaagacgttcctctactcccggctgatgtgctgggtggcgatcgaacgcgccatgcgactggcccagcaccgcggcctgcccgccgacatggtgcgctggggctgcgcccgggacgacatctaccggcgcatcatgcgccacggctggtccgccggacgccacgccttcacccagtacgaggacagcgacatcctcgacgcgtccctgctgatgatgccgctggccaaattcatctccccgaccgacccgaaatggctcgccaccctcgacgcgctgggcgaggacctggtgtccgactcactggtctaccgctacgacccgcaggccagccccgacggcctccagggcgaggaaggcaccttctcgatctgctcgttctggtacgtcgaggcgctgacgcgcgcgggccggctggacgaggcccgcctcgcgttcgagaaaatgctcacctacgccaaccacctcggcctgtacgcggaagagatcggccccaccggcgaacagcacggaaacttcccccaggccttcacccacctcgccctgatcagcgcggccttcaacctcgaccgcgtgctcggc

SEQ ID NO: 100 - DNA, 2532 bp, Streptomyces avermitilis
  CDS (1)..(2532)
atgttctgctggatcggggaggctgccactcgtcgcccgcggctcgtcctcttcggtgcgttcgtcttcctcgtgctgtgtgtggcgctcggtgcgggggccggtggccggctgaagacgcaggggtacgacgatccccgttccgactccagcttcgcggcccgggtgacggccgagcacctcggggcggccccgaacctggtcgtcgtggtgcaggtgcccggcggcttcgtcgacgacgccgccgcccagagggcgggcgaggacctgaccaggcgtctggcggcgcagccgcaggtgagcgccgtgtcctcgtactggaggggccgtgcggccgagttgcgcagccgggacggccgctcggccatgctgctcgcgcacgtggacggcaccggcgaggagctcggtgggcgggtcaagcggctgcgtgaggcgctgaccgctgccgggccgtacaccggcgggtcatccgcccccgggccgtccaccgccgggccgtccactcccgggccgtccgctgcggggccgtccgctgcggggtcttccacgggcggatcgccggccggcgggtcgtccgcccgggcggcggcaaaggggatgccggccctgaaggtgcacgtgggcgggccggctctcgtcgatgccgagctccaggacctttcggagtcggacctgaagcgggccgaggccgtggtcctgccggggacgctgatcctgctggtcctggtgttcggcagtgtggtggccgcactgctgcccctgctgatcggggtcctgtccatcgccgggacgctgctggtactgagcgtgctcggccgtgtcaccgatgtgtcggtgttcgcgctgaacctgaccacggtgctcggcctgggcctggggatcgactacgggctgctgatcgtctcgcggttccgtgaggagatcaccggcgggcacagtgcgcgcgacgccgccctgcgcaccgtgcgcaccgagggccacacgatcgtcttcagtgccgcgacggtctgtgccgcgctggcgacgctgctggtgttcccgccgtacttcctgcggtccttcgcgtatgcgggcatcgccgtggtggcgatcgcggccgtggccgccctgacgatcatgccggcgctgctcaccctgctcggcaagcgggtgaacgcctggccggtgccgtggcgccgcagggtccaggcgggctgcgcgtcgcgctggtgggaggcgctggcgcgccgtgtcgtgcgccgcccggtgctggccgcggtgccggtgatcggcctgctggcggtgctcgccgcgccgttcgcgcacgccggattcgccacccccgacgaccgggcgctgccggccggctcgttcagccggcaggccggggacctggtgcgcggtgagttcggcacgcgcagcgccggggcactgacggtcttcaccacgagtgcgacaccccaggtcgcactcgactacgccccccggctgtccgcgctgcccggcgtggcccaggtggtggggccgttcggtgtctaccgggacggccggcaggtggccgcatccggcccgggccaggccggcccttccggcaccgacagggcggccttccactcggtggtgccgtcggccgacccccggtcgggcgccgcccagcgcctcgttcgcgccatccgcgcgatgcccacgcccgcggacacccacgtccacgtcggcgggccgagcgcggtcctggtcgacgccaaggacacggtcgccggccggcttccgctggcgctggccgtgatcaccctcaccacgtccgtactgctgttcggcttcacccgcagtgtgatcctgccgctgaaggcgatcgcgctgaacgccctgagccttgccgcggtcatgggcgccatggtgtgggtcttccagacgggccatctgcagagcctgctcggcttcacgcccggaccgctctccacgaccatgccggtgctgctgttctgcatcgtcttcgggctctcggtcgactacgaggtgttcgtcctcgcccgtatcaaggaagcccacgacgccgggcaggacacggccggctcgatcgtcacgggcatcgcccgcaccggcggcatcgtcaccaccgccggcgccctgctcgcgttcaccctcctcagcttcggcacctcccaggtgtccctcctgcagttcttcgggatcggcgccggtcttggcgttctcctcgacgccaccctcgtgcgcggcgtcctcgtgcccgcgctcatgcgcctggcgggcggctggaactggtgggcaccgcgcgggctgcgacgcgaccggcccgccagaaacggcccgcccgtcacaggcgatccgccggcgcgccgggcgcctccgccgccgcccgcacggcatgcaccgcccacaccgcccgtaccgcccgtacctcaggtatcgcaggcatcgcaggcatcgcaggcaccggctggtgcaggccctgccgtacctcccgtctcgtccccatcacggcgcacacccgacgtctcccgctccagccacccgacccaggaaggcctctca

SEQ ID NO: 101 - DNA, 1503 bp, Streptomyces avermitilis
  CDS (1)..(1503)
atgactgacaacgccaccgacaacgccaccggcatcgccatcgtcggactcggctgccgtttccccggcgccggcgacatccaggcctactggaagctccttctgagcggacagcggcagttctccgcggtcccggcaaaccgctggaaccacgacaccttccacgaaccgggcaggcggcgcggcggccatgccgcatacaccgaccaggtcgccttcctggacggcgtggagcggttcgccggcctgcactacggtctgccgcccgcccgtgtgcgggccatggacccccagcaccgtctgatgctcgacgtcacccgcgaggccctcgacgacgcggggtggggccgcggcggcttcgaccgggagaacaccggggtcttcgtcgggatatcggtgtccgactacaaggacctcatgacggcccgtatccgcgccgtcagcctcgccgacgggtccatcggcggcgcaaccgacccccgcatcctggaggccttcagggagcgggccgaggagctgagcacgatccactccttcaccctgcccgggagcctgctcaacatggcgcccgccaccgtcagccggcagttcggcctcggcggccccagcttcgccgtggatgcggcctgctccagctcactgatcgcccttgagacggccgtcgcccacctgcgccagggcacctgccggatcgctgtcgtcggcggcgcgtatctcagcctcacccccgacggcctggtcggcttctcccagctcggcgcactgtccgccaccggggtgtgccgccccttcgacaaggacgccgacgggttcgtcctcggcgaaggcgccggaagcgtcgtcctacgaccgctgccggacgcactcgccgacggcgaccgcgtctacgccgtcatcaagggcatcggctcggccaacgacggcgcctctcccgaaccgctggcccccacccccgaaggccagctgcgggccatgcgccgcgcctacgccgacgcccgtgtgaccccctcctcggtgggcttcatcgaggcccacggcaccggcaccagggccggggaccgcgccgaggcccaggcgctgcgccggctgcgcaccgagtaccccgatgacgatcccgccctgtgctacctcggctcggccaaggccctcatcgggcactcgctgtccgcggccggcatcgcggggctgatcaagacggccctggtcgtccaccaccgcacgatcgtgccgcagccggacaccaccccccacccggacctcgggatcgaagcggccggcctgcgcttcgcccccgctgcccggccatggccgagcagcgggggcccgctgcgggccgccgtcagctccttcggcttcgggggcacgaacgtccatgtggtcctcaccccgccgcccgcccccctcggccatgccgcaggcaccgctgaggtccgcccccgtgcgacgcaccgaagcctcgcccccaatcccgccccgggcaccgccccgaaccccacctcgtgc

SEQ ID NO: 102 - DNA, 3732 bp, Streptomyces avermitilis
  CDS (1)..(3732)
gtgctgatctcggccggcagcccccgcctgctggacgggcaaatcggtgagctgctcgacttcctggaccgctcgcccggcaccccgccggcagccatggcccacaccctgggcggccgcgagatgctcaccgcccggctcgcggtggtggccgccaccccggacgaactggccgggcggctgcgccgagcccgccggcagctcgccgacggcgtccggggcgacctgggcgacggcgcgttcgccgcggacgctcccctgccgccggagcagcgccgtatcgccttcgtcttccccggccagggcagtcagcgccccgccatgatgcacgacctctaccagcggtccggcctgttccgggcggccctggacacgctgggcgccccggcccgcgagcacaccggcctctctcccgcccaggtgctgtacggacagcgggcgagcacccctcccggcgatgcgcagctgcggcagcggccggccggcaccgatgtgtgccagccgctgctcggcagcgtccagatcgccgccacccgcctgctggccgcctgcggcgtcagccccgacctcacgctgggccacagcgccggagaattcgccgcggccgccgcggccggcgcgctcaccgacgaggacaccgtccggctgctggcccaccggggcgccgccctggcccaggccgagaccggcgcccggggcgggatgctcgccgtgcagagcgacaaagagacctgcaggcggctggtccacgggatcgacgacgtgtggttcgcctgcttcaaccacccgcggcaggtcgtggtcagcggcaccgtccagggcctcgccgcgctgcggcgcgcctgcgccgcagcgaaggtcgccgcggtgacgctcgaagtgtcgaacgccttccactcgccgcggctcgccagtgccgaggcggccatgcgcgcggatctcgcccgccgccccgtcacccggccccccgtggcgttcgtgtcgtgcgtgagcgcggccctgtgcagcgaccccgccgagctgcgcgagctgtgggcccgccacgcgtgcgcgccggtccgcttcgaggaggccgtccgcagtgcctacgcccacggcgcccgcgtcttcctccaggtgaccggtaaccgctcgctcctggcctctgtccgccgcagcctcgccggccacggcgacgttcgtctcgcgggcaccgacgggccggcgcccgacagcggacgcggcttcctccaggccctggcccacctcgcggtcctgggcgccccggtggacccccgcgccctgatcccccagcaggaccgccggctgctggacctgccggtggcccggctcgacacccagtcctactggatacggcagccccgccgacccgcaacccccgtgaacccggtgaacccggtgaacccggtgaacccggtgaacaacgaagccccgaccgccggcgtcccgctccggcccgcaccattcggcccctgtggcgccccgcgcaccgaacagccggccaccggccggacgacggccggggaaaccaccggggaagccaccggggaaacgaccgggcaaacggccggggaggcagacgggcaagcggacgggccggcgacttggcaggcgaccgggcaggaagtgctgcacgaggcgctcaccctgctgcgggaacagggcgcgctgctcacccgcctgagcgaagccctcggaacgcaccacgccaccgggccggcggcgcagagcgaggccctgcccatagcctccacagccccggcagcctccgctccccctgccccggcagcctccggcatcccggctgtcccggccgtgcgctgcgcaccgcccgccgacgacgatcctgcggcggcctcggcggacgcagaccgcccagcggcccggaacatcacggacatcacgcagatcagggaagccgcagaggcaacaaaggtctcagaggccacggaggccacggaggccggggaggctgcggaggctgcggaggccgcggagacggtgttcgctcacgtggcgcggatcagcgcgttcccgatcagtcatctgcacgggcggcagctgctgaccgacgatctcggtttcgactccctgatgctgaccgacctgttcgcatccctcaaacggcagtggcccttcctgacgatcgacgagaagacctatgaccggccgaccgtcgaaggcctcatcaccatgatcacggacggctccgcggacaccgcaccgctcaccgcaccgcgcacccggccgacgggccgccgggaggcggcagatgccctcgccgcaccacaagccgtcaccgaaccaaacgccgaaccaaacgccggaccgggtgccggcccaggcgccggtccggatgccggtccggacggcgacgccctgcccgacccgcccgccgtcggcccgcacgcagtgccgccgacgcggaccggtttgcacgcggtaccgccggcgcacaccggcctgcacgcggtgcccgcggcgcgcaccgggcccgccaccgccggcctgcccgagcagcagacacaaatcgagtgcttcccggaggtcaccgcgcacaacgagcgcttggccacgtacagccgactgggcctgcccaacccgtacttcgtggtccatgaacgcggcatgacggacacgaccgtcgtcggcggccgcgagctcctgtcgttctccagctacaactacctgggcatggcaacgcacccccaggtcaacgaggcagccagaaaagccatcgaacgctgcggcacctcggtgtccgccagccggctgctgtccggcagccgtcccctgcacctggaactcgaagcggaactcgccgccaccctcggatgcgaggccgcgatcactctcgtcaacgggcacgccaccaacgtcaccgtgatcgggcacctcgtcggcgagggcgacctcatcgtccacgactccctcgcccacgacagcatcatccagggatgccggctctccggcgcgaggcggcggcccttcccgcacaacgacgcggccgccctggacgccctcctcacccaggtccgccaccactaccgccgcgtcctggtcgtcgccgagggcgtctacagcatggacggtgacatcgccgacctgcccgccctgatcgaggtcaagcgccggcacggcgcgctgctgatgatcgacgaggcgcacagcatcggagtgatcggcgccgcggggcgcggcatcggccagtacttcgacgtggaccgccaggacgtcgagctgtggtcgggcacgctgtccaaggcgctggcgagctgcggcggttacgtcgccgccggccgtacggtggtcgactacctccgctacacggttccgggcttcgtcttcagcgccggcatgactcccgcgaacacggccgcgtccctggccgccctgcgcgtgctgcgggccgaaccgcagcgcgtggcacgcctcaaggagaactccgccctcttcgcccgcctggcgcaccgggcgggcatcgacaccggacccagccacgacacgccgatcatcccgtgcatcgtcggggactcggcgaagaccctgcagctcgccgaggcgctcttcgagcagggcatcagcgtcaaccccatcctgtatccggcggtacccgagaaggcggcccggctgcgtttcttcatcacctgcgaccacacgcccgaccagatccaccacaccgtgcgggaactggcccacgggctgcggcaggcggacaccgcccccgccgcc

SEQ ID NO: 103 - DNA, 351 bp, Streptomyces avermitilis
  CDS (1)..(351)
atgaccagccggcacggaacgacgaccctgtggcgccccaccggccccaaggagctggacctggtccgggaactgaagtggcgggcgtggcccgcgcggcttttggggcagccgttcttctacccggtcctcaacgaggactacgcggtcaagatcgcgcgggactggaacgtgaagcacgacggtgccggcttcgtcacccggttcgaggtcgagtcgcagttcctgcgccggtatcccgtccggcaggccggcgggcagacgattctcgaactgtgggttccggccgcagagctcgacgacttcaacgcccacatggccggggagatcgaggtggtccacgagttccgc

SEQ ID NO: 104 - DNA, 576 bp, Streptomyces avermitilis
  CDS (1)..(576)
ttgccgctccctgcccgcagggcgggccaccgtgcaactctccgttgtgaaaggccagttcaacgtgggaggtgcagggtggccctgtctcagcggcgacctggacctcgcgatccccaagctgcggtcagggagcttcttccccgcgagctgcggtcagggagcttcttccccgcgctgctggagcggcgccgccgcatcgaccaggccctgtacgccgtcatcatggaggcctacgtccgcggcgtgtccactcggtcggtcgacgacctggtcaaggccctcggtgtggacaccgggatatccaggagcgaggtctcgcgtatctgccaggacctggacggcgagctgaccgcgttccgtgcccggcccctggatcacgtccgcttcccatacatctatctggacgcgccctactgcaaggcgagggtcgagcaccagatcgtgtcccgggccgtggtgattgccaccgggatcaccgaggacggcggccgggaggtgctgggcgtgatggtcggcgacagcgagaccgaggtgttctggaccgagttctgcgtcacctgcgcgaacgcggtc

SEQ ID NO: 105 - DNA, 507 bp, Streptomyces avermitilis
  CDS (1)..(507)
atgctcggggccgcgtatcagcgctgcagggttcacttcctgcgcaacgtgttcagtttgatcaacaaggaagcggccgagatggccgccgccacgatccgcacgatcttcgcccagcccaccgccgacgcggtccgcacccagctcgacaccgtcgccggcatgctcggcaagcagttccccaaggttaaggcgatgctgctggaggcgaaggacgacctgaccgccttcgcagcgttccccgagcgtcatgggaagaagatccagtccaccaacccgctggagcggatcaaccgcgaggtcaagcgccgcaccgatgtcgtgcaggtcttcccgaacgacgacgccctcctgcggctggtcaccgccgtgctcttcgagctgcacgacgagtggatcgccttcccccgccgctacctgcccgagggcagcatgagccagctttaccctgctgaactccccgaacaagcccccgcactagcccacaccaccagcacgacggccggt

SEQ ID NO: 106 - DNA, 225 bp, Streptomyces avermitilis
  CDS (1)..(225)
atggcaagcaagccggtacgtgcatcactgggcgaggtctggctcacctgccagatctgccgaggcgacctgttccgagagcgtggtgtcctgctcaacagcaccggtatggagttcatgaagctggcctgggccgacgagaacgccaccggcctgatctgctggcggtgcggctacgtgcaccttttcgtcaacaaggacatcaagctctaccgggcggacaaa

SEQ ID NO: 107 - DNA, 837 bp, Streptomyces avermitilis
  CDS (1)..(837)
atgcagccgcgcagccgtacagcgggccggcagggcgccggagcgggcccgggaggaggccggcacttctcgcggcccccgggcgggacgccttacgcccgccgccgttcaactgggcacgtccgggccgccggtagcggcgggatccggccagtgatcagttacgctgaccgctgccgcggcgcagacagtttcgacgcccgggcccctggcgtcccttgcggtgtgatcccaaggcccctgccaggcactttcttggtgaccgcagagggagacatgttcagcaagcgactgatagcggccgcagcgaccgcggtggtgatagccgggctgggcgcatgcggcagcgaaaccgggaacgggagcgggagcggcggcgcggacctggggtcctcctggagcgacgacgccggccggagcggccaggacgccgccccgcacgcccggccggacacggacaccgtgcggggactgcgggactcggtccgccacctctccaggaaaaccgccaaggccacccgcccgcacctggtcaacaagtgcacgcctgccacccggcgggccaagcacacccagcagaggggaacgggcacccggaagaagacccgcacctggtacaccacggagcactaccaggactgcaagaaggtccgcaacggcaccgagacctacacacgaaccgtcaggccgcaacagtggtgcgtgcgcctggacgacgtcgacggcgacacctcccaggacgaccgctggtaccaggtcacccggaccacctacgacgaagccctcaccatggccgagcacacccgcatcgagttcaccccggccggcaccggctgc

SEQ ID NO: 108 - DNA, 324 bp, Streptomyces avermitilis
  CDS (1)..(324)
ttgcagctcgacgtgtacggctacgtggtcgagaccctgtacctcgcccaccaaagcggtgtggcccgctgcggcgacaccgcggtcctgcaccagcggctggtcgagcaccttgccgagcggtggcagatgcccgacgagggcatctgggaagtccgaggtgagcgccgccacttcgtgcactccaaggtcatggcctgggccgtggtcgaccggaccatccgcctggtcgaggccggcgccctggacgccggcctgtgcgctctgatggaactgcgcgaggccatccgccacgaggtgtgcacccgcggcttcgagccggtt

SEQ ID NO: 109 - DNA, 417 bp, Streptomyces avermitilis
  CDS (1)..(417)
gtgggattcctgtcccccggcggcccccgcgtgctggggacggtggaggcggtgcgccggcagccggccactttggagggattcgtacggcgctacccgaccgcaggagatcacgcggggctcgacggcctggacggtgacgaggggggccttcctgctctgctcgttgtggatggtcgacgcgctcgctctgaccggccgcccggccaagcccacggtctcttcggccggttcctggccctgcgcaccgacctcggcctgctcgccgaggagtacgaccacgtcaccggatggcagttgggaaacttcccgcaggcgtacagccacatcggggtgatcgggtccgcgctcctgctgcagcagctcggctcgggggcgcccgcagccgaggccgaagtgctcctggcggcggatgtc

SEQ ID NO: 110 - DNA, 1233 bp, Streptomyces avermitilis
  CDS (1)..(1233)
gtgtccgaacagcagataatcgtcctcgacccgaccggatccgacccggacgccgaacaccaggccctgcgcgagcgcgggtccgccgcgctggtggacatcctcggcgtgcgcgcctggtccgtctccgaccctgcgctcctcaagcagcttctgaccagcaaggacgtctccaaggacggccgcgcccactggccggccttcgccgagaccgtgcccacctggccgctggctctgtgggtggcggtagagaacatgttcaccgcctacggcgacaaccacagccgcctgcgccgcatggtcgcccccgccctgtcggcccgccgcaccgcagccctccaggcggacatcgaggccctcgtgaacagcatgctcgacggcctcgacgccttccctgccggcgaggtggccgacctgcgcaagcacctcgcctatccgctcccgatcgccgtcatcggcaagctcatgggcgtccccgccgaccggcgcaccgagttccgcaccgtagtggacaacgtgttcgccacccacctctccgccgaggaacaggccgcgaacaccgccgccctctacgccctgctggacgccctgatcgagatcaggcgcgccgagcccggccaggacatgacctcactgctgatcgccgcccgcgacgaggaagacggctccgccttcagcgacgccgagctgcgtgacacactcctgttgatgatcagcgccgggtacgagaccaccgtcaacgtcatcgaccaggccatcaccaccctgctgaccgacccttgccagctcgcccacgtccgggagggccgctgcacctggcaggacgtggtcgaggagactctgcgccaccagcccgcggtcaagcaccttcccctgcgctacgcccgcatcgacatccccctcccggacgggcagacgatcaagaccggagaggcgatcctcgcctcctacgctgccgccaaccgccaccccacctggcatgaggacgccgaccgcttcgacgccacccgccccagcaaggaacacctcgccttcggacacggcgtccacttctgcctcggcgccccgctggcccgtctcgaagtcgccaccgcgctgcgcctgctcttcgagcgtttccccgacgcccgactcgccacggagcggaccgcgctggaggcactgccgagcttgatcagcaacggacacacctccgtccccgtgcacctgcgcccgacgtccagcgccagtagc

SEQ ID NO: 111 - DNA, 969 bp, Streptomyces avermitilis
  CDS (1)..(969)
gtgacttctgctgctggtgcgtcagttcctcgccggggcccgaaactggagttgttgctgctgtctgatgacgagcgggcggagtcggagcggtgcacgcgccgggcgacaccggcccgggccctggccctgcgggcgcggatcgtgccggcgtgtgcagggccggacgtaccgccgttcgtcgcggtcgccccagagttgcgggtggccgcggacacggtccgaaagtggcggcggcgcttcctcgcccggcggccggacgcactggccggcgagccgaggccgggccggccgcccaccatcagcgtcgatcaggacacgcagctggtcgtggcggccggacgcccactgccgggcaatcgccacggcgcccgcgcctaccgggaatcgggtgcggcccgcgccgtcaagaacgcgcccctcctcggcgacggcggctatcgcggcacacccgccctcatcccgcactggccgcgtaaagaccgaccgctcacgcctcagcagcaagccggcaacgcagtccaccgcagggccagggcctgcgtcgagcacgccttctcccggaggaagacctacaagatcctccgtgactgccgcttacgcggcgacggcgtccaccaggccatcctcgccgtggcccggccgcaccatctggccctcgccgggcaaccccacctcggccagggacactccctgcacttccccaacaccggcttacgggacgtcattcagccggagcagggccgggcggggccaggcggaggcggagcgggaacgcaagtgcgctgtcgccgacaccccaaaggccatcgacgggactcctcccgcgggccgcagcccggcccggaagcggggacaggcagggccgcgggcggggccctggggcgggtatccggtggcgaagcggtgccccagccctgctgctgcctaccgggccgggccgaggtggaggtactcggcccgggccgg

SEQ ID NO: 112 - DNA, 327 bp, Streptomyces avermitilis
  CDS (1)..(327)
ttgtcctctgcttccgagggtgtgagcagtgatgaccggaccgacctgtcggaggaaatccccatgagtctcacactcaccgcgccgtatgccgaagcccccgcccccgcccccgcccccgcctccgcccccgcctccgctcctgtgctggccccgcgtgagcgggagacgctgcggcacatcgccgccgggcgtacctatctgcagaccgcccgccatatggggctgtccaagcacacggtcgacgcctatctccgccgtatccgggccaagctcaacatcagcagcaccgccgaactcacccggctggccatctccctgggcctg

SEQ ID NO: 113 - DNA, 2532 bp, Streptomyces avermitilis
  CDS (1)..(2532)
atggagcgacttcccacccctgccggccagcaggcggacataccggacgcctcccccgcaccggcctgcacggccaccgccaccatcagtgagcagggcatcgtgacggggtggagcgaaggcgcccgcgaactgctgggctacacgcccccgcagatcgtgggacatcccgccgcacgcctgctcgccgacggcacgggcgaacaggcacggcgcgagacagccgggcgcgagcggttcagcggccaggtggcactcctgcaccgcgacggccaccggctgctgcgcaacctcctcgcgcaccgccgcacaccgcaaggaccgcagccggccgagtggctcgtggtgtccgcggtgaccgcggcctccgcaagtccccgcacccccgacagccaggccctgcgggaatgggtgttcagccagtccccctgcatcctggccgtcttcgacacagacctgcggctggtcaccgccaacaccggcatggaaagtgcgctgctgctccccgaggaacagatgcgcgggctgcgcctgccggagatcacacccggccccgcaagcgaagaagccgaaacaaaaatgcgccgcgcactggaaaccggccagacacagcacatgcaggcctacctccaccccaccggggtgagcgcacagcgcggctggtcgaccacactggccccgctgaaagaccccggcggaacggtgcgcgccgtatgcctggcagcccaccaccgccagcaagaacacctggcccggcagcggatgctgctgctcaacgatgccggagcccgcatcggcaccacctccgacatccagcgcaccgtgcaggaactggccgacgtcgccgttccccggctcgccgacttcgccgccgtcgacctgctggacgtcccccggcgcggcggcgaacccgcccgcctccccgccaccggccccatcaccatgcaccgcaccgccctgcacaccacccccgacaaccacaccagccacaccagccacaccagccacgacggcgacgacggcgacggcggcgacacgcaccccgccaccccgcccgcagccggcgagaaaatcctctacccggcacagtcaccggtggcccagtgcctggcccagggccacggcgccctgtacgaagcagacgaccccgcactcacccgctgggcagccaacgaccccacagccgcctggacccgccggcagggaacccactcggtgatggtggtacccctgcgcgcccacggcaccaccctcggcgtcgccctcttcgcccgcagccaccgccccgaacccttcgaagcagacgacctgtggctcgccgaagaactcaccgcccagaccgccgtccacctccacaacgcccaccgccacgcccgcgaacacaccaccaccatgaccctgcagcgcagcctgctcccccagaaactgcccgaccagggagcactcgacatcgccacccgctacctgcccgccggcagcaaagccggcgtcggcggcgactggttcgacgtcatccccctctccggcgcccgcgtcgccctcgtcgtcggcgacgtcgtcggccacggcatccgcgcctccgccaccatgggccgcgtccgcaccgccgtacgcaccctcgccgacgtcgacctgccccccgacgaactcctcacctacctcgacgacctcgtcatccacctcgccgccgacgaaggcggcggcgccgaaggcaccaccgaaaccgccgcaggcatcggcaccacctgcctctacgccgtctacgaccccacaacccgccactgcaccatcgcccgcgccggccaccccccacccgccgtcgtcacccccgacggcaacgtccgcttcctcaacgtccccgccggccccccactgggcctgggcggcctccccttcgaaaccctcgaaacccaactccccgaagcagcctcctcaccctctacaccgacggactcctcgaaacccgcgaccacgacatcgacgaaggcctcgacaaaatgttccacgccctcgcccgccccgcccacaacctcgacaccgtctgcgacagaatcctcaccaccatgctcacccaccgccccgacgacgacatcgccctcctcatcgcccgcacccgcgccctcaacaccaaccaaatcgccaccttcaacctcccctcccaccccgccatcgtcgcccaagcacgccaacacaccaccacccaactcaccacctggaacctcaccgacaccaccttcaccaccgaactcatcgtcagcgaactcgtcaccaacgccatccgctacggccacccacccatccaactccgcctcatccaccacaaccacaccctcaccaccgaagtctccgacaccagcaacaccaccccccacatgcgccgcgcccgcacctacgacgaaggaggacgcggcctcctcctcatcggccaactcgcccaacgctggggcacccgccacacccccaccggcaaaaccgtctggaccgaacaaaccctcacccccaactaatactgaattccgctttcgttgggta

SEQ ID NO: 114 - DNA, 249 bp, Streptomyces avermitilis
  CDS (1)..(249)
gtgctgagggcacggccgggccgtgacgagggcgagcgggagatggtccaccgcctggcgtcggccagaaaggcgccgaaggttgtggtggagcgctgtcggacggtggagctgagctggggcgggtggctggtgccgcagatagccgacgagctgcggtgcggtgtggggcaagcccgcaccacccacccgaaccctcagacgccgctacacgtacaccgtttgaggacagcactaataggactccat

SEQ ID NO: 115 - DNA, 519 bp, Streptomyces avermitilis
  CDS (1)..(519)
atgcggggactgatgctggacggtcgccgcaagtcgatccaggcgatggccgcgcggttgccggacggcaacgagcagaacctgcagcagttcgtgaaccagtcgacgtgggatcccgtgccggtgcagcgacggatcgccgagcggatgctgccgttgatcaacccggtggcctgggtgatcgacgatgtgtcggtgcccaaggacgagaggatgtcggtcgcggtggccccgcagtactgcggggctctgggcaaacgggccaactgccaggtcgcggtcaccgtccacgccgcgaccgacactgcctcctgcccgctgcagtggcgcctgttcctgccaaaggagtgggcctcggacaccgaccgccgggccatcacccgcatcccacccgaggtcgcgcaggcactgtcacgttggctgacggggtgggatgatctcctggttgatcaagctggtaggggtcgtccgtggggagcacgtcgccgtcgtacagggggcaccggtacccggtcgagg

SEQ ID NO: 116 - DNA, 717 bp, Streptomyces avermitilis
  CDS (1)..(717)
gtggggagcacgtcgccgtcgtacagggggcaccggtacccggtcgaggtgatctcccactgcatgtggctgtacttccggttcccgctcagcttccgcgaggtcgaggagctgatgctccagcgaggcgtcatcgtctcctacgagacagtgcgtcgctggtgcgccaagttcggccaggcctacgcgaacggactgcgccgccgccggccccggcccggggacaagtggcacctggacgaggtgttcgtcagggtaaacggggagctgaagtacctgtggcgggccgtcgaccaggacggcaacgtactcgacatcctcgtccagaaccggcgggacaaggccgccgcccgacgcttcttccgcaggctgatgaaggagacccggtcggtgccgagggtggtcgtcacggacaagctccgctcctacggcgcggcccaccgtgaggtcatgccctccgtcgagcaccgctcgcacaagggactgaacaaccgggccgagaatagccaccagcccacgcggcagcgtgaacgtgcgatgaagggcttccgcagtaccggtggagcccagcggttcctgtccgcgttcagcggcatctcaccccacttccggccccaccgccacctgatgacagcctctgaccaccgagccgagatgaccatccgcttcgccatctgggaccagatcaccggcgctgccagccggcccaccacggcc

SEQ ID NO: 117 - DNA, 333 bp, Streptomyces avermitilis
  CDS (1)..(333)
atgccccgacgcaccatcagacagtcacgcacccaacaacgtgacaacgccctgcccggcgttccgaggcggtggcgggtcaggcggcggtcggtgccggttgtcgagccaccctccgagccggatacccacgccatcctctccgtcttcaccagccatgttctcgacatgcttccttgggactcgcaggtgaccttcgcgggtgtggaactggcgtgccgcggccaggtggggtgggtggcccaccggttggcctgtgtccggcgcgcaggcggctgctcttccccgttggcgggttcgagtccgaggacgctgtccagcagcctggctttc

SEQ ID NO: 118 - DNA, 654 bp, Streptomyces avermitilis
  CDS (1)..(654)
atgccgcccaagtccgggcaggacgcccccaacaggcatagggtcggcggtgacaggcagcacggggaggactggttgagcgggggtaggtcaccgtcgccggattggcggaagccgtcgccgttgggcctcggggtcgccgtggacgccgtcaccaatgtcgccgccccgctgctggcggggttcgcgattgccaccatcggggtcgtcggcgcggatggcggccacttccgctggcccgggccggtcctgctgtgcctgacgctgtcggcgctgctgtttgtcacctgcgtgcagttcgggttccacgcccggcggcacctgtactcgttcgcggacatctctgcttggtggtcggacgaggagatgagagatcaccgcgacctgctgcgcgaggagcagaacgccgacttccagctctggaaccgctggcgcgggcgggcctacacggcgtacagcggtggcatggtcatgctgtggctgggggtggccctggttctggtgccaccggcacggagtacatcgcctgacacggagttccgctgggctgcagccgctgtggcggtcggcgccgccgtggttgaggccgtatggagcatgtatccgcaggtaagactctggtttcagcggcgccgagtccttagggggaacgcg

SEQ ID NO: 119 - DNA, 357 bp, Streptomyces avermitilis
  CDS (1)..(357)
atgacggatctggttgagcggctggtgccggatgagttgtgggtgttgttccggcgggtggtgcctccgacagaggtgatacgtccgcagggcggcggccggcgccgggcgggtgaccgcgaggccctggccgcgatcatcttcgtggcgacctcgggctgcacgtggcggcagctgccgccggtgttcggcccgagctggcagacggtctaccgacgcttcgcccaatggagccgggcccgtgtctgggcccggctccaccgcgtcatcctcgacgaactcggtgcccgcggcgagttggactggtcacggtgcgcgatcgactcggtcagcctgcgggcggcaaaagggggccac

SEQ ID NO: 120 - DNA, 495 bp, Streptomyces avermitilis
  CDS (1)..(495)
gtgcgcgatcgactcggtcagcctgcgggcggcaaaagggggccactgacgggaccgaatccgaccgaccgaggcaagttgggatcgaagatccacctgatcaccgaccggaacggactgcctctctcgctgggcatctcaggcgccaacatgcacgacagcctcggccttgaaccgctcgtgcgcgggatcccgccgatccggtcccggcgaggaccgcgtcggcggcgacccggcaagctccacgcagacaagggctacgactacgaccacctgcggcgatggctccgcaaacgcggcatccgccaccgcatcgcccgcaagggcatcgagtcctcaaagcggctcggccgccaccgctgggtcgtcgagaggaccgtgtcctggctcgccggctgccgccgactccaccgccgctacgaacgcaaggcagaacactgcctcgccttcgctgacatcgccgcagccctcatctgccaccgccgcctcaccaaa

SEQ ID NO: 121 - DNA, 1182 bp, Streptomyces avermitilis
  CDS (1)..(1182)
atgggtggggaccttgctggtgtcaggttgtgggcgggtgaactcgaggcggtgcacgagcggttcgtgcaccggttcagccgggaagagccgcgtcagtcggcgctggcctatatgcgggggctggtcgcgccgctggagcggaagaacggctggacgctggctgaggaggccgggcatgccggtcccgatcgcatccaccggttgctgaaccggatcgagtgggacgccgacgaggtcctggacgacgtgcgtgactacgtcgtcgagaacctcggcgaccgggatgccgtcctgatcgtcgacgacaccggattcctgaagaagggtgtccgttcggccggggtccagcggcagtactccggcaccgcgggacgcacggagaactcccagatcggggtctttctcgcgtatgcaacgggccgcggacgcacgctgatcgaccggcggctgtatctgcccacgtcctggacggatgaccgcgagcgatgccgacgggcaggcatcgacgacagtgtcgccttcgagacgaaggtggccatggccaaggcgatggtccgccgggccatcgccgacaggatcccgttcggctgggtgacggcggacgccgcctatggcttcagcaagggctggcggttcgagctggagcaggcggacgtcttccatgtcatggccaccacccggcacgacaccgtcgtcacccgctggtccatcgaccaccccgtccacgacctgttccccggcctgccccggcagaaatggaaacgccgttcctgcggcgagggagcccacggccggcggatctacgactgggcccgcgtcgaggtgaggccctggcaccgcgaggaccgccggcactgggttctcgcccgccgcagcgtgagcaggcccgaggagatctcctactacatcgcctactgtcccgccggcaccacgctggacgagctgatccgcgtcgcgggcagccgatgggccgtcgaggaatgcttccagacggcgaagcaggaatgcggtctggacgactaccaggtccgccgctaccccggctggcaccgccacatgaccctggccatggccgctcatgcctgcctgaccgtcctgcgagcccgtgaactggacatcgggaaagcagaaacggatcctcccagctcatccactacagcctcgccgagatccgacgac

SEQ ID NO: 122 - DNA, 459 bp, Streptomyces avermitilis
  CDS (1)..(459)
ttgttcgtggaatctggacaccactggtcgctcaggccgagagcacccggtttcgccggagagcgactcttccagcagcgcgtcagcaagagcgccgacattcgccttaccgccgtcggcgatcacctcaccgccgtccggatcgacggctcacccgggatcgactggcgccgccactacgaggcactcacttacaccccggtccccgtcccgcccgagatcaccaaaggggtccgcgcctacctcgacgccttcggcctggtcttcggtgccttcgacttcggactcggcacagatggccgctggcactggtacgagtgcaaccccaacgggcaatgggcctggttccccgacaacatcaccgcccccatcaccaacgctctcgccgaccgtctccagcacccccaaggaactttccaatcgtgttgtcaagccgctctcgtgacgggaggtgaagtg

SEQ ID NO: 123 - DNA, 1203 bp, Streptomyces avermitilis
  CDS (1)..(1203)
gtggaggggaacgtgcccgagatctgggccggagtggacatcggcaagacgcattaccactgcgtggtgatcaacgcggacggcaagcgtctgctgtcccgccgggtcgcaaatgacgagagtgaactgcttgccctgatcggcgatgtcctggagatatccgccgacgcgctgtgggctgtggacctcaatcacggtggtgccgcgctgctgatcggcctgctggtcagccacggccagccggtcgcctacctgaccggtctggcggtccaccgtgcctcggccacctacaagggcggcgaggggaagaccgacgcgaaggacgccttcgtcatcgccgaccaggcccgcgtccgtcgcgatctgggcctgttgcggcccggcgatgagatcgccgtcgacctgcgcacgctgaccacccgccgtctggacgcggtcttcgaccgcacccggcagatcaaccgtctccgcgcccaactcctggagatcttccccgcgctggaacgtgccctggaactgacgaaccgggggccggtggtactgctgaccggctaccagaccccggccgcgatccgtcgagcaggcgcgagccggatcgagacgtggttgaagaaccgcaaagtcaggggtgccgccgcactggcgaagacgaccgtggaggccgcccaggcccagcagaccgcgctgcccggcgagaagctggccgccgccatggtggtccgcctcgcgaagggggtgatggccctcgatgaggagatcgccgagcttgacgccctgatcgaggtcaagttttgcgagcatccgcacgccgaggtgatccgcagtctgcccggcatgggagccaagctcggagctgaattcctcgccgcgaccggtggtgacatggacgccttcggcagccccgaccgcctggccggcttcgccggcctggcccccagaccacgtgactccggccgtgtcagcggcaacctgcgccgcccccggcgctaccaccgtggtctgctgagaaccatgtacctgtcggccatggtcagcctccagtgctgccccgcctcgaaggcgttctacgaccggaagcgaggcgagggcaagggccacaagcaggccctgctggctctcgcacgccgacgactcaacgttctgtgggcgatgatccgtgacggagagtgctttcacacttcacctcccgtcacgagagcggct

SEQ ID NO: 124 - DNA, 1122 bp, Streptomyces avermitilis
  CDS (1)..(1122)
atgaccgaccccgccgacctgcgccgccaactcgccaacaccatccccacggatgaccccgcctggcgccatgccctccaaagcgtgccacgcgaaatcttcctcggcgacgccttgttccgcctcaccggcccccagtgggaacccatccaccgcgaccagaccgcccccggcgagtggctgcgcctcatctaccaggacaccacctgggtcacacagatcgacggcgtcaacgcggccgacgcctgcagccccacgaccggccgccccacctcgtccagcacgctgccgtccctgatcgtccgcatgctcgacctcgcaggcacccgcgacggcgacaacgtgctggagatcggcaccggcaccggctactccaccgccatcctctgcgaacgcctcggagacgaacacgtcttctctgtcgagtacgacccgggcctggcagccgcggcggctgaccacatccacgccgccggttaccaccccaccctgaacaccggagacggcctggccggacacaaggacggcgccgaatacgacgcgatcattgccacctgcgctgtccgccacatccccccgacctggctctaccaagtacgcgccggcggcaccatcaccaccaccatcagcggatggatgctcgcctccggcctcatccgcctcaccgtccacgacgacggcaccgccaccggccgattcgccgacgaccagatcagctacatgctcgcccgcccccacgaacgcccaccccgccccacgtactaccagcaccccggccacacccgccccacccgcgtaaaccccgccctcctggacgactggaccggccacttcctcgcccagctcgccgcaccctcagccgaactcatgaacaccaccgacggcgtgatcctggtggacgtcgccaccggatcacaggcatggaccgaaccagccgggaacagctggcacgtccaccagcacggcccgctcaacctctgggaccaggtggagaacaccctcaccacctggcagagggcaggctcacccccacaatccgacctcggcatgaccgtggaaccggacggcacacaacgggtatggctcggggcccccgacggcccctcatgggacctgcccgtc

SEQ ID NO: 125 - DNA, 1032 bp, Streptomyces avermitilis
  CDS (1)..(1032)
atggccgccctgtgggccgccgaggcggccctcaccccgggtgaggtgcaggccgaactcgcctccgacctggcccgcacgacggtgacgacgatcctgtcccgcctgtacgacaagggcgtcgtcgaccgcaggggcgtggctatggttactaccccgtgcaggacacccaggggctcaccgcccggcgcatgcataccgagctcgaccgtgacactgaccgggagaccgtcctggcccgcttcgtcgcccagctccatccggacgacgaacagcttctgcgccagctactggaggccgacgagggatgaccgtcctctgttgattccgctgctgctgcccttcgtgatgccgctactcgcccggcgagccctcgaccgactggcccctgccaccgctctgtgggcgctgaccgccgccgccctggtgctggcgggtgcttgcgtgaccgccctgggcgcactcgtcctgaccggactgctcaagctgccggcgttcgcggcgctcggtgaactcgcccaccccctgcgcacgcccacgggctacctggtcctgcccgcggccgcgatcgccaccggcctgctcaccatcggcgcctggaccctcgcacactcggccctgcgccagacgcgcgccttccgcaccgcccgcgccgaggccgaccggcgacctaccgctggcgatctgtgcgtggtcgactcaccgcacccggacgcctacgccctgcccggacgcccgcaccgcatcgtcgtcaccaccgccatgctgcgcagcctcaaacccgacgagcgcgacgctctcttcgcccacgagcgcgcccacaaccagggggccaccactgcttcctggtcgattggttcagcggcttgtcgtccggggcggatggtctcgtacctcggtgcgtgcggtgctagacgggcaggtcccatgaggggccgtcgggggccccgagccatacccgttgtgtgccgtccggttccacggtcatgccgaggtcggattgtgggggtgagcctgccctctgccaggtgg

SEQ ID NO: 126 - DNA, 684 bp, Streptomyces avermitilis
  CDS (1)..(684)
atgagagggcccgcgttcatgaccgcacccctgttcgcagcctcacagctcgcggtgaatgtcctgagcgcgcagtccctgctggccgccttcggtgtgctgggggtcggcgtggtgatgttcgcggaaaccgggctgctgatcggcttcttcctgcccggtgactcgctgctgttcaccgcaggcctgctgtgcacggggagcggccagcacggggtgaagctgtcgctcgctccgctgctagtggccgcggctgtgggtgcccttgccggtgcgcagtgcggctatgtgctcggccggaaggccggcggggccctcctggcgcgcagccgttcggtccgcctgcgcgaaggggcccagcgggccgaggagttgctggagcggtacgggcatgcgaaggccatcgtgctggcccggttcgtgcccgtggtgcggacggtcctaaatccgatggcgggcgcgttgggcgtaccggcgcggaccttcaccgtgtggcaggtcgccggcggactcgtgtggagtctggggctcacgctgggcggctacgcgcttggttcgtccatccccaatgtggaccgctacctgctgccgatcatcgccgtgatcgtggccgtgtcgttgcttccgctcgctgccgagctctaccgctcccgccgcgcagccaaagcgaaggaggtacgtgga

SEQ ID NO: 127 - DNA, 603 bp, Streptomyces avermitilis
  CDS (1)..(603)
atgatcctcgccttcgacggctcctcgatcgacggcaccgcctacaccgacgtggtggatctcgctcaccgctcgcccggctggcttgacgacatggtggcggcctggtcgacgtacggactggcggtgttcgccgcgctgatggccgtgggctggtggcgggcgcggcgggtgagcccggctgccgcggtgagcgcgctggccgttccggcgatcgtcttcgccgcatacggggtgaacgacgtgctgaaactgctggtacgcgaggaccggccctgtcagagcctgcaggtgatcacgctggaggcgtgccctgcgccgggcgactggtccttccccagcaatcacacggccatcgccgccgcggccgccatggccctgctcttcgtctcccgtcggctcggcgccgtcgcggccggggccgcctgcgcgatggcagcctcccgggtctgggtcggcgcgcactatccgcacgacgtcgctgcaggagtggtcgtcggcgccctcgtcgcggcgctcgcgatggtcacgctgcgccgccagcccgattccctggtccggtggatcaccggtacgcggctgcgtccgctggtactggcgtca

SEQ ID NO: 128 - DNA, 726 bp, Streptomyces avermitilis
  CDS (1)..(726)
atgaaacgcagtgacctcggcgagctggccggcagcgtcggcttgggggcgtggacggcattcggcgtgctgaccatgatcgtgatcggcgacggccagccgctgtacggggatgaggacctgctgtcctggtccgtcgggcaccgcccggacgtgccggtggcgctggcccgcgccctgaccgccaccggaaccggcgccatcccgtacgtcctcgccgtactggcgggaaccatcgccggacgcaccctgcgccaacgggccgtcgccaccgcgctctgcctcacctgcctcggcgcggggcaagccgcgcggtacggcgtgatggcgctcgtcgcccggccccgccccacccgagtggactgggccacacccgcctcggggtgggcgtttccctccggccacaccaccacggccgccctgaccgccggactgctcgtcatcgccgtgtacacacgctccccgcccggcagggccctgctcgccctcgttttcggctgctggggcgcgctggttgggctgacccgcgtctacctcggggtgcactggttcaccgatgtcgtcggcggctggctgttcgccgtcggctggctggggctgtgcctgtgcgccgctgcctggtggctgcccgaagcgttcatcacaggtacgacggacatagaccaaaagccgccggaggaccatgcgccacaagatcctggtcgtcgaggacgatcacgccctgcg

SEQ ID NO: 129 - DNA, 660 bp, Streptomyces avermitilis
  CDS (1)..(660)
atgcgccacaagatcctggtcgtcgaggacgatcacgccctgcgtgacgtcctgctgcgcggcctgcgcgacgaggacttcgaccccgtacccgccccggacggggcatccgccctgcggctggccacccgtgacatcgccgcgtcggtcctggacatcgggctgcccgacgcggacggccgggacgtgtgccaggcgatgcgggcgaacggattcctctcccccgtcatcttcctgaccgcccatcaccggctcaccgaccggctgtccgggttctccgccgggggcgacgactatctgcccaagccgttccacctcgccgaactcgccgcccgactgcgagcggccgtcaaacgagccgcaccacttcctgcggccacggccggtgatctggtgctggaccccgtccggcacagcgtcagcgtgcgcggtaccccggtcgacctcacgccgacggagttccgtctcctggcggcgctcatggcggcatccgggggcatcgtgcgccgacgcgagctggtcagagcggggtggcccgagggagcccaggtcagcgacaacaccctcgaccaatacctgacccggctgcgccgcaagctgcgtacggcgggcagcgatctgacggttaccaccgcccgcgggatcggccaccgcctgtca

SEQ ID NO: 130 - DNA, 1359 bp, Streptomyces avermitilis
  CDS (1)..(1359)
atgaactccatgttctcccgcctggtgccgcgcaccctgcgaggccgcctctccctggtggccctcaccaccgccaccctcctgatggtggtcctcaccgtcgccttcaacaccgtcatccggcaccgcctccagcaccaggccgacgacgagctgcacacccgggccgccgccgtcgccaccaccatcgacaccagcggccccacggtgcgcgtcctggagacctccaacgaccagctcctcgacacgaacgtgtggatctacgcgggcacccggctgctcgaacagccgccatccaccacagcccacagcaccctcgctcacgccgccgacagcctcgcgcggcaggatgggacacactgcctgactgccgaggaaccagaccccgcccagctgtgcagcctgcccgtatccgacggccggagcacggcgaccgtcgtcaccgcgctggacctctccccctaccgcagctcggcagccaccctgctttgggcatcgctgtgcctcgacgcggtgatgctcgcctgcacctacctactgacacgcctcgccgtcggacgcgcgctgcgtcccgtggccaccatgaccgaccaggccacccagtggagtatcgtcgcctccgaggaacgcttcggcgccgctcgacgtccgaccgaactcgcccgtctaggcgcgtcgttggacgcgatactggaccgcatccgcgccgtcctgcgccatgagcagcagctgaccggcgagttgtcacacgaacttcgcaccccgctcagccgcatcatcgccgaactcgactggtggcaggcccgcccccgctcggccgccgaaaccgaagccacccacgaggtgatcgctgacgccgcccggtccatgcgcagcatctgcgacaccctgctcaacgacgcccgcaagggcacgaccaccacccccggaacggccgagatcctcccggcactccaccgactcgccgcatccctggaggcaccggtccatgtgacagtcgacgcacgtagcgacagcgtcccgctggaggccggcgtccaggccgccctcctcgaacgcatcgtcagcccgctcctcgtcaacgccgtccgctacgccacctcgcacgtcaccatcaccgcgagccgggagcccggcggcgtacgcatcgacgttgacgacgacggtcccggggtacccgagtcgttcgcggcgcagctcttccagcccggccggcgggccgaccccgacgacggacgcggcggagcgggcctcgggctgccgctcgcgcgacgcctggcccgctccgtcggcggtgacgtgacgtacgaccccggtcacaagcccggggcgcggttcaccgtcaggctgcccgctggg

SEQ ID NO: 131 - DNA, 798 bp, Streptomyces avermitilis
  CDS (1)..(798)
atgaagatcgccgccacgaccctgggcgagacggccggtgacctgttcgcccagaccctgaagctcggctacttcctcaccacgatcgccctgttcctgatcttcgtggtgaccttggtggtccagctcaggtcccgccgctacaacccgttcttctactggacggtcatcctgtccaccagcatggccggtacgacgatgtccgacttcatgaaccgcgacgccagcgccaagttcctctcgggcggggccacgtcgctgggctggggcccgcagggcctgggcctgggctaccccgtcggcgccgcgatcctgatctctctcctgatcgccgtcttcgcggtgtggaaactgaccgggatgacgttcgtcatccgtgacatcgtcaccttccgcggcgaagccctcttctggtcagcgattctcgtctccaacaccctcggcacgtccatgggcgacttcctctccgacagctccggcctcggctacgcgggcggcgcgctgctcgtctccgggatgctcgcgatgcttctcgtcctgatgaaggtgcccgtggtgccgaacgtgctgctgttctggttcgccttcgtactgacccgcccgctgggcgcgaccgcaggtgacttcctcaccaagccggtcgccaagggcggtctcgacctcggcaccgcgggttcatcggccgtcctgctggccatcctggtgggcctgatggcgtatgcccaggtgcgggagcgccggaccgccctctcgagtccggagtcagccgagcaggaggccgtcacccagcgggcagcc

SEQ ID NO: 132 - DNA, 828 bp, Streptomyces avermitilis
  CDS (1)..(828)
atgacatctgagacttctgagacagcggcggtccacgggtccgccccgaacgcccccggccaccgtctgcgctggaacaaggtgcccgaagtcaccgtgtacttctgggtgatcaaggtgctgtgcacgacggtcggcgagaccgcggccgacctgctgaacgagaaggccggactgggcctgaccggtgtgtcgctgctgatgagcgtgctgcttgcggtgattctcgtcgttcagttccgtaccaccgcctaccggcccggcgcgtactggacggccgtggccctgatcagcgtcgtcggcaccctggtcagtgacaacctgaccgacaacatgggcataccgctggagaccaccaccgcggtgttcgcggtcctcctggcggtcgtgttcgtcgcctggtaccgcagcgagcggacgctgtccatccacagcatcgacaccctgcgccgggagtccttctactggctggcggtcctgttcaccttcgcgctgggcacgtcggccggtgacctggtcgccgagcgcatggcgctgggctactgggtctccgcggtcctgttcgccctggcgatcgccgcggtcgcggtggcgcgcttcgcgctcggggcgaacgccgtgtggagcttctggatcgcctacgtcctgacccgcccgctcggcgcctcgatgggcgactacctctcccagccgaccggtgacggcggcctgggcctgggcaccgtggtgaccagcgtgttgttcctcgcggtcatcctcggactggtggtgttcctggcggtgacgcgcaaggacgtcaccgagccggagcgcctcgcccgtacggcg

SEQ ID NO: 133 - DNA, 279 bp, Streptomyces avermitilis
  CDS (1)..(279)
atgaccatcccccactcccacggccgcacctgtgccgaccacgcgacgcactggctgcgccgccgcctcggacgggccgtcgcgctcgcgtatctcgccgccgtgctgctgcccggcccgggccggtggctgcgccacacgcataccctggtggggactggactccccctgtacacggcctcgttactgctctcgctggtcctgttctcggccggactacaggtccccgtgcgagcactgggacagctgctgcgacggccccgggcctgctggcagggc

SEQ ID NO: 134 - DNA, 696 bp, Streptomyces avermitilis
  CDS (1)..(696)
atgatccttatcgtcgcgatgccggtggccgcgggggcgacggtctggaccggcaaggggcacggtgaccagccgaccatggtcggtctcgtcctcgcctccacgctggtcagtccgctcacgatccccgtgacggtgggcgcgctggcgccgctgctcagcggcggctacccggacgcgctgggcccggccagggacacgatgaacagcggtttcgccttcgcgcaagtcgtactgccatgcgcggcgggcctcatgtgccgtctcgtcctgccggcgcgcctgctggacggtgcggggcgctgggtcgtgcccgtggcgctggccggctcggcggtcctgacgtacgtgaacgcgagcggcgccctgggtgccctcctggcccatccccgtccgctgctgctgatcgcggcaccggtcgtggcggcggtcgtctgcgcgccgtccttcgcggtaggacgccttgcggcgcgcgtcctgcgtctggacgccccggccgcctcctctctcaccctcgcctgcgggatgaacaacagcagcgcgagtgcggtcctgatcaccacgaccctgcccgacaagccgcacctgctgctgccggtcctcgcgtacgggctgttgcagaagacggccgcgaacagggtcgtacgcatgactcgccctcaccgcccgcccggaccgccctgccccgcctcgtcc

SEQ ID NO: 135 - DNA, 1380 bp, Streptomyces avermitilis
  CDS (1)..(1380)
atgagacagcgcgtggtgcgggtggccctgaccgccgtcctggtcgccatggtcctcctcgccgtccccctggccctcgccattaggttctccctgtacgcggaccagcgggacgccctggagcgggcggccctggccggcgccgtccgcgtgagtccggactacgcgaccggtgacccggtggagctgccgccgcctccggacggcgggcgcctgggcctgtacgacccgcagctgcggctgcgcgcgggcagcggcccccggatcggcgacgacacggcccgccgcgctctgaccggcacggtgacccggtcgacagggggcggtgaactcgtcgccgccgtccccgtctcccacgacgagcaggtcatcggcgtcgtccgcgtctcctccgccgtccaggacgtgcgtgaccgcatcctcgtcggctgggcgctcctgctcggcgtggccgtgctggcgctgaccgtggccgtcctcgtcgcccgccggcaggcgcgggcgcttgccgcacccctggaggacctctcacggcactgccgagccgtcaccggcggcgacctgaccgcgcgggccgcccccagcgccatcggcgaaatcgaccaggtcgcccgcacccacaacgagatgctgcacagcctggccgaactcctgctccgcgaacgcaacttcaccgccaacgcctcccaccagctgcgcaccccgctgaccggcctccagctcaccctggaagccggactcgaacacgacgacacccgtcccgtgctggaggaggccctggccgccacccgcaggctgcaccacaccgtggaggaggtccttcggctgtccggctccgcggggctgcctcagccggtcgcgccagaccggccggtcacggggctgctgcgggagaccgaggagcggtggcacgggctgttcgcccgcgagggaagacgcctggagtgcgatacgggcgaggtgccggacgacgtacgcgtcccgggcgggcccgtcgccgagatcctcggcgtgctgctcgacaacgcccgcgtccacggacacggcaccgtgcgcgtcacggtccgcgacctcgacgacgccctcgccctggacatcgccgacgagggcacggcagacggtgactccgcgcggctgttcgagcgcgggcacaccgaaggcggggcgggcacgggcatcggcctctcgctcgcccgcgacctcgctgtctccctcgggggccggctctccctggcgaaccgcgcgccgaccacgttcacgctgctgctcccggtacgggccgcaggaggacacggggcggaagaccgaaacgagtcggacggtcgccggggcgatggggatcctcaggacgaggcggggcagggcggtccgggcgggcgg

SEQ ID NO: 136 - DNA, 666 bp, Streptomyces avermitilis
  CDS (1)..(666)
atggcacgtgtacataccttcggcgtcgtcgggctcgtgctcgccgcggcggtgaccgccgggtgttccggggccacctccggctccggatctagctcaagttccagctcaagttccggtgccgctaccaccgctgcttccacgggtggctccagcagtggctcgggcagcagtccggcgcccaccgagtccaatccgcccggcgacatccccgacaaccaggcattcatcgcctaccagccgtccggcggtgcgttcaccgcgttcacggtgaaggtgcccgagggctgggcccgtaccagccagggcagcaccacggtcttcacggacaaactcaaccgcgtccagatctccgccgctgccacctcgaacgcgcccaccgtcggctcggtcgctcatcaggtcgtgccccaactgcgcggccacgtctcgaagttcgccagtccgaaggtgtccacggtgacccggaaggccggtacggccgtgctgctgacgtaccagggcgactccgccaatgatccggtcaccggcaaggtcgtgcgtgacgcgttcgagcggtacgccttctaccggcagggccacgaggtggatctcaccctgtccggcccggtgaatgccgacaacgtggacccgtggcgcatcgtcagtgactccttcacctggaag

SEQ ID NO: 137 - DNA, 738 bp, Streptomyces avermitilis
  CDS (1)..(738)
gtgaacaccatgctggtcccaccgtccgacgaagcccttaccgcgcgggagctgtaccgcttcttccgggccggtgaggaggagacgctcgcgctgcggggggtgtccctgcgggtgcggcgcggtgagacggtcgccgtggtcgggccgtccggagccggcaaatccaccctgctgtcctgcctggccggactcgacgaaccctcgggcggtgaggtgcgcgtggacggcgtacgcatcagccaccgaccggagaccgaacgggcccggctgcgcgcccaccacatcggcgtcctgctgcagaccagcaacctcgtcgcccacctcagcgtgcgcgacaacgtccgcctgacgcacagcgccgtgcgtggccggccctccgcgtccgtaggagacctgctggccgaggtggggctcgcggggcgggcacacgcgctgccccgacagctgtccggcggcgagctggcgcgcgccgggctggccgtcgcgctggccaactccccggccgtcctgctggcggacgaaccgaccggcgaactcgacggcggcaccgagcgcatgatccttcagatgctgcgcgaccgcgccgccctgggctgcgcggtgctgatcgtcacccacagcgccgaagccgtccggatcgccgaccgggtgatcgctctggacgacggcagggcccacgagaccaccacgtcccaggcccgcacacaacagcaggaggcccacgatgccgccccg

SEQ ID NO: 138 - DNA, 711 bp, Streptomyces avermitilis
  CDS (1)..(711)
atgccgccccgtgatcacgcgataccggccggcaagcccgtgacgtcgttggacgaggtgctcgtcgactgccgcaacgcggctctcaccttcggccggggcgcgaccgccgtggtggcggtgcacggggcgaacctgtgggttcgctccgcagaccggctcgccatcgtcggcccgtccgggtcgggcaagtcgtcgctgctgcatctgctggccgggctcgagcagaccaccagcggcaccgtcacctggcccgccctggacggcccgggcggcatcgggatcgtcttccagggcgacagcctgatcgccgccctcgacgtggtcgagaacaccgcgctgccgctggtcctggccggagtgccggacggcgaggcgcatcggttggccgccgaggccctcgccctggtggacgccgccgatctggccgagcggctaccggaggagatctccggcgggcaggcacagcgcgtcgccgccgctcgcgtcctggcccagtcccctcggctgatcctcgccgacgaacccaccggccggctcgaccacaccaccggcgggcacgtcctggacgccctgctgaccgcggccgaccagacaggtgcggccctcgtcgtcaccacccacgacccggccatcgccgcgcgactcaccacccgactggccatgcgcggtggccggctgctcaccgtggacgaaccgcaggaggcgtca

SEQ ID NO: 139 - DNA, 2646 bp, Streptomyces avermitilis
  CDS (1)..(2646)
atgaacaccgcttgggccggcgggctggcccgccaccgcgccggacgactcctggccgccctggccggcatcgccctggccgtcgccctcgtcgccgcgctaggttcgttcctcaccgtgtccaaggcgaccatgacgcagcgcgccgtgcgctccgtcgccgtggactggcaggtcgaggtgcagcccggcgccgacccgcaggcgatgctgtccctggtgcggaaggcccccggcatccgcaccgccgtcccggtcggcttcgcccacagctccgcgttcacggcccaggtccagggcagcacgcagaccaccggccccggcatggtgctcggcctccccgacggctatcagaagctgttccccggcgggatccgcccgctgaccggcggtaccagcggcgtgctgctggcccagcagaccgcctccaacctgcatgtcgcccccggcgacaccgtcggcatccggcttcccggaacgggcgtacgccaggtccgggtggccggcgtcgtcgacctgccgcaggccgactccctgttccagaaggtcggtgcccccacccagtcgcagcccaccgcgccgcccgacaacgtcgttctgctcccctccaccaccttcacctcgctgactgcccaggcgcccgccgcaggcgttaccacgcaaatccatgccgcacgcgacgccaagctgccctccgagcccgccgccgcgttcaacaccgcgacccgcggtgcccacaacctggaggcccgcgcctcgggcgcggcgatcgtcgggaacaacctgggtgccgccctcgactccgcccgccaagacgccctctacgcacagatcctcttcctgttcctcggtgtgcccggcgcactcctggccgccgcactgaccgccgcggtcgccgcagccggtggtgaacggcgccgccaggagcaggcgttgctgcggctgcgcggactgcggccgggccggatcgccaccctgtccggcatcgaggccgggctggtgggggccggcggcgccgccgccggactcggcatcgccgccctgttgggccgtctcgccttcggatcggcctcgttcgggacgagcgcgggcacctggatcctctggtacgcccttgccttcgtgctcggcgccgtcgtggccgcgggcgccgtcctcgtccccgcactgcgcgacctgcgcggcgtgacggtcgccgacacacgcagggccgggcgccgtacaggctccgtgtggtggatgcgctacggcgtggacttcgccctgctgatcggttcctggctcatcttccgcgcctcgtccggcaaccagtacgccctcgtcctcgccccggagggcgtgcccagcatctccgtgtcgtactgggcgtttttgggcccggccctgctgtggatcggctccgcgctgctgctgtggcggctcacgctcctcgcgctcacccacggccgccgcgtcctggcccggctctcgctcccgctcgccaagaacctggcagggacaacggccgccgtcctctcccgccgcaggcggccgctggcccgctcggtggtgctgctggcactcgcggtgtctttcgcgatctccacggcgaccttcaacgccacgtacaagcagcaggccgaggtcgacgcgcggctcaccaacggcgccgacgtcaccgtgaccgagccgcccgaagcacggacgccgcccggcgccgccgcttccctcaaggtctccggcgtacgtcatgtcgaggcgctccagcaccgattcgcctacgtcggatccgacctccaggacctctacggcgtacgcccggacacgatcacctccgccacctccctccaggacgcgtacttctccggaggcaccgccggcaccctcatgcgcaagctcgcgaagcagcccgacgcgctgctggtcagcgcggagaccgtcaccgacttccagctctcacccggcgacacggtcaacctgcgcatccaggacgctcacacgaaggcgctgcgcaccgtgcccttccactacgtgggcgtcgccaaggagttcccgaccgcgccgaaggacagcttcttcgtcgccaacgcctcctacgtcgcccaggccacaggcagcgactcggtcggcgccttcctcctggacaccggcggcacccaccaaaagcagatcgccgcccacctgcgccgacagctcggcaccagtgccaccgtcagcgacctcacccagacccgcggcaccgtcggcagcagcctgactgccgtcgacctggcgggactgacccggatcgagctggccttcgcggtgctcctggccgccggggccggcggactggtcctcgcgctcggcctcgccgaacgccgccgcaccttcgccatcgccaccgtgctcggcgcgacgcgacggcaactgcgcgggatggtcctcaccgaggcgatcctcctgaccgcgggcggtctggccggcggcgcgctcatcggctgggccctctccgagatgctcgtcaaagtcctgacaggcgtgttcgaccctccgcccgccgacctcgccgtcccgggcgcctatctggcgctcaccgcgttcgccgcgaccgtggccgtactggccgccgcgctgaatggggtacgccgcgccgcccgacccgccgtcgaagaactccgggatctg

SEQ ID NO: 140 - DNA, 777 bp, Streptomyces avermitilis
  CDS (1)..(777)
gtgaatgccccgcccggctctacgctgcccagcatgcgaacgcccgccgcaccggaccgcagccgctatcgcgtcctcgtcgtcgaggacgacgacaccatcggccgccatctggaaacaggactgcgcagcaacggctacaccccgacgtggagccggacaggcacgggcgccctcaccgagtccgcgcagacccagtacgacgtgctgctcctggacctgggactgcccgacatggacggtctcgacatcgcccgcaccctgcgcgcccgcctccccgacctgctgatcatcatcctcaccgcccgcacggacgacatcgacgtcatcgccggactcgacgccggagccgacgactacctggtcaaacccttcagcctgaccgtgctgctcgcccggctccgcgcccatttgcgccgccgggccatcgccgccccgccgcagcagccgatccggctcggcgacctcgtcctcgacgtcacggcccgccggtgcacactccacgaccgtgaagtcgatctccgccccaaggagttcgagctgctcgccgtactcgcccggcacgccggagaggccgtgtcccgcgaggtgctgatggctgaggtctgggacgagaactggttcggccccaccaagaccctcgacgtcaccatggccggcctgcgccgccgcctggccgacgctgccaacgcatccccgatccctgcggcgctaccgcggatctccaccctgcgcgggcacggttaccgccttgagccccacgcggtgccgcccgtc

SEQ ID NO: 141 - DNA, 972 bp, Streptomyces avermitilis
  CDS (1)..(972)
atgtcagagcgcaaccccatcctgatcaccggtgccgccggcgaagtcggcggtgtgagccgaacgacggtcgacatgctgctcgaacaagggcacccggtgcgcgcgttcgtgcgccaggacgacgaacgtgcgcacgcgctccgccaggccggggccgaggtcttcgtcggtgacctgctcaccatcgccgacgtgagcgccgcactgaagggcgtccgccgcatctacttcagcatgagcctgtcgccgtactacaccgacgccgtcagcctgatggccgccgcggcacgggcccagggcgacatcgaggtcttcgtcaacatctccgagtacgagcagtcgttcatgacgttcgagaagatgaccgcgccggaggaagagcggcgtgcgtggctcggcggactcgtcgccaactggtcgccgcagcagcgcgcccactgggtcgccgagcaggtgctggactggtccggcctcccgaccgtcaacatacgggcggccatgttcgtcgagaaccccctgatgacctggctggcgctggagccgctggccaacggtgaactgcgcctgcccttcggccaccaccggctcgcgcccatcgcgggttacgacgtggcggagctgtgcgtgaagatcctggcggacccggctccgcacatctcgaagtcctatgacctcaacggcccggagctgaaggacatgcacgggttcgcggaggactacgcggccgcgctgggacgccaggtcacttacgttcccgaagacgtcgaaacctggaacgagacctacgtcgacaccgtcctgggcgcgctcccacacaccgcggagcacctgaagactctgacccggctgatgggcggcggcggataccgcggcgtcaccgaccagctggaaaccctgctcggacgcccaccgaagaccgtgcggtgggcgttggagaaccatccgcgcatccggaagctggcgtctgcc

SEQ ID NO: 142 - DNA, 1032 bp, Streptomyces avermitilis
  CDS (1)..(1032)
gtggaaggttcgctcactcaccgtttcgttgacgtgaacggggtcaggctgcacatcgccgagcaggggcaggggccgctggtcctgctgctgcacggctggccggagagctggtactcctggcgccaccagttcggggcgctggcggcggccggataccgggtcgtcgcccctgaccagcgcggctacgcccgtagcgagcagccgccggacgtggcgtcgtacaccctgctccacctcgtcggcgacgtgatcggcctgatcgaggagctgggggaggagcaggcggtcgtcgtgggtcatgactggggtgcacccgtcgcctggaccacggcgatgctgcggccggacaaggtccgcgcggtggccgggctcagcattccgcccattctgcccggcgggatggtcccgccctcgatcacccgcactcagtacggcgagggcttctaccaggtctacttccagcagccgggagttgccgacgcggagttcgccaaggacatcccgaactccttccgccgcttcctggtcggtgcctcgggcgacaatccgctcggccgggaaccaagcccgttggtcatacccgacggtctgggcctcctggacatcatgccggaatcgcccgctcttccggcctggctgacggaggaggacatccaggcgtacgccgaggacttcgccctgcacggcgagcgggcgttcaccggagccttcaactggtaccggaacatcgaacgcaacaacgaactgctcgcgccgttccgggggcgcggaatcgacgtccccgcgctgtacgtcgtgggagaccgcgacatggtcacctcattgcgcggcccggacgggggtccctcgctgagcgagatcttccgtggccagggcggcccgggcaacccgctgagcgctgtcgcgcctcagttgcagggcccggtggtgctgccgggctgcggccactggacacagcaggagcgtcccgtcgaggtcaacgccgcactcctcgacttcctcacccgcatcgacggctccgcgcctcga

SEQ ID NO: 143 - DNA, 699 bp, Streptomyces avermitilis
  CDS (1)..(699)
atgacagcaatcaagggcgccagcgtcttcgtcaccggaggcagccgcggcatcggcaagatgctggtcgaggcgctctatgcgcgcggggccggcaaggtctacgccacggcccgtgacccgcgcacggtgactcaccccgatgccgttccgctggcgctggaggccactgacccggcatctgtggcggcggccgccgagcaggcccaggacgtcaccattctgatcaacaacgccggcgcctccgtccgcgcttcgtacctcgactccccgatggaggacgtgcgccgggatctggagaccaacttctacgggccgctgctggtcacccgggccttcgtgccggtcatcgagcgcaacggtgggggccacatcctcaacgcccactccgctctgtcctggctggcggacggcacgccctacggcgcctccaaggccgccctgtggtcgcagaccaactccctgcgcctggagttgcagccgcgcggcatcgcggtgaccgggctccacatggcctacgtggacacggaaatgacctcgggcgtcgacgcgcccaaggccgacccccgcgacatcgccgtggccgcactcgacggcatcgaggcgggagcgcacgaggtgctggccgacgacatcacccgctgggtcaagtcgcagctgtctgccgacctggaagacatgtacgcccagctgaagcat

SEQ ID NO: 144 - DNA, 567 bp, Streptomyces avermitilis
  CDS (1)..(567)
atgactaccgaagtgaagcaaagtccccgggagcggctgctggaggccgcggccgcgctcacctaccgcgacggcgtcggcatcggcgtcgaggcgctgtgcaaggcagcgggggtgtcgaagcgctccatgtaccagttgttcgagagcaaggatgaactgctggcggcgagcctgaaggagcgttccgctgccttcgtggcgaaggccctgcccccggcggacgatggccgttccccccgcgagcggatcctgtacgtcttcgagcgggtggagtcgcaggcgggtgcgcccgacttccaaggctgccggtacctggctgtgcagatcgagctcaaggatcaggcccaccccgcgagccgggtggcctaccagatcaaagcggacctgatggcctttttccgttccgaggccgaacggggtggggcaagcgatcccgacctgctggcccggcagctcatcctggtcttcgacggcgccagcgcccgagcggggatcggcgccgacaatctgaccgggctcatcgtgcccaccctgaccaccctgctcgatgccgcagacatgcac

SEQ ID NO: 145 - DNA, 1296 bp, Streptomyces avermitilis
  CDS (1)..(1296)
atgagtgggattcacccgttccgcgtcctgcgtgccaaacccctgtggatcgccaacggcgtcatcacgggcgtcctcgcgctgctgttcaccgtgttctacgtcggggccaacatcgatcccgtcgatcacatgaagaatctgcccgtcggcctggtcaacgccgacaagggggccgctgtcggcggcgagcaggtcaacctgggggctcggatcaccgagtcgatcaagaagtccaccgcgagcgggggcaagatcgactggaaggtgatggacgagaaggagatgaaggaggaactcggcaagggcaagctgtacggcgcgctcgtcgtccccgccgacttcacctccgccaccaccgcactcaccggtgccgcgactaccggggtcccgacccgtccgacgctgacggtgctgaccaaccagtccgccggcagcgtgggatccagcctggcccggactgcgacgacacaggcggccgaaaacgcctcgctccaggtgggcaaggagctcacgccccaaggcgggaccggacaggcgaagctacccgccgcggcacgcgtcctgctggccgacccggccgccgtcgccgtcgaggacggccatccgctcgactcgcacagcggtctgggcctgacggcgttctactacgcgctggtcctggtggtcgtcggcatgctttccgccaacgtcatcagcggccaggtcgaccacgctctgggctacacccacaacgacatgggcccactgcgcctgcaccgcccgctgatccgggcgacccgggtgcagaccctcgccatcagcagcactctcatggccgggctgtccttgctgatgggaaccttggtcatggtgggcgcgatcggcctcatgggcatggacgccgcccacctaccgctgctgtggctgttctcggtgtgcgccatcgcggtctccgggatcggtgcgctcaccctccttgccgtcttcggcacgcccggcatgctggtggtcacgctggtcttcatcgggatggcggtgccgacggccggcgccaccacgccgcttcaggcgctgcccggcttctaccgcttcctggcggagttcgaaccgctgcggcagatcaccggcggcatccgctcgatcctctactacgacgcccaggccgacgccggcctgacccggggctgggtcatgatggccgtcggcctcacggcagccgccctcttcggcttcggcatgacgggctggtacgaccgcaaggggctgcaccgcatccccgccgagacggagcccgcgaagaccgctgccccggcg

SEQ ID NO: 146 - DNA, 2181 bp, Streptomyces avermitilis
  CDS (1)..(2181)
atgtttgaggggtttgggcgtctgctgtaccgcaggcgaaagccggtgctgatactgaccctgctgttcgccgtcctgtccggggcctacggtgccggagtcttcggctcgctgacaccgctcggcttccaggaccccggctcggacagcgtgcgcgctgccaagatcgccgagaaggcgttcccgcagcggacacccgacgcggtgatcgtctaccgggacgaggaccgcaccgtcgacgacccgtcctttcagcaggcggtcgtccagcagttggcgtccctgccgaagtcggaggtgaccggctacctggacttctggacgaccaggatgccgacgcaggtcagccacgaccggcacgccacctacgttgccctgaacctccacggcagcagcgagaaggccaaggaggacgcgtacgaggcggtcaaggacaagatcccggcacccggccttcagacgctgcagggcggaacggtgcccaccggccaccaggccagtgagaagatcgaacacgacctgagaatcgcggaaatcatctcggcccccgtgctcttcctgctcctgctggtcgtgttcggcggtctcaccgcggccttcctcccgctgctcgtcggcgtgctctccatcctcggttcgatggccgtcctgcggaccatcgccaacatcaccgacgtgtccgtgttctccatgagcctggtcaccatcctgggtctcgcggtcgccatcgactacggcctgctgatcgtcagccgctaccgcgaggaactggcggccggctacaccggcgaagcggcgatcgggcgcaccctcgccacggccgggcgcaccgtgatggtctccggcaccacggtcgcggcggcgctggccggcctgaccctcttcccgtcgacgttcctgaagtcgatgtcgtacggcggtgtggccgcggtcctgctggcggtgctcttctcactggtcgcgctgcccgccctgctcgccgtcatgggaccgaaggtcaacgccttcccgctgcgccgcaagaaggcagggcggccgacggcggcaggggagggtgcctggtaccggttcgggcacggcctgatgcggcggcggcgggttgtggtggtgggcgcggcgggcctgctgctgacgctcgccctgccgttctcgaagatcgagttcggttccatcaacgcgcagcaactgcggagcagttccgagggccgccaggtcttcgacgccatggagcacgacttcgacggcgacgcggtgaagtccatcgactccctgctcgtgctgaagtccgacggcacctcgaaggaccagggcgcggcgctgaaggcgtacgccgagcggctcggcgccaccgagggcgccacgagcgcccggatcaccggagtcgagggcaccacggcccgggtgtcggtcacctacgacggcaatcccatctcgccccacgcgcgcgacctggtgaaccggctcaaggacgtccccgaaccgccgggcgcccgcgcgtacttcggcggcgagtcggcggtctacgacgacaccctggacgcactgggcgagaccctgccgtggatgctgctctacatcgcggtgatgacgtacctcctgctgttcctcgcgttcggctcagtgctgctgccgctgaaggccatcgcgatgaacatgctgtcgctgaccgcgaccttcggcgtcctggtctggatcttccaggacggccatctgcacaacctgctcggcttcgatccgacgggcaacatcgagcccaacatgccgatcatgcttttcgcgctgatcttcggactctccatggactacgaggtgttcctggtgtcccggatgcgggagcagtacgacaagtcaggtgacagcacggaagccgtggcgagcgggctgcagtccatcggccgcctggtcgtgagcgcggcgctgctgatgtgcgtgccgctcgcggcgatcgggatgagcgatgtgctgaccatcaagctcttcggtgtcggcatggtgttcgcggtcctggtggacgtgctggtggtgcgcatcctgctgggaacggccgtcatgaggctgttgggcagagcggcctggtgggctccgggcccactcgcccgcttctacgaccggttcggcatcaaggagaccgacatgccggccgacgacaccgccggcgagcgggtccccgtcgccacgggc

SEQ ID NO: 147 - DNA, 747 bp, Streptomyces avermitilis
  CDS (1)..(747)
atgcaagaggatctcgttcggaagtggcgggtcctgacgtggggcgcagcggacgacagcaagccaaggcgataccgagaagcattcgtaacggcgttgcaatacgatggcgccatggccaggctcaagacacatgacgaagcactccggctccggctcctgcaccgcgcggccgccacggtcttcgaccgcggcacggccgcgctgagcctgcgacagctcgctgcggacgtgaagacctcgaccacggcggtctactcactgttcggcaacaaggcgggtctgctcaggagcctgtacgaggaggccgcgcggctcttcgccgcacgcctggcagccatccgtcccacggacgacccggccggcgacgtgatccgacttgggctcgtctatcgcgaatacgccatcgccaacccgcatctctacgcgatcctcttctccgaccgcagcgttcagtgcccgtccgagtcggagccggagaggccgcgtgaggccatcgagacctaccggcccctcgtcgacgccgtgcggcgcggacagcaggcagggcagttcggttcggagtccgacccggaggtcatcgcgctgtcggtctggggaacggcccatggcctggtgtccctggtgctgtcggggaacgagccgcccgggctcgcggtcgccgactgctatgagcgggccctgggggtattggtagcggggtggcgagtgagcgagggggaggttcaggggttcgcggacgtgccg

SEQ ID NO: 148 - DNA, 351 bp, Streptomyces avermitilis
  CDS (1)..(351)
atgacgtcgaaggtgtactggacgacggcgccgcgctcgatgatgaagaagttcgggcagatcatgcgcgatttgggcgcggaccgggaggagccgggtccgtccgaggccggagaggggcccgaaaccggcctgcccgaccaggaaatcaccacgtgggtggacaccactgagttcggcagccagaagttcgacgcgctggccgcgcacgccagccagggtcagaacatcttcttcctgcggaggagcaaggagaggttcactcagctcatgagcgtggagacgtccgtccgggtcctcgacaccaccggcgcgcccccgcccgagaacgacctcttcgccggcctgcgc

SEQ ID NO: 149 - DNA, 1164 bp, Streptomyces avermitilis
  CDS (1)..(1164)
atgaaccgacgtacgttccttgcggcgaccaccgcttcgctggccgccacccaactcgccgggcccgcctacgcctacgcctactcctcctccccctccggttcaacagccgttcactacgcggtcgttgcccgcttctggggtgcgatgccgacgggtgtcaccgtctcgcgccgaggccggatcttcgtcaactttccccgctggggcgacgacgttccgttcaccgtcgccgaactgcgcggcgggaagccggtggcctaccccgacgccgaggtgaaccgtcaggacgcctcagacctggccgggcacttccagtcggtgcagagcgtcgtcgtcgatggggccgaccggctgtggattctcgacaccggaagcccggggttcgccgggtcctcctacggcggtcccaagctcgtggcggtcgacctgcgcacggaccggatcgtacggaagatcctcttcccgcccgaggtggtgccggcgaacagctacctcaacgacgtgcgcttcgacctgcggcgcggcgccgaaggcacggcgttcatcaccgactcgggcggctccaacggcattgtcgtggtcgacctcgccacgggccgctcctggcggcgactgaccgggcacccctcggcactcccggacgagcggttccttccggtcatcgatggtgagcccttcatggtccgccccgcgggcggcgagcccacgtactacgagaccggctccgacggcatcgctctcagcgccgacggcacgcgcctctactactgcccgctgtccagccgccggctgcacagcgtgtccaccgacgccctcgccaacccggacgccacggacgccgaggtggcggcgacggtcgaggacctggggttcaagccgatggccgacggcctggagagcgacgacaagggacggctctacggcggcgacctcgaacacaacgcgatctggcgcaggagcccgaacggcacctaccggaccctcgcccagggacgcgatctgctctgggtcgacaccctgtccgtcgcctcggaccggcacctgtacgccatcgccaaccagctcaaccggctctcgcccttccacgagggcaaggacctgcgccgcaagccctatctcctggtccgcctgccgatcgacgccgggccggtcaggctcgtg

SEQ ID NO: 150 - DNA, 516 bp, Streptomyces avermitilis
  CDS (1)..(516)
gtgtccgagaccctggactccgccgctactaccatcgcgcgctggcgctccgccgaggaacgcggtgatgtcgacgccgcggtcgcgtgcctgagcccggacgtcgtgctcagctcgcctctcaccgaccagttccgcttcgagggatctgaccagctgcgtgacttcctgacctcggcgttcgcggcggtcaaggacgtccattaccacacccagaccggcgagggcgacacctacgccctggtctaccgggcgcgggtgggttcccagtcgttcgaggaggtgcagatgctgcggctcgacaaccaagcacgcatcacggaaatcacgctcttcgggcgtccgatgccggccctcaccgccctgatgcacctcatgggtccggcgctcgcccgccagcagggccgccggggccttgcgacgctcatgagcgtcagcaccgtacccattcacgcgatggtctcctcgggggaccgcagcatggtcgcgaagacccgcccggcagcccggcagccc

SEQ ID NO: 151 - DNA, 810 bp, Streptomyces avermitilis
  CDS (1)..(810)
atgacgacaaatcggccggtggccctggtgacgggtgcgtcctccggtatcggcaagcagaccgcgctcgcgctggtcgcggcgggtttcgaggtggccggcacgggccgcgacacctcacgcgtcaccccgctccagggtgtgacgttcttcgacctcgacgtggtcagtgacaagttggtcaccgccgtggtccagcaggtgatcgagcggttcgggcggatcgacgtcctggtcaacaacgccggcgtcggctcgatcggcgcggtcgaggaaacctcactcgcgcaggcccagggcgtcttcgacatcaacgtcttcggggtcatgcgcatggtcaaggaggtcctgccgcacatgcgtgcccgggggcgcggacgcatcatcaacctctcgtccgtgcagggcttcatccccgctccctacatggccgtctacggcgcgtccaagcacgcgatcgagggctactcgcagtccctggaccacgaggtccgccagtacggggttcgctcgctcctggtcgaacccgcctacaccaacaccggattcgaggccaacagcgccaagcccgacagccccctgcagacctacgccgaccagcggcacgtcttcgaccgcctgatgacggaggcgatcaaggccggcgacgaccccgccgtggtcgccaaggcgatcgtcacggcagccaccgacaccaagccgaaactgcgctacgccgctggcccgatggccggacgcgcgcgcatgctccgcttcgttcccgcctgggtcctggacaagcagatccgcagcatgaacaagctcaccggc

SEQ ID NO: 152 - DNA, 639 bp, Streptomyces avermitilis
  CDS (1)..(639)
atgaccggcacacagaccgccgggcggcgctacggcggacgcgacgcggcgcagcgacagcaggagcgccgcacccgcctcatccaggcgggcctcgacctgttcggcacagccggatatgcctcggcctccgtcaagcaggtgtgctcgcacgccggactgaccgagcgctacttctacgagtcgttccgcgaccgcgaagaccttctcgccggggtctacgacgagctgatcactacgatcatcgccgagaccgcgcaggccgcagccgctgccgcacccgatgtcgacgcccagttgcgcgccggactcgaggtcttcatccgcacactggccggcgacgcacgcaaggcccgcctggtgctcatcgaggtcgtgggcgccagcccccgcctcgaagtgcggcgccgtgacgtcttgcacgaattcgccgcgatggtcgccgccgtcgtcggaccgctatctgacccggaagcctcctccagccggctcgccatgaccgcgatgagtctggtcggcggagtcaacgaactgctcgtggactggacgctcggccaccagaaggccaccgtcgaagaactgatcgacctgtgccacaccctgtacatcgcggcctaccgagccatcagcgatcagctc

SEQ ID NO: 153 - DNA, 909 bp, Streptomyces avermitilis
  CDS (1)..(909)
gtggcagcaccgcccaaacacccgaatacgtccagccggagagaccacgacaagctcgcccgcacacaaccgctgaccggccgagtgatcgcggtcaccggggcgggccgcggaatcgggcgtgccgtcgcagcccggctcgccgcggccggagccgccgtggcgatcggcgatctcgacacgcggctcgccacggaggcggccggtgccctcagcacgcgtcccggtggccggctgctcgggctgcctctcgacgtcaccgatacaccttccttcgaagacttcctgcgcaccgtcgagacccggctgggaccgatcgacgtactcatcaacaacgccggaatcatgtgggtgggccccttcgcggaagaaccggaggaagccgccctgcgccagttcgacgtcaacgtccacggcgtactgcgcgggatgaaactcgtgatcccgggaatgcggaaacgcggtcgcggccacgtggtgaacatcgcctccgccgccagcaaggtcgccccggccggcgaggcgacctacgcggcgacgaagcacgcactccacggctacagcacagccgtccgcgccgaactgcgcggcaccggcgtgcacatgtccctggtgatgcccggagtcgtggacaccgagctggccgtgggcaccgcgaccggacccacccgacgcctgacgacggatcaggtggccgacgcggtgctcgacgtcgtgctgcgcccgcggttcgaggtcttcgttccccgccaggtagccgccctgacccgcttggccgcgctgctgccgggccgagcccgcgacgccctgcatcacctcctcgtccccaaccagctcgccgccctgtccgaccggtcggtccgcgcggcctacgagcagcgcacccgcaccgcccgccaccccgaaagt

SEQ ID NO: 154 - DNA, 1134 bp, Streptomyces avermitilis
  CDS (1)..(1134)
gtgaccaccacgcccaagccggcgcccagcgcgaagaaggcccaggacgccgccgctccgcgccccatccccgaattcgaaggcgtccacgacgtatggccccgcggcgaccggctgagcgccgtgcgcagcgccgcggccacctaccgggagcggttcgtccagcagggccgcatccacgccgtccgcagtttcgacatcgccgccgccccgtacccgacccggttcggcttccacggcgccgcgctcgccgtcaacccgttcgtgagcatcgtcaaccggatgctcgtcgtgcagttcgacggcttcgacggcgagccgaaaacactggtgtgggagccgaccgtcgccgccggaacggctcaagcgccgttctacgcacagctcaagcgtctggcgggggactttctcaccgagcacgtcttcgcccgcttctaccaggacccgaacaccgtcctgccctcctgcggtctgcgacccgaggacgtggacttcgtcagcttcgaccacctgcacgtccaggacgtgcgcatgatcatgggaagtacccgcaccattcccggcgaacgggcgccccgcgaagcgctgttcccgcgcgcccggctgctggtacaccgcagggagctgggcaccttcgaatcgacgcatccgatgcagtgggcctggtacgtcgacggaggcatggacggcgtaccgcccgagcgcgtcaccgccttcgacggcgatgtcgaactcggcgtcggcgtcagcctgctgtggacccccggccatacggacggcaaccactccctggtgctgaacacccctgacggcgtgtgggtctcctccgagaacggcatctcggccgacaactggcagcccgagctctcccgcatccccggggtgcgccgccacgccgcgttctacggccatgaggtggtgcccaacgccaacaccctggaggactccctcaaccagtacgactccatggtcaaggagaagaccctcgccgaccccagccggcgcgatccgcgctggctgcagatcctgccctcctcggagctggcccccttcaagcggcactggccggtgcggcccagcttcctccacggcggtctgaactacggcgaactgacccctgccggtggtcgccga

SEQ ID NO: 155 - DNA, 921 bp, Streptomyces avermitilis
  CDS (1)..(921)
atgaccggcccggccgcccgccggatcgccgccgacggcgtggagctggccgcctaccagtggggaacgtccaccgctcctgcggtggtgctggtccacggctatccggacaccagcgccgtctggcaccccgtcgccgaccgcctggctgaccacttccacgtcaccgccttcgacgtacggggagccggtgcctcccaccggccaaggggtctgcgcgcctaccggatgtcccgaatggaagccgacctggaggcggttctcgacgccgtgagccccgaccgcccggtgcacctggtcggacacgactggggatcgatccactcctgggaatcggtcaccggcacccgcctggccgggcggatcgcctcgttcacctccatctccggaccctgcctggaccacgtaggccacctgatccgggcccgcctccgaccgcggcacccggatctgccgaaggtgctgaggcaggccgcacgatcctggtacatcgcctacttccatctcccgctcctgcccgccctgacctggagagcactgggacaccgctggcgcgccttcctcaccggctcccaaggtgtgcccgggcacaccccctaccccgcgccgacgctggcccgcgacgccgtgtccggcaccgcgctgtaccgcgccaacatgctgccccgcctgctgcgcccccgggaccggccgaccaccgtcccggttcagctcatcatccccacgcgcgacttctgcgtcaccccggtgctgtcgtacggagtggagcactggacggggcagatacaacggcgcccgatcgacgccgggcactgggcacagctcagccaccccgaggaggtcgcgtcccggatcgcggaattcgcccaccgcatcgaagacggctcccgccgcactccggaccgcaccgcgcacccgatc

SEQ ID NO: 156 - DNA, 909 bp, Streptomyces avermitilis
  CDS (1)..(909)
atgttccgagccgcacatgcccacccggagcgtccgtccgagcccatcgaccaccacgacctggtgctgcaaccccgggacgtcaccttcgactggagcaccaccccgctgcactggctgccgggtgagcccttcgccacccacaccttcgatgtgctccacctcatgctccccgagctcgaacgctggttcgtgcgcaccttcgagcaggccctgccattgatcaccgacgaccggctgcgcgaggacgtacgcggcttcatcggccaggaagcgatgcacgccgaggcgcaccaggaggtcctggagcacctgctcgccaaagggctggacccggccccgtacacccgccagtccgaatggattttccgaagggtgctcggagaccggccggaactgacgccggccgccacccacgcgcacctcctccaacggctcgccctcatagcggccttcgagcacttcaccgcgtacatgggtcactggattctcagcaacgggcacctggaccgggccggcgcggaccccgcgatgctcgatctgttccgctggcacggcgcggaggaggtcgaacaccgctcggtcgcgttcgacctgctggtgcacctcgatccccgctaccggcgccgagtgaccggcatgctcgtcaccgctccggtgctgacccggctgtggatccgcggagtccgcttcctgatgagcgccgaccccgaactcgacgaccgggtcgaggtccgcttccgcgactacctggccgccgcccgcaaggacctgttgcccccgccggtctcgttcgcccgctcggtactgcgctacttccgccccggctaccacccgacccaggagggctcgacccagcaggcggtcgcctacctggcgacgtcccccgctgcccgagcggccgcccaa

SEQ ID NO: 157 - DNA, 1098 bp, Streptomyces avermitilis
  CDS (1)..(1098)
atggacaccagcacacccctcacccggccgccggacctgtacggccgaccgcgcagcgactccttcatgcagaagctggctgctctcagcgaccacgcagtcacgcgcctcgcgcggcgcagcactccacccaggcacccgcaggccgccgagacgcccgcgatccgggaactggtggtcgccaccaagcaccaagaggccgaggatgtcgtctccctgcggctcgcagcacccgacgggggaatactcccgccctggcagcccggcgcccacatcgaactgcacctgccctccggccgcaagcggcagtactccctgtgcggcgaccctgccgaccggcaccggtaccgcatcgcggtgcgccgcatcgccaacggccaaggcggttcggccgaggtacacgacgccctctcagacggtatgcgggtcgccatcaccgggccccggaacgccttccccttcgccgccgaagcatccatcctgctcatcgcgggcggcatcggaatcaccccgatcctgccgatggcccgggaagccgcccgacgcggcctggactggaggctcgtgcacaccggccgcagccgcggctcgatgcccttcgcggcagagctcgccgaactcacggccgcagcccccggccgggtcaccatccgtcctgacgacgagtccggcgcgcccgaagcagccgatctgctgagcttgagcccggcgacgggtgcggtgtactgctgcggacccgcgccaatgatcgacggcgttcggcgcgcgttcggtgacagccgcgcgtcagccctgcacttcgagcgtttcgccccggccccgatcacggacggccgtcccttcgaacttcaactgggcgagaccggacgggtcctgccagtgccgtacgaccgctccgccctggatgttcttcacgacgccctgccagacctgccgttctcctgccgccagggattttgcggcacttgccgggtacaggtggcccatggccatgtcgatcaccgtgaccgccggctcaccgccaccgaacgtgcggccggcgccatgctgccctgcgtctcgcgcgcaccggaaggagagcggttggtgctggagctg

SEQ ID NO: 158 - DNA, 2412 bp, Streptomyces avermitilis
  CDS (1)..(2412)
gtgacccagcccgaccggatcctctctgatccctgcggcaccatcgtggacatggtcgcgcgggtcgagcctgatctgactgtggagcaaatccgggatgcggtgaagcaagccgcccccagccggaccgcacgccggagcctggcaaaaacattgacggccgatcccgcactgctgacgtccaggcgccccgaaggctctcgttccgtcgaacggctgatccacaagctcctggcacacggcgcccgccaagtcgccgttcccctctgcgccggctgcggcaagcccgaacccctcccgcagcgacgagggaaactccgcgtctgcgcctactgcgacgccaccgcacgagcccagcaacagccctgcgccgactgcggattgccccgggtcatccgttacacgggccgcaatggcgaaggactctgcagcagctgccagccgaaggacaatatcgactgggctcagcggatctgcgatcacattgccactgtcgaccccacggtcccggcagagaccgtccgccagatcatcaccaccattacccgcggccgtccccactacgtccggcggctggcctgggacctggaggaccggcccggaatgctgaccgggaacgccggccacggaacccccaaggtcatcgcgctgatcgatgccctccgggacgccggagcgcaagccatcgtccgcccgccctgcccccactgcggccgcaccagcgtgacgctccgcaacaccctgggagatgtcagggtctgcccgacctgctacaacacccgcaaggccgtcaactgctctcgttgtaagcgccgctctcccgtcgcccgccgcagccccgacggacaatccatctgcaaccactgtgaccggaccgacccgatcaaccatgaagaatgctccggatgcggccgactccggccgattatcagacgaaacagcccgaccggccccctctgtgacacctgctaccggccacccgtcgcaatctgcctgctctgcgggcacgcccgcccgtgcttcggcgtcgccggcggcatgccacgctgcgaaaactgcacgcgtttgcgagaaccctgcctggactgcggccgcaccatgcccgtcaaggcccgaaccgccaacggccccctttgcgagacctgcttcaagaagaaccccgtctccttcaaggcctgcacccgctgcggcacggtcgaacgactccggcaccacggcctctgccatcgatgcgcctgcaatgaggaactcaccgcgttgctggcaggccctgacggagccgtcgcagccccactcatgcaacttcactcgaccctgatggccagcaatcacgtccgcgtcctggactggctacaaaagcggaacacagcagtctcggtactccgcgagatagccaccgcagaatgctccctcgaccatgaatcactcgatgcccgaacagacaaggccgtcgaacaccttcgggccatcctcgtcgctgccggcgccctgccgcgacgcgacgaacaactggtcgcggcagagcgatggatcgccgccgctgtcgctgccattgcagatctctccgaccgccacaccatccaggcatttgccacctggacccacctgactcgtctgcgtaagtactcccgtcgcaagcccatcaccgctggccaggcggtgtccgcccgccgcagcgtcaaggcagcggtcggcttcctggcctggctgcgagccgagggcctgaatcttgaggctgtcggccagcgtgatctcgaccgctggctggaaggcggccccactacacggcaatatgctcgtgacctggttctctgggccgtccgcaccaagcgagcgacaaacatcagcatcccggcgcgtctcaagaactctccgacccaagctctcgacgaggacgaacgaagagagatcgcccaccggctcctcggcgacgaccagctcgacgcacgcgaccgtgttgccggcctgctgagtcttctctacgcgcagcctttcagcgtgatcatccgtctcactgccgatcacgtcgtcgtgcgcgagaagagcgtcctcttgcgcctcggcaaggagcctcttgaactatctcccgaactgggcaaccttattcagcagatcgcggctgatcgccgccgcgacggccagatcgggcagattgacgctcattggctgttccccggaatccgtccgggccagcacctcagccatatcactctcgctgcccgactcaagcggctgggtatccggtccttgcccagccgcacggcggctatccgcgacctgaccgccgaagtcccagccgcagtcgtcaaccgccttctcggcctcagtacctcaaccgctaccagctgggccaagagaacggctaagacttcatacgctgctgaaattgcccgccgaagtgactcggacaag

SEQ ID NO: 159 - DNA, 336 bp, Streptomyces avermitilis
  CDS (1)..(336)
atgacggcaaagctcgactaccggtggaaactgcgcgaggtcatggcgacccgcggcatgttttccacgatctccctgcaacctctgctggccgaacgcggcatcgacttgtcctccagccaggtctaccggctggtgactgagcgacccgagcgactgagcctgaaagttctcatggccttgctggacatcctggactgctcgatggacgacctcatcgagccagtagcctcggcctcctcggctgccaagccgaagcgtgcagtcggcgacgccgacaccagcgtcgggtcgttccgccccaagcgggcccggatcgtcccccggtcagagccg

SEQ ID NO: 160 - DNA, 1140 bp, Streptomyces avermitilis
  CDS (1)..(1140)
gtggccagggacgtagaagcacccatcgggtccgcgcgacttgagttggtcgagggcgtacgtctcctgcacccggcggatgcggtgcttgaggcgatgctcacggggtggggccgccagcagcgaggcggccggcacctgcaggagaagacggtgagcgaccggatcgctaccatccgcaggttcgtgaagttcgccgacgccttcccatggacgtggggtgccgcggacatggatgaatggacgacgcatctggtcgcagagaagcacttgcagccgtcgacgatcagggcgacgcagggggccgtcaggatgttctgcgactacctcctcgatcctcgctacgactgggccgtggagtgcgagaggcggttcggcacccatcccatccaggtctgccacgagtggaacaccctcgatcacctgctggactacgagggtgatcccgaccgccggccgatgacgcggggggaactgcagcagttgttcgaccacatcgacgaacgcgtcgacttggcgatccgacgcggccgcaagggagccctgaccgcctaccgcgacgcgaccctgttcaaggtgatctatggctggggcctgcggcggacggagactgcccggctggacaccttcgactggtatcgcaatcccaaggccaaggagttcggacggttcggcatgcttgaggttcgctatggcaagtcgtcccggggccagccaccgaaacggcggagcgtctgcagcacgatgccgtgggctgtcgaggcggttgaggactacaccaccaacatccggccgcggttcaaggggcacgaccggagcaaagccttgtggctgagtgaacggggcacccgcctgtccgcgaaggagatcgacgagcgattctccgtctatcgcaaggccctcaagctcgacgaggacctggtgccgcactgcttgcggcactcgtacgtcacgcacagcatcgaggacggggccgacccggtcttcatccagcagcaggtcggccacgagtatgcgtccacgaccgctctctacaccggcgtgtccggcgacttcgcgaacaccatgatgcggaaggcaatcgactcagcgctccagcgcgatctgcaggactttggccccggcggcaggagcagacga

SEQ ID NO: 161 - DNA, 585 bp, Streptomyces avermitilis
  CDS (1)..(585)
atgctgtacctggccacgccgtccggagctgacgtacgggccgccatgcaggccggactcctggcctgcatgacgaccccggcccagggcaacgtgatcccgcccggcgccctgtacgcgtgcgacaacggcaagttcggcaagggatggcccggcgagcaggcctggttcgcgtggctgacggcgaccgtcaaccgctacagccgaggccgctgtctgtgggccgtcgcccccgacgtccccatggacgccgcggccaccctcgccgagtcgctgccctggctggagcccatccgcgccctcggtatcccggccgcattcgccgcccaggacggcagcgagcacggcctcatcccctgggactcgatcgacgtgctgttcctcgccggcagcaccgagtggaagacctcaccggccgcccaccggctggccgttgaagcccggaagcgcggcctggccgtccacatgggccgcgtcaactcccgtcggcggctgcgcatcgcgcaggccttcggctgcaccagctgcgacggcacctacctcgcctttgggcccgacaccaacctccccgcctcctggcctgga

SEQ ID NO: 162 - DNA, 516 bp, Streptomyces avermitilis
  CDS (1)..(516)
atgacgacccgactgcgccatatcggcgccgcgatcatgggcatcctcgaccccattccctccaccgtgccctccccgatgagggaggaggaaggcgcctgggtacgcgcgcacgcctggaccaagggcctgcgcaagatcgaggacgcctacccctgcggcttccaccgctggtgctcctgcgagcgcggcatctgccccggttgtgcctccgggcaccacgaccggtgcgtcagcgccggcggcccccgcgtcgacgagcacgccgacaccatcaccgacgcccaagggttcgtcgtcgccgtgatccggttcagacctggccaacggccctgccggtggatctgcccctgccctcacccgacggccgtcgaagagaccgccgagacgggcaaacccgagaaaccccctgccgcccagcacgccgtccctgcgcagcggcctgcggtcgccccggagggacagctccccctcttcgcgagcggcccgcaggagcacggggacggggaggcaccg

SEQ ID NO: 163 - DNA, 1005 bp, Streptomyces avermitilis
  CDS (1)..(1005)
gtgaggttcccggtccaggagaccctgccgttcgaggacctgccggaggtaccgaccgcgtccccctggtgccagcggtggcgcgaggggaggcattcctgggcgcatgtccgcgacggaggcttcgacgcccgccgatacaccgtggacgtcatccccgacgaggagcccgccaaggggttcgtgctcgcacaccattactccggctcgtacccggcggtgacggtgcaattcggcctgtacgacgtcgtcgacggcgagaggcggctctgcggggtggccgtgttcggagtgccggtcagcaccgccgtcctcaccaagccactgcccgagctccggccgtacaccgagtcgttggtgtgctcgagattcgtcctgctggatgagtgcccggcgaattcggagtcgtggttcctcgcgaactgcctaaaacgcctgctcgccaggggtgtacacggagtcgtctcgttcgcggaccctgtcccgcgccggaccgcttcgggacttctggtcatgcctgggcacgtcggcacgatctacgcagccacgaacgcggtctacgccagccgggccaccgcccggacggtgagccagcagcggctggacgagctgtgcgcggaggttgagcagattgctgagctgctggtcgcccgcccagaggcggcgggcgaggcgatcgaggcgttcaacgcgatgaccggtcacgactacgtggctctcgacttcgctgagtactacggcagcaggagcctggaggagttcgcgaaggaggcggcccggccggctcgccccgtggttgcggacatcaaccgggacgagctcgttgagatcgttcgcagactcctgactgcctctgcggagagcggctactatctgcggctcctggaggcgaacgtgtcgcatccccgggtgagtgacctggtcttccatccctcggacatccttcaggacccgtctgcggagcagattgtcgacgaggctctgaagtaccggccgatcgcgctc

SEQ ID NO: 164 - DNA, 477 bp, Streptomyces avermitilis
  CDS (1)..(477)
atgaaaattcgccgaatacttacctggttggccgctacggcagcaaccactgccctgattctcttcggggcttcgccagcaagcgccaccgtgtactggcagacctacagcacgaactcgaactggcactgcggacccaccaccaagacccctctctcgaactatgtcgtgttccagacgtgcatcgtcgtcacgcccgacaagaccaaggggcaagctgtactgattgtcacgaacagcagtaccaaggacgtcatcctccgacaaggtgaagtccactctgacgagctgtatggcgtgaacgggtattccacgtgcacctacgactacaccctcagcagcgggcagtcccgcgcctgcttcggcccgacggtggcgttcagtacatgcggagatggctacgcatggggggtcctgcacgccaacagttttgactacgccatgggaacggaaacagtcagattcgttaccacgtgc

SEQ ID NO: 165 - DNA, 228 bp, Streptomyces avermitilis
  CDS (1)..(228)
atgagtcgggcgaagtgggtgaggacccggtgccgtcacggttccgggtcctcaccgtccgcgcagcgaccggtgcgatgcccggtgtacgtggccgggggctgcggacacgtcgttcgggccggggcggcggcatgcgggccgggccgcctgccctccacggtgcgcgcgccttcgaggtatcgcattttgtgtccgtacgtccgagtgaggcccgctgagacaccg

SEQ ID NO: 166 - DNA, 615 bp, Streptomyces avermitilis
  CDS (1)..(615)
gtgtaccaggcgttcaccccgcaggtccgcgcgctcaggaaggagacggacggcccgctgatgttcgccaacgtgctcgggatgcgggccgaggagagcccggaccgacgcaaccgggagatgtggcgccgtactaccgacaactcggcccggatcgtcgacgagtggctgcccgcgcaccaggtgagcaccgaggaggtctgggagcgcacgatcagcgcggggctgccctaccactggtgctacgactcgtaccccggtgccaaggaccggggtggttccagtcgctgttcgtgctcggcctgcaccctggccaatcaccgcgatctgctgctgaccgccgggcgccggccgcggatggccgagttgtgcgcgctggtcgaacgtgtccgccaggtgccgttcaacccgaacatcaccatggccgagctcatcgcgctgtcccgccggcgcgatgccccggaccccggcgtcttggtcgaggagaccgaggacttcgagcggatggaacgcgacgtccacgccgccctgcgcaagccgcccacatgggactccaaggcccgtaccgggccgggcgagatcctgcacagcgccgccgggtgcgatggctgccac

SEQ ID NO: 167 - DNA, 354 bp, Streptomyces avermitilis
  CDS (1)..(354)
atgacgatgacgacgacccagcgcatcctcgacctcgctgcggcggcaccggccagccacggcgaggacctggtgctgctcctggccgaggcaaacgagctgtaccagcagggcctgcaggagctgcaccgggaaatggcatcgcgtctcggcgggctggccaccgaagacctgatgttcgccgctgagactgccggtatgccctgcgatgcctcgcaggaccgcgacgaggtgatcctgctgctggccctggtcgagtgggagatgacgccggccgccatcgcgtacgcggagatggccgaggacgccgcgcgccgcggtgtctgcctggtccccgaggaaggccgtgagccg

SEQ ID NO: 168 - DNA, 714 bp, Streptomyces avermitilis
  CDS (1)..(714)
atgacctcgcgccgtgagcctcgcctggccgacgctgccgagatcgcggctgaacagggcctgacaccctcacggatcagccagttctacaccgagcgcgcggagaacgcggccggcaggacattccccgatcctgtcgacaagcgcggccgcgcccgcctgtggaaccacgcggaggtcaccgagtggttcgccgaccgggcgccgtcacggctcgctgaacacgcaccgccctccctccctccggggacgttactgaacgcggcggaggcctcgaggtatctcggctacaagaactccagccaggtcacgaccttcgtgcgcgatcaccccggttacttccccgagccggatgtcgtcgaagagaagggcacggcggcgaacccctaccgccggcagttgtggaaggtagagactctgcaggcgtggatggccacccggcccggccgcggaagacgagccggagccaaggaggcgccgccgctgcccgacgtgccggtcgacggcgatcccgaggagcttctgggggcgagccaggcggccgccctgctggggtacaagaccgtcggctccttctcgagcagcctgtcccagggcaaccttccgctactgaagaccacggacggggtcgcagagaatgccgggcgccagaacgggcgccggcggtggacgcgccggcgcatcctcgagcaggcagcccaacggtccaagaag

SEQ ID NO: 169 - DNA, 912 bp, Streptomyces avermitilis
  CDS (1)..(912)
atgaacagcgccgcacagagtattccggcgacggcaatggcccccactcccgctgagcccttgacccaccaggtgctggccgggctcgcccagcaccgcatcgccaccaccagccagatgcgtcggatgttgcgaccggacggcacgcggcagctgatgtcccgcgtgctgaacaggctacgttccgacggcttcgttgactgcacggtgctgccggacgcgaaccgaacccgtaccaacgcctggtacctcacgcaggagggcgcacggctgacccgggacctgcccgtcctacgaggacggccgccctaccccatctcctcgatgacggcagcatcgctgaagaccccgcacacgctcgccgtcgttcgcgctcaccttgctttcgccgcagacgcccgccggctcgggcacgagcacggcccctgggactggacccctgaggtgtcccactccatcggtgagggtgagcggatcgtagccgacgcggtgatgtactacacggtcgtcgagagcgaacaccggcgaaagctgcgcgcgttcgtggaagtcgatcgcagcaccatgagcagtgagcggctggccgtgaagctgatcgagtacgcccgcctgttccagtacgaggcccagcccgtcggccggcggaggcaggcgtccgtaggtcctgcgtggctgcgctggtatccggtttttccccgtgtgctcttcgtgctcacaggtgcctcccgggtcaggctggagaatcggatgagcgatctgcaggcgatggtggctcagcacccactcgtggcgggtctcgctcgggaggtccggctgggagccgccgtgcttgaagacctggagcagcacggtcccgcccaagacgtgtggatgcctctggtcggaggtaattcgcgcccgtggacggacctg

SEQ ID NO: 170 - DNA, 954 bp, Streptomyces avermitilis
  CDS (1)..(954)
ttgaacggcgttcgcggtggacagcatccctcatggcgctcagcttcgtcccagttcacgccgaccccgggggctatccatggcgaagcgcaccgcgaagaagggcagcagcagacgagtacggctgtccgccgaccggctacggaagggctggcccggccccgccggcacccgcgtgcggctcgccacagcagcggacgcggacaccgtcgacgcgctgctcgacacggccggggcccggctcatcccggtctgcggtcctccatcgagcagggcaccgcaggtgccgccctcctggacggtctggacggcaccaccaagacatttttcgaggacttcgcgcgccggaccatcgggcacccgagggccgactcgatggccagtgtcagcctgactctcgtggccgccaacgagcaggaccagccgatcggcgctctgtccgtcaccgcccccggaaccatcatcgagcgggctctggagtacgggtacagcaacgtgcaggctgtgatcctgagcgtggccattggcaaagtgcacggcctggcggtagccgagcaggcccgcggccagggcctcgccagcttcctgctgaagcgggcctggcaggtctacgaccagctcggctacttcctgttgcacgggtccttggagaccgagcgggacctaggcgccttctataagggctgcgtatataccgtgtacgcccccggcgagggattcgcgtgttcacccgctggcggcctccccgctgagcgaccaccggccgttcacctcacaggtccgtccacgggcgcgaattacctccgaccagaggcatccacacgtcttgggcgggaccgtgctgctccaggtcttcaagcacggcggctcccagccggacctcccgagcgagacccgccacgagtgggtgctgagccaccatcgcctgcagatcgctcatccgattctccagcc

SEQ ID NO: 171 - DNA, 1425 bp, Streptomyces avermitilis
  CDS (1)..(1425)
gtgaccgacacccgccgcagaccaacgccaagcggcttcacccagcacctgcaccccttcccggctgacctgggccggtgggaggcggaacacgcacgcgccctgcgaaccggccacgtacgcgaccacacctgtacagccgagtgcgaacccgtactcgtctacgagcgcacccggtggggctggctcgcctggacgatcccaggcgacggctcccagcccgaactccctcaccagatcggggtcctcaccccatcggccacacccacgcagcgcttggcgctgcgctggcttaccagacgccccggccgacgcatcagcctggcccccggcacccccggctcgctgcgcgtcgtcaccgtcgcggtcgcgttgttcagcctgctggccgggctgttcgccatggccgatggcatccccgccgacgtcgccctgccagcgatcgtgctcgcgccgctgctcgccgaacacctgccgaccacgctggacgcccgggcccgcgaacacgtccgcagcgtcgaaggcgccagcgcctgctgttacctccagcgcctcgcagccctgcacacctacctcgtccaggccgccgccgtcagcgaccgctacgaactgcgccggtcggcccagatcagccagcacctgctctgggatgccgccgacctgctccagacccaggacacccgctcggcctcctgtgaactcatcgcacgcgaacggctgatgctccagctcacccaccaggtcgcccaggtcctcaggtacccatccgcccggtcagcgccggccgacgccgaccaggcccgcgagccggagcggccgcctcgcccgtaccggcaagcacctcagcacacgcccggcacctcaccgccgaagggaacacccctcatgccccaatccaaccctgctgcccgcacctcagacatctacctgctcttcgcgcacgagccctactaccccggacccggaaccttggagatcaacaccaccgtggtcgccgccgacaccctgctccacccgtggatcctgcagcccgacggcacccggatccacgacctcctcacccaaggtcggcagccgcgcgaggtcatcccgcttgccacccttacccacgaactgaacggaggcgccgactggccgacggtcggcgactgggaacgtgtcaccgccgacctggtgcaactcgtgcagacacagaggtgcgacgccctcagcctcggacttcccgcagttgcccgggccctgatctgcacaggccccgagaaccaagtgcgcgccttcaacgctgcagcaggggatttcaccgtctacggaccggacgaccgcaccaaggtcctgaccgaggtcggcatgttcctcaccggcgtcgcggccgagcaacccttctggccgggcgacggactcctgccgccgctgtgccagagcgcc

SEQ ID NO: 172 - DNA, 1419 bp, Streptomyces avermitilis
  CDS (1)..(1419)
atgacccgtttcggggcggggatccgccgtggggtgatggcggcagaccagttcacccagatcgccaacggcctcttccgcgacagcaggctctccttcaaagcgaagggaatctgcggctacatcagcacccacgtcaccggctggcacgtcacagtcgccgacctcgtgcgcgtcggacctgacgggcgggacgccgtgcgcgccggtctgagcgaactgcagaggcacggctacctcatccgcgaacagctcaggcacgacgacgggaccctcggcgacatcgtctactcgatcacggaccacccagccatcgccgacgccgcgctcgcgcagacggctggcacggcgttcgtctcagcgccgcaggcgggggcgggcttcggggcaggggtccgccgtggggtgatggcggcggaccagttcactcagatcgccaacggcctgttccgcgacgcccggctctctttcaaggccaagggagtcttcggctacatcagcacgcaccgggacggctggcggatgagcgtcaccgacctggcgcgccgcggccgagacggcgaggcagccgtgaagagcgggctgaaagagctggagaagcaccgcttcctcctccgagaacgcgagcgccaccccgacggcaccctcggcgcggccgcctacttcatcacggacctgcccagcctgcaaaacaccagctcgcaaccgttgtcgggttttccaccggtggataacccgacgtcggttaatcgccccactaagaacaccaacagaaagaacaccacgaagcagaagaccaaccccctccgtccgtgcgaccgcggcgacgccgcgcgcacgaacgcacggacggtcccctcgcacgcgacaacgtcgccgaagccgccgactccagcagacgagatgcacgcgggtatccggctgctgctggacatcggggcgagccgtcccgaactcctgctgaccgggccggcactgaccgatcaaggccgcgtggcgaccgtgatgctggaagccggctggagcgccgagcagctgcgccacgtcatcaccagccgaccgctgccgaacctggtgcgcacctccatcggcgcgatcatcgccgcccggctccgcgccgcccaggcctacccgccgcccgctaccgccgcccgccccggcgcggccccgctggacgaacccttcgcggaggcgaccagagagcggtcatcgacagcggccgccgcccgctctgtgacccaagccctcacctaccgggccctcgtcgagtgcgccggctgcggcgtgcccgccaccgcccccggcgacgacctctgccccacctgcctcggctggccactgtgccgcacctgccccggaccaactcgcaagcgagcccaccccgacggcgacggccgctgcacgacgtgcgcctccgcc

SEQ ID NO: 173 - DNA, 936 bp, Streptomyces avermitilis
  CDS (1)..(936)
ttgaccatgtcccctggcaagcaggccgcggagagcggcgctgcccctgcgatggccgcaggcgtagagctggagaagatgaggcgccgcgtgcgtgtgtcgcgcctggccctgttcaccgcgatcgcggccggccccgtcgccctgggcgtcgcggtgatgtccggcccgaccacggttgttgccgcccccttggacaagccgactgctgtgcgtagcgccgtcgcttccgacccggcgggctatgcgcagttgttcgtcgacgcgtggttgcgcagcagtgccgacgacgcgaacagtgcgcaggcgcggcttgcgcagtccctcgcgccggacgtcgatctgccggatccggtcgccggtgcgcagccgaagccggcagcggtgaccgctgtgcgcagtgcgcagcgcgaggacggcgagtgggcggtgacggtggctgcgcagtacgcggacggccgtgtgcgctacttcgtcgtgcccgtggcggccgacgcgagcggcagctcgttcgccgtgaccggcgcccccggtgtggtggccggcccggcgcgtgccgcggtgtcccagtcgctgttcggcgtgagtgttccgtccggcggcgatctggcgtctgcggtcggggagttcttcggcgcgtacctgaccggggccggggaggtggaccgctacctcgcgcccggggtgaagctgtcgccggtctcccccgccccgtacaccgcggtcaccgtccaggaggtgtggggcgctgaggaggccgtggccgccgaggaggtgccggccgacggtaccaaggtccgtgtccgcgtccaggtcgaggccagggatgacgccgggcgctggccgctggcgtacgacatcgatctcaagtcccgctctggccggtgggaagtcgcggcgctggagtccgggactggcgggggcgggggtgcccgg

SEQ ID NO: 174 - DNA, 318 bp, Streptomyces avermitilis
  CDS (1)..(318)
atgctcgccggccgtctggacgagacaggcgacggctggatcaacatgctcgagagctgggcgaccaaggggttcaaggcgggcctgatggctctcgtggtgatcggcatggtccagaagttcagcctcaaggccggcctcggtgccctgctgctgatggtcatcgcgctggggctgtacgacagccgtaacgacctggcggacatgttcaccgacgaggtgaagaacccgtccaagggcgctcccgccgtgcccggcatcgtgcgcggtcccgatccgctcgcccgggtgcactccgacggcacgggagacgggctg

SEQ ID NO: 175 - DNA, 573 bp, Streptomyces avermitilis
  CDS (1)..(573)
gtgagcgccgcgaccatggggcgggtgggccgcttctacacctccgcccgccgccacccgtgggtgctggggaaggtcgccgactggaagatcccgctcggcccatataccccggcacagatcgcggtcgccgtcggcggcggcttcctgctggtcaagacgatcagctggtggtcgtggatgggcccggtgcccatcgtggcctgggtcctgacggtctgggcggtgcgccgcccgaagatcaaggggcgcgccccgttgcaggcggcgctgggctgggtgctgctcgcctggcagccgcagggtggccggatgggcggccgggccgcccgggaccgcctttctcgtcctctgtttggcggtttcaccctcgaggtggctgctcccgctgtcccggtcatggccacgctccgcgtcgaccagcctgcagccgatcgcaaggcgcgccggggcccggcggtccgtccgtccgcgcggccgcgctcggcgccgcaggcgcgcccggtgtcggtggggccggtgtcgggcgttcagcagttgctcgccctcgccgaacaggccgggggtgcgcgg

SEQ ID NO: 176 - DNA, 2679 bp, Streptomyces avermitilis
  CDS (1)..(2679)
gtgagggtgccgatccgtcacatcgccgggcatctggtgtggtcgacgcacggcagcgtgtgggccctctaccggctgcaccccggcccggacgagcggggccgccgggaggagaccgtccaggggacgtacgttccggctgcggtccgggacgaacagctcgccaagatcacccacttgatccgctcgctgtccggggcgccgcgcctgttcgggctgtgcgctcaggtcgacccgggcgagattgccctgcgcatgatcgagggcatcgagcccggcgagacggcggccgacggcggtccgcatccgtgggtggaaaacgtcgaagccaccctggacctgctgggcgagcaggagatgcaccgccgcaccctctggctggcggtgccgctgcagaacgaggccgccggcgggcagatgaccgcgtcgctcggcgcgatgtgggcggacgtcgcgccgatgctgggcatgcgggctgcacccgtggcgcgccgcgaggtgagcggctaccgcgagcaggcttcccgggtggaggccgcgctcgccggcggcgtcgccttccgcccggcccgcccggcggagatcgtgtggatgatccagcacactctccaccgcggcctggaggagccgctgctcaccgaggccgagaccagcgacctgtacggcggacagctgcgggcggggatgctgcagtcccccagctacgccgatctcggccaggtccgcctgcaggagggaggcgtcgacctggcgctcgacgacgtcgagggcctgtccggcggggaccggatcggccgctcgggccgtaaagcctggtggcggctgaagacgtcgtcgccgctgcggcggcgctggctgcaggtggagtccgacgccggggtgggctatcaggcgcagttggcgctggccgagtgcccgcccgcggtcagccaggacgccgccgacctgttcgcccagctggagacgctcgatttccctgtcgactacaccgtcgacctcactctggtcccggcggagaaggcccgcgaccaggtccggcgcaagaagaacgaactggtcgaccaggccgaccagtacgacgcccgccccaccggcatgcccgcctccctgaccgatgccgcccgcgacctgggcgagctggacgcccgcctgtcgcgtacgtcggtcgaggtcgaggtccagtccgtcaccgtgctgaccgtgtgggggccgaccgccgccgtgtgcgacgcccgcgcccgggccctggccgcgctgctcggcggcgccgactaccgggccgtgcgccccgccgggctgcaagaggccctgttcaccctcggtctgcccggcaccgcgcggcccggtgtggtgcgggagttcacccagcaccaggtcagcgaagactgggcgctgggcggggccttcaccgctgcggaggtcggcgaccccaacggcatgttcctcggcatcgacctggactgcggcaccacccgccccgtgatgatcaacgtggcggacgcacccaagcaggacgcctccgcctccatgggaatcgtcggcgatctcggcgcgggcaagagcgtcctggagaagctgatctccgagtcggtgtgggcgcgcggcggggtcgcgatctgcatcgaccgcacccccgtacgcgagtgggccaccttcgcccgcaccgcagctgcgggccgctgccagatcatcgacgccgcccaggcggaggtgtccatcgacccgctgcgcatgttcgacggccccgaaggccgccactacgccctgtcctacctcacgctgcagctcggcatcggcccgatgagcaccaacggggaggtcctgcaccacgccgtcgagcgggccgccgccggcgacgccccctccatgcaccgtgtccttcaggtcctcgacgagatggccggggcacaggcgggcaagcggcaggacgcggccgccaccctcgccggcctcatccgcgtagtcgccagcaaccctcttgccgcgatggtgttcgaccccgcgctgccgcccgtgcggctggacgcctccggtgcctccgacatgatcgtgatcacgacgaccggtctgaagctgccgccgaaggccgcgttcgacaagcccgaggtcctgcaccagcagccgctggaagccctgatcggccgcgcggtgctctacctgatcgccgcgatcgcccgccagaccgctttcgaggacccggagcggttcaccgccgtggtgctggacgagctgtactggctgacctcttcggccgagggcaccgccctggtccacgagatcctccacgacggccgcaagcacggcgccgggctcctcgccggctcccacgatgccgaggaactcggtcccgaccgcgggctgatggcctaccgcgcgctcgcccgcaccgcagaccgtgaacgcgcccgcagaggactggagttcctcggtctcgacccgcacgaccccgagctgctgcggctggtgaccaccggcctgtccccggtcggacaacgcggccgcgaaggcgagttcctcatcgcgtgcccgcggcaaaacaccggccgtatcaaggtcgtcatcccccgcatcgagcggatctcctcctccatcaccaccacacctggacgccgcaccactgcgcccgggtccgcgccgctcgccggcgcagccacaggcgaccgtccgaaggaactccga

SEQ ID NO: 177 - DNA, 348 bp, Streptomyces avermitilis
  CDS (1)..(348)
atgacctctttcgcacccagccgttcccggcgcctcgccgcagccgcgagcgctctcacggtgatcgccgtggccgtcggcgtgctcgtcctggcgctgggggtgagcctgccggaggcctggtggccgcgcaccggacaggccttcgccgccgacgccgccaaggcgcccgcagacccgtgcgatcggatagccggtccggccaaggcgtactgcgagcgcggccgccatgccacgagcgcccaggccggcggtgacgcagccgcatggaagctgctgtcggccgcgacggcgataggcgcgctcgtgatctggcgacgccgcgcgcatacgaggcaagggcgggct

SEQ ID NO: 178 - DNA, 2730 bp, Streptomyces avermitilis
  CDS (1)..(2730)
atgttccgtccagaccgcggcacgctgcgctcggtcggcttcgtcctgctggtcaccggcgtgttcgtcatggtgaacagccaggtcgtgtacgcggcgagcagcaacagtgagaccggtgacctgctcaccccgttgaacatcacttcctccgagggggtgccgatcaacgggtacgagctgaacgccgaaggcggctccattgtcgccttcaagacgcaggccctcgcgttcgctctgtctgggctgttcaccctgatccggatgctggtcggcctggcggggtgggcgatcgaggtggccttccggttcccgctgctgaagatcttgagccgtccggcgcagaaggccgccgacacctacgacaacgtggtcgtggacacgctcgggctgaagggtctgctgctggcctgggcgttcgtgttcgccgggttcatgatcgtgcgtggccgtgtcggccgcggtctgggcgagatctttctgactcttctcatcgcggcgttcgccgcctcggcgttcgtccgccctgacaccctgctcgcccaggacggaccgctggggcaatcccagcaggtggccgccgaggtcgcgcagcagagcgtcaactcctacgactggggaggcaagctcgccagcaaggggccgtgtgagggcatggcgggcagcgcggagatcacatgcctggagcgtgaaggcgaaggcccggtctccgcggcagaggtggcccgcccgatccaggactcgatcaccaacgcgctgatcgtcaagccgtacatgctgctgcagtacgggcgcatcctcgaccccgccaagcctgccgaccgcagggcctacgccgtccatctgatgtgggtcaccggcggatacaaggcgggcgccaagaaagacaacgaggacaagaaagacgcctgcgccaagatcaagggcgaggcgaagaagtactgcgagcgcgacaccgacgttgttcccgggaacaacggaagcggcaccctgccggagctcaccccaggcggtgaactgctggacgcctcccacgcgatcgtcaccgacgaggaccgcgagttctacgccttcctgcaggacatgaagaagaccggtgacgtcggcaagtcctgcgccgcctacgccgagaagcccacctggtggcgggtcggcggggccgccctgctgctcatcgccacgttgttcatctgcggcatgctgctctccagcgccattgtgctgctgggcacccagggcatctgtgcggcagccgcggccgcgggcggtgtcactttcatcgccggcatgctgcccgggcccgcacgccagtcagtgtggaagtggctgtcgatctggggcatctcggccctgaccgtggtcggggtctgcgccttcgtaccgttcttcggcatcgccgtggacgccaccatcaccaacggccccgacctgatggtcgagcgaatcctgctgatcgatgtcctcgccatcgcgggcacggccggacaccgcaggctcctgaccggaatcacctccttcgggcggcgcatggccatgcggatgcgctacgccaaggtcggcggcacccacatgcccggcgacacctccgagctcggcgccgcgctcgccatgaactcgcccgcagcactgggcggatacggcgggggcttgcgcgccttcaccggcggcggtggcggccggttcgggctgctcggcacccggcagcggctgatgggcgcgctcacctctttgttcgacggggcgggcatgccggtggacaccggccgtgtcctcgccgacgcaggcgccgaagccggtcgcgggctcgcaccgctcaccgcggcggccgccgtgagcggggcgggggcgcgacttggcgcgaagggcacccactggctgctgatcggccggcggccggacaaggagcagttggccaagtggcgcaagcccacggctgacggcgacccggacgcgggcggcccggacggcggcccggacggcggttcaggcggcggagggccgcgccgtcctggcggtccgcccgatcgttaccgcgacgaggacggccaggtcgtcgaccgccgcacggggcaggtgctgcacgaccagaacaccgaccgcacgctgctgtcgacgcgcgcccacaaccgtctggtgcgcttgcgcgggtaccgcatcctcaaccggggcggccgcgccgcatacgggacgacagtcgggctcccggccaatgtccgccgggcccgctcgggcaaatcgcagtacttgctggacgcccggcagcaggtgcaggtctggggcaacaccgtccgcgaggacggccgggcctgggccgacacaggacgtcatgtctctcgtgtcctgcgggagcacaccgacgacagcggcggccccggccccttcgtcacccgtcgcctgccggcccgtccggcaccggctccgcggccgaccgggtcctccagttctccagcccgtacgcgacaggcctccccacgggccagcgcgtccgcgtctccggcctcggtcagcacacggccgagcgcgccgccgacctccccgccccggctcggaagcggtgcgccccgggctgcagcaggcggcagaccagggcggaccgctccccccggcgacggtggcgcggagggttctgcaagcaccggcaaccgggcccggatgcaggagctgatgcggcaggccgaagcgctgcgcgagatgcgggcacggtggcaggtcgaggacggtgaggacggg

SEQ ID NO: 179 - DNA, 1149 bp, Streptomyces avermitilis
  CDS (1)..(1149)
gtgaggacggcccggcgccgcaagacgcagtgggggtgtgtggtggtgctgttgctgttcgccgccgtgtgctgtgccgcaccggcagggaacgcgatcagcgcgtacgtggcgctgaagacgggtgcgagcgccgacggcggggtcgccgaaggcggcaccgctgcggacatcccgccgcgcatgctcaccgcctacaagaaggccgtccagcaggtcgggaagcatgtgcccaagtgccagggcatgcgctggccgatcctggccgggatcgccaaggtcgagtccaaccacgccgtgggccggaacatcgccgacaacggcgacatccgcccgcgcatctacggggtgctcctcaacggctccggggccggcgggaacaccaccgccttcccggacaccgacggcggcaagtgggacggaaccgccagtggggagcgcgcggtcggacccttccaattcttgccgtcgacctgggagggcatcggcgaggacgcgaacggggacaagacggccgacccgcacaacgccgacgacgccgcgctcggcgccgcggcctatctctgcggcaacggacgggacttgaccaagcgggcgcagctcaaggcggcgatcctccagtacaaccactccaatgagtacgtctcgaacgtgctgggctggatcgaccagtacacggcggccgcgaaggacccggacctgaagaacgtcacgggcaaggtccgcaccgtcatcgaggcggcgctctcccagcggggcgtgccctactcgtggggcggcggcaacgcgagcggcaggtcgtacggcatctgctgctcccccagcggaaagagcggcgcaagcatcaagggtttcgactgctcggggctgaccctgtacgcctacgcgaaggctggcattcagctgccgcgtacggcggctgcgcaggccggggtcggccagcgcatccccacgagtctcgggtccgatgcgctcaacgccggcgatctcgtcttctatgccgacgctcccggtcatgactcgacgatctatcacgtcgggatttacgtgggcagcgggcagatggtcaacgccgcccgtccggggaccgttgtccgcctggacgcggtcaacgcgatgtcgggatacgcgggaggggcccgcctgctg

SEQ ID NO: 180 - DNA, 645 bp, Streptomyces avermitilis
  CDS (1)..(645)
gtgaccacgtccccggcgcgctcgccgcgcctgctgctgatcgccactggggtcctggtcgtggccggggtgatcctgctgacggtgccgcatacgcagagcgcaccctcagcttcggcgccaccgcgtgcggccgctcccacgtcgcatccctcggcgtccgcttctggcggccgtactgggcaggccagcgggctcgcgccggccccggcctccaccgcgtcggcacagtcggccagcgcgtccgcgctgccgccgcacggcgagggcaccgccggcgatgccgtcatccacaagtcgttggaggacgcctggcccgccgatctcgccgccgacgaggagcgcaagctcctcgcggccggccgtggcctgctgcgggcggacgccaccgggatcggccgcgccaagtggcccgcgatcttcggcgacccggaccaggcggtcgcaccggcgttcgccaccgcccgtttccgtatccaggccgccatcgcccgccgtgacggcagccctaacaaggcggtggtgcacctggtgtgggcgggcaccgaccgcggcggcacctacaccgaccggcgcatcaccgaccggtacttcacccgcacttcgacgaaaggagcatccacgtggactccgcagccccgtacc

SEQ ID NO: 181 - DNA, 2556 bp, Streptomyces avermitilis
  CDS (1)..(2556)
atgttcaccggcatcattcacaccgtcggctgggtgatcgcctactggtacgttcccgtggctgccgccatcgtcatctgggccgtgagcgagacggcggtacgccgcctggcgaggaaggcctcggccgagcggatggcgctggagctcgtgccgtcgcggcacttcgaccccggcctggaggagatcttccgccgcggagtccagctcgcccgggcctcgacgagcatgccgtggtgggcgccgcgccgtacgaaggcggtgcagatccggctgcgcgccgacgggtccagtccgctgcgctaccggatcgagggtcccgccggcggcgaacgtctgctgtcgatcactcccttcggcccgggcgtcacggtgaaccgggctcgtcccctcgtcgacaagccgcgtgagcatgtggtgcgggcggagttcatcctgcgcggcaagcccacggccccgctgcgtgaagtgccgctggacccggacccgttgcagccactgatcgatgccgtctgcgacctgcgggcggaactgggtgacctggctgagatacggctcgacatccagcgggcccccaagtgggcgcttcgggcgcgccgtgtgcagctgatgtcggacgctcgccgcagggagcgtcgcgaggctcagcgggctgccaggtgggtgcggcaggacgccaccggcatcgaggactcgctcgcctggcagttgcagcagttggtcagccggaagcaggacgggggcgggcgccgtctggtcatgccgccggtcccccgccgggtggacccccaggacgcgctgggcaagctcgccggtgacgaccatctcgtccgtgtgcagctgctcgtgatgtgcgcctcgaacaccgaagggcgggccgaggcgaggctcgcccagctccaggccgcgttcgacgtgttcggcgggggctcgcggtgggcgatgcgcgggtggcgcgtaggtccgtggcggttcggcgcggaccgctggcccagccggcgcggcttcgagcgccgctggcggctgggacactgccagccaccccgcccgaactgggtgcgcctggaggaattgctcggcctgctcaagccgcccacggtgcactgccgtctgccgctgctcgccgcagacctgccgaccttcgagttcgggaaccccgagttgctgctgcagggcatctaccgctcccccgacggtcgtcggcgcttgatcgccagctacgccaaggagacgctgttcgaggtaggggtgggcaaggcgggcggcggcaagaccgaacgcgccctcgctcaggcgatcggctgggcgcatgccggaggcgggctgctgttcgtcgacccgcaccgcgactcctggccccgtgctctgccgttcctggcccacgacgcgctgatgcagcggatcgcactcatcgacctcaacgcccatgggacttctccgcacgtgagttgctggaacccgctcggtatgcaccagggccagacagcgcacgaggtcgtcgaggccaccgcggacgccttcgcgtccgcgctcggctgggacgacgccagcgcaccccgcgcgctgacgatcctcaccgccgccctggcggtgctggtggccgtcaacgaaaccgcatgccaggccgggcgtccggaggaccaggccacggtcttccacctgcgggcgctactcaccgatccgctcttccgcgctgcggcgctcgccggggtggagggacggctcgaggaggagacccgctcctggtggcagacggtgttcccgacactgcccgccgactccttcgccgtggtcctcaacccgatcgcccgcctcgccgccaaccccgtcacccgcgcgttcctcgggcagccggccggcgtctacaacatccgcggcgcgatggactcgaagatgatcgtatgggtgtgcccgggcgggaacggacccaccgaccggctgatcaccgcgctgctcgcccgggacctgctacgcgccgtgcgctcccgccgcgacacccccgaaggccagcgggtgccgttccgcccatacttcgacgagctgatcaccctgactggcgcggcccccgaaacgatcgccagcatgttcgaggacttccgcaagtacaaggtccacgtccacggcatgacacagctgctggcccgcctgcccaacccggtgcggctgtccctggtccagaacgcctccaccctggcctccaccgccggctcacagtccgccatcgccccgatcaccgcggaatggggcgaccgccccggccctgacatcgtcgccgccctggaccggttcgagcactacatgtcgctgacggtcaggggcgctcgcgtcggccccgtcccgatcaccggtccgcacctcgacgaagtcttcgccgactacgcccgcccccgccaggcggcagcactggagcgctccgcccgggccatggccggggctgcgccactggaccagctcacagcactcgccactaaccaactgaaccgtgtgggcgactttctcgcccagcacgcccccaccacccggcccgccgcacggctgcagaagaagggataccag

SEQ ID NO: 182 - DNA, 912 bp, Streptomyces avermitilis
  CDS (1)..(912)
gtgaccaccgccttcgagaccctgtcgtccggccgcacaccgagtccggtcgagccgctgccgcatcagctccttgcggtgctggggcagcaccggatggcaacaaccggtcagctccacgacctgttgcggcctgacgcggcgcggcagaccgtctccacaccgttgaacaagctgcgccgcaagggcctggtggactacgcggtgctgccgcagtccaaccggtcgcgggcctggtacctgacaggggagggtgcccggctggtgagggacttccccgcgctccggggccgtccgccgtatccgatcacctcggccacggctgcctcgttgaagacaccgcacaccctgaccgtggtccgcacccacctggcgttcgtcaccgatgcccgcaggcgtggggacgaacacggtcacctggactggacacccgaggtctcacacccgctcagcgacggcgagaagatcatcacggatgcggtgatgcactacaccctcatcggtgatgatcagcggacaaagctcagggcattcgtcgaggtcgaccgaacgaccatgagcagcgagcggctcgcgtcgaaattgatcgaatacgcgcggctgtggtcgtacgagccgcagcctgccagccggtcccgagcacgtcagccggccgttcccggtgccgtctggctgcgctggtatcccgtgtttccccgggtcctgttcgcgctcaccggagcctcccggtacgtactggacaaccggatctccgacctgcaggccatggtggcgcagcatccgctcgtgggcacgctggcccggcaggttccgatgggcgcggcggtcctggaagacctcgaagacaagggtcctacccgcaatgtctgggtgcctctggctggcggcaagccgcggccctggaccgagctg

SEQ ID NO: 183 - DNA, 858 bp, Streptomyces avermitilis
  CDS (1)..(858)
gtggatggtcacggagttgaccgcgaaagatcaagcctgctgacccggcgcctgtcattactcatcggcgccctcgtcctggccgcggcaggcaccgcgcacgccgacgacgaccccgatgtcggggcgggcaagtgccaggtcatcaagttctgcgtcggcgtcggcgtggacgacgagaccggcgggaagggcacccagacgggctcgcagggcagcagcggcagcaagacgcagtgcaagctgaccaaggtcaacccgaagccgccggccaaccatccggtctggaacggcgccgaccccaagaagagcgacctgtacttccgcgcttgcacggacggcggcgacggtttcgtcgtcgtaccgcagggccaacccgcaccccaggtggacccgcaggagctggcgcagcgcgcggtcgactcgatgacgctgctcggcccggacatcgccagcccgcgcggggccgggaagtacacggtcggtgtgccgacgtggatgtgggtcaaccagagtgccacgaccttcgggcccaacaccgcgtcggcctcggcgggcgggataaccgtcaccgctaccgcgaaggtctccaagatcgtgtggcagatgggcgacggcgcctccgtgacgtgcaacggcccgggcacgccgtaccaggcgtccgagggcatggcccagtcacctaactgcggacatgtgtattccaagagctcagctggtgcccgcagcggcaagtacccggtgaccgcgacgtcgacgtggacgatcgactggcagggcggcggagctgccggccagctcaccgagatccggcaaaccaacgtgcaggtggcgatcggcgagctgcaggtcgtcaga

SEQ ID NO: 184 - DNA, 702 bp, Streptomyces avermitilis
  CDS (1)..(702)
ttgagcaagtcccaagaacgattagcagccagccccaacggagtcccccagcagggacgagtatccggcgcggttgctcccccacgggtgtcggcccgcaggcgccggccgggtgtcatcgccctgtcgctggcgctgatcgccgctggaggggccggtgttgccgtcctgctgctccaggtcggccaccgcaccgaggtggtgaccgtggcccgcgatgtccaggtcggccaggtcctgagcgaagaggacctgggcaaggcttccatcgccctggacccggccgtcaaagcggtgcgtgccggtgacctggattcagtggtgggcaagcgggccgctgtggagctcaggcccggttccctgttggcgccgtcgcaggtgacggaggattccttggtgaaggccggcgagcagctggtgccgatcgggctcaagtcggaacaggtcccggccaccgcgctggtgccgggccagaaggtggagctggtccacgtcccggcgcagggcgtggaggacacgggcaagtcgtccggcctctctccgaggaccatcgccgggcgggtcgtgaaggcgtccggcgccgcccctggtagcggggttgtggtcgtcgatgtcgctacttctgcggatgacggtcccatcgccgctgcgtgggtgtcggctggcacgctgcgcctggtcctcgctgctccggacggtagc

SEQ ID NO: 185 - DNA, 825 bp, Streptomyces avermitilis
  CDS (1)..(825)
atggctgtgatcgcgctggccggctgcagcggcgcaccgggagtaaccacgagtgcgctggcgctgctgctgtcgtggccgctggagcagggccggaagatgatcctggctgagtgtgacccggacggcggggccgtgctgcacggtctgctgcagggcacgctcggcgaccggtacgggctgcggaacctgtcggtcgctgctcgcaagggcgagtccggtgacgctttctggcggcagctgatcgatttgtccagtgacgacggcaagcaggagtcgccgcgcgaccggctgttgctgccgggcatcaccgaccccgcgcaggcggcgagtctggtttcggtgtggaaggcgctggcggtggccttccgcggcatcgacgccagccaaggccatgacattctgatcgacctcggtcgcaccggggccttcgggccctccgcggtcttggccgagcaggctgacgcggtggtcgtggtggtgcgcaataccctgcgctccctgcaatccgcgcaggcccgggtggccgttctggagaagcgggtcggcgatgtcgggctcatcgtgatcaacgaagggccctaccccgctggcgaggtgcagcgggtgctgcaggtgccggtggtggcgacccttccgtatgcgccgaaggacgcccaggttctgtccgacggcgccgatcagccgcgccacttcaccaaatccgccctgatgaaggcctcccggacgtgtagtgccctgctggttcagcgggccgctgcgcggcgggcccgcctcgatccgcgggcagcgtttgttgggggcggggaggtgacccgtgcgcgg

SEQ ID NO: 186 - DNA, 1491 bp, Streptomyces avermitilis
  CDS (1)..(1491)
gtgcgcggtaagccgttgcatcccgatcccaccgtggccccgccacctggccgcccccagccggcctggcctcatcaggcgaatgggacggctgccggtgctgcctcgagtacgcacgcgctcggcaccgccacgcctcaggtcaccgtcgactaccaggtggcccggcatatcgccggccaggtcgccaagcagcgcgaggagttgctgaaggcgaagcctgatatggaccgggccagcgagcagcagcgttgcctggactggatcaacgaggcggtcgcgctgtggtcggactcggcggcgatggcgccgcaggaggatgaggcactgcggcgtgccgtctatgacctgctctttcgggccgggcggctgcagccgtatctggatgatgagcgggtcgaggacatcatcatccagggcccggacgaggtgtggctcgactacggcgacggtgagcgccggatggtcgggccgatcgcggagtcggaggacgaactgctggagttattaagggagttggcccggagttccgggcacaacgagcgcaccatctccacggcgaacccgaccctggccctgtccctgcaggacggctcccgtctgcaggcgatcaccgggctgggcccgatgacctatgcggtcatccgccggcaccgggtctcccacgccggtctcgacgacctggtgcggctgggcacgatcgacccgatcctgcgcgacttcctcggcgcgtgcgtgcgcgcggagaagaacatcatgatcgcggggaagcagaaggccgggaagaccaccttgctgcgggcgatgctcaaggagttcggcccggagtgccggtttgcgaccattcagaccgaggacgagctgttcgcccacgccaacggctaccaccggcaggtcgtctccctggtgggccgcgagtccaacggggagaaggacgtcaccgggcggggtgctggcgaggtcacgctgttggatctgatgcatcccgcgttgcggatgtcgctggagcggatcgtggtgggcgaggtccgcgggccggaagtcgtggcgatgatgcaggcgttgacgaacgggtcgggcggcaacctgtgcacgattcacgcccggcgcccggacatcatcttcgaccggatcgccgagctgtacgcgctcgctcaggacaacctgtccgagcagctcgcctaccggcagaccgccaacggcctggacttcatcgtgtacgtcgacatgaccgatgagacgcagatcggcggccgccgccaccgctacgtctcccacgtcctggagctgactgggatcggcgagaacggccgtcccgccaccaacacggtcttctcccccggagccgagttcggcgagctgcgcgcggtgccgaggatggatccgggctgcgtcgacgacctgcgccgcgtcggcttcgactccgcccagctgcaacagccctacggggcctggcaggcgccgctgcagctgaaggtgggggtgatccga

SEQ ID NO: 187 - DNA, 927 bp, Streptomyces avermitilis
  CDS (1)..(927)
atgaccctgttgtgggggttgttgagcggcatggccgtcatcggcgggctgatcggcgtggtggcaggcctcgtgggcacgacggcgccgcgccgggctccgttgcagcagcggtggcaggccctgcgcgccgggaaggaccagggcgaggacgtccggctgcgccgtcggaccctcgcggccttggcggtcgtggtcttcgtggccgtgtggctggtctcggggaattttgtgggcggcgcgctgctcggcgtggccgtggtcggcgtgccctggctgatcagcccggcgcagatggcgcaggaacgcatcggccagctggaggccctcagcgagtggacgcagcgcctggccggcctgctgcggctgggcatgggcctggaacaggcgatgatcaccagccgtcagggtgcaccggacgaacttgccccgcagatcgtcaatctgtccgaccggctgcgtctgggctggcggccggatggagcgctacgcgcgttcgccgaggaactgaacgacgtcaccgcggacaaggtggtcgccgcgctcatcctgtccgtcaacgaccgcggcccgggcctggcccaggcgctggaggacctggcgggaacggtccgcgacgaggtcgccaagaagcgcgccatcgaggcggaccgggcgaagccgcggaccaccgtgcggtggatgaccgtcatcaccgtgggtgtcgtggtggccgggttcttcgtgccgtcctataccaagccctactccacgctgctggggcagctcgtgctcgccttcctgaccgtcgggttcatcggggtgctcgccctgatgcggcagctgggtgccttccgccgcatcccgcgctttttgatcaccgacccgtccagcacagtccggctgcccctcgccggcgacggagccgggcgtgccggtcgctggccg

SEQ ID NO: 188 - DNA, 882 bp, Streptomyces avermitilis
  CDS (1)..(882)
gtgaacctgtttcccgtcgtcctgaccggtggcgcggtaggcgccggcctcgcgctgctggtgcgggaactgctgcgccctcaggccgcgttggggccggccctgcagcgcagtgccccggccaccctgaccatgcccgagccggagctggaccgcgaggaggtgtggggccgctggctgctggcccgcctcgagcgcctgcccggtgtgcggatccccacgatcaacctggccctgctggggcaggggcggggccagttcatgctgagaaagaccacgctcgccgcgctgggtctgctctgcccggtcattgcgacgattccgtggatcatcgcgggcgtctccctgccgttctacgttcccgccggcgtgggcctcctcatcgcgggactgctgttcatcacaccggatctcgcggtccgtgaccaagcgaagcgggcccgggaggagttcgcgcacgccctgtccgcctacctggaccttgtcgcgctcaagcgggccgccgacgccggccccgccgaggcgctggagaaggccgccgaggtcggcctcggctggcccttcctgtttctgcagggcgccctgcgacgggcccggatggagaagatcccgccctatcaggcgctgaccgaactcgccgccgagtacgacctgcccgtccttgacgacgtcgccgacatcatgcgcggatcggccacggacggcgccgccgtctacaaggcgctgcgcgctcgtaccgcagcgctcaactccgaactgctggccgatcaggccgcggaggcgaacgccgccagcgagaagatgaccgcccccggcgccttgctggcggtcctggtgatgctgctgatggcgttccccgcggtcatccgcatgctcaccgtc

SEQ ID NO: 189 - DNA, 213 bp, Streptomyces avermitilis
  CDS (1)..(213)
atgaagcacaccgcagcccgcacctaccgtgcggtgcactgggcgaccacgcgtctgcaggagggcctggaggaggccaagcgcaggccggaccgcggcgacatcagcaccaccaccgtcatcatctgggtggctgccgtcaccggcgctgtactgatcgccgggaccatcgccgtcgtgatctccaagtacaacggcaagctcactgggctg

SEQ ID NO: 190 - DNA, 426 bp, Streptomyces avermitilis
  CDS (1)..(426)
gtgatgtctcctccggcgcggctgaaggactggtggcagggacgacgatggggcgacgaccgcggtgacacctccatccagatggcgatcattttcccgttcgtgctgatcgccacggtggccgtcatccaggtctccatgtggtactacgcacggcagatcgccctgaccgctgctcgcgagggcctcaccgcggcccgcgcctacgagtcgggtccggccgacggtgcggcccaggcacgggaggtgctggggcgcgtcgcgggtgacagcctgcgcggctacagcgtgtccgccagcagcaacgggcagcgggtgcgggtacaggtctccggcacggccatgtcgatgatcccgggcgttccgggtctgcaggtcacccagtcggcgtccggtcccgtggagcgctggacggtcccgggaagg

SEQ ID NO: 191 - DNA, 459 bp, Streptomyces avermitilis
  CDS (1)..(459)
gtgaactacgtgcgatacatggcccgatgggctcgcaggcttcgcagcgatgagggcagcgccgcgatcgaggcggccatcatcctcccgtcgctgatcatgttcctgtggctggctatcgccggggggcgcctcgtcacctctggctcgaagatcgacgcggcagctgaagatgcggccagggaggcgtccattcaccgtacggcgggtgccgcccagagtgccgcgcacgcggcggccgccgagtcgctcaacgaccagggcatcacgtgcgcgtcgaccagcgtcagcgtcaacaccggcggcctcagcgtgccggtgggccaggtagggacggtcaccgtgaccgtgacctgcacggtcgatctgtcggatctcctgctgccgggcgtgcccggggcccggaccctcacgtcgacagccacctccgtagtggatcagtacaggcagcgaggtgac

SEQ ID NO: 192 - DNA, 450 bp, Streptomyces avermitilis
  CDS (1)..(450)
atgagcttccggcagacagggctgagccgggcacggtgggatgaccggggaggcgtcaccgtgttcgtcgccgtgtgcgtcctcgccctgatcggcatcatcggcgtcgccgtcgacggcggcagcaaaatgcgtgccaccgaacgcgccgactacatcgccggcgaggccgcccgggccggcgggcaggccatcgaccccgccgaggccatcagcggcacagcgatcgtcgtggacctgcaggatgcccaggccgcggcccaggcctacttacgctcggccggcgccaccggcacggtcagcgtgtccggcgacggcaagaccctcaacgtgaacgtcaccggctcgtacgacacgaagttcctgtcggtggtcgggatcggctcgttgtcagtgaccggccagggcaaagccaccctcctgcacggcgttaccgctcccgaaggaaac

SEQ ID NO: 193 - DNA, 3465 bp, Streptomyces avermitilis
  CDS (1)..(3465)
atgcgcaccacccactcccccgccacagcggccggccgcacgctgggccgggtcctcaaggccgtgctgagcctgctcgtcctggccgccgcggtcgccgggctgccgctgctgctggcctgggtcaccccggccatctgggcctccagccacgacgacctcacgcacttgctggaccggcaggatacgggggcggcgttcctgctgctgctcgtcgcggtgggctggatcgggtgggcgcagtttgcgttctgcgccgtacgcgagctgatcgcgcaggtggggggccggagctggcaggccccgcgcagacttggcgcctcgcagcgtgccgcggctctcctggtcggcagcatcctggtgctgctgcccacgagttcggccctggcctccgacgcccacgcctcaccggccaccaccgaggcccgcgtccccggccaggccccagccccgcagaccgccgagcccgaccagaccttgccggactccgcaagcacaccggcgtcccgtacttcgtacacggtccgcgcgacgcgtcccgcacagagcctgtggggcatcgccgaaagggagttgggcgacggagagcggtggcgggagatcgccgccctgaacgagggccgaaccatggtcgacggccaggtctttcgcgcgcacggctttctgcagcccggctggcagctggagatgcctgataccgccgctgccgcgggaggcatccgtacacagctgggcagggccgctcccactgctgaaggaaaaaatgagcacgttgtcacggtccactccggcgactacctgtcgaagatcgcggaagaagagctcggcgacggcggcgagtggccacgcctgttcaaggccagccggggcaagacgcagccggacggcctgcccgccatctccgacccggatgtgatctacgcggggcagcaggtcactgtgcccggcgcccagcccgacccgcacacgccgccacgggacggcgacaacggcgatgaggcgggcagccaggagaccactcccccagccacccaaaagcctgatggcaagcaaaagccgggcgatgacaggagagatgagcaggcaccagcaccgggcaccaccacagcgcccgcgccagagtcatcggcccccagcaccccagccagccgtcccgccgagcaaccggggcaggaacagggctctccttccgcgacggcgtccgcgacgccgcggcccggcaccagccccgcaccctctgccgccgccccgtcggccacggccgaggcgccgggctccgctgactcctcccccgccaccacggcgtccgagacgccgccaccggcaccggcaccggcaccggccagcagtccgctgaacctgcgcactgttctcggtgccggcacgctgctggcggccgccatcaccggcgctcttgccctgcgcaggacgctgcagcgccgccgccgcacgcctggtgagaagatcgccatcgcatcagagacctctcccgccgaggcgaagttggcggcggccgccgaaccgggcggcgctgcccgcctggacgtggccctacggaccctggcccaccaggtggcccacgaaaaggctgcggatctgcccccgatacgggccgcgcggatcggcacccgcacagtggaggtactgcccgagggcctcgcccgcaagccgcaggcgcccttcgtggctgggcaggccggctggtgggtgctgcccgccgaagcagtcctcctggacgaggagaccgcccgcgaggtaccggcgccgtatccgggactggtcacaatcggcagcaccgagtcgggtgacctcctgctgctcaacctcccccaggtggccgccctgttgctggacggcaacccggtacacatcaccgaggtgtgcacgtcgctcgccctggagctcgggatgagcccgtgggcgagcgaggccgagatcgtgaccatcgggttcggcgaggacctgccgcagctgctgcccacgtcccggatcgcacacatgcgccacgccaggcacgcactgcgggacctgagcgaacggctgctggaagcgcaccagatgcccgaaaccagtcatcagccgtacctgctgctgtgtgcgtccacgctggacgccgatctggcctggcagttcgccgacataatcgacaaggcccaacacgttcccgtcaccctcatcgcccccgcaagcgctgcggccgcgtccttccccgacgccgaaatcctcaacgcctcactcagcaagccccagcaattcgactacatcggctctgagatcacggtgcagcgtctggagcatgccgcctacctgcagatcaccaccgcgctcgccatctccgcgcaacccgccgacccagccgagggaccatgggaagaggtaccgcacgagccggacaccccgcagcgcccccgtccactggacttggccaaacccacacagtctggcgacggcgagaaacccgtgccggcgtccccgttcaccgcgggcaccggtgacagcgagatctacccggcactgctggccgcgtccaccgaccccgccagcctgaagctgctgcccgacccgaaagcgcctggcaaggcccctgccgaacccgggacggaacccgccgaaatgacgcccgacggacgggcaccgcagaaggcagcggaggcaaccggccgcccgcaggagaccccggcagccgaggccgtcggcgaagatacccaggcgcaggacctgcacgcgccggagatccgggtcctgggccccgtggaagtgaccggcgtggccaccaccggccacggcccgagccaggcacggctggccgccttgctgtacttccggccgggccgcagcgccgacgtgctgtgcgccgacatggacccggtcagcccctggtccacagccacactcaacgcccgcctgcaaggcctgcgccgcgccctgggaaacgacccggccggcaacgcgtacgtgcccaggcgccggtccggcgacgacccttacgagctgtccgaagccgtccgctgcgactgggcacggttcacccagctcgcccagcgcgccctgccccaaggcacagccggactgccggacctggaaaaggcactcggcctcatccgcggccggcccttcgggacccgcccactgccgtgggccgagccctaccagcaggaaatgagcacccgcatcatcgatgtcgcccacaccgtggccacctaccgcacacccacaggcccgcaccacgacctgaccgccgccaggcaggccatcgcaaccggtctcgacgtcgacgacagcgcagagctgctgtatcgggactggatgcgcatcgagcacgcggccgggaaccgggccggactgcacaccgcgatcacccgaatccaggacatcaaccgcaagatcgactgctccctggaaaacgagaccgagcagctcatcaacgacctcctgggccccaccggcggacgggcacgtggccga

SEQ ID NO: 194 - DNA, 1827 bp, Streptomyces avermitilis
  CDS (1)..(1827)
atgaagtcaggagcagatagcggccagcagcccgtgaagacagcttctcaaaaccagctgctgtgccttggccgggcacaacgcctcgtgatctccgccgtcgttctcggcgggctcaccatcagcggtatcggcttcgctggctcgtacacggccgtccgcgcactcgccctcaagaaaggcttcgggaacttcagctatgtcttcccgatcggcatcgacgcaggcatctgcgtcctgctcgccatggacctgctcctcacctggatccgcatcccgttcccgctgctgcgccagacggcgtggctgctgacggcagcgacgatcgcgtacaacggcgcggcagcctggccggaccccctgggcaccgccatgcacgcagtgatccccatcctcttcgtggtcgcggtggaggcagcccggcacgcgatcggccagatcgccgacatcacggccgacaagcacatggaaggcatacgcatcacccgctggctcctctcccccctccccaccttcctgctctggcgccgcatgaagctgtgggagctgcgctcctacgagcaggtcatcaagctggagcaggaacgtctcgtctaccaagcccgcctccacacccgcttcggccgcgcctggcgccgcaaggcccccgtggagtcgctgatgccgctgcgcctggcccgctacggcgtcccactaacccagactgcgcccacgggcctcgcggcagccggcatcgaaccggtgctgctgcctccggcaccacagccacagccacaggccgaaccggcagacacagtcggccgtgggacgggacaggtcaccgcagcagccctgggaaaccagcccgctgccgccaccggtggcgaatacatccaggcactcccaacggatgaaaacacaaggcccgcgacaccccccaaggccggagaccccagctacccctgcgaccccagccatgcaccgcggaagcaatacgaacgggaccgaacagcccagcagccagccggcaagccgaaccccaccgtggtacccgaccacgacgattcctcgcaaccggaagccagcgacacacctgagacgccacaccacgaagaagctttagacgaggaggagtcccgtgcccgggaacacagccgactctcccctacctacggataccggctggcctccgctcatggcccactaccaagccagtacgtcctggaccaccacgaggtgaccaaccctgaaggacatcccccgtcccttgaggaaccggacacttccctagacagtcttctgccacagcagcccagggattcgcgccgcgacgacggccgctccccagagccggcggcaaccagccctgtacgcggcacaagaagcgaaccaggacgcaccccccgtgcaaccccttctgcagagcaccgcgctcacagcccggaacctgcactcgaggagacccccgacgcggaggccggggactcatcactccctgacctcaccgcagttgaccactactacctggcctggaacgacttccagcaacagcacggcaaggaaccaaacggcaccgaactatccgcccacctcgcccaacgcggcatacacgaccgcgaaaatcaccccatcaaacccaaaacgctcacccgctacttcctcgaattccggatctacgacgcttgggccacccaccgcgcccgcacctcccgcacggacagcgaacccgtcctcaacgaccttgcctaccaaggcatcacagctcagtacaaccggcccatccaaacaaccgacctcgaaaaacgcctcccaggattcgaacgccgctggcacgcactcagctgccac

SEQ ID NO: 195 - DNA, 552 bp, Streptomyces avermitilis
  CDS (1)..(552)
gtgaccgtcaacgtgaggcactacggggctgcggatctggacgagatccgcgagaccatactcgatctccacgtcgaagtacgacaccgggactttgggctcaccggcccgttctacgaccgcgaccgcttcaacgagcggctgtctgcctacgctgcacgtccgggctggtccgcagctctgggatacgaggacgggcagccagtcggcttctgcttcggcaccgccctggcaccggacacgaaatggtgggactcgatgaaggaaccccttcctgccgagaccacccacgaggatggccaccgcaccgtctccctcaacgagattgtggtgcgcaagtcgtggaggggacgctccgtcgcctggcagctccacgaggcgtggctccacggccgaacagaggagcgagtgacgcttttggtcaaccccgcggccggtaacggggcagtgcaggcccggtacgaggcctgggggtatcgctccatcggtctgcagcagccgttcccggactctcccgtgttcgcggtgatgctccgaccgacgaagctcgac

SEQ ID NO: 196 - DNA, 1434 bp, Streptomyces avermitilis
  CDS (1)..(1434)
gtgcagcggcaccgggcacttgacgctcagcgccgttgctctgcctcgttagtcaacgggcgactacgcgcagggcaaaggaaaaagcggagagggcccgtcggcctcggaccggaaatttttaccttcggagggccggagtccggggtagaggactaccgtggggccgtgacggcgaacgtcaatctcgcagcagctatggagcggtctggactaagtcagggggagttagcaagccgtctgaaccagcggatcgaggcgttgaccgggaaactcggcgcgctgtccgatcggcacgtccgacactggctcgccgggaaaactcgctggccgcataagagacaacggatcgtcctcgaagcagagttcggagtgagcgcggaggaactgggcttcatacctccccctcgtcgtacccctgcactatcggaggatgatgacgtgcgtcgacgcgccttcaccacggcgaccgcatccctcacggccgccgctttacggcccgcccatctgtccagtggtgcttcccgcgttgggatggtcgacgccaaccggctggaagagaactttgctcgcttggtggccgcggacgccgcgacgggtctcaccgtcggcctagagacccgggccgtcgcccatgcccagcacgctttagacctcatggccatcggccacgccagcgagcgcgttcgccgacgcctgtacttcctcgccgccgccttcatgggcaccgccctgtgggcggccctggaccggatggagaccgcgcgcgcgggacggcacctcgaccgaggcctgcgccttgcgcggctctccggcgatgccgggatggagatgcggatgtggggccacgccgccctgcttcacctccagcagcggcagttccctgacgccctcgccgcggcgcagatgggccgggagactcaggtgtgccgccgcgacccgcttttccggtccttggccgccgcccgtctggctggtgtgcagtcgggagctggagagcgtgctgcagccgtgcgaaccctcggccaggcagaggtcgcgtacgagcgcgccaccccagagcagctccgcccggcctacatggacttctacgaccgggccgaattcgaggggttggccggcctcgtaatgatgcggctgggccggaacgaggagtccgaagcccacctacaccgcgcgctgtccggcctgcggcctgactatcaccgcaaccgcgtctactacacggtcctcttggcgacgacacaacttcggcaaggggacgcagacgcagcatgcgctaccgcgctgacgaaattgccagacgaccctgattcactgtcagggcgcaccaaggccctgttcgcgcgtttcgaccaggatctgaccactgaggcggccggagcacacttcgtgaccgagtgggccgaccgttattcccgaggaggaattgcg

SEQ ID NO: 197 - DNA, 1818 bp, Streptomyces avermitilis
  CDS (1)..(1818)
atgacatcgactgcgctcgacgcactgacgagcgccatccctcgctccgtgcgtacaggccacgaggtgtccatcgaacgcgatcccgcttcgatgccgggacacctcacgaaggcagactccgtctggcccggtcggctccgtcgcattatccgggccggtctgaagctctggaaccagccggccctggtcgagaccgcggaactcctcacgacagagctggtcacgaacgctttccgccacggcagcggtaccgacatcggctttcgcttgctcatcagtggcgatcacgtcgtcatcgaggtccgggatggctctccggatcggcccgtcctgcgccgcgcgtcccctgaggacgaggacggccgcggtctcgcccttgtcagcgccatggccgacgaatggggcacgacctccgacggcacgacgacctggtgcaccctccctctccgcaaaggatctgaccacccgatgcaacgcaccgccacacccgtaccgtcgttacgcgagtaccccgccattcaactccccggaaaccccaacacggtcactcgagcacgcacgatcgcccgatctggactcaccgtcctcgactggcagggagacgttcacgctgccacagaggtggtagcgatccggcgaacaccccagcctgcgaccctgcttactgaggaagcgaaagggacagtgatggactggcgaacgcgggccatgcgcctggccggcgaggtcgtccgaccggagtcacgctggcacgaaccggtagccaccgtgccgcggcacgagttcgtgccgcgctggtggcagagcgacggtgacgcctggttactgcgtgacggcccggctgccccggatgcctggcttgaggcggcctacaccgatcagacgctcgtgacccgcgtcgacgcgtgccccgccgatcatgccgcccctggcgccatggccagtggaacgccgacgtcatcgtccacgctgcccagcttggtcgtgcggatgtaccggcacgcgatgatcgccgaaaattccgatgtgctggtgaccaccggtaccggctacggaaccgccctcgcctgcgcccggctcggccatgcccgggtcacgagcatcgacgtggacgccgacctggtgaaggcggcctcggaccggctcgtgctggtggcggggtaccggccacagatggctgttggcgacatcaccggtgaactgcccggcgcctacgaccggatcatcgccacggtgtcggtgcggcccgtgcccgtttcctggctgtccgctctccggccgggtgggaggctggtgacgaccatcgccggtacggggctgatcctggccgccgacaagaccaacgaaggcggcgctacaggccgtatcgaatgggaccgggccgggttcatgccgactcgccacggcgccgactacgggccgcccgcagacgacgtgtggcaggaggcggcagaggcagacggagaggacgtcatcaccagccgctacccgctgctatacccgccggatgcatgggacgtgatgtcgatgctcgagctccagatccccggcatcacgtaccggcgcagcatggacggtggcaaccgcaccgtgtggctgctgcaccccgacggctcatgggcccgcgccacagcccgcgggttcctcgactcgccgaccgtgcaccaaggcggcccgcgccggctgtggagcgacctggaccgcatccgcaaccggctcaaccgcgagggcgccctgcccgtgtacggagcccaggtcaccatcacgccggatggaacaaccaccctgacacgcggctcctggtccttcaccctc

SEQ ID NO: 198 - DNA, 987 bp, Streptomyces avermitilis
  CDS (1)..(987)
atgacccgcgatgacacgcccctgatcactcaccttgcgggccgtgacgaagaactccgcctcgctctcgaagatctcgggctggaccggtatctcgccgcaaagcgcctgcttcgggccacgggtaccgactgggggctgcgcacctcgcgcagtcaggtcctggccgtcgtcgccgccaacagccgtgcgatcgagtcgtggtgctcggaggagcccgaggacgtggacgcgaggatgatgtgggctcgcgtgctcacccagaggctactcaacgctcaccgcaggggactgtcgggtcaggacctggtcaacggtgtccacacagtctgggcggcgtgcagggctgctgcggagcggtggcccgaagacccggtgccctacgtgtgctacctggcgctggcgcagacggacatcgaccagcggtttcctcacagtccggtgcactgggccacgccggccgatgccatgctgccgccgggtccgtggagattgctgaactgggtcaaccagcgggatcccggcagccgggaggcgtatcaccggatgctccaggtctttcaggcccgcgcccggggagccctggattttgcccagtgggtagcctccgtcgcaccggagggatcggcgctgaaggttttgccgctgtacgcctacgtcgagtcctaccggctgcttcggcagcgttcgcagagcgtcggtgtgatcgcttactgggccaccgaggacaaggctcactacgcccgtcaggccctgtacggctggttcgcccacgccgatccgcgctcactgtccctgctggacctgaactacctggcgcacggactgaccgccaccggcgtgggacaggccactgccgtgttcgaggagatcggcaaccacgtcacgcccgccccgtggatccacgtcaccccgaacccccagtggtggcaggacgatttccgttccgcacgccgcagagcgctgacggctacaagcgggcgccga

SEQ ID NO: 199 - DNA, 1506 bp, Streptomyces avermitilis
  CDS (1)..(1506)
ttgtctgcgagaagaaccagagtccagctcgacgatgacgccgcgctgcgcgcgcacggctaccaccccgaactggcccgccggatgggcgggttcgggaacttcgccatcagcttctccgtgatctgcatcctggccggcggcatgaccttattcggctacggcctgaacaccggcggccccgccgtcatgatgtggggctgggtcggtatcggcttcatgacgctgctgctgggcatgtgcctggccgaggtgacctccgcctaccccacctcgggcggcctgtattacatggctcaccggctcggcgggccccgctgggcctgggtgacgggctggctcaacctgctgggcctgctcggcgcaatcgccggcatcgactacggctgcgccctgttcatcggcgcgttcgccagcctccagtgggaccttgtgcccacacccgagacaacgatcctgatcttcgcgggcatcctgctcctgcacggcactttgaacgcgctcggcgtgcgcctggtcaacgtcctcaacagcatctcggtgtggtggcagatctccggcgtcctgctgatcggagggaccctgaccctcgccccggccgagcaccagagcgccggcttcgtgttcggccacttccacaacgccaccggcttcaccagccccgtctacgtggccgccctcggctgcctgctggccgcctacacgttctgcggctacgacgcctcctcccacctctccgaggagaccagccaggcacaggtgtcggcgcccaagggcatcgtccgcagcatcggctactcatggatcgccgggttcatcctgctggcaggcatgctgttcgccgtccaggactacaccggcacccagggctcgagcacaggcgtgccaccggcgcagatcttcatcgatgtcctgggcacgggtgtggccaaggggctgctgatggtagtgatcgtggcacagctgttctgcggaaacgcggaaaccgccgcggcctcccgcatggtgtttgcgttctcgcgggacggggctctgccgttctcctcgacgtggcggcgtgtcacccatcgcacccgcacccccatcgccgcggtgtggctgtccgtgggcgtcgcgctggtcctggcgctgccgagcttgtattcgccggccgcgtacgccgccgtcaccgcgatcaacgtcatcgggatcacgcctgcgtacgtgatccccgtctacctgcgcctgcgtgccggtgaccgcttccaggcgggcccgtggaaccttggtggctggagcaagcccctcggctggatctccgtcacctacgtggctgttctgaccgtcgtgttctgcctgccgcaggcctcgcccgtcaccgcacagtccttcaactacgcgggcctcgcgctggcggtggtcctgctcctcgcgtgggccatgtggatcaccaagggcaagcggcactacaagatccccccgctcggcagtgcggccgagaacacggcactcgccggtgaggtgatg

SEQ ID NO: 200 - DNA, 918 bp, Streptomyces avermitilis
  CDS (1)..(918)
gtgatgtccggccagatcagccaccacctctcccccacccccgcccccgggctggtgacactcgaagagctcggccacctcgttcaaggccgtgagatcgacacggtgatggtcgccgtcccggacctgaggggccggctgatgggcaagaacctcgacgcccaccacttcctgaccaagctgcccggcggaccggagatgtgcgcctacatcctggcgacagacgtggacatgaacccgctggacgggttcgaactcgccggctggcacaccggatacggagacctgcgtgtcgtccccgacctgggcaccatccggcgcctgaactacctgccaggcacggtcctcgtacacggcaacgccgtacaccccgacggccgccccgtcgccgtcgcaccacgggagatcctccgcagccaactgcgggccctcgccgtccacggcctgcaggcacgcgtcggcatcgagagcgaattcgtcctctacaaaggcaccgaagcacagctgcgccgatccgggttcaggaacccgacacccgtgtcccccgacaacctcgactacgcgctggaccgcccgcccgccctgaacgcgttcttccacgacctgcacaacgccctgcacgaagcaggcgcaccaatcgaggccatcaaaacggaaggagccccaggccagatcgaagtggcctggccctacgggacacccccgtgggcgcatgcgacacctacaccctccacaaacacgccgtccgtcacatcgccgcacaacaccgcctcacacccacgttcatggccgccccgcagaccggcaccggatccggcctccacctgcacatctccctgtggcgcgacgacgaggcggccttcgccatgcgtccacgcgaggagctgcccgagctactccagcactccattgccgggc

SEQ ID NO: 201 - DNA, 7158 bp, Streptomyces avermitilis
  CDS (1)..(7158)
ttgggctgtgacccgtgtgggatgcgggccactggggtgggagttcgagtggctgctcggcgtacgcgttttctttcggctggtgttgcaggtgcagtgctggcgggtctgctgtcgacgatgtcggtggttgcaccgcagcaggcgtttgcgacggcggatgatccgacgccggtcgtgccgtcgcagtcgctggggtccgttcccgcgcagcaggcggaagaagtgggtaaggcgctccctgacccgaagtggcccaacgctgccgaggcgacggtggatctgtcgcaggcagcgcccggggatcccggcacggtgaccccgtcgccgactaccacgggcagcgagaacagcactcaggtcggtgacgtcgtggacgttgctccggctccggatcctgtgggcgccaccacgcagctgtcggcgcaacggcgtgcggacggcgacgtctcaccgagccctagcgcctccagtagcactgacgcaagcacctcgccaagccccgaggccagcactagttcctcaccacagcccccggattctgtcacgtccgagcccgaccaggacccggtgtcgccggatcaggtccaggtgcgagtactggaccatcagaccgtagagccggcgggcgggatcggtcttgggttgcaggtgaaccggaccgacggggtgaatgccccggggcaggtgcaagtcgatgtcgactactcgggtttccagtacgcctacggtgccgacttcgcctcgcgtcttcgactggtgaaactgcccgcgtgtgcgttgcagaccccggaggcggagggctgcaccgatcgcgagttcgtgccggtggataacgacaccgcgacagggaccctgactgccacggtcaccgcggccgcggacacggaagtctcgggtgcctcaacccagctgatgcgcgaggccagtgcgagcggcgcgagtgtgtacacgctagcgtcggggtcatcgtcggatgccggtgactaccgggcgtcgacgctgtcgccgaccggttcgtgggaggtgtccactggttcaggtgcgttcacctacaacgtgcccatccagctgccgaagccgccgatgggctcagcgccgtcgctgtcactgtcgtacaactcgcagtcggtcgacggccgtacctccgcctcgaacaaccaggcatcctgggcgggcatgggctgggacctcaacgttggctacatcgagcgccgctaccgcaactgctccgaggacggcctgccgaccatcggcgacatgtgctgggactctccgaactcggccaaggaaccgtccggcgcggtctacgtcatcaacctcaacggtgtcacctcggagctgatccaggacaacaccggtagcggcgcctaccacctcaagaatgatccgggctggcgcgtgcagcgcctgttcgatgggtatggcgcgggccgggacggcgagtactgggtgatctccacccaggacgggcagcgctactacttcggctggggccgctctgagcgcaccggtaccgctaccgcctcggtcttcactgagccggtggtcggcaatgacacgggcgaaccgtgccatgaccagttcccggagccgtgcactcaggcctggcgctggagcctggatagggcggtggatgccaacgaggtcgagaccatgtacttctatgacaaggagtacaaccactaccgttccgtcgccaactccgacaaggcccgcgagtacgtctccagtggctatgtgaaggagatccagtacggctggtcctcgcagatccccgacggcaagctgccggcgaaggtcgaactcagccacgtcaaccggtgcatcgagcgcgtacaggaaaatgatcccctccgcgacgaacccgccacctgccccaccttcgacgacaaaccgacctcgtatccggacgtgccggtcgacctgatgtgtgacggcacatcggccgactacaactgcgcgggcaagacgtactacccgacgttcttctccacggacatgctgtgggacgtcaagacgtacgtcagcgaccaggacggcacgggctgggacctggtcgagcagtaccagaacaaatacggcatgcccaaccccgacggcacgatcggcaagaccctctggctcgactacatccagcgcaagacctacggcgacggcgacgacatcgtcttgccggtcatcaacttcaaccggaccgacctcgacaacaaggtcggctccgcagaactgaacttcccccgcatccaggagatccacggcgacctcggcgccaccactaaggtctcctacggcttcgccaacgcctgcgacatcgaccacctgccgacccaggcctccaacacacaggactgctactggcagaagtggaccccggaaggggagacggagtcgaaaaccggctggttcaagaaattcctggtgaccaaggtcgaagtcgacccgaccgtcacgaccaaccaggacggcgcgccagtgatgaccacctcgtacacctacgagggcggggcaggctggcgcttcaccggtgatccgctggtcaaggacgaggacgagtcctggtccgactggcgcggctaccaggagacgcaggtcaccaccggcgcggacactgggcagaagaccaagaagtactggctctaccgaggcctggacggagaccgtacctccaagacggacacgtcggcgacgaagacagtcacggtcaatgatggtgacggaaacaactacgccgaccacgcctggctggccggccacaccctctcgacatcgctgcgcgatgacactgacatctcgcacgagcgcacctaccacacgtactggagccacaacaccgcccagtacgacggcctgcccgacgcccacttcgtgcgcgaatccaagtccaccaccaacaccaagatcagcggcggctggcgcgagcacgtcgtagagaacgagtacgacgacagcgaggcagcttccaccacgttcggcctgcccatgcgcaccgacgactggggccagagcaatgtctccgacaaccgttgcaccacctacgggcgtgcctacaacactgacaattacgactccaccggcgcccagcgctggaccgtagtgcaagaccaggtcaagcactactccgtgggctgctccagcatcgccgacagcaaccaggacggctacacctccaccctctacgacaacgccaccagcatcgacgccaacaagccggtcgacggcaacgcgaccgaggtccgcacgtacacgaaggcgggcagataccgctccagctggaccggctacgacaaggcgggccgcatcgtctggagcgaggacggcaaacacaaccgcagcaccatcacctacagcccagccaacacatggccgatgaatggcatcacctccaccagcccggacccggatggcaccgcgacggcccgcggccccctcaccttcaccgagtggacgtcccggttctgggccacgccgaccaccagcaaagacgccaacggcaacatcaccaaagtcacactcgacgcagccggacgccccgtagaggtgtggaagccgacggagaccggcagctcaccgtcgatgaagttcagctacaccatccccacctccaccaacagcgccggagtcccggactcggccgacggctacccccacgtagcctcacacaccctgcagtccggaagtacctatctggtctcccatgcctacaccgacggtctgggccgggcccgggaaacgcagacgcctctgccatccgacgtggaccctgcgaccaaacagatcgtgccgttccgacaggtcgccgtcacccgctacgactcggccggacaagtcaccggcgcctccgcggtcttccgtaaccagggaacggctggctccggcggcccctcaagcccgcagccctccgacctgccctcctacagcgacctggtcctggactgggccggccgcaccgtgtcctcgcagatccaggtcaagggcacaccccaaaaggcagggcgggtcgacacctcctacctgggcgactacaccagcgtgacaccggtcgacagcacagcgaccgacacctacaccgacgtgtacggacaggtgtccaaagtcgtcgagcacaccgcgagctcggcttacaccaccgcgtacggctacaccgccaagggcgaactcgctcagatcaccgatccccgcggcaacaacaccctgtacacctacgactgggccgcacagcgcaagaccaccgacgacccggacgccggcctctccagcagcgagtacaacgagaacggccaagtcagccagaccaccgccaccaccaacgacgtccagaccgtcctcacctacggctacgacaacctgagccgcgcgacatctgtcaggagcggcgccgacgaactggccgcctgggtctgggacgaccccgcagccaccggcggcaagggacagatcacctccgcggtcagccgcgatgcgagcggcaacacctacaccaccaagaccggcaagttcgacgagcgcggccgaccactgaacaccacggtcacgctgccgaccactgtcaacggcctcgcaggcgactacaccacatcggtcacctacgacgcagccgaccacatcacctcggtttcctaccccgcggccggcaagctcgccgcggagaaggtgaccaccacttacgacgactacgggcagcccacccgtcttaccagcagcctgggcggcacggcctacatcgacaacacgacctacgacgcctatggccgactggtagaacgtgactacggggccgagttcggcggcaacggcatccaggcccagcggcagtacggctacgacgacagcaacggcacccgctggctgaggtccatcgccacaaccaccacgatcaacgacctggtcagcgaggcacagaaggacacctacctctacgacaacaccggcaagctcaccgaactgcgcgaacaggccagcggacagactgcccagtcacagtgcctccgttacgacgaccagtcccgcctcaccctcgcctacacccacaccactgccggcaactgcgccgacaccacaaagaccacctctgacttcaagggcacctccccctaccagaccggctacacctacgaccgcctcggcaatctccagtcggtcaccgacaccaactcggccggtgcggcgaccacccgcgactacctctaccccggatacgacgacgccggtacttggaccactgccaacgccgaccagccccacggtgtccgcaaaatcaacaaagtcagcgcaggtaccaccacggcagcgggtacatacacgtattacgccgacggggcgatgaagcagcgcgtcgaaggcagtacgacaactgactacacctggagccggctcggccgactcgccacggtcaaaaccaccaagaccagcggcagcgacctcacccgctacacctacgacgccagcggcaacctcctcgtccgcaccaccccgcaggaaaccgtcgcctccatcggcggcacagaactgcgcaccaccgacggcatcagcgccaccgcgacgcgctactacagcttcggcgcaacaaccgtcgccatgcgcaccaccgacggcaacaacaccgtcaacggcaagatcacctacctgatgggagacacgcaagcctccacccagatcgccgtcgacgccgccacgggcaccgcaacccgccgcaggtacacccccttcggtgacgaacgcagtggcagcctgccgaccggcaccaaccacggcttcctcggcaaaacagaggacaccaacaccggcctgtccctcctcggcgctcgcgcctacgaccccagcctcggacgcttcctcagccccgaccccctcagcacgccctacgacccgcagaacctctctgcctacagctacagcggcaacgatcccatcaattactccgacccgtccgggctgatcaagctgaattcggacggcacgcaatgcagcgacggatggcagaagtgcggaccaggcactgtcggaggcggtggggacacccccacacccgctcccacggtccaagaccagcttgtcgatctgcttccgcgagaagaaaacggctgggacgcagaccgcttggcccaggtatgggtgcactacggccaaacgacacagggcggcggctactgggatgccccggtcggcgacggagaccggaccggcatggcgtgtttcggccgcaccgcctgctccgaggccttccgcgtctggaaggagacccacgacttcgcaaaagcgaagagagtcgcagccaccttctgcgtagagaacccaaagcgctgcggtgccgacaacggcgcctatgactccatgaaggaagcatccgaagcagtacccattttgctcgctggcgaaatgggtgccgcattcagcaaggtcctcaaggcccgcggatgcagcttcaaaccgaccacccgcgtgttgatgaaggacgggaagaccaaaccccttggcaaaattaagcctggggacctagtcgaggccgcagacccaacatccggacaccatagagaagtcagggaagtcaccgcggttcacctcaaccacgacgacgaccttgttgatctgagcatccgaggccttgacggacgaatccaaaccctgcacaccactgcgcgccaccggatctgggacgacacggcgcaggtttgggagcaagccgggcggctgatcacgggccacaaggtcaacacttcaggcaaccagcacgccacaatcacctctgtgcttgctcagcgcggtgcagcagacatgtacgacctcaccgtcgaaggccttcacacgtactatgtgctggcgggcgagactccggtcctcgttcacaacggcagctgttggagctccaccaacaggaagacgtccgtcaagaacgccttcgggcactggaagaagcacaagtcagaattcccgaacctcaataacgcgaaagaatacgtggaggcgggtaccgatttcctgcgcagcaccgatccaagcgtactgacgcgaacgcgagcgaacggggatgtgattcgcttcaatccagccacggatgagttcggcgtcatggatccatcaggggtgccgcgcacgtacttcaagccagaccctgcatctcacgggtacccgacgaatctggactacttcaatgcccag

SEQ ID NO: 202 - DNA, 243 bp, Streptomyces avermitilis
  CDS (1)..(243)
gtgcacgagcgcgtactgacagacgtggacccgatccaagaaacgcatctgtccgaacccggcctgctcgtgatcgacgtagcgggcatggacgacgaaaccgtgctcgccttccagaacgcgatcgcccaaacgtgggcgacctcgactgccgaccgcaccacccaggatccgggccagcccggcgtgcggctgcgtctgtacgccgatctgcggcaggtccttgccccaacctccccgccg

SEQ ID NO: 203 - DNA, 801 bp, Streptomyces avermitilis
  CDS (1)..(801)
gtgaggagcggccgggcgtcagcggggagggagatcgtgagcatggtggggggccagtggcggggagtcgtcgaacggcttgcgcagcaactcggcgaagcccaggcggccggccggcgtgtgaaagaggcgaaggcgaccgcggctcgccagagcccgagcagcaccggccttgaacgcgccgagtaccagcgccggctgcgcgcgtatgtacagacccccgagcacaaggcggcgggccacgccatcagggtcgccgtggctctgatgaaggcgcacgacgctgccctgctgcgttcggcacacacactgcttgcccggcgcgccaacggaaagcgcccaccccggcggttgccgcggccgcttgtactgcccggcggttatgcgtctcagtggtggatcagcagcatcgactccacgtacgcgggcatctggcgggcgatcccgtcccccggaccggagctccggctcggcagcacgaatgacccgctggtgcaggaggtcgccaagcaggcacgtctgctgcaggccagccacgtgggataccgagggcgcgacgacctgtacgaggctttccaccccgacggcacgcgcgagggcggcgagccggtagcgccgatccgcggcctgagccaggagacgagccgccgcgccaacctcgcactcggccgcggtaatggcatacgcatccagccctcccggatggaggaggccggtcagatgcacaccgactacttcgccgtctgggaccgatcccgcgcgtacgcggccgccgtgctcgccctgctgcgggcccgcgcg

SEQ ID NO: 204 - DNA, 423 bp, Streptomyces avermitilis
  CDS (1)..(423)
atgtcgctgaagaagatcaacaccgtcctggccgccgccttcatcctcttcatcctctggttcggggcggagttcatcctgagcccggagacgacggcaccgggcttcggcctgccgagctggccgtccggcgacggcgacggcttcctgatcatcaagggaatccgcgacgtcgtcttggccctggtcctgggcatcctgctggtgacgggccaccgccgggcgctgggctgggcgctgctggtggaggccctcgccgcgtacggcgacatgaccgccgtgctggcccaccacggctccgtggccaccgcgctcggcgtccactgcctgaccgcgacactgatggtggtcaacggcctgctgataatgcgtgagacccgcaaggtcgcggccgctccggcgacgcccgcccctcagcccgcc

SEQ ID NO: 205 - DNA, 576 bp, Streptomyces avermitilis
  CDS (1)..(576)
atgtcggtacaggaacgcaagcagcgcgaacgggcggagcgcgagcgcctcatcgtggcgacggcccgcgaactcgccgagcagcagggctgggacgcggtcaccacccgccggctcgccgagcgcatcgagtacagccagcccgtcctctacagccacttccgcggcaagcgcgagatcatcggcgccgtcgccctggagggcgctgccgagatggccgtggcggtgcgggccgcggcctccagcgcggacggcccgcgcgagcgggtcgccgccctcgcccgtgcctacctcgacttcgccgcacgcaacccggcggtctacgacgccttgttccagctcgacggcggcctggcgtacgcgcaggaggacaccccggaacctctcaaggacgccttcgccgcgctgctggagagcctcggcgaggtcgccgggaacggcgtccacccggggctgttcaccgagacgttctgggcggccctgcacggcctggcgaccctgacccgggcgggacggctgccgccggaggacaccgagccgagggtggagctgctggtggaccggctcgccatgctc

SEQ ID NO: 206 - DNA, 1974 bp, Streptomyces avermitilis
  CDS (1)..(1974)
atgcccggtgcggagaccggtgactaccggccgctggaggacctggcccgcaacaaggtcaacctgaccaaggtcaccacacactgcccggagatgctgcgggtcaccggctcactggtgaccgggcaggtccgcgcgtacgacctgctgcggatgttcggccgcgaggggcggccgacctcgctgggccaggcgttcgccgagtacgggcgcatcgccaagaccctgcacctgctccgggtcgtcgacccggtcgacgacacctaccggcgccagatgaaccggcagctcaccgtccaggagtcacggcacaagctcgcccgcgacatctgccacggcaagcgcggacagatcatgcaggcatacaggacggggcaggaggaccaactcggcgcgctcggcctggtggtcctcaatgccgccgtgctctggacaacgcgctacctcgacgccgccgtcgaccacctgcgggccctgccgcccgaggagcgggagcatgacgtcctgaacgaggacgtggcccgggtctccccgctgaagcacgccaacctcaactgcctgggccgctacagctcgccgcccgcccgccactcgagggcctgcgcccactgcgtgacccggcgaccgtccacctcgacgaggacgatgagggcaccggcgaatgacgcggcgttagggcgagtatcgggtcgtgatcaaggagcatcgcagcttccggggcgggtgcccgtctggggtacggggcccggcgatctgcgctgcgccgtgtggacgcgggtgaccggaagcgttgccgcaggcaggcaggcaggcagtggcggaggccgagggccccggctgcgtgcccgccgggatggtgtgtcagagcatggcgagccggtccaccagcagctccaccctcggctcggtgtcctccggcggcagccgtcccgcccgggtcagggtcgccaggccgtgcagggccgcccagaacgtctcggtgaacagccccgggtggacgccgttcccggcgacctcgccgaggctctccagcagcgcggcgaaggcgtccttgagaggttccggggtgtcctcctgcgcgtacgccaggccgccgtcgagctggaacaaggcgtcgtagaccgccgggttgcgtgcggcgaagtcgaggtaggcacgggcgagggcggcgacccgctcgcgcgggccgtccgcgctggaggccgcggcccgcaccgccacggccatctcggcagcgccctccagggcgacggcgccgatgatctcgcgcttgccgcggaagtggctgtagaggacgggctggctgtactcgatgcgctcggcgagccggcgggtggtgaccgcgtcccagccctgctgctcggcgagttcgcgggccgtcgccacgatgaggcgctcgcgctccgcccgttcgcgctgcttgcgttcctgtaccgacatgattcgatcctagcactgctagacaatcaagcggcagcagtactagcgttgcctcatcagctagcaacactagatgccaggggggtaatcatgttcaacgcactcgaggtcgtcaccaccgtgatcatcggcgtgatggtgggggtggagttctccgtcgccttcgtcatgaacccgatcctcaacgcactccccgaggacagtggccaactcggccatgcccacgggggccggatgctcggcgccgtgatgccggtctggtacatcggctcgctcgtcctcgtcgcggtctgggccatcgcgggatggcgccaccacggcaccggcctcgtcgtcaccgccggcgcgctgctgatgctcagcgtgatcatgtcgattctgctgctcgtcccgatcaacaaccggaacaagacgtggacccctgacaaccggcccgccgactggaagcagcagatgaaccgctgggaacgcttccactacgtccgcgtcgccgtcatcatcgccgccttcgccctgctggtcgccgccctcacc

SEQ ID NO: 207 - DNA, 222 bp, Streptomyces avermitilis
  CDS (1)..(222)
atggccgtgccgggcacgccgcgcgactccctgcacatcctggacgcgctgctgaacctggatgccggggtgaagccggagatggccgccaccgacaacgcctcgtactccgacatggtgttcggcctgttcacgatgctgggcttcaacttctcgccgcgcttcaaggacctgggcgaccagcggtttctggcgggcggagatgcccggtgcggagaccgg

SEQ ID NO: 208 - DNA, 204 bp, Streptomyces avermitilis
  CDS (1)..(204)
gtggacaccatcgccgcggcgaacgcgaagctgatcgaggcgcaggcgaaggtgccgatcgtgaagttctggggtgagggcctgctggcctcagtcgacgggctgcggttcgtcgtcccgaagcggaccatccacgccgggccgtcgccgaagtactaccacttcacacttcaagcgcggcatcacctgactgaacgcagtaaa

SEQ ID NO: 209 - DNA, 501 bp, Streptomyces avermitilis
  CDS (1)..(501)
ttgatccacaccctcgccaagtgcgaatggatcaagaagagcctgccgctctgcctcatcggtgactccggcaccggcaagtcccacctgctgatcgcactcggcaccgaagccgcgatggccggctaccgggtcaagtacgttctcgcgaccaagctcgtcaacgagctcgtcgaggccgccgacgagaagcagctgaccaagaccatcgcccgctacggccgcgttgatcttttgtgcatcgacgagctcggctacatggagctcgaccggcggggcgccgagctcctcttccaggttctgacggagcgggaggagaagaacagcgtggccatcgcctcgaacgagtcgttctctggctggaccaagaccttcaccgacccccgcctctgcgcggccatcgtcgaccgtctcaccttcggcggcaacatcatcgagaccggcacggactcctatcgcctcgccaccacccgcgcccgcgccgagcagcaggccgtcgtc

SEQ ID NO: 210 - DNA, 1188 bp, Streptomyces avermitilis
  CDS (1)..(1188)
gtgccccagatctgggccggagtggacataggcaaggaacaccaccactgcgtggtggttgacgaacgcggcgaacgcctcctttcacgccgggtcttcaacgacgaaccggccctgctggagctgatcgcagacgtactcgcgctctgcgaggacaccctgtgggcggtggacatcaaccacggtggcgccgccctgctcatcagcctcctgctcagccacgaccagccgatggtctacatcaccggcctggccgtgcatcaggcgtcagccgcctaccgcggccagggcaagacggacgagaaggacgcgttcgtcatcgccgaccaggcacgcatgcgccaggacctcggtctcctgcggcccggcgatgagatagccatcgacctgcgcaccttgaccgcccgccgcctcgacctggtcaacgaccgcacccgtcagaccaaccggctgcgggcccaactcctagagttcttccccgcgttggagcgggcgttgaacctgagcaaaaagggtccggtcatgctgctgaccggctaccagacgccgaccgcgatccgccgcagcggggccaggcgcatcggaacctggctaaagaaccgcaaggtgaagaacgccgccgcgctcgccgaaacagctgtcgaggcggccaggtcccagcacaccgcactgccgggagagaccctcgcggccgccgtggtcgcccgcatcgccaagggcgtgcaggcactcgatcaggagatcgccgaactcgacgcgctcatcgaagcccggttcaacgatcaccgacacgcgacggtgatccgcagcctgcccggcatgggcaccctcctgggcgccgaattcatcgccgccaccggtggcgaccttgaggccttcggcacggcagatcgcctggcctccttcgccggcctgtcacccgtgccacgggattccggtcgtgtcagcggcaacatgcgccgcccgcgccgttaccaccgcggcctgctccgggccttctacctctccgcaatggccagtctcagaacgtgcgccgcctcccaggcctactacgggcgcaagcggaacgagggcaagggacacaagcaggccctgctcgctctggcccgtcgacgagccaacgtcttgtgggccatgctccgcgacggagagtgctacgaggtccgaccaaccgtcacggcagcgact

SEQ ID NO: 211 - DNA, 957 bp, Streptomyces avermitilis
  CDS (1)..(957)
atggcgcgtcctgagaaggacatcccggcagccgcgccgatggaggtggcggagctcgcccgcgaactgcgggcgctccgccgctccagtggcctgacctacaaggacctgtccgacaagtctcactactcctccgctgcgctgtcgaccgcggcatccgggaagacagtgcccaagtgggaggtcgtggagtcattcgtccgcggctgcggcttcaccggcgacctcactacctggcagcgcctgcacaagaacgccctggcgcgcgccaagactgaggaggccgcgggcaaggtcaaggtgcgcgctgccgaagccgaaaccggtgagcctgacggcgccgacgagcggaccgaagtgcatcacccccgcctgctcggtggcctgcgcaaacctgtcccggccccggaagctgtcgtccccgcgcagccggacggtctgctgaccctcgtgcagcagttcatggacgcccacatgcaactggacgcccgtcttcccgaggatccccagcgggtcagcagtctcacggtcgaccacgtgcacactgcgctggcgctgtgcaccactccgcaggacgtgctgtccgtcatgcgcgagctggtggcggacaagggactgaccataggggcgctggaacgccgcagtcgcaagtactacccgatatccggcgcgaccttcgcccacgtgctcaacggggatgaactgcccaccaccgagtggctgaacatattcctgcgggcgtgcggagtcgaccaggagcggacgctgatctggcactacacggtgactcgcatcaagatcgcgaatctgcggcaccggaagacgccgcctccgctgactgtcactcccgtggagccctcgatcagcgccgattacatgaggcggcttctggtcctcacggtgggtgtgatgagcgtgctgggggccacggttacggcggtcatcgcgaccattcgg

SEQ ID NO: 212 - DNA, 624 bp, Streptomyces avermitilis
  CDS (1)..(624)
atgagggagggctgctccgcaaggggcgccctcactcatctccaccttcacagggactcagacgagccctacgaaccgggagttgagatgtctccatccagcagtagccgaaaaaagcgacggcggctgatcgtttccgccgtcacggcgaacggcgcgggtgccgtcgccggcgttgccgcgcaggccgccatctccgaccccttcttcagtgcgctggtcgccgccttcgtcgcaggcgtcgtcggcgatctcctgctgcaggtcacacgcacccgcaacggcgccctcggcgacgcggcccgtccgggcgagcacggtcgtgccggtcgtcgtgaactcgacaacggacacggtggggacgaccgtgccgctcgccataaaaccggcgacggaaacggccgggcgagtggagcccgccccggatgcacgcgctgcacccggcccagccggcaggacgcccaccccgccgcaccccgggtatccccgtccgaggcggtaatgacgccgcgtcacctgtaccaccgtcacctgcaccgcggggcaaagcggtttacccgccgcgtccacgagcgcaacgctcggcacggcctgcgccagcctaggggcacgcatggcgcgtcc

SEQ ID NO: 213 - DNA, 669 bp, Streptomyces avermitilis
  CDS (1)..(669)
gtgaccgccatcgacgacctcctggccgacgcccgcatccccaccacgcgacgcgagggcttcgatgtgggtgccgccctgcgccgcctcgccgccgacgcggccgccgccgcagccaagccgaacccggacatggtccgcgccgcccaggccggacagcggctgtccgtggtgtgccgttggatcctcaacaagcccgacgccgctgaccacgtcgaccgcctcgcccaggaacccgaaacccccgccgacgacggccatctggacgtcgacggcgccctcgtcttcgcgtgcctgctctacctgaccgaacaccgcgagagcgcccagttctggtggcagctcgccgccggggccggccaccgcgccgccgcatattgcctgcacctgcaccaccttgccctgggtgaggtgcgggaggcgcggcactggctgcacgaggtcaccgacgacgtcctcgactcggaagcacccgacagcgccttcctcgccactttggaggccgtcgcgatgtacgtccgcaggaccggctccagcctcgccggcgctcccaccgggggactggagatggaggtcgaccgcctggctaccgcgaaggccgactcctgcatcatcgtccagcgtcccggcaggcgcctcgccgacctgatgcacgacttcacccggcgc

SEQ ID NO: 214 - DNA, 600 bp, Streptomyces avermitilis
  CDS (1)..(600)
atgggcaacggcgacgtcagcactgacgtatcgccccaggacggcggccatggccagcccgtccaggcccctcccgccctgcccctcgacttcgagggcttctacctggggcaccaggagttcttccacgacttctcggagatccacctcggcagccgacgggtggccgaacaggtggtccaccaggtgttcctggagatcctcggaggctgggacgaactgctgcagcagggtgacctcgaacagcagacgctctccgtactgcaccggtgcgtcacccgccgcctcgaagaggacggacgctcgccggcgttcctcatcaacggcccgatagcgaagaacctcgaagcggtccgcagtcagctcgagctcagcaacagcgcaggcggcctgtacgaggcgatcctggagctgcccacccgccagttcaccgtgatcgtcctgcgccacctgctcggctaccccaccaaacgcatcgcccgctacatgggactggactcgcgcaccgtcgactatcacggccggaagggcaaggaacgcctgcgtatccggctgggcctgccgaccgctcccggcaaggacaagaaaggggcaggacag

SEQ ID NO: 215 - DNA, 486 bp, Streptomyces avermitilis
  CDS (1)..(486)
gtgcgcgggcgctgtcgttggcccgaccggcggcgccacggcctccactcacccggcggggcccctcagcctagtcagccgcggtccggtggggtggaacggccgaacaggtcgtcgaagaagatggtgccagcggcattaccggaaggcccggccggcggccgggttgtcggagaaggcggtgttcaccgcctcacagaccgtgtcttcgtcgttggcgagcagggcctgccaccactgttcggcctcggaggccatccgttcacggaccgcatgcagacgtgctgtctccgcggtcaggtatgcgggcgcatcctgctgcgcgcgttgtttggcggcagcccgttcggcacgggccagccgccctaccccctggaggtggaaggtctgggcctcggcgagcgcgcccagggcaggcccaattgcggagcgtctgggatcaaggggggggtgcgcgacggggaagcgccttcacctgctagaagc

SEQ ID NO: 216 - DNA, 3702 bp, Streptomyces avermitilis
  CDS (1)..(3702)
gtgaatggcgggggtgggtgcgtggaggagacttcgggaccggtagcggtcttctgcaagctgctggggcgcctggtgcgtgagtgcggcatccagcaaagcgacctagcacgcgccgtgaaccgcagcaccgccgccatctccatgctgctcaacgggcatcgctccaccctgcctccctgggacgatgttgcccgcatcgtggagtactgccaccaacgggcaactaccaccccgtcggccggactcgcctccgacctggcctactggcgccaccgccaccgcgaggcggaaaccgatgccgaccacgcgccaccgcggccacgcgccgctaaaccgcccgctctgccacccgcccagaccatccccgacgtccccgacgacttcgtcagcgccgtgggcgtcctcatcggagaaaggacgggcttcgaccggctggccgcagaactactggagccactgaagctgcacggtgccgtcgtcaccgacctgaacgccgtgctggaaggattcgccgaccgggtaggggccagctgcggcaccacccgaaccgccctgctgcgcgcagccgatctggtcaccctggtaacggcgttctgcgagaccgtggccgcctccggcatccgctacacgacagaactcgggcacgagcaggccgatctcaccagcgacgtggtggccgaactggagcgtgtcaccctgggatcgcagcgggtgaggcatcccgccgacctgcgtgcggaaatcgccgccgcctacgcctacgcggccgacaccgtatgcgacgaaagcggcgtaggcggccagcagccggacaagctcgcgcaccgcgcctggcgccgctacgaagccctgctggcccaggtgacgtgggaatgccccgaactgcgcctgacctccgagacgcaagacccgcccgaagccctggacccgtccgagcctgtgacaccggacgtttcatctagccggggcctcgccgggttgtcccggctgttggagaccttcgcccaggacaacggcgcccctaccccggcgcaccagcagcaactccgtgcccctctggcccaggtcgaggagtcgggcccgcgcatccccgacttggaggccggctacatcaaccccgcctttcgcgtggccggccgctcaggtgaccgtgccctggcccgtgacgactggtgggaagtccagccgctgtgggacgacctggaggacttcctcgcagcccatctgctcaccgaggacgccacccgtgcgccgctgctgatcctgggccatccgggatctggcaagtcgctgctgaccaagctgatcgccgcccggctgcccgcggcggagttcttctgccagcgcgtcgaactgcgtcacctgcccgcagacctgggcgtccaggaacagcttgaggaggccgtgctgcgctccaccggccgccgcacaccctggcccgacgtcaccgacccggacacaggcgtcgtcagagtcgtcctcctggacggcttcgacgaactgctccaggctgcggccgatcacatggatcccgcacgccacttcgcctacctgcaaagcgtgcagcagttccagcagcgcgaggccgaccaggcacgccccacgatcgtgatcgtcaccagccgcaccgtggtcgccgaccaggccctgaccccgcatcccagcaccgtcatccgcctggaacccttcgacgctgaccgcatccgcggctggctccacgtctggaacaccaccaaccgccgctacttctccacccacgccctgcagcccctcacatgggatgtggtgggccgtcacgaagaactcgccggccagccgctgctgctgctcatgctcgctctctacgacgcctccggcaacgctctgcatttgctgcacggtgaggacatccaacgcctgggcctgtacgagcggctcctgaccgagttcgtgcgccgccaggtgaccaaacacaacgccctgccggccgacaccgaagccgcccgcgtcgcccacgaactgcagcgcctgtccgtcatcgcgatcggcatgttcaaccgccaccggcaaggcatcaccgccaccgacgccgaaaacgacctggctgccctgctcgaccccgctcctgccgacgccacgccactgctgttcggccgcttcttcttcatccacgaagctcaggccatcgtcaccggccacgaacgtagagcctacgaattcctgcacgccaccttcggcgaatacctgctgacccgccttgtcaccggcgaactgcgccatctcctgcccaccaccagcccggacagcgaccaccccgtcgacgacggccggctgtacgcgctgctctcccacgtcccgctcaccgaccgggccgaagtcgtacgcaacaccagcgaacaactcacccgcctcacccaggcacagcgcgagcatctgacctcgctgctgaccagtctcttcaaccagacgcccggcgacacccaccaccgcacccacgtgccgtaccgccctgccctcacgcaccgcacccagcaagacgccgtctacagcgccaacctgctcctgctggccgtcttggcccaccccactctccgtgcctccgcccttgtgggcagccgcaacacggtcgactgttggcgccgccacaccctgctgtggcgctcgcagttcagcgacggatcctgggacgccttcacccgcgccctggccgccgagcccttcaccgatcccgccaccggccgcagagacctactggtggggctgtccacgcaccagcccgaacaagaactcgcctggaccgtgaacctcgccacccgagacgacaccacggcacagaccttccagcatctcgatggcaccgctccagccggcctgtaccggccggcggccttcacctacgacctcggcgcacagcacgtgctgcatgctgtggcaccggtcctgcaccagatgcccgcagccctggagacctaccacggggtcgaccgcacccgcagcctgtccctcgcacatgcgctgatctccctgctgtaccggcccgccaacgatcccgggccgcccggcaccccctacgccgaactccttctgatgctgcggagcctgtccggcgacgggcgcctgctggccgcggacatcctgggacgccatcttctccacgccgccgccgacctgcccgcggccaccgtcatcgacatcctcgaccagctgaccaccatccagttcaccagcgccggcggtctgtccgcccggacctggttggtcctcgcccagtgcgtcagcgacctcgccggacgcccggacatcccgcacgttcaactgggccggatcacacgccgcttcggcgccgatgcacccgccctcgatgccagcggcgacccattgacccgactgctctgcctgttcactgaggcccagaccagcaccatgtggcacgctgcagaccacccaccgggccaggccgtgcttaccgaaggcatcactctgctggagcgcatcccccaccccagaccgccccaagccgtggtcggcctgctccgcttggctcgcgatctcggcgccgacgactggctcgcccaacacgccgagccgttgctgaagacactcacccatgacggactgcaccgcctgcgccccaccgacgtcgactggctgcagcccctcgtacacgacgcgagcctcctggacgagctgaacctcgtcacccgccgctggcgccagcag

SEQ ID NO: 217 - DNA, 882 bp, Streptomyces avermitilis
  CDS (1)..(882)
gtgcgtgtggacttcaagcgctaccagcaagcggccatcaaaaccctccaaccccccgcagagggcaccgaccccgtcctcgtccctctcctcggtctcgccggcgaagtcggatccctgaccaccgcgtacaagaaattcctgcgcgacggacccgccttcgaacagggaaaacaccagttacgcgaagaactcggcgacgtcctgtggtacatcgccgctctcacccaccgcttcggactcgacctcgacgacgtagccgccgccaacctggagaaggtcaaagaccgctggcgcaccaccccccaagaggagcacgcccccttcgacgccggcttccccgcccacgaacagttgccccggcagacctcactcaccttcacgcccaccaagaccgacgacggccgcaccgtcatcgtcctcacgcgggaagacgggacccccgccggtgaccctctcaccagcgcctcccacgtcgaagacggctaccgcttccacgacatctttcacctcgcccacgccacggtgctgggctggtccccggtcacccgcttcctgctgggccgcaaacgcaaaagtgacccccgcgccgacgaagccgaagacggcggccgcgccatcgccatcgaggaaggcatctcagccctcgtcttctcgtacgccgcccgccatcgctacctcgccgacatcaagcacatcgaccaggaactcctcgccaccatcggtcacatgaccgcccacctcgaggtcagcatctgccgtgccgcggactgggaacacgccatcctcaccggctatgccgcctggcgccagctccgcgatcacaacggtggcatcgtccagctcgacctcgaccagcgcaccctcaccgtcacccaggac

SEQ ID NO: 218 - DNA, 258 bp, Streptomyces avermitilis
  CDS (1)..(258)
atggacgacatcacctcggtcgtcatcgacttcctcgccgagtacgagggcgtctcccccggcgagcttcgctccgaactggagcaggacgggcgggagttgcccgtggactccctcttggtggtcgagatcctcacgcgcatcgaggagcgttaccacgtcgccattcccgcagaccgggaagcggcccaggcgaccgggtcggtgcgggcattcgccgcggcggtcctggacgcgatcgaagaaaggcagcagtca

SEQ ID NO: 219 - DNA, 405 bp, Streptomyces avermitilis
  CDS (1)..(405)
atgacccctcccctctccgacaaccgtgaccgcgatcccgagctggtgcggctcggtgaacggctgaagaagacccgcgactacttgaacatgtctcagcagttcgtctcggactccaccggcatcccccgctcggccatcagcgacatcgagcgcggcgagcggcgtgtggacagtctggagctgaagaagctggcgcgcctgtaccggcagccggtcgcctatttcctggccgaggagaaggacgcggacgccagcgagtactcgctggccggtctgccgcgagcgctggcccagctcaccgacggggatgccaggaccgtgctggagttcgccgagtacctcacgctccggcgcgcggcagaacgcgaggatcagaacgccgagggcgggagtccgacggcg

SEQ ID NO: 220 - DNA, 894 bp, Streptomyces avermitilis
  CDS (1)..(894)
gtgaactgggccctggcacaccggatcgcttcgatcgccgccgtccagacgcaccgcgacctcggcatcgaccgcacgcagtacgtccacgtgcaccgggcgctcggggcagcggacgtgatcgggatggcgcagccgatgccccggctgttcggcgtgtacttctcccccgccgacaagggaccagccgtgatgctgaacgcttcgctgaacgcgatcacccagcggcacacggccgcgcatgagctggggcatcaccggctgggccatcgcaccgcggccgatgaggagctcgatcccgcgctgcgctggggcaacggcagctggcccgaggaggagaagacggcggaagcgttcgcagcatggttcctgatgcccctgccggcggtgcgggcagccctggagcggatctgcggcagccggccgtcgcatcccgagcacgtctaccgggtggcgcgcgaactgggtacgtcgtacgccggaaccgtacgccatctggtcaacctccggctcctcgatgccggccgggctggccagtggtccaagatcgctcctgccgacctgcgcagctcactggcggccggggcctcgctacccgggcaggcccaggtgcacgtgatcacagcagcctccgcggggcagacggtgcacgccgacgcgggcgatgtgctggtgctgcacctggacaacgcgctcttcgacgtcctgcccaagggagtggagccgtggaccagtgacggtacgacgccgttggcgagcgccgtggtgaccgacgaacttccgccgggcgaacagggcttgatcgaggtcgcggtgccgacgcacggcgccgcgctgcggctgactgtggtgcgcgaagccccgcgtgccggggtcgacgagacctggcccgcc

SEQ ID NO: 221 - DNA, 801 bp, Streptomyces avermitilis
  CDS (1)..(801)
gtgtcaggaggactgatgcacaccttcaccgtgaccgaacgcgacgtcacccaggcctgggtcgccgcctgcaacaagctggaccgcaaggacaacccggaccggaccggcctgcacacggtggtgcgcatcgccgacccgacgagcgacgacccggtgttccgcgccgaactcgaccggctgcgcaccgctcgcgggctctggccgttggagaccgtggccagcaccctgtttcccgcggccctggcggcacggagcgccgacccggatgacctcgccgagcgctaccgacggatgtatccagtcatcaagcggtacccgggcaaccaccgcggcacgtacttcggccgcctggtgttctaccctgcggcgtcgaagaccggcatcgaccagctcagcaccgtcatcagccgactgcggacacaggccgcgggcaccaagatagccgccgcgtacgagatcgacatagccgcagccacggaccaggaggaggctggcgcggatctgctggtccacactgccgggaaggacaacagctacatcggcttcccctgcctgagccacatctccctccagctggaccgcgaccggcgggtgcacgccgcggccctgtaccgcagccacttcatgttcgagcgcgcctacggtaactacctcggcctgggccgcctgctggcctacatcgcccagcaggccgaactggcctgcggaaccctgaccgtaatggccggccacgcccggctggacggccccgtcacacagctgcgcccgctgctgaccggcaccagccgcctcgcggca

SEQ ID NO: 222 - DNA, 1029 bp, Streptomyces avermitilis
  CDS (1)..(1029)
atggtgacggtgctgcaagagcgtgcagagcagagggtcttagactgcggcccggcgaggaagatccgtgtggcaggccgcacgctgacggtgacgccggtgttcgacacctactggcgtttcgcggcggcgcgtcagaaggtctacgaggcgcgactggccgggggagcggggccgttcacagacgatccgattctgcagcgacaccgcttcaccaactgcttcagggccgccgaccgggtcagccaggacctgatcggcggcgtgatctaccggggcgagcaggcgtgggaggaagtcttcttccggaccctgctgttcaagatcttcaacaagacctcgacatggcggctgctgaacggcgcgctgggagaggtgcggtggaacgcctacgactaccggacctatgaccgggtgctctcccaagcgttctctgccgggcagcggttgtactcggccgcctacatcgtgcccccgccgcagctcggcgaggagcgcaagcaccagaaccacctgcggctgctggagatgatgatgaccgcggacgcgccgcagcgggtgctgtccgcgccgacgctggagggcgcctaccgggttctgctgggcttcccggcgatcgggccgttcctggcctaccagttcgtgatcgacctcaactacgcggccgagatgccgttttcggagatggacttcgtcgtccccgggcccggggcgcgcgacggcatccgcaagtgcttcgggtcggcggctgacggcatcgaggcggaggtcatccgctacatggccgacacccaggacgagcacttcgcccgcctgggcctctcttttgcgggactgcgcgggcgtccgctgcagctgatcgactgccagaacctgttctgcgaggtcgacaagtacgcccgggtcgcccacccggacatcgccgggatcagcggccgcagccgcatcaagcagacctaccggcagcaggcagacgcgatgccggcctggttcccgcccaagtggcagctcaacggcccgcccggacac

SEQ ID NO: 223 - DNA, 285 bp, Streptomyces avermitilis
  CDS (1)..(285)
gtggaattgctgtggcagtgtccacgacgcaagacgctggtcgactggccggaggacgtggacacgaggctggacgtcctggtccgggccgcggcagcggccggggagcagacgtcgcgttcgcaggtgctggccgcactcgtgacggcggccgaggtccgtcccgccgtcatctccgaactcctccactcctaccgccagatgcaagccgacgccctcgaagcggacaacacgcgcgccgacttgccgtccgtacgctctcccggacgcactcgcggcaggagg

SEQ ID NO: 224 - DNA, 1053 bp, Streptomyces avermitilis
  CDS (1)..(1053)
gtgagatgtggcgggtgcaggcggcccatcagcctgcggaagtgggggcggggctgcgtctcttggctacctcccccactcgccttccgactgcacgccgggtcgacggggtggcgggccgagctgtggctgcctcggcgcgtggggcagggcgccgggttgaaggccgtatccgaggaacggttccaggatggtcttggtcacgcgcgcaggtatgtggcccggcatgggcatctggccgtcccgcacgccgacgccccgcaggatgggttcgacctgggccgatggctggcgaatctgcgcgccgcttctgccggcttgccgcctgagtacgtgcgggtgctggcggaactggacgtgtggtggaatccgccctggccgatcagctggcagcgggcctggcaccgggcccgtgctcacgctctcgcccacggccccgtcagcggtggtgacaatctggcggggttgccgcgctggcttgagcggtggctgcgccgccagatcgccgagtactcccagctggccgcggaacaacagcagttgcttgcccagctcggcctcacacccgccgagatcgaccgcttccacgcctggcccgcgcgacgccgcagcgtgatgcatggcctggaggctactcacgactatgccgccagccatggccacctggccgtctcccagctcacctcgcacgacgggttcgccctgggcaagtggctcaaccaagtgcgccaccgccagcgcaccgccacccagcccacgcgtctcggccggcagctcactgccctggacacctggtggaacccgccctggcccctggactggcagcggtactactgggccacgcgccatcatctccacggcctgcccgaaggcgtggtgtggtggcccggcgcaccggaagaggcacagacccagcagtggctgcacgagcagcaggcgtcctggcagcatctgcacaacgagcagaaggcgttggtgggccgcctggcaaccgatcagtcgacgggtggctctcccaggagcgaccgaccggactcatcgccgctgtccagc

SEQ ID NO: 225 - DNA, 1050 bp, Streptomyces avermitilis
  CDS (1)..(1050)
gtgcctcgcgggcgaccgcaggacctggcgtggcgccagttcgtccggcccgccgccgttcctgagccggtcgtcctagccgctgcgtacgctgcacggatgacgcaagagtggacctcagccatgagtttctcctcgttcgctcctccttcaggtgggcaggacgaggcggcacccgtcgacccgcgcgaggccgtggaggcggtagcaatgcgctggcaggccttcagcagtcgcggagcccaagtgggctgggcttcgcaggagagtctgaggcaggccggcgttacgggctacgggccgctgatcaaccgggtggtggaaatccacgggctgatgggcagcatcggagaacaactcgccctggcccgggccgcggaacaggacgcacagcgtcaccaacggaccgccgccatccatgatccacggcaagcggccgtcctggagcacagccggcggatggcggtgcgcgccctgtgcgagatgagtactcatttcgttctcggtgctgcgcacgggctggccaacctcgtgctgcggaccgttttgtgccaccccgctgccgcttacgaggtaaaccaggcgaaacggctgaagaaggcgcagggcttccctccgggcaccgatctcaaggaggcctggctgacgttctcccccacaggcgacgtctggtccacgttgctgccagcagcagccgaggcaagcggcctcacctcgctgcaggaccttgtggcgcggctctgcctgctgcaagtcgacccgaggttttccgcgttggaacaacggcgcggcatggactaccaccgtcaccgcccgcagtctttggaccacacctcaccgcgcgccggcctgtggtcatacgatcccgttcacaaggtgtccacgatgcgcatgcctggcgcctcggcggacgccgagcgggatgaggagaccgtccatcgcatcagcgccgacgcgctggagtgcctgggcgcggccctcaccgacatcgagcccctgatgggcgagagtctgcgcagctgccatctgtcctggataccagtcaacgcc

SEQ ID NO: 226 - DNA, 1275 bp, Streptomyces avermitilis
  CDS (1)..(1275)
gtgcagcaatgccccggagctacccgactgctcacggtagtcaacgaagagggaacgacgtcacacggttccctgatcgacgacatcgtcagggagggcgcgaggcggatgctggccgccgcactggaagctgaagtcaacgcctatatatccgagttggccgatcagcgggatgagcgcgagcaccgtctggttgtccgcaacggctatcaccaggcgaggaaggtcacgaccgtggccggggccgtcgaggtgaaggccccgcgggtgaacgacaagcgcgtcgatgagtccaccggcgagcgcaagcggttctcctcggcgatcctgtcgccgtggtgccgcaagtccccgaaggtcagcgaggtgcttcccctgctctatctgcacggcctgtcctctggcgactttgtgcccgcccttgagcagttcctcggttcgacggccggcctctcaccggcgacggtcacccggctcacccagcaatggcaggccgatcacgcggcgttcggcgagcgtgatctgtccgccagcgactatgtctacgtatgggccgacggcattcacctgcgcatacgcctgcgggaggcgaagtcgtgcgcgttcgtgctggtgggcgtgcgcggggacggcaccaaagagctgatcgccgtgaaggacggttaccgcgaatccgccgactcgtgggccgacctgctgcgggactgtgcacgccggggcatgcgcgctcccgccctcgccatcggggacggcgcgctcgggttctggaaagccctggccgaggtgttccccgaggcccggctccagaggtgctgggttcacaagatcgccaacgtcgcgaacgccctgccgaagtccgcccagcccggcgcgaagaaggccctgcaggagatctacaacgctgaggaccgcgaccacgcgctcaaggccgtcgccgagttcgccaagacttacggcgcgaagttccccaaggcggtcaagaagatcaccgacgacgtcgacgagctgctggcgttctacgactttcccgccgagcactgggtccacctgcggacaaccaacccgatcgagtcgactttcgccactgtccgtctgcggaccaaggtcgcccggggcgccggcagtccggccgccgccctggccatggtcttcaagctcgtcgagtccgcacagcagcggtggcgagccgtgaacgctccccacctcgtcgccctcgtccgcgccggagcccacttcgaacgcggcctcctggtcgagcgaccgacggccgcagcg

SEQ ID NO: 227 - DNA, 1764 bp, Streptomyces avermitilis
  CDS (1)..(1764)
gtgaccgaactggccatcgccgaaccccggatgaacggacccgagggcgacaccgagttctggcacagcattgactggagtcgagaagagacgtctgtaaagcggctgcgtcagaggattttcagggctgcccgcgagggtgacatgaagcaggtgcgcaacctgcaaaagctgatgcggcggtccagggccaacacgttgacgagtgtcaggcgggtctgccaggtcagcaccggcaagaagacggcgggaatcgatgggcagaaggctttgtctccggagaagcgggggaagacggcgcggcagatacttgctgaccccatgtcccacccccagcctgtgcgtcgtgtgtacatcccgaaggcgaacggcaagaggcgccctctgggtatcccggtgatccgggaccgggtcgaccaggccaggttcaagaacgctcttgaaccggagtgggaggccaggttcgaggccaggagctacggcttcagaccaggccggggagcttgggacgccatagagatgatcttcaatgtcgctgggcggaggaccgccaagcgactatgggtcctcgacgccgacctgtcagccgccttcgaccacatcagtcatcagcacctcatggactccgtcggcctgtttccgggacgacggcagatccagcaatggctgagggctggggtcatggaggacgggcggttcgtctcaacgcctgaaggcaccccgcaaggcggcgtcatcagcccgctgctgatgaacatcgcactccatgggatgggagaggtcatcggggcgaaccgcccttggaacgccaagacgacctcgccgactctggttcgatacgccgacgacttcgtggtgttctgcaccacggagaacgaggcgatcaaggccaagcaggaccttgccgcatggctcgaaccccgtggtctctccttcaacgaggagaagaccagggtggttcacctctccagcggggtggacttcctcgggttcaacgtcggcaggttccgccagaaactgatcatcaagccgagccgggatgccctgcagagagcccggaagaggatcagtaccacggccagggagaacagcggctcgcccactgaaagcctggtcagggcgctgtcaccgttcgtacgtggctggtccacgtactaccggactgtctgttcgaaggagaccttcaacctactggacgcccacaccttcgaggtcctgaaacgctgggccatgcgacggcatcgccgcaaaccctggggatggatcaaacggaggtactggggcacgttccagccaggcaggtccagcaagtgggtgttcggcacccccgagcactacttgccgcaagcctcctggatgccgatccagcgacacaccttggtcaaggacgacgcgtcgcccgatgatcaggagctggaagagtactgggggaaccgtcgacgcaagcggatacaggccgtgggagagcccaagaagatcctctccctcgcctaccgtcagcgggggctctgccccaggtgcggactggatctgatcgacggagtcgggttcgacccggacgacgttcaggactgggccaattggttcacggggagcctccgggcgattcacgtgcatcatctgacctaccgcagcaagggcggcagcgaccacccgagcaacctggagctgatccacacgacctgtcatcgccaggcacacgctggcgaccggaagtatgacgcccaccggcggccacaggccagcttgagccggatgcgggga

SEQ ID NO: 228 - DNA, 1362 bp, Streptomyces avermitilis
  CDS (1)..(1362)
atggggacctgccacgccgggcttcccagccctagtagggcttggtcatcttcacttgcgcatgcgtgtctactgctctgtgagcgtcgttggagtggtgtgacacctgaggagatggcctcggtccgggaggatcttgaggcgttcgcggcggagttgttcgacgggttctttcgtgcggatcagcggcggtgggggcaggcgtatgtgcgggggcttctcctggaggggcggcgcaagtcggtggagccgatggcggcccgccttggtgaggacggcaatcgtcaggcgctggcgcacttcatcacctccagcccgtgggatccggcgcatgtgcgggcccggctggcctggaggatgcaggacgcgatcggggcggaggcgttgatcgtcgatgacaccggctttgtgaaggacggggacgcctcggcgtgtgtgtcccggcagtacaccggcaccgcgggcaaggtcaccaaatgccaggtcggggtgtcgctgcatctggcccgggatcacgcctcggccgcggtgaactggcgcctgttcctgcctgcgtcctgggatccgatgtcttcggaggcggacccggacaaggtcgcccgccgcacccgctgcggtgtccccgaccgggtgggccatgtggagaagtggcagctggccctggacatgatcgacgagacccggtcgtggggcatcgacattcccctggtcgtcgcggacgccggctacggcgatgccaccgccttccgccacggcctggaggaacgcaagctgccctatgcggtgggtatttcctcccgccacaccgctcatccggccgacgcccggcctgtccagcccgcctatgcgggcagcggacggccaccggcaatgcagtatcccgagcctgcacagaccatgaaagacctggtcaccgcagcgggacgggcggctgccagggcggtttcctggcgggagggctcccggcccggcaagtcggtcagcggcttcaaacgcatgcactcgcggttcgtggccctacgcgtgcgacccgccggacgcggggtccgtcagagcaccgacggcccggagctgcccgaacgctggctgctggccgagtggcctgctaccgaacccgaaccagtgcagttctggctgtcgaacctgccctccgggatgccgctggccacactggtgcggctggccaaactgcgctggcgcatcgaacacgactaccgcgagatgaaacaggccctcgggctggcccatttcgaaggccgcacctggaacggctggcaccaccacgtcaccctcgtctccgccgcccacgccttctgcaccctgcaacgactggcgcaagacccaaaagacgcggcggaggag

SEQ ID NO: 229 - DNA, 1191 bp, Streptomyces avermitilis
  CDS (1)..(1191)
atgtgctccgaccaaggaacacacacgtccagcacgaaggccgtgaggatgagtctgctgcatcacgactcccgatcggaggcattggcgcaactgtcatgcttccggggcgagttctactcctgtctgaccgctcgttcggacgcgttgttcgagctggccgatgccgttctgtgtggcgacggaccggtgaggtcgctggccgagctgtcgctggtgggtgaacaccgccgaggccatggcggcctctacgccgccctggcccgtggacgcatcgatgccggccggctgcggcgggcactggccgaagtcccactgccacgggctgccgacggccggctggtcctggccgtcgatgtcacctgctggctgcggcccgacgcccacacctcaccacagcggatcctgtgccacacctacggccggggcaaggaccagcacatccccgtccccggctggccctattcgatcgtctgcgcgctcgagcccggccgcagctcatggaccgcgccgctggacgcactgcgtctgacgcccggggacgacaccgccaccgtcaccgcccggcagctgcgcgatctgcttcagcggctgatcaccgcggggcagtggcagacgggcgacccggacatcctcatcgtcgcggacgccggatacgacgcaccccgcctaggcttcctcctgagggacctgcccgtgcaggtgctggcccggatgcgctccgaccgcgtcctgcgcagggctgtcccaccccggctgccgcacactcagggccggccaccccggcacggcggcgagttcgtcttcggacagcccgacacctgggacaccccggacaccgaaaccgtcaccgacacacgcctctacggccaagccaccgcccgctcatggaaccggctccaccccaaactgacccaccgttcctcctgggcagccgccgacggcaccctcccgatcgtcgaagggacggtcatccgcctggacatcgcccacctgcccagcggagcaacacccaagccggtctggctgtggtggtcaggcaccgatgccacaccggcggacgccgaccgtctctggcaggcatacctgcgacgcttcgacatcgagcacaccttccgcctgttcaaacagaccctcggctggacctccccgagatccgcacccccgaggcagccgaccggtggacctggc

SEQ ID NO: 230 - DNA, 234 bp, Streptomyces avermitilis
  CDS (1)..(234)
atggtcgaggtcgtggcggacgggcgcgagcagctggtcgtcactggcagcaggtcgcgggagaaggcgtatctgttcaccggggaggacctggccgcaatcagcccgtacctgaccgaccacatcatgcggttcggcacctacgccaccacggagctgaccgcgcgaccggtcgcgttcgacccgcacctagacgtcgagttcgagacggaagaggaagtaccggctgcggcg

SEQ ID NO: 231 - DNA, 1701 bp, Streptomyces avermitilis
  CDS (1)..(1701)
atgcccaggaggtcggtaatggcgacgcgagagctgcgggttcgccggacacgaagccggacccgccgtactgccggggcctgcctgctcgtcgcggggtgtgtcatcacaagcagcgtgccctcggcctcggcgagcccgcaagggggcgcccgcctgtgcgcgacggagcccttccccccatcggaaagcactccgcccccgatcctgtcgggcagcgatgtgtggagtttcgtctccgatccggcccttcaccccatgcgggtgaaggtgaccgcgaacaaaccggggacggcgcgcggagacatcttcgtcgccccgttcagcgcggaccagatggtcggccagaccggagcactgattaacgacaactccggcgatccggtgtggttccgcccactgccctccacgaacctccagaacgccgacttcaaggtccagacctattacgacggccgcagggaccggggacaaccggtgctgacctggtggcagggcaccctcgcgcttcccccggcgtatacgaacctgccggccggtgcgcccgaacagggcgggtgctactacatctacgacaggcactaccgcctgctcaagacggtcttcgcgcatcacggctgctacccggacgagcacgaattcaccctgacccgcaggggcaccgcgctgttcatcgcgtccaagcccgtgcccatggatctcaccccctacggaggcccgaagaacggagccatcgagaacagcgaaatccaggaggtcgacctcgccacgggcagactcctcttctcatggaacgcactagaccacctcgaccccgcggattccgaggagccggtctccagtgcgtcgtcgtccgacggggtctgggatgcctttcacatcaactccgtcgacgagggtcctgacggccgactgctgatctcggcccggaacatgtgggcgatctacgacgtcaccaagagatccggaaggatccgctatcagatcggaggaaggaagagcgacttcaccttcggcccgaacgcggacttctactggcagcacgatgcccgattccggccaggaaaccggatcagcatgttcgacgacggctgctgcgaccttcccgacggcacccccgaacaggtgtcgcacggcctgatcctcaacctcgacgtccgcagccggaaggcaaccgtggacaggacctactaccaccagccgccgctggagtcaccgacccagggaaacacccaggccctttccaacggcaacgaattcatcggatggggccaaagcccgtactactcggagtacgcgggtgcggggaacacccagggcaacggcttgcagaacctgctctacgacgcgaagctgccgggctccaacatctcgtaccgagcgttccggaacgaatggatcggcacgccgtactacccaccgagtaccgcggcacggtccgacggcggacacagcgtcgtctacgcctcctggaacggctcgacgcagaccagagcatggcgggtactcgccggatccgacccccactccctgtcggtcgttgtcagacgcgccccacgctccggattcgagacagccatcaccacgaacgcccccggaccgtacttccaggtaaaggcgcttaatgcgcagggcaaggtccttgggacctcccacgtcgtgaccctctccagccgacagtcgacgagggacaccaagagg

SEQ ID NO: 232 - DNA, 846 bp, Streptomyces avermitilis
  CDS (1)..(846)
gtgcccggccgagcccctgctcggccgggccggcacttgaccttcaagtcgggtcgaaggtttaccgtcggcggtgtgacgacctaccgcatctcgcagctggccgaacgctccggcgtaccggccacgacgctgcgcttctacgaggacgccggcctgctgcccgccgaccgcacgccgtccgggtaccgggtgtacggcgaggacgcggtggagcgcctggccttcatctcctcggccaagctgctcggcctggccctggaagagatccgcgagctcctcgacgtccgcgaggaaggggtgtgtgcgtccgtacgagcgcggatgctgccgctggccgcggaccggatcgcggagaccgacggccggatcgccgagctccgcgcgttctccgcccacctggccggtgtccacaccgagctgtcggggccggcgccctcaggggcgtgcggtccggactgcggctgcaccacgaccagcccggtggcggccgggcccgtaccgatcacgttgtcgcccacccgcccgagccggatcgccgagccgtggcgggacaccccggtggcgtgcacgttgggcggcgcagagctgggcgtgcgcaccgagcagtggaagcagctggtcagcaaggcggaagagcgcgaggagatccccgacggagtacgcctgtccttccctgccggggccgagctggccggcgaggtcgcggcgctcgccgcggcggaacagggctgctgtgcgttcttcgacttcaccctgcacctgactccggccgctctccagctggaggtgcgggcccccgagtccgccgccgggatgctggcggacctcttcggagcgaccgta

SEQ ID NO: 233 - DNA, 516 bp, Streptomyces avermitilis
  CDS (1)..(516)
gtgtccgctttggacttctacgctcacgtcgccgtttgcggtgaggtccggggagttggcctcggtgccggcccggaagcctgggaggctgccctgggggcgacatgcctcgatgttcccggtggtggcctactgcggcgggactacgggctcgtggaaatcaacttctcgccggaccagccagggcggcaagggcagatgtcgtgcttcggcttcggcgtgaagatccaacggctgctgtacgaccagtccccgaacaccgtgccgtccccgctctcgcgggagtacggggaattcgcacccagagtccccttcaagcaactgcaggccgccatcctggccctgggccgcacgatcgaacttgacaagcacaacacttcgagtgacatggactgctaccgcgtatccgcgtccgccgcccgcatccacgtcgtcgccgaccctgacccgtacgggtcaggcgacccagatccagacggacatcagaggggcgacgtctggtccgtcgacgtgtgg

SEQ ID NO: 234 - DNA, 282 bp, Streptomyces avermitilis
  CDS (1)..(282)
atgggcatcgggcgacgcgagcggatgacatcgttgctcgacaccccctacttggtcaaagagtgggagctgccatcgccgatcgtgcttctctctggcgacgggcactgctggatcagtctcgactaccgagcctgtggcccgaacggtgagccatcggtcacctggttcgataccgatctcgacaccgaactcgcactcgcgagtgacttcaggatgttcgtcgagaacctcactgcaggcagcgccttgggtgtcgatcctggcgactccacatcggct

SEQ ID NO: 235 - DNA, 477 bp, Streptomyces avermitilis
  CDS (1)..(477)
gtggaagcagcccccggcagtgcgggaaacgtcatgccgggcgccgatgtgatcgagaccgccgtggccctggacggcgacggctcctgcatcgccgaagcccgccagctcgcggtcgaattccttacccgcgtccagagcgagtacggcgtgccggtgtccgcgcgcgccatggacctgacccagctggtcgtcagcgagctggtcaccaatgcgcgcaagtacgcccccggccctgtcctgatgcaactgcgcctcgccggggacctggtggaagtcgtcgtctgggacagcgaccccgtcctgcctgtggcccgcgccgccgaccccggccggatcggccagcacggtctggaaatcgtgatggccatctcccaggagttcgaagtccagcgcgagccggtcggcaaacgcatcactgcccgcatcgccctgcccgatacccctggcgcagacatcaccggccgccgaccccag

SEQ ID NO: 236 - DNA, 486 bp, Streptomyces avermitilis
  CDS (1)..(486)
atgcgcgctcggtgttggaggaaagactgtataggtgtacctcgccaggggactggggcagggtgggtgcgcacgcgttgtgccaggatcagagatccccagtcagcgagcccagtcgaggaagttgtgaccgacacccacgaagcagcacggcccggcctgtcgatcgaccaccaggctgtcgacggcatccggatcgttgtcctgcgcggcgagatcgaccacgccaaccgcgacagccttcacgaggctctgctcatacccgaaggggaggccgagccccggaccgtggccgacttccgcggcgtgacgttcatggactccagcggcatcaacgtactcatcaccgcccaccgggccgcccaggacgcaggcggctggctacgcctggcaggcgtgcaggaacccgtacagcgcgtcctggcgctcgtcggcatcgacaccctcatcccctgccactccaccctcgaagaggccctgaccagc

SEQ ID NO: 237 - DNA, 519 bp, Streptomyces avermitilis
  CDS (1)..(519)
gtgcgaggctcccgccatgagcaccacgcgacgccggcttggcaccagaccggacgcccccgccgccaccgccaccgccaccgccggcggaaccgaagtccccacggctgctccccgtcgaacgcatcgagccggacccggcaggcggcgacccagcaccaggccgtggccgaccggacaggcgatgccaccattgggccggaccctgaagtccggccccctgagcggccccaggccaaccagtcaaggggaggtcccgggctcctgctcgcgctcgcactgccgatcctgatgagggcggcgctctttgccctggatgccttcgaagaccgtctcttcccgccccccgcgcctgcggacgacgaaagccttgccgccgacacaagatcgctcgccctgacgacgtctcccccgcgcccagcgcggccaggctcggacacggcgagggcccggcactgcgcctatgacgctgttggcgaatcgcctgcaggccagtggcacgagtctcgtctcaggagc

SEQ ID NO: 238 - DNA, 1137 bp, Streptomyces avermitilis
  CDS (1)..(1137)
atgctgggccgcagcttcgaggaactcgtcgggcaggacttccacgacctgctgcaccgcgacagctacgggcatgccacgccccgcacgcgctgtcagctgagagacgcgcttctcgccgggagaaccgagcacggcgactcggagtggttcgcccgcggggacggcacgctcgtccggctgtcctggctcgtcgcgcctttctcctccgagtcggagggggcgggtgcgctgatgctgttgtacggatcgaatcggggtgtatcggacgagggcgacgatgaggtccccgcaccgctgacggagctggaccgcctggccctgctggcggagacgaccactcagctgacgtccaccttggatgtggacgaggcaatgcgccggctggcggccctgacggtgccccggcttgcggactgggcggtgatcgatctgctcaccgaacgagacgaggttcgacgcgccttggtgacggagcacaaggacggaatcctggtcgggcgggaggacctgcaaggacccatgccccccgtgccggaggagtcccccatgcccctgtcgcgggctctgcgcggcgccgcgtcctctcttgccggccctgccacctatcagggcccgcccgattccggaatcgcggtcgaacagggccgcttgttcagcgagacgggcatgcactccgctgtcatcgcgcccatccgaggtctgcgcgacgtgctcggagccctgaccctgggacgctcgacacgtcctgacgccttcaccgccgccgatctgccgctgctggaggacatcacccgccgggccggcctggcgctggacaacgcgcgtctgtaccagcgccagcgcaaggtcgccgaaaccatgcagcgccacctgctgccccagctccccaccgtgcccggggtgggcatgacggcgcggtacgtacccgctccgcacgcctcctccgtcggcggtgactggtacgacgccttcgccctgaccgacaactcccacgccctggcctcggcgacgttgtcgggcacgacctcgacgccgcagccggcatggcgcagatccgcaacatgctgcgcgccttcacatggtcccagccccaggccacgcccagcgccgtcgtcacccagctcgacgacgccg

SEQ ID NO: 239 - DNA, 519 bp, Streptomyces avermitilis
  CDS (1)..(519)
atggcgcagatccgcaacatgctgcgcgccttcacatggtcccagccccaggccacgcccagcgccgtcgtcacccagctcgacgacgccgtgaagcacatagccgaggtccccatggcgaccatgatcctggccacgctcactcttggcgacgacgagctgtggcaactgcgctggacgaacgccggccaccctcctccgctgctggtcagccatgacggtcgtgcccgctacctcaccgacgcccacggcattctgctcggtaccgggacgatccggcctcgccccgacgtcttcaccgtcctgccgccccgcaccaccgtcctgctctacaccgacggcctggtcgagtcaccccaccactccatcgaccacggactggaacggttgcgccgacacgccgcctctcttgcccaccgccctctggattccttctgcgacctgctgctggagcgggtccgccccagcgacaacgacgacgacgtcgccatgctggcgctgcgcacgcccactcgtgca

SEQ ID NO: 240 - DNA, 585 bp, Streptomyces avermitilis
  CDS (1)..(585)
gtgcaggggcaccggagcaactacgtccggccgcactgctactgcgccgcctgcatgggccttggtctccgcatcggcgccttcgggcctgccgtcgacgaagagggcaacaccgttcccggatcccgggccgtctacccctggtcggcgctgcccgcggtcatcggcggcgatgtcgatcgcgacgagcggcccttcgcctggttcacgcacttccttgaggcggccgggcccgtcgtggtcgacgagggggacggcgagaatctgtggccgcgcgggattcagcacgacgacgccttgttctgcgaaaccggcgtcaccggagagttcggcctcgccgacggcgtcgcggcgacccagttccagccgggcgcggggcggaccgccctccacctcggccggcaccccgtcgaacagctcctgcccagctgggatcaccgcgtcttgcgcttcccagggcagatcggagctgtcgaagtagaagatgtcgtagtcctcaaggaccacttctgctgctcctccgtgccctcgcacactctccccggtgatgggcacgcgcaagaggtccgaacgggtgacagggcg

SEQ ID NO: 241 - DNA, 378 bp, Streptomyces avermitilis
  CDS (1)..(378)
gtgagcgacgctgtgcacatcgtcctggacgacaccgcgatggccgcagccggccagggcaacgtccttgcttcccgtctgatccaccgcgcccacgctgaatcaggctggttcctgtacgccccggcgtgcgcgttggtcgaagccgaccgcgcccggcccggcacggccgagcacctggcttcccttcccggcatcaccgtcctcgatctggacctggccgccgccctggccgtcgcgcggcaaaagacgtgggctgccgcgcacagtcagtacgcggcgcagcccaccccggagcgtcccgacggcgcgatcatcgccaccaccgcccccaaccggtggaaaggggagccggtccgggttctggacctcaccccc

SEQ ID NO: 242 - DNA, 273 bp, Streptomyces avermitilis
  CDS (1)..(273)
atgggaaggagcacgatgatgtccgatgccaacgtccgtatccccgaggaagccaaggagcggctggccgctatagctgctgcggagggcttgtcgctgcgcgcgtatctcgcccgtctcgctgagacgctgctgactccggccgagcgggccgagcgggcggagaaggccctggccgcgttgaaggagtggaacggctacgcgccgaccgctgccgaggagcaggacctggacagcgtgctggaccggcgcctggcccaggcgaccggccgg

SEQ ID NO: 243 - DNA, 180 bp, Streptomyces avermitilis
  CDS (1)..(180)
gtgctgtcacctgggcgggccgcgccgtccctcccgaccctccccacaggagggccgacacctgccagaacggccctcggcccgccacggaccgactccaacatcgtcgttctggccctgggctggggcgcgttcatcggcgccgggatcatcgccatgtacttcctcggacacgccctc

SEQ ID NO: 244 - DNA, 438 bp, Streptomyces avermitilis
  CDS (1)..(438)
gtgggcgtgaggacggcatacaagttcaacaggtccgctgcgcgtgcagtcgccgctgcgtcgctcgcttggcgcaccgtgcgggccccagcaggcgtcaaccgccgggctccgacgccgcccatttcggtgatctccggcccgaagaccaccgacgtcgacgggtccgtcgccagactcgcgatcgtgcctgccccgaacacccctgatctcccctccgagcactcccctgacggggcaggcaccggccgggtccggttcccgctcgtgcagtgggtgctcgccccgcgcacgacgtggcaggcgcggcgcctggccgccgacttcggtgaggggatggacgcccggaccgcgtgggtgatggcacgcctggcccgtcatcccgacgaacgcgactacgccatggctcacctggacgacgaacgccgcattgcggac

SEQ ID NO: 245 - DNA, 312 bp, Streptomyces avermitilis
  CDS (1)..(312)
atgacagcagacgactcgcacaaccgactcgaggacgacgactaccccgcctacaccatgggccgggccgccgaactgctcggcaccacccagggcttcctccgcgccatcggcgacgcccgcctcatcaccccgctccgctccccaggcggccaccgccgctactcccgctaccagctgcgcatcgccgcccgcgcccgcgaactcgtcggccacgggacccccatcgaggccgcctgccgcatcatcatcctcgaagaccagctcgaagaagcccagcgcaccaacgccgaataccgccgcaccgccgaa

SEQ ID NO: 246 - DNA, 672 bp, Streptomyces avermitilis
  CDS (1)..(672)
atgtcggtcgacctcgtcggcttcctcggcgtagtactggtggcgtatgtggtccccggcccggacttcctcgtggtggtgaggtcggccaccgagcatcccgccaagggccgggccgcggcgctgggcgcccagagcggactgtgcgtgcacatgctcgccgccgcggtcggactgtccctgatcgctgcccgctccccggcggtctacgacgccatcaggctgctgggcgcggcctatctcgtctacctgggcgtccgggcagtgctggccgcgcggcgggccgcccgtgagcgggccgctgggcgggaggcggtcggcggcgtggaggacggcactgacccgcgaactccggaggaggaggcgccggcccacggccgttggcggtccggcttcacccagggtttcctcaccaacgtgctcaatcccaaggcggcgctgttcttcctcagcatcctgccgcagttcgtccacggcggcggctcgacctcgcggcagatcttcttcctcggcaccctggacatcgtcatcggcgtcgcctactggttcgccctggtcgccgtcgccgcgcggctacgggcgttcctcgcccgcccgaaggtccgccacggctgggaactgacgaccggctggctgttcatcgccatcggcatcggtgtcgccgcggcagcc

SEQ ID NO: 247 - DNA, 354 bp, Streptomyces avermitilis
  CDS (1)..(354)
gtggtgggtgtggtcggtgtggagaacggaccacggggtccggtgttcttctccttcgagccggccggaatcgtccccgacatcgtctgcctgtccaagtccatcagcgggtacgggatgcccatggccctcacgctgctgcgtcccgagtacgacgtgtggaagcccggcgagcacaacggcgccttccgcgggtacaacccggcgttcctcaccggggcccgggcgctggagggggctgctcttcggccgtgcgggcgcgggcccgcgaggtgtgcgatgcggcgtaccggggaggcctgctgctggagacggccgggtccaacgacgaggtggccacggtcctgccgccgg

SEQ ID NO: 248 - DNA, 2301 bp, Streptomyces avermitilis
  CDS (1)..(2301)
gtgagacatggcggacgcgggcggggccccaagcgcgtgggcatgcgctacttgtcattgctggtatttggagcgggcggagcgttagtgctggcgcagagctccggccagagcgtggccgcagtggggatgggactactgacagcgctgggaggcttctatctggcctggaaggccttccagcaggaccgcgaccaagtcaccgccatgagcctggggacggctgtcgaccagttggcggaagcggtgaagaaacagtgggacgctgaggcgtcggtccgccgtttgaacgacccatacccactgccggtcgcctggcgggccgctgatgcagacctggtacagccctggacgttgctggccgacgtagcgcggggctggcccggtggtccccccggtgatcccgcccaatggcctacggatgccgccgggctggcgggcgctgatgcgcagatcggtgaggtgtttgcccagcgggtacccacccgccgcctggtcgtcctcggcgatcccggctccggcaaatccatgctgctcatccgcctgctccacgacctgatcgcacagcgacccgacgatggcccggtgccggtgctgttctccctggcctcctggaaccctacccaccgacccttgcagagctggctggccgaccagctaagacacacctaccccggtctacgtgcccccgccccttcggccgcgccccaggcgggccagatcgacttggcccaggcgctgctggatacccggcggatcctgccgctcgtcgacggcttcgacgagctccctcctgcccttcacgcgatagccctcgacgccctcaaccaggccctgcccgcgaaacaacccctggtgctggccagccgcgccgccgcctaccgggaggcactggcccggtccgaagtcctggtgcgaccgctcaacggcgccgccgggatccatctgctgcccctgcccgccgaccaggccgcaacctacctgcgccatgacgcaggcggcgagcacacccccgccgccgaccgctggaacagcgtggccgcccacctgggcacgaacaccctcgtcgggcaggccctgagcacccccctgggcctcttcttggcccgcaccatctacaacccacgccccgatatcctgggcgcacccgcccccgtccctcacccggacgagctgtacgacaccaccatcttccccacccgcgccgccctcgatacccacctgttcaacgcctacatccccgccgcctacacccgccaccaaccgaaccccctccggtggtctccatcccaggcctaccgcaccctggtcttcctcgcccgacacctggagaccaaccgtaacggcagcccggaccttgcctggtgggaacttcaccacgccaaccccgcgtacatccgccgcctgacagctgggctcatggtcgggctcgggcctgggctcctgctcgggctcgtgtacggggtcggcctcgggctcgcggccgggatcgggctcgcggccggtctcacgtacggacttataggtggtgggcttgggtccgccccctcaaacattccaagtacacggctacgttggtcgcgccgcaggttcgcgggctggctcggggccgggcttgccctcggactcgtgggcggactcgcgttcgggctcgggatcgcgggcgaacgcggagcctggctcgcgaccgggatcttgcccggcgagcacggattcgtgggctggctcgcgttcgggctcgcgctcggactcattgccggactcgcgtgcggactcacgttcggactcacaggcgagaagcctgccctaaccaccatgatcggccctgcgacactactcatccaggatctccgcaccttcctcggaggcgggctcgcgtacgggctcggggccggattcgtgggcggattcataggttggttggtgagctggcttgcattcggggctgaggacggactcgcgttcgggcaggcgttcgggctcgcgttcgggctcggggcctcccttgaacagacagcatggggcgactgggtgatagccaaggcttatttggcaatgtggcgccgagcgccttgggatttgatgacgttcctccaggatgcgcatcagcatcgtggtgtcctgcggcaggttggggcggtgtaccagttccgccacctggacctgcaacgccacctcgcccagcaaccccggtccctccccacctacgccgggcagcccgattcgccatctcggctcactggcgaacaagcgcggtcaattcatcgccgcggaaacacccgaacaggaagcctgttcgac

SEQ ID NO: 249 - DNA, 312 bp, Streptomyces avermitilis
  CDS (1)..(312)
atggcaactgagaactgccgccgtgatctcactgccatctgcaaggccgcggacagcggctatcttctgcaagtggtccgggatgacggcttcgagcccctcgccgagaagcacctctcacactggcccgactggccgacattcccggtcgacgccgcgcatgcggcggggtgcgaactcatcatgctcggctacgtgatctggcctgacactgtcacccctgactcgctgatcggctggcgtgctgtaccggatcagcaggcatggtcggcgaaggtcggcaccttcgcccaagtgcaggccgccggaatc

SEQ ID NO: 250 - DNA, 432 bp, Streptomyces avermitilis
  CDS (1)..(432)
ttggtgtattgccgcgtcggaccatcacagggggtggccatgtacatgccaggtccgaaggtcacggcggcggtcggagcggtgctgtccgccgccaccgcggtggtgaccaacctggtcaccacccggtggagcccggccctgatcgctgcggccgtggtcctcgtcatcgccggtgccgcagcagccgcggcttccgccgcacacggtcggtcggattcaccgccgactgcccggctcacagcccggcgtcgcggccacctcgaccgcatccgggtcgcccacggcgccgacgccgcagtgcgcatcgaagccaccggcagtgcagccgaagtgtcgaacctggaagtcaacatcgacaacgccgaggccatcgccaaagcaaccggcagaggcacgatcagcaactcctcaatcgtgcagaggaattcc

SEQ ID NO: 251 - DNA, 3432 bp, Streptomyces avermitilis
  CDS (1)..(3432)
gtgtctcaggtattcaccgatcgccgggaggcactggccgcggtcgagcggctgacgggcgagagctcgccgctccgggtgctcgtagtgcagggtgtgtccgggaccggcaaatccacgctgctgcgctacgtgctgcaccacggccggcgtggccttcgtacggtccggctggacgtgctcgatgtggtcctggccccgttgccggtggaaaccgacgtggtgctgcgcctggtgaggtccctggccatccagctgtccacggccgggccctggtggcgccgacgccgcctgcgccggcaggccgagcttatcggggcggagcaccccgcaaccatcaccatgatcgcccgagggcacgggcagatcaccggtgtctcggcggtcgccgacggggccgcgcctaccgcgcaacgccgggaggcgtgggtgcaggcgatgctgagcatcgccgcacgggtgcgccgcccggttttgctggtggtggatacaacggagttgctgtatgtgttcgacgatgccgcccgagaagaccgggctcgcacggcgatcggcgtcggagactggttcgtgcgggacatgctggtccggctgctggacgtgtctgcccggctgcgggtgatccttgcggggcaggaccagctgacgatgacgggcctgcccgattcggcctggcaggagctggaactttcaccctggagtcaggacgacgtcgtcgaccactttgccgccttgggcctgggcctggagccggcgcgacaggcctacatgatgtccggcggaatgccactgatcgcagccgccatcgctgacctttgccagagcggaatcggcggtgagggcgcgtggctggatcaggcggcggggcagccgacgtcgacctggctggtggacaacattctgggtcggctctcggccgagcagcgcatgctggtacaggccgcctgcgtgttacgagtcatcaccgagcccgcgctggcccgcctggtggccgacaccccgctaagcgccggctggttcactgccctggctcgccaccaactcttacagaccgcgccagccacaaaccgggcaccccgtctggtgatgcacgccaccattcggggatggctgctggagcacctggcccgcgccgaccgcgaccggatccccgaccgccggcagctcccgcgctggcaccgggccgctgccgagttctacgccgccttggccgaggggagactctctgccgaggagatgtaccaccgcttcgccgccggagacgccgctcccaccagatgccggctatgggaacaggccgtcctggcagccgtcaccgacggccgtctcggtgatgcgttcacactggcccagaccgcgactgtcgcggccgccgaaccggcccagccgaccgtgccccaccccgcgttggcactggccttccatgcccaggcccacatcgcgctcttgcaaggccacctgcaccaggccgaccgtctggccgccgacgccgaccggcactaccagcaagtgcccgacactttcgggcaggcacaagtggcctggatgcggggcgagctggcctggcgcgaggaccgctacgacgacgccgcggctttctggcgccgctcacttcacacccctggaggcatcaccgaaccggccgaccgcgccgacctggctctcgcattagcccgtgccgtctgctgcatcggtgacctgcccgccctcgacaccgccgtcgacactgcacgccatctggccgccgacgccaccgcaccggctccacatccgaccgatacgaccgctcaccggctcccgatgatcccgctcacccccaccactacggcccagatccgccccgtcaccctgctgcgtctccaagccaccggcgccttcctcaccagcaactatgcccgcgccgatgccctcatcacgcagggtgtccgcctggccggcacactcggcgaacccggcaggcacgaacaagccctgctccacgccgtgtacgcgagtgccgcgctgctgcgcgacgacctcgacgccgccgaagaggcgctgaagcagggtctacaggctgcccggaactgtcccaacgctcgatgccgtatcaacctcctgcttcggcaggcgcgcctggcccgaatcagagcccaatccggccccggtctgcccacacacccgaaccccgcaccagcagcggtccagatctcgctgaaggccgccaccgaagcggcccaccagcgcgccctcagcgagcggtacgtccaagccgccctcgacctggccctcgacctcaccgaccgagccagccaagccgacgcactggacaacctgggatatgtcgctcttgaccgcggggacctcaacaccgcccatcagcaccatgagcaggccctgaccctctaccagcacaccggaaaccgcctcggccaagccctcgcactgaacaacctgggaaatgtggcccgtgagcgcggggacctggacactgccgaacagcaccacaaccaagccctgaccttgtaccggcaggccggcagccgattcggccaggccagcgcactagacaggctggggatggttgccaaggagagcggggacctggacaacgccgagcagcaccacaaccaagccctgaacctctaccagcagatcggccaccgctccggccaggtcgccgcactcggcaatctggggaacgtcgcccgggaccgcggaaagccggagagcgccaagcagtactacgagcaggcaatggcctccttccagcagatcggcgaccgctccggccaggccaccgcgctggaccatctggggaagctggcccgggaccgtggggacctggacaccgccgagcagcaccacaaccaggccctggccctgtttcaacagatcggccaccgctccggccaggccaccgcgctggacaacctgggacatgtagctgaagaccgcggggacctgaacaccgccatgcagcatttcgagcaatccctggccctcgaacggcagaccggcgaccgcctcggccaggcacacgcactggacaacctagggcacctggcctggtgccgtagggacctggacaccgccgagcagcaccacaaccaagccctggccctctaccggcagaccggcagccgacccggccaagccacggcgctaatgggtctggggagcgttgcccgcggtcgccgggacctggtcaccgccaagcagcgctacgagcaggcattgaccctctaccaacagaccagcaatgcctccggccaggccgctgcgctgaacaacctggggatggtcgctcaggaccgcgcggacctgaacaccgccaagcagctctacgagcaggccctcgccctgtaccggcagaccggccactaccccggcgagcagcaggtcctgcgcttcatcaaccagctcgacggtctcgccccgccttcgggccca

SEQ ID NO: 252 - DNA, 753 bp, Streptomyces avermitilis
  CDS (1)..(753)
ttgacgccgaagtccgacgcggcgcagagcctggtcggcgacgtacgggcgctcaccccgccccccggcacccacccgctggtgggcggcatcgacgccgaactggtcgacgccaagcactccatcagcggccagatcccgctcgccatcggcctggtggttgtgaccaccttcgtcctgctcttcctcttcaccggcagcgtggtgcagccgctgcgcgccctggccctgaacgcgatcaccctggtggcgacgctcggcatcatgacccggatcttccaggacggccatctctcctccctgctcggcttcacggcgcagccgatggagatgtcgatgaccgtgctgatgttctgcatcgtcttcggtctctcgatggactacgaggtgttcgtcaccagccggatcaaggaactccacgccccgggcgaggacaccgagtccgccgtcaccaacggcctcgggcacaccgggcgcatcgtcaccgccgccgcctgcctgctcgcggtgagcttcttcgccttcggtacggccaagctcagtttcatgcagatgttcggtctcggcagcggactggcgatcctgatcgacgctgtcgccatccgtggtgtgctcgttcccgccgcgatgcgcctgctcggcgactcggcctggtacgcgcccggcttcctgcgcagattccacggccggttcggcctcagcgaaagcgcgcccgagtccgctgccgagcccgaacccgcagtctcacggggt

SEQ ID NO: 253 - DNA, 594 bp, Streptomyces avermitilis
  CDS (1)..(594)
gtggaatgggaccaggtcgacctcgccaccgccgacccccagagtgtgtggaagtccgtcgccatggtcccgcaggactacacccggtggccgctgacctgccgcgagaacatcaccctcggcatgcccagcgacgaaggtgacgccgccgtactccgagcagccgaggaagcgggggcgatggccgtcgtcgcgcaccttcccgacggcctggacacctcgctagcccgctcctggtggggcggccacgacctctccggaggacagtggcaacgcatcgccctcgccagggccttccacaaggacgcccccgtactgatcctcgacgagccgacctcggctctggacgcccgcattgagcaccaagtgttctcccggctgcgggagttgtctgcgggccgcaccgcgctgttcatcacacaccgtcttgccaacgcccgcgtcgccgacaaagtcatcgtcctggagaagggcgcggtcgcggagagcggtacgtacgacgaactcctccggatcgacgggctcttcgccgaactccaccggatgcaggaaggggcggagagggacatcccgacgccgcgcacgacacggatc

SEQ ID NO: 254 - DNA, 387 bp, Streptomyces avermitilis
  CDS (1)..(387)
gtgacaagatcctcttctcccagcgcggcggcccgtaacggctacggccggtggcacatgccttccggcaagctcgaccagggcgatcccctgcccgccggtgctgcccgcgaactgttcgaagagaccggaatcaccgtcgccccgggccacctccggctcgtccacgtcgtgcaccatcgccaagacgacgaggtggaacggatcggcttcttcttcgaagccacggactggcagggagaacccgtcaaccgggagccggacaagtgcctcgccttgacctggttcaccgtgcacgaactgcccgacggcatcatcgagtacccgcaggccggactgcgcggatatctcgacgagaccggtcccctcgtcgcacacaactgggag

SEQ ID NO: 255 - DNA, 1386 bp, Streptomyces avermitilis
  CDS (1)..(1386)
gtgatctcgtggctggccgggcatgaaagcggggcctcccgcacagctcgtgggtgtcgaatccaaccgagcaacaggaggcccctggtgctgcagtcttccgtgccagcgtcgatgtcgtccaactcggcgtctctgtcgtgtgattgtctcgctcaccggttcgggaacgctggggaccggccgtacaggcgaccgaagtatccgtcggacatgagcgacgcggagtgggccgtcgtacgtgacgcgatgccggttcccggctggctcgagggccgcggcgggcaaccggagagctattgccaccggcagatggtcgacgcggtgcgctatctggtcgcgggcggcatcacctggcgggcgatgccggcggacttccccgcgtgggaccgcgtttatgccttcttccggcgctggcgggacaagggcctgaccgccgagttccacgaccggctgcgtgaccgggtccgccaggccgcgggccgggatctggagccgacggcgggcatcatcgacgcgcagtcggtgaaggcagccgcatcggtgccggccgtgaccaggggattcgacggcgggaagaaggtcaacggccgtaaacggcacatcgtggtggacaccctcggactgctgctggccgttatggtgaccgcggcctcggtcaccgaccgggacgcgggacagacactcctggcccggctgcgcgaacggcactggcgcgtcacgcgggtgtgggccgacggaggctacaccgggcgcctggtcgacttcgcccgcgacgcctggcggatcgcgctgaccgtggtcagacgcagcgacgacaccagcggtttcaccgtgctgccgaagaggtggctggtggagcgcacgttcgcgtggctgatgcactcacgccggctggcccgcgactacgagacgcgcaccgacacctcggaggcagtgatcaagtgggcgatgagcacagtcatgaggcgcagcaggcgctcgcgcagcgttctcctcctggccggcggcgcgttcgcgcccggcgagccaacttccgacggctgtatccagcgcgtcgccgtcgatgcgttggaggacacgacgcacggtggcctcggccggggcgacggggccgcggtccggctcccggcatgggccaccgagccgggccaggacgttgggcggggcgtcggcggcccactccgcgatcgcggccagggacttcgctccggccaggaccgcgcacgcggccagggagaggacgaaggcgaatgggttgaaccgggatccttactgtgcgccaacgtacagcgaacatcccctgcgtaccctggcattttcgccgcccaagcggagccgacctcccctcttcgcgcgggcctgtgtcggccgtggggaaccctg

SEQ ID NO: 256 - DNA, 1443 bp, Streptomyces avermitilis
  CDS (1)..(1443)
atgtcatctgtcatgtcgtccgccatgccttcgttgccttcgtcgcccacgggtccctcaagaaccggtcgccgtctgctggtcgccctgctcgcgatgctcgcgacagcaggctccaccgtggccgaggccggcacgccgtccggcccggcgcccggcgccgcggtgagagcggccgaacccgcgacgcctgaccgccccagctacgacgtgaagctgcgcgccgatggcgacggctcccactgggcgggccggcagacggtgtccttccgcaacgcctccagccggcccctgcgtgaggtgtacatacgcctgtggggcaatggcgaggacggctgcgggacatccggaagaccgtcccccgtccgcgtctcccacgtgcgcggcggcactccgggccgccccggcgtgaagtgcacggcgctgcgcatcgctctgccgaggccgctcgcacgcggtgagcggacggccgtctccttcgacgtggccctcaccgtgcccgcacgcaacaaccgcttcggccgcgaaggcgcgttccgcttcctgggcaacgcgctgccggtcctcgccgtgcacgacgcgagggggtggcacctcgatccgtatgtgtcgtacggcgagagcttctacaccctggcgagcgacttccgggtgcgcctcgaccacccgtccgccctcaaggtcccggcgaccggcagcacatggacccgccccggcggtaccgggcgtacggtcacccacagcgtcgccaagcgggtgcgggacttcgcatgggcggcgggcccgttccgcaccgcgacccagacctcgcccgacggcgtgcgcgtgaagtcgtattggtcgccgaacacgcccgccgctggtgtccgcctcaaccgcaaggacggcgtcgccgccatcgaccggttcggcagggagttcggccgctatccgtacggcgagatagacctcgtgatgacccccgggttcgccggcggcatggagtaccccggcctggtcatccttggcaccgaggaggagggcggcgccaccgtccatgagatcgcccaccagtggtggtacggcgtcgtgggcaacgacgagtacaactcaccctggctggacgagagtttcgctcagtacgccaacgcgcgctactaccgctgggacgggttcgagtgctcgccggacgactcctggccgagcgccaccgccgcgctcaccaactcgatggcctactggtctacacaccgtggcgagtacttccaggtcgtgtacgggatcggcccctgcgtcctggccgacctggagcacgtcctcggggccggcaccatggcgcgcctcatcaagaagtacgcccacgaccactggtacggcgtctccaccaccgtcgacttcaagaaggccgcacagtcgatgacgcacagggacctcggccccttctggcggaagcaccgcatccgc

SEQ ID NO: 257 - DNA, 1206 bp, Streptomyces avermitilis
  CDS (1)..(1206)
gtgcctgcccgctcatcctcgctcatcgcgcgctctctgggccaactcgccggcaccgcgccgaccgtccccgatgacctccccggcctgctgacctgcctggctcaggtgcccgatccccgccgggaccagggccgacgccacccgctcgccttcgtcctctccctggccgcgtgcgcggtcctggccggagcgaagtccctggccgcgatcgcggagtgggccgccgacgccccgcccaacgtcctggcccggctcggtggcccatgccgggagccggaccgcggccccgtcgccccggccgaggccaccgtgcgtcgtgtcctccaacgcatcgacggcgacgcgctggatacagccgtcggaagttggctcgccgggcgcgaacgcgccgccggccaggaggagaacgacagcgaccggcggcccctgccctccctcgccgtggacggcaagaccgtgcgcggtgcccgccgcaccgacggcacccaggtccatctgctagccgcgatgacggggaccggcctggtcaccgcccagcgcgaggtggacgccacgaccaacgagatcaccgtcttccagcccctgcttgccccgctcaacctgcacggcacggtggtcaccttcgatgccctccactcgcagaccgcccacgcgcgcttcctcgtcgaggacaagcacgcccactacatcgcgctgatcaagggcaatcagcccaccctgcaccagtggctgaaggccctgccatggcgggaagtgccactcctggacaagacgcgggccaccgcgcacggccgcgacgagatccgccggatcaaggccgccgccgtcgccgggatcgcgttcccacacgcggtgcaggccgtccagatcgagcgccgccgacggatcgtcaccaccggcaaggtcacccttgaacgcatctacggggtgaccgacctgaccgcggagcaggccgacgcaaccgagatcgcccgccgcgtccgcggccactggggcatcgagaacaagatccaccacgtcagggacaccacgtacgccgaggacgcctcccgcgtacgcaccggcaccgctccacgtgcaatggcatccctgcgcaacctggccatcggcgctctccgactcgccaaccagacgaacatcgccgctggactccggcaccacacccgcgacgccaaccgtccactgatcaccctcggcatcatg

SEQ ID NO: 258 - DNA, 594 bp, Streptomyces avermitilis
  CDS (1)..(594)
atgaccccggccgaccccacttcaccccctgggacaatcgttacccggggcctgcgccgcacctacggagatgtcgaagccgtccaaggcctggacctcaccgtcgcccagggcgaactctttgccttcctcggccccaatggcgccggcaagtcgaccaccatcgggatgctgtgcaccaccctgcgccccaccaccggccacgcccaggtcgctggcgccgacatcacccgctcccctcacgacgtgcgccgccaaatcggtgtcgtcttccaggaatccactaccgacgatgacctgactgcccaggagaacctgcgtctgtacgccgatctctatggcatttacctctactcagctcgcttgttgagcgtgctcggctgtccttgccttccattggtctgccgtcatacgccaaatgacatcgattcccacttcgccaggagcgacgtgcccgtcagttgctcgtatgcgctcaacctcagcgaatcccaagcggcgggcgacggccccgctggcagggttggcggcatcgtgatggatctcgatgcggtcgatgcccagggccgcgtcgttcaggtgatgtgtcctggt

SEQ ID NO: 259 - DNA, 261 bp, Streptomyces avermitilis
  CDS (1)..(261)
atgatgaactttgccctggcacctgaagtgtctgtcaccgacaccgagcacggtacggtcttgctcgacgaacgcaccggccgctactggctgctcaacggcacgggcgccctggccctgcgcgccctgcttgacggtacgtccccccaaggcgtcgttgccagcctgtgtcaacgtttccccgacgccggaaccgcccaggtcgagcaggacgtcgacaacctgctgcacgccctgcgcaccgccaaggtggccgcgtca

SEQ ID NO: 260 - DNA, 1908 bp, Streptomyces avermitilis
  CDS (1)..(1908)
gtgccagccgtgcgtcttccccacctcttactcacccttgtggaagggaccggcatggaattcttggtacttcccgaccacccggccggcgctgcggccctggcgctcatgccaactgccggaccgccaccgacgcacgtgattgagcaccactcggggcgaccgtggattgtgggctgctggaacgaagaggacgtcatggtcaccgctgtgggcccgcatcgcgtggctctgctcggccgcaccaccgcggacgcagacgtcctcacccggcggctgcgcgacgtccggtcggtccgcgacctcgacggcctagccgcaacagccgctggaagcttccacctcgtggcgtcggtaaacggagaggtgcgcgtccagggcacgctctcagcggcgtgtcagatctactacgccacggtcgccggagtgaccctggccgccgaccgcccccaggcactggccgaccggatcggggccgacatcgacgaggatcaggtggcactggcactgctctcgcccttcgggccgccgtggcctctgagcgagcggagcctgtggcgtggcgtgtgctcacccccgaccgggcactgccttgagatcggcagggacggcacggggcgtacccgccaatggtggactgcgccggatccggaccgccccctgggcaacggcgacatgatccgacaggcgctggccgaggcggtggcgacctgtaccgcgggccaggaggtcgtgagtgccgacctgtccggcggcctggactccaccagcctgtgcttcctggccgacgccgaccgccacgacgcccacctggtgacggtccactaccaggcgctgggccggtccagcgacgatcggtactgggcccgccaggccgaggccgctttgccgggcgcccggcaccttctggtcggccccggtcaagccccggactggtacgcgcctctcgcccacgccgtccatgaccgagaaggccccctgacgttcgtacggtcccgcgcgaccaccgagcacttggcccggcttgccgcagcgcacggctcgcgacgtcacctccaaggcattggcggtgacgagctcttccaccctagcccgatggctctgcacgccctcgtccgacggcatcctctcgccgccctgccacacttgcgcgccctgcgctccatgcgccgctggcccctgactacaaccgcccgtaccctcgcctctgcaccctcatacacgcagtggctggccgcctgcagcaacttccctgccgacaggcacgattggggagccggagcagactgggagccactgccgaaactcccgccctgggccaccccgcacgccgcggcgaccgtccggcgtcaactcctcgccgccctcgcagccacacctcagccgctggccaccctgcccgtccagcacgagatgatccggctcacccgcatcaacggcaatgccacccgccgcaactcccatatcggcgcccataccggcgtcactttccacgcacccttcaccgacgaccgggtcctggaggccattctggcggtacggctggaggaccgggtggccctgggccagttcaagcccatgctcggcacggccctgcgcagcatcgtccccgccggcctgctcagccgcacgaccaagggcgacgccagcgccgagctctacgcgggactgcgccgtcggcgcggcgagctcctcaagctcatggacgactcccatctggtccgcatgggcttcgtcgacgccgacgtcctgcgcaccgtcctgcgcggcctgcacgccgacacccggcccctgatgcccctggactccaccctcgcctgcgaattgtggctgcgcaccctgtccccggctgacaccgcccgggccaccgccgtgcccgttccctcccctcgaaccgtcaaggaaata

SEQ ID NO: 261 - DNA, 396 bp, Streptomyces avermitilis
  CDS (1)..(396)
atggggagggcggggccggtggcgttcttgaccgacgaacagcgccgtaactacggcacgttcaaccaggtgcccgacgacgggcagctcgccggctacttcctgctggaccgcgacgcccggcggcgggcgatgacctgccggggcgcgaggtcacagctcggctacgccgtccagctcggcaccgtgcggttcctgggcaccttcctggacaaccccgaggacgcgcccgccgaagtcgtcgcctacgtcgccgagcaactcggccacccgggatcggtgctcgccgggtacggcgccgagcgcacccgctgggaccaccagatcgccatcaaggacgcctacggctatcgggatctgaagggcgacgcctggtggaagctccgggacggtgac

SEQ ID NO: 262 - DNA, 228 bp, Streptomyces avermitilis
  CDS (1)..(228)
gtgctggggcagggtcagtacgttcccctggacttgatgatcgagggggagagccaacggatgagcgagcgcgacgcgttacgggggctgcgggccttgatgtgggtggtgatcgccatcgaggtcccggtgtacctggtgtggctggtcgaggtcagctacctgaccgggcagcagctgccccgcggcaccgaagaagaagacgggaagccccgggccgacaccgac

SEQ ID NO: 263 - DNA, 471 bp, Streptomyces avermitilis
  CDS (1)..(471)
gtgcaggccgacgcgatggcggtggcagtgatggaactgcagggcgcggccgccgccaaccgtctgctgtgggaggggccggccgagcggggccggacgttcctgctgacgctgctcgccttcgcgggtggcgccgcccgggcccgcatcgccggcggcacggatgtgcagagcgggctggtgggcttcgggcaggcggctgagttgctgagccgggaacgggtggccagcaagcagaccgtggccgccgtgcgggagccgctcgctcaagccgccaccgccgccgccccgctcatgcgctgctccgccccggccgtcgtcgctgccaccgagcagctgctgaacgccctggcagacgtggagaacaccgcgcgcctggaggctgccctggaggccttcggccgggccgtcaacgtggccaccccaccgcggctgtcctggtgggcgcggcggcgcgccgtctcgtcagga

SEQ ID NO: 264 - DNA, 1632 bp, Streptomyces avermitilis
  CDS (1)..(1632)
gtgatactcgccgagtgtggggagctgctgaagaccatgtttccgcacctcgaaggggtgctggtggaagaagtgagccccgagggtggggtgttgcacattgtggcaagaaccgtggagtcggttccggtgccgtgcccggactgcgcaacgccctcggtgcgacggcacagcggataccagcgccgtctcgccgacggtgcggtcggcggccgtcaggtgtccatcgagctgaccgtccgccgcctgttctgcgacgaccagagatgtgcacgggtgacctttgccgagcaggtcgacgggctgaccgtgcggtatgggcgtcggacgccgcagctgcggtgcttgttgagcgcgatcgcggtggccctggccggccgggccggagagcgcctcgcggcccggctgccggtgcctgtcagccgcactaccctgctggccctggtcatggccctgcccgatccgtacgccgagacgccccgggtgctaggggtcgatgagttcgccacccgcaaaggccacaagtacggcaccgtgctggtcgactgcgagacccatgctcccatcgacctgctgcccgaccgggagtcggcgacgttcgcagcgtggctgaccgaccaccccggagtggagatcatctgccgtgaccggggcggcgccttcgcagacggtgcccgcaccggggccccagatgccgtccaggtcgcagatctctggcacctctggcacaacctcgccgagaccgtgaagtccctggtcagcaagcacagttcctgccttcgtgaacccgccctcgcctcggagtcaccccctgaagtcctgcacccgccgctctcccacgcaggccggctggccgagcgggcccggcggcaccacgccgccgtgcacgatctcctcggccagggcctcaccatccgggccgtcgcccgccgcctggagctgtcccgcaacaccgtccgccgctatgcccgcgccgtcacctgggaggaactggccaccggccgctggcagaacctccccagcactctggacccctacaagtcctatctgcaccagcggtggcacgagggccacaccagcggtgccaagctccacgccgaactccgtgagcgcggcttcacggggtcctactccgtcgtccgcgactacctccggcgcttccgccgaacgtcgggcgaccgtccgcccccagcgcggccgcccggggtccgcaaggtgaccggctggatcacccggaaccccgaccgcatgaacgacgacgaccagcagaaactcaaggccatcctggcccgctgccccgaactcgaagcggccaccggacatgtccggtccttcgccgcgatgatggccatccgcagcgcgagccgactgcccgaatggatcgccaccgcccgcgccgacgagcaccacggcctgcgcggcttcgccgatggcctgctggccgacctcgacgccgtcatcctcggactgagcacggaatggagctcgggctgcgtcgagggcagagtcacggacatcaagctgctcaagcggcagatggcaggccgagccggactccccctgctccgcaagcgcgtccttctcgtcgccgccgaccgccgacaacacagagttacgaaccagacggctcac

SEQ ID NO: 265 - DNA, 2208 bp, Streptomyces avermitilis
  CDS (1)..(2208)
atgacgcccgctacacccacaccaccgtctagcaccccgccgtcgtggccgcagtgcggccacggcaccacaccggaggaccccgccggctgccgcgggatccgcgtatccggccacactgcatgcctcgcccacctttccgatgccgaccgcgacgcctacctggccggcctgagccccggcaacaacgtcgaccaccgcggtacttccttcagccaagacctgctcgatgccctcctcgatgccctccgcgatcccgacaccggcgacccccgcctcggtgtcgcccggttcaggtcggcgaccttccagcgcgacgtaggattcaggtcggcgacctttcagaaatgggccgacttcgggtcggcgaccttccaaggcaacgccgggttcaggttggcaaccttcgagggcgacgccgggtttgggtcggcccgcttcgagggcgacgccgggtttgggtcggcccgcttcgagggcgacgccagcttcgtgtcggctactttcgaaggcgacgccagcttcgtgtcggctactttcgaaggcgacgccagcttcgtgtcagcgaccttccaaagcgccgccagcctcgggtgggcagccttccaaggcgacgttaagttcgagtcggccaccttccagggcgacgccgttttcgggggtgcggacttccgaggcgacgctcggttcgggttggcggccttcgagcgcaacgctcggttcgggttggcgagattccggggcatcgccagcttctggttggtgacctttcatggcgacgcctggttcaggtcggcgattttccgtggcgacgccagcttcgtgtcagcgacattccaaagcgacactgacttggaggcggcgaccttctctgaccacacccgattcgacagggctaccttcttcggcgacgcccggttcgtcgaggcgaccttccgcggtgacaccagcttcgtgtcagcgactctccaaagcaacgctaacttcctgggagtgaccttcgagcgcgacgctaagttcgagtcatcgatcttccagggggacgccaccttcgtgtcggcaaccttcgagtgcgacgcctgcttcgagcaggtgggtttcgagcggtcggccagtctcgggccgttggtgtgtgccgggcgggtgaagttgtccggggcggtgttcggatgcccggtgaccctgtcgttcgccacgcgctgcctggagtgccgacggacgcgttggtcgtcaacggccgagctgcgcctgcgctatgccacggtggacttcgcccatgcggtcttcgagtaccccctgacgatcgccgcggaggccgaccccttcgtgctccacaacggacgaccagtggcagaacagagccttatcgacgcgcccgacatcgaagttcgcatagcttcgctgcggggggtagacgcggcccatctggtcctctccgacgtcgacctgtcaggatgcctgttcaccggcaccgtgcatctggaccagatccggctggagggcacctgctctttcgccagcgtcccgcgccgcacgcactggcggcgctggcgcccccttcggttcacccagcgacgcgccctcgccgaagaaggcttttggcgtgcaagccagccgacaccagtgccgggctggaacgcggcagtggccggcgccgtacacgccggaccggcacagttggcgccggtgtaccgggcgctgcgcaaggcgtttgaggacagcaggaacgagccgggggcggcggacttctactacggtgagatggagatgcgccgccacgaccgcaccggcagcacccgcaccgaacgcggcctgctgcacggctactggctgctgtccggctacggcctgcgcgcctcccgggccttgggctggctcgccgcagccatgctcgtcaccatcgtgctgctgatgggcttcgggctcccgaaggactctccgaagcaggtagcgaccggcaccgtgccccccggcgatggcaaggtcactctcgagatcgacaaggctgatccccaaaaccccaccggggacaggttcaccagcgagcgcttcgagaaggcactgaccggcacgctcaactcggtggtctttcgctcctccggacaggacctgaccactgctggcacctacatcgaaatggcgtcccgcgtgaccgaacccgtcctcctgggcctggcggtcctggccgtccgtaaccgcgtcaaacgc

SEQ ID NO: 266 - DNA, 411 bp, Streptomyces avermitilis
  CDS (1)..(411)
gtgggaacacgtctgcggcttcgacgtgcagatttctcagacggccgctgcgaacgcaaactcactcagaaagtgccggtctctcgtcccggcggtgttcagggcctgatcactaacacctacttgtccccgacggagtacgacctgctcgcgtcgctgcctgccgcggtgctgtccaagacgcgtttcagcgtgcctcccttgggcgtcgacgtcttcgacggtcccctgcagggtctggtcctggctgaggccgagttcaccaccgacgaggagacccagtccttcattcccccttcagagtgcgtggcagaggtgacggacgacgcccgcttcactgggggacggcttgtcgagacctctcgccaagagctgctcgggtggctggctgagtacgggctccgcccgcag

SEQ ID NO: 267 - DNA, 657 bp, Streptomyces avermitilis
  CDS (1)..(657)
ttgcctcatgtcgtgttgcggctgagggagtcaagtggctgctcttatctcaaccggctcgccgacgccaaccgcctgccggtccagttccggcccatcctgctcgggcataaccggcatcaccgccgcgacgacaaccgccccggtcgctggacacccgagaccctctgccggctctccgccctgacggggcgaacggctgccgagttgtctcacgcgatcccagccctcgccgtgatcggcgaaccggccgagaaccgtctgcagtcactgagcggccaggccgtcgaagtgctccggcgtccggcttgccgccggtgcatggcccgacgaggctttcacgggctcgtggtccgcaccatcccgccccatgaagccgtctgtctgcggcaccagcgttggctcctcggcgacgagcagtatcgccttcacgccctgcccgaactgcaacaggccaaccgccgacattgccgtcttgtccgtcgaacccgagcctccatcctcgctcgggagtacgccgttgcccgcgactgcctccgggactggttccaggacggaaagccgtcagctctgcgacaacgctggaacaaacgcatcgaccagctcggcgaggacccctacggagacgagacccccgtcgcccctcccagccccgga

SEQ ID NO: 268 - DNA, 357 bp, Streptomyces avermitilis
  CDS (1)..(357)
ttggtgaagatgctggaggacccggccgctcacggagtcgacctggactgcaccatggtgctgcacgagctcaccggggacgagtggccggccacccgcgcccacgccgaggagttcgtgctgccgcaccttcgcgagcaccgtgtccggctcgttcaagtcgcccgggccagccgctcgttggagatcacggtcatagacgactcccgccagccgcagcggatcgtcgagcgggggccctgggcactgtgggatgagtacgagtcgggcggcaccgttccccagcagggcggtattcggctctgcagcctgcatgccaagggcaactggcggatgcccttgtcaccgactacctgc

SEQ ID NO: 269 - DNA, 600 bp, Streptomyces avermitilis
  CDS (1)..(600)
atgggccggttcacgacaagcctggcgtcttctactccaactagacgaacccttggcctgttcgtcgccctccttctcgccgtggccgccgcctacacgctgaccggcggccagaacaccggcatccccgaaggagacgccctcaacggcggcatgcagtccgccggtgacgtcggctacgaacacgcccaggtcggcgaggagtactgggccggactgccgctcccctggaacgagtccggcaaagacatccagatcacgcgggcgaagttcacccacgtccccaagggtctgaaggtcatcgagtaccgggccttcaacggcgacgacaccgacggcaatgtcctgttcgcacgcaccgacggcaagggcagcgtgggcgacctgttcaaggctcgcaactacgccggccatcccatgacggtgaaagcgaaaacgggcagccacgtgtactacgtggcacgggtcaaggtcaccggcccgatccacgacaatctgtccggctgcagctactggtaccggcagggttccacggagttccagcagcaactggactgctcgaccatcgtccgcctcgggaaacccctcaagtacgagggc

SEQ ID NO: 270 - DNA, 2298 bp, Streptomyces avermitilis
  CDS (1)..(2298)
ttgggggaaccaatgtcttctgtttcgagggggcgcggcacgaccacggccatacaggtgctgagcacgatcgtgctcgccaccggcctgaccgtcgccccgcaggccctgactccgggccacccggcatccgctgcggatgtcagctgcactacctactccgtgtcgacgtacgtctttgagcccgccaccagcagcaacgccgccagcaagcgagttctgcacaagtacatggagtggggaccgaagagccccgacactgacttgctggacacgctgtacacggcgagcctgccgatgaccagcaaggtcttcaccggcggcggcaacggcatcatctacgaggccacgggcggtggccaggtgaagtcgtacaaggacaacactgccaccggcggttccctgctcaccccggtcaagacctacagcttcaactggtcgtcggcgaagcagatcctggccaatggccactggatcctggtgatcgcctccgacggcacgatggacgtctacaagcagtccagcccggacagcggcgacggcacgatcacgaaggtcatggacggcgcaaagtcgtccgtcacgagtgcgatcgccgacgccgacgacgcgtggatgatcaattccgcggtgcagtggctgaaggacggtacgatccagcaggccgctgtcacgtcgctgcccccgggccccgccaacctgccccccggccccggcatcaggctagaggcagcgaccagtatcgccaccggtgttgacgctgcccaggcatgggcacccggcccgaacgccatcagcacccagtcggtcaccagcgatccggacaccaccgggcagatccggtccttcaccaccggcccatggacgagtgcggacagcgacgtacgctcgggcatcctcggcgacgtcatggcggatgcaggtccctgcctgaccgacccggaccaggacacggtcccctacttcggcaccccgcccgtcgccgacaccgacgtccccaccgcgcaggagtcctcggacacggcaccgtcgacgccgtcgaacacgatcaccggcaggttcaccctcggcagcgggcagccggcgtcagggctgacggtcatggtcactgcctcggacgtcgacacgggcagtgacaccgccaccggggggacagagcccctcctcggtaaggcgactacagcatccgacggcgcatggacgctgaccctgccctcgacgctgccggcgaacgtgaagcaagccatggacgacaacggcggcgcgctcaacctgaacgccaccaccacggccaccacctcctcgggtgtacaggtactcggcgcggacacgctgaccgccgtacccgagcagtccaagaccgccctcgccgccgggaccgacgcttccgcccgggccgcagaggcgatcaacgacaatcacaccgtgcccctgatcccggacaccgtggacgacaccgccgcaaaggagcccaccgccgaccaggagaagcagaccttcgctgcccagaccaaagccgacccgcaggcgacgggcgagatgacgccgatgtggcagagcgaccacagcaccctggccgccagctacaacccgtatcttgtgggcggcaaggacatcagcgccgagacggtcaccccgcacgcgtccggatcgtgcgacacggtgaagtacaagcagaccagcaagatcaagtacacggtggtcggtgaagcacacgcgaactgggactcgaaggcctcgttcgactacgacgacaccatgaacagcgccatcgacaccgccgtcaacagcaacggcgactggaagctcggtggcagcatgcaaatctcgtcggagaccggcgtctcgacgggctaccccaacaagggctcctactacgcccaccagtaccaggtgccgatcgagtacaacaagtacaagaagcagaggatctgctccggcaccgtgcgtgccacctggtacacgatcgagcccggccgctacaaggtcccctcgggcggctccgtcggcaagatcggcaaggacgtgtcggccaaggacggctccggcaactacggcagggccccgaagagctaccacgccaaggtcgacaacggcacgtacttccagctgaccaggaagaagagtgccaagttcggcaacgccgtcaacttcatgggcgtcggactcggcgtcaccaccggctacgacaccaaccacaagcagaagatcatagccggtacccgtaggaacgcgacacacctgatctgggggaagaatgggccggttcacgacaagcctggcgtcttctactccaac

SEQ ID NO: 271 - DNA, 822 bp, Streptomyces avermitilis
  CDS (1)..(822)
atgagaacgccgattcttgagcttgctctgagcttccccggcacggactttgcgagatcaacacgcacatcatgcggtttacttaccgagcagttaccgatcggtaatgagcgcggctcggcttcgacctgtaggccaccgaacagccgcacgcgggaaccaggccccggcgactactgccgccgaccggcttcggatgatcgacagcgggggcgccagtgtcggcggttcctcaccctcgcgatcacgagtccccatggggaaggcggttttctttcgggagaacgatgttcgccagtgcgcccttggaggccctggtcgtgcccttacgatgatctgatgcgccaggccgacccgaagccgtactggaacaccaacgtcgcccggcacccgggcatcctgcgtgccgtgcctaagaccggcaccgcttccgcgacggcggcccagccgctgttggactacatcaaccgccggtatccgctcacgcagacgaccccgctggacgccaacaggttcagggccaacgcggtacccgaggccgagcccggggacatcatcgcctacgactggcagaacgacggcgaggtcgaccacctgtccctcgtcgtcgacatcgcagacgggcagtatccggagatcgccgagtggggtgtcgtcgactggaacccgctcggggtgatcaaccggaacgcgaccacgccctacgccaagcgcggctggacgtactccgagaagaaccacaactggctccagtcggtcgaggagacccggaacgtctcggcgaagttgatccacatcgacaccaggaacgtcaccaccttc

SEQ ID NO: 272 - DNA, 351 bp, Streptomyces avermitilis
  CDS (1)..(351)
atgggagttgaaagaggcgccatgctggacgagttggtatcggcggcagcggcggcgggcggatctgcagtggtccaggcagcggggactgacctgtggaacggttttcggggccgggtcgccgagtggttcggacgtggggacgcggtgcgggagagccgtgagctggagcggctggaccgcagcgcgtccgaactgtcgacggccggccaggacgaggtggagcggctccgggtgcggcacgaggccgtctggcagagccggatcgagaccctgctggaggacctggacggggtcgagcgcgaccaggcggtggcggagctcagcaaactcatggcccaggcccgccca

SEQ ID NO: 273 - DNA, 1041 bp, Streptomyces avermitilis
  CDS (1)..(1041)
atgtgccttgagcagcggcaaggccaccgtcgcgttgtccctcaccccggagaccgacgtccggcacgccgtgatcgcccacctccgagccgggcggcatcgggccctgcccgcggccggacatcgaatccactcgcaccgaacggcagggagagcagcatgaccaacgggaggatccacaccgactgggtggagacggtgtctcaggacggcctgcacctgatgcagacgcgcttggaggtgagagttcctacgtctgagggtcgcaagttcatcacctgcggtctggcccggaagacgtatgtggtgaaagacggtattgcttgtcgggtttcgtcctacgcactcggccgcgacctgggcagcccgggcaactacgacttcgagatcgtttctgcgacggggggccctccgatccggaggttcttcaactgggacggcgtgccggccgagatactcgagggcgctctcttcgacgcgcatgaggggcttgacgatggcgagtacatcgtccggatcgcggcgggaatgacgaccagctgggacagcgggacgggacagagcatcgagctccatgtcccgtgccacgaactcgcattcgtcgtggtgggatccgcaccgcaggaggtgcgcgcgcgtaccggcggcccgtgggcggcgcggccctccgtggagatccccgtggtcgattggcgcgatcagcccacggcggaggcggcatgggaggcctacctgaacgggagcagaatcagtctggatgcctacgggatcttctccccgcagcatctgatgaggaatcaacgggataccgctctggagattctccggagcgagggctacgccataccgcgaaccccggaacccgccgagacgcctgggacctggctgggccactggggtggagcatggatgccggccgatgtactcgcggcccttcacaccgtgccggacgacaccgcgcaacgtgcgtggtatcagggagcgaaggaatccctggacatcgcatgggatatgcacctcctgtggaccaccgacgtgttc

SEQ ID NO: 274 - DNA, 462 bp, Streptomyces avermitilis
  CDS (1)..(462)
atgacgtctccggacgagccggttccgcaagatcgagcggatcagtttcgagatccacgacggcgggttctccgccatcgacctcaccgcccgccacccgcgcaccggcgagctgctgtcatggggcaaaccctcgccgccgccggcggacttcagcgcgacctccagcgcgagctgacctatgacgggctacgcgccgccgaggccaagggcagcaagggcggacgccgccccgccgtggcggccgcgaaagccgagaccgtgcgcaccgcatacctggaaggccgctcaatcgccgccctcgcgcgcgaccacggcgtcagccgcggcgcgatccgcacggccatcgccgacctccaacaccttggcgagatggagtggatcgggcccgtgggtcagggcctcttcggcgcgacggacggcgggcgcccctcgcaagccgccgcccacgccggcctagtg

SEQ ID NO: 275 - DNA, 219 bp, Streptomyces avermitilis
  CDS (1)..(219)
gtggagcggtggttcggcctgctgaccgacaaactcatccgccgcggcgtccacacctccgtgaaagcgctggaggacgacatcagggcctggatcgactcgtggaacgagaaccccaggcccttcacctggaccaagactgccgacgagatcctcaagtccctcaccgactacctcagtaaggtaactccgccagccaccgagaaccagcaaggaact

SEQ ID NO: 276 - DNA, 738 bp, Streptomyces avermitilis
  CDS (1)..(738)
gtggccgaactcgcctacctggcaggctggaaacaccacgacctcggccaggaaggcgccgcccagcgctactaccaggtcggctaccaactcgcctgcgaagccgacccgcacggccacgccgcctggatgatgcgcgccctcgcccaccaggccctcagcctcaaacagccccaccactgcgtcgacctcgtcgaaggcgccctcacccgcggcctcggccacgtcgacggccagaccgaagccctgctctacatcacccacgcccgcgcctacgccgtgaccgacgagaagtccgcagccgcccgcgccctgctcgccgccgaagacgccctcctgcgcgacgacgtcccccagcccagctactcccgcgtcagcggccccgcagccggcagcgtagccagccacaccgcccgcaccctcaccgacctcgccgacctcgccgaccacgctggcaccgaacaacagcaccgcgacgccctgatccgctgggacctaaagaagtacaagcgcgtccacgccctcacctacgccgacctcggcgacagcctcgccgcccaggcccgcgccgacgaggccgtcgccgcctggtcgcaagccctcaccctcatggaaggcatgacctccgaccgcacccgcaaggcgatcacctcgctccgctcccctctctctgtctaccagcgccgcaaggtgcccggagccgtcgaactcgcccgccgcgcacgacaagcgctggcc

SEQ ID NO: 277 - DNA, 504 bp, Streptomyces avermitilis
  CDS (1)..(504)
gtggctcagcggacaacggacgacctgcccaacgccctgccgcccgccctcgaatccatgaccctgctggtcgccgccgtcatcgtccacgaccaggccaccaaccgcgtcgtcctgctccagcgcagcgagaacgccaaattcgcccagggcatgtgggacctccccgtcggcaagagcgaacccggcgagcccatcaccgaaaccgctgtacgcgagttgcacgaagagaccggcctgaccgtgaagccggaggccctcatggtcgcccacatcatccacggctcctggggcgtcgaggctcccaacggctttctgaccgtcgtcttcgccacccacgaatggaccggcgaacccgaaaaccgcgaaccacgcaagcactcccaggttcgctgggttgacgccgacgccatccccgaggagtgcgtggacaccaccgccagcgccctccaccactatctgtccggaggagcccaggtgtcactggacggatggctcccaaag

SEQ ID NO: 278 - DNA, 384 bp, Streptomyces avermitilis
  CDS (1)..(384)
gtgcacgcactgctgatactccacgctgcgggctaccggtgggaggtggtcgactcgcttgcagcgcttcggctggcagttcccggccgaagcgctgcatacaccgctcgctcacgcgtcacgcctctcggtgtgcgagagtcgatcaccgcccgcgaccagtccagcttcttcgcggcccgcagctttctcagcagcactacgtgcagttcgtcccaccacgccgcccgcctcctccaggcccagcaggacggcaccgacgaggacgacctccgccagatcgccgccgaagcgctcggcgaggtctacttccgcgacaacggccgccgcgcccagagcctcgaagtgaaactcaccgacctcgtcgacctcaagttcgagctg

SEQ ID NO: 279 - DNA, 405 bp, Streptomyces avermitilis
  CDS (1)..(405)
gtggcatttgctgaactgcccgacatcccgggggcattgctgcgaacatcggtcttgttcctgggcgagcgaaatcaggtgaggcagagcgtgaccagcgtctacacggagttgaccaaggaagccgggaagcgaggcgggcccgcagcactgcgggccttctaccgcatgcagggggccctaatcggccgcgcgcagggcatcgccatgggccgcgcgcagggcctcctcatcggccgcgcgcagggcgccatcgtcgccgcgagtgtgagcatcgccgggacccagctctacaacagggtgcgcggccgcgggtgcgattccaccgccgtgcccacgcccatgccagccggggagaacggcgccggcgccgaagttccgacgcagggccaagaggacgacgcg

SEQ ID NO: 280 - DNA, 810 bp, Streptomyces avermitilis
  CDS (1)..(810)
gtgggcgaggatcactccatggccagcctcgacgaactgcccccataccgacgcgcgcagttgctgtggcgctgggcgcacgagggggtggcgttcgtcgagcacttggtcttcgacgccgcgaaggaaccctgctgcctgccctctcccccgccggggccgccgggcaggaccgtcgcggtgcccggtgacgacggccggttccacctcgagcgtgcgggcctgatgctgtgcgggcaggccgaggccaccggcgcctggggccaccgtcagcactgcgggtgggtcgagcggtgggacgggccgcaggagtggagaggcggccgcgatgacggcacgtcggtctggggctccctcatcgtcgagtggccggtgcgggcgagcggcccgggcgtggacccgggcagcgtcgaccggcccgagcgctgccccggcggcgcgtacgagctgctgcacctgtggcctccccgcccggcccgtacggcatccgtccggcgcctgcgtgccgcgctggtcgacgcgctcggccccgactgccatctgtgcggcctgtaccccggggcgatggtcgaccatgaccaccagacaggtcgggtgcggggactgctgtgcgcttactgcaaccggctcttggaggaatgcccgcacctcaccgactgccccagggccgactatctgctcgcgcccccggccgacgcgctgaacctcatgtacccggccggccagcagtggcggcccaaggaatccacgcgcctgcgggtgattgagcagctggggttcgatccgttcgaggacctgcgcccgcccttg

SEQ ID NO: 281 - DNA, 366 bp, Streptomyces avermitilis
  CDS (1)..(366)
gtggaatcgtgtccgggtgtcgctcatcatcatgggatggggggccagatggacacggcgcggttgcggagtctgatcgacggcgtgctcctcacgcagtacaggcgctacaccgagaaggaactgccggcgctgtgcgagcgcctcggccttccctcgcccagcgcgggcgacaccaagcacaagcgcctggtagccagcctgaaagcctgccccgacgaccgcctgccagatgtcgccgaggcggttcttgagcaggaggagttggaccaggccgaacgaatggcgctgctggccagcgacaccaagatcgctcgactggctgctccccgggcgccgcgtgtcgtacggcgcccaaagaagaag

SEQ ID NO: 282 - DNA, 1080 bp, Streptomyces avermitilis
  CDS (1)..(1080)
ttggccagcaggcaaattcgcagtgcgcccgcacgccgcccctctaccttgatgcgcatgtcgcacaaatcgatccacgagcacctgctgatatcggcccggaagtgggcgcgcacggcggtcgacgcgtacctggaggagcccatcgaccaggacttcgccgtgcaccacatggcggtcgcggtggaacacgcgtccaaggcatacctggcgtccatcgctcccgtgctcctcgcgtcggagaagcaaccgagcgtcgacgacctgctggtcctgagcgggaacgaggacaagacgaagaagggccgcgccgggctcaagaccatcggcggcgagggcgccatcctcagggcagcccagctcctcggccccgggcacaaggggcctgccaagctcaaggaactgagggagtcgcgcaacggcatcacccacatggggtggggccagcccgtaaccgagtgccgcgaactcctggccgcgggcatcgagcacatcaacgcgctcctgaaagctctgtcgacagagcccgacggcttctggggcacacacctcgaagcctgcaccgcgctggtggcccaggccatgagcgaaatggagatccggtatcacgcgaaactccggcaggcccgcgagcggttcgccgagaccacccggcgcctgtccgaagccgagatcgccgagcttgccagcagtctctccgctctgccgacagcgcactcttcgaggagcaaaactgaggcgcggacagtcgagtccggctccctcacgcactgggaccatgagacacgcgccccgatgagctgcagcactctctcggcccgggtgagctgcatgatgtgcgggccggcccgggccgcgatgcgtcgagcgcgtcctcgccgatcctccgccgcccgtcggtgtgaaccgccgccgcaccgcgctcggcgccccggacaaagtgaccgtgcgcgaactggcaggcgtcccggcacaagcgctgagcgattaccgggaccggcacaccggcgacgactccctcgtagaaaaggctctcctcgcctgcgccgcgagcggacacaggtccgaggccgacttcga

SEQ ID NO: 283 - DNA, 396 bp, Streptomyces avermitilis
  CDS (1)..(396)
gtgcagggcactgcccggcggagggcgggtgagaggtcagccgacgatgtcgacgccgaaggcgcgggccaaggcggccagttggtggtcgtatccctggccgaccgcgcgtacgcgccaaccttcggccgagccggactccgacgcatccgcttccacaacctccgccactcgaccgcgaccctgctcctggaacagggcgtcgacctcgtcgtgatcaaggaactcctcggacacgcccacatcggcgtcaccgccacggtgtacgcccacctccgactccgcctccagcgcgacgccatcgacctcctcggcaacgcccttcgcaaccccgacgagaccgccatccgacccgacgacggtgacggacccccactttgtgcagcacccgtccac

SEQ ID NO: 284 - DNA, 7092 bp, Streptomyces avermitilis
  CDS (1)..(7092)
gtggctgttcggcgtgcgcgccttgtttcggtcggtttcgcgggtgcggtactggcggggttgctgtcgacggtatcggtggtgtctccgatacaggcagccgcggcttctgacgatccgacgccagtggtgccgtcgcagtctctggggtcggtcccggcgcagcagactgaggaggtcggcaaggcgctccccgctccgaagtggccgagcgcggccgaggcaacggtcgatctgtcggaggcggctgccggagagccggggacggtgtcgcccgaaccatccgcgtcggcttcgggcggtgtcggtgacggtgagagcacgcaggtcggcgaggttgtggaagttgctccggttgcggaggatctgggcaccgaagcccagctgagtttgtcccggctggccgacgagagcactccttccccaagcccgagcgtttcggacggctccgaaccgagcacgccccctacggctgaggcaagtccctcgccggagccttcagagtccgcttcggatgagcccatccaggacccggtgtctccggaccaggtcgaggtgcgggttctggaccgcgaggccgtggccccggccggcggtatcggcctggggctgcaggtctcccggaccgatggcgtcgatgccccggggcaggtgcaggttgacatcgactattcgggcttcaagtacgcctacggcgctgacttcgcctcccggctgaggttggtgaaggtgcccgcgtgtgcactgcagacgccggatgccgagagctgcgcagaccgcgagtttgtgccggtggacaacgacacggactccggcaccctgaccgctaccgtgacggcggctgccgacacgggctccgcgggtgcttcagcgcagctgatgcgggaggcgggctccagcagcgccagtgtgtacgcggtgacctccagctcgtcctcggacgcgggggattaccgggcgtcgacactgtcgccgacgggttcgtgggaggtgtccacagggtcgggctcgttcaactacagcgtgccgatccaggtgccggcgccgccgatgggctcggcgccgtcgctggcgatgtcgtacgactcgcagtcggtggacggccgtacctctgcttccaacaatcaggcgtcctggtccggtatgggctgggatctgaacgtcggcttcatcgagcgccgttaccgcaactgcaccgaggacggcctgcccacgatcggtgacatgtgctgggactcgccaaactcggctaaggagccggacggagcggcctacgtcatcagcctcaacggcaccacctcggagctgatccaggacaacaacggcagcggcgcctaccacctcaagaacgacccgggctggcgtgtgcagcgtctgttcgacgggcacggcgcgggccgcaacggcgagtactgggtgatctcgacccaggacggtcagcgctactacttcggctggggccgctcggagcgcaccagtacggcgaccgcgtccgtgttcaccgtccccgtcgtcggcaacgacgcgggcgagccgtgccacgaccagttccccgagccctgcacgcaggcctggcgctggaacctggaccgggcggtcgacgccaacgaggtcgagactatgtacttctacgacaaggagtacaaccactaccgctcggtcgccaacaccgacaaggcccgcgagtacgtctcatccggctatgtgaaggagatccagtacggctggtcctcgcagatcaccgacggcaaggtcccggcgaaggtcgaactcagccacgttaaccggtgcatcgagcgggtccaggagaacgaccccctgcgcgacgagcccgccgcctgcccggccttcgacgacaaaccaggctcataccccgacgtgccggtcgacctgatgtgcgacggcacgtcggcggactacaactgcgcgggcaagacgtacttccccacgttcttctccacggacatgctgtgggacatcaagacgtacgtcagcgaccaggacggcaccggctgggacctggtgcagcaataccagaacaagtacgggatgcccaacccggacggcacgatcggcaagaccctctggctcgactacatccagcgcaagacgtacggcgacggcgacgacatcgtcttgccggtcatcaacttcaaccgcaccgacctggacaacaaggtcggctccgccgagctgaacttcccccgcatcaaggagatccacggcgacctcggcgccaccaccacggtctcctacggtttcgccaatgcctgcgatatcgaccacctgcctgctcaggcctccaacacccaggactgctactggcagaagtggaccccggaaggcgagacggactcgaagaccggatggttcaagaagttcctggtcacccaggtccaagtcgacccgacagtgacgacgaaccaggacggcgcgccggtgatgacaacctcgtacacctacgaggacggcgccggctggcatttcaccaacgatccactgatcaaggacgaggacgagtcctggaccgactggcgcggctaccaggaagtccaggtcaccaccggcgcgggcgccggccagaagaccaagaagtcctggctgtaccgaggcctgtcgggggaccgtacgtccaaggcggacgcgtcggcgacgaagacggtcacggtcgacgacggcgacggcaacaactacaccgacgactcctggctgtccggccgcatcctgtccacatcgctgcgggacgacaccggcacctctcacgagcgcacctaccacaagtactgggaccacaacaccgcccagtacgacggactgcccgacgcccgcttcgtccgcgagaaggaaaccaccaccaacaccaaggtcagcagcggctggcgcgaacacacggtggaaaccgagtacgacgacaccgagggcgcctccaccacattcggcctgccgatgcgcaccgacgactggggccagagcagcgtctccgacaaccgctgcaccacctacggtcgcgcctacaacaccgacaactacgactccaccggcgcccagcggtggaccgtgctccaggaccaggtcaagcactactcggtcggttgctccagcatcgccgacagcaagcaggacggctacgcgtcgacgctgtacgacaacgccaccagcgttgacgccaacaagcccgtcgacggcaacccgaccgagtcccgtacctatacaaagtcgggcagctatcgctccacgtggtccggctacgacgacgcggggcgtgtgatgtggagcgaggacggaagccacaaccgcaccctcacgaagtacagcccggccaacacctggccgttgaacggcgtcatcgtcaccactcccgaccccgatggggctctgcccgcccacaccgcgctcacgtccacagcatggacatcccggttctggggcaagccgacctcgattcaggacgccaacggcaacgtcaccaaaatgagcctggacgcggcgggccgtctggtggaggtgtggaggccaaccgaaaccggcagctcaccgtcgatgaagttcagctacaccatccccacctccactaacagcgctggagtgcccgacgcggtcgacggctacccgcacgtcgccacgcacgtcctgcagtccggcacgacatacctgtcctcacacgcctatgtggatggcctgggccgtgcccgggagacgcagacccccatggggaacggcgtcgatgcggccacgggcaacgaggtgcccaaccggcaggtctcggtcacccgctacgactcggccggcaacgtgaccggcacctcggcggtcttccgcaaccagggcacggcgggctccggtggaccttccagcgccaaggtcgaggaccttccgtcctacacggacctggtactcgactgggcgggccgtgccatcacctcacggctccaggtcaatggcgcctcgcaggatgcaggccgcgtggacacgacctacgacggcgacttcaccagcgtcaagaacaaggtcgacgctgccgccgacacatacaccgatgtctacggacaggtgtccaaggtcgtcgaacacaccggcagcgccacctacacgaccgcgtacacgtacacggccaaagacgaactgatcaagatcactgaccctcgaggaaacgacacctcctacacctacgactgggctggtcagcgcaccgccacggacgactctgatgccggggtcagctccaccgagtacgacaagaacggccagatcagcaagatcaccagcaatggcggaaagactgtcctggactacggctacgatgccctcggccgtaagacggcggtccgtagcggcgacaccgaactcgccgcctggacgtgggacggcctgaacatcactggcggcaaaggccagatcacctcgaccaccagccgtgacacgaacggcaacacctacaccaccaagaccggcgagttcgacgtccgcggccgcccactgaagacgaccgtcaccatccccgacaccgtgaagggtctcgccggtagctacacgaccggtttcacctacgacgcggccgaccacgtcacctcggtggcctacccggcagccggtgggctccccgcggagaccgtcaacgcgacgtacgacggctatggtcgccctctgcgcctgcaatccgcgctgcagacatacatccgctccaccggctacgacgcctacgaccgcctgacggaccggtcctacggagtcgactccgtcctccccggcatcggagcagcggcacagcgcacctacagctacgacgacagcaacggaacccgcgaactgaagagcgtggcaacgaccacgaccctcaacaaggtagtcagcgagcggcagaaggacacctacacctacgacctcgccggcaaactgaccgagctgcgcgagcaggccagtggccagaccgcccagtcgcagtgcttcctttacgacgaccaggcccgcctgaccaacgcctacacccacaccaccacgggcatctgcgccgacaagaccaagaccgcctccgacttcaagggcaccgccccctaccagaccgcatacacctacgaccgtctcggcaacctccagtcgatcaccaacactgactcggccggcaccgccaccctgcacgactacctctaccccggctacgacgacaccggcacctggacgaccgccaacgccaaccaaccccacggtgtccgcaagatcgaccacaagaccggcagcaccaccaccaagtcggaccagctctactacttcgacgacggcacaatgaagcagcgcgtcgagccgggcatcaccaccgactacacctggaccccgcagggacagctggaagcagtcaagaccaccaagtccagcggcagcgaactcacccgctacgcctacgacgccgacggcaacatcctcgtccgcaccaccccgcaggaaaccgtcgcctccatcgacggcatggaactgcgcaccaccaacggcaccaccgtcaccgcgacccgtgtctacgcgagcggtacagcaacggtcgccatgcgcaccactgagggcaccacggccaccaacggcaaggtcacctacctgatggccgacacccaggcgtctacccaactcgccgtcgacgcatcgaccggagcctcgacccgccgccgctacacccccttcggcgacgaacgcagcggcaccctgcccaccggcaccgacaacggattcctgggcaagaccgaggacaccagcaccggcctctccctcctcggcgcccgcgcctacgaccccaacctgggccgattcctcagcccggaccccctggccacgccgtatgccccgcagaacctcaacgcctactcgtacgcgaccaacaaccccatctcctacagcgatccatccggtctgtgccgccgcgacatctgcggtgacggttaccctgtcgccggcgacggggagcgtgccggttacacgggccagcacccgggagagcacgcctgcacttcgtgcaacagcgggaatggcggttatctgctggctggcgtcgttccatcggactgggataaggcgcaagagttctacgaccgagtcgcggaaatcatcgtcagctggccggctggttggaccgactggaactacaagccacacgaggaccccctcgccgaccttcgcgtcgggcaggttgtgtacaacgcgtgtgaggacgtcgggggttgtcctgatggcatcgacccgcaacgagacatgctcaatgctgccgtagccattgagctgcccggaaccaacggacggggcagctccaagaaggcggcaggcccttgcaagtgcttcctggctggtactgacatcctcatggcggacggatcgaccaaggacatcgaggaggtggaactcggagacaaggtccaggccaccgaccccaaaaccggcgaaaccggacctcgcgaggttacccgtctcatcaccactacgggcgacaagcacttcaacaaactctccatcgccacggaagacggcgccgaggaattgacggcgacccatgaacaccccttctggtcgccatccgagagtgcctggattacagctgggagccttgaaccgggcatgaccttgctcaccgatgacggtgacaccgtcatcgtcacgggcaaccgggcatttacccagcacgccaccacgtacaacctcacagtcaatgatctgcacacgtactatgcactcgccggtaccacgccagtcctggtccataattccagttgctcgaccaatgcccagattttgggtgacaacatgacggccgcaggtaccattcggccggccgagacggcggcgcatcacattgtggcaagtgcatctcccaaggctgcgtctgcacgggcgaaattggctagcgtcggaattgatataaatgatgcggacaatggagtattcttgccgcgcggatcggcatcgccaaatctgactggtgcgtctgtgcactcaaggattcacacaaataactactatggctatgtaaacgacatgatgtcgggagtgaggactgccaatgaggccagagatgttctaaatcatattagaaatcagctgaacgcaggctactggccg

SEQ ID NO: 285 - DNA, 525 bp, Streptomyces avermitilis
  CDS (1)..(525)
gtgatcccgcggaccttcccgcccgcacccgcctggtcacccgatgggcaccggatcaaagcggaactcgactacagccgcggacccgagaagacctgggtctacggggccttacgcgtccgggacggccagcagatcaccatgaccgcttcctcccgcaacagcgtcttctaccagcagttcctgcaacagatcgaagacgccaacccgaccggcgagctctggatcgtcaccgacaatctgtccagtcacaacagcctgtccacccggacctggctcgaagaccatccccgcatccaccacgccttcatccctgtcggcgcgtgctggctcaacctgcaggaaggctggtggcgcatcttccgcaaagccgccctcgccggccggtcattcgccaaccccgacgacatcgaacacgccactgcccttgcaaccagccagctcaactcccgtgccaacccctggatctggggcagacccgcaccaccaacccgccgactacggcgccgatatgtgtacaccgtt

SEQ ID NO: 286 - DNA, 573 bp, Streptomyces avermitilis
  CDS (1)..(573)
atggttttacgggcacgaccggggcgggacgaggacgaacgggccgtcgttcgccgattgtcgcgggcacggaaggctccccgcgatgcagtgatgcgggcccggatgatcgagctgagctggtcgggactacgggtgccggcgatcgctggagaactggactgcagccagaaaacggtccggtgctggctgcaccgcttcaaccgctcaggcctgcaagggctggatgatctgggcgggcagggccgcaagcgacggatcaccgaggaggaacgatcgcggatcatctccctggtcaagaccgtgccgccggggcggctgcggtgggagcccgtcggggagctatgggccttcgacgagtccgggccacctgagtggaccctggattctctggccgcggcagcgcgggccgagggggtcgaggtgggccgctcacaggtccgccgtatcctgctcgccgagggcgtgcgctggcgccgcacccggtcctggacaaggtcgaaggacccggacttcgtcccaaaaggacaaggatcatcggcctctacacccacccgcccgacgacgcgacgg

SEQ ID NO: 287 - DNA, 1272 bp, Streptomyces avermitilis
  CDS (1)..(1272)
gtggatgcacatgaagtgaaccgtgctcgggcgacgttggcattattcgtggctgacgtgttcgcgtcggtgccgcgtaaggaccagcgggcgaagggcgactgctatctgcgggggctgatgctggacggacggcgtaagtcgatccagccgatggcagagcggctgccggatggcaacgagcagaacctgcagcagttcgtgaaccagtcgacctgggatccggtgccggtgcggcggcggatcgcggagcggatggtggcgcagatcggcccggatgcctgggcggtcgatgacgtgtcgttccccaaggacggcaagatgtcggtcgcggtcgcgcaccagtactgcggggcgctgggcaagcaggccaactgccaggtcgcggtgagcgtgcacgcggtctccgacactgcctcctgcccgctgcagtggcggttgttcgtgccccaggagtgggcgcacgacgcgccacggcggcagaagaccgggataccgccagaggtcgggcaccgggagaagtggcgcctggctctggacatcttcgacgagctggccgggtgggggctggtgccgccggtggtggtggccgacgccggctacgggcagaacgccgacttccgcgacggcctggacggccggggcatcggctatgtcgcggccatccgctcggatgtgaccgtccatccgcacgatgccgagcctttcgcgccgccctggtcgggcaacggccgcaagccccagccccgctaccgcgacaagccgtcctcggtggcggcgctggcgaccggccacgggcggcaggccttcaccgaggtgacctggcgggaaggctcccgcggaccgatgcgctcgcatttcctgtccctgcgggtgcggccggccggggtcaaatcccgacgcctcgcccaggccgccgccacagacgaaaactgctgggacggtgtcctgcccgaggtcacactgctggtcgaatggcccgaaggcgccgaggcgcccaccgactactggctgtccaacctgcccgacacgctctccctcgccgaactggtccgcctggcgaagatccgctggcgcatcgagcacgactaccgcgaactcaagcacggcctcggcctggaccacttcgagggccgctcctggaccggctggcaccaccacgtctccctggtcaccgccgcccacgcgttcctcaccgaacagcgtctggccccaaaagccggtacagcggactcaccctctaccagaccctcgacgccatccaggacctgc

SEQ ID NO: 288 - DNA, 462 bp, Streptomyces avermitilis
  CDS (1)..(462)
gtgtctccgcatctcgatgcggtgcgggtggaacgggtgtgggcggcgggcggcgtggtccgtatcgcagcctgcacccgggagttgacggtggcgtgtccggactgcggccgcggttccgcgcgggtgcacagtcgctatagccgcacgctggccgatgttgctgtcggcggccgtccggtcgttatcgggctgtcggtacggcgactgttctgcgacggcccgggctgtggtcggcggacgttcaccgagcaggtggaggggctgacggtgcgctatcagcgccgcagcccgctgctgcagcacctggtgcagatggccggggtgctgctcgccggccgcggcggcgcccggcttctgcagatcctgaaggtgccgctgtcgcggacgagcgtgctgttccacttgatgcgcttgccacttccggcggcagcgactccgcgggtactagtagggctccgt

SEQ ID NO: 289 - DNA, 444 bp, Streptomyces avermitilis
  CDS (1)..(444)
gtggccatccacgccctcacgcacgaagacctgccgcgcctgctcctggacgacctcgaccgagcccggggacgactgcgcgtccgccgccccggacgcgccgaccactacatctacctcgaagagatcaccaccgccctggccaccgcctggctgcggcagccccatcacagctggccacggaccacgaacccgcacctcctcgtgagccgcatctctgccaccgatcccaccaagccgatgctcagcaccgaggtcaccaagaccgtgttcgaacgcgccggcctccccgcgcgccgactgcgcgaggaccgcatctacgacgaagcccgccatacagccgacccggtccacctgatgcggctgttcggcctgggcaaggccacagccatgaagtacgtcacggccacccacccagacaagcgcccggacccgatcgcccct

SEQ ID NO: 290 - DNA, 2118 bp, Streptomyces avermitilis
  CDS (1)..(2118)
gtgagggcgtggatggccacgagggcgatgatcagctggcttcgggcgtcctcgacgcgggtcaggagacccttgagggtgtcgctcggcagcggggccgggagccgtggagcggtggtcagggtgatgtggcgggcggggtcgcggaagatcttgcgttcgcggcgcagcgcgcgaaagagcgaccggagcggggggtggaccgaatgccggcgggcggcttcggtcccatcgaggacggcggtgatgtggctgctggtgatctcccggaggtccgtgatcccctcggctgcccaggcgttcaggaccggggcctattcgcgtgatccgttctgctgcttcaccaccggccaggatctggcgacgttcttcgactgtcaccggctggcgttcgcgcacttcggcggggtgccgatgagcatcgtctacgaccgcaccaagacggtcgtgcgccggcacgttgctcccggtgaggcggtcccgctgcacccggaagcggtcgccttcgcggggcattacgacttcgacgtcgacgtgctggccgcctaccggccccagggcaaaggacgggtcgagcgccaggtcggcatcgtccgggaccatgtgctcgccgggcgggctttttcctccatcgaggagatcaacgcggccttcgccgcctgggtgccactgcggcgagcgaaggtccatggcacccacggcgaggtcatcgggcaccgggccgtgcgcgatcacacggctctacggccgctgccgacaactccgtatctggtcacgcagcggcatctgcggcatgtcggcaaagactgcctggtcgccttcgacgcgaacctctactcggtccccgcccgcaagatccgccctcgccagctggtcgaggtccgggcgacgaagtcccaggtcacactgcactccaccatcgccgaccgggacggtcagacgatgctcgccgtccatccgagggcagtcggccgaggcgcccgcatcgtggacgagacccactgggacggcctcgccgaggaggcggcagctgcggtcggcgtatcccaggcggcgggttgcaggtggttctgtcacggtggcggcatgccaccaatggatcttgctccgcagtccggccggtacctgtcctttcacgagcgtgaagagatctcgatcctcaaagcgcagggcatcggagtccgggagaccgcgcgacgtctcggccgcgatccatcgacggtatcccgggagctgcggcgcaacgccgcgacccgtggcggtcggctggactaccgggcttcggtcgcgcagtggaaggccgacctcgtggcccggcgcccgaagacagcgaagctggccgcgaacgaccggctgcgggactacgtgcaggcaaggctgtccggccaggtcagccgcccggacgggacggtcctgggtccggagagcccgcggtggaaggggaggaacaagccgcaccgcggcgaccgccaatgggtcatggcgtggagtccggagcagatcgctaaccggctgaaggtcgacttccccgatgatgagtccatgcggatcagccatgaggcgatctaccaggccctgttcgtcgaaggccgtggagcgctcaagcgtgagctcgttgcctgcctgcgcaccggcagagccctgcgggtgcctcgtgcccggtccaagcggaaggcgtgggcccacgtcacgcccgaggtgttgatcagcgaacggccggccgaagccgacgaccgcgccgtaccgggacactgggagggcgacctcctgatcggacttgagcgatcggcgattggcacgctggtcgatcgcacgacccggtacacggtgcttgtccacctgccccgccaggacggctacggcgtcgttccccgtaccaagaacgggccgccgctggccggttacggcgcggtgacgatgaaggatgcgcttgcggcgacgatcggcaccctgcccgagcaactatggcgatcactgacctgggaccggggcaaggagttgtcggcgcacgcccagttcacgatcgagaccggcgtcccggtctacttcgccgatccgcacagcccctggcagcgcggtgtcggcgtacaagtgaacgtggccctggcaagatttccg

SEQ ID NO: 291 - DNA, 624 bp, Streptomyces avermitilis
  CDS (1)..(624)
gtgccgctggagcgcatcgtctccaccgcactgcagatcgtggacgatgaaggggccgacgctctctcgatgcggacgctggcccagcgcctgggctcgggcacggcgacgctgtaccggcatttcgacaaccgggcagcgctggtcgcccatgtcgtggaccgcatgttcggcgccgtggaactgaatggcgacgaactcctcgcgatgggctggcagcaagcgctgcggacggtcgcgcataccatgttcgaggcactggcccggcaccggaacgcggcgcgcctgctggtcgaagagatacccctggggccgaacgccatggcgctgcgggagcactgtgtcgcggcgctgctcgacagcggcttcccgccgcgactggccgcgcacgcgtttgccaccctctcccgctacgtcctcggattcgccatacaggtcaacggtcatggcggcggcgggcaactcgcggacgcacaagtgtccgccgtcttccagagtgtcgatccagccttgttcccggccacggttaccgtcgccgggtcgatgcccgttccgatcgaggacgagttctccttcggactcgaactccttctcagcgggctcgcccacctgcgcgacgacgcc

SEQ ID NO: 292 - DNA, 1347 bp, Streptomyces avermitilis
  CDS (1)..(1347)
atgcccgtcctgatcgtgatagcgatctacgctgtccggatcgcgcgcgcccccctggacccgcgcctgaagaagcgccacgtcggacccctgtcggtcacgaccggagcggtcatgctctacctggcctgggactggctcaggcccgagggcctcagcgctgtctatttcgtcggcgagttcgccggcgtcctgtccgcctacctgatgtcctgcaccctggtgctggccacccgcctgatgtggctggagcagtggttcggcggcctggaccgcatgtaccgccagcacaagcggtacgccgtatggtccatactcctgctcaccccccacctgctcctccactttttctccggtttcgacgggagccagtacggctacgcccaccggaccgcgtcggtagggatgggccatctcctcggtgccgtctccgccatcggcctgctgctgctcgtcctcatctcactcggccaggtcggccgcatcctccgactgccctacgagcgctggctgttcctgcaccgcctcaccggcctgctgctcctgtcggcgctgttgcacggctggttcctcgatctcatcatcaacggatccacgcccctcctggcgatctacgtcaccatggccaccgtcggcatgaccgcctacgcctacgacgaactggtgctacggcacagggaaccccgggcggactacaccatccaccgcgtcgagcggccgacacccgacatcctcgacctcaccctcacgcccaccggcaagacggcgcttcccgtgaccggaggccagttcgtctacctgcgggtcggcggctggcacgaacaccccttcagcgtcgccggaacgcaggccgacggctcggtacgcctcaccatccgggccctgggccgcggtacacgcggcctctacacggacgtgagcgaaggacaccccgcaaccctcaagggtccttacggcatgttcgaccacaccctcggcggaccccggcagatatggatcgcgggcggcatcggtatcgcgcccttcctcggctggctcacccaccccggtgcggagccggcccaaaccgacctcttctactgcgccgccaccgccgaagacgcaccgttcctctcggaactcaccgcagcggcagcacaccgccccgagttccggctccacccgacgttcagccgcagccacggccgtctgaccgccgaaagaatccaggccgaggccggaccgatcacccccgacacgcacgtcttcctctgcggccccgcctcaatgatcgaaaacctcacccgcggcctccaccgccagggcgtcccccgccagcatctccacgccgagcacttcgccttccgc

SEQ ID NO: 293 - DNA, 408 bp, Streptomyces avermitilis
  CDS (1)..(408)
gtgcccgacccatcccataacagcctcgtaacgccgccacgacgccgacaccctggaagtaccctcatgatcctgaccatcaccctcgcctgcctcatcgccctgatcttcggggcaagcggagtgctcaacacactcgcattgccgaaggcacgtgagctggccgccgagaccggcttctccgtcgccgcttaccgccgcatcggcgtgctgcaactggcaggagtcgccggcgtggtgctcggcctcgccgtgccgccgctcggcggcctcgcgggggccgggcttctcctgctgcttgccggagctgtggtcgtgcacctgcgccagggcgacccggttgccaaactcgtgcccgccgccgtgtgcgcggtgcttgtcgcgtcatacctcgcggccttgttcgcc

SEQ ID NO: 294 - DNA, 267 bp, Streptomyces avermitilis
  CDS (1)..(267)
atgagccgcaccctgctgcgcggggcgcacgtcatcacgatgacgccgcaccggccggacgccgaggtcgtcgacttctccgagcgcatcgtcatcagccagcccgcgctggacggctgttgcgcgacgccctggagcaccatcccgagcgcgatctgcggggcggagccgacgtcacggccagcgagcaggaggaactccccggctccgggccgggggcggggcacgctgcgcgcaggaatggacggtcggcgacaagccccgacc

SEQ ID NO: 295 - DNA, 1575 bp, Streptomyces avermitilis
  CDS (1)..(1575)
atgaacaacccgcaggccatcgacgtactgatcatcggtgccggcccctcgggctccgccttggcgatcgacctcgtacgccgcggcctcgacgtccggatcgtcgacaggtccccccacgctttcgacggctcgcgcgccaagggcatccagccccgcagcctcgaagtcctcgaagacctcggcgctctcgacgacgtgctggccggcggagacacctatcccaagctcgggctccatgcaggacccatcggtgtgccgtggaagatgttcccccacaaagaggcaaccccggacgtcccgtacccgaacacctggctgatcccgcagttccgcacggaccgcgccctgcacgcccggctcagtgagctcggccgcgaggtcgagttcggcaaggagctgaccgagctgacgcaggacgaggacacggtggtcgccaaggtggtgggcgcggacggggtcgaggagatcgtcgcccgctacgccgtgggggccgacggcggctccagtgcggtgcgcaagcagctcgacatcggtttcgtggggacgacggacgagtccgaccgcgtgctgatcgtggacgcctcggtcagtggcctggcccgcaaccggtggcacatgtggcccggcctcggcggcaagctcatcggcgcctgccccatccccgacagcgacatgttccagtggatgatccggctcacgcccgacgagaagccgccccaggagatcggcgccatcatcgaccggatccactcccacacccgcaaccggcacatccagctgcacgagatccactggaagtccgtgttccggcccaacatccgtctcgcggagcactacggccgcggacgtgtcttcctcgtcggcgacgccgcgcacgtccacacgccggccggtgcccagggtctgaacaccggtatgcaggacggctacaacctcggctggaagctcggccaggtcctcgccggagccgacccggctttgctggagacctacgaggccgagcggcagccgatcgccgccggggtcctgggcctgtctacggagaagtggggcggcatcgccaagctcgacccctccagcatgaagcgcggcaaggacgagcagcagctctccctgacctactacggcggcccgctcgcccccgacggcatgcgcaccggcacgctgcacgtgggtgaccgcgccccggacgcccaactgctcggcgccgacggcgccgagacccgcctgttcaacctcttccagggaccgcacttcaccgccatcgcctacggccccggcgccgcccgggacctcgaactcctcgactggccgacgacgggcgcccagttgaagcggctgaccgtcggatcggccgcgggcggcggccgcgccttctccgaccccaagaacacgctgcagagtgcctacggcctgactggcgacacactgctgctgatccgtcccgacggctacctcgggcacatcgccactcgggatttcctcaccaccacacaagcggccgtgcgggcaatggcgccgcaggcaaagacccgcaccatgtcccagccgagccacacctacccccttgca

SEQ ID NO: 296 - DNA, 903 bp, Streptomyces avermitilis
  CDS (1)..(903)
atgaagtacttcgtcgcctcggtcgaggaccgcaagctcaccgccgactcgcgcaaggcgctgcgcggcagtttcatcgagctgtccgacggcgtcacccactacgagttgacggggcccgaggacggagaagtggtcctgatggcgggcggtctgaccatcccgctgttctactgggacggcctcgtcagcgagctgcacgcccgcgggctgcgcacgctgacctgcagcgcctacggccgcggctactccgaccgggtacaggcgcgatacgacgagacgctgttcacgcgacagctggccgaactgacggaccggctcggcctgacggcgcggcccctgcacctggtcggcacctccatgggcgcgctggtcagcatgacgtacgccgcccagtaccgctcatcgctgtccacgctcaccattgtgggccctgccggtcttgcgaaacctcagctgacctccccccaccgactgctgcgcaacgactggctggccgacctcatcgcccggcggcgcggccgacagatacttcaaggacacctggggcacaacgtccgcgaccccgagctcggcgggaaactgaccgagatggtcctcgacgccttccgcttcgagggctcgctgtacgcggtcttcgacacgctgcagcacctgcctttcaccggccgtgacgacctcttccggcggacgggggccctgggtattccgacgctgctgctgtggggcgacgaggacgacgtcacgccgctgacgcagttcgacacagcgcgcgctctgctgaagccccagaaacatcacgtaattaacaaatgcgggcatatggccccctatgaacggcctcgcgacgtcgccgatcagctcgtcccgttcgtgtccgcacgcaccgaaaggctcgactca

SEQ ID NO: 297 - DNA, 831 bp, Streptomyces avermitilis
  CDS (1)..(831)
atgagtacctggtctgaaccccagcccgactcccggttcgtcgtggtggacggcctgcggatccactacaagcgtgctgggcatggcccggctctcgtgctgctgcacggcagtgcctcgtccctgcagcacttcgaccgcgcgacggatctgctgtcggagtcgttcgatgtcatccgttccgacctgccggcgttcgggctgacgggcccgcgcccggaccgcgactaccgcgttccggcgtacgccgcgacggtgacgggcttcctggaggcgctgggcgtgccgtgctacgcgttggccggtaattccctgggcggcaacatcgcctggaacgttgcgctggatcatccggagcggctgaccggcctggtactggtcaatgccaccggctacccggagaagacggtgcccgcgggaatgcgcctgacccgcaacccgctggtgcggcccctgctgaggcgggtgatgccgcgcggagccatcgagcgcagcctgcgcgagagcgtcgggccgtcttcgcagatcgtggacgacgccatggtggaccgcgcccatcagctcatgagccgccccggtaaccgctcggccttcgtcgacttctgcaacaccgaccagccggaccgcagcgcgcagatcccccgcatcacggtgcccacgctggtgctgcgcagcgcgagcatcgacggccagcacttcgcccgcgacatccccggcgcccaggagctcgtccacccccacggcggacatctgctgccggaggaggaaccggagtgggtcgcggacgcgatcgcgacgttcctcggctcctgcgccgacacacccgcgaac

SEQ ID NO: 298 - DNA, 240 bp, Streptomyces avermitilis
  CDS (1)..(240)
atggatacactgttaccgataaggtggacgtgtcaagcggaagccgttgtcgcgggcgcggcgctctgcctcggccgactcctgcgcgacagccctgaacgcgacgacgccgaagtggccgaccaggtcgccgaggatctgctgcggatgttcggccttcccggcaacgaggcccacgagatctgccggcagccactgcccgacctggagaccgcggccgaccggcaaggcgccaccgct

SEQ ID NO: 299 - DNA, 1059 bp, Streptomyces avermitilis
  CDS (1)..(1059)
ttgaagccgagaaccgcgaccatccgaacgaaaggtgcgcagtacatgacactccgacgcgtcctcagcggactgagcgccgcagcaaccctcggcgctgctgcggcgatcagcacacgtcgccgcgctctggcggcagtcccccacgagctgcggcacccagtgctcttccttccgctgaacttcggcaacccggtcactctggccatcgctcgccgcctcgtgcccttggtgggagccgccaccaggcccggcgtccgcgtcgagcggcgcacgctgccggccacgaccgacgacctccccgtcggggtgctcacctaccaggcatcaggccaagcgccgcgcgcagcgctgctttggatccacggcggaggaaccgtcatgggtgccgctcggcaggagaacacctggtgcagccgcgttgccgacgaactcggcgctctggtcgtcagcgtcgactaccgcctcgcacccgaaaatccgtaccccgcagctttggacgattgcttcaggacgctccgctggcttcacgccaacgccgccgccctcggcgtcgatcccgcccgcatcgccgtcggcggcgaaagcgccggaggcggactcgccgccgccgtagtccagcgcgcccacgattcaggagtgccggtccggttccaactcctcctctaccccatgctcgacgaccgcacggctctacgcgtcgaccctcccaacagcgccatctatacgtggaccccggactccaaccgcttcgcctggacctcctacctcggccgcccgccacaggaccgcgacgatcgcccctatattgcggcggcaaggcgtaggaacctcgacgggctgccgcccgcgtggatcggtgtgggcgacatcgacctgttccacgacgaagatgttgactacgcccgacgcctgagcgaggccggcgtcgcctgcgagctgcggctcgaatcaggtatgtaccacggtgctgatgccttgctcgacggcaaagcaccttcaatgaccgctttccgcactgccgccctcgacgctctgcgaactgccctggcaaagccc

SEQ ID NO: 300 - DNA, 1236 bp, Streptomyces avermitilis
  CDS (1)..(1236)
atgaccgcacccgacagtctgcccctgcatgccctcgcggaagacaacctcgccgcggcgagtcccgacctgctgcgcgcgatggtcaagacgttcgccgacgcgctcatgtccgcggaggccgacgccctctgcaacgccgaatacgggcaggtcagcgacgaacgcgtcaaccaccgcaacggctaccgcccacgcgagtgggacacccgcgccggcaccgtcgaactcgccgtccccaagctgcgccagggcagctacttcccgcactggctcctggaacgacgccgacgggccgaacaggccctcatctcggtggtcgccaccgcctacctgctcggcgtctccactcgcagagtcgagaaactcgccgaatccctcggcgtcacccagctgtcgaagtcccaggtcagcgcgatggccaagcacctggacgagcgggtcgccgagttccgcaaccggcccctggaccaaggcccttacgcgttcgtccgggtggacgccctgacccagaaggtccgcgagggcggccgtatcatcaacgtccacgcgctgatcgcggtcggggtcaacgccgacgggcaccgcgagatcctcggcatcgacgttgccaccgccgaggacggcgccggctggctcgccttcctgcgctccctgaccgcccgcggcctgaaaggtgtccagctcgtcgtctccgacgcccacaccggtctggtcgccgcgatcggcgccgtcctgcccggagcatcctggcagcgatgccgcacgcattacgcccgaaatttgctgagccaggtccccaagtccgcccagccgtgggtggccacgctgctgcggaccgtcttcgaacagcccgacaccgacgccgtccaggcccagatgcgccacgtgctggacgccctggaggccaagtttcccaaggccgccgcccacttggttgccgctcagcacgacctgctggcgttcaccgcgttcccacgtgagatctggcggcagatctggtccaacaacccacaagaacgcctgaacaaggagatccgccgccgcaccgacgtggtcggcatcttccccgaccgcaccgccctgatccgcctggtcggcgcggtgctggccgagcagaacgacgagtggaccgaggcccgccgctacatgggccgcgagctcctcgccaaggcccgcctccacccgatcgagtcagaaaccgacgagaccgaactgcccaccgaactcaccgca

SEQ ID NO: 301 - DNA, 345 bp, Streptomyces avermitilis
  CDS (1)..(345)
gtgatctgcgtggccctgctggtgttctgcctgatcgagcgccaggtccggcgcgcgctgagccatgaccagaccatgcccgggctgtatcccgacaaccggcgtgcacggccgaccggccggatgatcctctgccacctcggtgaactctggctgcgggaccggcactgccaccgacccgccaaccgtggtaatcacccgcggcgtccaggtccatctactcgacctcctcggcatcgaagtgacccatccacgctggccacagacctgaccgacccacccgtgaagcatggaactacgtttatgcggctgctcccgtggaaccagctgctgccgaacgccgga

SEQ ID NO: 302 - DNA, 1095 bp, Streptomyces avermitilis
  CDS (1)..(1095)
gtgtcggccgtggatgccctgtcgtccgaccgtgaggaacactgtcccgtgatactgctcggtgttgacccccacaagtccacccacaccgccaccgccgtcgagctggaatcaaaccagcaggtcgggacgatgcggatcgaggcgagcctgacggactaccggcggctgctggcctgggccaagcggtggccgcagcggaagtgggcggtggagaacgccaacggattgggccggcatctcgctcagtggctcatcgcccgcggcgagagcgtcgtcgacgtgcctgccgcggcgaccagtcgggtgcgcgaactctcccgtggcggacggcgcaagaacgaccagatcgacgccgcggccgccgccaccgtcgcctgtttgcagggagacggacgggatgtcgagcccgaggaccacaccacggcgctggctctcctggacgaacggcgtgtgaacctggcccaggcccgggtccgcacggtcaaccaactccacgcgctgctgcgtgatctgctgcccggcggcgccccgacccagctgtccgcggacttggccgccaaactgctgcggtccgtccgtcccgctggcgacgtcgagaccgtccgcaaggacatcgcctgggatctggtcgccgagatccggaaactggacaagcagctcacggacaatgctgcccggatgcagagccttgtggaggcatcgggcagcgcactgatggacaccccgggcatcgggccggtcatggccgcccggctgatcggccgcacccgacaggctcaccgattccccacctcggcggcgttcgcgaactacgccggtgccgccccggtggagatcgccagcgcggacaaggcccgccaccggctctcccgctccggcgaccgtcagctcaactccgtcctccacaccatcgcggttgtgcagatacgcatgccgaactcacccggacacgcgtactaccagcgcaaactctctgagggtaagacggcgaaggaagcgaagcggtgcctgaaacgccgcctggccgaccacgtgtggcgcgtcatgatcgccgacgagcgaaaagccaagtccctccctgcccatgggact

SEQ ID NO: 303 - DNA, 1152 bp, Streptomyces avermitilis
  CDS (1)..(1152)
gtgatcgacaccccgatccgcacgtacatcgcccagcacaccgacggcctcgccgtcagcggatccgccgtctacgccttctggcaggcggtcggcctgttcggcctggtcggcggcttcttccacagcaccggcgctcgcatcacctacagcctctggggagcggcaagcgtcggcatggtgtggtccgcctcccccgccgacggccgcaccgtcgccaccggcatcgccgtcctcgcctggaccatcgcctccgtcttcgccctgcgcggcctgagtctgcgcccggtcatccacaccgccttccagccccacatagccctgctcggcatcgccgcccccgcgctgctccgctcgacggccgccctgcgtaccggactgctggtcctggccgcgtccctatctctgatgcccctgacccacgacagcggcgcctggtgggcactgcggctgatcgcgggcgcggccagcgccctcgtcttcatgatcgctacgagtgccatgctggccgggctcgccgcgcacatgaccggctgggccttcggcggggtcggcgcgggtatcgccctgtccgggctgatggtggtggcggtgcagcaggccggctcctggcagacggcctggttcgcctgcgccgtgctcaccgtgctgctgaccgtcgccgcttggaatctggtcccacgcggcgcggcggccacggctcccgccgccaccgctgcggccgaacggccgcgcacgcaccgctggttcaccgccctgctgaccagttacgtccttgagggcatcgggtacatcatcgccggcaccttcctggtcgccgccctccagcaaggtgcccccggctggatcggcagcggcgcctggatcgtggtcggcctggccgcgctgccctcgtgcgcagtgtggatgcgtctggcccggctacaccgaactcacgaaaccccaggtcacaaccacaacctgagatctctaccgaacccggggtgcctctgtgtcttgtcaagtcccatgggcagggagggacttggcttttcgctcgtcggcgatcatgacgcgccacacgtggtcggccaggcggcgtttcaggcaccgcttcgcttccttcgccgtcttaccctcagagagtttgcgctggtagtacgcgtgtccggg

SEQ ID NO: 304 - DNA, 1935 bp, Streptomyces avermitilis
  CDS (1)..(1935)
atgatgcggaccggctctttattgtcggtccgcggccgggatacgcttccgatcttcgtggggctggggaggccccgtgatgtggggggtgtttccttgagtgccgcaaaagacgagagccccagggacatttggaccctggcccgcagacgcaggatcaacgacccgctcgcgatcacctttgtcacgctgttgctcggcggtctcgtcgcgctcggctgggtgagcgggaacgtggagcgcgtcaacaccatgtgggtgggcgccgaggtcgccgcggacggcagtgttcgggtcaccgaggtcatcgactacgacttcgggtaccccgacgcgactcggcacggcgtctaccgcgacgtgccgggtctgtacagcgaccaggagaccgccaaggtcgtcgcgaccatggatggccaccgcgttccgtgggagttcgacgcgggcgactactacgaggagccggacggccgacgggagatcgccacccgcgtcaaggtgggcgaccccgaccgctccgtcaccggcgtgcaccggtaccgcatcgagtacacgctcacggacgtcgtgaagaacggcaaactcgcttgggacgccgtcggcacgggatggcgggtggaccgctccgacgtcgagatccatgtcgtggcgccctacgacctcaccggcacgcgctgcgtgcagggcaccaacgggtcggaggacggatgtacggccaagaaggccgcacccggccacctcgccgtcacgctcgacaagctcaaggggcgtgagggcgtcactctgtacacctcccgtggggcgaagctgaccggcgcgaagcccgccctgcccgcgctgccctccgggaaagccgtcggcgccgccgtcccgcatccgctgtgggtgggcctgctcgccttcctcttcgccctggcctgcgccctggtgacggttcaactgctgcgcttcctcggccgtgaccggatcgccgaggagggcactgacggggcgcccggcaggacccggcgtgtggacctcgaccggcgcgccgcctcgctcaccccgtccctcgtgccccccgagggattgaccccggcccagggcgggatcctcctctccgaaggcgtagggcaccaccacaaggtggcctggctgctgggcgcggccgccgacggccacatcaccgtcgaggggaccgaccagcaccccacgctgagacgccgggatccggccgacgccccggcggacccggtcgcgagagtcgtcttcggcagcatcttctcggggcgcgacacctgcaccctgggctggtacgacccgcagttcaggtcggcctgggagagtctcacccgcgcgctggaacagtggcaggcggacagcggcctgtgggacgcggccgccgcgcgtcgttcccgtctcggacggcccgtcggcctcgccgccaccttgctcggctttgtcgtcgcagggctcggagcctgggtcggcggcggccggaacgcggtcggctggccgatcctcgccgtaggcctgatcgccgtgagtgtcggctacgcgctgcggcggcgctcctgggaacttgagacccgcagccctcgcggcgccgccctctggctccggaccgaggcgttccggcgttacctcgccgacccggccgcgctccaggcggacgagcccctggacgaggaacggatggagctgtacacggcctgggcggtggccctggacgtgggccaggcctgggagaaggcgatcgccgactcgaccaccgtccccgaacaccggtcggccgtgacctcccggattgccccggccctggccgtgggcctgctcctccacaccgcgcgcgccagcaccgccccggcgtccagcagcggcggtggcggaggaggtggaggcggtggtggtggtgacgtcggcggtggctccgggggcggcggcggcggctcctgg

SEQ ID NO: 305 - DNA, 1581 bp, Streptomyces avermitilis
  CDS (1)..(1581)
atggcgcggcgcaagcaggtcgatccgacgatggcgttgctggagaccgcgatcaaggcgacggcgaagggcggcatcggcaagctgcgccagcgcagccggggccaggtgccgtactacgaggagtacccggcgctgaagcgggagacgtggcgccccgacatccgggccgccgtgctcgcgaaccagcgcgtgggcctgcaccgcaagctgatgaagacggcggccgccgccgacctctacccgacctccatcggcaccgacgcgatcgtctacccctcgcccggcccgtccccgctggacatcctgccgctcaccaacgaaggcaagcccgtgccgggcacgttccggctcggtgtctcgctgatccgttccgccgtacgcaacgccgacgacaccaccgatgaccgctggagtgagcgcgactggcagcaggctgcgcagcgcgccttcaccgcccttggcgaacagcaccgcaactcccccggctcggtaggctgctgctggttgcctgcctgcgccagggcctgcgcctggcccgcgaccaccgactggacctcggctggctcatcccggcggcctggacctgcgtcagcgactccgtgtgggaaccccctcgccccacccgacaccgacagcacgggactggacacggccgccgacgccctggtcgaactcctcagcgcgctcgcccgccgtcagcaccagcaccgctcgcgcaccgtcgcccgcctcaccacagtcatcaacagccgcctgctccctgacgacctgcagcacatggctctgtactaccgggccaaggcccaccgcgatcttggggacagcccggcctcccgcgcgggcatgcaggccgtcgccgacagccagggccgcctcgcccccgccgcccgacgcggacttgcccatctcgcccgcatggccggcgacttccccaccgccctcaccaccgcccacaccctgggctgggaaggccgccaccaccgcgtccaaggcgacacctggtggccccacggcgacatggaccgcgccgccgccgcgtacgccgccgcacgcgacgaagccgaacaccacggtgtcaccggtgagcgcggcaacagccaggcccaccgcgccttcgccctggccttcaccgacccggccgtcgccgacagcgagctcgccctcgctgagcagcttctggccggtgtggatctacgcgccaccaccctgatcacccatatcgcggcgctcgcccgcgacgccggccgcaccgacgccgacatcgacgaccgcgcccaggtgctgcgcgctgagatccgtacagcgggcgtgacatacaccgagctcgccctggacctcaccctcgccttccaccacgccgtccgcaacgaccaggaccaggtggccacgacgatcgcctggctgcgcgagaacacccgcagcggcgccttcccttactacagcgagatcgccgccttcatggccggcctgcccctgccccaggcctccagcactcggtggatcgacgacgaaccggccacccgccagcgctggcacgccctggtcaccaaccgccgacagcacctccacacccagcga

SEQ ID NO: 306 - DNA, 606 bp, Streptomyces avermitilis
  CDS (1)..(606)
atgacaatcggccgggtgtggttcgctgctggggtgactcaggacttggagatcgtcgcattcgaatccgccgaggcattccaggcatggctcggccagaaccacgccgtttcacccggcatctggctcaagcttcgcaagaagggccccggtatcgccgcgctggactacacccaggcgctcgacgtggcactctgctacggctggatcgacggccagaaggcaaagttcgacgaccagtggtggctccagcggttcaccccgcgcaagccgcgcagcaagtggtccaaggccaaccgggacaaggtggccgccctgatcgagcagggccggatgcatccgccgggacaggccgaggtggaccgcgccaaggcagacggccgctgggaagcggcctacgacggcgcgaagaccgccacggtgccggacgacctcacggcggccctgaccgccgacccggccgcggcggagttcttcgagacactggaccggcagaaccgctacgcgatcctgtaccggatccaagacgccaagaaggccgagacccgggcgcgccggatcgaaaagtacgtagcgatgctggcgaagggcgagaagctgcacccg

SEQ ID NO: 307 - DNA, 363 bp, Streptomyces avermitilis
  CDS (1)..(363)
atgtccatcacgctgaaccacaccatcgttccagccgtcgacaacgaggcggcagcacgcttcttcgcctccgtcatgggactggactatcgaggtgcagatcggcatttcgcgccggtgcaggtcaacgattctctgacgctggacttcatgtccgtcgagaatccggtcggccatcacctggccttcgacgtggacccgtcgtccttcgactcgatcctcgaccggctccgaaccgccggggtgccctatggcaacgatcccagcgagcccgacaacggtcggatcgaccacccgttgtgccctcgtggcctgtacttcaccgatgacgcggggaacctctacgaagtcatgtcccccagg

SEQ ID NO: 308 - DNA, 1188 bp, Streptomyces avermitilis
  CDS (1)..(1188)
gtggatcgttgttgtggcatggggagtccggaggggatcgaggcggctctggccgcaaagttcgggacgttgttcccgcatctcgacgagcggcagcggcggctggccataggagcagaagcacggtcgctgggccatggaggcatcaggctcgtcgctcgtacggccggagtccgggaggggaccgtgtcgcgcggggtgacggaactggagtccggggaggcgccgttgggtcgggtgcgtcggtccggtgggggccgcaagcgtgcggtggacctggatccgggccttcggcccgcattgctggccttggtggaaccggatgtacgcggggacccgatatcgccgctgcgctggacgacgaagtcgacccggcaactggctgccgagctgacccggcaggggcaccgggtctctgcggacaccgtggcggccgtgctgcgcgaggagggcttcagtctccagggcaacgccaagaccatcgaaggtgcccaacacccggaccgggatgcgcagttccgctatatcaacgaccaggccaaggacttccaggccgccggagacccggtgatcagcgtggacaccaagaagaaggagttggtcggcaactacaagaacgccggccacgagtggtgccgcgaaggtgatccggtccgggttcgcacccacgactttcccgatgccgatctgggcaaggcgatcccctacgggatctacgatctggccgcggacgcgggctgggtcaacgtcggcaccgaccatgacacggcagccttcgccgtcgcctccgtccgccgctggtggcacgcggttgggcgcgacacctacccgcgctcgcaccgactgctgatcactgcggacgcgggcggttccaacggctaccgcacccgggcctggaagttcgagctggccgcgctggctgtcgagaccggcctggagatcactgtgtgtcactttcctccgggcacatctaagtggaaccgaatcgagcaccgactgttctcccacatcacgatgaactggcggggcaggccgctgaccagccatgaagtcatcgtgaacagcatcgcagcgaccaccacccgcacgggactgacagtccgcgccgtactcgacaccgccgtctacgagaccggcgtccgcatcagtgacggacagctgaacgccctgccactgagccgccacgac

SEQ ID NO: 309 - DNA, 372 bp, Streptomyces avermitilis
  CDS (1)..(372)
ttggtcaccgagttggcagcagcccgcgcggctcagcgggaagcagacctccatcagcgacgcggcggcgaccggcagaagacccccgccgtcggcctctacaccggccgacgccccggcctcaccctcgtagaccggctcctggccaccatcctctaccagaggttcaagctgccccaggtcgtcatcgccccgctcttcaccgtgacacccgtgaccctcaacccggccatcagtcaaactcgccgactcctccacgacatcggacacgccatcgaacccgccgagacaccactggccaccctcgacgacctcatcgacctcgccacacacctcggcatccccgcgccagagatcaagacagcgagttat

SEQ ID NO: 310 - DNA, 999 bp, Streptomyces avermitilis
  CDS (1)..(999)
gtgccgtgttcggcactcccagcgacggggagacctcctacgctcgcaggctcctgcaccacctgggccccggcatgctggctggtcctgtgggacaagggtttcgacgccaacgccttcctcgccgccgtgcacgacaccggagccaggttcctgggccggctgcgcgccaaccgacgcaccccggtcctgagccgactcaccgatggctcctacctctcggtcatcggcaccgtcccggtacgcgtcgtggaagcgcagatcaccgtgatctatgacgactgctcgttcaccaactcctatcggctggtcacgacgctgaccgatgctcgtcgttaccccgccccggccctcgttgccctttaccaccagcggtgggagcacgagtcggcgtattttgctctgcgtcacacgatcacagacggccgggtcctgcgttcaggcgacccggtcggggtcgagcaggagatgtgggccctgctcgccctctaccaggcacttcggaccgtgatggtggaggccgccgagtcccggccgggcaccgacccggaccgctgcggcttcaccatagccatccacactgcccgcgacctcgtggtccaggccgccgacgtcatcaagcccggcgccctgggcacccgcaccaccgcgtcatcggcaaccgggtcctggccgggctcctcccgcaccggcgcccccgcatcagcacccgaaaagtcaggtcatcggtctcccggtacgccgaacgccaagacgacggccgccccgacaaaagccgcctggtcaccgaccttgacgtcaccatcctcgaacccgatcccgacctgcccaccgtctcgcacgacgatcgacacacaccggccgccgaccggcgcagacagcgcgtcctggacctccttcacgcagaacccgaccgccagtggcacactcgcgacctcgcccgccacctcggcgacatcaccctcagcacgatgtaccgacagctcgacagatgggccg

SEQ ID NO: 311 - DNA, 471 bp, Streptomyces avermitilis
  CDS (1)..(471)
gtgcccggtcgcagccggggacggctctcggtggccgggctgctgtgctaccggcccgccttgcccgcccgcctgtgctaccggctgcgccggcacaccggccgcaagggcgagcggcgctcgctcggcgagagcgactacatccacctgctcgacggcgcccaccacctgctcaaggccccgctgatcgtggtgtgggaccggctgaacacccacatctccaagacgatgaaggcgctcgtggccggccgggactggctgacagtggtcctgttgcccgggtatgcgcctgagctcaaccccgtcgaggacctgtgggcgcatatcaagcggagcctggccaacctggccgcccgcaccctcaacgagctggagactctgctccgcaggcggctcaaggcactgcagtacctgcacggcatcctcgacgggttcctcgccgggacaggcctcgctctcgacagaccgaac

SEQ ID NO: 312 - DNA, 1626 bp, Streptomyces avermitilis
  CDS (1)..(1626)
ttgcccgttcagtgttccaccgtcacgctcacgtcgtccatcaccgtcgccgacggcatcttcgctccggggcatcttggcgagctgacccagcagttacccttcgaactcgtcgatgacgtgctggaacgcgccggcggcgcccagcacaggctgcggctgctgccgtcgagggtgggcgtgtacttcgtgctggcactggccctcttcccgcagctggggtacgtgcgcgtgtgggacaagctcaccgccgggctgcgcgggattcttcaccggcgcccttcggagaaggcgttgcgggaggttcgccggaggctgggcgtcgcgccgcttcggttgctgttcgaaacgctggccggccctgtggcacagccgatcacacccggggtgcgataccggtgctggcgcacggtcgccttcgacgggtgcagctccaccaaggcccctgaccggccgcgagtctgtgcgtggctgggcaagcacaagcaccgctacggcaccgacggatacccaatgctgaagatcatggtgctgtgcgagaccgggactcgggccctgctcggcgcggtcttcggaccgacgccagagaaggagaccggctacgccgagcaactgctaccgctgctggacggcggcatgctgctgctcaacgaccggggcttcgactccgacgacttcctcgcgaaggctgcggccaccggcgcacagctgctggtgcggctcaagggaacccggacccccgcccgctgggcgctactgccggacgggtcgttcctgaccaggatcaacgggacccggctgagggtcatcgacgcgcacatcgcggtgacgaccgccaaagggctgcggctggaaggccactaccggctggccaccacgctgaccgatcaccgccgctaccccgccgtcgagctggtggagctctaccacgagcgatgggagatcgaatcggcgttctactcgctccgccacactttgcagtgcggcctggtgctgcgctcccaggacgtggccgggatccagcaggagctatgggctcatctgaccgtctaccaggcactgcgccgggcgatggtcgaggccgtcgagacgcttcccggcacggatccggacagggcttccttcaccgtcgccctggagaccgccaaggaacagctcatcaccgcggccaatgtgctgccagacgccggaccagggcgcatcacatcggccctgctgcacgatctactcccaccccgccaggcccgcgtcaacccgcgccgcgtcaagtgcccgatctcccgctacgccgccccgcccgaccaggcccaagccttcggggcctccaggatcaccagcatcgccgtcaccgtgcactcgtccgccggcaccggctctgacgggcgtcgcgaccacacgctgcaactcctgcgcaccaaccctctccgcacctggcgcgcatgcgaaatcgcccgcggtatcggactggacgacgctcgaggactacgcgcggaactggggcgctgggtccgcgaaggaatccttcgccgcaccgggcgaggcatctacaccctcgaacccgagtggatcacacccgacctccaccacccctcggtcccgccccatttgacaaccgcggatcggcct

SEQ ID NO: 313 - DNA, 276 bp, Streptomyces avermitilis
  CDS (1)..(276)
ttgcgtgagcgtgcggtgcggatgtaccgcaccgcggacccgaagccccagatcaagaagctcgccgtcgacctcggcgtccaccccgaggccctgcgcggatggatccgccaggccgaggccgatgccggcgagcgtgacgaccggctcaccaccgacgaacgcgccgagctcgccgcgctgcgcaaggagaacgcccagctcaagcgggcgaacgaggtactgcggacagcctcggcttttttcgcggcccagctcgacccgacccggcccagg

SEQ ID NO: 314 - DNA, 915 bp, Streptomyces avermitilis
  CDS (1)..(915)
gtgaccgcgctcctcgacgagcacccgcacctgggggtcgagtgcgtacttcgggaactgcacctcgcctcctccacgtactaccgctggcgccacgcagagcgcgagccgtgcgaacgtcggcgccgggacgcggaactcaccgagcagatcaagcagatccacacggactccggcgggatctacggctcaccgcgcgtgcacgccgtcttgaagcgtgagggtgtgcacgtgggccgcaaacgggtcgagcgccttatgcgcgaggccgacatcgcgggcatcagcccgcgccgaaagggcttcacgcgccgggatcccaaggccacgctcgccccggacctggtcgagcgcgacttcaccgcacccgccccgaaccggctgtgggtcaccgacctcacgatgatctcgaccggtgagggacccttgtggctctcggcgatccgggacgcgttctcccggagagtggtggcctgggagacctccgcccgcgcggacgcggacctggtcctcaccacactggagtacgccctggccagccgagaggtcgagcccggacaactcgtgcaccatgccgatcacggctgtcagtacacatccgtgaagctgacaactcgccttgtgagagcgggagttgaggcatctatgggctcggtcggggattcgtacgataacgccctcgcggagaacctttggatgctcatcaaaaccgagtgcatccgtgggcgcaccttcaccacccgcgccgaggccaacctcgcgctcttcgagtacatcgacggcttctataactcccggcgcatccagaagcggctcggctacctcagccccgtcgagttcgaggagaagcactacgccgaccaggcaacggccgaacgaacgaacctgaaaccccgtcaacccgccctggccagc

SEQ ID NO: 315 - DNA, 495 bp, Streptomyces avermitilis
  CDS (1)..(495)
atgcggtatccggacgggggcgggctgaccgccgagcagcgcaaacgccgcgaagaggtacgcatgcgggccgctgacctcttcgagggggacgtaaaagtcccgtgcatcgcccgggagttacgggtgagcgagaagtcggtctaccagtggcgccgtgcgtgggcgttgaacgggcgcgaagcactgcgttcccagggacccccgggctacgactgccgactcggcccccacctgcaggccaagctcgcgacgtggctcgacgaggggccggccgcgcacggctggagggatgaccaggtgtggaccgccgcaagagtccgcacgctgatcgggcggaagttccacctctcctacagcatctccggggtgacccggctgctgcaccgcatgggcttcagcgtgcagatgcccgcccggcccgccgccgaacgcaacgaggacgcgatcaccgcatggcgggaggcgacctggcaggaggtaaaaccctccggg

SEQ ID NO: 316 - DNA, 906 bp, Streptomyces avermitilis
  CDS (1)..(906)
gtgactaacaacctggacaccctcgcaacggcactctatgcccggattgacgacgagttgaaggcttcaccgtggctggcgccgtggcggcctgccatcggaatcacgcccacactcagtgacgccgagctgatcacgctcgcggtcatgtcggcgctgctcggatacacctctgagcggcgctggcttcgccgcgtcgggcgggacttcggccacctgtttccctacgtgccccagcagtccggctacaacaagcggctgcgcgccgcgttctcactgctcaccagcatgatccggatcgtggcccgcgatacctcactgtggagcgacgatgtgtggctggtcgactccacaccggtcggctgcggttgctcccgtgagacggccaaacgctcggacctggcaggctgggcccagtacggctactgcgcatcacactcgcgatacttctgggggctgcgtctgcacctggtgtgcacactcggcgggctgccggtcctgttcgcactcaccggggcggacgagcgcgaaacactgcgcgacatgctcgataccgcgccagacgtcctcgccgctcaccccgggcagacgatcatcggggacaagaactacttcggccgcgagttcgagcgcggccttgccgagcgtcacctgaagttgctgcggccagcccgcaagggggaagccgagccgaccgggtcacacctgttcaaaccgctgcggcaggtcatcgagtcgatcaatcagaccttcaaggggcagctcaacctggaacgacacggcggcaagagccctgcaggagtgtcagcccgggtcttgtgccggatcctcgcactcacagcggcgatctggcacaacgaccaaactggacagcccatcaaacgatcactcacagcctacgatcac

SEQ ID NO: 317 - DNA, 936 bp, Streptomyces avermitilis
  CDS (1)..(936)
atggacgttacgaccctctactcgatcggggagctttcccggcggaccggcttgtctgtgaggaccatccggttctactccgattcgggggtggtagcgccgaccacccgtagtcccgccggttaccggctctacgacctcgacgcactgctccgtctggaactcctgcgcacactgcgcgagctgggcatggacctggccacgattcaacgggtactggaccgtgagctctcggtggcggaagtcgccgcggcgcacgccgacgccatggacgtccagatccggacgctgcaactgcgtcggagtgttctgcgagtcgtggccagccgcgggtccagtcccgaggagaccaagctcatgcacaggctcacgcagttgtccggcgaggaacgccgccgtctgatcgacgatttcatggatggcaccttcggcacagtggatgccgacccagccgcggtggccatggttcgcgctgccactcccgacctccccgatgatccgaccggcgagcaggtcaccgcgtgggtggagctcgccgagctggtcggcgacgaggatttccgtgcccggatgcgccggacggccgtacgtcaggcggccgggcgcccgctcgacatcgaatgcgatgccggcgaggaactgatggagttcacccgtcagaaggtggccgaggccatggaggcgggcatcgacccgctcaacgacaggggcgcacccgtcatcgacgacctcgtgcaccgcttcgccgaggtgctcgcgcgcacccctgacacggaattccgggactggatggcccagcagttcgaagagacgcacgatccccgggtagaccgatactggcagctggtatggatcgtcaacggctggcacgtagtaccgaacctgatcccggtgtacccctggctcatccaggccctgcgaaatagccgtgacgca

SEQ ID NO: 318 - DNA, 1152 bp, Streptomyces avermitilis
  CDS (1)..(1152)
atgctggacggacggcgtaagtcgatccagccgatggcagagcggctgccggatggcaacgagcagaacctgcagcagttcgtgaaccagtcgacctgggatccggtgccggtgcggcggcggatcgcggagcggatggtggcgcagatcggcccggatgcctgggcggtcgatgacgtgtcgttccccaaggacggcaagatgtcggtcgcggtcgcgcaccagtactgcggggcgctgggcaagcaggccaactgccaggtcgcggtgagcgtgcacgcggtctccgacactgcctcctgcccgctgcagtggcggttgttcgtgccccaggagtgggcgcacgacgcgccacggcggcagaagaccgggataccgccagaggtcgggcaccgggagaagtggcgcctggctctggacatcttcgacgagctggccgggtgggggctggtgccgccggtggtggtggccgacgccggctacgggcagaacgccgacttccgcgacggcctggacggccggggcatcggctatgtcgcggccatccgctcggatgtgaccgtccatccgcacgatgccgagcctttcgcgccgccctggtcgggcaacggccgcaagccccagccccgctaccgcgacaagccgtcctcggtggcggcgctggcgaccggccacgggcggcaggccttcaccgaggtgacctggcgggaaggctcccgcggaccgatgcgctcgcatttcctgtccctgcgggtgcggccggccggggtcaaatcccgacgcctcgcccaggccgccgccacagacgaaaactgctgggacggtgtcctgcccgaggtcacactgctggtcgaatggcccgaaggcgccgaggcgcccaccgactactggctgtccaacctgcccgacacgctctccctcgccgaactggtccgcctggcgaagatccgctggcgcatcgagcacgactaccgcgaactcaagcacggcctcggcctggaccacttcgagggccgctcctggaccggctggcaccaccacgtctccctggtcaccgccgcccacgcgttcctcaccgaacagcgtctggccccaaaagccggtacagcggactcaccctctaccagaccctcgacgccatccaggacctgc

SEQ ID NO: 319 - DNA, 579 bp, Streptomyces avermitilis
  CDS (1)..(579)
atgtccgatcgcaataccctcatccgcagcctgcacgatgtgggtctggcagcctggttcggcggctctctcatgggcgcggtcggtctcaacggagcagcaaaggaccaaagcgagacggcccgggccagggcacggatcgcctcgtcggggtgggcgaagtggacgccggtcaacgccgcggccattggcgcgcacctgttcggcggcggcggactgcttgcggtgaacgctcaccgggtcgccgcccagaagggcgtgggggcctctaccacggccaagaccctggtcaccgctgcggccctggccgccactgcctacggccgtgtcctgggcaagaaagtcgagctggctgcttcctccgacccgcaggacgccaaagaggctgcccggcatccgatcgacatcgactcggcccagcggcagctggccttcgcgcagtgggcggtaccggccctgaccggatgcctggtggtgctcaacgccctgcacggtgagcagcagcgtcctgaggagcagctgcccggcatgtgggagcgggctcgctccgccgccacccccttcatcccgcagcactct

SEQ ID NO: 320 - DNA, 1236 bp, Streptomyces avermitilis
  CDS (1)..(1236)
atgactctcgcggggacgctggcggcggcggaggcagcggcgcccgtggagtcgctcgacgtggtcgcgcgcatgctcaaggagcacctgggggccgcgtcggtgtcgttcctgatcaccgacttcaccggcggctcggtcgtacgactgggggcggcgggcagcgtcgagaccgatgaacccgcccaacgcatcacgctgcggggcaccctgtacgacgacgtgatccgcacccagcggccgagcgtggaggccaagggccagggcgcgctggtgcggatcgtcgccccggtgaccaaccgcggggacgccatcgggctcctcgaactgttcctgcccgcggcaccggacgcggaggtgatgcgggagatcggcgagaccgcgcacgccctggcgtacatcgtcatcgcgaaccggtccttcaccgacgtgtaccagtggggccgccgcaccaccccgctgagcctggccgcggagatccagcaccggctgctcccggcttcgctggcgtgcgaggcggcacagttcgcggtggccggggcgctggagccggccgaccacgtcggcggtgacaccttcgactacgtgatcgaccgcgacacggtccagctctccgtcaccgatgccatgggtcacgatgtcgacgccgcactgctggccacccttgcggtgggcgccttgcgccgggcacggcgggccggtgccgacctcgccgaacaggcccgccaggccgaccaggccatgcgcgagcacggccacaagggctacgtcaccggccagctcctgcgcatcagcctgatcgacggcacaaccgagttcatcaacgccgggcacccctggccgctgcggatgcggaaccgacaggtgcgggagatcactccgaagatcgatatgccgttcggcttccacgccccgcacagctaccaggtccagtcgctggacctgcggccgggcgaccggctggtgatgctgaccgacggcatgctggagcgcaacgcaggcagcctcgatctgtccgacctgatcatccgcacccgcgcgctgcatccccgcgaggccgcccgcaccctcatcgcggcgatcgtcgacgccaacgacggccatctgcaggacgacgcgaccgtcatgtgcctggactggcacggcaccaaccactcccagcgtgacgccgccaccggcgccgacctcaccgacgcctcacgaccgtcaaggacgggacggaccactcccgggcga

SEQ ID NO: 321 - DNA, 798 bp, Streptomyces avermitilis
  CDS (1)..(798)
atgatcgccgaagatactcagccgcccgcacacggacgggagttccagccccgccccgacaccaccgacgccctgtccacccccgtggttgatgcgcctgccagcgctaccggccagctcgctgcccggcagccagccgccggcctggaaggcggggtggagcgggcgacggctgcgctgaagccgaggctgcgcggctggctgcacgccggcgtgttccccctcgcgctggtcggcggcattgtgctgatcgccgtttcgcgttcggctgcggcggtggcggcgtgctcggtgtacgcgttgtcggcctgcctgctgttcggtaccagcgcggtctatcaccgcgggacgtggggtgcgcgcggggaggcggtcctgcggcggatggaccacgcgaacatcttcctcatcatcgccggcacgtacaccccgctggcggtactgctgctgcccggaggcgagcagttggtgctgttggccgtggtgtgggcgggcgccttggccggcatcgccttccgcgtgctgtggatcggggctccccgatggctgtacaccccgtgctacatcgtcctgggctgggtggccgtcttctacctgcccgacttcgcacgcaccggcggcaccgcggtcgtcgcactggtcatcgccggaggtctgctctacaccgcgggcgccgtcgtctacggcctcaagcgccccgaccccttgccggcctggttcggctttcacgaggtcttccacgccctgaccatcgccgccttcaccgcgcactacacggccatcctcctggcagccaca

SEQ ID NO: 322 - DNA, 330 bp, Streptomyces avermitilis
  CDS (1)..(330)
atgacagcagacaacccgcacaaccgactcgacgacgacgactaccccgcctacaccatgggccgggccgccgaactactcggcaccacccagggcttcctccgcgccatcggcgaagcccgcctcatcaccccgctccgctccccaggcggccaccgccgctactcccgctaccagctgcgcatcgccgcccgcgcccgggaactcgtcgaccaaggcacccccatcgaggccgcctgccgcatcgtcatcctcgaagaccagctcgaagaagcccagcgcatcaacagcgaacagcgccgcgccgcagcccggcacacggccggcgtc

SEQ ID NO: 323 - DNA, 294 bp, Streptomyces avermitilis
  CDS (1)..(294)
gtggacttcaggcctggtccgtcgctccccccgtggtggcggaccaggcctcactgcgtgctggtggccggcgcccgctatagcagggagatcggggaggtctgcgtgtgcgagctgccccctgccttcgacttgtcacagccgacgatctcccaccacctcaagctgctgcgccaggtcggcctgatcgactgtgagcgccgcggcacctgggtctactactgggtgctgcccggcctcctggacaagctcgccgcgttccgccgtgtcggacgacatccctggtggcatgca

SEQ ID NO: 324 - DNA, 765 bp, Streptomyces avermitilis
  CDS (1)..(765)
gtgagcatggtggggggccagtggccgggagccgtcgaacggcttgcgcagcaactcggcgcagcccaggcggccgaccggcgtgtgaaagaggcgaaggcgaccgcggctcgccagagcccgagcagcaccggccttgaacgcgccgagtaccagcgccggctgcgcgcgcacgtacagacccccgagcacaaggcggcggcccacgccatcagcgtcgccgtggccctgatgaaggcgcacgacgctgccctgctgcgttcggcacacacactgcttgcccggcgcgccaacggacagcgcctaccccgacggttgccgcggccgctcgtattgcccggcggttatgcgccccagtggtggatcagcagcatcgattccacgtacgcgggcatctggcgggcgatcccgtcccccgggccggagctccggctcggcagccctaatgacccgttggtgcaggaggtcgccaagcaggcacggctgctgcaggccagccgtgtgggttaccgagggcgcgacgacctgtacgaggcttttcaccccgacggcacgcgcgagggcggcgagccggtaccgccgatccgcggcctgagcccggagacgagccgccgcaccaaccttgcactcggccgcggcgacggcatacgcatccagccctcccggatggaggaggccggtcagatgcacaccgactacttcgccgtctgggaccgatcccgcgcgtacgcggccgccgtgctcgccctgctgcgggcccacgcg

SEQ ID NO: 325 - DNA, 303 bp, Streptomyces avermitilis
  CDS (1)..(303)
gtggacatcgccgacgcccagaagcttgcctgggagaacaagattaaccagggcttcaatacgaccgacatcccacttgagttcggcctgctcaacgccgaggtcggcgaggcgttcacggcctggcgcaaaggcctgcccgatcatggggaagagctcgccgacgtcttcctgtacctggtcgcaattgccgagatgcagggtgtcgacctcggcgaggaggtcaggcgcgagatcgagaagaatgcgcgtcgtgtttacacgcctggggtcggcggcgcactggtgcggaccggcggagag

SEQ ID NO: 326 - DNA, 693 bp, Streptomyces avermitilis
  CDS (1)..(693)
gtgtgcatggagatcggctacgccaccgcccgcggcgtacccgtcatcctgctgaccaccgacttccaggactattccggaacccccgccggcccgggcaccgtcttccccgacccgctgctggacatcctcgccacccgcatcatccgcgccccccgacttggggctccaccagacctgcccgggtccagccgcttcgccgacttcgccgcccgcaaccacgcccagatccagcacgccatcgaggtccgcgtcgacgccgcattacagctccctgtccccgccagcagcgccgtcccctcccgaacgggcagcaccgtgtacgccgagtcctccccgtacaccccggcgcaccacaagctgcccggcacgggcgcccgccccgggatcaccgtccgccgtcccactcgcttcgcggccaccgaccccgaggccgccacgcgtgccgactgggcagccgctctcagctccgaccgcatcgtcgtcgacgcctgcggccccgagaccccgcccaatgccgccctgctgatcggagcgtcctgcgccaccgcccaaccggtggccgcctatctcccgcgcagcacctacacccacgcctccggccgcgagcccaaccaccgcaacctgatgatccagtacggcgtgggccatacgcttcgcagcgcggaagaggtgaccgcgtggatcggcccc

SEQ ID NO: 327 - DNA, 306 bp, Streptomyces avermitilis
  CDS (1)..(306)
gtgggtgatcgcgatgagggcgcggatgtggcggagccggttgcggtcgagttcaccgctcccgcatcgtcatcgaggtcgacggcgtacagcactacggcctggagaacccgcccgacgagaagggtcacccacactgccgtgccgcggctgtatgcggagatggtcgccaaggaccggcggctgcgcctggccggctacgagatctaccgcttcggtggtttcgagctcaccgcgccgggcggcgagcagatcctcgcggccttcttcaccgaactcctcggtcggcacaggaagccgcccctg

SEQ ID NO: 328 - DNA, 405 bp, Streptomyces avermitilis
  CDS (1)..(405)
ttgcgggaggaggccgagcaggtgcaggccgcgctcggcgcctcggagcgcgcgcttcagcggctggtggatgcccgtgcaacggtggccgaggtactggccgagccgccttccgtagtcgcggagccggtgtctggcgcggtggcgggggcggtggtgccgcggcggaccggggacatggccgcgtcggtcctcgcgccggactaccagcagatcttgtcggtgctggagtcggaagcggggcgggagggcatgcgctgccagcagctggccgtggccctggggcttcaggcggtcccggcgaaggtggaggggctgcggtcgaaggcgaaacgcctggtggaacgggggtgggcactccaggtgcggccgggagtgttcaccgcgctcgcgatgccgaccgtc

SEQ ID NO: 329 - DNA, 306 bp, Streptomyces avermitilis
  CDS (1)..(306)
atgaacgcctggcgcatgctcgctcccgagatccatcccacgccgaagtccaccaagcacgtcggccgcgcccaggtcgtcatcggcggcaccgcgcgggagacgcaggtgcggttcgatgccgaagcccgcgcgtgggccaccaccggcccgaccaccaccgcgaagaaccgcgccgctgtccccgcccagccaggaccgacgcagctgcagaagccgaccgcccccgccgccctgcccgtgcgtagtgactccagcaggcgttgtaggtcagactgggacaaggccatcgggcacctccagggt

SEQ ID NO: 330 - DNA, 312 bp, Streptomyces avermitilis
  CDS (1)..(312)
atggaaggccggcgccgcgtgcgcgtcgccgacgaagtcggcatcgatgccgacccggacgccatcggcgcgaggctgctgatcctcctcgaagaggtcaacgccaccatgcggcagctggcgcgctactgggacaagatccgcgagtccggtgacccgaagacctctccggcgatcgacgcgctcatggagattctgttcatgggccgtcgggtccgcatgcacgtgttccttgtcgcgcagtccgcgaccgcccgcgccctcggaggccaggaggtccgcgagcagttcaccacccgcatcctcgccagc

SEQ ID NO: 331 - DNA, 234 bp, Streptomyces avermitilis
  CDS (1)..(234)
gtgcgtgtcggctgcgcgagcgcctcgtgcagtgggacaacccactcacgcatcaactcccggcgttcgcgggacagcagcccgtacgcgatgccgccgacggccagggcggaggccgcgcctatcccgccagtctccagcgtggccagggtggcgtccccggttctcccaaaggtcctggaaggcgtgcgcgaagtcgccacctcacgcccccggcgcacgccaaaagcgcgc

SEQ ID NO: 332 - DNA, 378 bp, Streptomyces avermitilis
  CDS (1)..(378)
gtgggttgtcccactgcacgaggcgctcgcgcagccgacacgcacctgcggttctcccgcgacctggtcgccgacctcatcacccaaaaactcgccctggagggcgtgacgttctcctggcacccggccgaacgcaagccgtacgtgctggtgaagaagacccgcaagtctccggcggaggccgccttcaaggaccccaaggtgcgcgacctggtggccaaggctgcggagcctgcgcccatcatcggctccggcggcaagccggtctccgtcgacctggatgccgattcgccgcacatcctggtctacgcctccaccgtcggcggcaagtcggtcatcctgcgctgcatcgcctgccagatgatccaccgtggctcg

SEQ ID NO: 333 - DNA, 618 bp, Streptomyces avermitilis
  CDS (1)..(618)
gtgcgtctgttcgccgatcatgtctcgggtccgccgtccgctgagcgattcgccgggccgctgtggttgcgggagcggcccggtggactcaatgagatcgaatggcggctgcgtcccggtttgcccgcgtttgtgctttatcacgccaggatgacgtcgtcgatgtccctgttgttggcctgctgcggcaacgcgttcgactcgactttggccgcgatgcgggaaggcaccgaggagcatttgcccaaggagatggcgaagcactggacgtccttcgcgcacatggtggccaatgggcagcgaggcgatctctccgatctcgggatcacgttggtcaccgaccccgttgacggtgtgaagggtggttgtgtcgccacgatcgtgagcccccgcgggagcgagagcgagctgaaagacgccctgacccgggtgatcaggggagcggcctccgcgatcggggagggggtggaggcggctgagcgttcaccccggatccacgggctgctggccgctcagtcggatcacgcggtgctggacgaccggctggagaccatcgccgcgaccgggttccgtttcggcgccaccaggtccctgctcgacctggactggcctacagaa

SEQ ID NO: 334 - DNA, 1596 bp, Streptomyces avermitilis
  CDS (1)..(1596)
atgaacactgtcggcatggcagtgagcctgctgcaccagcgcgcgctgaccgatgcggcggcctaccgcagcggacgtcggcgcgacaaggatgtcgcgcgccggatcaccggcgccatgatgcggtacgaggcattcatcgcgctccagcgcccgctcgccgagggactggcactgttcgccgagttcgacctgtcgtcgttcggcacgctgccccggctgtgcccggtgttggcccgggtcgccgactacttcggccccggcgcgatcgcgtccttcgaaccggaggagcaccaggacgcggtgacccgcaacgtgctcgacgtcatcctcggttcgacgcgtcggcagcggcaggtcgtgacccgccgctgcgatgtcctcgtccggccggccgatcccgaggacggcggctacctgcccggctacttgctggtgaaggcgctgtggagcgccggcatcggagtcgacgcccgccttggcgaccccgagctgttcttctcctatgccatcgagtacttgtacaccgacctcgggttgatcgcccacctgctcgacgaggacgacaaccaacgcgcggtcgacaagatgatcgagtacttcgtgcggcgggtgatcgacttcggccgcgcggaccacgccgcgaacctcgatgagttcctcgcgagccaccgggaccgcaagatgtacacggagttcgacgcatgggcgcgccacagcaacaggcggtggaacgtcgacgacgccaccgccgacctgggggcggaccggctcatcgcgctgcatgacgaaacgctcgaacacgctccggacgaggacctcgtccggaacatcgcgctgatgttccagcgcacggtgctgtcactcggccgccacccggtcacggtcaccgtcgacgagcgcgaccggtacaccgtcaccgacggcgagcagtcggtcatgagcggcacgtacgcgtccggactgcccgtcggaacggtggtcgacggccatgtcgacgtctccatcgacgcccacaccggctgcgccgcgatcgttctgtcgatcggcgacgacgcgcccgtgtactggttctccgacgacgcgagcgaggactggcggcactccttccaggtcgcgcgggccgccctgtcccgggcggaaggtgagggcgaggagctgctcaccctgctgcgcgacgtcgccaaggaggcgtccggcgtgatctatcccctggagatcgcgcgggatcgtgccaccggcgccaccaaggtgttcacccgactggcggccgcggtgctcaacgcggcgatggcgaaccgcactcccgatctcgatgcggtggccaggtccgccgcgatcctcgagcctgccggtctggccggcgtgttcgaccggatccgctatgtccgcgcgctggcctggggcggcctggtcatgtccaccggcgcactgccagacgtggacaccgcgcgccggctgttcgaggaggaccgagacatccaccgcgtcgccgagacgttcgacgaggcgatggacctgatccgccgcaccggcgtcgacaagctcggcaacccgctctacaccgttcgcgacggacggccggtgttcattctg

SEQ ID NO: 335 - DNA, 699 bp, Streptomyces avermitilis
  CDS (1)..(699)
atgacgtggctggaccttcccccccactccaggtgctccaactgcaaccggaagttcgtccacgacgggcgccgcgcggtgtgcttgagccggttgaacgcgctcttgcctcccacccccaccgcgagcagcccatccacccgctccgccccgaaccgggccaccacctgcgcgaagatctcgtcgttgacccggccgcgaatcgcagtggccaggtcgttgagcgtgcagagagccggcagctcgaacgagccctccaccagccgtttcaacgcgatacggcaacatcgcgcggtacgatgccgctccgccgtgcgttgtttggagacttccgtgtcagcaaccaaggtccgtttaccaggactgtccaggtccgatgccctcgagctgggcgagttcgtcgaccgcggggcgatcgcgttccaccacgagcccgtgccggaggggagcttcggcgatctcggcgtggtgaccgttgtggtggccgcttccgcctacacgctcaaggggatggtcagctatctgctgtaccgccaccggggcacgtcgttcgaggaggtcgtcgagatcgagcatcccgacggccggatcgagcggaggactctgaagtggcgggacacgtcaagcgagtccatcgactccgcattggcgaaggagctcgcctccgccaccggcattccctgggatcaagatggtcgg

SEQ ID NO: 336 - DNA, 855 bp, Streptomyces avermitilis
  CDS (1)..(855)
gtgatcgtcagcgacgctggctacgacgtcacctgcctggcctgggtcctgcgtgacctgccggtcgagatggtcggccgggtccgctccgaccacgtgatgcgtctgccgaagccaccgcgggtgcacggtgtcaacggccggccgcccaagcacggtccgaagttccgcttcaccaagccggagacctggccagagcccgcgatcaccacggtcacggacacgaccaactacggcaaggccgagacccaggcgtgggaccgggtccatccaaggctcacccaccgctcctcctggctcgaccacgacggtgaacttcccttggtcgaggggacgttgatgcggttgaaagtcgagcatctatcgaaggacagggataccccgccggtgtggttatggtcctcgaagaccggcgccaccccggacgatgtggaccgtttctggcaggcatttctccgccgcttcgatctggagcacaccttccgcttcgcgaagcagaccctgggctggaccaccccgaaactccgtactcccgaggcggcggaccgctggacctggatcctgatcgtcgcccacccccagctccggctcgcccggacgctcgctgaagacctccgccggccctgggagaaacccaccacctccgaccggctcacccccgcacgggtccgccgggggttcaggaacatccgcgctcacctcgcctgcccgacccgtgttcccaaaccccgaggcgccggcgccggacgaccccccggcgccaagaacaaacaccgggcaccccgctacgacgtcggcaagaccgtcaaacgccccgagaccctcaaggccatcggcaagcctggaagatcttgg

SEQ ID NO: 337 - DNA, 1131 bp, Streptomyces avermitilis
  CDS (1)..(1131)
gtgagcacccctaccgccacccggctgcaggccgccgacgcggacgtaaccgtcctgagcaacaccgccttcgtcaccgactggtcccgccggtacttcgggccgtggtggaacgcgttcgaggtccccacgagcagcgtctgcgccgggcccctggtcaccgccgacgtcgacgagaaggcatacgccgacctggccgcgctgctggcgtccgtgccgcacagcgaggccacctacgccaaggcccggctgctcctcgcccgcgacagcacgggcaccatcaccgccgtctcgcccgacgagcagctcgcctaccgctccgaacagttgggcggccacgtcaccatctccggccacgccccgcagcccgtggcgctggccgcgtcccggatcgcccgggagatgatccgcgcggccctgctgcgggacggatggacgctcctgcacgcctccgccgtcgtccgcgacggccgggccctgctcgcctttggcgacaagggcgcagggaagacgaccacggctctgctggtggcctcccgttgtgcccagctcctcgccaacgaccgggtgttcatcaagcgcatcggcgccgacctgcgcgtgttgccctggccgtctgcagcggccatcgggctgggcctgctggacgccctcggcctgtacgacgtcgtccgcgaccggctccaggccggcgaacacctccaccccacccagcaccaggacgtcaccgacgccctgctcgccgggcggcgcgagccgctgtgggagcccggcggcaagcgagagcgcaaggtccaggtcttccccgaccagttcgccagctggttcggcatggagctggccaccggcggccgcgccgccgcgctgctgttcccccgcatcgacccggccgccgtcccggccctggtcgacggcgaacggaccctcggtgaggacgacttcatgagcggggccaccgaggaccgttacccggaccacttcggcctcgcccacggcatcgacggcggtggcagcgacctggcccgggccaccgtcgccgaacacctggccgcccttccgcaccaccaggtggtcctcggtcacgacgtgggcgccaatgccgacttcctcgccaaactctccgacagtccc

SEQ ID NO: 338 - DNA, 909 bp, Streptomyces avermitilis
  CDS (1)..(909)
gtgggctcggtcggtgtcgtcggtgccggcgccgtcggccagaccgtcgcggccacgctggtggcctccggcatctgccctcgcctgctcgtcgtctcccgcaccgtcgagcaggcgagggcgctggccgctgacctcgacgacatgcgccagaccaccggatcgcccgtgcagcccgaagcccgccgggtggcggacctgatcggctgccacgccgtggtcgtcgccgtgcgggccgcgttcaccaacacccgtgccgccgacgtacggatgggcggcgcgttgaccaacgctcccgtgatccgtgctctggccacgacactgcgcggctaccaggggaccgtgctcgtggtcaccaacccggtcgacctgatgacccggctgttcgccgagacctccggctgcccgcgcgtgtacggaatcggctcgaacctcgactccgcccgctaccggctcaccctggcccacctgctcgacgtgcccgcaaccaccgtgcacggccacgtcatcggcgaacacggggacggtgcggtggtgtgcgcctcgtcgaccaccgtcaacggcacgcccgccgccgtcccccttgcggaggtacgcgcggaactgcgtacccgccccggccagatcagcgcgggcgtcggccgcacccgctccggacccgccggcgcggtgctgtccactctgcgcaaggccctcggcctggtcgacggcaccgaggaactgactgccgaacaccgcggcgactggctcggaattccgttgcgcttcaccgccggccagcccgtagcgtgcctgcccgccctcaacgcggacgaagacgcgcaactggccgcgaccgccaccaaactccgtgacgcctaccaggcgttacggccgtccggacccacacccaactcccaggagacgacg

SEQ ID NO: 339 - DNA, 1353 bp, Streptomyces avermitilis
  CDS (1)..(1353)
gtgcacgggagctcccggcaggtgggccgctcctcaactggccagccgggggctcctccccagccaccatgcgcccacccgcccggggcaccgggcgggattcatccactgccgttggaggcgtacgtgagcaccacagccgtgagcacatcgcccggtcccgttccccccgtcccggacgccgacgaggtgttcgccttcgccgcccgggagatcgctgccgctgccgccggcctgtggccgcgcgccgacgtcgacctcggcgaccacgtcccgagcgtcaccggctacgtgcgccggatccgcgtggacgggcgcaccctgtacgccaagtacgccttcctcggggtgtcgctggtctcgctcctgcggggcgcctgcgggccctggccggatgtccgggcggcgcagcaggcgtacgtgcagcgtcccggcgcgctgatggatcgggaggccgcgcagctgcggctcctggcccagctggactcgccccgggtctgtcccgtggccggcctggcgcgaggggtgctgttcaccgagtcggtgaccggcccgaccctggccgacctgctcctgcagcgtccgcacgatgcggccgatctcctcgagggcttgttcggtgagctgcggcggcttcaccgcccgtcggcggcccggctactgggcccggcccggggcatcggggagcacagcatccgggggaccttccagcgcaagttcaacggactgagcggcccgacgtatgtggaacggctcggggccgaacggtgcgcgcccggcgatcgcgccctggtcgtcgggctgctgcgcgacgtcgtggtccggctgcaccggctccaggccacggggctgccccagcaggcgagccggcgggtgctggcgtacggggacctcaagcctgagcacgtggtgttccctgaaggaacatccggtcagccggtgttcatcgaccccggcctgctgctcgccccgcccacggtggatgccgcgaagctgatcagccgaaccgtgctgctgctggccgctgcccggcccggcgccgggacgggccagcaggccatgcgcggggtcggcgccttcgccgcggcgcgggcggacgtcctacccgcccgggtccgccgctcctggctgcgggagctgctggtgctgtggctgatggacagcgtcaacatcctgaccacgtacctgtccgcgcccggcgtactgccgatgcccggtcggggcagcgctctcatcggccgggccgtcgacctgtgccggatggccgatcagctcagctcggagctggcggccggcgccgatacgcgcgccgtgtgggagagcgcgctcggcctggctcaggcggtcgccgcg

SEQ ID NO: 340 - DNA, 234 bp, Streptomyces avermitilis
  CDS (1)..(234)
gtgagcaccaagcgcagcctgctgcatcgcgatcacccgtggatcggccgggacgtcgaggacaccgcgaccggccgtcggggggtcctgcgggccatcgccccggacggcgaccggccacgcccggtggcatggctgctgccggcgggcggcgggatggagtggaccacggacccgggcgcgctagccaaccccgcgcccctcacggcggacatgcaccccaaggaggagcgg

SEQ ID NO: 341 - DNA, 405 bp, Streptomyces avermitilis
  CDS (1)..(405)
atgaccaggacgcctgatacccgggagaacatcaccgtcgctgcttctgccagcgccgctgtgctgtacgtgtgcgctgagcgaagcaagctcactcccacgctcgcagccgaccgtgccgaggccgaggggcgcgacttcgccgaggcgcgcgggctgacgatcacagaagtggtcacggacccgtacggcgatcccgacccttgccaccgtgacggatggctgcgggtgcgggagctggcggagtccggcgcggtccgagtggtgatcgtccggtggcccgcgtgtatcgctccggagccctcccacgagctgaggcaccgcgagattcgctggctgcaggatcactgcgtacaggtgcggtactcctgggagccgctggccacgggcggcggtgaggccaag

SEQ ID NO: 342 - DNA, 1338 bp, Streptomyces avermitilis
  CDS (1)..(1338)
atggcacgtcgaccgcgaacaccgaatgcagcccttgcggccctgatgcagtcaggaggaatcggaaacgcacagctcgcacgccgggtgaacgccgccggccgcgaactggggctccgcatgcactacgacaagacgagcgtgtcccactggctcgccggatccgttccaaaactcgaggcaaggcccgccgtcaccgaggcgctctcacggctgctcggacggcccgtaacgtgcgcggaggtcggctgggagaccgaggaaaagccggccggagagcgcgacttcgtggcaggagtgatcgacctgagccgggcagacatggatcccacacgccggggagtgctgaagaccgggatgtacgccgcggcgctggccgtgccccgatacgaggacgtggcggggcggttggagtcggcaacggccgggcggacggtgcacatcggccgctccgacgtcgagaccgtccgcaccatgaccgacaaggtcgccgacatcctggaccaggtcggggcaggccacgcccgcccgatggccgccgccttcctcgtcaacaccgccggcccctacctgcgcgcgagcggcacggacgaggtgcaacgcgacatgcgggccgctgtcgcggacttcgtgtacctcacgggctggatggccatgtacgaagaccagcagggcctgggccagacgtactacctgcgcgccctcgagctcgcgggcgctgccgaggaccacgtcacctactgccgcaccctgcgcggcatgagcctgcaggcgacgcacctaggccacggcaagaagggcctggaactcgccgacgccgccgccgaggcggcgccctccgccggcccgcgcctagtcgccttcctgtgcggccagcaggccgccgccgctgcgatgaccaacgcccggaacaccgccctggcccggctccgtgaggcggagagcgcgctgtcccgcgccgacgaccgacgcgatgccgtaggcggatacgaccaggccgcctacttcttccacgaggcacacgtgcgctggcacctcggcgacaaggacggctccatcgcctccctgcgccgctcgaacaccgcccgctccccgctggaacgccaaggccgcctgcactgcctcggcgtgaccgccgaacgccagttccgcatgcggcacatcgaagccgcctgccagacctggggaaccttcctggacgagcacgtcacgatctcctctgcccgaggagacgagcacctgaagacgatgctcaaggcgctccccgcctaccgccgcgtcgccggagtacgggaactcgaagaacgcgcccgccacgtcgccactctcaagacagcc

SEQ ID NO: 343 - DNA, 1287 bp, Streptomyces avermitilis
  CDS (1)..(1287)
atggggtacaccgccgtacacccggtctggggtcgactggacgcgtcgatggacgacctcgggtgtgaccgcgcttggacggacgtccaccgggtcaaaggactgcggctggcatgcccggagtgcggcggtcgggtcttcgcccgggcctcccagcacgtcgtccggcacttctaccaccaggtgcggcccccggactgcgagctggcgaacgaatcaccggagcaccacctcctgaagctggagctggtcgtggctgctcgggcggcgggatggcgagcggagctggaggtgagcagcgaggtccggaactggcgggccgacgtgatggtcttcgacgagcacgaccgccctttcatggctctggaggcgcagttgtcgcccatgacgcaggatgaggcgcgtatgcgtacggaccgttacgcgcgggacggagtggcggtgtgctgggtcgccctgcaggaccggccttgggagcgggtcgttccctcgctgagggtgcgctctccgcgccggcggggcgagacctggacggtgtggcatgggatggcgcgctatgactgggcgccacgcacgctgaaggcgaaagcaaagtgggtgcacatcacctgcccgctcggcgacgcgatcaggtggatcctcgacgggcgggtgcacgcccacaccggcgcgaatggcacggtgtggtggacggcgcccgcgtacgaggacctggttttggcacgcgcccagatggaggccgaagccgaagccgtcagacgggtggctgccgccgagcgccgtcgccaggaggccgagcagcgagccgcggccgccgagcaacaccgccaagacgccgagcggcgggcgctggaatggcaggcggagttgctggagtggcaggcggagttgcagcggctggcgggctttttccagcgcacgggccttgacgccacggtgtgggaggcgttcacgcagatggtccgctccgcctcgggcaaagcgatcatgtatggagatcagagccccgctcacggtaacgggctgctcgtctacgcccggccgcgatggacaggcgacgggttcacgctggctggtgtggtctgccccgatctcgaagcgctcatcgagtggccggcggagctgacgatcctggtcccgaaccagacgtggctctcgcgcatccaggccgccgcccggtctccgctgaaggtcgcggtgctgaaccccgtcaccggacgcagcaccttcatacgcgtcaccgctccggatgttgtccctgttagacccaacgggcctgatagggga

SEQ ID NO: 344 - DNA, 822 bp, Streptomyces avermitilis
  CDS (1)..(822)
atgtacgcggccgcgcgccaaccagagggagaaggacaggcagcggagagcagggcgacgggggtctaccgggagcgagcggagcgccgacggcggacgcgaggaacgggcgaggcccgcggcgacggctggcagcgcaccgaggaggacgagcagctgctgcggctggccacccggtacagcacgctgacgctccaccaggccgcctacgcctgttggggcggacggatcgaggccgcccggcggcgggtgcggctgatggtcgaggccgggctgctgcaccgcctggccgtcgcggatgtcggtatccggctggagagcgaagggcgcactgtgctctccgagcgggaggtgcacgccgccgaagccgtaccaggccgcgcggcggagctcctggcggaccttggcgtgcaccaggtcccggtcggcgtccggcgcggggaaatactcgctgtgcccgtcggggcccgtgccgtgcactggcccgacctcgtcgtggtgctgcccggcggccgcctcgccgcgttcgaggtcgagctcacagccaagcccgcggccgcgctccggacgatcctgcgtgcgtacaagcaggcccggcgcccggtggcctacctcgccactgagcctgtcgtgggccagctgcagggcggccccgggccgggcggccggtgggtcaacggtgtcgcccaggagctggaactcctgccgccgggcgggcctggcccgggcgccgacgggcaccttcaggtgcggccgttcaccgccgtcgacccggccgtggcccgccggacagcccagcaggccgcccggctacgaggtgga

SEQ ID NO: 345 - DNA, 1386 bp, Streptomyces avermitilis
  CDS (1)..(1386)
atgccgtcgccaccacgttcaacgactgacccgcccagcattctcaccccttccctcagtagggaactgcccccaaaggaacagcgtcccccagtaactgtcagcgccagagcggttgccagggcttcagggatggggagaagaccttccgcggcgcagcgacggctgtccacgacccttccggcagctgatcaacagcgcgtaatctccatgccgccacaagatctgcgtttcaggtcggggggagaccgcatgcagcacctttccacaccactcgccaggactctgggcgcggcggctttgttgtcggcagccgccgcatggggcgcggcctcgatccggtacgaagctgacggccctcgcctggacgttctcgtgccgctggccctggcggcggtgttcgtcgtgggctggctgatggcctctcggtcagcaccccccgttaagctactgccatcgaccgctcctccccgggagaaggtccctggcaagctgggagcggtgcgccgtgactgggggctcgtcgccgcggcctacctcaccgtctgggcaccgttcgcggcggccaacagcgcctacggcggccggggttcacagctcggtgccctgtactgcctgctcaccttcatcgtcggcgccgtgctgtccctgtgcaatctcgcgctgctccagagcaacctcggtcgatcgcaacgcatgctcaaggaggacgccgccgcgggcagcgtccacgctatccgcgtccggttcggtaccccagtgctggagatgtaccgatacccgacggggcagggtgccggcaggatcgccgcctccaccacttacggcgtcgagttggttcacgagagcgacagcggcgagcaacggactatccggctccgggccatgaaggccgcccaaagcgacaaggtcggtgacaagcacctcacctatgccgcttcccaactcgtcggccacggcggctggttgtgctggcctgcccggtggcgtgacatcgcgggcacgaacaaggacctcaaggtccccgccgccttcgcctccgactccggtcacgtggtctggggcgagatgcagcaggatgactacgcgtactatctgcgcgacggtgccgcaccattgtgcgagaccgaccccaggctcgccgtcgcgccgcttccccggccgtcgcggtacttcccgaaggtgcacgcctcgcacctgcgtgtcgcggcggttggcgccctcctcgccgtcccgttcctgctggatgccgtcccgtactgggccggtctgctgttgggcgtggtctcgggggccttagggctcttggcggggatgacgatggacggagtgggcgtggaccaggaaccgtggactgtacgtacaacctcccatccgtcactgcag

SEQ ID NO: 346 - DNA, 1236 bp, Streptomyces avermitilis
  CDS (1)..(1236)
atgaccgcacccgacagtctgcccctgcatgccctcgtggaagacaacctcgccgcggcgagtcccgacctgctgcgcgcgatggtcaagacgttcgccgacgcgctcatgtccgcggaggccgacgccctctgcaacgccgaatacgggcaggtcagcgacgaacgcgtcaaccaccgcaacggctaccgcccacgcgagtgggacacccgcgccggcaccgtcgaactcgccgtccccaagctgcgccagggcagctacttcccgcactggctcctggaacgacgccgacgggccgaacaggccctcatctcggtggtcgccaccgcctacctgctcggcgtctccactcgcagagtcgagaaactcgccgaatccctcggcgtcacccagctgtcgaagtcccaggtcagcgcgatggccaagcacctggacgagcgggtcgccgagttccgcaaccggcccctggaccaaggcccttacgcgttcgtccgggtggacgccctgacccagaaggtccgcgagggcggccgtatcatcaacgtccacgcgctgatcgcggtcggggtcaacgccgacgggcaccgcgagatcctcggcatcgacgttgccaccgccgaggacggcgccggctggctcgccttcctgcgctccctgaccgcccgcggcctgaaaggtgtccagctcgtcgtctccgacgcccacaccggtctggtcgccgcgatcggcgccgtcctgcccggagcatcctggcagcgatgccgcacgcattacgcccgaaatttgctgagccaggtccccaagtccgcccagccgtgggtggccacgctgctgcggaccgtcttcgaacagcccgacaccgacgccgtccaggcccagatgcgccacgtgctggacgccctggaggccaagtttcccaaggccgccgcccacttggttgccgctcagcacgacctgctggcgttcaccgcgttcccacgtgagatctggcggcagatctggtccaacaacccacaagaacgcctgaacaaggagatccgccgccgcaccgacgtggtcggcatcttccccgaccgcaccgccctgatccgcctggtcggcgcggtgctggccgagcagaacgacgagtggaccgaggcccgccgctacatgggccgcgagctcctcgccaaggcccgcctccacccgatcgagtcagaaaccgacgagaccgaactgcccaccgaactcaccgca

SEQ ID NO: 347 - DNA, 2274 bp, Streptomyces avermitilis
  CDS (1)..(2274)
atgagcgaggccaaccccctcaagcgagcagcacggaagatcaccaacagcctccaggacaacggcgccacgcctgaggagggcatccccggcaggcccggcccggagtctccctccgtggcggagccgacggagccgcgtgacccgctgccgccgaagccggaccagagcggccccgacaccgtgtcgcccaccggccagccgaccggcgccgaccaggcccgaatggctcagtccggcagctacctgacgaccgcccagagcacccgcctgtacgacaccgaccactcgctcaaggccgggccccgtggaccggtcctgctgcaggaccaccacctgcgcgagaaggtcatgcacttcgatcacgagcgcatcccggagcgcgtggtccacgcgcggggcgcggccgcgcacggcgtgttccagagctacggtacggccgcctccgtgaccaaggccgccttcctctccgaggacaaggagacgccggtgttcgtgcggttctccacggtgctgggatcgcggggctcgtccgacaccgtgcgggacacccggggcttcgcgaccaagttctacaccagcgagggcgtcttcgacctggtcggtaacaacatcccggtctttttcatccaggacgcgatcaagttcccggacgtcatccacgcgggcaagccgcacccggaccgggagatcccgcaggcgcagagcgcgcacgacacgttctgggacttcgtcaccctgcacaccgaagcgacgcaccacaccctgtggaacatgtccgaccggggcatcccgcgctcgtaccgaatgatggagggcttcggcgtccacacgttccgcctggtcaacgccgagggcgccacgacgctggtgaagttccactggaagcccaaattgggcgtgcactccctggtgtgggaagaggcgcagatcaccaacggcgtcgacccggacttccaccgccgggacctcgccgacgccatcgaggccggcgcccacccgcagtgggagctgggcatccagaccttccccgacaccccggaccagaccttcgagggcatcgacctgctggacccgacaaacctcgtgcccgaggaactcgctcccgtgcagccggtcggcctgctgaccctgatgcgcaacccgtcgaacttcttcgccgagaccgagcaggtcgcctttcacgtcggccacctcgtcccgggcgtcgacgtcaccgacgaccccctgctcgccgggcgtctgttctcctacctggacacccagatcacccggctgggcggcccgaacttcccgcagctacccatcaaccggccgcacgccccggtcaacgacatgctgcgcgacggcatgcaccagacggccgtgcaccggggtgtggctccctaccgccccaattcgctcgatggcggctgtcccttcctcgcgggagcggacaccggcgcgttcgtcgagacgcccgtacgcgtgccggaggcggcgaaggtccgggaggcgcccgagtcgttcgcggaccacttcagccagccgcggcggttctggctgagcatgagcccgatcgagcgcgagcacatcatcgccgcctacaccttcgagctcggcaagtgctacgagcaggccgtcaaggagcgagcgctacaggtcctggcgaacatcgacccgaacctgtgcgctgaagtggccaccggtctcggactgccggccccccagccgaccgtgcccctggccgaggtcgaggccagccccgccctctcccaggtcggcgggacctggcccacggacggccgggtcatcggcatcgtcatcggtccggacggcgacctgcggggcgtgagcgcggtgcgcgaggcggtcctcgacgcgagcatggtcccgctggtcgtcgccccggccggaggcgttttcggctcgggtgagggcatggtgacggtccagcgcacctacgccaccgcgcggtctgtcgagttcgacgcgattctgctggccgggacaccgggcgtgggcggcgacgcgtacggcgcccgtgacgccaaggcgttccccgcccccgcgcagcaggcgaccggtgacccccgcgtcggactgctggtgtcggaggcctttcggcacggcaaggccgtcggcgcgtgggccggcggcgaggcgttcctcgaagcatccggggtgcccctcgacgcgccgggcgtggtggtcggtgactcaggcaccggcgccctggcgcagctcaccggtctgctgggcaagcatcgcgcgtgggaccggttcagggctgtg

SEQ ID NO: 348 - DNA, 465 bp, Streptomyces avermitilis
  CDS (1)..(465)
atgcagacgttcctgccctttcccgacttcgccgcatctgccgccgcgctcgacccgcggcgcctgggcaagcagcgcgtcgaggcgctccagttgctgcgcggtctgatggttcccggctacggctggcggcatcacccggcggtgcgcatgtggacaggctacgaggaggcactggtgcgctacggcctggaggtctgctgcgtgtggacggcggccgggcgcgcggacacgtgcgccggctccctgatgaccgacttcacggcccaccgagccgatgtgggcgtgcgtacgcaggagcggcttgcagcggacggcgagctgccaccgtggctgggcaatcccgcgttccaccgaagtcatcggtcggcgctgcggcgcaaggatccgggcttctacgcacccctgttcccggacgtccccgaggacctgccctacgtctggcccgcctcggaccggtctcgc

SEQ ID NO: 349 - DNA, 2121 bp, Streptomyces avermitilis
  CDS (1)..(2121)
gtgcccgacgccgcgtccaccgatttccctgcgggcttcggcccggaggcactggagtccgtcctgctccagttcgcgcgggagagcggcgccagcttgagcgccatctacttgctgtcgccggacgagcccgcgctgcagctggcggtgctgagcggaatctcgtggcggatcgccgtcccgtgggcgcgggtgacgctggaggctgcgaccccggtggccgacgccgtacgggagcgccacctggtgtggatcggcagcgaggaggagcgggcgcgccgctacccgaaactggcgctcgtcctgccccaccccttcgccctggccgccgccccgatcacgaccggcccgaccgtatggggcggcctggtgctgcactggcccgcctcgcacccaccgacgttgagctcgcacgagcgtgatgcgatcgccggcgtctgcgagcgactgggcgtgatcatgcggcaagccgccaacagcggtcaccccgtggtgcccgggctcgagccgcgaatactgcctccgtcgcagacccgtaccgccgggcaccacgaggcacaggccgcggtcggcttcgccgagcgtcttcccgacggctgctgcgccctggatgtcgacggccggatcaccttcatcaccacggccgcggcagacctcctcggcgtcggtgttttcgaccttctgggagcgcggccctgggaggcactgccgtggctggacaatcacgtcgccgaagaccgctaccgatccgcagcgctcagccgcctacccacgtccttcactacgctgcgcccaccggatcactggctgtccttccacctctacccggatgccaccggcatcagcgtgcgcatcgtccccaacccgtcggctcataccccggaccctccgcggttggtccaccccgcgccgcccgttgaaccgggccgggccaacgccctctacagcctcacgcatcttgctgtcgccctcaccgaagccgtccgcgtatgcgacgtggtgaacagggttgccgaccaggtcctggccgccttcggcgcgcgggccctcgccctgatgaccgcacaggagggccgactgcacatcatcggctaccgcggctataccgccgacctcatggaccgcttcgacgccacccccctgaccgccgacacccccgccgcgcatgtcttgactactggcatcccctgcttcttcgccagcttcgcggagctgaaacgggcccaccctgccgccgtcctccaggacggcatggcttcttgggctttcctgccgttgatcacctccggccgcgctgtcggctccctggtcctcgcctacgaccagccccatctcttcaccccgcaagaacgcgccgtcctcaccgccctcgccggactgatcgcacaggccctggaccgcgctcatctctacgacgccaaacatcagctcgcccgcaacctccaggccggcctgctgccccacaccctgccgcgcatccccgggctcgaggttgccgcccgttacctccccgccagccgcggcatgggcatcggcggcgacttctacgacctcatccgcctcgacgagacgactgccgctgcagctatcggcgacgtccaaggtcacaacgtgcaggccgccaccctcatgggacaggtccgcaccgccgtccacgccaccgcaggcgcagcccctggcgaagtcctcgcccgcaccaaccgcctactcaccgacctcgactccggcctgttcaccagctgcacctacatcgtcctcgacatgacccaccaccacgcctgtctggccaccgccggccacccacctccgatcctgcgccacccagacggccacgtcgaagtcctccacctccagccaggtctcctgctcggcatcgaccccgcagctgaataccccaccaccgaagtctccctgccacccggcaccgtgctcgcgctgtacaccgacggactcatcgaagcacccggcgtcgacatcgaggacgccatccacagcctcgccaaccaactggctcacgccgacactttgagcatggaggccatcgccgacagcctggtcgaccacgcccggcaatccgcgttccgcagtgacgacatcgcgttgcttctcatccactcgcgt

SEQ ID NO: 350 - DNA, 1527 bp, Streptomyces avermitilis
  CDS (1)..(1527)
atgagtggtcgccgcgctgcactacggctcggccaaggtggggctccttcagcaactggtgcgcggccaggtcaccccgctgtggccgccgaccggtatcgccctggcgagcccgctcctgggcggcccgcgggtctggcccgggatcgcgctcggcgcgctcctggtcaacgtctccctcgggccgtcggtctgggccgtgctcgtgatcgtgtcgggaaacaccctcgcgcccgtctgctcgtacatactgctccgccgcacgggattccgtctcgaattggaccgctcgcgggatgcgctcgcgttgatctttctcggtgcgttcaccgggatgctggtcagcgcgacgacaggcagcgggaccctggcccacgccggcgtgctgagtgccgaccagttctggccgacatggtcggtctggtgtaccggcgatgcgatgggcgtactggtggtgacgccggtcctgctcgttttgcgctcagcacaccggccgaaggacgctccgcctacccgttgggtggaggggctgctgctcctcgcagccacctcctacatcggtttcctggagaccggcagcacacccctcaggttcctcggcttcccgagccgatctgggcggccttccgcttccaacgggccggggcagcgccctgcgccctggccgtgtcgaccttcgcagtcatcgtggcctgtctactcacagcgactgccggctactgggtcctcggtcgagggacgccccgtccgaacggcacgtgggccatgggcgcgctccttggctcgttcgccctaatcttcgccacctacgccccgctgttcgagaacgccgttgagggcgtcgtgccgcacgtcgcccggctgatgagcaactgcgcttccctggccgccgccacggcggtcctggccgtctcgttccagctcaacctggaacccgcggaagcgcaacggcgagtccgcccgcgtctcgtcctcttcgccacgtccgccctcggcatgaccgtgctgttcacgtacgagcagatgacgcatcgctctccgcaggtgtatgcgctctacctgctccttttcatctcctacctcggtttcgccatcgtcgacttcctggtgcaggccgtaagccagtcgaggtcgacccgccgcagcagcgtccggataggtctgcgcatggcggcagcagggtgcgccttcacactcgtctacgcggtgtacaagctgacggtcctcatctccctgggcctgggcttccacctggtgtccgaccattcggggtgttcgtcgctcgtgtctacgccgtgcgtcttcagcgtgacgtctccggcgctcgccgccctgctgatctgcgtcggtcgcacactgacggctgtcgtctacccggtcagccaggcccgacgtcgccgctgggaggcacaatccttcgaagccctcggtcctctctggcaagacctgtccgccgcaatgccgaatatcgacccggactttacgaggccgcttcgaacgactccgacttcctgctccaacgtaggg

SEQ ID NO: 351 - DNA, 1395 bp, Streptomyces avermitilis
  CDS (1)..(1395)
gtgagtctgctgcatcacgatgcccggcacgaggcgttcgacttcacgtcccactttcgggaggacctctacacatgtctgacccggcgcggtgacacgctgttcgagctgtgcgacgcgatgctctgcgaggacggcccggtgacctcgccggtcgatctgacgctgctggccgaacaccggcgtgggcacggcgcgttgtacgacgcgctcaaccagggccgcatcgacgcggtcaggctgcgcaaggcgctggccatgctgccgcagcccaaggccgccgacgggcgcctggtcctggccgtcgatgtctccgcgtggctgcgtcccgacgcgccgtgcagcccggaccggctgttctgtcatgtctccggacgctcgggacgctcctcggaccagttcatccccggctggccgtactcgttcgtcgccgcgctggagaccgctcggacgtcgtggtgccaactgctggacgcggtccggctcggccccgacgacgatgtcgccgaggtcaccgccgcccaggtccgccgtgttgtcactgacctgatcggccaaggacagtgggaggacggtgacgatgacatcctggtcgtcttcgacgccggctacgacgccccgcgcatggcctacctcctcgacagcctgcccgtcgaggtgctgggacggatgcgtgcggaccgtgtcatgcgacggccggcaccttcgcccaaggagtacgccgtgtcctatccccagggcgggcgaccgccgaagcacggcaaggagttccgcttcgccaggcccgatacgtggggcgatcctgacgcggagacggtgcaggtcaccgaccgctacggcgccgcgaaggcgatggcctgggaccgtatccagccccggctcaccacccgcagcgcgtggatcgaccatgacagcgaactccccatcatcgagggcaccctgatccgcctccaggtcgaccatctgcccggcggcggcgacccactgcccgtctggctgtggtcctccaagaccggcatgaccagcacagacgtcgacctgcggtggcaagcgttcttgaggcgcttcgatcttgaacatactttccgttttgtaaagcagacgctcggctggacccgtccaagactccgtactcccgaggccgcagaccggtggacgtggctcgtgatcgcggcgcatacccagctccggctcaccccggcccgcgttcgccgggggttcaggaacctccgcccccacctgcacagtccagcccgtgcacccaaaccctcaactcctggtttgaccaccaccgccccggcgttgttcagcagctgccgggtcgcggcggcggcctcgtccgggccgcggacgacagtgcccgctgcggggccccggccgcggtcgcgagcatcc

SEQ ID NO: 352 - DNA, 2187 bp, Streptomyces avermitilis
  CDS (1)..(2187)
atgcgttgcatgctgttgaaagccggtgtgtgcggcagcgctgccgtgctcgcactcgtcacgtcgcccatcgtggcgagagcagccacgttggagccgaggatcgacctgaaggtgctcgtcgtggatgacgggggcccggccaccggggccatcaccgccgaactcgactcggcaggcaccccgtacaccagggtcaagctggccgacagcgggcggccgcagatcaacgccgccttcctcagcgataccgtcagcggccgtcctagggccaagtaccaggccgtcgtgctcccgaacgacaacccgttcggtgccggctccgccgagatggcgaccctggcgaccttcgagcagaccttcggcatccggcaggccgacgcctacacctacgccaggcccgaggtcgggctgaactacgcgcaatcgcctgggtacatcggctcgctcgacggcaccaccgcccaggtgacgtccgccgggaattccggatccttcggctacctcgccgggagcgtccccttcgaggacaacgcgcccgacgtgtccgagagctacggctatctggccgtgccgctcgcccaacagcaggccggggccacgttcaccagctatgtggacgccccgatcccgggcagttccgcgcgcggctcgctcgtcggcgagtacgcccacgaggggcgccgggaactggtcgtcaacttcgtctacaaccagtaccaggagcagtaccggctgctcagccggggcatcgtcgagtggctgacccagggcatccacctgggcgctgaccgcaactacttcgcggtccacgtcgacgatgtcctcctcggcgacgaccggtggaacacctcgctcaactgcacccccggagacgtggactgcaccccgggcgggggcgccacccccgacccgatccggatgacggcggcggacgcccagtacgccaagcagtggtccgccggtcacgggctcactctggacatggtgttcaacggcggcggcagcgaggactacaaggcggaacacggtggcgccgacccgacggcggaccagctcatcgccgacaagagcgccttccgctgggtcaaccacacctaccagcacccgttcctgggctgcgtccaggacgtcagcgtggtgccgtggaagtgctccaccgacgcgagcggaaagatccagtgggtcagccaggccgacatcacctcgcagatcacccagaaccgtacctgggcgggcggcaagggcctcgccctcgacaacacggaactggtcaccggtgagcactccgggatgaaggtgttgccgcagcagcccgacgacaaccccaacctggccccgtccctgaacgccaccggggtgaagtggctggccagcgacaattcccgagacccgcagcagcgccagatcggctccgccctcaccgcgccgcgcttcccgatgaacgtctactacaacgcgggccacgcgaccgaggaagtggacgagtacaacttcgtctacaccagcagggccaacggcggcagcggcatctgcgagggctcctcgaccaccacctgcctgagcgccccgctggacccccagaccggctacacgtcgtacatcgtcccgttggagagccgcatcgccctcgggcacgcgctttccaacgacccccggccggtgtacatgcaccagtcgaacctcgccgaggaccgcatcgcctacccggtgctggacaagatcctgggcgactacaccagcctctacgccgccaacaccccgctggtcaatctgcggatgaaggacatcgggaccgagctgaagtaccgcgccgcctgggccgccgcagtgaagaacaaccaggtcaccgcctaccggatcggcaacacggtcaccatcagctcgccgaacggcacccagaccagcgcgaccatgcccgccggcaccacccagaagcagctgatcggcagcaccgccttcggcgccgcctacgccgggcagctgtccggctggaccacccccggcacgctgcagacctcgatcaccctgcaactgaccacgcaggccacgcccgcggcccccaccggcaccggcaccggcaccggcaccgcgaaggtagccgcaccggcacccgcgctgcgtgtgcccagcggtgtggccagccctgtcccggcaggccccggcgacaccgcccgccgcaagcgc

SEQ ID NO: 353 - DNA, 1680 bp, Streptomyces avermitilis
  CDS (1)..(1680)
gtgatcaacgggcacgacggcacgaccggcacgcgacgggcgcaaccgtcccaacgtgcacgacgggatacggggatagggggatacggggatttggcagtaaccgaccgcaccaggccagcattcggggacacaccgccatccggcacagccagggccatcgcggccatcaacaccggcacgacccgcgtcaccatgctcaccgagggcacctacccgcacagccacggcggagtgagtgtctggtgcgatcagcttgtccaaggcatgcccgacgtgaacttccagatactcgcggtcaccagtgacggccgcgagcccctcacctgggaaacgcccgcgcacgtcagcaaggtggtctccatacccacctggggaccgacgccgaccggccgcgcaccgcgcggccggcggctgcggggcttcctcgacacctacgaaatgttcctgctggccctcctcgatcccggccccggttctggctcctgtgccggccccagcacccttgagcgcttcgccgaagggctgtacggcctcgcggcacgagcccggtccggggaactgacggcggcgctgcgcaccgaggcagcgatacgcacactggccgccgtctggaaccgtccgcacgtacccacccacgccgcccggccgaccatgcacgacgtactgaccgcgaccgacctgctggaacacgccctgcgcccactggcggccgccccaccccggcacgggatcgcccacgccgtcagcggcggactggcggccctgcccggactgctggcccagcacctgcacggcacgcccctgctgctcaccgaacacggcgtctacctgcgtgagcgctacctcggttacggcgccggcggttaccactggccggtgaaggcgctgctgctcggcttcttccggctgctggcacaggagacctacgcccgcgccgcgctcataacgccgggaagccactacaaccgacgctgggaggaacgcggcggcaccgcacccgacaagatccgtaccgtctacaacggtgtggaccccggggcctttcctcccgccggtccggaaccggagatccccacgctggcctgggcggggcgggtcgatcccatcaaggacctggaaacgctgatccgggccttcgccctggtacgccgggagatgccccaggtgcggttgcggctgttcggcggcacacccagcggcggccaggcctaccgggaacgctgccaggctctcagccgggacctgggcatcgccgaagcggtggccttcgagggccgggtggaggacatccgcgacgcctacgcggcgggcaccgtggtcatgctctccagcatcagcgagggctttcccttcaccctcatcgaggccatgtcgtgcggccgggccaccgtctccaccgacgtcggcggggtccgcgaggccgtgggtgacgccggactcgtcgtaccgccgcgcgaaccggaggcgatggcacgggcagccctggaactgctgcgcgcgcccgcccgccgggcccggacgggcgaggccgcgcgactgagggtgatcgagcagttcacactccggcacaccatcgactccttccgggagatctacggcgcgctgggagcgggcgaggaccggacgcacctggccgaggacccggcgccgcgcgcccgacgggccggaggtgagtgg

SEQ ID NO: 354 - DNA, 1350 bp, Streptomyces avermitilis
  CDS (1)..(1350)
gtggtgaaccggccgggcgatgaccgaaccgtattactgcgcctgccgaccccgccgcagcggccgacctgggccgacgacccgctcgacgagctcgccgaacggctggcggacgtgtgcggggccgccgttcacccggacgagatcgccgcggtgctggagtccgacgggctgacgcaccaacagatcaccacccgctactcgcgacgggacctgttcgccatcgcggaggagctgtacacccgggtgccgcgccgattcccggaccccggaccgggacccgacccgtggcggaccagcccgtggcagtgcctgctgcgcgggatgctgttcggcctgccggggctggcctaccttctgggcgcaggactgctgcccggccgggtcaccgggctcgctgcctcggcactcgtggcctgggcctggaaccaggcactggcccaccgcgcctacgtacgactcgccgcgggcggccggcgggcagccgcgcggtgcctgctgctcggggccccggccggggtgacggcagcggcggcggccgcactggccgtctcgggggcgggtgccgccccggccttcgcggcgggagaggcgctctatctggcggcggccacggtgctgctcgttctgggacgcgagcagcacctgctgatcgcgctcgtaccgacggcggccggggcggcctgcataccgctgtggcaccccggcccggtgccggtcgccgtgctgctgctggccaccgtcgcagcggcggcgctgtcggcggtacgggagatcgtacggtcgctgcgcaccacaagctccgcggcaccgggcacgccccggctcaccgcctccgtcccgtacgggctgttcggcctggccggcggggcgctgacgctgatggccccggcggcgggcaggccggccgccgtcgtactgacgctgagcatgggcgtggccgagtggttgctctaccgctaccggagcctgaccctcaccgccctgcggcacagccggaccccgtggggcttccggctccgggcggtcggcgtgctcgccctgtgcctcaccgggtacctcgcggtgctcgccgccccggcgctggtcaccggggtgccgccgctgccgctgctcgccctcggcgcggcgctctgggtcgccctgctgctccaggcggccgggatcgcctggccgtccgccgtggcctgcctcgccgccgccgttgcggaggtggccctgtcaggcggggccaaccgggggccgggtctgctcagcccggcgaccgccgagttggcggcctgcggctgcgcgacggcagtgctgctggcggtcgcgtgcacccggatgggccggaccacggcccaccgc

SEQ ID NO: 355 - DNA, 1005 bp, Streptomyces avermitilis
  CDS (1)..(1005)
gtgacctcgtccgctcccgtaaccgtcgccgtcaccggtgccgagggattcatcggctcgcacctggtggaggcgctcatcgcatcaggacaccgggtacgcgccatggcgcagtacaactccttctcgtcgtacggctggttggagaccctgccgcaggacgtgatggacagtgtggaggtcgtactcggcgacgtacgcgacgccgggtcggtgcagcacctgctcaccggcaccgaggccgtgtaccacctggccgcgctgatcgcaatcccgtactcctaccaggcaccgcacagctacgtggccaccaatgtcaccgggacgctcaacgtgctggaagccgtacgccggctcggcatccccaggatggtgcacacctccaccagcgagacgtacggcaccgcgcagaccgtccccatcaccgaggaccacccgatcaacacccagtccccgtactccgcctccaaggcaggcggcgaccggctggccgacggctactacgccagcttcggcatcccggtggccaccctgcggccgttcaacaccttcgggccgcgccagtccatgcgggcagtgatcccgaccgtcatcgggcaggtggcggccggagagcggaccatcgccctgggcgacctgcggcccacccgggacttcatgttcgtcaaggacaccgcccaggcgttcctcgcggtgggcaccgctcccgccgaggcagtcgtcggcaggacgttcaacgccggtacgggcggtgagatttcggtcggcgacctggtgacgctggtcggcaagctcatgggggccgagcttgaggtccgcgaggacgcgcagcgcatccggcccgccgcgtccgaggtgatgaggctggtctgcgacgcctcccggctgcgcgccgcgactggctgggaaccggcccacagcctccaggaagggttggagcagaccgtccggttcttctccgacccggcgaacctggcccgctacaagactgccatctacaacgtc

SEQ ID NO: 356 - DNA, 711 bp, Streptomyces avermitilis
  CDS (1)..(711)
atgcacgcagtcattctggccggaggcaagggtgtccggctgcgcccgtacaccaccgccctgcccaagccgctcgtccccatcggcgatcagcacgccatcctggaaatcgtgatgcggcagctcgtcaactcgggattcaccagctgcaccatcgccatcggccacctcgggcacatcatccgcgcctacgtcggcaacggctcccaatggggtctgcgcgtcgactattcgaccgaggacagcccgctgggcaccatgggcccgctgctgaccatgctcgaccggctgccggagcacttcctggtcatgaacggcgacatcctcaccgacctggacttccgcgccgtcctgcgcagtcaccaggccgacagcgcgccactgaccatcgccacgtactgccgcaaggtcaggatcgacttcggcgtcctcaccaccgacggcaagcaggtcgtcggcttcaccgagaagccgaccctggactaccgggtctccatgggcgtctacgggctctcccggtccaccctggacggctacacccccggcctgccgctcggcttcgacgaactcgtcctcgacctgctccgcgacggcacgcctccggccgcccacgagttcgacggctactggctggacatcggccgcccggacgactacgaccgggcgaactccgagttcaccacccaccgcgacctgctgctgaagggagcg

SEQ ID NO: 357 - DNA, 897 bp, Streptomyces avermitilis
  CDS (1)..(897)
atgcgcattctcgtcgcgggctccaccgggttcctgggccggcacatcacggagcacctgctcgccctgtccggcgtccgggtgctccgcgccggccgctccccgggcgccgacctacgggtcgacctcaccaccgccaccgtctccgctctcgccgccgacctgcacgcgctggccccggacgccgtcgtcaactgcgccggcgccgtcggaggcggcccgcttctgctggcggagaccaacgcccggggacccgccgtgctgtgcgaggccctgaccgcggccgacctcccggtacgcctggtccatctcggatccgccggcgagtacgggacgacccccgggcagccgctcggcgaggactccgccacctgtccgcagggcgcgtacggggccaccaaactggcgggttccctgaccgtcgccgaggccgcactggacgccgtcgtcctacgggtgttcaaccccctcgggccagactcgcccggcacaagcctgcccggccggctcgccgacgagctgctgcgcgccggaccggacggcacagtgcgggtcggtgacctgtccgcgtaccgcgacttcgtcgacgcacgggacgtggcccatgccgcagccctcgccaccacggcgcccggcccgctcccccgcatcctcaacatcgccggcggcagcgccacccaggtccgcaaggtcgcggaaggcctggcccggatcagcggattccatggccgaatcgacgagaacggcaccggttcccagcgctcgtcagccatctcctggcagcaggcggacatcacagctgccgccacagctctgggctggcaccccgaacgtaccctcgacacctcgctcgccgacctgtggacctcgcgcaccggcacgcccccgaccccggca

SEQ ID NO: 358 - DNA, 702 bp, Streptomyces avermitilis
  CDS (1)..(702)
gtggacctcgcgcaccggcacgcccccgaccccggcatgacacacggccgactgcttgttccgctgtacgtccaccccgctgtggaccctgcggcgtggcaggccctgacgcgagtcccgtcgcggctgtacggtgtcgtcctcaacgttgccgacggccccggcgcgacccgcgacccggccttcgccgccgccgccggggccctgcgtgcggcaggcatacgcgtgctcggatacctcgacaccgcctacggcacccgtccccaccagacggtgctcaccgagctgcgccaccacgtcagctggtacggaaccgacggcgtctttctcgatcaggccagtgccgaagctggcctgctgccgtactaccgcgtgctgggcgacgaggcccgcgaccacggcgtcggcaccgtcgcgctcaacccgggaatgcaccctgattccggctacgcctccatcgccgatctgttggtcaccttcgaagggaactggcagacctacctcacctcagccgcgcccttctggaccgcggcgcacccgtcggcccgcttctgccatctgatccacggcgtccccgacggcctgtgcgacctcgccgcccgcaccgcacggatccgccgagccggcgtccactgcgcggtaccgggtgagggcgcgaacccctgggccgccctgccccccgccgtgaggaggggaaccaca

SEQ ID NO: 359 - DNA, 531 bp, Streptomyces avermitilis
  CDS (1)..(531)
gtgtgtgcggcctggccgcctgcgatcgggaacagcggctcacccgcgagctgggcggcgtcgacccggtcgagttctgcgccgcgccggccaaggcggcgcccgtcaccccaccggttcgtcaaggaagtgctgcgaatgtggagcccaccgctcattctggtgcggcgcgcacgggcctcgttcgacctcggcaccacccggctggagaaagcgcagaactacctggtcagcccgcacatgatccaccgcgatcaccgctactggcagcagcccgataccttcgaccccgaccgcttcctgcccggggtaccgcacggaccgaccgacagatcgtgttacgtaccgttcgggtgggcgccgaagaagtgcatcggtaacgatatcggcaccactcagctgatgggcctgtgctatctgatctgcacgcgctaccgcctcagcgtcccgaactccgacacgctccccatggcctgccgtttcgcccctgtaccgcagcgattcaacggacgcctcgccctggcctggaac

SEQ ID NO: 360 - DNA, 1332 bp, Streptomyces avermitilis
  CDS (1)..(1332)
atggccgaggccctcaatggttccttcaaggccgagctgatcgagcaccaagggccctggcgagacgctgaccaggtcgaacgttccgtcgttcaatgggtcggctggtacaacaccgagcgcctgcactcagcactcgactgcctccccccccgaggaattcgagacccggcactaccgatctcaggcagcaatgaacgccgcctgaaaccacgcaaaccggccgctacgaaactcggtgcagctcacaacgggttgtacgtaacggctctggggctactgttggcgcagtacacgttctgcggctacgacgcctcctcgcacctgtcggaggagaccacccaggcccagatatcggccccccgcggcatcgtccgctccatctgggtctcctggatcgccggcttcatcctgctggccggtctcacctccgccatccaggactatgccggaacccagagcagctcgaccggtgtgccgcccgctcagatcttcctcgacgtcctgggggccgacggagcgaaagccctgatgctcatcgtgatcgtggcccaactcttcagcggcagcgccgagaccgccgccgcgtcccgcatggtgttcgccttctcccgcgacggagcgatcccgttcgctgccacctggcgccgcgtcagccctcgcaccaagacgcccgccgccgccgtatggctgtccgtcggctcggcgctcgtactggccgcgccgtcgctgtactcgccgaccgcgtacgccgcggtgacggccatcaacgtcatcggtatcacgcctggtccgccctggaggacaaggcctcggggaagctgtgggacggcgccctcgatgcccagcacgccttcggcgacctcgacgggcaccggcccgcactcctggccgtccacgacgccgtcgtcgacggcaccgcctttcgggcggagccatctatgcgggcatcagccagaagccggagcaaacccccggatcaggtcgaacccgtacaccacttccctggacgcagcccacggatacttcgcagagggcacgcgcctgacagccgttgccaccctgggcggcgctgcatatcggcgttacgctcaacaaacgcggcggtcgtccccgccgcgggcggcaggcgggggagttatgtggatcttcttggtactgggtttgctgcccatcgttctgctcctgtggaccttcgcgggacaagtgaaccagcagatggacagccagttcgccggtgaggtgatcgccctttcggtccatcgcgtcacgctgaccaccggcatgcgcaccgactacgtgctgacgacggtcggcagttcaccttgcagg

SEQ ID NO: 361 - DNA, 1032 bp, Streptomyces avermitilis
  CDS (1)..(1032)
gtgatcggcgtcgacacacacaaacacgtgcacgtcgcagcggtgatggacacaatcggcggaatcctggccaccctcacgattcccaccgacaccggcggcttccagcaactggcggactgggcaggctcgttcggtgacgttgtggccttcgggatcgagggcaccggctcctacggcgccacgttgacctcattcctgcgcagggccggtcacaaggtgggcgaggccggacgcccggaccggcggctgcggcgcatgaacggaaagtccgacaccctggacgccgagaacgccgcccgcgccgtgctggccgggttcgcgaccgccacgccgaagaccgccgacggcgaggccgagatgatccgccaactcaagatcgcccatgaccaggccgttgaacagcgtgcgacggcgatggtcaccatcaaggcgatactcgtccacgcctcggacgccctgcgtcgggagactgtcggcaagacacagatcagcctggccaggcagctggcagctctgcgtcctcgccgtctggaaggacccgaggacgcccttcggcacaccctgcggacgctcgccaggcggtggcagtacctggatgccgaggccaaggaactgacgaagatgatcggcgacctggtccagcgggtcgccccgcaactgctcgagcccttcggtatcggcgtggacacagccgcggagatcctcgtcgtgaccggcgacaaccccgagcggatcaagtccgaggccgccctcgccaagctcgcgggcatcgctcccgtgcccaccggctccggcatgaccgccggcaggcatcgcatcaaccacggtggccaccgccagctcaacgccgcgatctaccgaaccgtcatcgtccgcatgcggttccaccaccccacgatcggctacgtcgcccgccccaccgccgagggcaagacgaaacgcgagatcatccggtgcctcaagcgctacgtcatccgcgaggtctaccacctgcttcggccagccccacggagggcctccgcggcaagt

SEQ ID NO: 362 - DNA, 1626 bp, Streptomyces avermitilis
  CDS (1)..(1626)
ttgcccgttcagtgttccaccgtcacgctcacgtcgtccatcaccgtcgccgacggcatcttcgctccggggcatcttggcgagctgacccagcagttacccttcgaactcgtcgatgacgtgctggaacgcgccggcggcgcccagcacaggctgcggctgctgccgtcgagggtgggcgtgtacttcgtgctggcactggccctcttcccgcagctggggtacgtgcgcgtgtgggacaagctcaccgccgggctgcgcgggattcttcaccggcgcccttcggagaaggcgttgcgggaggttcgccggaggctgggcgtcgcgccgcttcggttgctgttcgaaacgctggccggccctgtggcacagccgatcacacccggggtgcgataccggtgctggcgcacggtcgccttcgacgggtgcagctccaccaaggcccctgaccggccgcgagtctgtgcgtggctgggcaagcacaagcaccgctacggcaccgacggatacccaatgctgaagatcatggtgctgtgcgagaccgggactcgggccctgctcggcgcggtcttcggaccgacgccagagaaggagaccggctacgccgagcaactgctaccgctgctggacggcggcatgctgctgctcaacgaccggggcttcgactccgacgacttcctcgcgaaggctgcggccaccggcgcacagctgctggtgcggctcaagggaacccggacccccgcccgctgggcgctactgccggacgggtcgttcctgaccaggatcaacgggacccggctgagggtcatcgacgcgcacatcgcggtgacgaccgccaaagggctgcggctggaaggccactaccggctggccaccacgctgaccgatcaccgccgctaccccgccgtcgagctggtggagctctaccacgagcgatgggagatcgaatcggcgttctactcgctccgccacactttgcagtgcggcctggtgctgcgctcccaggacgtggccgggatccagcaggagctatgggctcatctgaccgtctaccaggcactgcgccgggcgatggtcgaggccgtcgagacgcttcccggcacggatccggacagggcttccttcaccgtcgccctggagaccgccaaggaacagctcatcaccgcggccaatgtgctgccagacgccggaccagggcgcatcacatcggccctgctgcacgatctactcccaccccgccaggcccgcgtcaacccgcgccgcgtcaagtgcccgatctcccgctacgccgccccgcccgaccaggcccaagccctcggggcctccaggatcaccagcatcgccgtcaccgtgcactcgtccgccggcaccggctctgacgggcgtcgcgaccacacgctgcaactcctgcgcaccaaccctctccgcacctggcgcgcatgcgaaatcgcccgcggtatcggactggacgacgctcgaggactacgcgcggaactggggcgctgggtccgcgaaggaatccttcgccgcaccgggcgaggcatctacaccctcgaacccgagtggatcacacccgacctccaccacccctcggtcccgccccatttgacaaccgcggatcggcct

SEQ ID NO: 363 - DNA, 2283 bp, Streptomyces avermitilis
  CDS (1)..(2283)
atgatggggccgttcgagcagccccggtgcggtgggagcaaacagatgcggctagacgggaagacggccccgtccgatctccagctgaagatcgtgctgcacggcacgagaccgcccctgtggcggcgcctcttgctgccgtccgacacctcgctcgggacgctgcacgacgccatccaggtcgccttcggatggcacggtggccatctgcatctcttcaccgacgagttcggccgggggtacggcgatgcggcccggctcaccgacatcgatctcggcttcggccgcggggtcggcgacgaggacaccaccgcgctcggcgacgtgctggccgaggagggagcacggctgcgctacgtctacgacttcggcgacgactgggagcatgggatcacgctggagaagacactgccgcgcccggtcggcgcggagcggacggtgcgctgcgtcggcgggcgtcgcgccgacgcaccggccgaggacatcggcggcgtgtcgggtctggccgaggtgctggggttcctcgacaccccggacggggccttcgatggcccgtacggtgaacttgtcgccgagctgcgggcggcgggttacgacccggcggccttcgaccgggacgcgatcaccgctcggctggccgaggtgacgccggacacggtgtccggtaaagcgaagccgccggccggtgatcggtccgggcgcggcggtgtccgtcggctgaccgccgaggacgtggcgttgtgtacctgcgggcagtgcggggtgggcgatccggtcgatgccggagtcgacgggccggccgaggatgtgcctgtgctgcgcccggtgaccctggctccgcaggaggaccttgtcgctgccgtgcggggtgttccgctcttcgacgcggcgctgcggctcgccgcctggtgccacgagggacggcaggtcaccgccggccgggtgctgcgtcccgcgctcgctcgtgaggccgtcgaggagctccagttgtggaagctggcaggccacgactcgccgtacgccgatgccgtcgcgcggtctcgtgcgttgaaatccctgcgcagcgccaaggacgtggccgttctcgatgatccgtggtggctcgccgtggatggcgagatgatcacgatcagaggaggccgcgcgtcgggcggcgcggcgaccgacttcaccggtgaggaccttctggagttctgggccgccacgatgggcgatctgctggaggagatcggtgagacgggggtgctggacgggtggcacggtgagctgggcgagctgacggccgagatcgccgacggactggtcggcctcctgtacgacgccccggacgacgcctgggtggatggcgacgacctgcgtgcgaaggcccgtgagaggggcgagaacgggccggagttcgatctcttccgggcgctgttcgcggcgtccttccgggcactgggggaagggctcgccctgctgggtgcggtggagtacgagtccggtgacggcgacgattcggccgaggagactctgcgcacactcctgaacgccgtggtcggacagaagccgggcggttcaggaaccttgccgtcggcgtcggactggtcgcgggacgacaggcgcggggaccgcatgcggctcacccccctcggtcgctacgggctccgcgcctacctgatggagtgcggtgtgcccgcccccctgctcggtgagtacgccgaagcggacgccggcgctctgctccaagggctcctgggctactcccccgaggagctgcgccgggaggtcgaagggtggctggaacaccgcacggcggcagatgccgcggtagggctgctcgacgcatgcgcgggagccgaccacgaggcagcggcgaagcgcgccgtggcccaactggtgctggccgatctcgacgacccccgggcactgcgcgtgctgcgcaaggcagcggactccgacgtcgaggggtgccgacaggtggccaccgcgaccctgggcgcgcaccttgagggagaagcgcccgtggacccggcacgggcggaggaggccggactgtggctgctcatcgacgggttgtccatcctcgccggtgcaggggagaccgaggagctggtccggggcttcctggagaacgggaacacggcgccggaggcgctcgaacagcgggtggacgagctgtggcgagtggagcacccagccaccgcccaagtgctcgccgaactgggtgagggtttgcgcggcgtagacaagcggctagccaagcgtatgcgtaccgcggcgaacaaggcccaatcccgccgg

SEQ ID NO: 364 - DNA, 2850 bp, Streptomyces avermitilis
  CDS (1)..(2850)
atgaggagcgtgccgccattggccgcaccggaatcggctgcctgggcgcggagtctgctcaactacggctgggcggcggtgttcctgcccggtgagcccgcccgcctcggccggttgctgctgtggcgacccgccggggcagccgccgccgagggcatggcacccacggacatcgagaccgaggcggcggagctcgtgctgccgcacggccgctcggtcaggcggcgcaaggtggagggctacgcgctgcccgtcgccctcgccgttgccgcgctgtccggggcacagccgccgcatccgtccgcctccgcctggcaggccgccgcccgcttcgcgctccggctgctcgccgatggtcgtctccacccggccctcacccccgccggctacgacacctggcaggcgggccccttcaccgccgcccagcgtcggacgctggacgccctcgccggcgcgttcccgccccacgcccactgcctgccggaaccgggtccgaccccgctgcggatcaccaaaccgagcgcgctggtacgccggttctgcgacgcggtcgccgacgaactggtccgcacccccgccgctccgctcgcgatgggagccctgccgtacgcctggcgcgagacgcgtaccgtgcccgtcctgcacgagtgggccgaggagaccgccgccgcgttcaccgccgacgtcagggtctcgctgcgggtcgacgtgcccgagggacgccgtcggcagttccgggccgtcctccagttgcacaccgttgcggatccggcgctcgtcgtggaggccgcacagttgtggaacgagccggccgagaccgagcatctgctcggcccgcgcgccgaaatcgaaacgctgctcgcactgcgccgcggcgcccacgcctggccaccgctcgaccggctgctgagggacgccgctccggaccagctgcggctgaccgacgacgaggcgttcgacctcctgggcgacgccaccgacaggctgcgcgccgccggtatcgacgtgcactggccgcgcgagctcgtcaaggcactcactgcgaccgcggagatcgggcaacgctccgcgcccggctccagcgcgggcggcatgctcgacgccaacaccctcgtcgacttccgctggcggctctcgctcggcggcgacccgctcaccgaggccgagatggacgccctcgccgagacgcgccgccccctcgtccggctgcgcgaccagtgggtcgtcgccgacccgaagctggtggcccgcgccaggcgccgacggatggaaccgctcactcccatggaggggctgggcgccgcgctgaccggcgagatggagcgggacggggagacttttcgctgcgcggcggtgggagcactcggcgacctcgtcgcccgtatccgcgaccccgaatcccgcacccccgccccgcagcccaccgcactgaaggccacgctgcgcgactaccaaaaacggggcctcgcctggctggccgagatgtgtgagctcggtctcggcggctgtctcgccgacgacatgggcctgggcaagaccatcaccctgctcgcgctacacctgcaccgccagaccgaaccggccactgcgggccccacgctcgtcgtctgccccgcctcgctgctcggcaactggcagcgtgaggcagcccggttcgcgccggccacgccggtgcgccgctaccacggcggcgaccgccacctgaaggacctggctgggaacgagatcgtcctggtcacctacggagtgctgcgccgcgaccgggagaccctcgctgagaacgcctggtcgctgatcgccgccgacgaggcccagcacgtcaagaacccctacgccgtcaccgcccgcgagctgcgcgccctgcccggccgcgcccgcgtcgccctcaccggcacccccgtggagaacaacctctccgaactgtgggcgctcctcgactggaccacccccggactcctcggcccgctcaccgccttccgcgaccgccacgcccgtgcgatcgagtcgggcgaggacccgcaggccgccgaacggctgtcccgtctcgtccgcccgttcctgctgcgccgcaggaagtccgacccgggcatcgcgcccgaactccccgccaagaccgagaccgaccgcgtcgtgccgctgaccgccgagcaggcaagcctgtacgaggcggtggtccgcgagaccatggcgaagatcgccgaagccgagggcatcgcccgccgcggcctggtcctgaagctcctcacggcgctgaagcagatctgcaaccaccccgcccagtatttgaaagagcacagcctgcgccagtccacaccgctgaacggccgctccggcaaactcgacctcctcgacgaactcgtcgacaccatcaccgccgaaggcgagtcggtgctggtcttcacccagtacaagcagatggcgaccctcctggagaagcacctcgccgagcgcggcgtccccaccctcttcctgcacggcggcacgcccgtcaccgcgcgcgaggagatggtggaccgcttccagcgcggcgaggtgccggtgttcctgctctccctgaaggccgcgggcaccggactcaacctcacccgcgccacccacgtcgtgcactacgaccgctggtggaacccggccgtcgaggaccaggccaccgaccgcgcctaccgcatcggccaggacaagcccgtacaggtccacaagctcatcgccgagggcaccgtggaggacaaggtggcgaagctgctggaagccaagcgggcgctcgccgacgccgtcgtcggctccggcgaggccgccctgaccgaactgtccgacgccgacctcgccgaactcgtcgccctgggaaggcagtca

SEQ ID NO: 365 - DNA, 1242 bp, Streptomyces avermitilis
  CDS (1)..(1242)
atgagtccctcgatccccggtccgcgccgcgcgcccgcccgcggcaggcgcgccttcgccgcgacctggtggggacaggcgtgggtgacggccctggaggactccaccctggactcggggcgcctgtcccgcggacgcacctacgcccgccagggtatggtcggcccgaccaccgtcgcccccggccaggtcaaggccccagtccagggcagccgcccgcgcccctaccgctgctcggtccacctgtccgtcctcaccgacacccagtgggacaccctgctcgacaccatcgcggcccgcgccgggcacctcgccgcgctcctcggcggcgagatgcccggcgaactcgtcgacgacgcccgccgggcaggcgtccccctgctgccgcagtccaccgagctcgacccggactgctcctgccccgactggggatacccctgcaagcacgccgccgcgctctgctacgccatcgcagccaccatcgacgccgacccgttcgtgctgttcgccctgcgtggccgcgaccgtgaggaagtcatcacccagctgcgcgcccgccgtacggccgcccaggcgacctccaccccaccggccccggccggcctcccggccgccggcgcctacacggcctggggcgccctggccgaccagcccccgtccctccccgaacttcccgaaccggcaccccacaccgccgcactgcccgccgccccgccgcccggcaccggactgtccgccgcggacctcgaacgcctcatggcggacaccgccgcacgcgccgcccggctactcacgggcgacaccaccagcctgcacctgtcccagcatgaggacgcggcgcggatcgcctcgagcaactgcggacccgagtggttccaccgcctcatccagaacaccggtgccaaaccggccgcgttcgcccgcctcacccgcgcctggcggtatggcggcccaaccggcatcaccgtcgccgaacagccacgcactcccgacccgaccgcgatgacagccgcccgcaccgccctgaccgagacgctcaccgaaatgaccacgcccccggtcgccctcagggcctggcgcaaccgcctcaccctcgccgaccacggcatccagctgcgcctgggccccgacacccgttggtacccctacctccaggatgacgacggcgactggtggccggcagcgccggccgaccccgacccggtcacggcactcacctccgtctggcagcagaccgagagg

SEQ ID NO: 366 - DNA, 615 bp, Streptomyces avermitilis
  CDS (1)..(615)
gtgcaccgcccccggcgggcccacgtccaaacttgcggtccgcatcggtctgcggcgggtgaggtactcggctgcgtcgtggatcttcacgaaggggtcctgaccgtccggcaggccctacagcgggtcggtggcgaactgctgatcgtcgcgccgaagactcagcgctcggcccgccgcgtagccctgccggccgagtgcgtgaccgcgctccgtggccagtgcgcgcggcagatcgccgaccggaaagcggctggtgccaactggaaggggacggttcagggcctcgtcttcaccaccaagaacgggacccccatcgtgccgcgcaacctgaaccgctccttcgaggtgctgtgcgtccgcgcgggcgtccgcaaggtccgcttccacgacctgcgccacacctgtgcctcactcctccacgaacagggtgccgacgcccgcatgatcatggaagtcctcggccacagctcgatccgcgtgaccacggacatctacaccttcgtccggctcgactcgcagcgctcggcgttcgatcgcgtcggggatgccctgaggggtgacggcaacgatccggacgatgacgacggcgcggccggtgtcctggtagccgtc

SEQ ID NO: 367 - DNA, 594 bp, Streptomyces avermitilis
  CDS (1)..(594)
atgaccacgatcgcagttctcggaaacggccgtgtcggcggcaacctggccacagccctcacccgggcagggcatgaggtgaccgtcgcggaccgcacgccgggcgccgccgccgacactgcccgcacagcccagatcgtcatcaacgccaccccgggcgccggctcgctggaccggctcgccgccctgcgcgacgaactgcgcgacaagatcctcgtcgacgtctccaacgccaccaacgacggaccggacggcctgcccgccgacctgatctaccccggctcaagcctcgccgagcacctccaggaagcactccccgaaacccgcgtcgtcaagacactcaacaccatgctcttcccggtgatgacagcaccggccacgctcacccagacacccaccgcgttcctctccggcgaggacccccaggccaagcagaccgtccgcgaactgctcaccgacctcggctggcacaaggagtggatcgctgatctcggcggcatccagaccgcccgcgccacggaggccgcaatcctcttcgtcccgcacgtcatcggggccaccggattcacacccttcgcgatctcaatcgcccgc

SEQ ID NO: 368 - DNA, 816 bp, Streptomyces avermitilis
  CDS (1)..(816)
atgtccgaaacgcttcagaccaccgcagtcgccgcctccgacgccgacctgctcgcccagaccgcgaacgccgtgcgtgcggccggttcggcgctgcgcgagcgcttcggcgaggtggtccgttaccagagccgtgaagagctgatgcgcgcgctggccgccaacgacgacacggccctcgacatcctgcgtccccgcctcacgagcctgcgcccggacgccggctgggtggaggacgagctggacggcggggcgctgccgcccggcgaatggtgggtcgtggatccggccgaaggcaacgtcaaccacctgcacgccctgccggaatgggcggtgaccgccaccctcgtgcgtgagaaccagccggtgctcaccgcggtccacctgccgttgaccggcgagacctacaccgcgctcaccggcgcgggcgcccacgtcgacggccggccgctgcacgtctccccggccgcagacctcggcctgagcatcgtggccaccagccaggcccggccggacgaggacgagaaggtcgtgcggcgcgtcggctcttcgatcaccgcgatgctcttcgacgcgcttgtcgtccgcaccgccgtgcccgcgaccttgcacctggtgaacgtggccgccggccggatcgacgccttctggcagttcgccggcgcccgcgcggacctgctgcccggagcgctcctcgtcaccgaggccggcggacagatctccgacgcccagggccgcccctggaccccgcagagcgagagcttcctggccgccgcgcccggcatccacgccgaggccgtcgccaccctttcccac

SEQ ID NO: 369 - DNA, 930 bp, Streptomyces avermitilis
  CDS (1)..(930)
atgtcaagcacggctaggattacccgcatgcaattggatttgaatttgctcgccgcgctcgacgcgctgctggaggagggcagtgtggccggggcggcggcgcgcctgcacgtcaccgcccccgcgatgagccggagtctgggccgcatccggcgcacgaccggggatcagatcctggtgcgcaccggccgcacgatgaccccgacgccgtatgcgatcgccgtccgggaacaggtgcacgagctgctgcaccaggtccagggggtgctggcaccaagccgtgaactcgatctggcaacgttggagcgcactttcacactccgctggcacgattccctggtcgccttgagcggccccgcactgctcgcggccgtgcgcggacaggcgccgggcgtgcgattgcgcttcgtcgcggaatcgagcatcgacacccccgagttgcggcgcggcgaggtcgacctcgaggcgaacgccaaccgcccgagcgcaccggacatccgtgccgagaacgtgggcgagacccgcctcgtcatcatcgtgaggcaggggcaccccctcacccgcgtcaaaaccgtcaccgcacagcggtacgccgccgccgaccacgtcaccgtctcgcgacgtggaaacctcagcaatgccctcgacgactccctcgcgcggctcggcctcactcgccgcgtggtggcgaccgcgcccacggaagcggccgcgctggagttcgcgcgcggctccgatctcctgatcagcgtccccgaagccaccacgcggtcagcggtcgccgacctcggcctggtcgtgctccccctccccctcgaactgccgtcggcgccgatatacctgtcgtggcatcagcgctacgacaccgaccacgcccacacctggctgcgcgggctggcgcgaaccgcgctggccatgggcggagcgtcg

SEQ ID NO: 370 - DNA, 381 bp, Streptomyces avermitilis
  CDS (1)..(381)
gtggtctacctgttactggcggccgtcttgttcgaggagtgcggctatctcgccgtctggcgcaagctcaccgccgcgctggactcgatactggttgtgacgatcagcggaaccgcgttgtgggacgcacggacccggctcggggtgcgcccggtgcgcgctctgttcgatcttctgcgcggccctgcctcggcggtccgcacggccggggcccgctgggccggaatgctcgtcgtcgcgatcgacggcacccacttcggtcgcgcgggcccagtcgtgtgcgcagacagcgcagtcggtgtcttccgggagcggggccactcgatgccgccgctcggcaccgatctcgtctcggcactgaaccctgtgtcggcacggcgc

SEQ ID NO: 371 - DNA, 507 bp, Streptomyces avermitilis
  CDS (1)..(507)
atggggtggcagagacgcgtgactcacgccccgcagtcccacacgctctcgccacgggtggcgatgttgtgggaagcatcccggtcagtgtgggcaacgaccccgcaccctcggcagatgaaaagcccctggtcgacacggtttcgcttgtccctgcgggagttcaacggcgaacgcgatcacgtccacctgctcgtgcactacccgcccaaggtcgccatctcccgactcgtaggctccctcaagggtgtctccgcccgccgcctgcggcaggagttccccaaccacatccgcaagtacccgtggggtgagcacttctggtcaccgtcctatttcgccgcctcgtgcgggggcgccccgctctccctcatcaaggagtacatcaacaaccagaaacgtcccagcttaggtcaacagcgcagacccgtggacccgcgcgggtcagagcagcgtcaaaaagcgcttcctcccgggcgtgaacgctcggggttccgcgctagatcatgc

SEQ ID NO: 372 - DNA, 1272 bp, Streptomyces avermitilis
  CDS (1)..(1272)
ttgttccccaggacaaaacaggggcgttacgctgcgggaatggacctctcaggtgtggtctcggcacttcaggcgaggctgccggaactgggcgagcggatggcgcagcgcatccgctcggacgtcgatgcctacaaggacgcgtcgctgatccccttcgactcgctgcgccgctcgtgcaccgccaacgcggacctgctcctgtaccagctcggccgcgcgggcgcgcaggacccgagcccggcccgggagaccggtcgcctccgcgccgagcagggcgtgccgctggcggacacgctgcacgcgtaccggatcggcttcgagttcctgtggacggacatcctcgccgaggcacgcaaccgccccgaggtcaccgacgcccaactggtgtcccagtccgcggagatctgggccctgttcggccgctacgcggaggcggtggcggcggcttaccgggagacgaccgccgagctgacctcgcgacgtcaggcgcgccgctcggcgctggtggaggcactgttcaccggagtcatcgccgaccgcacgctgtgggaggccgcccgcgagctgggtctgcccgaccgcggaccgtacgtggtcgccgctgcggcggccgacgctcccggcgaggagccgttggcggggacggaagcggcgctgcgtcaggcccagatccccttcgcctggcggctgctgcccgaccaacagatcggtctggccgccctgcccacggcgacggcggagagcacgtgtctgagcattctgcgccgcgcgggcgcccgcgtcggtgtcagcccgtgctttcactcgctgggggacaccccccaggctctgcgcttcgcccgtctggctctggccggcctccagggcaccggccccggcgtcgcgcggttcgacgacaacccgctggccatggtcgtcgccgccgccccggccgaggcggcgcacctcgtggaggtggtcctccagcccctgctcgatctcccggcagcggagcgtgcccgtctcctggagaccctggagcactggtacgccgccgccggctccgccacggacgcggcgcggagcctcttcgtccaccccaacaccgtccgctaccggctgcgccgcgtcgaggagctggcgggccgctccctgtccgatccccgagcggcggcggacatcggcgcggcgctcctggcggtccgccgcgcgggcgcgtcacccagtgacgtcattcagcatgatctagcgcggaaccccgagcgttcacgcccgggaggaagcgctttt

SEQ ID NO: 373 - DNA, 1485 bp, Streptomyces avermitilis
  CDS (1)..(1485)
atggccaatctggcggagttcctggtggagacggcacggcggcagccggaacgccccgcgctgcgactggggggccaggtcaccagctacgcggagctcgaccaacgcagcgcccgcgccgccgcgctgctgcgggccgagggcgtacgaccgggagaccgggtcgctctgatgctgcccaacgttcccgagttcgtcgtcctgtactacggcgtgctgcgtgccggagcggtcgtcgtgccgatgaatccgctgctgaagacccgggagaccgaataccacctgcgcgactcgggcgcgcagatgctcttcgagtggcaccaggcgccgggcgagggcgcgcagggcgcagccgccgccggagtgcggcacatggccgtcgagcctgccgccttcgcgggcctgctggccggccacgcgccgctgccggaggtgagcgagccggacagcgaggacgtggccgtgctgctgtacacctccggcaccaccggccgtcccaagggcgccatgctcacccacaccgggctgcgacacaacaccgaggtcaacgcggtcgatgtgcagcggatgacggcggaggacgtggtcgtgggctgtctgccgctgttccacatcttcggccagatctgcgcgatgagcgtgaccgtccgcgccggtgcctcgctcaccctgatcccccggttcgacccgcagaccgtgctggacgccatcgcccgcgaccgggcgacgatcttcgagggcgtaccgaccatgtacgcggcgctgctccagcacccgtcggaggccgacgtgtccacgctgcggatgtgtatctccggcggagcctcgctgccggtggagatcctgcacggcttcgagcgtcgcttcggctgcgtggtgctggagggcttcggcatgtccgagaccagtccggtggtcaccttcaaccaccccgaccggccgcgcaaggccgggtccatcggcaccccgatcaaggacgtacaggtacggctcctcgacgaaaagggccaggacgtgactcccggcgagatcggcgaactggccgtccgcgggccgaacgtgatgaaggggtactggaaccgcccggaggagacggcagccaccatcccggacggctggctgcgcagcggcgacctcgcacaccgggacgaggacggctacctgtacatcgtcgaccgcaagaaggacatgatcatccgcggcggctacaacgtctacccgcgcgagatcgaggaagtgctccacgaacacccggccgtcgcgctggccgcggtggtgggcctggccgacgcgcatcttggcgaggagatagcggccgcggtggtgctgcgcccgaaggcgcaggccacgcccgacgagctccggcagttcgtcaaggagcgggtggcggcgtacaaatacccgcgcgaggtgtggctcgtggacacgctgccgaccggccccagtggcaagattctcaaaagggagatcagcgcgccgacgggg

SEQ ID NO: 374 - DNA, 189 bp, Streptomyces avermitilis
  CDS (1)..(189)
ttggacgcgatccgctatctggtcgcgggcgggatctcgtggcgggcgatgcccgcggacttccccgactgcggccgggtttacgcctttttccgccgctggcgcgagcacgggctgatcgcagagttccacgaccggctgcgcgggaaggtccgtgagcgtgagggccgcgagtccgaacccacggca

SEQ ID NO: 375 - DNA, 153 bp, Streptomyces avermitilis
  CDS (1)..(153)
ttggccgagtgggccctgcggtatgagggcatcacgctcggactgctgcagcagctcgtgatctgcggttgcatcgaactgcccctcctcgaaggactcctgctcgcctgcgactcacccctaccgcgcggcactgggctgttggtcagcgat

SEQ ID NO: 376 - DNA, 3336 bp, Streptomyces avermitilis
  CDS (1)..(3336)
atgctgagcccggcggaaccacttcgccgaccagcgcaggacgggctgtggggagggcgggtgggcgcacagacgttctcggcggcgggccaccgggcattgaccgaacctgttgctcaacgggccctgtcgggccgcggccaggaggttccaactgccgcgcgtacgttgatcgaacgcgccaccgatctgtccctgggccacgtccggctgcacaccggcccggcggtgcgtacggccgcacgtgccgcaggtgtggccgggttcaccctcggccctgacatcgcggtggccaccggcccgggagagggcgcccccgaccggcttctgcggcacgagctcatgcacgcggcccagcagaccatgacaaggcgtggcggggctgccggaacggccccgacagagctgcgagccgccgcggaggagcaggccgcgcgcgccgcggagcgccccgagcgggccgagccgccggtggcggtcggcccgcatgtggcggcggctgccgagggctggctcaactccactgcggacgtgcgcaattacggcatgacccagctcctggacgagctgaacgcggtgaacgagtggctcgaccggcagaccaccagtaccccggaagacgacaccatgctcgcggcgaaggctgcgatcgaggccgaactcgcccgcaagaaccgcgcgatggcagctcccgaccgcacgcgccgcggccggcgcccacggggagccgcccccgcggcggaggagctcccgcaacaggtccccatgccccgcgtcctcgccgaacgcaccagcacagtgccggccgacgccgtggaggcccgtaccgaggtcgaccgcatcaccgcctggctgcagcgccccgacctctcccggcaggaccgggccctgctgcggcaggaactcaaggaactcgcgccgcacctcgccgccgacctggccagggcgagcggcgagcgccgccaggcccgcctgacggaggccttcacaccggtggccgagcagagctcgggtctcgtcgacaacctcaggaccatcgagggtatccgtccctccgtcgagcagcccggcatggcgtacgtcatccaccgtgacgaaatgctcctgttcccgcaggagttggccgaccaggtgcgcgagcagacggtagccgcgctcgccgacgccgcccgggggatccgcaccatgaacgcggccaccgacgagcgcatgcggcaccacctgcacctgaactacgaggagcagccgtacgtcggcttcgccggcagcgtggtaggcggcgaggagccctacgaggtccaggaccgggtgcgggacccgtggctggaggccgtggcggccctgcgcgacttcgacaaggcccgtcggcagggagccctggtggcgatgggcgaggcagtgctcgccgcgacggcgcaggcggaacaggcgcgagccgttgtcaacgccggtgtgggcaaggccgaggcggcggccggtgacatcgccgacgcgctgacgaccgtacgcaatctttcctacaccgtcgccctggcggccggagcgatcatcgcggcacccctcgccgcctcggcggtggcgggcatgggcgcgaccggcctgacggcgaccgcgctcaccacggcgggcacggcgggcatggtcggcgcgggcggcgccggactcggctttgtgggcggtgcgggcggggaagcggtctccggcggatcggcacgacaggtgctgcgggccggacttgaagaaggccaacgggtcgggatcgagggcctccagaccggcgccggtgccggcgcggccacgggcttcgctcgcaacctcgggcttcacgcggtgcggatgtcgcgggcacagacgatggtgcgcagcgccgtggcgcagggcggcggcaacgtcgtcggcggcctgaccggggccgcactcaatgcgccgcccgaggggatgacccgtgcggaggccgccttgcgcggcgtactgccgaacctgggactgggagcgctgggcggtttcgccggggggtacagccaagggctgagttcccccgcgatgcggcgcctggtgggcgtgggtctgcccgcggccgcggagggcggcgtcgaatacctgcgcaccggcgacgcggagcacgccttcaccacggcggcgagatccgcggcgatcggttccctcttgcacgaacgcgccggcctcggagccggcgcggagcggcgtgccttcgagttcggtcacggagtgcggacgagggcgggcaacatcggccgcggtatagcggcgcgtgtgcggcctctcgcgctgggcttgtccctgggactgtcgcaggtacgggcgctgaggatggcggggacgggaggcactgccccggttgtcgaactgggcgtgccgggcgcacggtcgagcttgcaggatgtgccgaccacccagggggccgacgtcgtgctggccggggacttcgcggggccgtcggccgaacagaaggcacagcccggcgccccctcagcgacggtggccgaacccacagcacaacccggcgcaccctcatcggcggcggccgaacaaccctcggccccaggacagacggcgagcacactgggcctcgacgcggcacggttcgccgcgccggagatggccaaggacctcgcgaccctgaagaactcctatctgcgcgccatcgccgacctggacgccgtccgggcgcaggcccggacgctggggctcagcgagcgggagaccaacgcgttcctgcggatgtggggcgagtgcccgacgccgatgaccgccgaagaggtgggccaggagatgggcgcctggagcaccctgcgaaagcagagcctgccgtccgcagtgtcctccgcagaggaaacccttccggtgacgctgaaggccagcgtgctgccgcactactcctcgaagtcggcgttcatggaggccatgcgcagacgactgctggcccaacgggcctcgggaaaggagtcactgctcgacttcctcctcgacgcggacgggcagtggcagaagggctccttcatcgcccgctcgggccggccgatgcgtggccgctacgcgctctccgatcccgaccggcagatcgtccaggccgggcacatgctgtcggactggtatgtcaaggccatgtcgaggcgggaccacctgatgctcgaggacgcggacctgaactggatgagcggcttcaccgaggcatccgggtcggtgaccagcaagtcggcggtgctcatcgagggctatccggtggacatcccgacggcccggctgtgggaggcccacggcaaactaccggcgggcacggtgtcggccgcccctgtcgtcgagcctcctgccttc

SEQ ID NO: 377 - DNA, 1512 bp, Streptomyces avermitilis
  CDS (1)..(1512)
atgacgacgcaattctcctatcccggtgtgtacatcgaggagatcgagagcccggtgcggcccatcgccggtgcggagacctcagtgacggcgttcgtgggcccagcgttgttcgggcccacgtcgccgacgaccgtggagagctgggccgacttcgagaaggagttcggggggctgtggcagggcagcgaactgagctacgcggtctaccagttcttcctcaacggcggcagcaaggcgatcgtggtccgcgtcggcgagggggtcgaatacgcgggggtcgacctcaagaacggtgtcaagctcaaggcgaaggcgccgggcgccgcaggcaagaagctcaaggcgaccgtgacgctcgacgccaacgacaacaagcgctacacgctcctcatctccgacgggaccacctcggagtcgtacgacgtgacgatcgacccggccctgcgcaaccgctggctggaccggcagctcgccacctcgcagctcgtggaacgcgacaccgagaccttcgacaagcggcccgacgccgtcacggacgagtcgttcaccggcggcaaggacgccaccttcacgcccgcacatgtgctgggtgacgccaccaagctgccgcacaccggcctcgcggcactggccgacgtcgagatcttcaacctcctggtgatcccggcccagttggccaaaccgtcaggcacggacgaccgcgacaccaagtgggcgcccgtcgtcgacgccgccgttcggctgtgcgaggagcagcgggcgatgctgctgctggatccaccgttcggctgggactcaccggaaaccgcggtgaccggagcccgggccgggatgccggtcggcgggctcgccgggcgcaacgcggccgtgttcttcccgaaagtagtgatctcggacccgctcagcggtggaaacctcgaggtcggcccggccggcacggtcgccggggtgatcgcccgcaccgacacccggcgcggagtgtggaaggcaccggccgggaccgacgacggcggcctgctgggtgtgcgctcgctggccttccggctgtccgaccagcagaacggcaccctcaacaagctgggcgtgaactgcctgcgcaccgtcccggtctacgggaacgtgctgtggggctcgcgcacctgccgcggcggcgacgccgtgagcgacccctggaagtacatcccggtcaggcgggtcgccctgcacatcgaggagtcgctgttcatcggcaccaagtgggtggtgttcgagcccaacgacgaacccctgtggtcctcgatccggctcaacatcggcgcgttcatgaaccggctcttccggcagggcgccttccaggggccgaccgcgaagggcgcgtacttcgtgcgctgcgacgcctccaacaacccgcaggacgacatcaacgacggcatcgtcaccatcgacgtgggcttccagccgctatcgcccgccgagttcgtccacatccgtatccagcagaagcgcgacgacgcgacggcccaggggagc

SEQ ID NO: 378 - DNA, 528 bp, Streptomyces avermitilis
  CDS (1)..(528)
atggcccagttcacggtcaatgccgcccgcctggacccgtacaagaacttcaagttccgggtgaagtgggacaaccgctatgtcgccgggatcagcaaggtcagcgcgctcaagcgcaccaccgaggtggtcgagcaccgcgacggcggcgaccactccagtgcccgcaagtcaccgggccggaccaagtacgagccgatcaccctggagcgcggggtcacccacgacccggagttcgaggcgtgggcgaacaaggtgtggaactacgccaacgcccaggcggcgccggaccagcgggaccgcgaggtctccctggccgggttccgcaaggacctggtgatcgaggtctacaacgaggcgggccagaaggtgctggcctaccaggtgttccgttgctgggtgtcggagtaccaggcgctgccagacctcgacgccaacgccaacgcggtcgccatccagcagctgaagctggagaacgagggctggctgcgcgaagcgagcgtcaccgagcccggtgagcccagcttc

SEQ ID NO: 379 - DNA, 711 bp, Streptomyces avermitilis
  CDS (1)..(711)
gtgccggggatgagcacggtgagcgccgccgagttgctggacgcctgggaggcgggctggggccgcgatccgctgcggcgcggcctggctctgctcggtgtcgcccggggcaccacaccggccgccgccgcggacgtgcccgtgggccggcgggaccggggcctgttcgccttgcgcgcggcgctgttcggcaccgcggtggacgcggtgtcccgctgtcccgaatgcgagacggaggtcgaagtcgccttcgaccaggaagagttgctgggccggctggggcaggcggacccggaggcctgcgacgcggtgaccgtgcgggagggcgaccgtgagatccgggtgcgtatgcccacgagcacggatctggccgccgtcctcgacaccggcgacccggctcccgaggaggcgctcgtacgccgctgcgctcccgtcggggaaccggctccggccgccgacgtggtcgccgaggcctgggtggcggccgacccgctggtcgacgtgcggctcggggtcggctgccctggctgcggcctggcctgggaggagcccttcgacatcgtcggatacctgtgggcggagctggacgcctggggccggcggaccctgctggaggtgcacgagctggcgcgtgcgtacgggtggacgcaggcgcagaccctggcgttgagcccgtggcgccgccagtgctatctggggctggtgggcaca

SEQ ID NO: 380 - DNA, 894 bp, Streptomyces avermitilis
  CDS (1)..(894)
atgaccggcccgctggcacgcctcgtcgaccgcagccgctcccccgtggccggtctgcgtccgcgccccgcctcccgctacgagcagcgctccccggcggccggcccaccggtcctcgaaggtggcctcgaggacgtggggccccgtccggtcaccggaccgcccacggccgcggaacccgccgcgcaccgggacgcctccgcggtacgggtaccgggccccaccgagtccgcggcacaccggcacgaccccgcggtgcccgccacccgcgtcatcgagcccgccgaccacggaccctccgtcaccgggctctccgtcaccgagaccgtcgcgaccaagccctcctcgaccgatgccgacctcctgggccccgacctgaccacccgcgccctgtccgccgtaccggccctgcccgtcgtacgagaggacgcacccgcgcgcggggacgggacaccgcagcccctgcccctgctcctcccggtccgcgtcgaggcccccgtgcctcccgcggactccttgcggaccacacccgagctgggccgtcctgctgcggatccgcggacaaacctcgtgcggaaccctgcggacgagggaccgccacccgtcccaccaccccctcgcgacaacgtccggaacacgcccgtcgtcctggagcgcccgctcctgtacccgcacgcccggccgcccgctctcgcgaccgacgctccgccgtccaccgccccggaggcggaaccggcggtcgtggtcgaggtgtccatcgggcggttggacgtacgtacgcccccctcccccgcgccccctcagacgccggcccggccgcccgcggcgctgcgggccgaccacgccagggcgctggagaactatctgcgccgccgcgccgagggggaactggga

SEQ ID NO: 381 - DNA, 1188 bp, Streptomyces avermitilis
  CDS (1)..(1188)
atgagcaactcccttgccctcgcggccgtgaccgccaccctgcgcgctcggctcttctcccggctcggcggcccccaggtcaccgtcgccccgcccaacaaggcgcccgacgcggcgagcggcgaccatgtgaacctcttcctgtaccgggccgatctcaacccggccttccgcaacgccgatccgcccggctggcagcccggcgagtcaccgaaacccgtgctgccgctggtgctgcactatctgctcgccgcatacagcaacgacgagggcaaagcgcacgaactgcttggcgccgcgatgctggcgctgcacgacgccccggtcctgtcgggggacgagatccgggcggcgacggcgacggccctgcccggcagcgatctgcatctacagcccgagcgcgtgaagatcactcaggagacgctgagccaggacgacatcgccaagatgtggacggcgttcgggacaccgttccggatgtcgtccgcgtaccaggtgaccgccgtcctcatcgacagcgcattgcccggtgccgcgccgatgcccgtgctgcgccgaggggccgacggccgcggaccgctcgcccggcccggtaccggctcgcccgcgctgctggggatccggtacgccgccgccgggcaggtcggcgccctgccgggcgagcaggtcgcgctactggtggagaacctgccggccgtcgccctgaccgcgcggctgcggcatctgcgcgtgacacagagcgtgaacgtgcccctggcgacccccgccaccggggcctccgaggtggcgctcacgctgcccgccacggggctccccgccgggctctgggcggtggacctcggacccgcggcgggcggttccgtgcggaccaacgaactcgctctgggcgtcacaccggcggtcaccgcgctcgcggccgcggcggcgggcggtacaccggtgcggacgaaggtgaccgtgacggccgcgcagccggtgctccccgggcagcaggccgcggtcctggtcggcgcccggcaactggccgtgggactgctcaccgcggccgccaaaccggtctcggtcaccgccgtcctgccgtccggaaagacccgggtgcggctgcgggtggacggcgtcgacagcgagatcgtcgaccgggcacacggcacgttccggaccgggccgacagtggaggtgacgatcccg

SEQ ID NO: 382 - DNA, 1497 bp, Streptomyces avermitilis
  CDS (1)..(1497)
gtgagcctcggcgtcccggccgacctccgctgggaggaggccaacaaccgttatctgaaggcctcgttgacctggctgcgggctcggctggaggcggtggcccacagcgaccgggcctccgacgccccggacacgaaggacgcccctccccagaccggcagcgcgcgccggaggcggcgggggcgaacgcccgaactaccacccgcggccgtggacctaccggacggcggcccaggcgggtcacggcgaggacgagccccggagccgctgaccgccgtacccgacgcgggcgacctcgacgcactcgccaccacacggcaggacgccgccgccccctcggacctcgcgccgcccgcgctggtgcggctcgcggagcggttcgggctgaccgacttcgagcgcgacgtgctcctgctggtcgtggcgcccgcggtcgaccccggtgtcggcgccgcgatcgccgccgcacacggcgacccgcaggccaccgctccgacgttcgcactggccctacggctcttcgacgacgcccgctgggacgtgctgtcgccgctacggccgctgcgccgctggcggctcgccgaggtcgtgcccgcacccgcgggaccgctgctcacggcgccgctgcgccctgacgaccggatcgccaacctggtgcgcggcctcaaccacctcgacgaacggctcacctcggtactcgaaccggtcgccgacccggccgccggcgtcgcctcgcccgcctcggtccgacgcgccgaggacgcggtggtggcggccgtgctcgccgacacgcccgacggccggttccccgtcgtccacctcgtcggctccgacgccgacagtgccgtactcgtggcggtacgggcgttcgcacggctcgaacgcgagctgtaccggctgcggacggggctgctggtgcggggcgggcaaggccaacaagaccctgacacggtggccctgctgtggcaccgggagagtctgctgatgccggtcgcgctgctcctggacggcaccgacgccgacccggacgacccggccctggtcgcggccgtacggcgcctgctgtcccgcagcggcgggcccgtcgtgctggccgcgcgtcaggtgtcgccagtggacgggcggtccacggcggtcgtcgacgtcgatgtgccgccgcccgacgagcagcgcgcgctgtgggcggccgccaccggcctggagcccgccggggcgccggccgagctggcggggcagttccgcctgggcctgcccgcactgcaccgggtggccaccgcccaccggcccgagggcctctccgccgaagacggcggggaccggttgtggggcggcctgccgggacgccgcccggcctcgcctggagtcgctggcgcagcgcatcgtgccccgcgctcactgggcggacctggtgctgccggagcagcagacggaggtgctgcggcggatggccggtcatgtgcggcacggcgccaccgtgtttggggactggggcttcgg

SEQ ID NO: 383 - DNA, 783 bp, Streptomyces avermitilis
  CDS (1)..(783)
gtgccccgcgctcactgggcggacctggtgctgccggagcagcagacggaggtgctgcggcggatggccggtcatgtgcggcacggcgccaccgtgtttggggactggggcttcggtgagcggacgaaccggggacagggcgtgaccgcgctgttctccggtccgagcggcaccggcaagacgttcgcctccgaggtgctcgcccatgaactcgggctggatctctaccgcgtcgacctgtccgccgtggtgaacaagtacgtcggggagaccgagaagaatctgcgccaggtgttcgacgcggccgagtccggcggctcgctgctgctgttcgacgaggccgacgcactgttcgggcggcgcagtgatgtgcaggacagtcacgaccggtacgcgaacatcgaggtcagctatctcctgcagcgcatggaggcctaccgcggagtcgccgtgctggccaccaatctgcgggcggcgttggatcccgcgttcctgcgaaggctgcggttcgtcgtggagttcccggtgcccggcgcggaggaacggcggctgctgtgggcggcggccttcccggactcggtgccgctcgccgacgacctcgacctcggccggctggccgacctgccgacgaccggcgcggccatccaggcgatcgcgctcggcgccgccttcctcgccgcggcctgcggacggcccgtcgacaccgcgatgctcctgacggcggctcacgcggagttccggaaactggacctgcccctgccggtgctcgccggggaggcgcca

SEQ ID NO: 384 - DNA, 678 bp, Streptomyces avermitilis
  CDS (1)..(678)
atgacctcgtccttcctccccggcaccccggtcgtcccccgtggcgcgatcgtgctgctggaccccgccaccggagccgtcctgcgggtgatcgccctgcagtacaaccccgacacgctcacccgcaccctgcagccgcagggcgtcggcgcggaggccggggagcgcagtgaagccctgcggctcaaggggcccgcgctcgagacggtgaaggtggatgtcgagctgaacgccaccgaccaactggaggacccctccggtgcggacgcggactccgtggcgcggcacggtctgctgccggtgctggccgcgctggacctgctggtcaatccgacggcgcgggcgctgctggaccaggacgccgcggcccgctcgggggcgttcgagatcgcgcccgtggaggcgccgctgacggtcttcgtgtggagccgggaccgggtggtgccggtgcggatcacggagttcacggtcacggaggaggcgttcgactcccagctgcacccgatccgggcgaaggtctccctcggcctgcgcatcctcaccgtcgacgacctgggcttcggccaccgcggcggcgccctgttcctcgcccatcagcggcgccgcgagcagctcgcggccctgcaccgctcggcccgcccggccacggcggtcctcggcacgccaccgggaggcggc

SEQ ID NO: 385 - DNA, 315 bp, Streptomyces avermitilis
  CDS (1)..(315)
atgttcacccccgcgagccgctaccacggcgtcgaggtcgcccggtacgagccgccggacggcggcgacccgattccgtacgtccgccgcaggctgctgcccgaccccgccggcctcacaccggccgggttccacaccgtgtccgagggcgaccggctggaccggatcgccgcggccgcgttcggggacccggagctgttctggcggatcgcggacgccaaccccgtactggatccgcccgagttgaccgaccgccccggccgccggctcctgatcgccctgtccgccgcggccgccgggagcacccatggcttc

SEQ ID NO: 386 - DNA, 1104 bp, Streptomyces avermitilis
  CDS (1)..(1104)
atggcttctgagatgctgctggccctgcggctcggcccggtgctcgccgagcccgtgccgcgcgaggtcgccgacgccctgctgtcggtccaggtcaccgagggagtcggccgctccggcggcttccagctggagttcgcgaccgccaaacggtccctgctgttcgccgagttgctgccgcagggcgccctggacccgcccgcgcgggcgcagatcgtcctgaccgtgctcgggaggtcgaccgtgctgatggacggtgtcgtcacccgccacgaggtcgccccgtccgccgaaccgggccaggcgaagctgaccctcaccggcgaggacgtctcccggatgatggacgtggtcgacttcagcggcgtcaagtaccccggcctgcccccggaggaacgggtcgcggtgatcgtcgccaagtacacggcgtacgggctggtcccggcgatcgtgccgagtgtgttcatggtggcgcccaatccgctccaggcggtgcccagtcaccagggcaccgacctcgcctacgtcagacagctggccgcgcaggccggttaccagttcttcgtggcgcccgggcccctgccgggcgtgaacatcgcccactgggaaccgcccaacaagctgggcctgccgcaggagccgctgctggtgaactgcgacgcggcgagcaacgtcgagagcctctcgttctccttcgacggcttctccgccacccagtacgtcgtgctgatccagaacccggagaccaagttccccgtcccggtgcccgtccccgacgtcagtccgctctccccgcccatgggccgtcgccgtccgctgccgctgaaggtgcaaccgatccacggccttgccaaactgaccccgccgcaggccgcgggagtggccctcgcccgggccgcggacagcttcgaggtcatctccgggcagggcagcctcgacgtgctgcgctacgggcagccgttgcgcgcccggcgtccggtaccggtacacggcgcgggcgcggcgtacgacgggacgtactacgtcagaagcgtcacgcactccatcaaacgcggcgcctacacccagcagttcaccctgacccgcaacgccttcgggccgctg

SEQ ID NO: 387 - DNA, 588 bp, Streptomyces avermitilis
  CDS (1)..(588)
atgacgaacatggacgacatcggctacgtggagtcgccgggcttcttcagccccgcgcagcgcgaggacgccgagccgccgggcgcgcggcgcttctacggcaagtaccggggctcggtggtcaacaacgtcgatccgctgggcacgggccgactgctggtgagcgtgccggacgtgttcgggctgttcccgaccagctgggcgatgccgtgcgtgccactcggcgggctgcagtccgggatgttcgtgaggccgccccaacaggccggggtgtgggtggagttcgagggcggtaaccccgaccacccgatctggacgggcttcttctggggcggccgcgccgagaccccggccacggccggcacgctcgtccccggctccccggtcttcctcgtggagacctcgggcaagagcaagatcgccgtcagcgactcgcccgtcacgccgatgaagggcggcggggtactgctgcagtcgccgtccgcgtcgatcaccgtggacagcgcgggcgtgaccatcacggcggccaacatcagcctgaacggcctggtcgacatcaacaacggcgcgctcgtcgtgaagacggcg

SEQ ID NO: 388 - DNA, 345 bp, Streptomyces avermitilis
  CDS (1)..(345)
atgccgggattcgccctcaccaccgccgccgcgctgacctgcgcccaccagggccaactcaccctgacacccggtcagcagcaggtgctggccgggggcgcgccggtggtgacgacggccgacgtgaacgtggtcgctccttcctgtgtcctgtcctcgtcgacgccgccgacgccctgtgtgaaggtcgacttctccctggccgcctcgacccgcgtcttcgtgcagggccgccccctcgtggtacagcccgccggaccgggcacggggctggggctgtccgccgcccaggtgtcgcaggggccacccgtggtgtcgaccgtccagcagcgggtggtggccgcg

SEQ ID NO: 389 - DNA, 387 bp, Streptomyces avermitilis
  CDS (1)..(387)
gtgagcgcgcacccggactacgcgaggacgcatctggacttccccttccacgtcgacgcgcgtggccggtcggccggcacgagcgacgagggccatgtccgtgacctgatcgagcagttgctattcaccgtgccgggcgagcgcgtgaaccggccggacttcggttccggggtgctgcagttggtgttcgcgccgggcggccaggagctggccggtgcggtggagtactccctccaggcctcgctgcagcgctggttgaccgatgtgatccaggtcgagcgggtcgaggtggaggccgaggaggcggagctgcggatcaccgtcggctatgtgctgctcgcgacgggcgagccgggcacggccgtggtggaacgggggacgggacca

SEQ ID NO: 390 - DNA, 2817 bp, Streptomyces avermitilis
  CDS (1)..(2817)
atgaccggcgtacccgatacgcgcccttgtctgccgggtgagcgggcggaccggacccgggagagcgggctcggcgcggtcgtcgccgtggatgtcgacgcgcccggccgcaccctgcgtgtgctgctcctcggcgcggcgcccgatccagtgcccggtgccgagtgcgtccggatcgaggggccgggacgcgcggtgcgcgccgtgtccgtacgggtggagggctcgccgccgccgacccggcgggccacgctgctcgtcaccgtggaccgtctcggcgaccgctccccgtacacgctccgcctggtcgatccagaccggcccggcgccccgttccccggcttcgatccgcggcacagcggcgcggagttcaccttcaccgccgactgcgccgaggaggccgactgtgctgctgtggccgactccccggtaccggccacgcccgtgcccgccctggactacctggtcaaggactacgcgagcttccgccgcctgatcctcgaccggctctccctcgtctcgcccgcctgggccgaccgggaggtcccggacctcggcatcaccctcgtcgagctcctcgcctacgtcggcgaccagctctcctaccggcaggacgcggtcgcgaccgaggcgtacctgcacaccgcgcgcctgcgcacctcggtccgacgccatctgcggctggtcgaccaccgtctgcacgagggctgcaacgcccgtacctgggtgcatctggcggccgaggagcccgcggtgctgcgcgccgggacgtactggttcgccaccgcgctgcccggcgtccgcccgctcgtctccgaggcccaactgcgcggcgccaccacatacttcgagcggtatgagcccgtggtcgccgccgatctggtgctgcgcccggcgcacaacgagatccggctgtggacgtgggacggcgaggagtgccgcctgcccgccgggacgacgtccgcgaccctggtcgacccgggcaccggcaaggagcgcgagctggagctggcgcccggcgacgtcctggtcctggaggaggtacgcggcccggtcaccggcgttcccggcgacgccgacccgcgccaccggcaggcggtgcggctgacggacgtggaggagatcacggacccggtgcgcgggcagcggctgctgcgcgtggtctgggccgaggaggacgcgttggccttcccgctgtgcctggccaccgtgggcggcgagcggtgctgtctgttcgaggacgtcagtgtggcccgcggcaacatcgtgctggtcgaccagggcagcagcggcacgcctcccctccgtctcaccgcgcccaccacggccacgggcccggcgtcctgcgatgacctgggccgacctcggccgcggaccgaggcgcccctgcgatggctgccccgcctggacaccggtccgctcacccggcgctcgccccaccccgacccggcgcgcacggcggccgcgcaggtgcgggcgctggaggggatccccgcgcgggcggcggaggccgtcgcggacatgtaccggcgggcgagcgctccgccaacggatgccgacctcgccctggcccgcaccctgtggggtgcgcgggcggtggccgacgccgggctggagacggcgcgcgacgccgcgcagcggagggcggcgctcaccctgctgcgcgcccgatcggccgccctgctggcccgacgcaccgcacgcctgacccggctcgccgcacgcgcccgcgccggcgtccccctcgacaccgacaccgccgccgaagtggccgcgggctggggccccgtcctggccgccgggctcgacccgggcgacccacgcgtcgcggggccggcatcggccgcgctcgtccaggatccgcgggccgcgctcccccagttgacgttgacgtcggcgggcgagcactgggaggtgcgggccgacctgctcgacagcgacagcgacgacccgcacgtcgtggtcgaggccgaggacgacggcacggcccgactgcggttcggcgacgggcagttggggcgggcggtgaccggcgggcaggagttcctggccgccgtgcgcgtcggcaacgggcctgcgggcatcgccggttcgggcacggtggtgcatgtggtggtgagcgcgccgaccgacgcacgcgtcaccgccgtacgcaatccgctgcccgccacgggtggtacggcgcccgaacctgtcgccgacgcacggctgttcggccctacgcagtaccggcaccggctggagcgggcggtcaccgccgacgactacagcgcgctggcgggcgagccggccggggtgcagcgggcggccaccgaccttgcgtggaacgggagttggtacgaggcggacgtggcggtcgacgcgctgggccgtgtcgatcccccggcggcgctgctggacgccgtgcgcgaccgtctcgaacgtggtcggcggatcgggcacgacctgcgggtggacgcgccgcgcacggtcgccgtggaggtacggctgcagctgtgcctcgcgccggacgcgcgccgggccgccgtggagcgggcggtacgcgcccggctcggcaacggagtcgggggcctgttccaccccgaccggctgaccttcgacagcgacctgtacccgggccggctggtcgccgaggcgatggcggtgccgggcgtggtggcggccgcggtggagcggctgggccgcgccgaggcgcctctgccgctcgtgccggacgacggggtgctggccttcgggccgctggagatcccggcgggcggcgcggatccctcgggccccggcgccggggtgttgtggatcgatctggcgggaggacgg

SEQ ID NO: 391 - DNA, 2601 bp, Streptomyces avermitilis
  CDS (1)..(2601)
atgtgcgccacgggtgagggcagttgctgctgcacgaccggggccgggaccccgctgccgacggacaacccgcccggcgccgcgcggttgcgcgcccgggccggcacccacgccacgttcctcgcgtcgatgaccagggccctgtccggctccgcgcaccccgaactggccgagctcagcacccgggaccccgccgaccccgcgctggccctgctggacgcgtgggcctgcgtcggtgacgtcctgaccttctatcaggagcgcatcgccgacgagggctacctcgggaccgccaccgaacgccggtcgctggtggagctgggccgcctggtcgggtaccggccgcggccgggcctggcggcggacgggtggctcgcctacaccctggatccggacccggccgacgtggaggtcacggtccccgccgggtcgcaggtgcagagcgtgccggatccgggggcacagcccgtggtgttcgagacggcggaggatctggtggcgcggccttcgtggggcgcgcttcgggtgcggactcggcggccgatgccgatgacacgcgagtgcgcgctgggactgcgggtcgtgtacgtggacggggtgagcgcgggggtcgccccgaacgaccggctgctgttccacttcgacgacggcaagctgcccacgttgcggatcgtggagtccgttcacgccgacgccctggcgggcacgacagccgtcgctctggtgcggatctccgacaagttcgagaaggcgtgccgggagaccgtcgggaggacggggagggccgcgttcgtacggctcgacgtgctgcgggtcagggcggcgccgttcggtaccgccgcgccgcagaaactgaagtccaccggcgaggtgggagccaccgccgcggcggtcccggagttcgaggaatggccgttggaccccgccctctacacagtggggacgaaacccgaggaggaaaggcgccggctctggctggacggggaccatccgcggatcctgcggggcagctggatcgtcatcgagtcggctgacggctgggggacgccgttccaggccaccgacgtccgcagccgcggcctcgcgcactacggcatcacgggcaaggtcaccgtcctcgacctgccgacgacgtggtacgacaacccggctgacggcaccccgttgctgagcctgcacaggggcctcaccgtccacgcccaggccgagcccctcaccctcgccgacggccccttcaccgacgggctcacgggatccgccgtcgacctggaccgggtgatcaccgccccgcccccgtcccgcaccgtcctcatcagcggcgcccccgtcgacggcggcgcgcccgccggcgaggtcgcccacgtcctggccacccacacggtcaccgaccccaaccggccgggggcgaccccgtacaccgtcctcgaactggccgccgggctgcgccacacctaccgccgcgacacggtcaccgtgtggggcaacgccgtacgcgccacccacggcgagaccagggaggagccggcgctcggcagcggcgacgcgtcccggccgggccagacctttaccctggccgcgcatccgctcacccacgtggcggcccccgctgccgacggaggacaggccgaactcaccgtcagggtcggcgagtcggcgtggtccgagacggacgagatcgcccacgccgcccccgccgagcacgcctacgaactccgtgcggacgacaccggcaccgccaccgtcaccttcggggacggccgtcgcgggtcccggctgcccaccggcacggccaacatcgccgcccgctaccgggtcggcctcgggcgcgcgggcaacctgcgggccgggcagttgagccagttgcgcgccaagcccctcgggatcgacgccgtcgtcaatccgctgtccaccggcggcggcaccgacgccgacaccgacgccgcgctgcgcggccgggcgccgctgccgacgctggccatggaccgcctcgtcggcctgcgtgactacgccgacttcacgctggcccgggccggtatcggccgggcggccgccgcccggctgaccgtcggcggccgcgaactcgtgcacgtcaccgtggccggtgtcgacgacgccgaactcgacccggacacggccgtcgtcacctccctgctggccgcgttccgccgctacggcgacccgggcgtgccggccgccgtcgcgccccgcacccgttggaacctcgtcctccaggcccggatcggcatcgcccccgaccgttccgccgtcctgctggagccgcgcgtccgggcggagttcgagcgtgtcttcgccttcggcgcacgggagttgggccggagcgcgtacgtggcggaggccgtggccgcgcttcagggggtgccgggggtggtcttcgtggacgtacggcgtttcggtgcgactctcgggacgacacccgccgacgcggccgaggtcacgggggtcgcgcagcgtgtcctggcgcggccggcccgcgtcgagttcggagcagcgccgccgacggaggtcgtccgtcccgcggatctcgtcgtcgccgcaccgggcctccctggcttcgtcgtactgaacctggaggtggcccga

SEQ ID NO: 392 - DNA, 2097 bp, Streptomyces avermitilis
  CDS (1)..(2097)
atgagcagcccgccccccgaccgcctctacgacctgctgcccgcggtccaccgcggccgcgacgaggaacagggcttcccgctgcgggcgttgctgcggatcgtcgaggagcaggtccgggtgatcgaggaggacctggacacctggtacgccaactggttcgtggagacgtgcgaggactgggtggtgccgtacatcggcgccctggtcggcacccgccccccgccgccgggcagttcacccggagcggtccgcgcgctgtcgccgcgccaggacgtggcggacgcggtggcgaaccggcgtcgcaagggcggtgcggcggcgctggaggcggtcgccctggacagttccggctggcccgcccgggccgtcgagctgtaccggcacctggtgcgcgcccagcacgcacggcatgtgcggctcgaccgccccgccaccttcgccgtgcgcgacccgctggcctgcgcccggctcggcggccccttcgacgacgcgccgcacctggtcgacgtacggcggccgaacagcacgcagacccgtgggctgcacggcatcccgagtctggccctgttcgtctggcggctgcgggccttcccggtgacccgggcgccggcgttctgcatcgaccagcgctacagccgctatctcgtcaacgtcctcggtatcgacacccggttgttcgccccggcaccgcaaggcccggcgcccgcacgggtgtcgggccccggcgacgtaccgcatccgctggggcgggaggagttcgaggccgccgtcaccgagtactacggcccaggcagaagcctggagatctggcgggactcccccgacaacccggtaccggcggaacagatcatcgtcgccgacctcaccgactggcgctatcggccgcggccggggcaggtcgtggtcgacccggtgctcggccggatcgccttcccggcggacgaggcgccggaggacggggtgtgggtgagctggcactacggtttcgccgacgcgatgggcggtggcgcgtaccgacgcccgcagaccccggtcggcgaacgcaagctgtacgcggtgggcggcgaggacgacttgggctcgatcacggccgcgctgcggcagtggcgggcggacaaggcagcggatccgtcccttcatgacgcgctgatcgagatccgcgactcggccgactacacggaggccctgcggatcgacctggacgaggacgaccggctcgagatacgcgccgcacgtggtgaacgcccggtcgtccgcctgctcaaccagaaggccaaccgcttcgacgcgctcaccgtacgggccaccgcgaagaagccgccgcccggcacggtcgccgactgcccgccgccggccacccgccgcccgcaactggtcctggacggtctggtggtgagcggccgcagccttgacgtggtcggccagatcggcgaagtgctggtccgccactgcacgttggtccccggctgggagttggaccacgattgccgcccccgctggggcgaggaaccgtccgtcgaactgcgccgcaccacagcccgcctacgcgtggagcattcaatagtcggcacgatcgtggtggaccaggacgagacgaagggcaacccgctgaccgtcgagatcctggactcgatcgtcgacgccacgtcccacgacctgcccgccgtgacagcccccgaggaccgtttcgcccacgccgagttgaccctgcgccgctgcacggtcctgggcgacgtgcgcgtccacgccctccccctcggcgagaacagcatcgtcacgggctgcctgcacaccctccgccgcgacacgggctgtctgcgctactcgtacgccccggtctcgcaccctggcccgccccgctaccgctgcgccacggaccccgcccgtccgcacttcaccagcacccgctacggccaccccggctactgccaactccacaccgcctgcgacccgttgatctccacgggcgccgaggacggcgccgagctgggcgccttccacgacctgtaccagccccaaagcctgagcaacctcgtcggccatctcgccgagtacgtgccgctcggcgtcgaggcagccgtcatcaccgccacc

SEQ ID NO: 393 - DNA, 1290 bp, Streptomyces avermitilis
  CDS (1)..(1290)
gtgcacggtgacttctcgaacatcacgttctcgcccgaccgtagctattcgaccgtgttcgacctccagggacgggtggggctggacgccaaccggaacgaacagacagccatcctgctgcactacctacggacggcgatggccgacctggtcgggccctacgccggccccgccaccagcctgggcttcgagatctccgacatcggcaccggcggattctccatcggggcgggccgctactacgtggacggcatcctcgtcgagaaccccgccaaggtgacctacgccgagcagccgcacgcctacatcgacctcgacgacgccgaccgactgccgtcgggcagttacgtcgtctacctcaaggtctgggaacgccacgtcaccgaggtcgaggacccctcgctccacgaacccgcgctcggcctgcaccagcccgactcggcgagccgcgcccaggtggtgtggcaggtccgggcactgccgctcaagagccggcagaaccccgtgcaccggatcgccgccgagcacgcaccggaccggggcacgggcgtcctcgacgtccgcacctcccgcgacgacagctcggccgacgatccctgcacggcgtcgcctgacgcgtcgtacaccggcgagaaccagctctaccgggtggagatccggcgcggcggtacggcggccgacggcgcgacgttcgcgtggtcccgggacaacggctcggtgatccaccccgtccgccctctcggcggcaccaagatgcggctgacgtcaccggcccgggaccggcacaccgctctggagcccggccactgggtcgaggtggtcgacgacgcgatctcgctccgccgcgacctcggcctgcccgccggggcacccccgctccaccggatcgacgacatcgaccccgacaccctgacggtcatcctcgccaccacccccgacccacccgtctcccccgaccgccacccctacctccgccgctgggaccacacccccctcgacaccgactcgggcggcgcgatcccgatcacggaaggcccctggatccccctggaacacggcatcgaaatccacttccagccctccgcggcacgggagccggcccacgagtaccgctgcggcgaccactggaccttcgccgcccgccggactctcggcacggccatctggccgtatccgggtgggagtgggccgcatggggtgcggtatcacttggcgccgctggcggtggtggcggggagcaaggtgagtccgctgcggacgtcgttcgcggtgccgttgacgtcgggcgtg

SEQ ID NO: 394 - DNA, 1923 bp, Streptomyces avermitilis
  CDS (1)..(1923)
gtgcccctatgtcctctgaaggaaggcccttcgatgattcgcgcgctgatcgacagaggccggacgggccatgatgcggctgctgttctccacagccgaggccacccccttgatgccgggatcaggcagaccatggagatggccttcggtcatgacttcagccaggtgcgtgtgcactccgatccgcaggctcacgccctgacccggcggatgaacgccagggctctcaccctgggcgaccacatcgcgctgggccaggactggtacagccccgattcagcggacgagctccgggctctggcgcacgaactcgcgcacgtcgttcagcaacgatccggctgtgcggaaccgccagccccttctccccatacggaaaccgagcatgaggctgtcgcggccgccgacaccgtgatgggcggcggagccgcccgggtacgcgggcgcaccgggatcggtgtcgcccggcaggccgtcgagtccgacccttccgacctgtccgacacgcaactcgaacaggagtggctcctggccgcggcatggctggtcgaccactccatgctcgagagtgactacttcacggtggcgaagtatgtgaaatccctcgaggacgcgatgcggggacgcgcgggaggcgcacaccgggctcagtccgaggggacgctgccgttggagccgctgcggcccagcatccttcaggtccctctccggtcgcccgtcggtgcggcaggctccagcggagccgttcccgccgccccgcgaccggtagtcgccacgcccctcgacataccggctgagggggtcgacatgccctgggtcggccgcgggaaaggcatctcgtccagcgagctcggttacctgcgagactcgaagtacttctggccccggttccagcagagctacggttccgccatcagcctggccaacgcacagctcatcgcgtcgggccaggctccccgcgtcgatgccacctggatcgagcatttcccgggccatgccgcctatgtgaacgacactctggaacaccatcacgtcggccaggggtctcgtgccgttccgctgccgagccgtctgcacgacgcctacacggtgtttcacccgcagcgccgtgtggtgagcacaccgcagggaggcctgcgaccgatacccccaccacgctctcacgccgacgcccagaccaatctgaacagccatgtggaggccggtcgtatcagcggcccggggatcgacccgacgaagccgcccactgttccggccgtcccaccggcctcagaagtagccggacaacgagccacaccgccggcggccgtcccccggatgttcggagggggccggatacgggggctcgtcggcggaacgatactgggcggcctccagctgctcgccggatatctgtccgccaagctccaagaccacttcgaccagcagcgctgggaacgggaacgggagaccattcaggcacaggtcgaacgagagctcgacgggatgtccttggagatcaccgaccgctacctggacgctcctggcagggaggtattcgccgtcgtcgcgatcacctccacggcactccgcacggtgcaggtctacgctacgggcatacaaagtgaagtcgtggaccagaccgtgtacttgggcagcaagctcgcgtctgtggaactcggctccgcggcccggagtgagcggcatgaagaggtacggcagatagcggccccgctcaatctgggtttcccgaccacgacgtacaccaccacgaccttgtactcattcgcagtgccgagcccggacctcatcgccttgcgttggcgggccttggaacgacttcgcgacctcgatctgcaggcacccgcgtcacagactgctcaggccgctgccgcggtccaggaggaacgaacccgcctgtccgcctggctgcgcccctccgccgac

SEQ ID NO: 395 - DNA, 219 bp, Streptomyces avermitilis
  CDS (1)..(219)
atgagcgaaacaccggagactcccaccgccgtgctgctgatcactgtgtggttcgagcccgcttcgcccacgctgcgcgcccgcgtcatccaggcagtcgacgtgcataccccaggtgaaaccatggtgctggtcgggcgcgacgcggtcctgggggtcgtacacgagtggttggacgcctgtgcccacgaccgtccgaatccgccgtcaggcgcgacg

SEQ ID NO: 396 - DNA, 822 bp, Streptomyces avermitilis
  CDS (1)..(822)
ttggcgtttcgtgaaaaaccttacgaacatagggagttccccgatgcgccggaaccctcttgtgcagttgcatcgatcggactcgtgggatgcgtcgggggaggcgccatgagcactgccgacacgttcgcgcccagactgtgcctactgggccgcttcaccctgacctacggccccaccacgctcgacgtcggcaccgcggcccaacgcctcctcgcctacctcggcatgcgccaccacggcacccgcacggtggtcgcggggacactgtggccggacgtgccggaggaacgggcgcacgggagcttgcgtacggcgctctggcggctgcaccgggggagggagccgctggtgtgcagcgagggcgacaccctcgcactggccgagtcggtcaccgtggacgcccggaccctgatgaactcggccctgcacgtggtcggcacatcacccccggcacccgcaccgccccgggacctgctcttcgctggcgacctcctccccggctgggacgaggactgggtgctcttcgaacgcgaacgtcttcgtcagctccgtttgcatgcgctggactccctggcccaccgactcttggcggaggggcaccacgccctcgctctggaggccgcattggagagcgtcaggatcgaacccttgcgggagagcgcccaccgagctgtggtcgcggtacacctggccgagcacaatgtgctggaggcgattcggcattaccgggcgttcaaggaccttctccgcatcgaactcggtatcgccccttctctgggcttcacttcgatgcttccggcctgcgcgttgatccgtgac

SEQ ID NO: 397 - DNA, 2832 bp, Streptomyces avermitilis
  CDS (1)..(2832)
atggacgagacgacggtcgtgaccggcggcgtaccgggggccgggacggggccggccggggacaccgagttcccgccggtcggacgagagtgtgaacgggccctgctcgacgggctgttggatgccctgacggagcggggtggcgccctgctgctcagcggtgacccggggaccgggaagagcatgctgctggggtacacggccggccgctgccgtacgaccgtgttgcgggcccgcggggtggagtcggaggcggtgctgccctataccgtcctcgccgacctgttgcttccgctccggccgtacttcaccgagctgcccccggggcagagacgggcgctggagggctgtctggcgctggcggacgtggcggggcccaatccctatgcggtgtgcgccggtgcgctcggtgtgctagcggcggccggtgaggtgcggccgctgctggtggtcgtggacgatctgcactgggtggatccctcgtcacggcaggtcctgcagttcgtggcacgcaggctgaccacggagcgggtggcgctggtgatggccgtgcagcccggggccgaagaggacggcccgtgggcgagcgtgccgcgggtggcgctggggccgctggccgaggacgactgctggacgctgctgcgacggcacggactggaccgaacggatccggcggcggatcggctggtccggctgtcgctgggcaatccgctggtgctcgtcgagtacgcgggcatgctcgcccggatgcgcgcgacgggagccacgcagtgggacgagatgtgggaggcgcccgggccgctggtggagcgggcctggcggggacagctgcgcgcgctgccgcatcgcacccgggaggcactggtgtacgtcgccgcctgccgcacacccgacctcgccctgctgaccaaggcgttggcggcggacggcacggacctggacgcgctggacgcggccgagcggaccggactggtgcggatccgggacggcgtgtgcgagctccggcatcccgtgctgcggccggtggtgctgggccagtgcaccacggcccgccggctccaggtgtatcggcggcttgcggcgctgtcatcggacgagctgcggacctggtatctggccgccgccgcgcccggcccggacgaggcggtcgccggccggctggccgccgacgccgaacaggctcgtaggcgcaatgcgttggcggccgcggcatgcgcctggcaccgtgccgccgagctgtccccggaccccgctgacgccgcgcgtcggctgctcgaagcggcccgtgacgccttctgtggcggcaccgcacgcgacgccgcccgctggtgcgaacaggccctcgtgcacagccgtgacccgcggctcaccgccgacatcgggctgctgcgcggacaggcctgcacctggctcggcgacccggcccgcgcccaccggctcctcgtcgacgccgcccgtgcggtggaacccgtggaccggccccgggcctgcctcctgtacggcgccgcggtggcgcccgcgatgatggacggtcggctgcggcacgcctccgacatcgcggcacgctgccaggaactcgccgacgacggacgggacacccagcgccggcacgccgccgtgatgcgggccaaggcccaggccctgggcggcgacgtgccgacaggacgcgcggccctgctcgcgctcctggacgagagccacagccctgtggccatggacatcgcccgcggccccgaggaacgccagatcgccatggacatcgcgcagggcctctcctggacggacgacggcgaggccgcccggccggtgctggacgcagtgatcgagtgcacacggcgcgacagttcaccgacgctcttgtcgtacgcgctgctgggccggtgcgaggtggagatgtggagccattggcagcaggcacgtgcggacgctgcggaagcactgcgctgggccgaggagttcgggcttctggcgatgtcgggctacgcactgatccagctggcccggctggatggcctgcggggcgacactgcggcctgcgaggagcggatcgcccggtacgagcactggtgcggcggccggctgcgcggtctggacatgttcgcgcggggcacgctgggggcggccgcgctgaccgccggggatccggacacctgccgtacgcacctggaggcggccttccggatggccgacgggatggggctggtcaaccccagcctcatgccgtgggtggcggatctggcggaggcgtctctgcgtaccggcgcacgggagcgagccgtcgcggtcgcggactggctcgccgagcgcgccgaggcgaccgcgctggcgtggcccgcggccgcgtacgcccgctgccgggtgatgctggcgcggacggcgcaggaggccgccgactggctcgccaccgccgaactcgcccacagcaaacgggagatgcctttcgaacgggcacgcacccggctcgtcgccggagaggtgctacgacggttccggcggccgtcggcggcgcaggaacccctgctcgccgcgcagcgcacgttcaccgcgttgggggcggcgccgtgggcggcccgagcccgggcggaggtcgcggcggccgggcaccgcaccgccgtccgccagaccgagccgtccttgacggagctgctcacgccccaggagttccaggtggcacgggccatcggcgagggtctgagcaacgtcgaggccgcggccgccctgttcctgtcccgcaagacgatcgaggcccatctcacccgcgtctaccgcaagctgggcatccgctcgcgctcggacctggcacgctgcatggcacacgccggcgccgttgga

SEQ ID NO: 398 - DNA, 552 bp, Streptomyces avermitilis
  CDS (1)..(552)
atgcggtcgtggatgctgacgcagatcgaggcgttggcgcaccggaccgcagtgccccccgtggccggtgatgacccggccgccaaggccgaggtcgtccggcttctcgacgtcctgggctacgacgccgtcgacatcggcgcactcgccaacgcctggcactgcgagccgggcacactcgtctatgtctggccctacctcggagagcgctcccagagaatcaccaaggaggaggcacggctctggttccgggaaatcccgggcgagccaacgcccgccgactgggtcaaggaactcatcgaccaggccgtccgaggccccgtgggcggctctttcgccgccctaccgttcaggacacggtggtgcccgaggcgttcaccgacgtcgccgccccggtggaggcgcggactgtgtccacaggtccggcgtccgaggcagcggtcacgactgaaaaaggcacccagtcccaccccgccaagaccgcggcgccgactgccgcgtcccgtccggcgcgcaccgccaggccgtcggcggcgtcgcggcgcccaggcg

SEQ ID NO: 399 - DNA, 1464 bp, Streptomyces avermitilis
  CDS (1)..(1464)
atgacctccctgaaggcttcacacgctgccgacctggtcgccgccctgttgttcatcctcagcctggccggcctgtcccagcatcgcacctcccgcgccggcgtcgtctacggcattgctggcatggcccttgccctggtcgctaccgtggttgtggcggcgcggagcatcaccgccggagcggtcgcgctgatcgtgctggcgatggcgctcggcgcggcgatgggcctgtggcgggcccgccgcgtcgagatgacgcagatgcccgaactgatcgctgtcctgcacagcttcgtcggcctcgctgcggtgctggtgggctggaacagctacctggaggtggattcccacggctcggcgcagacccggatcggcgccaacctgctgggcatccaccacgccgaggtgttcatcgggatcttcatcggcgcggtcacattcaccggctcgatcgtcgcgttcctgaagctctcggcgcgcatcaagtcccgtcccttgatgctgccgggcaagaacgcgctgaacctcggcgcgctcgcggcgttcgtcgtgctgaccatctggttcgcgatcagcccgaacctacccctgatgatcgcggtgaccgcgctggcgctggccctgggctggcacctggttgcctcgatcggcggtggcgacatgccggtcgtcgtctccatgctgaacagctactcgggctgggcagcggccgcggccggcttcctgctcgacaacaacctgctcatcgtcaccggcgcgctggtgggctcctccggtgcctacctgtcgtacatcatgtgcaaggcgatgaaccggtcgttcctctccgtcatagcgggtggtttcggcatcgcggcgccgtccggcggcgaggaggagcagggcgagcaccgcgaggtgcgggccgcggaggcggccgagatgctggctcaggcccgctcagtgatcattacgcccggatacggcatggctgtcgctcaggcccagcatccggtcgcggagctgacgcggcaactgtgcgagcggggtatcgaggtccgcttcggcgttcatcctgtcgccgggcgcctgcccgggcacatgaacgtgctgctggccgaggcgaaggtgccctacgacatcgtcctggaaatggacgagatcaacgacgacttcgccgacacctcggtcgttctggtcatcggtgcgaatgacaccgtcaaccccgccgcgaccgaggacccgggcagcccgatcgccggcatgccggtgctgcgggtatgggaagccgagcaggtcatcgtcttcaaacgctccatggcctccggctatgcgggcgtgcagaacccgctcttcttccgcgagaacagcagcatgctcttcggcgacgccaaacagagcgtggaggagatcctgcacgcgctcagcaccgacagccgacacgacgcggccccggccgcacgccaggcgacggtggccagccac

SEQ ID NO: 400 - DNA, 1554 bp, Streptomyces avermitilis
  CDS (1)..(1554)
atgtctgctcaaaaaccctcacaccatcctccccggcgcatcggcgtagtggccgagtctgtctccggggagacgcgggtcgcggcgaccccggcgacggtacgactgctgctgggcctcggctacgaggtcgtcgtcgagtccggggccggtgaggcctccggcttcggtgaccaggcgtacgccgatgccggcgcggggattggcgaggcctgggacgcggatgtcgtgctgaaggtgaacgccccctccgacgcggaaatctgccggttgcgaaagggcgcgaccgtggtcgccctgctgaccccggcgcaaaagcccgagctgcttcaggcgctcgccgacgccggggtgaccgccctggcgctggacgcggtgccgcgcatttcgcgggcgcagtcgatggacgtgctgtcctcgatggcgaacatcgctggttaccgcgcggtcatcgaggccgcgcacgccttcggacggtttttcaccggccaggtcactgcggcgggtaaggtgccgccggcgaaggtgctggtggctggcgcgggtgtggccggtctcgcggcgatcggtgccgcttccagcctcggcgcgatcgtgcgcgccaccgacccgcggccggaggtcgcggaccaggtgaagtcgctgggcggcgagtacctgccggtggaagccgttcaggagtcgagcaccgacggctatgccaaggcgacgtccgccgactacgaccgcgccgccgcccagctctaccacgagcaggccgaggacgtggacatggtgatcaccaccgcgctgatcccgggccggccggcgccgcgcctgctgacggccgaggacgtggccgtcatgaaatcgggcagcgtcatcgtcgacatggctgccgcgatgggcggcaacgtcgagggcaccgtgccggggcggacggtggtgaccgacaacggcgtcaccatcatcggctacaccgacttggcctcccggctcccggcccaggcctcgcagctgttcggcaccaacctgctgaacctgctgaaactgctcactcccggcaaggacgggcagctgacggtcgacttcgacgacgttgtgcagcgggcggtgaccgtggtgcgcgacggtgacgtcacctggccgccgccgcccgtcgcggtctcggccgcgcccgccgcgcagcctgcggccgcacccgtagcgcccgaaccgaagcagtcgaacctgacgcctgcgtggcgcttcggcctgatcgggctcgggatgctcgcgatgtttttgctggtggccttcgctcccacgcaactcgcgggcaacttcaccgtgttcgcgctggcggtggtgatcggctattacgtcatcggcaaggtgcaccatgcgctgcacaccccgctgatgtcggtgaccaacgcgatctccgggatcgtcgtgatcggggccttgctgcagatcgggcacgagagctggatcgtcaccacgctgtccttcgtggcgatcctgctgacgagcgtcaacattttcggaggtttcgccgtcacccgccgcatgctgtccatgttctcgaaaggc

SEQ ID NO: 401 - DNA, 717 bp, Streptomyces avermitilis
  CDS (1)..(717)
gtgaggtcgcctccccgtcgccggctgtcgcgcctcgtctatggcaccatccacgcgggggccgcgcggctccttcaccgcctgcggtggagcaccgacaggcgccgactgcggctcttgcgcctccgggaacggctcgtcgggttgcccgtgaacgccgcctcagcacccactgccgcggccgagccgcgcgacgccgccggacggccgccggtccgcgcggcaacccccgctgacgccgaaggcatcacccggatgcgctccgcatacgtcctgtccgcaccgttcaccgaggactgggtccggcagtgcacggacgagctggcgccacggctcacgccggaaggagccgcccgggccttcgtcgtcgacgccccggacggcacgatggccgcctgcgccctcggcctgatccaccccgtgctcccggccccggcctacccccggggccgggccgcccgcgtacagatcgtcgccacccagcccgagttccgccgccgcggttacgcccgggcggtcctatccgcactcctcgaccacctcggcgacgtcgaggacgtcaccctgttcgaactgcacaccagcccggaggctgcgcccctgtaccgggagctcggcttcagcggcagcccggcactgatgtggatgacccgccaccgtgaacgtgccggtgctgtggccggtgcgcagccggactcgacgtggatgccaccgcag

SEQ ID NO: 402 - DNA, 435 bp, Streptomyces avermitilis
  CDS (1)..(435)
gtgtgcctctacgtcaccgacgaggacgaccggccgctgcagctgcactccgtctactcccccggccacccctggcacatgatcggcggcgcgatggatctgggcgagcggccctgggacgcggtggtgcgcgagggccgggaagagaccggcatgaccgccgtgggcccggcccggctgctggccaccgtgttcgggctgccccgggagggacgttcgtacagcactctgcagctgatcttcgacggcggtcgtctgaccgcggaacagatccggggcatcaccctcaattcgcgcgagcacgacgaggcccgcgtcctgcccttggccgagtgggaggccttgatgccggcccgcgatttcgtgcggctgcgcgccgtggaggaggcccgccgcaccggcgtggccgcatacgtcgacacctgggggcacgca

SEQ ID NO: 403 - DNA, 765 bp, Streptomyces avermitilis
  CDS (1)..(765)
gtgaactccccgctcaccgagcacaacagcctctggattcgcaggttccacccgcgccccgacagccacgtccggctggtctgcctgccccacgcgggcggctccgccagcttctacttccccgtgtcccggtccatgcccgaaagcgtcgacgtgctgtgcgtgcagtaccccggccgccaggaccgccgcaccgaacctctcctggactccgtaccggcgctcgccgacaaggtctacgaggccctcctgccctggaccgaccggcccatcgccctgttcggccacagtatgggcgcctccctcgcctacgagatcgcccgacggctggagcaggagcggggcatcacgcccgccaccctcatcgcctccggccgccgcgccccgtccacgcaccgcgacgagaccgtccacctgcgcgacgacgacggcctcgtcgccgagatgcgcggcctcagcggcaccgacccccaactgctgggcgacgaggacgtcctgcgcatgatcctcccggccatccgggcggactaccgcgcagccgaaacctacacctgggaaccggggccacccctgacttgccccgtgacctgcctcgtcggcgacgacgacccgaaggtcaccgtggaggaggccgccgcctggtccgggcacaccgacggcccgttcatgctgagggtcttccccggcggccacttcttcctggcccggcaccagacggaaatcgtccgcctcatggccacccagttggaggtgctcgaccggcca

SEQ ID NO: 404 - DNA, 1641 bp, Streptomyces avermitilis
  CDS (1)..(1641)
gtgattgcacaccagcctctgtcgcggcgccgcatgctaggcgtggcggccttgggtgccgccgcactcgcggggcagactacgatcaccgccgccccccgggcggccgctgccaccgcaaccagtggttccggcggcacgttcgtccccgccgtcgtggtcggcaccggttacggcgccgccgtctccgccttgcgcctcggcgaggcaggggtccccaccctgatgctggagatgggccggctgtggaaccagcccggtccggacggcaacgtattcagcgggatgctcaagcccgacaagcgctcgagctggttcaagacccgcaccgaggccccgctcggctcattcctgtggctcgacctcgccaaccgggacatcgagccctacgcgggtgtactggaccgggtcaacttcgaccagatgtccgtgtacctgggacgcggtgtcggtggcggttccctcgtcaacggtggcatggcggtcacgccccggcgctcgtacttcgaggaggtgctgccccaggtcgacgccgaggagatgtacaccaagtacttcccccgcgcgaactccaccctccgggtcaacaacatcgacaagagctggttcgagcagaccgactggtactcgttcgcgcgtgtctcgcgccggcaggcctcgaacgcgggcctgagcaccaccttcgtgcccaacgtctacgactgggactacatgcgccgtgaggcggacggcgcggtgcccaagtccgcgctggccgccgaggtgatctacggcaacaaccacggcaaggtctcactcgacaagagctacctggcggccgctctgggcaccggcaaagtcaccatcgagaccttgcaccaggtcaagacgatccgtcagcagaacgacggcacgtacctgctcaccgtcgagcagagggacaccggcggcaagctgctcgggaccaaggaggtttcgtgccgccacctcttcctcggtgccggcagcctcggctcgaccgaactactcctgcgtgcccgcgagaccggcactctcccgggcctcagccctgaggtcggcgggggctggggccccaacggcaacatcatgaccgcccgcgccaaccacatgtggaaccccacgggcaccaagcagtcgtcgatccccgccctcggtatcgacgactgggacaacccggacacccccgtcttcgccgagatcgcccccctgccggcgggtgtcgagacctgggtcagcctctacctggccatcaccaagaacccggagcgcggcaccttcgtctacgacgcggccaaggaccgggcggacctgcgctggacccgggaccagaacgcgcctgcgatcgcagccgcgaagtcgctcttcgaccgcatcaacaaggccaacgccaccatctaccggtacgacctcttcggcaagcagatcaaggccttcgccgacgacttctgctaccacccgctcggcggctgcgtcctcggcaaggccactgacgactacggccgcgtcaccggatacaagaacctctacgtgaccgacggttcactcatccccggaagcatcggcgtcaacccgttcgtgaccatcgcggcgctggcagagcggaacatcgagcgcgtcatcaagcaggacatcgcggattcc

SEQ ID NO: 405 - DNA, 696 bp, Streptomyces avermitilis
  CDS (1)..(696)
atgacgcccctgttgacggccttcacggccgctcaccggcctccgaatttatttcgcccaagtttcctgacggggggcactctcttgctgattccggcacctgcaactccgggcctgtgtatggcgagtctcgataaaaccctgaccatccagcaggcgaaccaggagttcttcaggcagttcaacggctcgtccgaggacatatgcggtcgcaatttccgtgacgtggtgcacccgagcgtgcagcagccgctggtgcgtcaattctccaatttacttgaagggaagaaccaccgtttcgtcacgcccgtcatcgccgtggggcccggcgaggagtccgccttcaccgttcccctcaccgcggtcgcggtgcgcggtggcctgcccgacacgaccgcgatcctggtcatgatgcccacggccggggacgccgagcagacgcgtgtggtgcccaaacgcaagaagatcctctccacgatggacgcgcgcatcctcgaaggcatcgccgccggcgtctccaccgtccccttggccgcgagcctctacctcagtcggcagggtgtcgagtaccacgtgacctgcctgctgcggaagctgaaagtgtccaaccgcgccgcgctggtctcccgcgcctactccctgggcgtgttcaaggtcggcacctggccgcccgaggtcgtggacgacttcgtgaag

SEQ ID NO: 406 - DNA, 3288 bp, Streptomyces avermitilis
  CDS (1)..(3288)
gtgctacgtcatcggacgcccggttacgtcctcgatctcgatcccgaacaggtcgacgcctggcgcttcgagcgtctggtcaccgacggacggcggctgctggagcagcgcgatccgcgcaccgcgcacgcccggctcaccgaggccttggggctgtggcacggctcgccgtacgcggagttcgacagccatcccccgctcagcgacgagtgcacccgactcgaacagatccggctcaccgccgtcgagtcccgcgcggaggcgcggctggccctcggcgcggccgaagaggtcgccgccgatctggacggggaggcgcgccgtcatcccacgcgggagcggctggtcggccacctcatgacggcactgtcccggctcgggcggcaggccgaggcgcttgaggtgtacgagcggacgcgtagtcatctggtcgaggagttcggcgtggacaccgcagccgaactacgccgggtcagaaacgcgatcctgcgcccggggccgggagcgagcgccccctcgaagaagctgtcacccacaccacttgagtccaccagagcgtcacctgtcccgctcgcgatgaacgagagcggtgacgacggagtacagaactccgagggcttcgtgggctcctgggacggtaggactgccgtcacgccccggaggcacggcacgacggtggaaaccaacgacgccaacgggacggacgacgccgacgcggccgtcgaacgcgaggggatcacggggaccggcgcgcgcccggaggcgcgaaccgatgtgccgccgggcacgcgggcggatgccgccggcacgcaagccgggacagcccagtggcggcctgcacccgggccggaacacgagctcgcagccaccccggaagccgggaaatccccggagtccgagtcggggtggacggctgccccttcgccgttcaccggccgcagccaggagctcgaccgcttgacgaccgccgccgcgagcgcggtcgtgggccacggccatgtagccggcgtcctcggccccccaggagtcggaaagacccgcctgctgctcgaacttgcggcacgtctggagagcatggaggcgcccgagaagggctccaggttggaggtggtctggagtcactgcttccccggcgaaggcgtccccgcctactggctgtggactcagatcctgcggcggctgtccgccacccggccggatgcctttcgcgacgcgacggaaccgttcggcgccctgctcgccccactgatgcccgagcggtcggcggcccggaccgaaggccccaaaggggcctccgactggttccaggcccgcttcctcgcccacgacgcggtctgtgaggtgttgctcgccctcgccgggcaacacccgctcgtgctgttcctcgaagatctgcaatgggcggacaccgcctcccttgacctgctcaggctactgagcacccgttgccagggccatccgctcagcatcgtgctcacgacgcggaagttcgaggccgagtcggacgcaacgctgcgccggatggtctccgacgtgttgcgcggccccaggaccgagacgctgcagctctgtgggctttccctgcaggccgtcggcgccctcgtcgaggcacacgcaggctctggtgtggacccgaaggttgtcgaggtgctgcaccggcgcagcggaggcaacccgtacttggtgatgcagcttctctctctcgtgggcgatgcgcgtaaactccgtcgcccggatgcggtcgacgcgctcctggcccacattcccaccggcgtacgcgaggcgctgcgccagcggttcgccgggctgcccgagccggtcctgcgggtgcttcgactgtgcgccgtcatcggcgccgaggtggacaccgacctgttgcaccgcaccgccacgcgggacgagccggtcatcgcgggtcttgagtcggccatccgtgccggcctgctcggggaggacccgcaccacccggggcgactgcacttcgctcacgccctggtccaggagacgctcgtcgacgagctcccccgtgaggaccgccaccgcctgcacgccagggtcgccgacgcgctgagcgcacgcaggcgagggcaagtgcaggacgaggagatcgagcgggtggcacatcacagctggcacgccaggagtgcactgcccgcggccgaggtgttgcctcggctgctgctcgccgcggaacacgccgagcagtccatggcgtacgagcaggtggagatctggctgcgccgcgccgtgcacctggtcggcttcctaccgccggacgatcccgccacagggaggttggaacaggacctgcacatccaactcggccaggtgctcgccaccactcgcggctacggccaccccgaggccgagacggcactgacgcgcggtcgcgccctcagcacggccgcgcatgcccccgaggacccgtcggtactctgggcgctgtgcaccgcgtacctggtcaccgggcgctacgacgcctcgcggcagttctccggcctactgcgggacatctcgcggcagacctgggagcccgtggcggcgctcggtgcgacgtacggcgaaggcatcgtgctgcatgtgcgcggaatgctcccgcaggcactcgccgaactggagcgcggcgtcggcatagcggatcgtttcgccaacaaggatcacgggctgtcgcgaaccttccagcacgacccgcgcgtctcctgccgctcctacaacaccttcacccactggctcctgggacaccggcagaccgccggcgcgcgccgacgtgagttgttgagcctcactcggtacgaaagcaggccgtccgaccgctccttcgcgctgtacgtggacggggtcgtggcggcttgggagggtgacacccgcaccgcactcgcctcgagcgacgaaggcgctcgcgttgcgggcgaacatggacttgtctactggaaggcgatgctgggcgtcgtcaaagggtggggcctggcgcacgcaggagatcacgaagatggcctcgccctcatgcacacctcgctggccgaattgggccagtccaagacgcacatacgccacccgctccacctgggcctgttgggccaggcgcaacatcacggcgggcggatcgaggaggcgaggaccaccttccggaagctgctggccgccgtcgaacaacgccgcgagcgcgtgtacctccacccggcactgcccgcgaccccgctgctccacgaactgctgggccacggtgccgacgaggcgctcacggaccggggcccaggacgggacgggcccaactccggccgacgagcg

SEQ ID NO: 407 - DNA, 192 bp, Streptomyces avermitilis
  CDS (1)..(192)
atgcgcatcaccatcgaccgcgaccggtgcatcggctccggccagtgcgccatgaccgcacccggcgttttcactcaggacgacgacgcgctggtcgccctggtcccgggacatgaggacggggcgggggacccgcgagtgcacgacgtccccatggcctgtcccgtgcaggcggtcgcgatcttcgaggac

SEQ ID NO: 408 - DNA, 1248 bp, Streptomyces avermitilis
  CDS (1)..(1248)
atgaacgccgcactgccgatgttcgaaaggcacgacatgactgagaccgaaatccgcctcaccgggtcaccggcgccgtccttccctcaggaccggacctgcccgtaccagccgccgaaggcctacgaggaacggcggggcgagagcccgctgacgcaggtcacgctgttcgacggccgaccggcgtggctgatcaccgggcatgccgagggacgggcactgctcgtcgatcctcggctgtcctccgactggggtcacccggacttccctgtcgtcgtccggcgcaccgaggaccgcggcgggctcgccttccccctgatcggtgtcgacgaccccgtgcacgcccggcagcggcgcatgctgatccccagcttcggcgtcaagcgcatgaacgccatccgccccaggcttcagagcctcgtcgaccggctcttggacgacatgctggcgaaagggccgggcgcagacctggtgtcggccttcgccctgccggtgccctccgtggcgatctgtgagctcctcggcgtcccgtacggcgaccacgacttcttcgaggagtgctcccgcaacttcgtgggcgccgcgacgtcggcggaggccgacgcggctttcggcgagctgtacacgtatcttcacggcctggtcggcaggaagcaggccgagcccgaggacggtctgctggacgagctgatcgcacgccagttggaggagggcgacctggaccacgacgaggtggtcatgatcgcgctggttctgctggtggccggccacgagaccaccgtcaacgccatcgccctcggagccctcacgctcatccagcaccccgagcagatcgacgtgctgctgcgcgaccccggtgcggtctcaggagtggtggaagaactgctgcggttcacctccgtctccgaccacatcgtccggatggccaaggaggacatcgaggtcggcggcgcgacgatcaaggccggagacgcggtgctggtctccatcacgctgatgaaccgcgacgccaaggcgtacgagaaccccgacatcttcgacgcccggcgcaacgcacgtcaccacgtcggcttcggccacggcatccatcagtgcctggggcagaatctcgcccgcgccgagctcgagatcgccctcggcgggctcttcgcccgcatccccggcctgcggctggcggtccccctggacgaggtgcccatcaaggccggacacgacgctcagggcccgatcgagctccccgtcgtctgg

SEQ ID NO: 409 - DNA, 1197 bp, Streptomyces avermitilis
  CDS (1)..(1197)
atgcccgagcccaccgccgacgcgcccaccgtccccaaggcccgcagctgcccgttcctgccgccggacggtatcgccgacatccgggccgccgccccggtgacccgggccaccttcaccagcggccacgaggcgtggctggtgaccggttacgaggaggtgcgcgccctgctgcgcgactcctcgttcagcgtccaggtgccccacgcactgcacacccaggacggcgtcgtcacccagaagcccggccgcggcagcctgttgtggcaggacgagccggagcacacctcggaccgcaagctgctcgccaaggagttcaccgtacggcgcatgcaggcgctgcggccgaacatccagcgcatcgtcgacgagcacctcgatgccatcgaggcgcggggcggcccggtcgacctggtgaagaccttcgccaacgcggtgccgtccatggtgatttccgacctgttcggtgtcccggtcgagcgccgggcggagttccaggacatcgccgaggcgatgatgcgggtcgaccaggacgccgccgccaccgaggccgccggcatgcgcctgggcgggctgctctaccagcttgtccaggagcgccgggccaaccccggtgacgacctgatctcggcgctgatcaccaccgaggaccccgatggtgtggtcgacgacatgtttctcatgaacgcggccggcaccctgctgatagcggcccacgacaccaccgcctgcatgatcggcctcggtacggcgctgctcctcgacagccccgaccagctggccctgctgcgcgaggacccgtcgctggtcggcaacgccgtcgaggagctgctgcgctacctcaccatcggccagttcggcggcgagcgcgtcgccacccgggacgtggagctcggtggggtgcgcatcgccaagggcgagcaggtcgtcgcgcacgtcctcgccgccgacttcgaccccgccttcgtggaggagccggaacgtttcgacatcactcgacgccccgccccgcatctggccttcggcttcggcgcacaccagtgcatcgggcagcaactcgcccggatcgagctgcagatcgtcttcgagaccctgttccgccgcctcccgggtctgcgcttggccaagcccgtcgaggaactgcgcttccgccacgacatggtcttctacggcgtgcacgagctgcccgtcacctgg

SEQ ID NO: 410 - DNA, 1254 bp, Streptomyces avermitilis
  CDS (1)..(1254)
atgacgaaagctctctacgagataggcgagacaccgccgctcggtgaggtcccgcggcagatgtatgcctcggtgatccgccagaaccgcttcggagagccgaagcaggcgttccgcaccgaggtcgtcgacacccccgcggtgggtcggggccaggtgctggtctacgtgatggccgccggcatcaactacaacaacgtgtggtcctcgctgggcgagccggtcgacgtcatcgggatgcggcagcgccagggccagcccgaggacttccacatcggaggctcggaggcctccggcgtggtgtgggccgtcggcgagggcgtccgcagcgtcacggtgggggaccacgtgctgctcaccagcggccagtgggacgaggccgccgcggacatccggatgggcacggatccactggtctcggagagcatcaaggcctgggggtacgagaccaactacggttccttcgcgcagttctgccgtgtcgacgaataccagtgccaccccaagcccgcccatctgtcatgggaggagtcggcggccttcctgctcaccgggcccaccgcctaccggcagctgttcggctggcagggcaacacggtccgccccggcgaccccgtcctgatctggggtggtgcgggcggcctcggctcgatggccatccagctcgtcaggctggccggcggcattccgatcgccgtggtctccagcgaggaccgctccgagtactgccgccgtctcggggcggcgggcaccgtcaaccgtcgcgacttcgatcattggggccgactgcccgatgccggggacgccgaggcgtcggcgcggttcctgcgcggcgctcgcggggtcggcaagaaggtctgggagatcctcggtgagcgcaagtccccgcggatcgtgctggagcacagcggccaggacagcctgccgacctcgatgtacctgtgcgacaacgccggcatggtggtgatctgcggtggcacctccggctacaacggagacgtcgacctgcgccacctgtggatgcgctccaagcgcctccagggctcgcactacgccgacactcgccagtgccgcgaggtcatcaacctcgtcggcgccggcatgctcgacccctgtctgtccgtctgcgacggcttccaggacatcgggcgcatgcaccagatgatgcacgacaacgtgcacccccccgggaacatggccgtcctcgtgaacgcgcctcggcgcggcgagatcgcgctcgaactcgccgccgcc

SEQ ID NO: 411 - DNA, 10056 bp, Streptomyces avermitilis
  CDS (1)..(10056)
atgagcagcaaagaagacaggcttctcgagtatctcaagcgcgtcaccggggaccttcgtcaggtgcgtgagcgccttcgtgaggtcgaggagaaggacgacgaccccatcgcgatcgtcggtatggcgtgccggtatccgggcggggtgcgttcgccggaggacctgtggcacctggtggccgccggtggtgacgcggtcggggacttcccggcggatcggggttgggacgttgagggcatctacgacccggacccggatgcgagggggaagacgtacgcgcgtcgcggtggattcctgtacgaggcgggggagttcgacccggggttcttcgggatcagcccgcgggaggccgtggcgatggatccgcagcagcgcctgctgctggagaccacgtgggagacgttcgagcgggccggcatcgacgcggagtcggtgcgcggcagccgtaccggagtcttcgtcggctccggctaccaggactacgtcaacctcctggtcggggtgggtggcgagtccgacggtcatctcgggaccggcaactccgccagtgtgatgtccggtcgtatcgcctacaccttcggcctggagggcccggccgtcaccgtggacacggcgtgctcgtcgtcgctcgtggccctgcactgggcgatccaggccctccgtaacggcgagtgttccatggcgttggccggcggcgtgcaggtgatgaccacgcctaccgcgttcgtggagttcagtcgccagcgcgggctggcccctgacgggcggtgcaaggcgttcggtgccggcgccgacggcaccggctgggccgagggcgtcggcatgctcctggtcgagcggctgtccgacgccgtgcgcaacggccacgaggtccttgcggtggtacgggggagcgccgtgaaccaggacggtgcgtccaacggtctgaccgcgccgaacggccccgcgcagcaacgggtcatccgccaggccctggcatcggccggcctgtctcccgcccagatcgacgtcgtcgaggcgcacggcacgggcacgacgctgggcgacccgatcgaggcgcaggcgctcctcgccacctacggccgggagcggacggaggaccggccgctgtggttgggctcgctgaagtccaacatcggtcactcgcaggcggccgcgggtgtcggcggcatcatcaagatggtcatggccatgcgccacggagtgctcccgcagaccctgcatgtggacgagccgacgccgcacgtggactggtcggcgggcgcggtgcggctgctgaccgaggccgtggagtggccggagacccatcacccgcgtcgggccgccgtgtcgtccttcggcgtcagcggcaccaacgcccacaccatcatcgaacaggccccgccggcccaggacgaggggcccgcaggggctctcgtcgacggccccctggcgtgggtgctctccgccaggagcgacgcggcgctgcgggcccaggcggcccggctgcggccttcggcacggggcgaggtccggccgcaggacatcgggctgtcgctggccacgacccgcgccgccatgcgtcaccgggccgcggtcgtgggggacaaccgggaggaactcctcagcgggctcgaggacctggccaccgggaccccttcgtcccgtgtgctgctggggcgcccggccggcggcaagaccggcttcctcttctccgggcagggctcgcagcgcatcggcatggggcgcgagctgtacgcggcgtaccccgtcttcgccgcggcctacgacgaggtgtgcgcgcacctggatgccccggtcgacgtcgatgccgaaacgcttcaccggaccgggggcacccagcccgcgctcttcgcggtcgaggtggccctgttccggctcctcgaatccttaggcgtacggcccgacttcgtcgtgggccactccgtgggcgagatcgccgccgcgcacgtggccggtgcgttgtccctcgacgacgcggcgaagctggtgtccgcgcgggccgcgctgatgcaggccctgcccgcgggcggcgcgatggtcgccgtgcaggccaccgaagaggaagtcctgccccacctcaccgacggggtgagcattgccgcggtcaacggcccgtcgtcggtggtggtttcgggtgacgagacggcggccctggcgattgccgcgggcttcgccgagcagggccgtaagacgtcccggctgaaggtcagtcacgcgttccactcgccgctgatggacccgatgctggcggagttcgccgaggtcgtccgtggcctggccttcgagcagccgcagctccccgtcgtctccaacctcacgggtcagcctgtcgaggcttacacccccgagtactgggtccggcacgtgcgcgagaccgtccgcttcgccgacagcgtccgcaccctgcacgacctgggcgtgaagaccttcatcgagatcggtccgggcggtgtgctgagcggcatggcacagggctgtgcggacgacatcgtcaccgtccccgtactccgggccgaccgccccgagcggcaggccgtcgtgaccgcgctggcccatctgcacacgcacggcgtgtccgtggactggcactcgttcttcgccggcgcgcgcaggaccgacctgccgacctacgccttccagcgcgagtggtactgggtcgacgccccggaatccgccgccgccgaagcggacccggtggacgcggagttctgggagaccgtggagcgcggggacctgcaggccctcgccgagaccctggacatcggcgcaggggacacgttcggtgacgtgctgccgaggctgtcgtcgtggcggcggcagcgcaaggagcagtccaccgtcgacgaccggcgctaccgcgagtcgtggaagcgcctgggcgagctcggtccggccggcatcggcggcacctggctgttggccgtgccggcggaggagaacgagcagaccgccgcggtccgcaccgcgctcaccgcccgcggcgccactctgaagacgctggtcgtcgacgcggcgagccaccgcgccggtctcgccggggagcttgccggaatcgggccggtcgacggcgtgctgtccctgctcgtcaacggcgaccccgtgctgcccaccctgctgctcgtccaggccctgggcgacgcgggcgtcgacgccccgctgtggtgcctcacctcgggcgcggtggccgtgagcggctccgacgccgtacgcgacgcccggcacgcccaggtctggggcctgggccgcaccgtcgccctggagcttccccggcgctggggcggcctgatcgacctgccggagtccgtcgacgaccaggccgccgtacgcctggccgacgtgctggaacaggcgctgacgggccggtgggaggaggaccagctcgctgtccgcgcctccggtgtcttcgcccggcggctcgcccacgcaccggcacgggcggccacccgccgctggcagcctcgcggcaccgtcctcatcaccggtggtacgggcgcgctgggcggccacgtcgcccgctggctggcgcgcggcggcgccgaacacctcgtcctcaccagccgccggggcgcggacgccccgggcgccgccgctctgcgggacgagctggaggtcctcggcgcccgcgtcacgttcgccgcctgcgacgtggccgaccgcgacgccgtagcggccctgctcgcccagcacgtcttcaccgccgtcgtacacgccgccggggtcgccgacgccggcacggtggacgccaccacccccgctgccttcgccgccgcgctcgccgccaaggtcggcggcgcggcccacctggacgagctgctgggcgatcaggagctcgacgccttcgtcctcttctcctccatctccggtgtctggggcagcggcggccaggccgcctacgccgccggcaacgccttcctcgacggtctcgcccggcagcgccgggaccgcggcctcaccgcgaccgcggtctcctggggcccctgggccgacggcggcatggtcgcggacggcgacgacgaggagcggctgcgccgccgcggcctccgcgcgatgacccccgcatcggcgatcacctccctgcagcgcgcgctggaccgcgacgagaccctgctgaccgtggccgacgtggactggtcgcgcttcatcgtgccgttcaccctcggccgacccagcccgctgctcggcgacctccccgaggtgcgcgcggcgctcgcggtggacacccccgcggcgggccacggctccggtgcgctcgccgagagcctggccgcgctgtcgcaccaagaccgcgcacgcgccctcgtggacctcgtgcgcacgcacgccgccgccgtcctcggccaccgcggggcgggcgccgtcgaggccgaccggcccttccgggacatcggcttcgactccctgaccgcggtggaactccgcaaccggatcaacaaggccaccggcctctccctgcccgcgacgctgatcttcgaccaccccacggccgcggacctcgccgcccacctgctcgccgaactcaccggtggccaacacgaggcggtcgcggcggccgcgaccgcagcggtgctggacgagccgatcgccatcatcgggatggcctgccgctaccccggcggcgtgcgctcgcccgaggacctgtgggagctggtcgcctccggccgcgacgcgatctcccgcttccccggcaaccgtggctgggacgtcgaggcgctctaccacccggaccccgaccaccccggcaccacgtacaccacccagggcggattcctgcacgacgcggacgagttcgaccccgcggtcttcggaatcagcccgcgcgaggccgtcgccatggacccccagcagcgcctgctgctggacaccacctgggaggccttcgagcgcgcccggatcgccccccacgcgatgcgctccaccaccacgggcgtcttcgtcggctccggctaccaggactacaccggccgcccgctcaaggtgcccgacggcgtcgagggctacatccccagcggcaacgcggccagcgtgatctccggccggctctcctacaccttcggcctgcagggcccgtcggtcaccgtcgacaccgcgtgctcgtcctcgctgaccgccctccacctcgccatgcaggcgctgcggggcggcgagtgctccatggcactggccggcggcgtgatggtgatggccggaccgtccgcgttcacgatgtcgagccgacagcgcgcgctgtccgccgacggccgctgcaaggcgttctcctcgtccgccgacggcaccggcttcgccgaaggcgtgggcctggtgctgctggagcggctgtccgacgcccgccgcaacgggcacgaggtcctggccgtcgtgcggggcagcgcggtcaaccaggacggcgcgtccaacggcctgaccgcgcccagcggcaaggcccagcagcaggtcatccggcaggcgctggccaatgcccggctcgccccggacgaagtggacgccgtcgaggcccacggcaccggaacccggctcggcgacccgatcgaggcacaggccctgctggcgacgtacggcaaggagcgttccgagggccgtccgctgtggctcggctcgctgaagtccaacatcggccacacgcaggcggccgccggcgtcggcggcgtcatcaagatggtgatggccatccgcaacggcatcctgccgcagacgctgcacgtcgatgagccgaccccgcacgtcgactgggccggaggaaacgtgcgcctgctcaccgagcagaccgcctggcccgaccaggacaggccacggcgtgcggccgtctcctcgttcgggatgagcggcaccaacgtgcacaccatcatcgagcaggccccgcagaccgcgaccgccgccgaggtcgagcagccccccgcagcgcaggacgcgaccgccgcccagcccctggacgtgttcccgtgggcgctgtccgcgaagaccgaccggtccctgcgcgaacaggcgcgccggctgctgaaccacctcgaccgcaccgaagggctcaccctgcccgacgtcggccgcgccctcgtcaccacgcggacgcaactggagcagcgggccgtggtcgtcggccaggaccggcacgagctgcgggccgggctcgcggcgctcgccgacggcaaacccgcggacaccgtggtccagggcaccgcctcggcctccggcaaggtcgccttcgtcttccccggtcacggctcgcagtggaccgagatggcgcgtgaactgctggacacttccccggtcttcgccgagcaggccaaggcctgcgccgaggcgttcgccccctacctcgactggccgttgctcgacgtcctgcgcgccgagcccgatgcgccggacgtggccgacgtggaggtcgcccaacccgcgctgttcacggtgatggtgtcgctggccgccctgtggcgctcctacggtgtgacgcctgccgccgtcgtcggccactcgcagggcgaggtcgccgccgcgtacgtcgcgggcgcgctgacgctggacgacgcggcgcggatcgtggccctgcgcagccgctcgctgaccaagctcatcggcaagggcgcgatgctcgcgatcgccatgccggccgaacgggtccgagcgaggctggagaagtacggggaccggctgtcggtcgccgccgtgaacgggcccgcggccctgaccgtctccggagagcccgacgcggtcgacgaactcctggcggaactcgaagccgagggcgtgcgcgtgcgcaaggtccgcggcgccaccggcgccgggcactccacccaggtcgagagcctgcgccccgaactgctccacctgttggccccggtcgcgccgggcgcggcggaggtcccgtactactccacggtgaccggcacggtgctggacaccaccaccctcgacgccgagtactggtaccgcaacgccaggcacacggtggagttcgaatggaccgtacggacgctgctggcggacgggcacggggtgttcgtcgagtgcagcccgcacccgctgctggccgacgcggtgcaggagatcgcggaggagaccggtgccgacgccgtgaccggctcctcgctgcgcaggggccagggcggcatggaccgcttcctgcgctccgtgtccgaactgcacgtgagtggcgtgcacgtggacctgacggccccctttgccgggcgtccggtacggcgcgtggacttgccgacgtacgcgttccagccacagcggtactggctggagagcgccgacccggtgcctgcgggcaccgatccggtcgaggccggattctgggagctcgtggagaacacggacctctccgggctcgccgatgaactcggggcggacgacgccgccctcgtcggcccggcgctgccggtactgtccgcgtggcgtcggcgcagccgcgagaagtccacggtggacggctggcgctaccgcgtctccttccggcgactgaccgaccacgcggcccccggcctgaacggtctgtggctcgctgtcctccccgccggactggcggacgagcagtgggcgccctgcgtcgtcggcgtgctcgccgcccatggcgccaaggtgcgggtcgtcgaactccctgtcgactgcgaccgatcgcaggccgcgaagcggctcgccgaggaactccgcggcgaacagcccgccggtgtcttgtcgatgctcggcctcgcccccggctgccacccggcccaccccacgttgtccgcgagcctcgccacgaccgtcaccctgctgcaggcgctgggcgacgtggacgtccaggcaccgctgtggtgtgcgacccgcggagccgtgtccaccggagtcaccgacccactgcgcgacgccggccaggcacagctctggggcctgggcgtcgtcgccgcactggaactgccccggcgttggggcggtctcgtcgacctgcccgaggagctggacgagcacgcgctgcgccgcctggccggagtgctggcccagcacgacgaggatcaactcgccgtgcgtgtcgacggcgtgtacggccggcgcatggtccgggcgcggcccgccgacgaggagtccgcgacaccgtggaagcctcgcggcaccgtcctgattaccggcggaaccggcggcgtgggccggcacctggcccgttggctggccggcgcgggcgcgcaacacttggtgctcaccagcaggagcgggcctgacgcccccggtgcgcaggaactgcacgcggagctgaccgccctgggcgccgaagtgaccatcgccgcctgcgacatggccgaccgcgctgcggtcgcgcggctactcgccggcatcgagtcccggcacccgctcaccgcggtgctgcacgccgccggcacggcacggtcgtccatgctggccgacgccggtctcgacgagttcgccgaagccgcggcctccaaggtcaccggcgccatccacctcgacgagttgctcgacggccgtgagctggacgccttcgtcctcttcgcctccggtgccggcgtctggggcagcggtgggcaggcctcctacgcctccgccaacgccttcctcgacgccctggcactgcggcggcgggcccgcggcttgaccgcgacctcggtcgcctggggcggctgggcgggcggcggcatggtcgacgacgcggtccaggagcgcggcgagcggcggggcctgggcgtcatggcccccgagctcgcgatctccgcgctgcgcgaggccgtcgagcacgacgaggcggccctcaccgtcgccccgatcgactgggagaagttcctgcccgccttcaccgtgggacggcccagcccgctgctggccgacctgcccgacgtacagcggctcctggaggccgagcaggccgtcggcgaggggaccagcgccggagcggcgctggcgaccgagctcgccgctctcgccccggtcgagcaggaggagcggctgctggaacacgtccgcgcccagagcgccgtggtcctcgggcacgcgtcggccgaggacgtgctgcccaccgcgcacttcctggagctcggcttcgactcgctcaccgcgatcgacctgcgtcggcgactgtcggcggcgaccggtctgcgcctgccctccggactggccttcgaccatcccacgcccgccaggctcgccaagcacctgttgacgcggctccagagcaccggcagcgccgcggcggaggaacggcccgccgacatgctggtccagctctaccggcacgcgagcgagaacgggacggccgccgaggccatggggatgctgatggaggcggcccgcttccggccgtcgttcgagcggcccgaggaactggaccggcggcccgccccggtgcggttgtcgcaaggcgaccatcccctcgcgctgatgtgcttctcgccgtacgtcgtaccggccggggcgcaccagtacgcgcggttcgccgcacccttccgcgaccggctggacgtgtgggcgctggtccaccccggctacgagaagggcgagccggtcccgtccgacccggacgtcgtgttccggctgcacgcgcagaccgtacgggagtgtgccggcggaaagccggccgtcctgctcggctactcctcgggcggctggatcgcccacggcgtggcggcacacctggaagccatgggggagcggccggcggccgtggtgatggtcgacagcttcagccgcgaggtccccttcgaccaccaggtgctcaacgcgatggcccaggcgcactcgcagcgcctggacttcatgaggtccggcggcgaacagctcaccgcgatgggccgctatatgcgcctgttcgacgactgggccgcgccgcagatcgccgcgccgaccctgctcgtacgggcgagcgagcccatgctggccggcgccggtgacggtgacgggcgcgcggcaccgcccgagcacgtggacacgatcgtcgaagtgaccggaaaccactactcgatgttggaggaccacgccggcaccaccgcggcggcggtggattcctggctggcggacgccgtcaccgatgcgtccggccccgtagcacctgcggacgcaacgaccgca

SEQ ID NO: 412 - DNA, 18435 bp, Streptomyces avermitilis
  CDS (1)..(18435)
gtggacctgagccagacccgcaggcagctgggtgagctggaggcgaaggacaccgagcccatcgccatcgtcgggatggcctgccgctacccgggcggcgtcgcctcgcccgaggaactgtggcaactggtcgcctcgggcggcgacggcgtgtccgggttccccaccgaccgcggctgggacctggacacgatctacgaccccgagcccgggcggacgggccgcacgtacgtgcgcgaaggcggcttcctctacgacgccggcgagttcgaccccgcgttcttcgggatctccccccgcgaggccctggtcatggacccgcagcagcggctgctcctgcagacctcctgggaggccctcgaacgcgcgggcatcgaccccgtcaccgcacgcggcacccgggccggcgtgttcgtcggcaccaacggccaggaccacgcctaccttcagcggcagggcgacagcgacagcgaggcccacctcgtcaccgcgaacaccgccgccgtggtgtccggccgcatctcctacgccctcggcctcgaaggcccggcggtcaccgtcgacacggcctgctcgtcctcgctggtggcgctccacctggccgcccaggcgctgcgccgcggcgagtgctcgctcgccctggcgggcggcgtgaccgtgatggccacgccgaacaccttcatcgcgttcagtgcgcagcgcggcctgtcgcccgacggccgctgccgcgcgttctcctcgaccgccgacggtacgggcatgtccgaaggcatcggcgtgctcctgctggagcggttgtccgatgcccgtcggctcggccacgaggtgctcgccgtcatccgtggcagcgccgtcaaccaggacggcgcctccaacgggctcacggccccgaacggtccctcgcaggagcgcgtgatccggcaggcgttggagaacgcgcgcctgaccgcctcccaggtcgacgcggtcgaggcgcacggcacggccaccaccctcggcgacccgatcgaggcggaggcactgctcgccacgtacggacaggagcactcggacgaccggcccctgtggctgggatccatcaagtccaacatcggtcacacgcaggccgccgcgggtgtcgccggtgtgatcaagatggtgatggccatccgcaacggagtcctgccgcagacgctggacgtggacgagccgaccgctcaggtcgactggtcggcgggcggcgtgaagctgctgaccgaggccgtcgcatggcccgagtcggaccacccccgccgggccgcggtctcgtccttcggcgtcagcggaaccaacgcgcacacgatcatcgagcaggccccggccctcgaccgggagcccgccgccgagccggccggggccccggccgccggcgcgctgccgtgggtgctctcggcgaagagcgacgcggcgctgcgcgcccaggcagagcgcctgctctccttcctggaggacggccggagcggcgggaccggccccggccgctcgccggccgacatcggcttctccctcgccacgacgcgcaccgcctgggaccgccgggcggccgtcgtcggcgagagcctggaggaactcaccgaaggcgtaagggcactggcctccggcaccccgtccgctgccgtcgtccgcaacgcggcccgccacggcgacaagaccgggttcctgttctcgggtcagggttcgcagcggttggggatggggcgtgaactctacgacgccttcccggtgttcgccgcggcctacgacgagatccgcgcccacctcgacgtcgccctcgacgcggacgcggagcagctcaaccagaccggttgcacccagccggcgttgttcgctgtcgaggtggcgctgtttcggctgttggagtcgtggggtgtccggccggattatgtggcgggtcattcggtgggtgagattgcggctgctcatgtggcgggtgtgttgtcgctcggggatgcggcgaggctggtgtcggcgcgtgccgcgttgatgcaggccctgcccgctggtggggcgatggtggcggtgcaggcggccgaggacgaggtggtgccgcatctcacccacggcgtcggcatcgcggcgatcaacgggccgcggtcggtggtggtctccggtgccgaggatgcggtgctggcgatcgtcgaggtcttcacccaacagggctgtaagacctcccggttgatggtcagtcacgcgttccattcgccgttgatggatccggtgctggaggagttcgcggaagtcgttcgcggtctgacgttcagtgagccgcggattcctgtggtcgcgaatctcaccggtcggttggccgaggcgtacacgcccgagtactgggtgcggcacgtccgcgaggcggtgcgcttcgccgacggcatcgagaccctcggcgagctgggcgtgaccaccttcgtggagatcggtcccggcggcgtcctcagcgccctcgtccagggctgcttcgacgacggcacagacatcgtcaccgttccctccctgcgcgccgaccgccccgagccgtacgcgctcgtcaccgcgctcgccgaactgcacgtcagcggcgccgaattggactggcacgccttcttcccgggcgcccgacgtgtcgacctacccacgtacgccttccaacagcagcgctactggctggaggcccgcgaggccgagacggccaccgtggacgcggtcgacgccgagttctgggcgagcgtcgagagcgaggacgcgcagtccctcgccgccacgctggggctgaaccccgaggaactggacgtcgtggtaccgaagttgtccgcctggcggcgccggcggcgcgagcagtccgtcgtggacggccggcgctaccagctggcctggcagccgctgaacggcctctccgccggcgacctctcgggcagcacatggctgttcgccgcgcccgaaggtgacgagtgggccgggacggtccgcacggcactcgccggacgcggcgcgcacctgatcccgctgacggtcggcgccgacgccgaccgcgcgtccctgaccgatgagctgacccgggtcgcgggcgaagccggatcgctcgacggcgtcctgtccctgctcgcgaccgacgagatcgcctcgcccgaacaccccgcgctctcccagggcttcgcgcagagcgtggccctggcccaggcacttggcgacgcgggcgtcgacgcgccgctgtggtgcgccacccgcggcgcggccgccaccggccgctccgacgacgcaccgctcagcgcggtgcagaaccaggtgtggggcctcggccgtgccctggccctggagcacgcccggcgctggggcggcctgatcgacctgcccgcggccgtcgacgagcgcgccgccggccgtatcgccgccgtactgagccagggagccgacgctgcggacggccaggaggaccaggtcgccgtccgcgccaccggcgtgttcaccgcccggctcgcccatgcccgaagcggcgtcggccgtccgtggtcgccgcgcggtaccgtcctgatcaccggtggtacgggtgcgctgggcgggcacgtcgcccgctggctcgccggtgccggagccgaacacctggtgctcaccagccgccgcggcgccgacgcgcccggcgcgaccgcgctcaaggccgaactggaggagctgggagcgcgcgtcaccctcgccgtgtgcgacgtcgccgaccgcgacgcgctggcggcgctgctcgccgagcacaccttcacctccgtcttccacgccgcgggcgtggaacagttcgcccccttcgacgagctgacgccggccgacttcgcccgcacgatggcggcgaaggcccacggtgccgcacacctggacgaactgctaggcgaccgcgagctggacgcattcgtcctcttctcctcgatcgccggcgtgtggggcagcggcctgcagaccgcctacgcggccggcaacgccttcctcgacgggctcgccgcccggcgcagggcccggggtctgaccgccaccgcgatcgcctggggtccctgggcagacggcggcatggtcaccgacgccgacgaagcgcacctgcgccgccgcggcgtcgtcaccctgcccgccgcactcgccgtgaccgcagtccagcgcgccctggactgcgacgacaccgcggtcgtcgtggccgacatcgactgggaacggttcatcggaccgttcaccttcggccgcccgagcgccctgctgtccgagctgcccgaagtgcgccgcgccggcgccgtcacagcggccgtcaccgcggcgccggccgacgtcggcgccacgcccctggcggcccggctcgccggactgccggaggccgagcgcacacacaccctgatcgacctggtccgcgcgcacgtcgcggccgtgctgggccactcctcggcggcggaggtcgagcccgaccgggccttcaaggccctcggcttcgactccctgaccgccgtcgaactccggaacaaggtcaacacggcgaccggcctcgcgctgtcgcccacgctggtcttcgactaccccaacgccacggcgctcgcccgcttcctgcagagcgagctgctcggatcgcaggccgtcgtggagcaggagcagcacgcggccgccgacgacgagcccatcgccatcgtggcgatgagctgccacctgcccggcggcgtcgactcgcccgaggcgctgtgggacctggtgacgtccggcggcgacgccatctccgagttcccgtcgaaccgcggctgggacgtcgaggccctctacgaccccgaccccgatcgcccaggcaagacgtacgcgcgcgacggcggattcctttatggcgccaccgacttcgacgccggcttcttcgggatctctccgcgtgaagcgctggccatggacccgcagcagcgcctgatgctggagacctcgtgggaggccttcgagcgggccgggatcgcccccgcgcagctgcgcggtagccggaccggcgtcttcgtcggcatggcctaccagggctacggagccgatgtgcgccgcacgccggaaggcgtggaaggacaccggctcgtcggcggcgcgtccagcgtcgtctccggccgggtggcctacaccttcggactcgaagggcccgccgtcacgatcgacacggcctgctcgtcgtccctggtcgccctgcacctggccatgcagtcgctgcgcaacggcgagtgcacgatggcgctggccggcggcgtcaccgtcatggccggcccgagcgtcttcgtggagttcagccgccagcgcggcctgtcgcccgacggccgctgcagggcgttcggcgcggacgcggacggcaccggctgggccgagggcgtcggcatgctcctggtggagcggctgtccgacgcccgccgcaacgggcaccaggtgttggccgtcgtccgcggcagcgcggtgaaccaggacggtgcgtccaacggtctgaccgctccgaacggtccggcccagcagcgggtgatccaccagtcgctggcctcggccgggctcgctccgcgtgacgtggacgcggtggaggcgcacggtacggggacgaggctgggtgacccgatcgaggcgcaggcgctgctcgccacgtacggccagggacgggacggcgaccggcctttgtggctgggctcgttgaagtccaacatcggccacacgcaggcggccgcgggtgtcgccggtgtgatcaagatggtcatggcgatgcgccacggcatcctgccgcggacactgcacgcggacgagccgacgccgcacgtggactggtcggccggtgatgtccggctgctgaccgaggccgtcgactggcccgagtcggaccgcccccgccgggccgcgatctcgtccttcggtgtcagcggcaccaacgcccacaccatcatcgagcaggcccccgccacggcggagctgccccccacgcccgactccggcgcgctcgtgccgtgggtgctgtcgggcaagggcgagccggcgctgcgcgctcaggcggccaggctggccgaccacctcgacgcgaacgacggctggacggcttccgacatcggcctctcactggcctcccgcgagacgttcgaggaccgcgcggtgctcctggcacagggctcggacaagctccggcaagccctcaccgccctcgccgccggtcaaccggcggcgaacgtgacgctgggacgagcccgctccgagggcaaggtcggttttctgttctcgggtcagggttcgcagcggatcggtatggggcgtgagttgtatgaggcgttcccggtcttcgccgatgcgtacgacgaggtgtgtgcgcgtctggaggcgccggtcgacgtcgacgccgagaccctgcatcgaacggggtgcgctcagcccgcgctcttcgcggtcgaggtggcgctgttccggctgctcgaatcgtggggtgtgcggccggattacgtggccggtcactcggtcggtgagatcgcggccgcgcatgtggccggggtgttgtcgttggacgacgccgtgaggttggtgtcggcgcgtgccgcgctgatgcaggccctgcccgtcggcggcgcgatggtcgcggtccaggccactgaggaggaagtgctgccacacctgaccgacgaggtcggcatcgcggcgatcaacggcccgcggtccatggtgctttccggcgctggcgaggcggtcaccgcaatcgccgaggtcttcgtcggccagggccgtaagacctcccggttgaaggtcagtcacgcgttccactcgccgctgatggacccgatgctggaggagttcgcggaggtcgtccgcggtctgacgttccatcagccgcaggtcccggtggtctccaacctcactgggcgcctggccgagccgtactccccggagtactgggtccggcacgtgcgcgaagcggtgcgcttcgccgacggcatcgagaccctcggcgagctgggcgtgaccacgttcgtggagatcggccccggcggcgtcctcagcggcatggtgcaggactgcgtggacgaggccgtcaccgtgcccgtcctgcgcggtgaccgccccgagcagcaggccgtcgtcaccgcgctcgccgaactgcacgtgcacggcgtctccccggactggcaggccctgttccccggcgctcaccgcgtcaccctgcccacctacgctttccagcgcgagcgcttctggctggacggggagggggacctggccgctgccggcaccccgaccgacgcggcggattccggcttctgggacagcgtggagcgcgaggacgcggagtccctcgccgcgaccctgggcgtcagcgcggacgcctcgctcggcgcgatcctgccccggctgtccgcatggcgccgtcagcgccgcgagcagtccgtggtcgacggctggcgctaccgcgtcacctggaagccgctcggcgcgctccctcagcccggcgcgtccgggacctggctgctcgtcgtggccggcgagagcgagtggaccgcctcggtccgcaccgcgctcgacgagcgcggcctggaactggtgacgctcgtcgccggacccggcaccgaccgcgggacgctggcccgcgagctggccggcgtcggcccggtgaccggcgtgctgtccctgctcgccgaggacgagagcgcctcggccggcgaccccggcctgtcgcacggcctcgccgcgaccctctgcctggtgcaggcgctcggcgacgtgggcgtcgacgtcccgctgtggtgcgccacgcgcggcgcggtggccaccggccgctccgaccgcgtggaccgcccgctgcagtcgcaggtgtggggcttcggccgggcggcggcgctggaacacccgcggcgctggggcggactgctcgaccttcctgagctgctggacgcccgcaccgcggcccgcgtggccgccgtcctcggtcagacggccgaggaccaggtggcggtccgcgcctcgggcgtcctcgggcgccggctcgtccgggccgcccgcgccaccggccccgcccaggggtggtcgccgcgcggcacggtgctgatcaccggtggtacgggtgcgctgggcgggcacgtcgcccgctggctcgccggtgcgggtgcggagcacctggtgctcaccagccgccgcggccccgcggcgcccggcgccgcggagctcgtcgcggagttggaggagctcggcgcggccgcgaccgtcgtggcctgtgacgcggccgaccgtgacgccctgcgggcgctgctggcccagcaccccgtcaacgccgtcgtccacgccgccggcgtcggcgaccacgtcatgatcgaggactccgacccggccgggttcgccggctcggtggcggccaaggccgcaggtgccacgcacctggacgaactgctggccggtcaggaactcgacgcgttcgtcatgttctcctcgggcgccggcatctggggcggcgccggccagggtgcctactcggcggccaacgcctacctggacgccctcgccgagcatcggcgggcacacgggcgcaccgcactcgccgtctcctggggcggctgggccgagggcggcatggccggtgtcggcgacggagaggagatgctgcgccgccgcggcctgccccccatgcggcccgccctcgcgatctccgcgctccagcaggcgctggccgacggcgagaccgccctcaccgtcgcggacttcgactgggagcggttcatcggcccgttcaccgtcacccgccccagcgccctgttctccgacgtgcccgaggcgggccgcgccctggaggcgccggcccccggcggcgccgaagccggcaacgcgctcgccgcgaagctgaccgggctgccggcggccgagcaggaccgcacgctggtggacctcgtccgcacgcacgcggccgccgtgctcggccacgacggcaccgcggcggtggagcccggccgcgctttcaacgacctcggcttcgactcgctcagcgccgtcgaactgcgcaacaagctcacggccgacaccggcctgaagctgcctaccacgctggtcttcgactaccccaacgccacggccctggcccgcttcctgcgcgccgaactgctcggttcgcggggcgccgcgcggcaggagcagcgcacggccgccgtcggcgacgaacccatcgcgatcgtggccatgagctgccgcctccccggcggcgtcggctcgcccgaggacctgtggcagctcgtgacgtccggcggcgacgtgatctccggcttccccgaggaccgcggctggaacgtagaggccctctacgaccccgacccgggcaccccgggcaagacgtacgcgcgcgacggcggcttcctctacgacgcgggcgacttcgacgccgcactgttcgggatctcgccgcgcgaggcgctcgcgatggacccccagcagcgcctactgctggaggcctcgtgggaagcgttcgagcgggcgggcatcgacccggcctccctgaagggcagccgcaccggcgtgttcgtcggcatgtcctaccagggctacggcgcgggcctcccgcaggtcccggaaggcgtcgagggccacctgctcaccggcagcgccgcgagcgtcgtctccgggcgcgtagcctactcgttcggactggagggcccggccgtcaccgtcgacacggcgtgctcgtcgtcgctggtcgccctgcacctggccatccagtcgctgcgcaacggcgagagcacgatggccgtcgccggcggtgtgaacgtcatggccgtaccggctgcgttcgtggagttcagccgccagcgcgggctggcccctgacggacggtgcaaagcgttcggcgccggcgccgacggcaccgggtgggcggagggcgtgggcgtggtgctcgtggagcgcctcagcgacgccgtgcgcaacggccacgagatcctcgcggtcgtgcggggcagtgcggtcaaccaggacggcgcgtccaacggtctgaccgccccgaacggcccggcgcagcagcgggtcatccggcaggccctggcctccgccgggctcaccgaggccgacgtcgacgcggtggaggcgcacggcacgggcaccgctctgggtgaccctatcgaggcgcaggcgctcctcgccacctacgggcaggagcgcccggaggaccggccgctgtggctgggctcgctgaagtccaacatcggtcacgcccaggcggcgtccggcgtggccggtgtgatcaagatggtgatggcgatgcgccacggcgtccttccgcggacgctgcacgctgatgagccgacgccgcacgtggactggtcggcgggcgcggtgcggctgctgacggaggccgtcggctggccggatacgaaccgcccgcgccgcgccgcgatctcgtccttcggcgtcagcggcaccaacgcccacacgatcatcgagcaggccccggtggccgaaccggccgccgtcgcaccggtcgaggtctcctcggcgaccgtgccgtgggtcctgtccggcaagtccgaggccgcactgcgcgcccaggccgagcgcctgctgaccctcaccgccgacggcgccgaaccgtccctcaccgacgtcggcttctcgctggccaccacccgggccgccctggagcaccgcgccgccgtggtcggtgccgaccacggccggatcgccgagggcctgcgggccctggcctcgggggcgcccgctcccggcgccgtcctcggccgcgccgacgccggccaggtcggattcctgttctccgggcagggctcgcagcgcatcggcatggggcggcaactgtacgaggcgttcccggtcttcgcggaggcgtacgacgaggtgtgtgcacacctcgaccggcacctcgaccggccactgcgggacgtggccttcggcgagaatggtcacgaggacggcgaggagctgaaccgcaccgccttcacgcagcccgcgctgttcgcgcacgaggtcgccgtccaccgcctgctggagtcgtggggcgtgcggccggactacctggccgggcactccgtgggcgagatcgcggccgcacacgtggccggggccctggcgctggaggacgcggccgcactggtgacggctcgtgccgcgctgatgcaggccctgcccgccggcggggcgatgatcgccgtccaggccaccgaggacgaggtgctgccgcacctcaccgacgacgccggcatcgcggcgatcaacggcccgcagtccgtcgtggtctccggaaccgaggacgccgtagccgccgtcgcggacttcttcgcccgggagggccgcaagatttcccggctcaccgtgagccacgcgttccactcgccgctcatggaccccgtgctggaggacttcgcccgcgtcgtcggcggtctgcgcttcgagacgccccggacaccggtcgtctcgaacctcaccggtgagctcatcgacgcgtacacggcggactattgggtccggcacgtccgcgaggccgtccgcttcgccgacggcatccggaccctgggcgagctgggcgtgaccacgttcgtggagaccggccccggcgcggtgctgagtgccatggcccagggctgcctggacggcgcggtcgccgttgcatccgcccggtccggcagccccgagcccgaggcgatcaccggcgctctcgcgcagctccacgtgcacggcgtccccgtcgactggcgggcgttcttcgccggccgcggcgcccggcgcgccgacctgcccacctacgccttccagcaccagcggtactggctggagaccaccgcgcccacggccgccgcggggaccgacgccgtggagaccgggttctgggagaccgtggagcgcgaggacgcccagtccctcgccgccaccctcgaactgcccgtcgagcaactggacgcggtgctgccccggctgtccgcgtggcgccggcagcagcgccgggagtccgccgtggaaggctggtcctaccgcacgggctggaagccgctcagcggcctccgggcgcacgaactgcggggcaactggctgttcctggtcaccgaggacaccgaggccttcgaggccttcgagtggaccgccgccgtcgccgacgggctcgccgcccgtggggcccggctggtccgggtgacggtcgacccggccgccgaccgcggcgcactgctgcggcagctcggcgaggccgtccgggagagcccgctcgacggtgtgatctccctgctcggcatcgacgagaggcaccacgccggacacccggctctgtccgtcggcaccgtgctgaccctcgcgctcgtccaggccctgggcgacgcgggcatcgacgccccgctgtgggcgctgaccaggtccgccatgtccaccggccgggcggacgcggtgccgagcgccgcccagaacgccgtctggggtctgggccgggtggcggcgctggagcacgcgccgcgctggggcggtctgatcgacctcccggacacggttgacgaccggatcgccggccgactggccgcggtgctcgcccagtcggccgaggaccaggtcgcgatccgcgaccgcggcgtgttcggtcgcaggctgtcccacaccgccgcccgccggaacacccgggccgcccaggggtggtcgccgcgcggcaccgtgctgatcaccggcggtacgggtgcgctgggcgggcacgtcgcccgctggctcgccggtgccggtgccgaacacctggtgctcaccagccgccgcggccccgacgcgccgggcgcggcgggtctcgtcgcagagctggaggcgacgggtgtccgtgtcaccgtcgccgcgtgcgacgtcgccgaccgtgaggcgctcgccgcgctgctcgccgagcacccggtgaacgcagtcgtccacacggcgggcgtggaccacatggagccgctggaggccatgacgccgggcgcctgcgccgatgtgctgtccgccaaggctgccggcgccctgcacctcgacgcgctcctcgccggccaggaactcgacgccttcgtcctcttctcctccatcgccggcgtgtggggcagcggccaccaggccgcctacgcggcggccaacgccctgctcgacggactcgccgaacgccgccgggcccaaggcctgccggcgaccgccgtggcctggggcccgtgggccggcggcggcatggccgaggccgacggcgcggacgaacgactgcgccgccgcggcctgatcccgatgcccgccgcgctcgccgtggccgggctccggcgggcgctggactccggcgaggcgaccgcaacagtggccgacgtcgactgggagcggttcctgcccccgttcaccgtgggccgcccgagcgccctgctcggggacctcccggaggccgagcggatcctcaccgcggacagcaccgccggcgggcccggcacggccgccgcctcgcccctggccgaccgcctcgccaggatgcccgagaccgagcagcacgcgctgctggtcgatctcgtccgcacacacgcggcggccgtcctcggccacaacaacgccggcgaggtcgaggccgaccgagccttcaaggacttgggcttcgactccctgaccgccgtagaactgcgcaacaagctcaaagccgagaccggcctcgcactgccccccacgctggtcttcgaccaccccaacgcccaggcactcgcccggcagctgcgcaccgagctcaccggcctcaccatcgcggccgctccggaagcggccgccgcgcccgccgaggacgaggagcccatcgcgattgtcggtatggcgtgccggtatccgggcggggtgcgttcaccggaggacctgtggcacctggtggcggccggtggtgacgcggtcggcgacttcccggcggaccgcggctgggacgtggaggacatctacgacccggacccggatgcgagggggaagacgtacgcgcgtcgcggtggattcctgtacgaggcgggggagttcgacccggggttcttcgggatcagcccgcgggaggccgtggcgatggatccgcagcagcgcctgctgctggagaccacgtgggagacgttcgagcgggccggcatcgacgcggagtcggtgcgcggcagccgtaccggagtcttcgtcggctccggctaccaggactacgccgcccgggccttcaacgcgatagacgattccgagggcttcttcggcacgggcaactcggcgagcatcatgtctggccgtatcgcctacaccttcggcctggagggcccggccgtcaccgtggacacggcgtgctcgtcgtcgctcgtggccctgcactgggcgatccaggccctccgtaacggcgagtgctccatggcgctggccggcggcgtgatggtcatgtccaccccgcgtgccttcgtggagttcagccgccagcgcgggctggcccctgacgggcggtgcaaggcgttcggcgcggacgcggacggcaccggctgggccgagggcgtcggcatgctcctggtcgagcggctgtccgacgcccgccgcaacgggcaccaggtgttggccgtcgtccgcggcagcgccgtgaaccaggacggtgcgtccaacggtctgaccgcgccgaacggtccggcgcagcagcgggtcatccgccaggcgctcacttccgcgggcctcaccgccgccgacatcgacgcggtggaggcgcacggtacggggacgaggctgggtgacccgatcgaggcgcaggcgctgctcgccacgtacggccaggagcggcccgcaggacagccgctgtggctggggtcgctgaagtccaacatcggccacacgcaggccgcggcgggtgtggcaggtgtgatcaagatggtcatggccatgcgtcacggagtgctcccgcagactttgcacgtcgatgaacccacgccgcatgtggactggtcggccggtgacgtgcggctgctgacggaggccgtcgcatggcccgagtcggagcgcccgcgccgtgctgccgtgtcgtccttcggcgtcagcggcacgaacgcccacacgatcatcgaacaggccccgccggtcccggccgaagaggccaccgtcactccggccccggccctcctgccgtgggtgctctccgccaagagcagcgctgcgctgcgggatcaggcacgacgactgctggccttcgtggaggacggcatgtcactggccgatgtcggcttctcgctggccaccacccggagcgccctgcgccacagggcggcagtgatcggcgagagcggtgacggcttccgccgcggactgggatccctggccgccggaatgccctcgcccggagtcgtccagggccggccgggaggcaaggtcggttttctgttctcgggtcagggttcgcagcggatcggtatggggcgtgagttgtatgaggcgttcccggtcttcgccgatgcgtacgacgaggtgtgtgcgcgtctggaggcgccggtcgacgtcgacgccgagaccctgcatcggaccgggtgcgcccagcccgcgctcttcgcggtcgaggtggcgctgttccggctgctcgaatcgtggggtgtgcggccggattacgtggccggtcactcggtcggtgagatcgcggctgttcatgtggccggggtgctgtcgctggacgacgcggtgaagctggtgtccgcgcgggccgcgttgatgcaggccctgcccgcgggcggtgcgatggtcgcggtccaggccactgaggacgaggtgttgccgcacctgaccgatggcgttggcatggcggccatcaacggtccgcggtccgtcgtggtctccggagccgaggatgccgtgctggagatcgccgaggtcttcacccgacagggccgcaagacctcccggttgaaggtcagtcacgcgttccactcgccgctgatggacccgatgctggaggagttcgcggaggtcgtccgcggtctgacgttccatcagccgcaggtcccggtggtctccaacctcactgggcgcctggccgagccgtactccccggagtactgggtccggcacgtgcgcgaagcggtgcgcttcgccgacggcatcgagaccctcggcgagctgggcgtgaccacgttcgtggagatcggccccggcggcgtcctcagcggcatggtgcaggactgcgtggacgaggccgtcaccgtgcccgtcctgcgcggtgaccgccccgagcagcaggccgtcgtgacggccctggcccatctgcacacgcacggcatgtccgtggactggaacgtgttcttcgccggtgcgcggaaggccgacctgccgacctacgccttccagcacgagccgtactgggtcgacgccccgcaaatcgctgccgccgccgaagcggaaccggtggacgcggagttctgggagaccgtggagcgcggggacctgcaggccctcgccgagaccctcggcgtcggtgcaggggacaagttcggtgacgtactgccgaggctgtcgtcgtggcggcggcagcgcaaggagcaatccaccgtggacacctggcgctacggcgagtcgtggaaagggatacccgaccgcgtcccggagggccctgcccggatcggtctatggctggttccggtcagcgctgcgcaactcggcgacgattgggtcaccgcctgcctccgcgggctgaccgagcgtggcctggccccgctgccggtcccggtcgagccggccaccggccgtgaggacctggccgcgcagctcacccgagcggccggtgacgaaaccgtggcgggcgtcctgtcgctgctcgccgtcgactgcggggccgccccggcagccgccgcactgaccgtcggcgtcgcgctgtccgtcctgctcgtccaggccctcggcgacgcgggcatcggagccccgctgtggtgcgtgacccggaacgcggtgggcgtgagcaccgccgacgaggcgacggacccgtaccagtcccaggtctggggtctgggccgggtggcggcgctggagcacgcgccgcgctggggcggtctgatcgacctcccggacacggtcgacgaccggatcgccggccgactcgccgcggtgctcggccagtcggccgaggaccaggtcgcgatccgcgaccgcgggctgttcgtgcggcgcctgtcgcgtctgcccgcagccctgagcgagcgttcgtggtcgccgcgcggcaccgtcctgatcaccggtggtacgggtgcgctgggcgggcacgtcgcccgctggctcgccggtgcgggtgcggagcacctggtgctcaccagccgccgcggccccgcggcgcccggcgccgccggcctcaaggccgagctggaggaggcgggcgtacgcgtgaccgtcgccgcgtgcgacgtggccgaccgtgaggcgctggccgtgctgctcgccgagcacccggtgaacgccgtcgtccacacggccggcaccgccgaggcgggcatgctcgccgagacgagcctcggcgacttcgcggcgacggtcgccgcgaaggccctcggggccgtgcacctccacgaactgctcggcgatcaggagctggacgcgttcgtcctcttctcctccatctccggcgtgtggggaggcggcgggcaggccgcgtactcggccgcgaacgccttcctcgacggcctggcgcagcaccggcgggcccgcggcctcgcggcgaccgcgatcgcctggggcccgtggggcgagggcggcatggtcgccgacgccggggacgaggagcggctgcggcagcgaggtctgagcgtgctgcggccggaccgggcgatctccgcgctgcacggtgcgctgagcggcggcgacggcacggtcaccgtggccgacgtggactgggagcggttcgtcgtcccgttcaccatcggcaggccgagcgcgctgctgagcgacctgcccgaggtcggggacgccctcgcggagaagcgcaccgagcgagccgcggagccgtccgcgctcaaggcgaagctgtccacactgtccgaaggcgaacggcaacgcctgctcgtggacacggtgtgcgcgcacgcggcggccgtgctcggccacagcggctccgcggcggtggatccggacctggcgttccgggacctcggcttcgactccctgaccgcggtggagctgcgcaacctgctcagtgccgacaccggcctgaccctgcccgcgacgctggtcttcgaccacccgacgcccgaggcgatcgcccgctacctgcggagcgaactcgccgacgagacgggcccggaggaggtgtcggtcttcagcgagctcgaccggctggagtcggtgatctcgacggccgcctcggccgagcagacggtccggtcgggggtgcggaggcggctgcaggaactgctgtccctggtgaactccgccggagagcaaggcgcggaatccgccgatgcgcagcgacagctccaggacgcgacgatcgacgacattttcgatctgatcgatcaagatctagaaatttcc

SEQ ID NO: 413 - DNA, 5505 bp, Streptomyces avermitilis
  CDS (1)..(5505)
atgaacgaagacaagctccgggactacctcaagcggaccaccaccgacctgcgccaggcccggcggcgcgtgcgcgagctggaggcccgcgcccaggagccgatcgccattgtgggtatgagctgccggttccccggcggcgtcggctcccccgaggagctgtggcggctgctggccgagggcgaagacgccatctcgcagttccccgtggaccgcggctgggacgtcgacgcgctctacgaccccgaccccgagcagcccggcaaggtctacacccggcagggcggcttcctgcacgacgcggcggacttcgacgccgaattcttcgggatttcgccgcgcgaggcgctggccatggacccgcagcagcggctgctgctggaggccgcgtgggaggccttcgagcacgcgggcatcgaccccgccggcctcaagggcagccgcaccggcgtcttcgccggtctgatgtaccacgactacggcttcacgcccggcgtcctccccgaaggggtcgaggggctgatgagcaccggcaactccggcagcgtcgcctccgggcgcatcgcctacaccttcggcttcgagggccccgcggtcaccgtcgacaccgcctgctcgtcctcgctcgtcgccctgcacctcgccgtgcaggcgctacgcaccggcgagtgctccatggcgctcgccggcggcgtgacggtcatggcgggcccgagcgccttcgtcgagttcagccgccagcgcggactcgcccccgacggccgctgcaagtccttcgcggcggcggcggacggcgcgtcctggtccgaaggcaccggcctgctgctcgtggagcggctgcgggacgcccgccgactcggccacaaggtgctcgcggtcgtccggggcagcgccgtcaaccaggacggcgcgtccaacggcctgaccgcgccgaacggcccctcgcagcagcgcgtgatcctcgaagcgctggccggcgcccggctgtccgccgaggaggtcgacgccgtcgaagcacacggcacgggcaccagcctcggcgacccgatcgaggcgcaggcgctgctggcgacctatggacaagagcgcgaacggccgctgctgctcggctcgctgaagtccaacatcggtcacacgcaggccgcggcgggtgtcgccggtgtgatcaagatggtgctggcgatgcagcacggcgtgctgccgaagaccctccacgtggaccggccgaccccgcgggtcgactggtcggtcggctcggtcgacctgctgacggaggcgatcgcgtggccggagacggaccaccctcgccgggccggggtctcgtcgttcgggatcagcggcaccaatgcgcacatcatcctcgagcaggcgcccgaaccggaggcgggggacccggccgatgacacggctgaaggcgagggcgtggccgaggaactgctgcgggcccggaccacggtggtgccgtgggtactctccgcgaagaatggggcggcgctgcgagagcaggcacaacgactgctgtcgtccgtggacctcgcggccgcgtcaccggccgacgtcgggttctcgctggcggccacccgctcggcgctggagcaccgggcggcggtcgtcggcgccgacggggaagagctgcgcgcgatcctgaccgccctcgcggcgggcgagcccgcggcacaggtggtgacggggcgcgccggggccgaccggggcaaggtcgggttcctgttctcgggtcagggttcgcagcggatcggcatggggcgcgagttgtacgaggcgtaccccgtgttcgccgcggcctacaacgaggtgtgcgcgctgttggacttgccggtcgatgtcgatgcggaaacgcttcatcagacgggttcgacgcagccggcgttgttcgcgatggaggtggcgctgttccggttgctggagtcgtgggccatccggccggattacgtggccggtcactccgtgggagagattgctgccgcgcacgtggccggggtgttgtcgctcggggatgcggcgaggctggtgtcggtgcgtgccgcgttgatgcaggcgttgcccgccggcggcgcgatggtggcggtgcaggcggccgaggacgaggtgctgccgtacctgaccggcgaggtcggcatcgcggcgatcaacggccctcagtcggtcgtggtctccggcgccgaggacgcggtcatggcggttgccgaggtgtttgctgctcagggccgtaagacctcccggttgaaggtcagtcacgcgttccattcgccgttgatggatccgatgttggaggagttcgcggcggttgtccgcggtctgacgttcggtgagccgcggattcctgtggtctccaacctcacgggccgcctggccgagccgtacacccccgagcactgggtccggcacgtccgtgaggcggtccgtttcgccgatggcgtgcggaccctgcacgagctgggcgtgaccacgttcgtggaggtcggcccgggcggtgtcctgagcgccctcgcccagggctgcctcgacgacgcggacatcgtcaccgttcccgctctgcgtaccgaccgccccgaaccccaggcgctcacgctcgccgtcgggcagttgcacacgcgtggcgtctccccggactggcaggcgctgtttcccggcgccctgcgtgtcgacctgcccacgtacgccttccagcgcgagcgctactggctcaaaggcacgaccgcggtcgacgtctcctcggcgggcctggactcctccggccacgccctgctcggcgcggtggtggagaccgccggggcgcaggacgtgctgttcaccggccgactgtccccggccgacctgccctggatcgcggaacacacggtcggtggcgtgccggtgctcccggtcgccgcgttcgtggagctggccctgtccgcaggacggcaggccgggttcccgtacctggaacagctggacgtggacgccccgctggttctggcagaacagggcgccgtccgcatccaggtgcagatcggtgcggacgacgaccctgaccggcgctcggtgcgcgtcttcagccggccggcggcgggcagctccggcgagccgtgggtccgccacgtcaccggaaagctcacccggaacgctccggcgccggagttcgaccagatgatctggccgccgacgggtgccgaacccggggacgtcgagggccgtccgggtctgcgcgccgcctggcgcgccggggacgagttgtacgccgaggccgaactgccggtcacggagcgggaccgggcggaccgctacgccctgcaccccgtcctgttggacgccgccctcggcatggcgacgtcggaccgcgccgcagaccccggcgaggtgctcatgccccacgcctggagcggcatgtccgtgcacactccggggcccggggccgtacgcatccgcatccggcccgtcggcgacgacgcggtggcgatcgaactgtccgacgccgacggctctcccgtcgcctctgtcgcgtccgtccggacgcggacgatgactgcgcagcaggtactggcctcgcgcgtggcgcaccaggactggatgttcgagatcgactgggtcgagcacaccgcggcctccgctcccgccaccgctgccgtagccgactgggcggtcctcggcgacgagggtgttcactccgatatcgacgcgctccgcaaggcggtcgacggcggtgcggccacgcccgcccacgtcctcctgccgtgcgccccgagtgaaggcgatgctgccgcggcgacgcgcggagcgctggccggtgtgctgtcggtcgtccaggagtgggtcgccgacgagcggttctccgacgcgcggctcgtggtgatgacgcgcggagccgtcgagctggacggcacagctttggacctcgcgcacgtcgcggtctccggtctggtgaagtcggcccagaccgagcacccggaccggctcctgctcgtcgacgcggacgactcggtcacgaacggcggcacggtcactgacggcggcgtcgacccggcgctggccgcggcgctcgccgctctggacgagccgcaggccgcggtgcgcgacggaaagctgtacgtgccgcgcctcgcccggatcaccccgcccgaggagcccaccggtcacgcctgggaccccgaggggaccgtgctgctcaccggcgcgaccggtggcctcggacgatcgctcgcgcggcacctcgttgccgaacgcggcgcacggagactgctgctggccagtcggcggggccccgcggccgaaggcgtcggcgaactcgtcgccgccctctccgagctgggcgcgcacgtcgacgtggccgcctgtgacatcgcggaccgggacgccctcgccgaactgctggcctccgtcccggccgagcacccgctcgtggccgtcgtgcacgcggcggcagccctggacgacggcgtgatcaccgccctgaccccggggcgcctggacaccgtgctgcggccgaaggccgacggggcgctgcacctgcacgagctgacccgggacctgaacctctccgcgttcgtactcttctcctccctggccggagttctgggcagcgccggcgcggcgggctacgccgccgcgaacgccttcctggacgggctggcgcggcagcgccgggccgcgggcctgcccggcacctcgctcgcgtggggcctgtggacggacaacggcggcatgggtgaccggatcaccgacgccgaccgcaaccggatggggcgggccggagtggtgccgttcagcccggcggaggggctggccctgttcgacgccgccctgaccgtggaccggccggtgatcgtgccggtccggctggacgttccgggactgcgcgccatggcccgcgcgggcatgctgcccgccgtcctccgcggcctcgtcggcgacaccggcgccgcggccggtgaggcagcggccgcagggaccaccgccctggcccgccgcctcgccgggataccggaggccgaccaggagaaggtcatgctggacctggtgcgccatcaggcggcagccgccctcggccacgccaccgctgcccgcatcgagcccaccacggccttccgggacatcgggttcgactccctgaccgccgtggaactgcgcaaccggctcaaggccgcgaccgggctgcggctcaagcccaccctggtcttcgaccaccccaaccccgtcgcgatcgcccggctcctccacaaggacctggtgctcgacctcaccgccgaggccccgcccgtgctcggcgaactggaccggctggaggcgcagctcgccgcgctcgccccacaggacgcggtacgggacaagatcaccgcccggctcaaggcgctgctctggaagtggacggacacccatcaggacgccgcggcgaacaccgccgacgacggccacggcaccgaccgcgacttcgacctcgacctcgaccggatcgacgccgccaccgacgacgagatgttcgacctcatcgaccaagagctcgggtcccac

SEQ ID NO: 414 - DNA, 10692 bp, Streptomyces avermitilis
  CDS (1)..(10692)
gtggcgaacgaggacaagctccgccatttcctgaagcgagtcaccgcagatctccaggagacccggcggcgccttcgtgactacgaggacgccgccggggagccggtggccatcatcgggatgagctgccgctacccgggaggggtcgactcgcccgaggatctgtgggagttggtcgcaggcggccgcgacgccgtctcggagttccccgccgaccgcggctgggacctggacgccctctacgacccggacccggagtcccgcgggaccagctacgcccgcgagggcgcgttcctgcgcgacctcgcgcggttcgacgccggcctcttcgggatctcgccccgcgaggcgctcgcgatggacccccagcaacggctgctgctggagacgtcgtgggagctcttcgagcgggccggaatcgatgccgcctcgctggcggggagcaggaccggcgtgttcgccggcgtgatgaaccacgagttcctcgccgccctccagaactccccgcaggacctggagggttacctggggacgggcacctcgggcagcgtcgcctccggccgcgtggcctacaccttcggcctcgaaggcccggccgtcacggtcgacacggcctgctcgtcgtccctggtggccctgcacctggccgtccagtcgctgcgcaacggcgagtgctcgctggccgtggcgggcggtgtcaccgcgatggtcggccccgccaccttcgtcggcttcagccgccagcgcggactggcacccgacggccgctgcaagccgttcgcggccggtgccgacggcaccggctggggcgagggcgccggcctgctgctcgtggagcgcctctcggacgcccgccgcaacgggcacgaggtccttgcggtcgtccggggctccgccgtcaaccaggacggcgcgtccaacggcctgaccgcccccaacggcccctcccagcagcgggtgatccgccaggccctggccgccgcccagctgaccaccgcacaggtcgacgcggtggaggcgcacggcacgggcacccggctgggcgacccgatcgaggcgcaggcgctgctcgcgacgtacgggcagggccgtcccgacgacaagccgctgtggctgggctcgatcaagtccaacatcggccacacccaggccgcagccggcgtggcgggcatcatcaagatggtcatggccatgcgccacggcgaactgccgcgcacgctgcacgtcgacgcgccgtccgtgcacgtcgactggacggcgggtgccgtacggctgctcaccgagcgcacgccctggtcggcgtcggaccagccgcgccgggccggtatctcctccttcgggatcagcggcaccaacgcgcacacgatcatcgaggaagccccgtcggccgaagcgttcgcacaggacaccggggccccggaagggccggaggaaggcgcggagagcgccgagcccgtcgcctcggaggcggcgcgcccggccgcgggcggaccggtgccgtgggtgatctccggcaggaccgaggaggccctgcgcgcacaggccgaacgcctgctgtcccgcacggacgccgaagtccccccgctcgacgtggcgttctcgctcgccacgacgcgcacggccctggagcaccgcgcggtgctccagggtgagacgccggcggaactcgccgaggggctgcgggccgtggcctccggctccccggcccggggcgtcgcgcgcggtctctccggcaccggtggtcgcgtcggcttcctcttctccggtcagggttcgcaacgcctgggcatggggcgtgagttgtacgcgtcctacccggcgttcgccgccgcgtacgacgaggtctgcgcgcagctggacgccgtggtcgacgtcgactcggaagaactgcaccgcaccggtgccgcccagcccgcacttttcgcggtcgaggtggcgctgttccggctcctggaatcgtgggggatccgggcggactatgtggccggtcactccgtcggagagctggccgccgcacatgtggccggggtgctgtcgctcgacgacgccgcgaagctggtgtccgcccgcgcccgcctcatgcaggccctgcccgccggcggggcgatggtcgctgtccaggcgaccgaggacgaggtgctgccgcacctcaccgacgccgtcggcatcgcggcgatcaacgggccgcggtccgtcgtggtgtccggagccgaggacgcggtcaccgcgatcgcggaggccttccggcagcagggccgcaagtcctcccggctgaaggtcagccacgcgttccactcgccgctgatggaccccatcctggaggagttcgcggaggtcgtccgcagtctgacgttccaccggccgcagatcccggtggtctccaacctcaccggccgcctggccgagccctacaccccccagtactgggtccggcacgtccgcgaagcggtccgcttcgcggacggcgtccggactctgaacgacctgggtgtgaccacgttcgtcgagatcggtccggggggcgtgctgagcgccctcgccgagggctgcctggacgacgacgtggtcaccgtgcccgccctgcgcgccgaccgtcccgagcgggtcgcactcgtcgccgccgtctccgaactgcacgcgcacggcgtctccccggactggcacgccttcttccccggcgcccgccgcgtcgacctgcccacctacgccttccagtacgagcgctactggctcgacgcctcaccagccgctcccggtggcgtccgcgccgccggccttggctcggccgaccacccgctgctgggcgccgccgtatccctggccggcggcgacgagcggctgctgaccggccggctgtccctgcgcacgcacccgtggctgagcgaccacgccgtgctcggaaccgcgctgctgccgggcaccgcgttcgtcgaactggccgtgcgcgccgccgacgaagccggctgcgcattactggaggacctcaccctcgaagcgcccctggtggtgcccgagcagggcggcgtcgcggttcaggtgtgggtcggcgcggtcgacggcaccggccgcaggccgctgaccgtgcactcgcgccccgaggacgactccgacctgccgtgggtccgccacgcgaccggcttcgtcaccgaagggagcgaagaggccggcgccgcggccgccgaccggacgctcacggcgtggccgccgacgggctccgagccggtcgacctcgacggcttctacgaccggctggccgccctcggcctggcctacggaccggcgttccgtggactgcggagcgcctggcgcacgggcgaggacgtcttcgcggaagtcgccctccccgacggcacggacaccggttccttcctcctgcacccggctctgctcgacgcggcactgcacgcgatcggcgcgggcggtgcggacggctccctcgttgccgaggcggacgggccgctcctgccgttcgcctggtcccgcgtgtccgtgcgcgccacgggcgcgtccaccctacgggtcaggctggcaccggccggtacggacgcggtgtccctgctggtggccgacggcgcgggcgagccggtggcgtccgtcgagtcgctgacactgcgcgcggtgtcggccgagcggctgcgcaagcgctccggtgacgcgatgttcaccgtcgagcgggcgccgctgaccctgccctccgacgacgcggacgggacggcggtggcgtacgtcccggacctcgccgctctggctgaggccgacgggccgtcgcagccggacgtggtcgtggtcccgtgccccgacggcccggaaggggcgaccgaggccgagcgggtccgtgcggtcagcaccgacgtgctgcggctggttcagcgctggttcgccgaggaccggacgccgcgcctcgtgctgatggcgcgctgtgacgacctcgcgcacgccgccgcgggcggactggtccgctcggcccaggcggagaaccccggccggatcgtgctgctcgaaaccgaccgcccggacgaggcggccgcgctcgtgcccggcgtcgtgctgtccggcgaaccccacgtcgtcgtccgcgaaggggaggtcagcgcaccgcgcctggcccgcgccgcctccctggcaacggaggacgcggtcaccggccgcgcggacgaagctgcctcggccctcgtcgagggcgctgcctcccgcctcggcaccgtgctgctcaccggcgccgctggcgcgctgggcaaaaccctcgctcgtcacctggtgaccggacacggcgtgcgccggctgctgctcgtcagccgccgtggcgcggacgccccgggtgcagccgacctgaaggccgaactcgcggcgctcggcgccgaagcgacgtgggccgcctgcgacctcgccgaacgggacgccctcgcccggctgctggccgccaccccggtcgactcggttgtgcacaccgccggcgtgctcgacgacggcgtgatcgccgcgctgaccccggagcgcgtgggcgcggtcctcgcgcccaaggccgacgccgtgctcaacctggacgagctcaccggcccgagcacgacgttcgtgctgttctcctccgcagcgggcgtcttcggcaaccccggccagggcaactacgccgcggccaacgccttcctcgacgccttcgcccggcaccgccacgcccagggacggcccacggtctcgctggcgtggggcctgtgggagcaggagggcgccatggccgacgccctcgacgaggcgggcaggtcgcggatggcgcgttccggcgtcctgccgctgcccaccgaggacggcctgcggctgttcgacgcggcgctcgcctccaacgagcccgtactcgtgcccgtccgcctcgacaccgccgccttgcgcaaccgggcggcagaaaccgtaccggccctgctgcgtggactcgtccgcgtctccctacgcggcacggcccagcgcgccgccgccggatccctggccgaacgcctcgccggtctggccgccgacgagcgcgacgaggccctcctggaactggtccggggcgaggtcgccgccgtgctcggtcactcctcgtcccgggccgtccagcccacgtacgccttccaggacctcggcttcgactcgctgacggccgtggagctgcgcaaccggctcgccacggccaccggcctgcgcctgcccgccaccctcgtcttcgaccaccccacccccgccgccctcgcccggcacatcggcaccgaactcctcggcgaggcccccgcggtcacggccagggccgcggcgcggcagaccgcgaccgccgccgacgagccgatcgccatcgtcggcatgagttgtcgcctcccgggcggggtccgctcgccggaggacctgtggcggctggtggcctccggccgggacggcatcacccggttcccggacaaccgcggctgggacgtcgacgggctctacgaccccgaccccgagcgcctcggcaagacgtacgcgcgcgacggcggcttcctgcacgaggcggccgagttcgacgccggcttcttcggcatcagcccccgcgaggccctggcgatggacccgcagcagcggttgctgctggaggcgtcctgggaggcgttcgaacgcgccgggatcgacccggcgaccatccggggcagccgtaccggcgtcttcaccggcctgatgtaccacgactacggccagggcccgcgccaactgcccgagggcgtcgagggactgctcaccaccggaggctccggcagcgtcgcctccgggcgcgtgtcctacaccttcggcctggagggcccggccgtcacgatcgacacggcctgctcctcgtcgctcgtcgccctgcacctggccgtccagtcgctgcgcaacggcgagtgcacgatggcgctggccggcggcgtcacggtcatggccggcccgacggttttcgtggagttcagtcggcagcgcgggttgtcgcccgacggtcggtgcaaggcgttcgctgccggtgcggacggtacgggctggggcgagggagtgggcctgttgttggtggagcggctgtcggacgcggagcgcaacggtcaccgtgtgctggcggtcgtgcggggcagtgcggtgaaccaggacggtgcgtccaacggtctgaccgcgccgaacggtccggcgcagcagcgggtgatccggcaggcgctggcgtccgccgggctcaagccagccgatgtggacgcggtggaggcgcacggtacgggcacgacgcttggcgacccgatcgaggcgcaggcgctgctcgccacgtacggccaggagcggcccgcaggacagccgctgtggctgggctcgctgaagtccaacatcggccacacgcaggccgccgcgggtgtcgcaggtgtgatcaagatggtcatggccatgcgccacggagtgctcccgcagaccttgcacgtcgacgaacccacaccgcacgtggactggtcggccggtgacgtccggctgctgacggaggccgtcgcatggcccgattcggaccgcccgcgccgtgctgccgtgtcgtccttcggcgtcagcggcaccaacgcccacaccatcatcgaacaggcccccacgaccgaggaactgcccctgacgtccgattccggcgcggccgttccctgggtgctctccggcaggaccgaagccgcgctgcaggcgcaggccgccggcctcgtgtccttcctggacgaccacgacggcgacaacgacagggacgacgtcggcgaggcggccttcgcggccgacgtggcgtactcgctggccacgaccagggcggccttcgaacaccgcgccgtggtggtcgggcagacccttcaggagctccggcaggggctggccggtgtcgccggcggtgccacgccgcccggcgtggtgaccggcaccgcacacaccggcggcaagaccgtcttcgtcttccccgggcaggggtcgcagtgggtgggcatggccgccaaactgctcgagacctcaccggtcttccgcgaccggatcgacgcctgcgagcgcgccctcgcgccgcacgtggactggtcgctgaccgcggtgctgcgcggcacgtccgaggtcgagcaggaccgggtcgacgtgctgcagcccgtgctgtgggcgatgacggtcgccctcgccgaggtgtggcgctccttcggagtgacccccgacgcggtcgtggggcactcccagggcgaggtctccgcggcggtgatcgccggagcgatctccctggaggacggagcacgcgtcgtggtgcggcgcagccttgcggtccgcgaactccagggccgcggcgccatggcctcggtgacgctcccggacgagaaggcgcgggaactggtcggccggtggaccggccgcctcggcatcgccgccgtgaacgggcccgccaccgttgtggtctccggggacaccgacgccctcgacgaattcctcgctcactgccaacaggatgccatccaggcccgcagggtcgccgtcgactacgccgcgcactcgccgcagatcgaacgcgtcgaagcgcaggcgagcgaggggttcgccggcatcagcccgctccccggctccgtgcccttctactccacggtgacgggcgggaagctggccgcggacgagctgggctccggctactggtaccgcaacatgcggcagacggtgcggttccacgacgcgatccgggccgctctggccgacgggcacgacgtgttcgtcgaagtcagcccgcaccccgtccagttggcgggcatccaggatgccatcgaggccgccgacgcggacgccgcggtcgtaccgacgctgcgccgccgcgacggcggacggaaccggctgatgctggccctggcccaggcccttgtgcacggcgtcgccatcgactgggacgccgtcctgccgggcgcgcgccgcgtcgacctcccgacctacgcgtttcagcacgagcggtactggctggaggccggcgctccggccggtgacgtacgagcggccgggctggacgccgccgaccacccgttcctgggcgcggcggtggagttgccggacgccggcggccacctgctcaccgggctgctgtccctgcaagcccagccctggctggccgaccacgcggtgctgggcacggtgctgctgccgggcacggccttcgtggaactggctgcccacgccgcggccgagaccggctgcgacctggtcgaggagctcaccctgcaggcaccgctggtgctgcccgagcacggcggtgtcgcgctccaggtgctcgtgggcgcgcaggacgactccggccgccgcccgttgagcgtgcactcgcgagccggggacgacggcccgtggatccgcaacgccaccggcgtcctcgccgccggcggagccccctccggcaccgacctgagcaactggcccccggccgacgcccggccggtggacctggacggcttctacgaccgcatggcggacctcggcctgagctacggcccgctctttcaggggctgcgtgccgcctggcgcggccacgacgcggtctacgccgaactcgccgtccccgacctggcgcagacggacgcgttcggtgtgcacccggccctgctcgactccgcgctgcacgcgctgggcgcgggcggcctcgtaccggctgccgacgggcccctgctgcccttcgcgtggtcccgcgtcacggtgcacggaaccggagcggccggcctgcgggtacggctctcccaggtcggcggggatgcggtacggctggaggccgccgacggcacgggtcgtcccgtcgtgtcggtggagtcgctgacgctgcgcccggtgtcggtcgagcaactgcgcccgagctcccgggactcccttttcaccgtgcagtgggcaccgctcgccgccaccgctgacgcgcggacaccagtcgtacaggcctacgacggcatcgccgccctcctcgccgcccccacggtggagaccggggcgcaggcggacacggacgccgtcgtcgtcccctgccccggcgggtcgggtaccgatgtcgagcgggtccggagcgtcctcgccgaagtgctctggctggtccagtggtggcaggccgaggaccgggccgcccgcctggtgctggtgacccggggcgcggtcgccgcaggcgacgagtcggcacagggcgacccggtgcaggcggccgtgtggggcctggtccggtcggcacagtcggagaacccggaccgcatcgtcctcctcgacaccgaacagaacgccgacgtggagcaggtcgcggcgacggtcgtcccccggctcgtcgcctccgaggagccgcaggcggcactgcgcggcgacgcgctcctgctgccccggctcgccagggccgccgccgacgccccgcgggccaccccggacttcgggaccggcagggtgctcctgaccggcgcgtccggtgccctgggcggactcgtcgcccggcacctggtcgccgaacacgggttgcgcagcctgctgttgatgagccggcgcggcgcggacgccgagggtgcggcggagctccaggaggaactgaccgccgcgggtgccgaagtgctctgggccgcctgcgacgtggccgaccgggacgctctcgccgaggtgctgtccggcacgccggtgacggccgtggtgcacacggccggcgtcctcgacgacggcgtgatcggttcgcttacgccggagcgcatggagatggtgctgcgccccaaggtcgacgcggtgttgaacctgcacgagctggccggtgacgtgtcggcgttcgtcctcttctcctcgctcgcgggcacgctcggcacccccggccaggccaactacgccgcggccaacgccttcctggacgccttcgcccggcgccgccgggcccagggtctgcccgcggtgtcgttgccatggggcctgtggcagcgcaccggcaccatgaccgaggacctcggcggcgccgaccggacccggctcgcccgcggcggcgtgctgccgctgtccgacgaggacggcctggaactcctcgacgccgcgctcgcgctgcaggagcccctggtggtggcggcacggttggacctcgccgccctgcggaacgcgaccgccccggtgccgccgctgctcagggcgctcgtcggcggccggctgcggcgcacggaccgggcggccgcggtaccgctggcgcagcggatcgcgggcctgcccgagagcgagcgcgaagaggccgtgctggacctcgtccggtccgaggtcgccgccgtcctcggacacagctcggccaagaccgtccagcccgaccaggccttcggcgacctgggcttcgactcgctgaccgcggtggagctccgcaaccggatgaaccaggccacgggcctgcggctgcccgcgacgctggtcttcgaccacccgacgcccgcggtgctcgcgcagcgggtgctgaaagacctccccggtggtacggccgggacggcgccggtcttcgacgagctcgaccgcctcggtgccgccctcgacggtgccggagcggacggcatcgacaacatcacccgaaccaagatcaacatgcgtctccaggcactgctcgcccgctggaacgggaacgagccggccgatccgggaggcgccggcggagccgaggacgaagacgacctcagctcggcgagcgacgaggagctgtacgagctcctcgacgacgaactcggcatctcc

SEQ ID NO: 415 - DNA, 23238 bp, Streptomyces avermitilis
  CDS (1)..(23238)
atggtcgagtccgagctcaacgcaacggggaatcgggactgttcggcttcggcagattcggccgatggcatagctgtcatcggcctggcgtgccgactgccgggggccgccgacccggccgccttctggcggctgctcagcgagggcgcggacgcgatcaccgacgtccctccggaccggtgggacggggcggtggtggccgacgcgtccgcacccgacaggaccggcatccgccggggcggcttcctcgacagcatcggcgacttcgacgccgggttcttcgggctctcccccaaggaggccgccgccatggacccgcagcagcggctcgtgctggagttggcctgggaagcactggaggacgcgcacgtgcgcgccgcaacgctgcgctccacccgcaccggagtgttcgtcggcgccatgtgggacgactacgcgacgctgcaccaccgctccggactcacggccatctccccgcataccgtcaccggcctgcaccgcagcatcatcgcgaaccgggtctcgtacttccttggcctgaacggccccagcctgaccgtggactccggccagtcctcttctctggtctcggtccacctggcctgcgaaagtctccgcaagggcgaatcgacgatcgctctcgcgggcggcgtgaacctgaacatcgtccccgagagcgccctgggcgccgccaagttcggcggcctgtccccggacggccgctgcttcacctttgacgcgcgcgcgaacggctacgttcgcggcgagggcggcggcatcgtcgtcctcaaacctcttgcccgggccgtcgcggacggcgaccctgtctactgcgtgatccgcggcagtgcggtcaacaacgacggtggcggcgacgggttgaccgtgcccctgcagtccgggcaggaacaggtgctccggctcgcctacgaacgggccggagtcaaccccgccgatgtcggctacgtggaactgcacgggaccggcaccaaggtcggcgaccccatcgaggcagccgcgctcggcgcagtgctcggcacgggacgtgagcccggccgccctctgcgggtcggctcggccaagaccaacgtgggccacctggagggcgccgcgggcatcaccggcctgctgaaggcggtcctgtcgctcaaccaccgtgaactgcccgccagcctcaacttcgggacgccgaacccggcgatcccgctggaccggctgaacctgagggtgcagaccgagcacagcgaatgggccgccgaggacggccgcccgctgctcgccggcgtcagctcgttcggcatgggcggcaccaactgccacatcgtgctggcgtcgggcgcggctgtggaggcgggtgagggtgcgacggcgggcgggggcgcggctccgaccttttggccgctgtccgccaagaccgcatccgggctgcgcgcccaggccgccgcactgctcgcccacaccgaggcgcccctcggtctcgccctgcccgacgtcggctggtcgctggccaccggccgcaccgccttcgaacaccgggccgtcgtcgtgggcgaggttcgtgacgacttcctgcgcgccctgcgcgagctgtccaccggcggcattgacgccgcactgaccactggccgcgcgggcccgcgcggcgagctcgccttcctcttctcgggccagggcagccagcgggccggcatgggccgcgaactggcagagtccgtcccggcgttcgcctccgccctggacgaggtgtgcgcacacctcgaccccttgctgccgcggccgctgcgcgaggtcatgttcgcacccgtaggcactggggaagccgccgaactcgaccagaccctctacacgcagacctcactgttcgccgtcgaggtggccttgttccggctgctggagagctgggacatcacccccgacgtgctgatgggccactccatcggtgaactcgccgccgcgcacgtggccggcgtcctctcgctcgccgacgcctgcgccctcgtggccgcgcgcggtcgcctgatgcaggcgctgcccgccggcggcgccatgatcgccgtccaggccgcggaggacgaggtgcgcgcccgcatcggcgagcgcacggaccgcgtgagcatcgccgcgctgaacggcccggactccgtcgtcgtctccggcgacgaggacctcgccaccgagatcgccgacgccttcgccgccctgggccgcaagaccagccggctgcgggtcagccacgccttccattccccgcacatggaacccatgctggcggagttccgcaacgtggccgagggcctgaccttccacgccccgcgcatcccgatcgtgtccaacgtgacgggccgactgtccgaggagccctcgggatacgaagggtgcacggccgcgtactgggtccgccacgtgcgcgaggcggtccgcttcgccgacggcgtcgcccgcctcgacgagcagggcgtccgcacgtacctggagctcggccctggcggcgtgctcgcctccatggcccgcgccggcgctgacagcgagtccctgttcgtccccgccctgcgcacccgtcgccccgaggcgcaggccctgctggcggcggtcgcctcgctgcacgtccacggcgtggagccggactgggacgccctgttcggcggcgggcgaggcgcacgccgcaaggtcgcgctccccacctacgcgttcgaacggcagcggtactggctggacggcgacacgacgtcgcccgtcgccaccaccggctgggctcctgtggctccgcagccggacgccatcgccgagactgacagcgcgcctgtcggagccctgggtcggcggctggccggactggccgagtccgagcgcgacgaggccgtgctcgacatggtccgcgcacacatcgccgccgttctcggccacgccgaagcccgccaggtcgagaccgagtggacgttcaaggacctcggtttcgactcgctcagctcggtggaactgcgcaaccagctcagcgaggctaccggcctgcgcctgcccagcgggctgctgttcgaccacccgacccctgccgcgctcgcccgccatctcgccgcccagtccctgggcggcggggacgcggcggccgccgcgcccgcgacggtggccgacccccacgagcccatcgccatcgtggccatgagctgccgcctgcccggcggcgtgagctcccccgaggacctgtggcggctgctcgcctccggtggcgacggcatctccggattcccgacggaccgtggctgggacgtcgaaacactctacgacccggagcccggcacgcccggcaagtcctcgacgcggcacggcggcttcctgcacgaggcggccgagttcgacgccggcttcttcggcatcagcccccgcgaggccgccgcgatcgacccgcagcagcggctggtcctggagaccgcgtgggaggccttcgagcgcgccggcatcgacccggccacgctgcgcgggagccgggcgggcgtgttcatcggcgcgacggcacaggactacggcccccggctgcacgagccggccgacggcgtcgagggctatctgctgaccggcacgacgaccagcgtcgcctcggggcgcgtggcctactcgttcggcctcgaaggccccgcggtcacggtggacacggcctgctcgtcgtctctggtcgccctgcacctggccgtccagtcgctgcggagcggcgagtgcaccatggccctggccggcggcgtcaccgtgatgtccacgcctggcatgttcgtggagttcagccgtcagcgcggactgtcggcggacggccgctgcaaggcgttcgcggccggcgcggacggtacgggctgggccgaaggcgtcggcatgctcctggtggagcggctcagcgacgcccggcgcaacggccaccaggtgctggccgtcgtgcggggcagcgcggtcaaccaggacggcgcgtcgaacggactcacggcgcccaacggcccctcccagcagcgcgtcgtccgccaggcgctggcagccgccggactcgcgcccgcggacgtcgacgccgtggaggcgcacggtacgggcacgctgctcggcgacccgatcgaggcggaagccctcatcgccgcctacggccagggacgggacggcgaccggccgctgtggctgggttcgctgaagtcgaacatcggtcacacgcaggccgcggcgggcgtcgccggcgtgatcaagatggtcatggcgatgcgacacggtgtgctgccgcggaccctgcacgtcgacgagccgaccccgcacgtggactggtcggcaagcggcgtacgactgctgaccgaggcggtggagtggcccgcgcgcgacctgccgcgccgcgcggcggtgtcgtccttcggcatcagcggtaccaacgcccacgtcatcgtcgagcaggccgcgacgagcgaagagcccgcccgcgggacggccgttgccggaccggtcccgtgggtggtgtcggcgaagagtgatgtggcgctgcgggagcaggcgggccggttgttgtccttcctggacgccgagggcgtcgggggtgccggggttcggccggaggacgtggcgttgtcgctggcgacgtcgcgtgcggtgctggagcgccgtgcggcggtcgtgggcggggatctcgcggagctccggcaggggctggaggcgcttgcttccggcgcttccggcgctgctccggtgggcggtgccgtcgggggcagggtcgggttcttgttctcgggtcagggttcgcagcggatcggcatggggcgtgagctgtacgcggcgtaccccgtcttcgctgcggcgtacgacgaggtctgcgcgtttctggacgcgcccgtcgacgtcgactccgaggagctcaaccagacgggtacgacgcagcccgcgctcttcgccgtcgaggtcgccctgttccggcttctcgaatcgtggggcatccggccggactatgtggccggtcattcggtgggtgagattgcggctgctcatgtggcgggtgtgttgtcgctcgaggatgcggcgaagctggtgtcggcgcgtgccgcactgatgcaggcgctgcccgacggcggggcgatggtcgcggtccaggcgacggaggacgaggtgctgcggcacctgaccgacggggtcgggattgcggcggtcaacgggcctcggtcagttgtggtttccggcgctgaggacgcggtcaccgcagtcggtgagatcttcgccggtcggggtcgtaagacgtcccggctgaaggtcagtcacgccttccactcgccgttgatggatccgatgctcgaggagttcgctgcggttgttcgcggtctgacgttcagtgagtcgcggatcccggtggtctcgaatctcaccggccggttggccgaggtgtacacgcccgagtactgggtgcggcacgtccgcgaggcggtgcgcttcgccgacggcatcgagaccctcggcgagctgggcgtgaccacgttcgtcgaggtcggccccggtggcgtgctgagcgccctcgcccagggctgcttcgacgacggcacagacatcgtcacggttcccgtcctgcgcgccgaccgccccgagccgtacgcgctcgtcaccgcaatcgggcggctgcacacccacggcatctcacccgactggcaggtgttgttccctggcgcccggcgtgtcgacctgcccacgtacgccttccagcgcgagcgctactggctcgacgcgcctcgggcggcgaccgccggcgccccggacgcgatggacgccgagttctgggactccgtcgagagcgaggaccgggcatctctcggtgcgctcctgggactggagcccaccgaactggacgtggtcgcgtccaagctgtctgcctggcgccggaagcggcgcgagcagtccaccaccgacggctggcgctaccggatcacctggcagccgctcgatgacatggtccgggccgctccgtcggggacctggctctacgtggtctccgaggagaccgcgtggaccgaggcgatccgcgccgggctcacggaactcggcgtcgcgctcgtaccgttcgccgtgggcgaggacaccgaccgtgacgcgctcgcccgggccttcgccgacgccgggcaagagcaggccgacggcatcctgttcgccgcagcacagggagaagcgggggcgaacgccctccagcggctcgtcctgctcgtccaggccctcggcgacgccgggatcgaggccccgctgtggtgcctgaccagcggcgcagtgtcgaccggcacggcggatctgctgaccgaccccgtctccgcccagctctggggcctgggcaggatcgtcgccctggaacagccgcagcgctggggcgggctcgtcgacctgcccgccgagctggactcccgcgcgctggaacgactggccggcctgctggcccaggccgacgaggaccaactcgccgtacgcgcctccggagtgtacggccgccgcctcgtgcgcgcgccgctgagcgcggcaccggcggacgcaccctggtcgccgcgcggcaccgtgctcgtgaccggtggtacgggtgcgctgggcgggcaggtggcccgctggctcgccggtgcgggtgccgagcacctggtgctcaccagccgccggggccccgacgccccgggcgccgccgaactcaaggcggagctggaggagctgggcgctcaggtcaccgtcgtcgcgtgcgatgcggccgaccgcgacgcgctcgccgagttgttcggccggtacatcgtgaacgccgtggtgcacaccgcaggcgtactcgacgacggcctggtcgaatcgctcacgcccgagcgcctcaaccacgtgctgcgccccaaggtggacgcagcgctccatctgcatgagctcacccgggaccgtcaggacctcgacgccttcgtgctcttctcctcgatgaccggtgtctggggcaacggcggccaaggcgcctacggtgccgcgaacgccttcctcgacgccctcgccgagcaccgccgggcgcagggcgtgcccgcgctggccgtcgcgtggggatcctgggcggacggaggcatggccgacggcgccgccggtgaccatctgcggcggcgcggcgtacgggcgatcgcggcccttcccgcgatctccgtgctgcacggtgcgctgacccacggcgagacctccatgaccgtcgcggacgtggactgggagcgcttcgtcccggccttcgtcggcacgcggccctgcccgctgctgctcggcgtgcccgaggcccgcgaggccctcgaagcacgcgcccgggccgcgcagagccccgaagtacccgtgtccgcgctggtccagcgcctcctcggcgccacgccgggggagcagggccgcatcctgctggacctggtccgcgagcaggccgccacggtgctcggccacacgggcaagggcgccttcgaagccgaccggacgttccgcgagaccggcttcgactcgctcaccgccgtcgaactgcgtcacaggctcaacacggccactggcctcaggctgcccaccaccctggtcttcgaccacccgaccccaaccgccctcgcccgtcacctgggcgaggaactcctcggccggcacgggctggagacggccgccgcgcaggcgacggccgccgctgcggccgacgagcccctcgcgatcgtcggcatgagctgccgcctccccggcggcgtccagtcgccggaggacctgtgggagctgctgagctccggccgggacgcgatgtccggcttccccaccgaccgcggctgggacatcgacgcgctctacgaccccgaccccgaccggcccggcaagacgtactcgcgcgagggcggcttcatccagggcgccgaccgcttcgacgccggtctcttcgggatctcgccgcgtgaggcgctggcgatggacccgcagcaacggctgctgctggagaccgcgtgggaggccttcgagcgcgccggcatcgccctcgcgtccgtccgcgccagccgcaccggtgtcttcatcggcaccaacggccaggactacgccaacgggctacgcaacgcgcccgaggagatcgagggctacgcgctcaccggcaaggcggcctcggtcgtctccggacgcatctcctacacgttcggcctcgagggtcccgcggtcacggtcgacacggcctgctcgtcttcgctcgtggccctgcacctggccgcccaggcactgcggagcggcgagtgctcgatggccctggtcgggggcgtcaccgtcatgaccacgccggacctgttcgtggagttcagccggcagcgcgggctgtcgccggacggccggtgcaaggcgttcgcggccggtgccgacggcacgggctggggcgagggcgtgggcctgttgctggtggaacggttgtccgacgcccgtcggaacgggcaccaggtgctggcgttggtccgcggcagtgcggtgaaccaggacggtgcgtccaacggtctgaccgcgcccaacggcccctcgcagcagcgggtgatccggcaggcgctggcgtccgccgggctcacgccggccgacgtggacgccgtcgaggcccacggcacgggcacgcggctcggcgacccgatcgaggcgcaggcgctcctcgccacgtacggccaggaacactccgacgaccggccggtgtggctgggctcggtcaagtccaacatcggtcacacgcaggccgccgcgggtgtcgccggtgtgatcaagatggtgctggcgatgcggcacggcgtgctgccgcagacgctccatgtggacgagccgaccgcgcacgtcgactggtcggcaggcgccgtgcggctgctgaccgagccggtgcaatggcccgggaccaccgggccccgccgggccgcggtgtcctccttcggtatcggcggcaccaacgcgcacacgatcatcgaggaagcgcccgccgcggccgcggccgagccggcccgggaacaccgcccggtgcccgtgccgtgggtgctgtcagcaaagagtgaagtggcgctgcgggcccaggcggagcgtctgctggccttcgcgaccgacgatgtgtcgcccgtcgacgccggattctcgtcggccacgacgcggtcggcactggagcatcgggccgcagtcatcggcagcgacccggccgagctgcgggcaggtcttgaggccctcgcggcaggcgaaccggcggcgaacgtcgtcgccgggcgcgctcactcggcggacaaggtcgggttcttgttctcgggtcagggttcgcagcggctggggatggggcgtgagctgtacgcggcgtacccggtgttcgctgcggcgtatgacgaggtgtgcgcgcttttggacgccacggtcgacgtcgatgcggaaactcttcatcagacgggttcgacgcagccggcgttgttcgctgtcgaggtcgccctgttccggcttctcgaatcgtggggcatccggccggactacgtggccggtcactcggtcggtgagatcgcggccgcgcacgtggccggggtgctgtcgctcgaggacgcggcgaagctggtgtcggcgcgtgccgcgctgatgaaggccctgcccgccggtggtgtgatggtggcggtccaggcggccgaggacgagatgctgccgcacctgattgacagagcgggtatcgcggcgatcaacggcccgcggtccgtggtcatttccggggcggaggacgcggtcacggcgattgccgaggtgttcgctgctcagggtcgtaagacgtctcggctgaaggtcagtcacgcattccattcgccgttgatggatccgatgctggaggagttcgcggaggtcgttcgcggtctgacgttcagtgagccgtggatcccggtggtctcgaacctcaccggccggctgactgagtcgtacacccccgagtactgggtccggcacgtccgtgaggcggtgcgcttcgccgacggcgtgctgaccctgcacgagctcggtgtgaccacgttcgtggagatcggaccgggcggcgtcctcagtgccctcgtccagggctgcctcgacgacggcacagacatcgtcaccattcccgccctgcgcgccgaccgccccgaaccccaggcgctcaccaccgcgtacgcccaactgcacgtcagcggcgccgaagtggactggcacgctttcttcccgggcgcccggcgcgtcgagctgcccacgtacgccttccagcgcgagcgctactggctcgacgcccccgcctccgccggtgacatgcgcgcggtggggcagggcgaggccggccacccgctcctcggcgccgccgtgccgctggccgacagcgtcgggcacctgctcaccggccggctctcgaagcacacgcacccgtggctggtggaccacgccgtcagtggggtcgcgctcctgccgggaaccgcgttcgtcgagctggcgatcaccgctgctgacgccgtgggctgcgacctgctggaagagctgacgctggagacaccgctgctcgtgcccgagcgcggcggcgtcgccttgcaggtgcacgtcggcgccgacgacggctcgggccgcaggccgctgaccgtgcactcgcagatcgacgacggggacgcgtacgcccacgaggacgactccgagcgggcatgggtccggcacgcctccggcgtgctgaccgtcgccacaggagggcccgtggacggctcgctcaccgcgtggccgcccgtgggtgcggagccggtcgacgtcgacgggttctacgaccgcctcgccggcatggcgctcgactacggccccgtcttccaggggctgcgcgccgcgtggcggagcggggacgacttcttcgccgaagtggagctgcccggcgcggagcggacggacgcgggcgcgtacggcctgcatcccgccctgttcgacgccgccctgcacaccgtctggctgggcgcggtcgagcccgaggccgggacgggaaacgggctgttgccgttcgcctggagcggcgtgcgcctggcggctgccggagcctccgacctgcgggtgaaggtatcgcgcgccggtaccggcacctctacggtgtcgctggtgctggccgatggcaccggtgggccggtcgcggaggtcgactcgttgacgctgcgcccggtgcccgccgaccagttgcgcgccggttccggcagcgacgacgcggtcttcggcctaaagtggacgccggtcagcctgccgtccgcgccggacggcatgaggatcgagacgtacgaggatctcgccgctcttcgggccactgacccgccggcggacaccgaagccgatgccgcagccgccgccgatgccgtggtcgtgccctgcccgaccgggaccggcgcggacctggccacccgggtccgtgaggtcacccatgccgtgctggagttggtgcagtggtggctggccgaggaacgcccggggcgcctggtgctggtgacgcgtgggggagacctcgcccagtcggcggtctgcggactggtgcgctcggcgcagaccgagaaccccgaccgcatcgtgctggtcgagacctccagcgatgcccatgccggggccggcagcggtgttgatgacgccgatcttgcccgggtgctgcccggcctgatcgcgtcgggtgagccgcaggccgcggtgcacgcggacgacgaggtccgggtgcccaggctggttcgagtcgccgtgccggacgcggagccggaacttcccggcctcggctccggcaccgtcctgctgaccggtgcgtcgggcggcctgggcgggttgttcgcccggcatctggtcgccgaacacggcgtccgtagtctgctgctcgtcagccgccgcggcggcgacgcacccggcgcggccgagctcaccgccgacttgaccgcgcagggcgccgacgtcacctgggccgcgtgtgatgtggccgaccgcgccgccgtccgtgcactcctggccgggcccgggcagagcctgtccgcgatcatccacaccgccggcgtactggacgacggaatcatcggctcgctgacccccgagcggctggacgccgtgttccgcccgaaggtggacgcggcgctgaacctgcacgacctggcgggcgagctgtccggcgacctgtccgcgttcgtgctgttctcctcggtggcgggcactctcggcacgccgggccaggcgaactacgccgctgccaacaccttcctcgacgccctcgccgagcaccgccgtgccgcgggccagcgggccacgtcgctggcctggggcctgtgggcgcaggacagcgagagcgccatgaccggcagcctcgaccacaccgatctcacccgcatccagcgcatgggcctcgccgcgatcccgtcgtcggacggcctgcggctgttcgacgcggcactggccctggatcgggccgtcgtcgccccgctgcggctggacctgggcgggctgcagggcacggtgccgccggtcctgcgagggctccgcggtaccgtacggggcaccgcgcgacgtacggcgcagaccgcgccgaagggatcgctgggtcagcggctggccgggctggcggaggccgagcgcgagcaggtggtgctggacctggtgcgtaccgaggtcgccgccgtgctcgggcacgccggagcacagtcggtcggcgcggacgactcgttcaaggacatcgggttcgactcgctgaccgccgtcgaactgcgcaaccggctcaactcggccgtcggcatgcgcctgcccgccaccctgatcttcgactacccgaacccgcttaccctcgcccacttcctcaccggcgaagccgcaggcggcgaggcggcgacagccgtgccgacgaccctctccacggccaccggaacggcggacgagcccatcgcgatcgtgggcatggcctgccgctaccccggtggcgtgcagtcacccgaagacctgtggcagctggtgttctccggccgcgacgccgtgtcgggcttccccgagggccgcggctgggacgtggagcagctctacgacccgaatcccgaccagtggggcaccagctacacccgagagggcggcttcctgcacgacgcggcggacttcgacgccgagttcttcgggatctcgccgcgtgaggcgctggcgatggacccgcagcagcggttgctgctggagacgtcgtgggaggcgttcgagcgggccgggatcgacccggcgacggtgcggggcagcaggaccggtgtcttcgccggcgtgatgtaccacgactacggcgggcgggtgcacacctcgcccccagggctggagggctacctcgtaaacggcagtgcgggcagcatcgcctccggccgggtctcgtacacgttcgggctcgaggggccggcggtcaccgtcgacacggcgtgctcgtcctcgctcgtagccctccacctcgctgcgcaggcgctgcggagcggcgagtgctcgatggccctcgtcggcggcgtcacggtgatggcaggcccgtccgtgttcgtggagttcagccgtcagcgcggcctgtcggcggacggccggtgcaaggcgttcggcgccggggcggacggtacgggctgggccgagggcgtgggcatgctgttggtggagcggttgtccgacgctcgtcggaacgggcacaaagtgctggcggtggtccgcggtacggcggtgaaccaggacggtgcgtcgaacggtttgacggctccgaacgggccctcgcagcagcgggtgatccggcaggcgctggcgaacgcgggcctgtcttcggatgaggtcgatgcggtggaggcgcacggtacgggtacgaggctgggtgatccgatcgaggcgcaggcgctgatcgccacgtacgggcaggagcggtcggaggaccggccgttgtggctgggttcgctgaagtcgaacatcgggcattcgcaggcggctgcgggtgtcggtggtgtgatcaagatggtcatggcgatgcagcacggcgtgctgccgcagaccctgcatgtggacgagccgaccccgcacgtggactggtcggcgggcgcggtgcagctgctgaccgaggccgtggagtggcctgcgagcgacgggccgcgccgggccgcggtgtcctccttcggtgtgagcggcaccaacgcgcacgtcatcgtcgagcaggccgcgacgagcgaagtgaccgcccgtgggacggccgttgcaggaccggtcccgtgggtgctgtcggcgaagagcgatgcggcgctgcgggagcaggcgggccggttgttgtccttcctggacgctgagggcgtcgggggtgccggggttcggccggaggacgtggcgtactcgctggcgacgtcgcgtgcggtgctggagtgccgtgcggcggtcgtgggggaggagcttggggagttccgccaggggctggaggggattgtttccggcgctgctccggtgggcggtgccgtcgggggcagggtcgggttcttgttctcgggtcagggttcgcagcggatcggcatggggcgtgagctgtacgcggcgtaccccgtcttcgctgcggcgtacgacgaggtgtgcgcgcttttggacgccacggtcgacgttgatgcggaaactcttcatcagacgggttcgacgcagccggcgttgttcgctgtcgaggtcgccctgttccggcttctcgaatcgtggggcatccggccggactacgtggccggtcactcggtcggtgagatcgcggccgcgcacgtggccggggtgctgtcgctcgaggacgcggcgaagctggtgtcggcgcgtgccgcgctgatgcaggccctgcccgcgggtggtgcgatggtcgcgatccaggccaccgaggcggaagtgctgccgcacctcacccacggcgtcggcctcgcggcgatcaacgggcctcggtccgtcgtgctttctggctccgaggatgccgttctcgacatcgccgaggtcttcgcgcagcagggccgcaagacgtcccggttgaaggtcagtcacgccttccactcgccgctgatggacccgatgctggaggagttcgccgaggtcgtccgcggtctgacgttcagtgagccgcggatcccggtggtctcgaatctcaccggccggttggccgaggtgtacatccccgagtactgggtccggcacgtccgcgaggcggtccgcttcgccgacggcctgcacaccctgcacgagctgggcgtgaccatgttcgtcgagatcggcccgggtggtgtcctcagcgccctcgtacagggctgcctcgacgacggcacacacatcgtcaccgttcccgccctgcgcgccgaccgccccgagccgtacgccctcgtcaccgccgtggggcaactgcacacccacggcatctcgcccgaatggcaggcgctcttcccgggcgcccgccgcgtcgacctgcccacgtacgccttccagcgcgagcgctactggctcgatgcgcctcaggcgtccggtgacgtccgggccgccggtctgggggctgcggaccatccgctgctcggtgccgcgattgcgacggccgacagcgacggggccgtgctcactgggctgctctccctcggaacccacccttggcttgccgaccacgccgtgaacgggattgttctgctgcccggcaccgcgttcgtcgagctggcgatccgggcgggcgacgagacgggatgcggatggatcgaagacctcacccttgagcttcccctggtcgtgcccgagcgcggtggcgtcacccttcaggtggctgtcggcccggaggacgagtcaggccggcggcagctgagcgtgcactcgcgcgtcgacgaccgttcgtggctgcggcacgcgacgggtgtgctgtcctcggcagaggcaccgtccgccgcgaagctcggcgcgtggccaccggcgggtgcggaggccgtcgacctgacggcgttctacgaaggcatggctgctgcgggcctggactacggtccggtcttccagggcctgcgctcggtgtggcgcgacggggacgacgtcttcgccgaggtcgagctgccggacgagtcggctgccgaggcggcggcgttcgccctgcacccggcgctgctggacgccgccctgcacgcactggccgccggtgggctggtgtcgctggacgacagcccggccctgccgttcgcgtggtccggcgtcgtcgtgcaggcggccggtgcggcgatggtgcgggtgaagctgtcgcggacggccaccggttcggtgacgctggccgtggccgatggcgccggtgacccggtggcctcggtcgagtcgctgtcgttgcgggccgcttcggcggagcaattgcccggtgctgttggcggcgatcagctgttcgggctggagtggacgcggttcactctgccctccgccaccgacgcgctgatgatcgagaccgtcgcggacttcgacgcactgcgggagtcggaagggacaccggacgtcgtggtcgttccgtgcccggcgggttccggtagggagaccgccgaccgcgtgcacagcaccacgagtgaggttctggcgctggtgcagtggtggttggcggaggagcgtgcggggcgtctggcgttggtgacgcgtccgggcgatctggctcatgctgcggtgtgggggctcgtgcggtctgctcagtcggagaacccggaccggatcgtgctggtggaggccgaggagaccgatgaggcggtccgtgtgctgcctgccgcgctcgcttccggtgagccgcagttcgcggtccgcgacggggaggtgttcgtaccgcgcctggtgaaggccacccggagcgccacggggaccgccaccggcacgccggacttcggcgtcggccccgtcctgctgaccggtgcgtccggtgcgctgggcgggctcgtcgcccggcacctggtcgccgagcacggcgtacgcagcctgctgctgctcagccggcgcggcgcggaggcccctggcgcggtcgagctggaggccgaactggccgcgtggggcgccgaggtgcgctgggcggcttgcgacgcggccgaccgggacgctctcgccgaggtgctggccggcacgccggtgacggccgtggtgcacgcggccggcgtcctcgacgacggcgtgatcgccgcgctcaccccggagcgcatggagaaggtgctgcgcccgaagacggacgccgtgctcaacctccatgaactgacgagcgacctgtcggcgttcgtcgtcttctcctcggtgtccggaatcctgggcagcgcgggacagggcaattacgcggcggcgaacgccttcctcgacgccttcgccgaagcccggcgcgcccgggggctccccgccacgtcgctggcgtggggcctgtgggagcagggcagcggcatggccgaccggctcgaccaggcggacctcgcccggctcaagcgggtgggcctggccccgatagccgtcgacgaaggactgcggctgttcgacgcggcactggccctggatcgggccgtcgtcgccccgctgcggctggacctgggcgggctgcagggcacggtgccgccggtcctgcgagggctgcgcggtaccgtacggggcaccgcgcgacgcatggcgcagaccgcgccgaagggatcgctgggtcagcggctggccgggctgccgcaggccgagcgcgagcaggtggtgctggacctggtgcgcgccgaggtcgccgccgtactcggccacgcctcggcccaggccgtccagccggaacacgcgttccaggacgccggtttcgactcgctcacctcggtggaactccgcaaccggctgaacgcggcgaccgggctgcggctccccgtgaccatggtcttcgaccatcccacgcctgtcgcgctctcccgcttcctgctggccgagacgctgggcgtccaggagcaggccgaggccgcgatcgccgcggtgaccgggacggacgaggcgatcgcgatcgtgggcatggcctgccggttccccggtgacgtgcggtcacccgaagacctgtggcgcctcgtcgcatccggcggcgacgcgatctcgggcttccccgaggaccgcggctgggacgtcgagaacctctacgacccggaccccgaccgctccggcaagtcctacgtgcgccacggcggcttcctccacgaggctgccgagttcgacccggccttcttcgggatctcgccgcgtgaggcgttggcgatggacccgcagcagcggttgctgttggagacgtcgtgggaggcgttcgagcgggccgggatcgacccggcgacggtgcggggcagcaggaccggtgtcttcgccggcgtgatgtaccacgactacggcgggcgcgtgaaaacggctccggagggcatggacgcctacctgggcagtggcagcgcgggcagcatcgcctccggccgggtctcgtacacgttcgggctcgagggcccggcggtcacggtcgacacggcgtgctcgtcgtcgctggtggcgctgcacctggcgacccaggcgctgcgcagtggcgagtgctcgatggcgctggtcggcggtgtcaccgtcatggcgactccctcgacgttcgtggagttcagccgtcagcgcggcttgtcggcggacggccggtgcaaggcgttcgcggccggcgcggatggtacgggttgggccgagggcgcgggcatgctgctggtggagcggctgtccgacgcccggcgcaacgggcacacggtgctggcggtggtccgcggcacggcggtgaaccaggacggcgcgtcgaacggtctgacggccccgaacgggccctcgcagcagcgggtgatccggcaggcgctggccaacgccggtgtgtcctcggagcaggtcgacgcggtggaggcgcacggtacggggacgaagctgggtgacccgatcgaggcgcaggcgctgatcgctacatatggtcaggagcggcctggggaccggccgttgtggctgggctccctgaagtcgaacatcggccacgcccaggccgcggccggtgtcggtggtgtgatcaagatggtcatggcgatgcggcacggtgcgctgccgcggaccctgcacgtcgacgagccgacgccgcacgtggactggtcggccggtgatgtccggctgctgaccgaggccatggagtggccggagaccgatcacccgcgccgggccgccgtgtcatccttcggcatcagcggcaccaacgcccacgtgatcgtcgaacaggctcccgacaccgcggagctgccgcccgtgcccgactccggcaaggccgtgccgtgggtgctgtcgggcaggacggaggcggcgctgcgggcacaggcggagcgcctgctgtccctggtcccggagatggacctgccgccggccgacatcggcttctcgctcgccaccacacgctcggccatggagcatcgggccgccgtggtgggggagagccgggacgaactcctggaagggctccgcgcgctggccgcggggtccccgtccacgcgggtcgtcctgggtgaaccgggcgccggcggcaagtcagggttcttgttctcgggtcagggctcgcagaggatcggcatggggcgcgaactctacgatgctttcccggtgttcgctgcggcgtacgacgaggtgtgcgcgcttgtggacgcgcccgtcgacgtcgactccgaggagctcaaccagacgggtacgacgcagcccgcgctcttcgccgtcgaggtcgccctgttccggcttctcgaatcgtggggcatccggccggactacgtggccggtcactcggtcggtgagatcgcggccgcgcacgtggcgggggtgctgtcgctcgaggacgcggcgaagctggtgtcggcgcgtgccgcactgatgcaggccctgcccgccgacggggcgatggtcgccgtccaggcgaccgaggacgaggtgctgccacatctcaccgacggcgtcggtatcgcggcggtcaacggcccgcagtccgtcgtggtctccggtgccgaggacgtggtcgtcgccatcggcgaggccttccgggagcggggccgtaagacgtcccggttgaaggtcagtcacgccttccactcgccgctgatggatccgatgctggaggagttcgccgaggccgtcagcggtctgtccttcaacgagccgcggcttcccgtcgtgtcgaacctcaccggccggctggccgagccgtacacccccgagtactgggtccggcacgtccgcgaggcggtccgcttcgccgacggcctgcacaccctgcacgagctgggcgtgaccacgttcgtcgagatcggccccggcggcgtcctcagcgccctcgcccagggctgcctcgacggcgacatcgtcaccgtccccgccgtacggaccgaccgccccgagccgcaggccgtcgtcaccgcgctcgccgagctgcacgcccatggcgtctcccccgactggcgggcgctctttccgggcgcccggcgcgtcgacctgccgacctaccccttccagtacgagcgcctctggctggaagcgcccgaggagtacaccggcacagcggctgccaccgggctcggactgggggcggcggagcacccgttggccggtgcggcggtcgcgctccccggcgccggcgggttcctggtcacagggcggctctcactcaggacgcatccctggctcgccgaccacacggtcatggacagcgtgctgctgccgggtaccgcgctcgtggaactggcggtgcgcgcgggcgaggaggccggttgtgcacaggtcgaggacctgacgctggaagcaccgctgatcgtcccggagcgcggtggtgtggccgtgcaggtgtgggtcgaggccgaggaggagccgggcaggtgcgcgctgagcgtgcactcgcgacgtgaggacgccccggacgacgcgccgtgggtgcggcacgcggtcggccgcctgacggacgcgctgcccgagccgccgcacggcgcggacctcggcgcgtggccgccggcgggtgcggaggccgtcgacctgaccgggttctacgagggcctggacggactcggcctgggctacggcccggtcttccgcggcctgcggtcggtgtggcgcagcggggacgacgtcctcgcggaggtcgccctccccgagggcacggaggcgggcgcgttcgccgtgcatccggcgctgctggacgcggcgctccacgcagtcggcgcgggcgggctcgtccccgtcctcgacgggccgctgctgcccttcgcctggtccgaagtgggtgtgcgggccgcgggggcgacggcgctgcgggtcaagctctctcgcacgggtacggacgcggtgtcgctgaccgtggccgacgcctcgggtggtctggtggccacggtcggctcactgtcgctgcggccggtgtcgcgcgagcaactgctcgcggcgggcggctccggcaggcgtgccgacgactcgctgttcggcctcgcatggcagcccgcggtcctcacggagactgacgccgccgccggcctcgacgtacggagctacgcggacctggccgcgctgtcgaccgagccggcccttcccgatgtcgcggtggtcactgtcgttccgtgcccggcgggttccggtagggagaccgccgaccgcgtgcacagcaccacgagtgaggttctggcgctggtgcagtggtggttggcggaggagcgtgcggggcgtctggcgttggtgacgcgtccgggcgatctggctcatgctgcggtgtgggggctcgtgcggtctgctcagtcggagaacccggaccggatcgtgctggtggaggccgaggagaccgatgaggcggtccgtgtgctgcctgccgcgctcgcttccggtgagccgcagttcgcggtccgcgacggggaggtgttcgtaccgcgcctggtgaaggccacccggagcgccacggggaccgccaccggcacgccggacttcggcgtcggccccgtcctgctgaccggtgcgtccggtgcgctgggcgggctcgtcgcccggcacctggtcgccgagcacggcgtacgcagcctgctgctgctcagccggcgcggcgcggaggcccctggcgcggtcgagctggaggccgaactggccgcgtggggcgccgaggtgcgctgggcggcctgcgacgtcgcggacagggaggccgtctccggaatgctgaacgggctcggggagcaatcgctgtcggccgtcgtgcacaccgcgggtgttctcggcgacgggatcgtcgcctcgctcacaccggagaggatgagggaggtcttccgccccaaggtggacgccgtgctgaacctgcacgagtgcacccgggacatgggcctggccgcctttgtggtgttctcgtccgtcgccggcatggtcggcagcgccggtcaggcgagctacgccgcggcgaattccttccttgacgccttctcggcgcaccggcgccgtgaggggctgcccgcgatatcgctggcatggggtgtgtgggaacagtccggtgcgatgacggacggcctcgtcgaggccgaccgggcgcggatggcgcgcagcggcgtgctgccgctgccgcccgaggaggggctgcggctgttcgacgcggcactggcttcggacgaggcggtactcgccccggtccgcatcgacaccggcgcgctgcgtgccggtgaggcaccgccggtgctgcgcgccctcgtgccggccgcggccgcccggaggaccgcgcgggccgccgccgctccctccgcgtcctcgctggccgagcgcctggaggagatgcctgaggccgagcgggagaagaccgtgctggacctggtccgggccgaggtggccgcgggcctggggcacgcgtcggatcgtacggtccggccggaacacgccttccaggacctgggcttcgactcccttacggccgtcgaactgcgcaaccggctgaacaaggccaccgggctgcggctccccgcgacgctggtcttcgaccatccgacacccgctctcctggcccgtcatgtgttcatggcggcggcgggggcggccgaaccggccctagtggattccctacttgccgatctggacagggtcgaacaagaattggtcacgacgttggcagcgagtgaagctcgcgaccggatcctgtcaaagctccagggtttgttggcgattgccggtgaattcggcaaggcgccggcccaggaaggccctggtacgggcggcagcgatctggaatcggccacggacgacgaagtattcgatctgctcggcaaggaattcgggatttcc

SEQ ID NO: 416 - DNA, 1032 bp, Streptomyces avermitilis
  CDS (1)..(1032)
atgccagttgaatttctctctcatgaccaggtctcgcgctacggccggttcgcttcggctccgacacccggggagctggagcagttcttccgtctggacgcgaaggcgttggagtcggcgcggtcgaagcgggcgccggcgaaccggctggggtgggcggtgcagtggggctgcgtacggatgctcggggtgttccccaccgaggacctgtccgtggtcccggaggtggtggtccgcttcgctgccgaacagctgggtgtcgatccgggcgagttcgccgcgtacggagcccggcggcagaaccggtacgagcacgcatgggagatccgggacgcctacgcgtaccgggagtccccggcggcggaggcgcaggtgcgggagtttctggcgacgcgggtgtgggcgtcgtgggaggggccgcgggcgttgttcgaccgggcggtggggtggctggtggacaaccgcgtgctgctgccggggattacgacgctgacccggctggtggccgaggtccgcgcgcaggagaacgctgcgttgtaccggacgctggatgaggcggtgcccgagaagctgcggcagtcgatgcgggatctgctgaaggtcccggagggcagacgggtctcggagctggagcggctgcggagatccccgatgggggtgtcggggtcggcggacaggctggcgttcagcgagcggatccggatggaagcagtcgcaatgttcaccgctgggccgggcagcacggacatcgcgaaggagttacgggtcagcgtccagtcggtccagcggtggcgttcaggcctggcgggagaccggccaggacggggtgcggtcccgcagcccgtctcggtcgagctgagcgagaccctgttcgccgcgctcgatgaggaacgggccaagggcttcgctccctcatggacaatacgttaccttcaccacgatttccccatttttggacagaggtatgcctataaatggtcacagggctgcttgcactccttcgggcgatcagcgcagggatacagagaccag

SEQ ID NO: 417 - DNA, 1251 bp, Streptomyces avermitilis
  CDS (1)..(1251)
atgggagaagctttgatcacgctgtgtacacgaagcaccaggctggcggctacggccggcgtactcggcggtgtactcgcagtcacggccctcggcggtacgagcaacgctgcgaccagcggcaacggtgcagggaaccacccgacatcgcaggcgaggataaatcaggcgggcgcccaggaagcctccgacgcccgcatcgagatcacgcccgggcaaggcacctacagcgtcgggaccaaccacccggtcagtgtcaccgtcaccagcggcaagctcaccaaggtgaccatgaccgccgtcgcgaccggtgccgagatcccgggcactctgtccacggacggcacctcctggaagccaaacggccggctggagcgtgccaccaagtatcagatcgccgcagaggctggggacgtcaagggccgctccaccaccggtagcgccacgatcaccactgtctccccggccaacgacttcatcgggcacctctcccccgaggacggctcgaccgtcggcgtggccatgccggtgacggtcaacttcgacaaggcgatcagcgacaaggcggcagtgcagtcggagatccgggtcagctccagcagcggccagcgggtcgtcggtcactggttcaacgaccaccgcgtggacttccgccccgagaattactggaggcccggctccaccgtcaccgttacgctcaaccgccacggcatccagaagacggtcacgttcaagatcggccggagccagatcagcaccgtggacgccaagacgaagcagatgaccgtcgtccgggacggcaagacgatcaagaccatcccgatctcgtcaggcagccctgagcacccgacgtacaacggtcagatggtgatctccgaaaagttcaggcagatccatatgaatggtgcgagcgtcggcctcacggagaagaacggcaagccctcgtacgacatcaaggccgtaccgcacgccatgcgcctgaccgactcgggcacgttcatccatggcaactactggggtaccgactctgtcttcggcgaggccaacaccagccacggctgcgtaggcctgaaggatgttcgaggcgacagccacggcaggcagcccgccgcgtggttcttcgaccactcgatagtcggtgacgtcgtgatcgtcaagaactccgaggagaagaccatgttggcccctgacaacggcctcagcgattggaacatgtcgtggagcgagtgggtcgcgggcagcccagccacc

SEQ ID NO: 418 - DNA, 576 bp, Streptomyces avermitilis
  CDS (1)..(576)
gtgccggccggtggctgtgcccgagacggcgtgccgagtaccggcactggcgtctggtcgcggtggacggcacgacgctggatgtggcggacatgggccaacgaagagttcttcggccgccaggccggcggccgcggggagagcgcgttcgcgcaggcgagggtggtggcactggcggaatgcggcacccatgcggtgttcggggctgtcatcggacccgctgtcggcgggcgagcagagctgtcccggcagctgttcccccagctcggggaggggaagctcctgctggccgatcagggcttttacggcttcgagctgtggcagaccgcccgcgccaccggcgccgacctgctgtggcgcctccgcagcagcgcggccgtgcccgggctccaagttctggacgacggctcctacctcagctccatccgcgccgaggcggaccgaacagtcctcactgcgggggcccagagcgccaaccggagtgaccggcttcggcgcttgcggctgcccgcaggtgccgggctggtcacgttgcacgaggccgagcggcgccccctcccagccttcctcttgatc

SEQ ID NO: 419 - DNA, 636 bp, Streptomyces avermitilis
  CDS (1)..(636)
atgaagtacaccaccaccgcgccgacagcagactgcgctgttcgacccagccggtctcggcgatcagaacgccccgccgaggccgcagaccgcgcggtccccggacactgggaaggcgatttgatcatcgggacggggcgctccgcgatcggcacgctggtcgagcgcagcagccgctccacgctcctggtgcacctgccccggctcgagggctggggtgagaatccgcccgtgaagaacggcacctcacttgggggctatggcgcgatcgcgatgaacacagcgctcaccgcctcgatgacgcagctgcccgagcagctacgcaaaaccctcacctgggaccgcgggaaggaactctccggccatgcccagttcgccctcgacaccgggacgaaggtgttcttcgccgatccccactcgccctggcaacgaccgacgaacgagaacacgaacgggctgctgcgtcagtacttcccgaagggcaccgatctctcccggtggtcgtccacggacctcgaagccgtcgccatggcgatcaacaaccggccccgcaagaccctcggttggcggacgccagccgaggtcttcgaagagcagctacgctcgctgcaacagcccggtgttgcaacgaccaat

SEQ ID NO: 420 - DNA, 936 bp, Streptomyces avermitilis
  CDS (1)..(936)
atggacatcgcagccatcgatcggttcgaggctagccagggccggctggcctcgctcgcgtaccgtctgctcggctcggccgccgacgccgaggacgccgtgcaggacacgttcctgcgctggcaggccccataccgcgaacgggttgaggtgccggaggcgtggctgaccaaggtcgtcaccaatctctgcctcgaccggctccgctcggcgcaggcgcgccacgagcaggcggccggtgcctggctgcccgagccgctcctcgatagcgacccgatgctcggcccggccgacaccttcgagcagcgcgaatcggtgtccttggccgtactgaccctcttggagcgcctctcgccggtcgagcgggccgtctacgttctgcgtgaggccttctcgtacagccacgccgagatcgccgggatcctcgacatcaccgagtccgcgagccagcagcacgtccaccgggcccggatccgggtcgccgccgagcgccgccgaggcagcgagaccgaccccgcgtccgcgcgccgggtcgtcgaggagttcctcgccgccgccacgtcggggcgcaccgaacggctggtggcgctgctcaccgacgacgtgacggcggtctcggacggcgccggactgagcaagcggctgctgcactacaagacgcgcgagcgggtcgcctcctacgtgcgggccggcttcaagcccacgccggcgaagcgccggctggccggcggctcgcccgcgttctatatcgcgctggtcaacggctccccggccgtcctcgccgtggtcgacgaccgggtcgtgggcgccgtggcgttcgaagtcagcgacggcaaggtcgcgtccctgcgcggcatcgccgccgcggaccggctcgcgcgcctcaacgaggcgtggcggcagcacgaacccgacgcgccagccatcaacgcatgg

SEQ ID NO: 421 - DNA, 1188 bp, Streptomyces avermitilis
  CDS (1)..(1188)
atgaagcaccgcatcgtcgtactcggcgccggatacgctggggccttcgccgccggaaacctggcccgccgactctcccccgccgacaccgagatcaccgtcgtcaacgccgtgcccgacttcgttgagcggatgcggctccaccagctcgcgatcggccaggacctcgcgttctgcaacctcgccgacgtattcgcgagcaccggggtgcggctgcgcctggcgcgcgtcaccggcgtcgaccccgaccgcaggaccgtcgccgtgaccggcgaggacggcgacggcgagctcgcctacgacacgcttctctacgcgctcggcagctccgtcgcccaccatggcgtccccggcgtggccgagtacgccttcgatgtgaccggccggtcctcggcgctgcgtctgcgcgagcgcctggccggcctgggcgagggcggcaccgtgctggtcgtcggtgaggggctgaccggcatcgagagcgccaccgagttcgccgagtcccggcccgacctctcggtcgccctcgccgcccgcggcgagctgggcgcctggctctccccgaaggcccgccgtcacctgcgccaggcgttcgaccggctcggcatcaccgtccacgagcacaccggcatcgaagccgtggagccgacacgggcgatcgccgccgacggtacgtccatcccggccgacgtgaccatgtggtcggccgggttcgccgtgcaccccatggcggccgccagcggcctggaggtcgccgagaccggccagatcgtcgtcgaccgcaccatgcgctcggtctcgcacccggacgtctacgccgccggtgactgcgcctacgcgatcggcgacaacggccggccgctgccgatgtcctgcgcctcggccggcttcaccaacatgcaggcaaccgccgcgatcatcgcgcgcctgacgggtagtgaggtcccgaccaccgggctgaagtaccacggcaaccacatcagcctcgggcggcgggacgcgatcttccagatggtggacggggacggccggtcgaagccctggtacctgggcggccggaccgccgcgcggctcaagtcgggcgtgctcaagggcgccgggtggagcatcgcccacccgaccttcggcatgccgaagcgcaagcgccgcctggccaccgcgcctgaccgggccggtgtgaaggtcgccgcc

SEQ ID NO: 422 - DNA, 516 bp, Streptomyces avermitilis
  CDS (1)..(516)
ttggaggggaatgcgacgaccctggttgtagtacgggctaatgcggggagcaggaccggcctgggtctacggcgcggtcgaaacagcttctgtcgtacgggagtcgctgaccggtgtggtcacgggagtacgtggccacgggactacatgctgcaggacgccaccgtcaccgcgatccgctccgtccttgccctgctgcgccgcgtcaccgaggcgcgccgtggcggggtgagccgggagagccagctgcgccaccacgccgactggttcacctcctgtgcgagcgacgaggacgcgcacgccctgttacaggcgggcttcgggctcggcgcaccccggcacatcgccgtcccgtatgccgatcccgaacagatcccagggcgtacgtcctggtggggggccgaaccggtcgagctggctcgcaccctggtccagtccggccgcacctccgcccggcacggcaccggccgcatcgagcgcaacgacgcccagcggcccggctccgcgccgagcacc

SEQ ID NO: 423 - DNA, 333 bp, Streptomyces avermitilis
  CDS (1)..(333)
atgtccggggcaccgcaattcctgccctcgcagtcgcttccggaggtgccgtacgcggacttcgcacgctccctcggcctgggcggcgtgcgggtggagaagccgggcgacgtggagagtgcgtggcgccaggcgctggcttgcgaccggccattcgtgctcgacttccgcacggacccggcggtgccaccgatcccgccgcacgccacgctggagcagatcgaagcggcggccaccgcgatcctcgagggtgacagcgaccgggcgggcgtggtgaagcagggcttcaaggcgaaggtgcaggagatgctgcccggcgggcatcggaacaag

SEQ ID NO: 424 - DNA, 459 bp, Streptomyces avermitilis
  CDS (1)..(459)
ttgaggagtgctgtgtccaaggtcgaggaatccatcgaggtcgccgtacccgtcagcaccgcgtacaaccagtggacgcaattcgaggagttcccgcagttcatgggtggtgtggagcggattgaacagcagaccgcgacgctcacccactgggtgacgaaggtaggcggcgtgaccagggagttcgatgcggaaatcgtcgaacagatcccggacgaacaggtgtcatggacgacggtcggcggtgatgtacaccaagcgggcgtggtcaccttccaccgactggacgaccggcgcaccaaggtcatgctgcaaatggaccacgactccaagggtgtcgtcgacgccgtcggggacaagcttggcgtggtgaagcaccaagtctccgaggacctgaagcggttcaagtccttcatcgaaaatcggggccaggaaagcggcgcctggcgcgggcaggtc

SEQ ID NO: 425 - DNA, 627 bp, Streptomyces avermitilis
  CDS (1)..(627)
ttggaggtcgccatgtcagagcgccacgaaccccgccacgaacccgccggacagacccgtccgcggctggtgcccctccccgaggagcactgggatgcaaggacccggaagctgttggccggcgcagcccacgaccccggagggcggatcccgaacatcttcacgacactggtgcgccatcccgatctctacgagcagttcatgcccttcggaggccagttgctccgcaggggccgactaccagcgaggctccgagaactgctgatcctgcgcacctcctgcaacaccggcacccggtacgagtggggacggcaccttacgctggccaaggccgcgggcgtcacggatggggacatcaaccgcatcaccgagggaccggaagcgcccggctggacggacctcgagaggcacctgatccgggcggcggacgagctgaacagcggtgcaacactgtccgacgccacctgggaggcgctgaccgaacacttcggcgacgccgagctgatcgagatcgtcatgctggtggggcagtaccacatggtggccttcttcctgaacgccaccggtgtggaattggaccccggtttcgacagcacaggcttcacggaaggggaccggaaccatggg

SEQ ID NO: 426 - DNA, 801 bp, Streptomyces avermitilis
  CDS (1)..(801)
atgggtgaaggacacccggagcaggcggcccctcggctggccggccgcaaagtgctggtggtcggtgcgggcacccgccccgacggcgacccgcgggcacccgtcggcaacggccgggcgatcgccgtgctcgccgcccgtgagggcgccgacgtggcatgtgccgacgtggccgccccggccgccgccgcgaccgccgaactggtccactcggagggggcattgagcgtggccgtcgtgggtgacgcgacggatgccaagcagtcggccgccatggtcgccgaggcggtccgccgtctgggcggactggatgcgctcgtggtcaacgtcggagtcggtctcggcaccgggctggatggctcatcacccgaggactgggaccaggtgctctcgctgaatctgcgtgcgccctttctggccgccaagcacgccctgccggcgatggccgacggaggcgccgtcgtcttcatcggatcggtcgcaggactgcgcgccgccacgaactcgccggcctacgacagttccaaggccggcctgttcggcctcacccgccatgtcgccaaagagggcggggcgcgccggatccgcgccaacctggtcgtccccggtctgatcgacacccccatgggacgacaggcctcggcccaacgggcctccaggaccgcctcgttcgagcgcatcccgttgggccgccagggcaccgcctgggaggtcgcggaggccgtcgcgttcctgctctccgaccgcgcctcctacatcacgggccagagcctggtggtggacggcggactcagcgccgta

SEQ ID NO: 427 - DNA, 642 bp, Streptomyces avermitilis
  CDS (1)..(642)
gtggcggcccgacgccccccgaccaagcgcgatgaccagcgagaggcctcccgccgaaggctcctgaacgcggcactggagatcctcgcggaggagggctaccgcggcctgacggtgaagaaggtcggcgaccgtgccggagtcagccggggcatggtcaactaccacttcatgtccaaggccgggctcgtcgaagccgtggtcgccgacattcgtgagacgttcatcgacctgctccggtcgcagcccgggtacgcccggatgaacgggctcgaatcagttttggccaagctcgaccagctcttcgcccggctggcggagccggagccgggggtgcgggcgcgggcgttgctggtgctcctcgtcgaggcggtcggcagcgccgacgggatgaaggacttgatggccgagcatctcagtctcgtgcgcaccggcgtcgaggaggacctcaggcgggggatcgcggatgggagcatccgcccggacgtggacgtggtcgcgcaggcgttcctggtggagagcatcgcccgcggcgtgctccttcagtatcaactggactccgcccgaacccgtctggtggacatcgcacgggctgcccgcgagacgctggtgctcggactcacggccacgcggggcgccgac

SEQ ID NO: 428 - DNA, 1230 bp, Streptomyces avermitilis
  CDS (1)..(1230)
gtgcaccgcatgaaggtcagagccatcccgacagcagtcaccgccgctctccttgtcactgcggcgcatcccgccgccggtgccgccgcccccgccgaagccgtgccgacgaggttcaccgtcgacaccacatccgacgcggtggacgccgacccgtcggacggccggtgccgcaccgcgtccggcacgtgcagcctgcgcgccgcggtgatggccgccaactcccggccgggcagcacgatcgcgctgccttccggccgctaccggctgacgatcccgcctgacccccggctgatcaccggcgaccatcccgacccgaccactggcgacttgaacgtcgacgcgcccaccacgattaccggcgccggtgcgcgggctaccgtcatcgacgccaaccacctggaccgggccttccgcctgcgggcggacacccgtatgtccgatgtgacgatcacggggggagaggcaaggcagcgggaacttcccttcaccgacaccgggggcggcggcatcgccaacgaacggcatctgacgctgcgtcgggtcgcggtgaccgggaattccgccggctatgggggcggcgtcttcaacgtcccggactcccacctggatctcgtcgacagcacggtcagcgggaacgccgccggagaggccggaggcatcaggttcgacgacagcggcactgtgacgaactcgacgatcgccggcaaccgcgtgacggaccccggcgaccgccccggcagcctcggcggctacggcggaggcatcgacatccgcggactgggaaccgtggaaatcctcgactcgaccatcacggggaaccgttccagccaccacgggggcggaatcaacatcgcccccgcctacctcgacagcctgcccgcaccgatccccgacatcgtcgatctgcctcttggacgtctggtcctgcgcaactccatcgtcgcgggcaacaccgccgactgcgcgaaggccttcgccatcatcgcgtctcgaggccacaacatcgacggcgacggcagctgccggctgaccgccacgggcgatctgccccgccgtgacccgctggtggggccgctcgcggacaacggcggccccacagacaccacggcgctgctgccgggcagccccgccctcgacgcggccgacggctgcccagccaccgatcagcgcggcgtcgcccgcccccagggcaccgcctgcgacatcggcgcctacgagtacacgcca

SEQ ID NO: 429 - DNA, 1860 bp, Streptomyces avermitilis
  CDS (1)..(1860)
atgagatcttcgagctcgcgccccgccctggccaccgccgtgaccgtcgtagcggccctgctgctgtccctcaccactcccccagtcacggcgcatgccgatgccgaccatgactccctggtcgtgcgcaccgaccgcggctgggtgcgcggggcagccggccgcgaccgcgggcgaatctttcaggggattccgttcgccgccccgccgacgggtgacttgcgctggcgtccaccccgacccgccgcacggtggtccggcgtacgggacgccaccgcgtccgcccatccctgtccgcaactgccgctgaccctgctccccgacggcggccccgtcctgcccggcgagtccaaccgcaccggcagcaccacagaggactgcctgtacctcaatgtgtggacgcccgcccgcaccatggtccggcccctcccggtgctggtgtggctgcacggcggcggcaacgcctacggcgcgggcagcgactacgacggctcggcgcttgctgcgcgcggtgtggtcgtggtgaccgttaactaccgcctcggagcactggggttcctcgcccactccgccctgtcggccgagagtgcggaccgtgcctccggcgactacgccctgatggaccagcaggccgcattgcgctgggtacggcgcaacatcggcgccttcggcggcgaccgcagccgggtgacgctcggcggtcagtccgccggatcgtcggacgcctgcgtccacatcgcctcgccgaccgcgaagggcctgttccaccgggcgatccagcagagcggaagctgcgcagcggacggcggactgacaccgcccacgctcgacgctgcagagcggaagggaagcgacttcgcggccacggtcggctgcaccgacccggcgaccgcggcggcctgtctgcgagccgtacccaccaccgagctcatccgcagcacaggaaccggggccgcgtccttgtggggcccgaacaccgggccccacatccttccgcgcacgccgcacgcggcgtgggccgagggacgggtgaacgcggtgccgacgctgagcggcaacacccacgacgagtaccgctacttcaccgccctgtacgtggatctgctcggcggcggcccgctgacccctgcctcgtacgcggcactgatcacgcttcagcacggcgaccgtgcggccgcggtcctcggcacgtacccggctgcggcgtacccgtcgcccaacctggcctattccaccgtcggcaccgaccagcggttcgcctgcccggcacgggccgacagccggctgtacagcagccgagcgcccgtgtacgcctacgagttcgccgactcccaggcaccaccgttcattcccgccccgcacacaccgcagggcgctttccacgcctccgaactcgcctttctcttccccacggacgcggtgccacccctgacgccggcccagcgccgtctgtccgccatgatgaccgcctactgggcccgcttcgcggccaccggcgaccccaacgtgccctgggctcccacctggccgcgctacacggccgacggagaccgcatccaagtgctgacgccggaccggacgggccccaccaccgggttcgcggccgaccatcactgcacattctggcagccccccactccccgggggcggtgcggtgacgtcgacgtgggccctggtccgggacgggtgccggagcgtgcggcagggcccctgacgccctggccaaccgtcagcgggagcgtttggtcgcgacggtcgccttcgcccgcgctcactccccgtactaccgcgagctgtaccggaccctgccggaacgcgtcgaggacccggccctgctgccggtcacgcgcaaagagatac

SEQ ID NO: 430 - DNA, 387 bp, Streptomyces avermitilis
  CDS (1)..(387)
atggcccgattcgacgactgggttaccgacccggaggtgacgctcgaccgcgtacgtgccttcgtcgccgaccccggccgggtcggcgagcgcttcctgtacaggtacctggtcaccaccacgtccggaaccaccggacaccgcggcgtgttccttctcgacgaccgggcggcggcggtggccagggccctatcgctgcgggccgcccggcgcactttgaccgcctcggcgacggcccgtttactcgcccaccgcgagcggtcggcgcacatcgtcgccaccagcggccatctggccgcctgcacgcccggggcagccgggtgctgtcggcgcacagcccgctgcccgacctggtggaccaactcaaccggtaccggcccgtgttcc

SEQ ID NO: 431 - DNA, 423 bp, Streptomyces avermitilis
  CDS (1)..(423)
gtgccaatgggcgcagccgatcctgcgctacgacctcggcgacagggtctgctgcgcccggacgcgtgcgcgtgcggagacccgctcccctccatcaaggtccgtggccgcgtggccgacctgctgtccttcccgcgccggggcggcggcaccgtccggatcgtgcccatggccttcgagaccctcctggaaagcatcccggacatcgacctgttccagatcgtccagacgtcgcccaccaccctccgggtgaggatccggtccaccaccggagccgatcgagaacggctgtggacggcggtgcgccaggagctggccgccctcctcggcgcccacggggcggaccaggtcagtgtcgaacgggcccacgagccacccgagcagtcgccgggcggcaagtaccgtgtcgtcatgccccattcg

SEQ ID NO: 432 - DNA, 657 bp, Streptomyces avermitilis
  CDS (1)..(657)
atgacggaggcaccggtccagaaccgcggcgcacggtcccgggacgcgattctcgacaccgccggcgaactgatggcgcggtacggctacgccgccacctccatctcgatgatctccgccgcgtgcggtctgccgaccagctccctctactggcacttcgggagcaaggacgggatttatatcgcggtgctggagcgcgccaggaccgagctgctggctgccctgcctccggccgaggtgccgggcgccgacgtcatccagcgcctggacaccttcctggccgaggtcagggacgcgttcgagcgtcatccgcacggtctgcggttgctgctggggctgggcatggtgcagcaggatgccagtgcggcggccgtggccgaggtgcgtcagtaccgcgacgcgctggtggtctgggcacgggaatcggtgagcgccgtcttcgggttgcgtgaccgcccggaggtggcggacgagttggcgcgcttcacgctcaggatggcgagcggaacagccgtggccctctggttcgatccgggcaccgccctggagaccgggtcgttgcgtgtggcgttgctggcactggccgctcaccacggcgttccggtacgggacgccccgggtgaggacgccccgtcgcgcggcgtcacgaatggggca

SEQ ID NO: 433 - DNA, 2442 bp, Streptomyces avermitilis
  CDS (1)..(2442)
atgtgctcgaggtgcggaatgcatgacatcacctttcgcggcgacggtgaatttccggaaccgggaagcgaggcggacgtcctgctggacgcctgcggtcgggtcgcggcctggggtccgggagcgcagcagatgctcggctgtccggcgcgcgaggctgtgggccgtagtgcggacgagttcctctacgaccccgccgacgcggcggacatcgtcaggcgctgggagaagggcgcccgccgggggtctctggtcctgcgacagcgcagcgggaagccgctggcggcccagatctgggtccgtgccctcacgtccgcgaacggtgatccgcagtggctggtgcaggcggcccgtaccgccgtactccgcacgtacgaatacgggcgcgccctgctgaaggggctgttcaccgactcgccgttcaacatcgacatcttcgacacgcagctgcgcttcgtcggcctgaacatcgccgagcggcgcgccggcgtgttccaggggaccgagtactccgggcacaccatgcgcgagatggcgccgcccggcctgctggacgtcgatgccctcgaagcccgccagcggcgggtccttgagaccggcaaggcgctcatcgacaccgaggtggtcggccaccccgtggccaactcgccgcgggagtacgtgtggtcggagtccatcctgcccctgagggacccgtccgggagggtgatcgcgttgggtcatgtcgtctccgacgtgacccaacgggtccgatcgcgcgagcggctggtcctgacgaacgaggcggccatcgggatcggcaccaccctggacctttggcgcaccgcccgggaactggccgaggtcgcggtaccgcgcttcgccgacatctgctttgtcgacctgttggactcagtcttccccggccgcgaaccgaccgaaggccgaccaccgcgtcccccgctgttccgcagggccgcttgcagtggggcagccgaagacacggggtcagacgctgccggggaagtgaaggtgggggatgccaatttgtgggcgacggcgcccggctcgccgttcctcgacgctctcacgaagggtgaatccgtcctcctggcggacgatcaactccagaactgccccgccgcagtcggcctccgccactccccggacgacggaccgaagatccattcgtggctgctcgtcccgatgttcgcccgcggcgtcgtcctgggcgctgtcgtcttcctgcgctccggcaacccccgccggttcgagcccgacgacgtgctgctggcggaggagatcgtgaccagagcggcggtgtgcgtcgacaacgccagccgataccaccgcgagcggacgaccgcgctgaccctccagcgcagtctccttcctcagcggctgccgtcggcgtcggcggtgcggacggcgtcctgctacctgcccgcgagcgggcacaccgggctgggcggcgactggttcgacgtcatccctctgtccggcgcacgagtggcgctcgtggtgggcgacgtgaccggacacgacctgcagtccgctgtgaccatgggccgcctgcgcagcgccgtacgtacgctcgcggatctcgatctggcccccgacgagcttctcacccatctcgacgaccagatgaaccgcttcctcgacgaacggagtgacgaagggcccctggcgacaggagcgacgtgcctgtacgcggtgtacgaccccgtgtcccgccgctgtctcctggcacgcgccggtcatccaccgccggctgtgctctcggtgaacggcgccgtcgacttcgtggaactgcctggcggccccccactgggcctgggaggtatcgtgttcgaaaagcgtgagatcgccatggacgacggggacgttctggtgctgtacaccaacggcctgctgcagccgcgcgcccaggatctcgatgccggactgcaccgcatgcgcgacaccctttcgcggactcctccatccgccacgcctcaagaggtgtgcgacacgctggtccgcgaactgctgccgacatgccacaaggacgacgtggccgttctgacggcccgggtcagcggcctggcttcggaccgccatgtcacctggaagatagaggctcaggacgaactggtcggccgggcacgcgacctgacgacgcagcagatggcccggtgggggctggaggaggagtcgttcaccaccgagctgatcgtcagcgagctggtgacgaacgcgatccgctacggcgaagaaccgatcacgctacggctgatcctcgaccgcaacgtgatctgcgaggtgtcggacggcagcagcacatctccccacgtcagacgggcccaggacacggacgagggcggacgcggtctctacctcataacccagctgacccggagctggggaacccggtacggcgaacgcggcaaaaccatctgggccgaacagccactacgctgc

SEQ ID NO: 434 - DNA, 1098 bp, Streptomyces avermitilis
  CDS (1)..(1098)
atggacaccaccaccactactgctaccgccgctgccgtcggctggaacctgctgatcgcccgcgacgatctgtcgatcgccgaactcgccgacgcaccggttcccgaggttcgtgacggcgaggcgctgcttcgggtcgaccaggtcggcctcaccgcgaacaacgtcacctacgccgcgctcggcgactccttccgctactggcagttcttccccgcttcccgcgagggctgggggatcgtccccctgtggggctttgcagaggtcgtcgactcgcgtgtggagggcatcgagccgggcagccgctactacggctatctgccgtccgcgagccacctgttggtccgccccggccgggtggacgagcgcggcttccgggacgcgagcccccaccggcagacactgccccggccctacaatgcgtacgccctcaccacgggtgatctcgcctacgaggccgaccgcgaggacctccagatcctgtaccgcccgctgttctggacctcgttcatgctggccgactggctcgtcgacaatgcctggctgggggctgcgacggccgtcctgtcgtcagcgtcgagcaagacggcctacggtgccgccttcctgctgcagggccgggggtgcgagatcgtcggccttacttcccggcgcaacgtagccttcactgaaagcttgggctgttacgaccgggtgctcgcctatgaggacgtcgtgcaactgcccaaccggcccactctgtacgcagacttcgccggcgacgagcggctgaccgcctcgctgagcgcccatctgggcgacgccctggtgcaccacgtggtcgtcggtatcaccaaccaggagcccgggccggccggcacactggccgaaaccggtccgggcatgttctttgcccccgaccagatgcgcaagcgcaccggcgagtgggggcgcgcagggctggaccggcggttcgccgacgcatggcagcggttcgcccccgtggccgagggatgggtcgacgtcgtccatggccagggcccgcaggccctgacgcaggtctggcgcgaggtccagtcgggccggaccgcgccgcgcaccggccacgtggtcatcttc

SEQ ID NO: 435 - DNA, 699 bp, Streptomyces avermitilis
  CDS (1)..(699)
gtggcggatcgggttggtggcgtggcggctgctggttctgcagactgcagatccggcggtcgccgccggcatgacaacttctccacctaccgcgcgcacccgtggcggcgtagcgagcacacgatggacagcgggaagcggctgttcttctccgaccgtgaagggctacgccgtgaggtcgcccgtctggagcgcacgcaccgccgtctggcagggaccgacgagcagggcaggccattcacagcgttggacccggcggtgcgggtgtgggtgctggtcaccttgtacgagtgcatgacggcgatgcgagaactgtcgggacgcccgctggcgccgcctgaactggatcagatatacggagaattccgtgcggtgtgtaccgagttcggcctgtccgacgacctgttcccggtcacggccgctgacgtacccgcgtatatggaccgcacgatccgcgagcgcctcgaatacagcgaacccgtgcgctacctgctcttcgacatgctccgtgaagctcccgcaccccgccgcctcggccacctgaagccggcctggccgcttgtgcgcacggtggccgcccacgtgatcggtgcgctgaccatcgcagacctgccggaagcctttcgcgagcgcttcagcccgccccgcacccgccgcgcggccctgctgtccttgatcctgcaccgcggtatcgcgtgc

SEQ ID NO: 436 - DNA, 1014 bp, Streptomyces avermitilis
  CDS (1)..(1014)
gtgctgattgctcagcgtccgtccctgaccgaagaggtcgtcgacgagttccgctcccggttcgtgatcgagccgctggagccgggcttcggctacaccctcggcaactccctccgccggaccctcctgtcctcgatcccgggtgcggcggtcacgtccatccgcgtcgacggcgttctgcacgagttcaccaccgtgccgggtgtcaaggaggacgtcaccgacctgatcctcaacatcaagcagctggtcgtctcctcggagcacgacgagccggtcgtgatgtacctgcgcaagcagggtccgggtctggtcaccgccgccgacatcgcgcccccggccggtgtcgaggtgcacaaccccgacctcgtcctcgccacgctcaacggcaagggcaagctggagatggagctgaccgtcgagcgcggtcgcggctacgtctccgccgttcagaacaagcaggtcggtcaggagatcgggcgcatcccggtcgactcgatctactcgccggtgctgaaggtcacgtacaaggtcgaggcgacccgtgtcgagcagcgcaccgacttcgacaagctgatcgtcgacgtcgagaccaagcaggccatgcgtccccgtgacgccatggcgtcggccggcaagacgctggtcgagctgttcggtctcgcccgcgagctcaacatcgacgccgagggcatcgacatgggcccgtccccggtggacgccgccctcgccgccgacctggtgatgccgatcgaggagctggagctcacggtccggtcgtacaactgcctcaagcgcgagggcgtccactccgtgggtgagctcgtcgcccgctccgaggccgacctcctggacatccgcaacttcggtgcgaagtccatcgacgaggtcaaggcgaagctggccggcatgggcctgggcctcaaggacagcccgcccggattcgacccgaccgccgccgcactcggtgcggacgacgacgcggacgcgggtttcctggagacggagcattac

SEQ ID NO: 437 - DNA, 558 bp, Streptomyces avermitilis
  CDS (1)..(558)
gtgctgtttcccgggatcgacgtgcggttggagggcgtggtggtcaccggtacgctgctgttcgtcgatgccgcagcgtgcgggcgaccaccgtactgcccgaactgccggtggcgggggcgcagaatccactcgccctaccaccgcagcttgtccgaacgccccctggctggccagaagtcggtcgtgcgcctgcgggtgcggcgcttcttctgcgaccggaagtcgtgcgcccgcaggaccttcgtcaagcaggtcgaccggctgacggaacgccaccgccgctccagcctcgggctgaaggaatggctgacgacggtagccgtcgagctcggcggccggcctggggaacgggtttgccgcaagctgaacctggcggcgggtcggacccacctggtggggctgctggaggagccgccggtgccaggcccgcgctctgctggacgagcacaccgctgtgcgcggcccggggaccggctgggacctgcaccgccacactccgtcctcaccccctcggcgagcagggtgcctccctgctggtacttgtttcccatcctc

SEQ ID NO: 438 - DNA, 303 bp, Streptomyces avermitilis
  CDS (1)..(303)
atggcagacgtcaaagtcgggctgtacgtatctctccaggccaagcccggcaaggaggaagacgtcgctgactttctccgcaagggccttgacctcgtgcaggaggagcccggcaccgtcgcctggttcgccgtgcgcctgaacgcgaccgccttcgcgatcttcgacgccttccccgacgtctccggacgccaggcccacctcgcaggccggctggccgcggccctgatggaacgagcccccgatctgctcgcccagccgccttccatcgagcaactcgacattctcgcccacaaactgccc

SEQ ID NO: 439 - DNA, 174 bp, Streptomyces avermitilis
  CDS (1)..(174)
gtgttcaacgaccgtctgcacctggtccaccgcgggcaggccaacgacagcctgtgggagtcggtctacgacggcagcagctggaccaccgacactcccatccccggccggcacagctggcgcggacccgccctcgccacctaccgaggcgccctccactgtctcgccaccgga

SEQ ID NO: 440 - DNA, 2460 bp, Streptomyces avermitilis
  CDS (1)..(2460)
gtggcaggccaaggacaacaccggccgcaccgccgtcttccacctgacgcgaacggcaacctggcctccaccaccgacaccgagggcaagacgaccgtcttccgctacgacgcctggggccgcgtcgacaagatcaccaccgccgagggccgtgtcacggtcttcacctacgacgacgccaaccgcgtcacctccatgctgcgcggcaccggcttcaacagcgacggccacaccggcccgacctggacctacgcctacaccagcgactctgtgaccgcggccggtacgaccacggccaccgacccggagacgcacgcgacgaagtaccagcacgacagcgacggtcaggtctccgacgtcaccgacgcgatgggccacaagcgctcgaccaagttcgacgcgaaccacagcatcgacaccagcacggatgcgatgggctcgggcaccacaccgggcaacgtcaccgactacggcttcaacacccgtaacaacctcgagaccatcactcagccaacgggcggcaagacggtcaaccactggcagaccatcgccggcgcagacgtccccaaggactccaccaaccccgacggtgaaaagacggacttcacctacgacgcggtcggcaacacgatgtcggtggcacagaccggtaccggcggcggcaacgtctcctacacctacaaccccgcctccccgacgtgcggcggcttcgcaggccagcgctgcaccgagaagacgaagatgaccgcggcgaagacggtcaccaccactttccactacgacagcgcgggcaacctggacaccgtcactccgcccgccccgctggccaagatcacctacacctacgacgcgctgggccgcaccaagaccgtcaccgacgcccgcggtgtgaccgtcacctatacctacgacaaccgcgatcgcacccgcatcgtcgacacgaccaacaaggcacgtgtcgagtactggtacgacggcgacggcaacctcacccagcgcaccgacagcaccggcaccatcaagtacgacttcgacccgctgcaacgcgagacgatccgcaccctgcaggacggctcgcagaccctgctcgcgtacaccccgtccgggaacgtcgactactaccaggacccggccggcacggtcgactacacctggaacgaggtcaacaagctcgccgagctgaaggaccccgcgggccgggtgacgacgtacaagtacaacaacaacgacgtccgtaccacgaccacctatccgggtggcacggtgcagaaggtcgatcccgacaactccagccgccccaagaccatcaagaccacctcccccaagggcaccccggtcgacctggcctactcctacggatacggcaccagcgggacgacggaaggcagcaagatccgctcgtccaccgacaacgtcaccggcctgaagacgacctacacctacgacggcgcgggccgcttctcgtacgccgaggagaagaagggcaccaccctcaactcctcctggctctactgctacgacctcgccggcaacctcaccagccagggcactgcggccggctgccccggcgccaccacctacaccgtcaacgacgcccagcagctgaccgcgaagaacggctccacgacgaactggtcctacgacaagatcggcaacgagaccgccggcgcgtcgactccggagggcacccgcacggccgagaagtggaccgaccactcccagctgacgtcgctgaccgtgggcggaaagacatacaccgggcagtacggttccaccgaccagagcgaacgcatccgcctcggagacacctacttccacaacgggccgatcggcctggccggcacctcaactgccggtgtggacacgggattcaaccgcgaacccgggggcaccctgaactccatgacgaccgggggcaaggcgtactgctacctcaccgacgcactcggctccgtcatcgccctcaccgacgagacaggcgccaaggtcaacacctacgcctacagcccccgcggcgtcaccagggcctccaccagcgagaagaacccccagccctaccgcttcgccggcggctaccaagacgtcacgggcctctaccactacggcgcccgctactacgaccccaacatcggccgcttcaacagccccgacccctccggacaggaggagaacccctacctctacgccgaaggcgaccccgtcaaccgcatcgaccccaacgggctgttcagcttctccgacgcactcgacacgggcagcgacattttcggagtcgttactggctgcctcgcgggagttacagctgcagcagagaccggatccatcgcatacgccgccgccgtcggcggcgtggtgggcgccggagttggcagtgctgtaggcgttggtctcgccgtagtcggcagctgcgcgcttggaggtgccgcaggcttctatggagcggagattctcacctacggg

SEQ ID NO: 441 - DNA, 393 bp, Streptomyces avermitilis
  CDS (1)..(393)
atggccggcccaccccgctcggcgacgcgatcacgtactacggcggatcgcgaagactctgcacatcctgcgcctgaccgtgccgacgagcccggctaccggcggcagatcaaggtgcaggccaacctccaggaaggccaccacgcgctcgcccggcgggcggggcagctctaccagcgctaccaggacggcatggaggaccagatcggggcgctcggcctggtcctcaacgcgctcgtgctgttcaacacccgctacatggacgccgccctcacccagctccgcgccgacggcttcgaggtgcgcgacgaggacgtcgcccggctctccccgttcatgcgccaccacatcaacgtgctcggccggtactccttccagcttcccgacctggag

SEQ ID NO: 442 - DNA, 264 bp, Streptomyces avermitilis
  CDS (1)..(264)
gtgcccgatacgcagaacgccggcccctcgaccagtgtgacggcggccgccgtgagtacggccggttccgtctactcgatgatggcgccgacctcgccggtcatggctcctcctagcccggggcgccgacgagagcctggaagcctcggagccgtccgcgcctacgacgtcatccggatgctctcccgcgatggccggcccaccccgctcggcgacgcgatcacgtactacggcggatcgcgaagactctgcacatcctgcgcc

SEQ ID NO: 443 - DNA, 219 bp, Streptomyces avermitilis
  CDS (1)..(219)
ttggtggtcgtggcggttggatgtgcactgacgtccgtcccgaccgctgggggtgtggtggccgagcctgtctgcgtgcgcaggttgaccgatcaggagggtcagaagctgcagcagatcgtgcgccggggcagcgccagttcggtgcggttccggcgggcgatgatgctgctggcctcggccggcgggaaccgggtgccggtgatcgcccagctggtg

SEQ ID NO: 444 - DNA, 615 bp, Streptomyces avermitilis
  CDS (1)..(615)
atgccgaccagcacgagacgggcccgcgaacgggcgaacacccgggagcggatcatcgaggccgcgctgcacgtcctcgagaccgagggcatcgcggccctgacgatccggcgcatcgccaccgacgtcgaatattccgcgcccgtcgtctaccagcacttcgccaacaaggacgcgctcgtactggagctggtcgcgcacggtcaccgcctgatgctgagcgagttcagccaagccgcgcaggagcccgatacggaccggcgtatgacgcgcattgcgtcgcagtacgtccggttcgccggcgagcacccccacctcttccaggtcatgaacgacccgatggtcgacgcggacgaacgtcggcgcgtcgcggaaccggtcatcgacgtcctcaaggagctgctcacctcctggtcggctgcgcacgacgtggtcctggccgatttcgaccaggcttgtgagatcctctggggcacgctgtacggcatcgcgtcgctcagttacctcggcagcgtcggcaacgatcgcgcccgctacctcgccgaacaggcgcttcacacgatcctcctcggctggcgaaccgagacgccggcgaacggtcgaccggcgagcagc

SEQ ID NO: 445 - DNA, 402 bp, Streptomyces avermitilis
  CDS (1)..(402)
atgatttaccacatcaacagagtcacgatgaaggccactgcgacgcctgagcagatcgaaggggtgctggagagctggcgcaatcagggccggtcgaaccccgccatcaagtccttcgtggtcggccgcaaccacggcggcgactacacgtacggcgcggtgttcgtcgtcgaacatctcgacgggctcttcgcctacctgacgcacccgaccacctaccagaccgaccacctcgggctgcacctggtcgaacggctggagatcttcgacgtcagtgacgacgacgaccctgacctgaacgccaagatccaggaactgcaccggcgccgcaacgagctcaacccgcagatcgccggcatgctcgcggacgtgcccacctacaccggctccggcgtggacgac

SEQ ID NO: 446 - DNA, 900 bp, Streptomyces avermitilis
  CDS (1)..(900)
atggccaagcacgtcatcatcggtgccggttccatcggtaccaacgtcgctcgtctgctcgccgagggcggcgagagcgtccggatcgtcacccgcagcggctccggccccgagcacccgctggtcgaccgggtcgccgcggacgcatccgacccctcccgcctgaccgagctgtcccgcggcgcgggagtgatctaccactgcgccaatccaccctcatacacggtgtgggagcgcctgttgccgcccctgcagacggcggccatcaccgccgccaaggcgaacgacgccgtcctcgcgctgaccggcagcctttacgcctacggtccgcagcccggcggccggatgaacgaacacacccccatggccgccaccgggcacaagggccgcctgcgcagacgcatgtgggaacaggccctcgccggggggatccgcaccgtcgaggtccgcggctccgactacatcggcaaggacgccaacggcatctactccctgctcatcaagtcggccctgcagaagggaaaagcggcctggatcaccggccacctggacatgccgcacaccttcaccttcaacggcgacatggcacaggccctcatcacgctggcctcggaagaacgcgcgtggggccgaccctggcacgtgccgtccgcgccggccgtcaccattcgcgagctggcgcggcgctacgccgtcgcggcaggccggccaccgatcaaactaatccagataccgcgctccgtgacgcgtacggccgggctgatcgtgccgatcgcccgcgagatggccgagatggactaccagtggtatgcgccgttccacatggacgcgacggagaccaccgagaccttcggcctgaccgccaccgacctcgacaccgccgtccgcaacgaggtcggc

SEQ ID NO: 447 - DNA, 366 bp, Streptomyces avermitilis
  CDS (1)..(366)
atgaccgacgcattccacatcgacgtcccgcacaccgacgctgccctggccgtgatcgccctgtccggcgagttcgacatcgccgccgcacccgccgtacgggcccgcgccctggaactcatcgcgaacggccaccctgacctggtcgccgacctctcaggcgtcaccttctgcgactcctcaggactgggcgccctcgtcggcatctggcgctgcgccaaggacgccgacggctccctgaccctggcggccatccccgaccggctgagccgcctgctcagcgtcaccgggatggacgccttcctgcccgcctactccagcgccgacgccgcgctcgccgcacgccaaggcaaccgcaccaccgcc

SEQ ID NO: 448 - DNA, 519 bp, Streptomyces avermitilis
  CDS (1)..(519)
gtgttcgcggtcaaggagagccgcgtacgcgtggtgggcgagatcgcggccacgcccaccggcgaggctctggaactcgtgttgcacttgggtgaatccctgcgcggcgtgcgggtggagagcagcgatgccaccgcgcggccggacgggctggatttcctggccgagcttccggcgcgcggcgaatggcacaccaccgccctggtccgccccagcgtcgagggcgaggaggccggcggcctcttccacccgggggcggagcccggcgagtccgggccggcgcgccgcctgtgtgcctggcgcgagagcgccccgcgcatcaccgacatcgaggacccggaagtgcacaggacgctgcggcggagcctggaggacctgggcgcccctgcgcatcttcgacccgcggcaccccgaacacacggcggtcgccgccggtgccccctggttcatggccctgttcggccgcgactcgctgctgtcctcgtacatggcactgccgctggaccctgcacaccacgg

SEQ ID NO: 449 - DNA, 594 bp, Streptomyces avermitilis
  CDS (1)..(594)
gtgccccctggttcatggccctgttcggccgcgactcgctgctgtcctcgtacatggcactgccgctggaccctgcacaccacggtgaacgcaggcgtcaagctgtggatgctcgtggtcaccgccgtccgtgcgcgggcgcgggccgggtcggcgtggcaggcttgcaggggggcgcgccgttcgtcgcaacacagcagcgaaggggtacgccgcatggatgagaaggaattcctccgtaccgtcgccgagcgcaccggactgagccggcaggaggcggcggacctgacctgggccacactcgagacgctggcccgccgactgagcccgggggaagccagggacctgatcaccgagctccccgagggcctcgcggaggcggtgcgccggggaaccacggaccgcatcgagcgcttcggccaccacgacagcgtgcggcgcgtggccgaacgcaccatgctcaaggaggaggaagccgaccggggtgtgcggaccgtactggccgtgctccgggaggcgatcagcgagaaggagttcaacgacctgatgtcgcagctcggaactgacttctcccaggccctcgaatccgccggg

SEQ ID NO: 450 - DNA, 1152 bp, Streptomyces avermitilis
  CDS (1)..(1152)
gtgatcatgacagctgacgtgcccgagacatcctccggcagatccgtgcgcgtcgcgctggtggccgaccccggcctgccgtcggagatcgcccgggctctcgccccccggttgcccgaccatctccgccgggcagtcggtgctcgggtcagatggcaggtcgacacgatgaccgccccgctcagcgtgagcgagcaggccgacgtctccgacatcgccgaggccgtcagaagccacctggacggtgccgaatgggacgtggcgatctttctcaccgactttccgcggcgggcccggctctacccgatcagcgtcgaggtcgacaccgcgctccgggccgcgctcatctcccttcccgcccttggggtccgccgccttcggcgccgggtgcggcaggccgtcgtggatgtcgttcgagagctggtcgcgcacgaggagacgcccaggcacccggaggtgatcggccgcccgccgcgcgaaccggtaccggacacccgtcccggccccgagcagccccagcgctacgtcgtgcccggcctgcgcggccacacccgactcgtcgccggcatggtgtacgccaaccgcccctggcggctgttcggctccctctcccgggccctggcgggcgtgttcgccacggctacggtgctgttcatcaacagcgccacctggaacctcgccaccgcactcggcgccgtgcagcatgccgtcatcaccgctgggtccgccgtcgcgctcaccctgtggatcatcgtcgaccaccagctctgggagcgcggcacccacctccccgcacggcaccatcccctgtacccctacaacctggtcaccctggtcaccatcgcgctcgcggtggtggtgctggccgcggcgctgttcgcgactctggtcgccgtctccttcctgctgctggacgcgtccgtcctgcgcaagttcatcggacggcaggtcggcgtcggcgactacctcttcctggcctggttcatcaccgccatcgcgatgatcggcggggccttcggcaccagcctcgaaggggacgagaaggtgtccgacgccgcctatggacgacggcagcgtgaacgtcagcggatgctgcggcagatgccgcggccggaacgaggcgaacgcagggggccggacaccaccgacggg

SEQ ID NO: 451 - DNA, 639 bp, Streptomyces avermitilis
  CDS (1)..(639)
atggccactttgctgaggcgcgtgtgccctcacgagggcgtccgaattgcggcagtgccggcagggttcgtgctgtcgaggcgtccgtggacggcgtcggtgtatcgctgtgcggtggtggggccgcagtccgaagaccgccgcgaggtggaggggtctcggacaccggtggcttcggcttcgtcgaggctgcggccctgtcgcaggcggctgagtgtggtccgctgtccgcgaagggcggtcccgagccaggccgtacggagccgattcaggcccggcaccacacgcttcctcggcgatgtgctcgtctatcaacgccaccgagacgctctccacgcccgcgtacgccatgtcatcgacgatgtgcatcccggcctcgggcgcggtgccgcccgcccggtgcgcatcgcgacccacagcctggggggtgtcatcgccgtcgacatggccaccgccaacgtgccgttgtggaccgagtccctggtcacgttcggctcccaggcgaccttcttccatcagcccgtgccgggcgacctgctatgccagatgattgcgttccgcatgcgcaagcaccaggaagcggaaacgggcgctcttcctccggagacagggttcatagcccatgccggtcaaggatgg

SEQ ID NO: 452 - DNA, 567 bp, Streptomyces avermitilis
  CDS (1)..(567)
gtggccatagcacgcgcgcagttgatggcacgtcagcctgcagagaacggagagaacgtgaacccctatgctcctgcctccggcatcgagcaacggccggggtggtcctggctcgacgagtacctgtggtgttcgtgcgacatcatcgccgacctggccgaaggacggctggagcagcggccgctggtcgcaaccgtcgcccggctcgaggccggagaacgagtactcgcggtcggccccgcacaacgtgtgacctggcgggccctcggcgacggcagatacatgcaccaaaacgccgttgccttcggcagccccgcattcgtactcggcagcatggcaagcatggccacctcggccctcggcaactccgcccgccgccgtgccgctgcgaatgacgcgcaaccacgctgcggtgcgcgcacccccggtctgcacgtcctggacgtcctggacgtccacggcaccatgctccgctggagcatgcatctcggcacgtcgtcgacccggcggcccagctcggccctgcgggcgctgctcgagctggtcgacctccacgtcatcgccctg

SEQ ID NO: 453 - DNA, 1665 bp, Streptomyces avermitilis
  CDS (1)..(1665)
atgggattcggcgaagacgaactgcgggccctcgcagggactcggtccttcgagcgggggtcggggtatgtggacgcggtgaggggtctggaggtgggcgacggctcagtcactgccgtggtgcacggcacggacatctacgaggtggagctcgccctcggcgcaggcgccggagtttccgggcggtgcgactgcccgtacgggcaggagggcaacttctgcaagcactgcgtggcggtggggctgaccgtgctgcggcaggcggaggcgatcccgcggcagcgggccgacgcccggacgcgggcctccggcctagaggcgtggctcacggcgctgtccagggacgagctcctggcgctggtgcgggaacaggtcgccgacgaccgggagttgcgccgacggctggagctgcgggccgcggccgcgcgctccgattttggcaccgtccgggagcgcgtcctggcgctgatcgatccgcggcccttcgcccggtacggctacgtcacgtacgcggacgccgccgggtacgcgaggcaggtggcggagacggcggacgcgctgtgtgccctgaccaccagcggacaggcggcgcgcgcggtcggcctggccgaggacgcgatccgggcgctcggcgaggcgtacgaggagatcgatgactcggacggcgtagtcgggcaggccattgccgcggtggccggggcccacctggaagcgtgcggagtcgctcgccccgatccggagcgcctggccgaatggctggtcggtcacgtgctcggtgagtggaatgatgcgacggacctcgatccgctcgactacgccgacgtgttggggcaggccgggctggcccgcctgcggcagctggcggccgaggctcggcggcgcagcccacggggctgggcggagaagtacctgatggagcgcctggccaaggcggagggcgacgtggacgcgctggtcgccctgtacatgaaagatctggtgccctctggtgccacgcatctgcgcattgccgaggagctgggtgcggccggccgccccgaggacgcgctctcgtgggcggaacgcggactccgggacaccgtcgacgaggcacacgtcgacggtcgcctggtcgactacgtgtgcgcccgctacacgcggacaggccggaaggccgagaccgtcgcagtccgtcgagaccgcctcctggccgagcgatccctcgccgcctaccagcaactgcgtgctgctgcccgggccgcggactgttgggagaccgagcgggcggcggcgctggccgctctgcgcgagggcactcgccaggagcgcggcggctggcaccgcgggcccgtactgatcgacgcgctcctcgacgacggtgacctggacaccgcttggcgggaggcggccgaccgtgccgacgaccggcagtggcagcagctcgccgacctctcgcgcgagacgcgcccggcagacgcgcttgcggtgtacctgcggctcgtcgagctgctgaagggacccaccggggaccgcgtctacgagcagatggcgaggctgttgctcgacgtccgctcttgccaccggtcgctgggtacagaggatgagttcaccgcgtatgtcgccgatctgcgggccgagctgaaacgcaggcgcaaactgatcaccatccttgaccggcatgggcta

SEQ ID NO: 454 - DNA, 678 bp, Streptomyces avermitilis
  CDS (1)..(678)
atgaccagggacgatcagcccgacccccgcgtatgcggtcccgcgccggcgtcattcctcgccgccgccgcggccctggacacgatcgacgatgccctgcgcgctgcccagaccactcgggacggcgagccctccaagcccggccaggccagctcggagcaggcgctcgccgcgctcctactgctgcgcgaagtgcgcgatcaactggccgactgggagccgggcctgatcgaagccgcacgggaggcgggcgccagctgggccgacctcgcccaccccctcggtgtcgccagccgtcaggccgccgaacgccgctacctgcgcgtacgccccggaaagccgggagccacgggcgaacagcgggtccaggccacccgggaccgccgcgccgccgaccgcaccgtctccgcctgggcccgcaccaacgccgccaccctgcgccagctcgccggccagatcaccgcactccccgacctccccgccgccgcccacgccccactcgctgatctcaccgccgccctcgccgacaacgaccccgccgccctcgtccctcgcctgaaggacacgcacccctatctggcatccggccaccccgaccttgccgcacgcgtcgacgacctcacccgtcgcatcgaccaactccgtcagaacagcggaaaccagcgccgaaaccaaccc

SEQ ID NO: 455 - DNA, 432 bp, Streptomyces avermitilis
  CDS (1)..(432)
atgttgatgcgtaccgaccctttccgtgagctggaccggctcacccagcagctcctgaacacgaccggaacgtggtcgcggccgtcggcgatgccaatggacgcctaccgtgagggcgaggagtatgtgatcgccttcgacctgcccggtgtctcggcggacgcgatcgacatcgacgtcgaacggaacatgctgaccgtcaaggccgagcgccgccccgtcaccaaggcggacgacgcgcagatggagctctccgagcggcccctgggcgccttctcccgccagctcgtgctggccgacaccctggacaccgagcacatcaaggccgactacgacgccggggtgctgaccctgcgcatcccgatcgccgagcgcgccaagccccgcaagatcgccatcgggggcaggacggaacgcaaggagatcagcggc

SEQ ID NO: 456 - DNA, 393 bp, Streptomyces avermitilis
  CDS (1)..(393)
atggtgatgcgatgggaggcgttccttcaccaggtcaaggaacgcggcgactacgagaccaccagggaagccgagcgggcggcccgcaccgtgctggcgctgctgggcgcgcacctggtgggcgaggtgcgggcggaactggccgctcggctgccggagagtctggcgctcgtgctgctcaatccgctccaggcgcgcgagccgctatcccccgagcggttcgtcagggctactgcggcatggatcgagggagccaccgaacagaccgcggcctgggacgtgagcgccgtgctcagcgtcgcagcggatgcggcgggcgacgaactcacccgccacatcctgctccagctcccagcgggctacgacctgctgttcggccacccccaccccgtc

SEQ ID NO: 457 - DNA, 516 bp, Streptomyces avermitilis
  CDS (1)..(516)
gtgctcacgcgttcagtaaggagcggagtgtaccgtcttgagacgtctggcctgctaccgcagtgctcccggtgcggcggagacctgatcgtgagcgtcgtcgcgccaaagaacgacaccgacggtcggccgatccaactccagctgtgcagtgcgtgcgacgctgagaagcccgcagccggcgcacttctgttctggttcgcctcgggcggcgggcacgacacggaacggagcgaggagggcgcccgactgctgatggaatggacgggagaggcgatggccgagtacggctggtactggcctgggaccgacgtggacgcggccacctccgcccccggcctggagcatgatgaggcagccgcccgcgacctcatgaatccaggcacggccggcgaattccctgagatcgaccagcgccagcaggaacgcgacgctctgcgcaccgagttggcgaacgccggctctgagcagcgcacgcagcttcaggcggtgtggctgctgctgggggatcatcgc

SEQ ID NO: 458 - DNA, 312 bp, Streptomyces avermitilis
  CDS (1)..(312)
atgacaactgagaactgccgccgtgatctcactgccatctgcaaggccgcggacagcggctatctcctgcaagtgatccgggatggcagcttcgagcccctcgcccagaaggacctctcacactggcccgactggccgacattcccggtcgacgccgcacatgcggcggggtgcgaactcgtcatgctcggctacatgatctggcccgacactgtcacccccgactcgctgatcggctggcgtgctgtaccggatcagcaggcatggtcggcgaaggtcggcaccttcgcccaactgcaggccgccggaatc

SEQ ID NO: 459 - DNA, 156 bp, Streptomyces avermitilis
  CDS (1)..(156)
atggcaccgtacgcagcctggagagggttgtggtccgctcgccaccaggcctactgctatcagcctctgggcagcgcgtacgacgcgatcgccaactgccgtcggccgctgaacgcgatgcggcagatggcgcagccgcccatgtccccttgctgc

SEQ ID NO: 460 - DNA, 321 bp, Streptomyces avermitilis
  CDS (1)..(321)
gtgctggcggcggccggggttctctccatgccgttgatctggctgctggacagccccgatgcggggcagctggtcggggcctccatccaggccgccgtcggcgtcgcggccctgatcggggcgctgttccagcacccggcaagccgcacggacgacacggccgcgcggaccggagtggcgcgcgcgagcggcggaggcacggctgtcaccggcgttgagtgcccgcagggccggggcagcggatcggcgcagacggagaggaccggcaacgctaccgccggtggcgacggcagcagcgctgtcagcagcatcgactacacc

SEQ ID NO: 461 - DNA, 501 bp, Streptomyces avermitilis
  CDS (1)..(501)
gtgaccatgacgttcaccagtgccccgaagcccgtcctcgtccgcgccggcgaggccgagacactgcaggacggtgcaaccagcctgatcacgctgctggccgacgcgaacaccaccggcagtgcgctgaccgccaaccgcgcgacgctgcacaagggctcgcccggtgctcccgcacacttccacacccgggcaaccgagatgttctacgtgctcagcggatccatgcggatcctgctcgacgaccaggtcctcacgctcggccagggcgactttctgaccgtcccgccgaccgtgccgcatgccttcgccccggccccggacagcgaggccgagatgctcgtcgtcttcactccggggatggaccggttcgactactaccggctgctggagcgggtgtaccagggcgaggcctcggtacaggacatccgcgacagctccgagcagttcgacaaccactacttcgagagccccgtctggcagcaggaactcgcccggcgc

SEQ ID NO: 462 - DNA, 588 bp, Streptomyces avermitilis
  CDS (1)..(588)
gtgtgccgtccggatgagacggcgtccgtcgctgacacatgggagtgggacgtgaggtcttcggggcgtatggctgtctcggcaatggccgtggctatggcggcgctgggagtaggaagtggtgcccccgcgtccgccgcccccacggcgacgccgtcgtgcagcgggacggaatgcctcagtctgaagccgaccaggctcacggccagccaggccagcctgaatgtcactcagatgcaattggagaacatcaacgcgatggcgtccgacgcggtgaccggggagcccattcgcggcgcgaagatcgtgttcgccaccacgggcggcaggacgctggggacggcctacacggactacgacggcatcgctgcgatcgctgctccggagaacctgggccccggaaccctccaggaactgctgggcggctacgaagccgcaatggtcggcgacggcgttcacgccccggccggggcccacggagcgatcacgatcggcactgaccagggccccggtgtcccgggcagcccatgcgccgtctgcagcgaccgtgcgctcaagcaagacgtggtcccggtcgactggagccgg

SEQ ID NO: 463 - DNA, 444 bp, Streptomyces avermitilis
  CDS (1)..(444)
atgcgccgtctgcagcgaccgtgcgctcaagcaagacgtggtcccggtcgactggagccggtagcggtgcgaatcttccgtcggcggtctcggacggctgaccgcggtgacccggcacggcttcgagccgagacgcgggagagcagcggtgtggcgccggtcggcccggtcaacggctacgcggtcctggagaccgtggccgcgctgcccatcagtacctggcgctacctctgggagccagaaggcgtacgtcacttggggccgatggcccaggactggcacgccgccttcggcttcaaccaggacgacaccaccatccccgtcgtcgacggcctcggcgtcgccctggtgtgcatccaggcactgcaccgccgcgtggaagagctcacggctgaaatggatcgtctgcgacaagccgcgagcgtgaacacgtccggggccgcg

SEQ ID NO: 464 - DNA, 669 bp, Streptomyces avermitilis
  CDS (1)..(669)
atggatcaccggtcaccggtgtgtacggacgcggtctggcggcttccggtgacggtctgtcgcatcacacagttcctgggtgagcagacggccggcgccctactggagcgcgccatcgactccgccggcgacacgttgcagccctccatgatccgcgaccgagaggtggtccccgactttcgccggtcccgctcgcgccacgacttcgccgcacccgagctgatggcagccatcgacgaggtgctggaggcggtcgagcacactctcggagtctcctgccagcacaccgaacccagctacagcctcaacgcgcacaacgacggcgacttttaccggccgcaccaggacaccagcgccgagttcgccccccgtcgtctgctcacattcgtgtactacctgcatcgcacaccccggcctttcgatgggggcgagctgcgtgtgttcgacgcggctctgccactgcacaccgagacagccgggagatggcaggaacgcacctggcgggactgggaacccgagcacgacagcatcgtgttcttcctccccactgcctggcatgaggtacggccggtcagctgcccgagcaagcagcacgcggacagccgattcgccatcaacggctggctgtgcagccccgaccccgcgaaccgcgggaatgacgcgagcccg

SEQ ID NO: 465 - DNA, 1203 bp, Streptomyces avermitilis
  CDS (1)..(1203)
atgaccaccacgccgttcatcagccggaagggcatgacgcgccggagcatgctgggagccgcgctggccgctgtgccgctcgccgccgttgccggccccgcgtgggccgacccggccgcccccgccgtgacgcggctcatgctgcccgtgccgaccgggccgcacccggtgggcacggtccagctgcacctcgtcgaccggtcgcgtccggacgacatcgcgggccccgggcacttccgcgagctgatggccaccgtctggtaccccgcccgggacgttcagcggtacccggtggcgccctggatgccagccggcgcacttcaggcgttcctcgccgacgccgggttcagcgctctggtccgcctggggccgctcactgccggccacgtgggcgctccggtgcggcgatcgggccgacggctgcccgtcgtcgtgttctcgcatggcgcgcacagccaccagggcgaccacaccgtcatggtccaagagctcgccagccatggatacgcggctgtgacggtggctcaccaatacgacacgtacaccgagttccccgacggccggatagccgtcccgctccacgacgggcaggcgccgacgctgcccggggacttcgctgctgacctgcgcttcgtcctcgactgcgtcgagcagctcgccgccgggtgcaatcccgacgtcgaccacagggagctgccggccgggctgctcggctccctcgacccgcggcgcgtgggcgcgttcggctggtcgaagggcgggacggccaccgcctgcgccacgctcgcggacgagcgcatccgggccgggctgagcctcgacggcccgatgcagatgaacccgccactggccggcgacttggaccggccgttcatgatgatgtccgccgtgtttacccgggccacggatcccgaggccgccgcattctggtcgcacctgcggggctggcggctgaacattcaggcccagggcgccgtccacgtctcgtacggcgacaatgaggcgctgttcccgcaggtggcgaagctgctcggatggagcgggcagcagctccaggacgtgatcggcaccctcgatcccgaccaggcggtgaagatccagcaggcatacccgctcgcgttcttcgacgagcacctgcgccaccgtcgggggcacctgctcgacggcccgtccccagccttcccggcagtgacgttcctcccc

SEQ ID NO: 466 - DNA, 780 bp, Streptomyces avermitilis
  CDS (1)..(780)
gtgctgggcgcggcggtcgccggacgtagcggcgggcgacgaggccgttctcgagggtctcgccgatctgctcgcacagcggcgccaggacgtcggccgcgtcggtgtcggagaggtaggccggggcgacttcgagcatcagctccccgatcgcgtgcgtactgcagcgaggtcgtcgacgacggcgcgcagcccggcgagcgtaggatccgccggcggatcggcgggcgccggcggcggggcggtgcggacgtcacggacggcctggcggaccaccgggcgcaccgtcggctcatcgagcggatggaggccgctgggggcgagcgtggcgagtcggcgggtgatcaactccggacgtcgccgcgatggatcgacggcaccgggatccgggtccgccgcccggccgacgggcgcaaggaccgggagaagttcatctccggcaagaacaagcagaacgccgtcaagttcatggccgtcacggacgctgacgggcggctgctcttctgcagcccggccgagcccgccagctgcacggacatcacccatgcccgacagttcagcctggtcaagctcctggccaacgggccggtcgtggagatccttgccgacgccggctaccagggactgggcgctcagacaggagggtgtgtagtgacaccaccgcaccgcaagtgcaagaagaacccgccggactggtacgaagagatgcatgaacgcctgcgcaaagcccactcctcccggcgtatccgtgtggagcacggcatcgcgcacctgaagaac

SEQ ID NO: 467 - DNA, 564 bp, Streptomyces avermitilis
  CDS (1)..(564)
atgcggaaactgatctacggcatgaacctgaccctggacggctacatcgccgcggccggcgacgacatcggctggagcggaccgccgagcgacgagctgttccagtggtggctcgaccaggagcgggcgatcagcctgttgctgtatgggcgcaagctgtgggagaccatgagcgcctactggccgactggcgaccagcagcccaacgccaccccagcggagatcgagttcgcgcggaactggcgggacacgccgaaggtggtgttctcctcgacggtcgacaaggtcgactggaacactcgcctggtctccggcgacgcggtcgcggagatcactcggctcaaggccgaggacggtgggccgatgagggtcggtggcgcagcgctcgcaggggcggcgatgcgggccgggctgatcgacgagtacgcgatcgtcacccatccggtcctggtgggtagcggcacaccgttcttcaccgcgctggacagctgggcgagcctgaacctggtggagacacggacgtttcccggcggcgtggtcctgaccaggtacgagacgaggcgc

SEQ ID NO: 468 - DNA, 1236 bp, Streptomyces avermitilis
  CDS (1)..(1236)
gtggctcgatggctcgaccagggcggtgtacgtcgcctccgggtcgctctcctcgatgtcgttgaacgtggtgccgggcgagatccgcaggccggtgcgctggagccgatctctgcggtgacggccttggtgacctcgacggtgaacttgatgcggccctcgacggagccgccccaggcgtcggtgcggctacctcatccaccagttcatcgcgaccggctccaaccggcgccgttcctgtcgagtctggccgccgaagccgggacgtacagccccgaggtcggtgaattgctcgcccgcaatgtgggagacctgctcacgacggtcgtcaccgaacggctcggccgggatgccgccccgacggacgccggccggcagaccctgctgcagcggatccggcacttcatcaacgcacaccttgcggatccggccctgtcggcggaagcaatcgccgcccaccaccacatctccgtacgccacctgcaacgcctgttccaggccgaggggacgacggtcaacggatggatccgcggccgtcgtctcaaggagtgcggccgcgagctcagccgcccccgccggagcaggccggccgtgtccgcggtggggcttcgtcagccccgcccacttcagccgggcgttccgcgccgcctacggcatgtcgccgcgcgaatggcaggccacggccgatgcgaccggcggtgcggctccaagactctccgcgcctgggtgagcggccgcgtcctcaagtcaggcgctcccgtgggccgccctcgcttgcgactcggtacgcgattgaggtcaggacgtgccggcctgacgggtcggctggtaggtgatcagcaggcagcatgccaggcgagcaccagttcggtgctcggcttgcggcgggtcggccgacgggcggagcggttcgagagcagtgaaagtgggccgcctacgactggcaggccaaggcggtcaagtgccaccggggtgagatccgggcggcgtacgggttcagggcgaacaccgaggcgccgtgccgtccgcagaagcggtgcgcgccgagatggcgccggttgcgggtgtcgacggcggtcagggactcacggggccagacggccgggtcgcggcgtactcgtaaccctgctccaggcggcggaacttctgcgccgcccgctcgtggaagacggtgccgtcggcaggagcttcaccgtgcgcgcggtcgcccggccggcgtacaccgcgtgcgtcgcc

SEQ ID NO: 469 - DNA, 729 bp, Streptomyces avermitilis
  CDS (1)..(729)
gtgaacgaagtgctgccgcagttgaacgagctgctgttttcctcggtcgagggcgtgttggtggaatcggtcgaggtgatcggcacggtcgtcagggtcgaggcccgtacgaccgcagggcgggcggcctgtgtggggtgcgcatactgggcggggcgaatacaaggctcctacctgcgatttcctcgtgatctgccgacgccgggcaagtgcgtcgtggtgccgttgcgggtgcggaggttcgtctgcgaggaggaatcctgcgagcgcatgaccttcgccgagcaagtacccggtctcacccgcaggttcgggcgacggaccgagcggctgcggtcgacgctggtgtcggtcggtcttgcgctcgagggccgggccggcgcccggatgacggacgccttcaaggttccggtcagccggaacaccctgttgaggctgatcgcctcgcttccggaccccgccaccgctgtactccgcgtggccggcgtggacgagtacgcccagcgcaagggccgtgtctactcgatcagggtgagctcgtcggggccggtcgggccctcggtcgaagggttgagcacgaaggcgcctgagaagcacttgcgcagggcgagggtcagctcgcggttgtccagggcgctctccacgacgtgccggtacgccaggccgagtggctcgatggctcgaccagggcggtgtacgtcgcctccgggtcgctctcctcgatgtcgt

SEQ ID NO: 470 - DNA, 849 bp, Streptomyces avermitilis
  CDS (1)..(849)
gtgactgatgagcaggagcgggtgcagccgtcgggcgtgtgggccacggcggtgggggtggccagggtgcgggcgctggagaccgagcgggagaacgcgctgttccgcgacccactggcacaggccttcgccaccgccggcggcctgtggccctcctcgccgccgctgcccgatgacgaagccgcgcgacgccgccggctgaccgtgtcgttctccatcgtcatcaggacgaagttcctcgacgacctgttgcagcaggcctccgcgtccggggtccggcaggtcgtgctgctcggcgccggcatggacagccgggccttccggatggactggcccgagggcacccggctgttcgaggtcgacaccgccgcgccactggacttcaaggcttcggtgctgcgccaggaacgggccgacgcacgctgcgagcggatcaccgtcgcggtggatctgcgtgaggactggccaggcgcgctggccgccgtagggcatgacccggccgtgccgaccgtgtggatcgccgaaggactgctgatctatctgcccgaggacgcggtggagctgctgctggcccggatcagcgcgcagtcggcggcaggcagtcggatggggctgacgttgggctcgcgcggcgtgatcgagcgcttcggcgcggacgccgcgccgggatcggcggcgtccatgtgggtctcggagatgcccgacgacccggtgggctggctggccgggcacggctgggaggccgacagtcacaccctgcgcgagcgcgctgccgcctacggccgcccgatcagcaccccgccgcagcgcgaggagcggcccggcggactgatctcggcggtccgccgg

SEQ ID NO: 471 - DNA, 144 bp, Streptomyces avermitilis
  CDS (1)..(144)
atgcagccgaacgagatcatcgaggttctgaaccgcccgatcagccaggagctgctggcccgtgacgtgacccggtcgcatatcggcatgtctacgacgaagaacgcccccaaactcccgtggccaccctcgcgcacaggctcc

SEQ ID NO: 472 - DNA, 564 bp, Streptomyces avermitilis
  CDS (1)..(564)
gtgctgaggcgcgatccagatttttcggagttcggcggtctgacaatgtcgagaacgtgccactggctccgtcccagggacagcagcggccaccaccggccgcacaaggaagaaggagaaacctgcatggcgattcagcggatggacaacgtcggcatcgtcgtcgaggacctggatgccgccatcgcgttcttcgtggaactcggtatggagctggagggcagggcggaggtcgagggcctgttcgccgaccagtgcaccggactcgacggcgtccgctgtgacatcgcgatggtccggaccccggacggtcacagccggctcgagctggcgaagtaccgcagccccgcggtgatcagcgccgggccgcgcaaccggccgcacaacattctcggcacgcaccgcgtcatgttcgccgtcgacgacatcgaggacaccgttgcccgcctgcgccctcacggcgccgaactcgtcggcgagatcgcccggttcgaggacagctatctgctctgctacctccgcggcccggagggcatcatcgtcggactggccgagcaactgcgc

SEQ ID NO: 473 - DNA, 381 bp, Streptomyces avermitilis
  CDS (1)..(381)
ttgtcgccctttccgcccatcgagcattggaaccccgatgaccgcacctttccccacacctgtcccaaggctcgaggccctgatcctcggctaccacggcgtcatcggcaagcaacccaccagcagatgtggctacggctggccgcactcgccggatggcccgccgatcagaccgccaacttcgagatcgagttctgggcacgccgcgcgctgtacgacgccggcgagatcagcacccacaccttctggagcggcatgctgtacggccaactgaccgccccgccgggcagcaccctgctctacgcactgcgcagcaccgacgccgagatgtggacccacaccgacgaggacgtcgtccgggtgtcctgtctcactgaaggt

SEQ ID NO: 474 - DNA, 315 bp, Streptomyces avermitilis
  CDS (1)..(315)
atgactcttctgtcgaatgtcccgcacccgcttgcggaggcactcgacctctctgcctggtgcagcaccctgatgacgaggaccgtctactccgcccggctcggcgtgaacaagccggacccgcgtgcatacgaggccgccgtcgtggctgccgggttgccccacccggaaaatactctcttcgtcgacgacaggcttgagaactgcgctgtcgccgcccagctcggtctgcgaacgctccatttcaacggtgacagccaggcactcgcttctcacatcccgcagatggttcctgcgacggggatccgcaggaac

SEQ ID NO: 475 - DNA, 597 bp, Streptomyces avermitilis
  CDS (1)..(597)
gtggcggcgctcggggcctggctctgcttcgaagacgaggccggtttctcgatgacgccgcccacctcccgcacctgggccaggcgcgggcacacacctgtcatccgggtgcggggacgctcccagcgccgcatctcgatcgccgctctggcctgctacaaacagggcgagcgctcacgcctggtctaccggtccaaacggcacgtggaccacaagcgaggcggtcggcgcagtttcgcctggaccgactaccgcgacctgctcatcgccgcccaccagcagctcggcgccccgatcgtgctcgggtgggacaacctgaacgttcacaaggaccgccggctgcgggagttcatcaacgcccacgactggatcaactgcttcttcctgccgacctatgcccccgacctcaaccccgttgaaggcgtctggtcactgctgcgacgcagcagccaggccaacaccgccttcaccgaccccggccacctgatgcgcgccctccggcacggcctccgccagatccagtaccgcaacaacctcatcgacggatgcctcgccgaaaccggcctcaccttgacgacaaaacgccaacaagctcag

SEQ ID NO: 476 - DNA, 333 bp, Streptomyces avermitilis
  CDS (1)..(333)
gtgtcgctgcccaagctgagcgagaagttgttcacggtactggagcaggagctgggcaaggggccggtggcgcacggctggccggaccagacctggacgctgtcgcggatcaagacgctgatcgggcgtcggttccataagagcatgacgctgtcggccatcgcgcagatgctgcaccggcacggcttcagccaccaggtcccggcccgccgagcggtggagcgcaacgaggaaaccgtcacgggctgggtgaaggagacctggccccaggtggaaacaccgtggcggcgctcggggcctggctctgcttcgaagacgaggccggtttctcga

SEQ ID NO: 477 - DNA, 315 bp, Streptomyces avermitilis
  CDS (1)..(315)
gtggcgggccaatgtgcgttgccgccgccgctacccggcgtgccgtcgtacaagaacgcggtgtcaaggcaggccgcccggcggagcctgcccggctcaccgtcgacgccctggaggtgctggcgaccgcaccggcgcgggcattgcaggagatggtcctcgacaggtacgcacgactacgtcgtggtgttcgacgccgacaccgacgccgtgcccgtcttcaccgccctcgggcggtgggtcggcatggcggaaagctccggcaccatcggcacgctgaccgagatccacgagcgcgtgaacggcggtgacgcg

SEQ ID NO: 478 - DNA, 321 bp, Streptomyces avermitilis
  CDS (1)..(321)
ttgtacgacggcacgccgggtagcggcggcggcaacgcacattggcccgccacgggctactacgccacaaccacccgggactgcgaggacatcaacctgaaggtcaacgcaacccgttcggtcaggacctgcttcaaggccaccggatcgtgcaacgcgtggagtactgccagggcgaaacagtgggcactggccgccacagacgtgtcggacggatccgatttctacatccagttctcgggcacggccaagagcaccggctacatcgcctaccgagaagaggatgggatgaaccacctcgccacacctgatgactgctac

SEQ ID NO: 479 - DNA, 219 bp, Streptomyces avermitilis
  CDS (1)..(219)
gtggtgagcaaacggcggagcgccgcgcccggccggggaagccgggccgcggtgctcgggatggtgctaccggcgagtgatgtcggtgaccacgaggaactggtcgctgccgaggtccaccaccacccgggcgtccgtgccctgggcgtgttggtcggcggcgtactcttccgcacgccacctcgggggcctccggcggggaaccgctccaggacggtg

SEQ ID NO: 480 - DNA, 819 bp, Streptomyces avermitilis
  CDS (1)..(819)
gtgacgactactgcatcgcaagaagcatttctccaggcattccacgcggagtacccggcggtgaccgcggaagcgttcggccgtggccatgctccagacggccggtccagctatgagatcttgtgcgatcgggtagccggaagcatgcgcgtgctggacctcggctgtggcgatggcctactgctcgagttcctggcccgaaggtccgggagacaactcgccggggtggacctgtctccgcactctctggcgctggcacgccgtcgaccggcgctttccgaagcgaagctggaagagggccgggctcaagagcttcccttcgccgacgacagcttcgacgcctgcgtctcccacatggcactgatgctgatgagcgagatcgagcaagtcgcatctgaggttgcccgagtgctgtctcccggaggggtactggcatgcgtagtgggaggtggggctgtaggcggcgaggcctacgaacgattcctcgccctgctgcggtgcacgatcgaggagacgccggcctcgcagcgcatcccggcactgggagacaaaagaacacgcagtcgcgaggggcttgatgaagtcctcgggccagcaggcttcacagcggttgactgggagaccgttcctatcgatctgagcgcaccaggggagcaggtatgggctgctgtttccagtctttatgatcttggcccgctcgatcgcgcgactttggatcggttgcgagaagccttttttgccgaggtgagggatatgacgacgtcagagggacacgtcccctgcgccttcaaaatccacctcgcaacagcgcgactgcgt

SEQ ID NO: 481 - DNA, 225 bp, Streptomyces avermitilis
  CDS (1)..(225)
gtggaagccggaattgacaccagaacctgggaggaacgccacgaggagatccggacctacgcccgcgacgcctatgaactgcccccgcagttcgacccggcaaccgaggtcaatcggatccgggcgtacctctacgacaactacccccagatcgccgccgccctggccgtcttccttcatgagatgccgcccacctggcgcgaggacctgtttcaccatctgccc

SEQ ID NO: 482 - DNA, 681 bp, Streptomyces avermitilis
  CDS (1)..(681)
atgacccggcaggaagccacgcacacgcaacggatccccctgaacagggaccgcgtcctgcgcgccgccgtcgcgctcgccgacgccaccggcatcgacgcgctcagcatgcgcaggctcgcgcaggagctggacgtcgtaccgatggccctctacaagcacgtggccaacaaggaggagctgctcgacggcatggccgacgccgtcgtcggcgagatcgacccgccagccgcgggccccgactggcagcgcgtggtccgcgggcggatcctctcggcccggcgggtcttgctgcgccacccctgggcggcccgggtcatcgagtcgcggaccggccccaccccggccgtgctggcgtacctggactcgatggccgggagcttccgggacggcggcctctccgccgacctcacgcaccacgtcatgcacgcgatgggcagccgcctgctcggcttcagccaggaactgttcgacacctcaggcccctccggcccgccggaccccgggctggcggcgcgctacccgcacatcgcggaactggccgcgacggccgcacacgacgggggctccacggtcggtggcggctgcgacgaccagttcgagttcgaattcgccctggacctcctcctggacggcttcgaaagcctccgccgccagggctggacgtccgcgcggaagacg

SEQ ID NO: 483 - DNA, 759 bp, Streptomyces avermitilis
  CDS (1)..(759)
gtgtacggcgtacaccaccaccgagcgaggggtaccgaaaagatgagtccggaccggagaaccgcggtggccgccgggtcgctgttcctgctgaccgaggccgccgcgatagccggggcggttctgtaccgcccgctgctgggcgcggcggacggccggctcgcgcagggcgccgacacgcgggcgctgctcggggtgctctgcgaggtggtgctggtggcggcggtggccggtaccggggcggcgctgttccccgtcctacgacgccacggcgaggggctcgcgctcgggtacgccttcgggcggctgctggaggcggccgtcatcgccctcgggatcgtcgccgtcctggcgctcgtcaccctgcggcgggacgcgggggcggcggccggcgccgacgtcgcgctggcggccgtgcacgactggacgttcctgctcgggcccaacatcgccctcggcctgaacaccgtcctgcttgcgtacctggcgtaccgcgcacggctcgtgccgcgcttcatcgctgtgctcgggctggtcggcgggccgctgatctgcgcctcggccgtcgccgtgatgttcggggcttacgcgcagctctccgtggcggggtcggccgccgcactcccggtgttcgcctgggagctggggctggccgggtggctgatcgtcagggggttcgggcccggctcaggcgccacgtcccaggcagacggagaggtggctgatccggtatgtgtgtcggtgaggccgacccgagct

SEQ ID NO: 484 - DNA, 300 bp, Streptomyces avermitilis
  CDS (1)..(300)
atgacgttgaccagccaggtccaccggtccgtcgcctcgggagtgcggagcttccggcgggtccagcccagcatctgcttgattatccggaacggttgctccaggtcgaatctgcggaggaacgcctgccagcgcagatcgatgccctgtcccgaccccgtggccgacgaccacagtcagactgggagcggatcgtgcccgccgggcaggaagtcggcctccaggcatttcaacgtgcccttgatgagggggagttcgccggtgtggtcggtccatgtggagcgggtggtcaggcgagga

SEQ ID NO: 485 - DNA, 384 bp, Streptomyces avermitilis
  CDS (1)..(384)
atgaaggacaccgacctgcacgcagttggcgccgaaacaccaaccgttttccgggcggactgcccgagccgtccgatccttgaccagatcgcggacaagtggtcgatgatggtcatggcgctgctggaacggcccacccggttcaatgagctgaagcgcggcctggagggtgtgacacagcgcgtccttacccagacactgcgccgcctcgagcggaacggcatgattcggcgcaaagtgctgccgacctcacccgtcggcgtggagtactccctcacaccgctgggcgagtccctgcgcgagccattcgggcatctctacgactggaccgtcgagcacagcaaagagatccagaactgccagcgggcgtacgacagcaggggc

SEQ ID NO: 486 - DNA, 831 bp, Streptomyces avermitilis
  CDS (1)..(831)
atgagaaacgatgcctactcgaccctgcgcgtgagcagcgaacacggcgtcgcacggatcatcctcgacaatcccccggtgaacgtgatcggcgcgacgatgatgcgcgagctccgcaccgtgctgaccacgctcgcggacgattcatcggtccgagtgatcgtcttctccagcgccgacccggaattcttcctcgctcacgtggacatgcggatcggggagaagatggacgccctccaggaactcgccgcgtcggcgccggcggacgtcaatgtgttccaggctgtcggcgagctcatccgccaccagccccaggtaaccatcgtcaagctcgccgggaaggcccgcgggggcggggcggaattcgtagccgcagcggacatggcattcgccgccgccgagaccgccgggctcggtcagatcgaagcgctcatgggcatcatccccggcggaggcggcacgcagtacctccggggacgcgtgggtcgcaaccgcgcgctggaggtggtcctcaccgccgacctgttcgatgccgagaccgcagcgtcctacggctggatcaaccgggccctgcccgccgacgagctcgacgagtacgtcgaccgtgtcgctcgcaatatcgccgcgctgcccgacggtgtcatcgaagcagccaagcgctcgctgcccgccgatgacctcaaggaaggactcctgggtgagaacgacgcctgggctgctacgttcagcctgccggccgctcagcagctgatcagcgggggcctgaaggacggggcacagacaccggccggcgaacgcgacctcgagggactgatgcgcagcgtcgcgcgc

SEQ ID NO: 487 - DNA, 333 bp, Streptomyces avermitilis
  CDS (1)..(333)
gtgcacgactactcggcggcgctgtcggcgggcacactggcggtcatcgccagggtctcgctggccatcggcaagccgttcacgttgggcattgtcaagcgcaccaccccgcgcgaggcctggggactcaagccgttcatccagaccaacgtcatcatcaccgccgtctggaccgcggccttcaccctgaccgctgtcgtgctcgccttcatggcgcacgccgggaacgcccactcgaccctcgccatgctcatccaggtcgtcggcttcgccgtccctatgatcttcactgtccgctatgtctcccgcgtccaggccaaggccggtgcccga

SEQ ID NO: 488 - DNA, 813 bp, Streptomyces avermitilis
  CDS (1)..(813)
atgagcgcgcgtttcgaggagatcgactggcgggcgaccttcatgggtgagatcagcctgcggcgtcggcgggaccccgtgtcgggggaggacgtgtacgaggtgaagctcggcgacgagtacctgatgtccagcctcttcaccgcgggggaggtggagctggcccggctcggcctggcggagctgcccgacggcccgctcgatgtcgccgtgggcggactcggcctcggttacacggcccgaacggcgctggacgatccgcgggtgcgctcgctgatcgtcgtcgacgccctggccgaggtgatcgactggcaccggcgcgggctcgtaccgctgggcgcgggactggcgtcggacccccggtgccggctggtgcgcggggacttcttcgcgatggctgcggggagcgcggcggcggccagaccggtgcccgcggacggcgcgaaggtgggcggtccggtgcctgctgggggcacggcccgcggcgccagtgcggctccgcgcggtctggaccccgagactcccggccgccgtttccacgcgatcctgctggacgtcgaccactcaccgcgccatgtgctgcaccccggccatgccgcgctctaccgcctggccggtctgaccgctgtggccgaactactccatcccgggggcgtgttcgcgctgtggtcgaacgacccgccggatgaggagttcggctcggtgctcgcggaggccttcacggagaccgctgcgcacgtggtcaatttcgacaatccgcttcagggcgggaccgcggccaacactgtctacgtcgcccgcaggtacgacggc

SEQ ID NO: 489 - DNA, 186 bp, Streptomyces avermitilis
  CDS (1)..(186)
atggcgcggggcggatcgatcaccgccgagtacgggctcgaagtgctcaacaccgtgatctatctgccgcgcggcgagatcttcccgatcacctcgagcgctaccttgtgcaacggcttcagcagacaccgggacgggagcttgcaaccaccctcccacgtcggagctggcgcggtctggcgtagc

SEQ ID NO: 490 - DNA, 477 bp, Streptomyces avermitilis
  CDS (1)..(477)
atgactggtgactggaggatggatcggatcggggctgctctgcgaggtgagaacccgaccgtgctgcggcggcttgagtcggggttcgcggtgatcggcgacgttcagttcttgccgggttactcggttctgctcgtggacgaaccaggtgttcagcggctgtctgatctgccgaaggcgaggcggctgtcgtttctgtccgacatggaccggctcggagaagctgttgagcacgtctgccaacgcttggaccccgacttccgccgggtcaacctggagattctggggaacaccgacccgttcttgcatgcccacgtctggccgcggttcgagtgggagccgaccgagctggtgggcaagcctgtgtggctgtatccgggtgaccggtggagtgacgaggggttcagactggggccgcagcatgacgtgctgcgggacgggatcgagagcgaactggatcggttgcgttcgatgggc

SEQ ID NO: 491 - DNA, 222 bp, Streptomyces avermitilis
  CDS (1)..(222)
atgtcgtcgaacgggcctgcctgcgtgccggcctgcccccgcgttggtccgcaccggctgcggcacgcgctggccggcgagatgctccggcaaggcgccggactggccgcgatcggccaagtgcttcgacatcaggacttggccacgaccacgctctacgcgaaggtcgacttcaccgccctgcgtgcggtcgcacagccctggcccaggacggaggcggca

SEQ ID NO: 492 - DNA, 480 bp, Streptomyces avermitilis
  CDS (1)..(480)
atgaccgtcctgcgggaggcactggccgactacctgcggcttcgtcgctcgcttgggcaccagatggccgagaccgcctggttgctgccggacttcgttgccttcatggaagaccgcgggcagaccaccgtgaccatcgcggccgcgctggcatgggcgaagagccgtgagggcgaggtggtgacgacggtgagcccgcgccgggtcacggcagtccgcggcttcgcccgccaactgatcggcaccgacccagacaccgaggtcccgccgctgggcctgctgccctaccggcagcgctggcgtccgccgtttctctactccgacgccgacatcgccgcagtgatggccgccaccgatacattcgacccgccactgagggcggcgacctaccgaacgctaatcggactactggccgccaccgggctgcgagtcagcgaggcgatcaacctggaccgcccccagccgaaaactcagctcggg

SEQ ID NO: 493 - DNA, 645 bp, Streptomyces avermitilis
  CDS (1)..(645)
atgagcagcttcaacacgcaccagagacgggtctacgacgaggacctgccgacgcgcgcccggcatacgaatttgcggtcgtgcctcgtccacttcgcgccctacggcttccgggccacgtatcaccatctctgcctcagcgcggggatccccaaggatctggagaaggatccgagctcgctcatacgtgccgtcgaggagttgcaccacgcccgacagctctggctcgctgacgagcgtgcctatgccaacaggcgccgagctgacaaagcgcgtggctttcggcaggtgaaacgagacgagtcctggcgaggctggcagcgtgagtgggggaacattgcctactgtcccgagccgacaattcatcccgacgagccgctgccagcggtggtcgagcgggtgctccgttcgtcagtgccgccggatgaagctcctgcgctgacgtgccgtgtatgcggaaaccgggacaacaccagcgtctggtacgacggcgcctaccggatccatcagctgtgcagggaatgcggggtcagtctcgcggtacagcgggccaaagcgcctgacccgcggttggcggccgaccatgcccggaagtggaaggagatctggaggttgcgcaacgaatctcctcgcagctacccgagc

SEQ ID NO: 494 - DNA, 261 bp, Streptomyces avermitilis
  CDS (1)..(261)
atgccttaccacacacggatcgcacttcacttcgactcaaggtttcggctcggccgtgttcttaacgaaagtgctgccagaaccaaatccgaatatcgccatcacctccacctggctgccccgtacgccggctactggtgccagtacgtcaccgactgggtcgccgacaagacccgctaccgcctcaccatcgaccccaccgcactcgcccaacgcctcgccgaatgccccgacctgcccatcaccatcaccctcgcgcgc

SEQ ID NO: 495 - DNA, 855 bp, Streptomyces avermitilis
  CDS (1)..(855)
gtggtcgatctcggcttcgtgggccccagccggcccgccaacgactaccggttcttgagcgtcactgacggcgacacccccaacatcgccatggcgatccgcatggtgtccatcgacaccccggagagccactacggcggggccccggccaccgcccaggccgctctggagcgtgccaagacgcgactgctggatggcacctacgacgcgctgccgcaggatcttcgtgactatctcgtctcccggatcacccctgatgccgcgcagcggcatcagtcggcgggccaggcggcggccgaggcgcacacggccatggtggccagccgcttggcgcaccccgacgggtcccagcgcaagatggcggtgatcgccaccggcgagctcgtcgagggcaacggacgcctgctggcctacaccgcgccctggttcaccggcagcgcctccgatccgctgccgccccgcgacgacccccgtcggcgcacgttcaacctggacatggtggcgctcggctgggcggccacgttcgtcatctacccctccatcccgcccaccaaggacttgaacctgctgctggaggaggccgaggcggcctggacacagcaacttggcgcctgggcgcagttcgggcaggacctgctgctgggatatgagtaccgggcatgtatcaagctcggcaccaaggagctgaccgatccggccgcggcgatcgcccaggcctaccagcgggtgtgcgtggacctgcggacgctgaccgaggtcggcctgtacggctaccaccaagtgccgccccagcaccggctgtggatctgggcaaccgacctggagcaggcgcgcaaggacctaccgatcagctcc

SEQ ID NO: 496 - DNA, 246 bp, Streptomyces avermitilis
  CDS (1)..(246)
atgcccgccggcacagccggtccggcaccggccgcgggccgggagcttctcgggccagggcggcagcagcggcgcgatcagcgcccaccggccagcgaagctcacctgaactggtcgctcatcaccctcatgagcaggaggctgacacgcaagggccaccccgacggctggaagaagaccggcccgatgaggaagcccggaccgaccactctcaaccagccgcgcacctcgcgagaaatggacgga

SEQ ID NO: 497 - DNA, 222 bp, Streptomyces avermitilis
  CDS (1)..(222)
atgacgaagaacaagaacgtcatcgaagtcgagggcaaggtcgtcgagtgcctgcgcagcgccatgttcaccgtggagctcgagaacggccaccaggtgctcgcgcacatcagcgggaagatccgcaagaactacatcaagatcatgctggaagaccgggtgctggtggagctcccgccgtacgacctgacgcgcggccggatcgtgttccggtacaggaac

SEQ ID NO: 498 - DNA, 648 bp, Streptomyces avermitilis
  CDS (1)..(648)
ttgaggtttcacgatggtgcggtgaccgataacggaatcaccctgatcgacgcgtgggaactgcccgaggaccgcatcgacgagtccatcgcacgctggcgggagcgcgtcgggctcatccatgccgcccccggtttccgggatgcgcggctgcaccgcagactgttcccggagtcccggctcggcctggtcaatgtggcgcactgggacagcatcgaagcccgggacgaggcgctggcggatcccggattcaccgcgtcggcagccactgcggccagctacgccaccgtgaacggcggctggtatgaggtggcagccgaattcctcgcagtgggaaacggttcgggcgaagggccgggaatcaccatcgtcaatgctttcgaggtgcccgccgagcggatcgatgaattcctgccgcattggctcggccgcgcagagctcatgaccaaggcgcccggcttccgggacaaccggctgcaccgtgcggtggtcccggacactcgcttccagctggtcagcatcgcgcactgggacagccccgacgcatggcgcacagcagacaacgacccccgcttccaacagagcctgtccacctcccctgacttcgccatcgccgaccccgcgctcttccggcttgtcgtcgagttc

SEQ ID NO: 499 - DNA, 858 bp, Streptomyces avermitilis
  CDS (1)..(858)
atggaaacggcgagcctacgagcggctccgccccctaggtttcaccccatggcctcatccgccggtccggaagaccgcgataccgaggcgcggtcgcgtccggcgacccgcccgctgctgttgcgcattgttacggtcgtcggctcctcggcgagcttctatctgctgctgtcggtcgtccctgcgtacgcgcagagcgcacccggcgggggcagcgacaaggcgggcctggtcaccggtgcgctgatgctggccacggtggccggcgagctgacagccccatggctggccgcacgctgtggctttcgcgtgatgctgggggcggggttgttgttgctgggtgctccggcactggccctgaccgtgtcgcagagtatgccgtgcatcgtggcggtgtgccttgtccgggggctcggcttcgcgttcaccctggtggcgggtggggcgctgacggcgtcgctgatcccgcccgaactccgcggggaggggctggccctgatcggcgtgatggccggtgtgccgtcgctggtgggcctgccgctcggggcctggctggcattgcacacggaatacgggcccgtctgctcggtggcggcactgatcgccctggtctccatcgccgccgtcccgggcctgcccggccgggaagcgacgtcggctggcagcaggtacctcgtcgcaggacgagtgaactcactggctggtgttgattttgctggccatacggagcagtccaacgggttgagggctgtgatcttggccaaggtaagagcatggtcgacagcagtgacgcgacgacgacgtcccggaggagtcgtttcgacgccgtgcacaaatgggctgctacagccgccggtg

SEQ ID NO: 500 - DNA, 1053 bp, Streptomyces avermitilis
  CDS (1)..(1053)
atgagcacagaagacctctcattccccgaagacgagaaggtcctggtcaccggcggcagcggattcgtcggcgcccacacggtcgtccgcctgctgcgcgaggggcatcgcatccgagtggcagtccggggtcccgcacaggaggcgcaggtgctggcggcactccggcaggccggggtcgatcgggcggacctgctggagttcgcggtcgcggacctcagcgccgacgacggctgggcgcaggccatggacgggatcgcgcacgtcctgcaccacgcgtcgcccttcccgcccactcctcccgagacggaggacgaggtcatcctccccgcccgcgacggcgcgctgcgggtgatcgccgccgcccgcagcgccgggatcccccgggtcgtgatgacgtcctccttcgccgcggtcggatacaccctgacgcccgacgaccactacacggaggagaactggaccgatccgaacacccccggactgcccgcctaccacaagtcgaaggtgctggccgaggcggcggcgtgggactacgtcaagaccaacgggggcatcgagctggcggtcgtcaaccccaccggcatcttcggcccccaactcgtggaccggccctcaggatccatcggactgatcaaggccctcatggccggcgagatgcccgtcgtgccggtctggaactttggcgtcgtcgacgtgcgtgacgtcgtggacctgcatctgcgcgcgatgctgcacccggcggcggcgggcgagcgattcctcgccaacagcggatcgtcgagcctgttcaagatcgcgaacatccttcgcgagcaattccccgccgcggccgaccggctgcccgcgacggaactgaccatcgatcaggtacgcgaggccgcgaagaccgagcccgcgctgaaggacgccgccgtcctggggggcaggatccccgaaatcagccacgagaaggccagttccatccttggctgggagcccctggacgtcagggacaccatcgtggcaaccgcggaggccctgatcgagctgggcgcggtcaccctgccggag

SEQ ID NO: 501 - DNA, 582 bp, Streptomyces avermitilis
  CDS (1)..(582)
gtgactgtgaccagaaccgagacgacgcagcgcagaccgcgcgcggacgggcagcgcaatcgcgcccgcatcctcgaggcggcactgcgcctgttcgtcgagcgaggtcccgacgcccccttcaccgagatcgccaagcaggccggcgtcggtgtcggcaccgtctaccgccacttcccggcacgcgaagacctcatcgaggcggcttaccgctcggaactggacgccgtgtgcgccgcggccgcggaactgctggagcaggcaccgccccaggacgccctgcggatctggatggaccgcttcgtcgactactgggccaccaagatcggactgacggaggcgatcggagccgtcgtggccgcgggcagggacccgttcgcgcagagccgcgggcgggtcgatgaagccgtcggcacgctgctggccgcaacctcggcggcgggggtcacacgtcccgaggtcgaacctgacgatgtggtggtgtccctcagcggtatcgccatggtcgcgcctgtgctccaggaccgcgatcaggtgagccgggtgctcgacctcctctatgagggaatccgcgcccggccc

SEQ ID NO: 502 - DNA, 372 bp, Streptomyces avermitilis
  CDS (1)..(372)
atgggcgccatgctgtatgtcgaccggaccgggatcccgtggcgctacctgccgcacgacttcgcgctgtgggagaccgtctacgggtacttcgccgcgtggcagaagaacggcatcttcgaccaactcatctgcatcctgcgtcagttggtacgcccggccgaaggccggaacggcgaaccgagcgcctgcgtgctcgacgcccagagtgtcaagacctccgcgaacgtgccggccgcagggcagggcatcgacgcggggagaagggggtactgcttcgccgcctcgaccccgggtgccggcgccctgtggcccctatgcgacccggacacgcccgacctggacgaggacgacgacggcagcgaggatccg

SEQ ID NO: 503 - DNA, 159 bp, Streptomyces avermitilis
  CDS (1)..(159)
atgcgggcctcgacaccgaagtccgacaggtgggtctcgccacggatgagcccgtccggttcgagcggctcggcggtttcgcgcaccctcgaggtgcgagcgaagtgccgcccgaacaggccgatgggcaggtacggctcactgccccggcccgcctgg

SEQ ID NO: 504 - DNA, 1173 bp, Streptomyces avermitilis
  CDS (1)..(1173)
gtgtggcgatcggctgtcactccatgtcccgtgcagccgcaccccccatacccggcacgcgtgagcgttccgcccggccaccgtgccgatctgccccggaccggggcccagagaaggagacacatcatgaccaccgccgcagacctgtccgtcttcgagcagctcgacctccccgacacgagcctcacccgggacacattcgcctttgcggcacaggccacgcctgccttcattcacgatcactgcgtccgcagctacgtcttcgcccgcgcccatgcccagaaccagggtctgcgcgccggtaccgactacgacgacgaactgctgttcgtcagctgtgtcctgcacgacttgggactgagcgaggagggcagcaacggcgaccagcgtttcgaggtcgacggcgccgacatcgcagcggcattcctccgcgagcgcggagtcgaggaagagcgtatcgccgtcgcctgggacgccatcgctctgcacacctcggaaggcatcgcctcgcggaagggcacggaggtggcgctggcccacttgggtatcgccaccgacatcctcggaatccagcgtgagagccttccggccggcctcgccgacgaagtgcacgccctgctgccgcgtcaggacctggcccacgggttcagcgacctcatcatcacccaggccgtggccaagccccacaaggcgtccccgacgaacttcatcggcgacctgctgcgccgccacctgccctacggcgcctatcccaactggtacgacctgatcgacgcggccggctggggcgacaagccggtcggcgtcaccgcccggcgccgtgccgagacaccccagcaggtggggaccttgttcatggagtacctggaggccggtgacgtcgagggcttggtgtcgctctacgagccgaacgcccacttcgtccccactcccggaacccacctggtgggcacggacgccatccgcgaggccatgcggcagatggtcgacagcggtgcccgcctcaagctcgaacagcgcgagatccgacaggtcgacgacatcgccctggtgtcgaacaacgccatcctcaccgggatcggaccggagccggtggtctccaccaccaccgagatcctccgacgccagccggacggcggctgggttcacgccgtggacgacccgttcttcagc

SEQ ID NO: 505 - DNA, 909 bp, Streptomyces avermitilis
  CDS (1)..(909)
gtggcccggaaggcaggttccggagcaggatcgaagagcgagcgcggggcagccgactccacaccccggtggagcggtccgagagccccggccgtggacgaggagccggcaatgacttcgcagcatgtggtgggccgcttcttcgacgtgcagggcggccaggtgtacgcccacgtccgcgagggtgacggcccggcgctgatcttcctgcactactggggaggctcacggcgcacctggatcccggtgctgcagcgtctggatcccgggcagggcttcgtggcctacgaccagcgtggatggggtggctccacgagcgtgccgggaccgtatgacctggagcagctcgcggacgacgcgcagcgcgtcgtcgacgcgctcggatactcccgctatgtgctggtcggacactccatgggcggcaaggtggcccagatcctggccgcacgcaagcccgccggtctgaggggagtcgtcctcgtggcgcccgcgccgcccgcgccgatcggggtgaccgagcaggtgcaggagacggtttcccacgcctacgacaacgaggaggcggttcttcagagcatcgacctgatgctgacccgcggcgggctgactcccgagctgcgccggcaggtggtcgaggacagtctgcgcggcggcgacgaggcccgtctcgagtggccgcgccgtggcctggtccaggacgtgtcggccggagtctcagccatcgaggtgccggtgctggttctcgcgggcagccacgacaaggtcgacccgccgaccgtgctcgccgaccacctgctgccgctgatcccgaccgccacgctgaccgtcctgaaggacaccggccacctctcgccccttgaggtgcctgaccaggtggccgcgcacatcggcgcgttcgtcgcccagctg

SEQ ID NO: 506 - DNA, 999 bp, Streptomyces avermitilis
  CDS (1)..(999)
atggcggctccctggactccctgcgacattggtgccggacgtaatattgcggccatgaacaagcaccgggtcatggtcctggcggtcgacggcgtgctgcccatggatctgggcatccccacgcagatcttcaacgcccgtccgaacaccccctacgagctcaccgtgtgcggcgacaccgaggagaccgtgaccacgagcgccggtttcaccctcggactgaccgctggtctggaggcgctcgccgaagcggacacgatcatcgtcccgggcttcgaggacttccggcgccctccgcgcccacgggtgagggccgctctcaagctcgccggccgcgccgggatacgcatcgcttccatctgcaccggcgccttcgccgtcgcctcggccggactgctcgacggccgcaccgtcaccacccattgggccagcgcggatgacctcgaagagctctacccccggctgcgcgtcgaccgcaacgtcctctacatcgacaacgacaccatcctgacctccgcgggatttacggccggcatcgacctgtgtctgcacctggtccgcaaagatctcggcgcagccgtcgcgaacgacatcgccagggacatcgtcgccgccccacaccgtgacggcgggcaagctcaatacatcaacaggagcctccccaccccccaggccaccacgctcgccaacacccgtgaatgggccctgctccacctcgaagaagacctcaccatcccccacctcgccggccatgccggcgtctccccacgcaccctgacccgcctatggcgccaggaaaccggcgtcagcccccgccaatggctcctgaccgcccgcagcaaccgcgcgcgagaactcctggagaccaccgacctccaggtggaacagatcgcagtccggtgcggcctcggcagcggcgccaacatgcgcgcccgattccgtgacgccctcggcgtcacacccacggcctatcgccgcaccttccagcaccaggctgcc

SEQ ID NO: 507 - DNA, 474 bp, Streptomyces avermitilis
  CDS (1)..(474)
gtgacgccctcggcgtcacacccacggcctatcgccgcaccttccagcaccaggctgcctgacggcgaaggccaaaccgggcggcacggcacctgggcctacggctccgacgcccacactcccgtcgacgccgcccgcctcctggcctggcctcgcctcgcctcgcaggatgccgaacgtcccggggactgggcccgcatcgagcgcacgtgccgcgatgggcacaccgccacttggcgggccgccgaggcacggctgggccggtggggcccggacgggaacgtccgcctggcggtggccaccgcccacccggccaccctgccggcgaaggcaacctggtatccggccaccgacctgccccgcccgggctccccacgcgtcaccgaatcgccctgcccgcccaccaccctcgccgagatcgagcggatctacgggctgcgacactgggtcgagcagagctacaaacaggtcgtc

SEQ ID NO: 508 - DNA, 474 bp, Streptomyces avermitilis
  CDS (1)..(474)
gtgccgatgccgtcctattccttcgtcctcaacggcgagcgggtcaccgtcgaggcgccggccgacatgccgttgctgtgggtgctgcgcgacctgctgaacgtcaccgggcccaagtacggctgcggggtgggcgtctgccgggcctgcaccagccacctcgacggcggcgagatacagccctgtgtcgtgccggtcgccgactgcgcggaccgcgaggtcaccaccatcgagggcctcgccgacggcaaccggttgcaccccgtgcagcaggcctggctcgactgcgacgtcgcccagtgcggcttctgccagccgggccagatcatggccgcggtggccctcctgaaacggacgccacggccctccgacgccgacatcgacgccatcgagaacgtctgccgctgcggcacgtacttccgcatccgcgaggcgatcaagaaggcttcggtgaagttcccccggtcaggccca

SEQ ID NO: 509 - DNA, 2103 bp, Streptomyces avermitilis
  CDS (1)..(2103)
ttggcacctgagttgtcccgtcgcaggttcgtgatctacacactcgcggcgtccacgctgaccgtcgcggccccgctcggctgtgacaccccggccgcggagggcgccgagagcgtccgggcgcggtcggacgtcctggtcaccggcgcggacgacgagatgctggtgctggaggtcaccgaggccaacaaggtcgtcgtacggctaccgcggctcgaggtcggacagggcgtgaccacggcggtcgccatgatgatcgccgaggagctggacgctcggctcgtcgacgtgtctatcccgctcgccgaggcacgcaggaagggcaaccagtacacgggcgggtcgagttcggtcagttcgctctacggtccggcccgggaactggccgccctggcgcgggccaagctggtgaccgcggccgcccggcggtggcacattcccgcacggttcctccgtaccgagggcacccgcgtgatcgcccccgacggacggtcggccaccttcggttcgctgaccgcgagcgccgcccgggtcgggcgccccgccgtgtccagcaagccgaaaccggtgtcgaaacaccgggtgatcggccgcccgactccccggatcgacgcccgggacatcgtcaccgggcgggcccagtacgccggggacctcgccgtggccggggcgaaaccgaccgtcgtggcacggcccccgacgctcggcggcagggtccggacgctcgacgaccgggcggcccgcgcgatgcccggcgtacgcgcggtcgtcaaggtcgccggcggggtggccgtcgtcgcggacacctttcaccacgccttcaaggcccgggacgccctgaagatcacctgggtgcccggcccgctcgccgcgctctccgacgccgagatccgcgcccggctgcaggctgccgttcccaggttcggcaccccgccgcgcggctcggcgcagacggaggccaagttcgagttcgccttcgtcagccacgccccgatggaggtgctgactgccgtcgcggacgtacgcgcgcacagcgccgagctctggttcgcctcccagtccccgatggacgcccgcgactcaatcgcctccgccatcggcctgcccgcgtcgaaggtacgggtccatgtcctccgggccggcggctcgttcggccgccggctgaaccatgacgccgcactcgaagccgccctcgtctcgaaggcggcgggccggccggtcaagctgatgtggagccgtgccgacgacatccggcacgggcggatgcgcccggcagaccaccaccggattcgggccagccacgccggcggccgggtggtcgccttcgcccactccgtggccacggtcagcgagacgaacgacggcctgagcgccggtgtgcgtccggcggccttcgcacgagcggcggggccgctgcccagccactccggcctctacaacttcggctcgatctccggggactggggctcggtcgacctggcggtaccgatcgggccctggcgctccgtgagctccgggacgtcgcgcaccgccgaggagatcgtcgtcgacgaggtggcccgggcgctcggaaaggacccggtcgccttccgtcgaacgacactgcgcggcaaggccgttcgcgccgtgctcgacaaggtcgccgccgccggggagtggggccgggccctgcccgccgggcaggcccagggcgtcgccgtccacgaggagtacggctcctgcgtggcctgtctcgccgagatcgacgccaccgacccgaagaacccccgggtgaccaaggtggtgatggcggccgacgtcggcacggccgtgaaccccagcgggctcgaggcacagctcatgggcaccgcggtcgacggcatctccaccgttctgcgggccggactgcacatcgaccggggcgccgtccgcgagagcagctacgccgacttccgctacgcccgccagcggcacgccccgctccacttcgaggcccacatcatgccctcgcggcgggcgccgggcggggcgggcgagctcggcgtcccggccgcggccggcgccgtcgccaacgcctacgcccgggcgaccgggtccaggccgcgccgtttccccctcgacttc

SEQ ID NO: 510 - DNA, 564 bp, Streptomyces avermitilis
  CDS (1)..(564)
gtgaagttcatggtgcagaccctcgccgccgccaggcgagctgcagtgcgacctccagcgcgagctcacctacgacgggctgagggccgccgaggccaaaggcagcaagggcggccgccgccggccgtcaccgccgagaaggcggacgccgtacggacggcgtacctggacggccagtccatcgccgccctggcccgggagcacggggtcagccgcggcgccatccgcaccgccgtcgccgacctcatgcccgagcacaccaccggccccgaggacgtcccggcaccggagctgcccgtcctcctcgacatgcccggcaaggtcgccgacttcctccgcgaagccgacctgcccgacgaccagcgctcggccctcgccggcggggtgaccgtacgacgcggccagggctacaccctccgtgtgaacgccgccccgtccatacaccgcgagctcctcgctcgctcccaacccctcgacggcgcccaggccgtccccgcccagcgcaaagcccgccgcgagtacgagaatcgcgtcaacgccctcatcgcggtcggcgagcgaagt

SEQ ID NO: 511 - DNA, 165 bp, Streptomyces avermitilis
  CDS (1)..(165)
gtgcacatctccgagatgttccgccccgtacgcggcaccggccacatcctcgacacgctcgacgtcctccaccgcgaccgcctcgcgctacgtatccacgacggcgcgttctccgccatggacctcaccgcccgccccccgcgcaccgggagctgctgtccaccg

SEQ ID NO: 512 - DNA, 927 bp, Streptomyces avermitilis
  CDS (1)..(927)
atgcccatccgacgacgctgcgaggagactcgtgcgacctggttcgagcgcatcgtgacgaggggcggcgtccgcctgtcttgccgggactggggcggctgcgggcggcccgtcgtcctcctgcacggcctggccggccacgcaggcgaatgggacaccctcgccggggccctcagcccccgctaccgggttatcgccgtcgatcagcgcggccacggcgccagcgagcgcttcccgcgcgaagtgagccgtgccgcgtatgtcgccgatgtcgtcgccgtcctcgaccagctcgccctgcaccggcccgttctggtgggacagtccctgggcggccacaccgccatgctcaccgctgccgcacacccccacctcgcgcacgcgctcgtcctcgtcgaagcaggccccggcggaccgaacccgcgcgtgcaggccgagatcggcggatggctcgatgcctggccgacaccgttcccgtcacgggagtccgctgtcgagttcctcggcggtggcctggtcggcgagggctgggctgccgggctggaggagcgcgacggctggtggccctgcttcgaccgggagatcatggtcgcctcgctggccgagatcgcccaacgctccttctgggacgagtgggcaaggatcacgtgcccggtcctgaccgtcctgggccagtccggcatcatctctccgcaggagtccgagaccatgctccgacggctaccggtggcaacggccgcgagcgttcctggcgcaggccacgacgtgcacctggagcgccccgccgtcctgcgccacctgatccaggaattcctcgaagagaacgccgcgcctcgcgggcccgcgaggcgtcctggccgaggccgggatcgaggacccggtcgtcttcgaggaggaggccggcaccttcagccgcctccacccgct

SEQ ID NO: 513 - DNA, 645 bp, Streptomyces avermitilis
  CDS (1)..(645)
atggcgactcgggagtacaagcagttctgtggcctggcccgcgcgatggagctggtcggagaacggtggtcgatgctgatcgtccgcgacctgctcagcgggccccggcgctacacggatctgcgcaaggggctgccggccatccccacgaacatcctgtcgacgcgtctgaagcaactcgaagaggcgggtctggccacccggcgtgcgctgccgcaccccgagcgcgcggtcgtctatgagctcaccgacttcgggcgggacctcgaaccggcgctcattgcgctgggccgctggggcgcccggacaatgaccgagccccgccccggcgaagccatcaccgccgaagcggtggccatgtccttccgtaccgccttccggcccgcagcggcccagcacgtcactgtcggcttcgaggtccgcatgggcgagttcaccatccgcctgcagatcaccgacggtgtgctcgccgtcggcatcggcgagcatcctgcacccgacctcgtcatcgagcgcctgtccggccacccggtccgcgagctgatgagcggcaccaaaacccccgacgaagcgcttgccgacggcagcctgcgggtggacggcgatcctgctctgctcgcccggttcgccgcgatgttccgcttc

SEQ ID NO: 514 - DNA, 729 bp, Streptomyces avermitilis
  CDS (1)..(729)
atgtccaagacgctccctccagccgctcgcggcatgaccccggcccgcgcggcgcccgggctcctggcggctgccggcatcacggcaggcccactcttccttgcagcgggcctggcccagggcctgacgcgcgacgggttcgacttcacccgcaacgccctcagccagctcagcctcggcgccttcggctggatccagatcaccgtcttcttcctcaccggcctgctggtcatcggcggcgcgatcgcgatacgccaggagctacgtgatggtcccggcggcacctgggcgccccgcctgctcggcgcgttcggtgcctccttcctgctcgccggggtcttccgcgccgacccgggggccgggtttcccgccggcgcccctgtgggccgagtcacctcgctgagcgcacacggcaccgtccatatgctggccggcgcgggtggctatctcgcgctgtgcgccgcgttgctcgtactcgcccggcacttcaccgcgcgccggcagccaggctgggccatgctcgcccgcctcgtgccggtcggggtcctcgccggattcgccgcctccgccaccaccgtcgcggccttcaccgccggagcaggtctcggcctgctcggcttcagcgccgtcaccgcccgcctgactctccccgcagagcgggagcagccctgctcagccgcccggagcaaccgcaccacgcccatcaccgcacgacaggagacctccgca

SEQ ID NO: 515 - DNA, 207 bp, Streptomyces avermitilis
  CDS (1)..(207)
atgaccacaccggcaaagggcccggtcagctacttccccgcgatcgaaaagaagtacggccgccccatagcggagtggaaggacatcatccgcacctcgccgctgaccaagcacatggaactcgtcgcctggctcaaggccgagcacggcctgggccacgggcatgccaacgcactggtcgcacacacattggccgaaggcagcagg

SEQ ID NO: 516 - DNA, 204 bp, Streptomyces avermitilis
  CDS (1)..(204)
gtgcagcaggtcctggccgagccggcctgggcgaagaagctcaccgatgaggaccggcgcggcctgactgcactgttctggtcgaacgtcaacccgtacggaaccttccgcctggacatggacaaacgaatcgacctggggctcacgttgccccggccccgaacccaggcgggcgccggcgaccgatcgggcgcggagacacga

SEQ ID NO: 517 - DNA, 1083 bp, Streptomyces avermitilis
  CDS (1)..(1083)
gtgagcgcctggaaggtcgacggcgaaggggcgggcgtgcgacaggagtggtcgctggaagacgtggtggcgtgctggacgttggtggaaggcgaccgggacttggtggcgaacaagtccgggccgacccggctgggcttctgtctgatgctgaaggctgcgctgcggcacgtgcgccggtacttcatcaccgtcgacaacctgcgcgccgcggtgaggaagttggtgaacgccaccttcgccgcccgtgatgccgcctggtgggggcaggggacggcgtgcgcgtcggactcgaagaagttcgggtcctggtcttcgaacttcatgactgagtaccacgcccgctatggcggcaacggcgtgatgatctactggcacgtcgagaagaagaacgtctgcatctactccaagctcaagagctgttcgtcgtccgaggtcgcggcgatgatcgagggcctgctgcggcactgcaccgacgccgagatcgaagccaactacgtcgacacccacggcgccagcgtggtcggcttcgctctcaccgagctgctgaacttccggctgctgccccgtttgaagaacatgggcagcatccgcctgtaccgcccggacgacagcccgcccggctggccggccctcggcgcctctctcacccgccccatcaagtgggacccgatcgcccagcagtacgaccagatggtcaagtacgccaccgcgctccggctgggcacggcggaggcggagcaggtgctgcggcgcttcacccgcggcggacccaagcaccccacctacgccgctctggaagagctcggccgcgccgtgcgcacgatcttcgcctgcgactacctcgctagccccgacctgcgccgcgagatccacggcgggctgcaggtcgtggagaactggaacagcgccaacacggtgctccactacggcaaggacggcgcgctgaccgggccggacaaggagcacgccgagacctcgatgctcgccctgcacctgctgtgcggtccgcactcgtgcacgtcacaccctgctggtgcagcaggtcctggccgagccggcctgggcgaagaagctcaccga

SEQ ID NO: 518 - DNA, 735 bp, Streptomyces avermitilis
  CDS (1)..(735)
atgtccgagaaccactgggaaaaccagcccggcaccccgccggatgtcacccccgaatgcggccaggaaagtgacggtgaaaggctctacctctggaggcagatcgttcattggcgatcggggactggcggcagccaatgcaatccccttatagagttggacaagcaaaatcactggtccgtgatgaacggcggggcgactggcgcgagcggttggctactggtccccacagaccgcaaaaagggaatagagtgccgcgacatctggacgcaccgtgatccgaactactggaatgctgcatggggatacgtaagaagtccctacgggagccccaccaccaccggcttggggatcaactcgaaagacaaacgcacacaggatcagctgcacatccacatcgccaccttccagtcggacgcaaagacgtacctcgatgcaagatcgccgagcgaaatcgccaccacgccaggcgattgggcgaaaaaactcctgacggtgcccagcgactcgaagccgggacaagtctatcgcgtcctccatgtcaaggacctcgccactgacaacctcttcaacctcctgcagagcaatgtggtctcgtccgatcaaatgggaaaccaaacaatgatcgtgattccggcgaagtcgggtggattctacgtgctcaatagtgacatcagtctctcccaaggcgcagccttcggcacaggcacctgcaaccacctcctcaaatgcagc

SEQ ID NO: 519 - DNA, 450 bp, Streptomyces avermitilis
  CDS (1)..(450)
gtgggcgagccgatcttcaagctgtacagggtccgcttcaccgagccgggggtgggcaagtacctcatgcggtgggggctgacgttcccgcggccggacaagcgggcgatccagcaggatccggaggcggtccggatctggcgcgaggagacgtggcgggcgatcccggcccgggcgaaggctgagaacggggtagtgctgttcgccgaccaggtcggcatccggtcggaccaggtcgaactgcacttcctgccctcgtactcacccgacctgaacccagacgagctcgtcgacgccgacctcaagcgcagcctgccccacactcaccgggccaggaaccagaccgaactcgcctccgaaacccgccggttctttcaccgccgacagcaccaacctcacatcgtgcgcggatacttctgcggtcggcacgtcggctacgtcatcgacgag

SEQ ID NO: 520 - DNA, 720 bp, Streptomyces avermitilis
  CDS (1)..(720)
ttggatggagcagaagatcgctgccgtactggcgcatcgcaccgaggtggagcggggagccctgccggggctggtcgccggtcttccggcggatgtgcgggagcggttgttcgctaccgagtggttcatccgccacgacccttttgctgcggcgggggtccagacggagctgactgcctgactgtgcggtccggtccatcgaccggtccctgcccagggccgactgggactggggaacagcgctggtcacaactgccccagggcaaccaacactcccgcgcacgcgtcggacaacacatgcaacgcgaatggcttttctcgctcatcccgctgacgatcggcgtggtcttcctcagcttcggcgtttacggactccgccgcgccaaggccctgcggcgcaccggtgtcaccgcaccgggacggatcgtccgccacgacgtcagacgagatgatgacggtgccaggtaccaccatccggtcgccgcctggacgacccccgacggcctcgagtgcgagcactcgtccaggttcggccgcggctccatcggcggccgcttcggcgtgggcgccctcgtcgtggtccgctacgatccggagaatccccgccgattcgaaatccaaggctgggactcagcgatagtcgaccggacgttcaccatcttgggagcgctgctcacagcggccacgttgacggtgttgctggtccggctccttactctc

SEQ ID NO: 521 - DNA, 615 bp, Streptomyces avermitilis
  CDS (1)..(615)
gtgacggggatcacgttggcgggaaaacctgcggcccggctcgggcgtctagccggtgtgagatcagtcaggaaggcaccgcgcgagctggacgaggagcgtctcgtccggttggtggccaggggtgaccgcgcggcgttcgaggagttgtaccggcgtaccgcgccgtggatggcgttgcggctgcgccgtcgctgcgccgacgagcagatcgtcgccgaggtcatgcaggagacgtatctggcggtgtggcgcgcggcgggcgcgttcgcggggtcctcggcgggcgggacggccgccggatggctgtggacgatcgcggcacgccgcctcgtggacgccttccggcgcagggcccaccacgccgagccgccggtcgccgccgctctccccgacgcggcgcccgccgccgaggaggaggcactcgcaacggccgtcggcggtgacgtcggcgacgcgctgcggcgcctcgcgccggaactcagacaggtactgcaggccatggtgctcgacgggctgtccgtccgggagaccgcggtcctgctcgggctgcccgagggcacggtcaagacccgtgcccgccgggcccggatcgcgatgcgggaggcgctggca

SEQ ID NO: 522 - DNA, 816 bp, Streptomyces avermitilis
  CDS (1)..(816)
atgagcgtggaacacgcgtcgatgcggatcatcgacggttacgcacgcggcgacacggacatcgccgccgacgaggtgtgggccctggaggcccatctggaggcgtgcggggtgtgccgtgaccggctgtcggccgccgtcacagccgaggcgcccgccgtggcggcgctggtcggcaccgtgtggtccggcctcgaaccccagttggcagccaccgccacgatgccgcgccaacggcgctggtcggcgcggctgtcgaggtggatgacgcccacgatgatgccgtggctggccatggtcgtgagcgtgacactgctcgcgctcctgctcgacctggtcgacaccggcttcggcgaggtgtcgctggtgctgctgctcgccccgatcctgcccgtcctcggcgtcgccgcgtcgtggtcgcgcggcctggacccggcgtacgaactgacggcctccgcaccgagggcgggactgtacctggtgctgcggcgcaccgcgtcggtgctcgccgtggtcgtccccgtgctgctggtggccggatgggtgaccggcgtgacggccgcgcagtggctgctgccctgtctggccttcacttcgacgaccctggcgctcggcggcgtcgtcggcgtgacccgcgccgctgtctcactggcggccgtgtgggccgccgcggtcgtggcgccgaccctggccaccagccgtacgaccttcgccctgcagacgggcagcctgcccgtgtggggactggtcctcgcactcggtaccgctgtcgtgatcgctcgcaggggcgcgtactccgtgctgggagcacatcga

SEQ ID NO: 523 - DNA, 831 bp, Streptomyces avermitilis
  CDS (1)..(831)
atgaccatcggaaaggaacaccacatgatgtccgcggtaagcgcggccggcatcgcaccaacggcctacgcctggcagatccaggccaccgggctgaaggtcagggtcggcaggaagcggatggccgtcaacggggtcgacctgtcgctgggtaccggcgtacacggcctcctcggccccaacggggcgggcaagaccaccctcatccggacgctggccacagtattgcgccccaccgagggcaccctggagatgctcggcgagtccgcgggcggcatgggcgagcaccgtgcgctgcgccgccggatcggctacctgccgcaggagttcggctactacaagcgcttcacggtgcgtgagttcgtcgagtacatggcgtggctgaaggaggtgcccaaggcggacatccccgccgccgtgcagcgcgccgtggagagggtgggtctggcggaccgcgccgacgagaggatgaaggccttgtcgggcggcatggtgcgcagggtcggcatcgcccaggccatcgtcaacgacccgacgatcctgctgctggacgagccgacggccggcctggacccggcgcagcggctgcgcttccgcgagctgctgcaggagttgggtacggacacctgcgtactcgtgtcgacccatctggtggaggacgtcgccgccgcctgcaccaacgtggtgctcttcgccgaggggcgactggtcttccagggacctccggacgagctggcctcggtgggcggccccgagcacatgggtgacagcccgctggagcgcggctactcggcgatgttgctcaaccccgagcagggaaggggcacctgg

SEQ ID NO: 524 - DNA, 1392 bp, Streptomyces avermitilis
  CDS (1)..(1392)
gtgaacgtccgcgtcctgcgtatcgagctgaagcgctccgtcgccccgtgggccggcgccgtggtcctgacgacggcactggcgtttctgtacctgattcccggatcgtggtggacgggcaccacggcgtggacggcccagtggacgtccatggccctgtggacccgctccgtgctgttctacctgtggccgctcgccgtggggcttggggcgctgcagggcctgcgcgaccaccgctcgaagatgtccgagctgctgacgagtactccgcggcccgcccggcaccgcgcggccacgctggcgggcgcgacggcgctcacgctggcctcggcctttgcgctcctcgtcctcgtgggcgcggtccaggtggtcgccaacaccgagtacacgcacctcggatggttgccgatctcgctggtaggggcactctctctcgtcgcgggggccgtgctgggcatgggggccgggcgggccctgccatccgtgctcaccccgcccgcgctggccatgggcgccttcgtgttcacggtcctcctgcagacgtcgttgggccggacggagacgaccacggcgacggggctcccgagcacggagccgaaccgggtctccctgctgtcaccggcggtgcaggaggtgcgcgacgcactcgtcacgctctccgcctccgtgcacgtcgggcagacgatctggctgctcgccatggccgcgaccggcttcgcgctgctggtcgccgcgaccccgcgcgcccggctgctggccctgacgcccgtcctggcgggcgcggcgctcgctctgctcgtccttccctccgatccgcgccggatgtatgtcgtcgacgaggccgccgcggagttggtgtgcgacggcccggtgtgcgtgacgaagacgcagcaggcgcgactcgccgacctcgcgggtcctggtaaggaggtgctacgcctgctgcatggcgccctgggcagccaggcgccggtctcggtccgggagaacaccgccgtactgccagaaggctccacgccgcagtggtcccgcacgaccgtgctcttcgacttcgacgacgacctcatcgccgccgcgaagggcgaggagctgacccgggccctgatcgccaaaggcctggtgccagggtgcacccccgtgggctggagcggcttcgggagcgatgagttcgcgcagaccgtcgcggtgggctgggtcctcggggacctcaggccgcttcccggcacaccggcaagtctgcgccgcgaggtcaacgccaagacccgcccggtgtggaagaaactcaaggcgctgccgcgggccgagcagctctcgcggatcaacgcgatgcgcaccgccgcgctctcctgcaagggcgatgcgttcgacgcgctgaacggcggtgcgtcccgg

SEQ ID NO: 525 - DNA, 693 bp, Streptomyces avermitilis
  CDS (1)..(693)
gtggaagaaactcaaggcgctgccgcgggccgagcagctctcgcggatcaacgcgatgcgcaccgccgcgctctcctgcaagggcgatgcgttcgacgcgctgaacggcggtgcgtcccggtgagatggctgacgctgtacgcgcgctcgcgtcagatacccgcgtcgctcgccgcggtggtgatcagcgcggtggcggtgtgggcactcgcccggaacggcagcggcgggcccggtgatccgcggctgcccgcgctcgccctcgctacggggacgatggcagcctcgatcgggctcagcgggcaggacctcgcgctggaccggacggccgcgatccgctgggtgccccgcagagcggcacatgtactgctctgcggtgcggtcgtcggcacggcgctgctgacagcgcaggcgatgggtgaggacatggccaccaccgcgttcgtcgtccgggacagcgcgggcctgatgggactggtcgccctgggcgcggcgctctcgggcggccggcacgcctggacgctgccgttcgcctggctctcgttctcgtttttcgccccgcccccgacgagtgtgccgatgcgggtggcgagctggatgctgctgccgcccggcacggcagcgggcacctggacggccctggtcctcgcggttgtcggcaccgcggcctacgccgtcgcgggaccgagacgg

SEQ ID NO: 526 - DNA, 372 bp, Streptomyces avermitilis
  CDS (1)..(372)
atggtcgtcgccactccggccaaggggaagcggctcaccgacgcagtgggggcgcagaacatcgccttcagccgtccggccggtgagcgggtcaccgccttcggctgtccggcgaccactccccagcggggcgaggaactgctgtactgccccggcaactcccagcgcgcccccgagggcgagcagcgcgtcccgtgcgacctcggcggcggcgcgagcggcggtccctggctcgccggcttcaactccgccgccggcaagggcaccgtggtgtcggtcaacagcgacggcgagggcgacggcggcaccccgatgtacgggccgacgctcgacaagaccgcgcgggccgtctacgacgccgcccagcgcggc

SEQ ID NO: 527 - DNA, 783 bp, Streptomyces avermitilis
  CDS (1)..(783)
gtgaagattgtgtcgcttgggttccgcacagatttgatgttgctaaagatgggtggagcagtggtcaccgaccacggaacgcacctggtggtacgcactccggcgaatcccggttttcactgggggaactttcttttgttcgaggttccgcctcagccaggtgacgcgccccgatggtcgacgttgttcgaggcggagtttccggagacgcagtaccgagcctttggtgtggacggcgtcgccggcctggtgggggacacggcagaacaccaagtgcttggagtgaccgccgaagtcaacacggtactgacggcggaccggctcgtgtcaccggtcgcggccccgcacgccgacgtccgtgtactgaccggcgacgatgattggcgccaggcgctcgaactgcacttcgcctgctacggactgccgtcgggcagcgacggtcggcacttcgccgagcgacgggtcgcgggctaccgcagtctgtgcgaggccggtcacggaagctggatcggcgccttcgtcgagggccgcctgcgtgccggagccggcctgttctccgatggctcggagctggcgcggttccagaacgtcgagacccatcctgacttccgtcgccgaggtctcgcttccgccgtcatccaccatgcggcccagcgcgcgctgctcgccccaggcatccgcaagctcgtcatcgttgcagaccccgacgaccacgccatccgcctctaccgggcgctcggcttcgtggacacggagcgacaggtccaactccacagggcaggc

SEQ ID NO: 528 - DNA, 330 bp, Streptomyces avermitilis
  CDS (1)..(330)
atggataccgacgggcaggaccacctcccctgcccaggggcgcaagctgcccggcggggcagccgcccaccaccgtcagtcggccaggacctgctggactgcgagctggtcacggcgccgcagcagggcgtcgatgtcgccaccgatctgcccggcctccagcggttcgcccagcgcctcgaacgcgacctcgaggccgtcatcgcgggcctcgcccagccctggatcgccggtgtcgtcgaaggccatgtcaaccgggtcaagatgctcatgcgccacatgttcgggctcgcaggattcgatctttcccgcgatcgggtcctactggcg

SEQ ID NO: 529 - DNA, 288 bp, Streptomyces avermitilis
  CDS (1)..(288)
atgatcaacctgcaggttcgtcacgagtccgggaccgttctggctgggtccgggcatggcgtcgcctgggacgagtcgctcgcagagatcgaccggtcgcagttccccatgctcgccggtgtctgcccgttcgcggataccgtcttcaacacctggcagctccccatgctggttgaggagttggaccgtctgcccgcagcgcgaggtggtccctgggttgacgcggtgcgagccttgtgccggactgcggaggaaggctcccatcgatacgtctggttcgttggtgac

SEQ ID NO: 530 - DNA, 909 bp, Streptomyces avermitilis
  CDS (1)..(909)
atgcgcatgcgtcccactctgagctggactcctcccgaggacttgccaccggctaccacggatgtggagccggtcgcccgtgcgctgagtaacggcggtgtgctggtgctcagcggggcgggtatctccacggactcgggcatccccgactaccggggcgagggcgggagcctgagccggcacaccccaatgacctatcaggacttcaccgccggcgtgcaggcccggcgccgctactgggcgcgcagccacctcggctggcgtactttcggccgcgcccgccccaacgccggacaccgggccgtggccgcattcgcgcgccacggcctgctctcgggtgtgatcacccagaacgtcgacggcctgcaccaggccgccggcagcgagagcgtcgtggaactccatggaagcctggagcgggtcgtctgcctttcctgcggcgccttcaccccacgccgcgaactcgccctgcggctggcggaggccaacgtgggattcgagccggttgccgccggaatcaacccggacggtgacgccgacctcaccgacgaacaggtcggggactttcgtgtggtgccctgcacggcctgcggcggcatcctcaaaccggacgtggtgttcttcggtgaagccgttccggcgcggcgggtccagcactgtcgcacgctggtcgatcaggcgacctcgttgctggtcctgggctcctcactgacggtgatgtccgggcttcggttcgtccgccaggcagctcaggccggaaagccggtactgatcatcaaccgggatgcgacgcggggcgacccgcacgccgtcactcgaatcgcgctcccgctgggaacggctctgaccaccgtggccggccggctggacattcccgccgacgacgaagcggcggcccagacaaggcag

SEQ ID NO: 531 - DNA, 642 bp, Streptomyces avermitilis
  CDS (1)..(642)
gtgtgccggtctgaccgccttccgcgatggggagaccgacacggaggagcgtccggcgccgtggtctacgtcgattccgatgccgagacggcttcggcggctgtgtccatggcatggcggggtgagcccggcgtggtccgggccgctccaccaacacacagccagagactcaaggcatggtcctgctccgggatgcgggtagcgtcggtgcgtatggactttgaactgatagaaggagcgcccgagttcgggtgtctgatcgccgaggtcgaggagaccggcgagcgcatccggctcaccgcggacggcgagccggcgggggtgctgctggcggcggccgagctggcgacactggagtactgggccgcacgtcacaacaagggcgcgcggccgcaggacgagccggcagacgagtacccgccggggccgacgtcgtacgggccttacatcggctacagccacccgcacggcgggatgaccctcacgcggggccggctggtcgtggcagagctgcgtgacgccgaaacggtggcgtggttggaagaacaggcgatgtatggccgtcaggggtacatggggccgaagcagtcagcagcattcgccgagttcctcgcccgtcagacgccggtcggcgacgagcac

SEQ ID NO: 532 - DNA, 1335 bp, Streptomyces avermitilis
  CDS (1)..(1335)
gtgtcgccaggaggagatcatgtgacgaattctttagggcccgactcagggtcccgctccggctcgcacgtgatggtgcgacggggcctgacgaaatccaaatgcgcgcaggcggaaatggtatgggttgcgctggtcctgctcctgacggcgctgccggtgggctggtgcggcctcaaggacttcaaggatgctctgactttcccgggttgcgtcaccggagcggccctcatggtggcggccctcatcatgctcgtgggtgttgccgcggtcgtggactgttggatccgagggccgatttccaactttggagtggtcgcgctgatcagtaccggcgtggcgttgttgacgaacgtcttgctcgcgtttcagacatggaatgacggcgagagagtcgtctacaaggtactgtccattgtgctcagcgtgggttcgctattggctgtcatccaggtgtggcgaagactggatgagatccccactcccaagcgggtggctgcggcactcattgtctccacgatcgtggcggtcgccaatttcagctaccagtatctctttcagccgcaccggcgcgaggtcgccccgctcgtgcagctgaacgtgggcaaggcggtgctcagtgcggaccgcaaggcgttctccgtgccggtcgacatcaagctcgtgaaccacagtgatgtgagtttctatgtgctgggcgccgagttccacgccatgggagaggacgtgacggtgagcccgacggacctggaccgctcgaagtggcgggagggcgccgagcaatgggccagataccgggagaagcacccgctcacccgcagggaggtctaccagcccggcaagctggtggcggcgcagcagtggattcccgccggacactgggtcgaggcgaaagatgaggcgctcacgcgaaccgttgttcagcttcccatcgacacgcatttcgacaagctgacgttctacgccaccctgagcctggcgcgtaaagaccggctcgttatgggaaatttcggaaggcctggttactcctggcggggcgtcgagctgccccattgggtgaaggcagggcaggaggacaacgacaccatcatccaaacggccgatatgcaagaaaacaatgcgatcgatcattatacgagagaatcgcgccgcgtcactacctattggcgctttggtctacatggtgtagacgtggcgccggtcatcgtgccggtgggtgaggaaggtcgcacattctccgaacagacgaaccgcgaggtgcggaaccgctacggtctgatcgacgtcttggcgggcccggtcgaacagacgctggacgagatcaagagccggcgc

SEQ ID NO: 533 - DNA, 900 bp, Streptomyces avermitilis
  CDS (1)..(900)
gtgtgccggaccatctccttcatgcgcacgtggcttgcctcccagtgccgcgacttgactctgacattgatgtcagagtttagcgtcggcggcatgaacactgagcactcgcttgccacgcctcacctcgacgttgtcgtgaagggcagcggccccgcactgctgcttgcccacggtgccggcggcggtatcgatggcaacttcggcctcgtcctcgacgatcttgcccgtgaccacacgctcatcggcccgcactacccgggggcgggcggctctcctttggcaaccgagcccttggacctggacgaactcgccgaccaactggtcgcctccgccgtcgcggcagggcaggagtcgttcgtcgtgctcggcgagtcgctgggcagcgccgtggccgtccggatcgcctcccggcatcccgagcgggtcagggcactcgtcctcaccgccgggttccctgtcgcggacccggtcctggcgctggccgcccagctcatcaagaccttggcaggggcgggccagtggcgcgacatggcccggctcgcctgcctttcgtgcctgtcgccgacggatctggcggacatcgcgccggccgacctcgatgcactggtgacccagaccctggccgggatgccgccggggacggtggaccacttcgacctggtgtcccgagtggatgtccgagcagacctcggacacctgtccgcccccacgctggtggtggcaccgaccggcgacaggctggtcctgccccagagctcgtatcgattggcggccggcatcacgggcgccaagctgatcgaactgcccggcgcggcccacatcctgaacgaggccgaccgcacgacgtggctgcgacacgtccgcgagtttctcggcactcttcccgcgaagtcggca

SEQ ID NO: 534 - DNA, 399 bp, Streptomyces avermitilis
  CDS (1)..(399)
atgaaggagatggtccggcacaccggagtccatgagcggctactgcgctactacgagcagcaagggcttctggcaccggcgcggctaccgagcggctaccgcatctacagcgagtcggacgtggaaacggtgcgccgtatccgctgcctcctggcggcagggctcccgacttctctgatcgctcaggttctgccctgcatccgcacggacgacgatcgcctcgtgcccacctgcccggacctggtcgcccagctggcgcaggaaagggagcggatcacccgcgccatcaaggagttgcaggcatcccgcacgatgctcgacaccgtcatcgccgccgcgcccgtacagggcgctgagacactgagatcgcctcagccagacgctgacgaggcaagttac

SEQ ID NO: 535 - DNA, 1119 bp, Streptomyces avermitilis
  CDS (1)..(1119)
ttggtgcggtacttcttcctcgatgccgcggaccgggctgaaccgggacgccacacgctcctgcccgccccggctacaccaacacccccggtcacggaccgtgatcaccctgtcagctcctccaggctgccgtcgggcgccggggagggcagagtggggccgtggcgcgacccgacgagcgcacaggcgctggccgtatccctgcggccatcgggtcgttcccaccggccgacgcaggtcaggagaccgcccatggcagcaggagcgagcaacagcaccgcgaatgccgactggggcaaagccaacttcaacgacatctacaactgccccgacccccgcccgtacttcgcaaccctgcgatccctcgagtaccaaataccccaccatgggcaggccgtcttccgggcactgacctatgctctgcgctggctgcaccccgaccggacgccactgaacgtggtggacctgtgctgctcctacgggatcaacacagctctcctcaactgccgtgtcactctgtcggacctgtccacccggtacacctcccaccacctctccgccctgccaacccggcaactcgcggccgaggaccggaccttcttcgcagcgcgccgccgcccggaagccgcaacggcgacaggcatcgactcggcagccctggccgtcggatacgcccgcgccgtcggcctactcgaccacgccttcgcggagaacctcgaagtcaccgaaccgagccccgccctgcgccgcacactggcgggcacggacctcatcaccgtcacaggcggcgtcggctacgtcttcacccggaccttcacgaggcttctcgactgcatgccgaccccaccgtgggtcgcggcgttcgtgctgcgcaccgtgccctaccagccgatcgccgacctgctcgcacgctcgggcctggtgacggagaaactgtccgcccgtaccttccggcagcgccgctttgccgacagcgccgaacggtacgcggcgttccacgccctggctgtgaacggactgcacacggcagacaaggaagcggacggcttctaccacaccgacctgtatgtctcccggcccgctcccgacatcgcggcgctgcctctcgcacgcctgctg

SEQ ID NO: 536 - DNA, 861 bp, Streptomyces avermitilis
  CDS (1)..(861)
atgtccgcgactcagacggcccagctcatggacggcaccggccatgcccggcgcatcgtcgaagaggctgctgccaaagcggccgagatctcacagcgcacgggtactgccccctgtctggcgacggtgctggtgggagatgaccccgcatcggtcacttatgtccgcatgaagcgggcacggtgcgcaaaggcaggtatccggtctcgacacatcgctctgcctgctaccaccacgaccgctgagctgatcgacagtctctctgggctgtccggcgatccggaggtgcacggcatccttctccagcatccttgcggcccgcacatcgatgagcgcgcggcgttcgaggccatcgccccggcgaaagatgtcgacggggtcacgatgcattccttcgccgcaatgagctttggcctgccgggcttcgtatcctgcaccccgggcggaatcatgcggctgctggaggcgtacgacgtcgacctcgccggcaagcacgccgtcgtggtggggcgcagcgcgattctcggcaaaccggtggggatgctcctgctcgccaaggacgcaacggtgacctactgccactcccgcacggcagacctatcggcgatggtccgggaagcggacgtcgtggtagcggccgtgggacggccccggctcatccgcggtgaggacatcaagcccggcgcggtggtgatcgacgccggatacaacccgggcaacgtcggcgacgtggacttcgacgccgttctcacccgtgcccgtctgatcactccggtgcctggcggcgtaggaccgatgaccatcgccgtcctgctcgaacagaccgtggacgccgccgcgaaccagctcggagtccagcag

SEQ ID NO: 537 - DNA, 1272 bp, Streptomyces avermitilis
  CDS (1)..(1272)
gtgtccggcggcgcccttttctggtgcgcggtcggacaggattccgcccagcgtgtgaaccgactcacccccacgccccgccggaaccacccgtcctctgtggccgtcttgtgcgctgactgtgtacgaagcagggatgtgggggacgttgtgacgcggaacgtaacgaaggccggtcttctggcggtggccatggcgacgatgctcggggcctcggcctgcggcggggaagccggcgcggcggccggggggaccggcgggacgctccccgcgcacgggaagggggagcccgtggcgcccgcaggggacggggcgtcctccggctcggcctcgacgtctcccggcaccgtggggaagttgtccgggatcgcgcagaccgcggcgtcgcccatcacccggcacgtgccgtggaatctggacattctggatcagcggtcgcggccgctgaacgggaagttcaccaccaccgccacgggcaagggcgttcacgtctatgtgatcgacaccgggatggacatcgctcacaaggagttcggcggacgcgcccgcctcggcgccgacttcgtgggcccgaaggactccggtgactgcttcaacgaggggggcatcggccacggcacgttcgtcgcgggcattatcggcggggcgaggtacggggtggcgcccaaggcggagctcgtacgggtccagggcatcctgtgcgagagcgagggcggcggttccccggcggcggccgaggcggccgtggtcaagtcggtcaagtgggtcaccgcgcacgcgcagaagccggcggtggtgaacatgtcgctcaacttcgaccaccggtcggcggccgtggagtccgccgtgaagaagatggtcgacgcggggatcccgacggtggtgtcggccggcaacttccatgacgacgcctgcaagcactccccggccggcgtccccggcacgatcgtcgtggcggcctccacctcgaacgaccgcgcgtggagcgacggcggctcctacggatcgggttacggccggtgcgtggacctgtacgcccccggccagaaggtgaccgccgccctcgccggcggcggtacgaccacggagaacgacggcgcgacgtcctgggccgcgccgcatgcgaccggcgtgatcgcgctgtacctgtcggcgcacccccatgccactgctcacgaggtccacgtctggctcgaccacacggccacccgtggtgtcgtgcgcgatgtccgctccgacactcccaaccggctgctcaacaccggcggcctc

SEQ ID NO: 538 - DNA, 675 bp, Streptomyces avermitilis
  CDS (1)..(675)
atgcgcgactcacgcaacgccaccgcatccagtgacagcaggaatccgacaggcctgtcggcaaccacggtgcgcacccgcgtgacggtcccactccgcttcggcgacggctgtacagtgaccgccgacctcgccaccttccaccacctcgccgacgggcaggaacacgtggccgtcatcctcggcgaacccgccgctggccggcccccgctggtgcgcctgcactccgagtgcctgaccggcgacgtcttcggctcggcccgctgcgactgcggcccccagctgcgcgaggcgctcgagcgcatcgccgaccgcggaggcgtcctgctctacctccgccaggagggacgcggcatcggcctctacaacaagctcgacgcctacgccctccaggaccagggcctcgacacctacgaggccaacacgaccctcggcctccccgaggacgcccgcgactacaccgccgccgcgcagatgctcgccgccctaggcatctttgagctggacctgctgtccaacaatccggacaaggcggcccagctgcgcaccctgggcctaacggtgacccagcacgttcccacgggcgtgttcaccacggcccacaacatccgctacctccgtaccaaggtggtccgcactcagcacacactgccgctgacggaactgacggtgggc

SEQ ID NO: 539 - DNA, 1044 bp, Streptomyces avermitilis
  CDS (1)..(1044)
atggacaccatgctggcaggacgcgtccacctggacacgaagaagttcgccatggaggagatcccggtccccgtacccgggccgggcgaagtactgatcgaagtgaaggcggcgggcgtgtgcctctccgatctccacctcatcgacggaagcatcacgccgctgcacctgaactccaatgtgctcaccctcgggcacgaactctccggcgtcatccattccctgggacccggcctcaagcgggacctggccgtcggcacacgggtcgccctgcaggcaggacagccctgcggcgagtgcgcccgctgcgtcagcggcggcacgtgcgtatcgttccgcggccgcggcgtcgactacgacggtggctggtcccagtacacgatcgcccgtgaggacaccgtcgtccccatccccgacacacttcccttcgaccaggcggcgatcatccccgacgccgtttccacctcgtacgcggccctggtcgacaccgtgcaggtgcgttccgcccaggccgtgggcatctggggagtgggcggggtgggcgcccatgccgtccggctggcccgcatgatgggtgccacgccgatcatcgccgtcgacccgctgcccaatgcgcgtgcgcgagccctcgcgttcggcgccgatgtcgcgctcgacccgtccgaccccggtttcgtcgaagccgtgctgcgggccaccgacggcctgggcctggactacgccttcgacttcgcgggcgttccccgggtcagggagcaggcgtcgcctctcctcggtaaccacggtgcgctcgtcctggtgggtatcaccaccgagccgctgaagatctcggagaagatgaccttcaacctgaagaacaagaaggtgttcggacactacggatcctcgttcgatcacgtctacgagctgatccggttggccggcagcggccgtctcgacctggccccgtccatcaccgaccacatccccctggccgacgtccccgaggcgatccaccgcctggagaacaagatcggcgatccgatccgcctcatcctcgttccc

SEQ ID NO: 540 - DNA, 1086 bp, Streptomyces avermitilis
  CDS (1)..(1086)
atgaccggggcgcctccccaggagagggagccggtcacgacgagcggcaccatcgccgtaacgaatctgcacgggcagatcgacggcctggccgtacggctcagccgtgcggataccggggagacgtcggcggctccgttggcggtggcgcaaggggcggccctgatcgacctcctcaacctccgaggccacatcctgggccgcgtcgccgactacgagcgggccgcggaactcgctgagcagctcgtgcacgtcgctcccgaggacggcacggccctgctcgcccgcgccaggacgcgggcgaccctgcaccgcttcgccgaggccgttgccgacctcggcgcggcgggccggaacggcgcggaggaggccacggtggacgcggagcgagccgtcgttctgcaggccctcggctgctacgcggatgccatggccctgatccgcaaagcggcggagcggcagagtgacttcacgacgctcggcgcgctcgccgtactccaggccgagcggggggaggtcagcgaggcggagcggctgttcggcgaggcgcggcgccactatcaggggacctcaccgtttccgctcgcccagctggacttccgacgcggtgtgatgtggcaccgcgagggcgatctcgatgcggcccgctcgtgctacgaggccgcccggcgccgggtgcccgactacgcgccggcactgggccacctggccgaggtcgagctgctgcgcgacgaccctcaggccgccgtcgccctcctgcgtcccctcacctgggccagcgacgaccccgagtacgccggccacctcgcggccgcgttgcacgcatgcgacaggtttcaggaggcgaaccagtggcgcgagcgcgcggcggcgcgttacggcgaactggtgctgcgtcacccggaggcttacgccgaccacgcggccgacttctggctcacggtgggggccgatgccgagcgggggctccaactggcgctgcagaacctcgcattccgccagacagcccgagcccatgccctgttccagcgcgctgtcctcgcgcagaaccgggttgcccagaaccgggttgcacaggctgcccca

SEQ ID NO: 541 - DNA, 1167 bp, Streptomyces avermitilis
  CDS (1)..(1167)
atggctgaccacttctccgggccgcgtgccatcgccgaccctgcgtccgacatcgccgacgtgtatgccttccccagcccggagcggccggggaacctggtgctcgtcctcaacacgttcccggcctcggcccctacggccctgttctccgatgcgatcacctatcgtttccgcgtccgcccggtcacgcccgggagcgagagtgccgatgcggcgttcaatgtcggcgaggacgagtacgtcttcgacttcaccttcgacgccccccagaaggtcgacggcacggacaccctgctgcagatgggcacgtgccatgcgcccagcggccggaagatcgccttccaggtcggcaacgaggtgcccaccgaggccgaggaactgaagatcttcgccgggtcgcggctcgacccgttcttcatcgacttcgtgggagtgatggtcaccgaggcgacggggaagctgggcttcaggtctgatgccagcaacgttctggagggcctgaacgcgctgagcatcgtgctcgaagtcgacgccgcggtgctcggtccggccgccgactcgctggtggcggtcgtcggcgagaccgtgacttccggtggacgcccggtgcggctggagcgcatgggccggccggagatcaaaaacgtgatcatgtcgcccaagaagttcgacaccgtcaacagcgatctggagatccgcgacctcttcaacgaggaggacgccttcagcgtgcggcccgactatgcgagcacttaccgcgcacgactcaatgccaacctggccttctacgacggcctggacggcaagaccgcttggccgctggacgagcagggtgcccacccgctgaccgaactgctgctggcggacttcctcgtcgtcgacctgtccaagcccttctccgaggacggctgtttcgagatcgagaccgccctgctcgccggccgcccgcacacgacctgcggtggccggtcactcaacgacgacatcgtggacaccctcttcacgctgctggtgggtggcatcgacggcgagcgcatcagcgacggcgtcgaccagccgactcagccggcgacccacagcttcccctacctgaacgctcccaacccgaccccgccggacctgggtgcccgcctggccgcgcagatgcctccccgcgaggaagcggca

SEQ ID NO: 542 - DNA, 1326 bp, Streptomyces avermitilis
  CDS (1)..(1326)
atgagcatcgagaagggcaacgccctggagatcgacgacatccaggccgccgctctggagccacggccgacgccatacgcgggcgcctacctcgccctgcgcatcgacgaccggcggcaggggcgcgagctgctgcggcggctcacccccgccctcgactcggtcgccgcgttcgaccccgagcgtcaggtctcgctcgcggtggcactcagcttccagggcctgaaggccttgggggtgcctgaggagtcgctggccaccttcccggaggagttccgcgagggcatggccgcgcgggcggagtacatcggggacatcggggagagcgcgccggagaactgggagggcccgctcggttcgaaggacgtgcacctcgtcctcggcggactcgccccggatgccgcccgcctggagacggtcctcctcctggtccgcgacgccctgcgcgatctgcccggcgtcgttgccatctggcagcaggacgtacacgtcggaccggacgagaaggaacccttcggtttccgggacagcatcggtcagccggcgatcgagggcacgggcattcccggtaccaatccgtacgaagagccgctcagggcaggcgagttcatcaccggatacaaggacgagacccacggcatcacacccgttccgcagcccgaggtgctcgggcgcaacggaacgtacgtggccttccgcaagctgcacacgcgagtggccgacttccgtcagtacctccgcgaccgcgccaaagaccccgctgacgaagagctgctggcggccaagttcgtcggccgctggcccagtggcgcccccttggcgctgacgccggacaaggacgatcctgaactcggtgccgaccccgcgcggaacaacgcgttcatgtacggcgacgacccggagggcctcaagtgcccggtgggctcccacgcccggcggatgaacccgcgggacgcggtcgtcaccggtgaggtgcgactgcaccgcatgatccggcgcggtacgacctatggcccgccgctgcccaagggagtgctggaggacgacggcgccgaccgcggcatcatgttcgcctttgtcggagcgcacctggaccggcagttcgagttcgtccagcggcagtgggtgaacgacggcaagttcatcgggtcgcccgcggaaagggacccgctgatcggcgtgaacgacgacggcgggttcaccgtcccgcgccagccgatccgccgccgcttcaaggggctgccgccgttcgtcgtcaaccggggtggcgagtactgcttcatgcccggtctgtcggcgctgcgctggatcgccgacctcgacacc

SEQ ID NO: 543 - DNA, 678 bp, Streptomyces avermitilis
  CDS (1)..(678)
atgtcgtcaatgccatggcattcgcgcacaaggtctctaatggaggaatccatgaacgctacggtcacgaagaaggcgggcaagggcgccaccgacggtgtcgtttccgagatggccacgtacttccacatcaagccggggcacgagcaggagtgcgcggcggcctgccagcggatggtcgaggccctgaagcaggcccccatggccgccaccatcaagaccggtctgcgtgacacccgccacgtgatcttcaacaacggcacggagctgctgtgggccaccaccttcgagacggagtgggagccctacatcgacgacgcgttcctgaccgtcggcttcgagcacttcgtggactggatgcagcacaccaccgagtgggacaccaagatcgccccgtggatcgagaagtccggcggcctcgagtcgctcacgggcgacaaaacgcgcgagggcttcgacgagcacatcatcgcgaacatggccggcatgaggtggatcctgcaggacgggcagcagaaggccaccgcctactggaacccggtcagctccctgacgatgtcggagatcaccaaggccgagcggatcaacgccgccttccaggaggtcctggacgaccccgccgccgaggaggccctccagcacccggccctcaagccgctgctcgcccaggccgccagc

SEQ ID NO: 544 - DNA, 585 bp, Streptomyces avermitilis
  CDS (1)..(585)
gtggaagacagaaccgatccgcgtttgttgcgcagccgtgacgccatggtctcggcggccaccgcgttgctcacggaaggggggctggaggccgtgacgcatcaaacggtcgccacccgcgccggcgttggcagagccaccgtctatcggcactggcccggccttctcgacctacgcctggccgcgctggaagccggcatgccccctctgcctccgatgcctgaggagcttcgggccgcttcgggcaacgatccgcgagcggagctcgttcaccgtctcggcgtgcttgccgagcgatgggacgacgagcagtccggtgccgtgcttgctgcgatcctcggcggctcacggcatgacgaaggcatgcgccgcctccgggagtcgctgctgaaccagatcgccgatgccctgcgtcccgctgttgccgtggccgtggagcgcggccggctccggtccgacgtcacccccgagacctttgccatggctaccgcgggccccttgttcttcgagcgctttctcgctgggaaccgtctggggcgggacaccgtggaggccgtcgtggatgccgctatgcggggctggtcc

SEQ ID NO: 545 - DNA, 1509 bp, Streptomyces avermitilis
  CDS (1)..(1509)
atgtcgcagaacaccgtcgccgccgctcgcggcgttgagaccgcaccgaagaatggggctgtcgacccgtcacaccagcgccgctggtggattctggtggtcatttccctcgcccaactgatgggagtcctcgacggcaccatcgtgaacatcgctctgccgtccgcccagcgcgagctgggcttctcggacgccgaccggcagtgggtggtcaccgcctatgcgctggccttcggcagcctgctactgctcggcggccgggtcgcagaccttgtcgggcggaaggtgaccttcctggtgggtctggccggtttcgcggccgcttccatggtgggaggcgcggcgaacggattcggcatgctcgtcgccgcgcgcgcggtccagggcgggttcgccgccctgctggccccgtccgcgctgtcgcttctgatgaccaccttcaccgatccgcgcgagcgtgcgaaggccttcaccgtcgcaggctcggtcgccggtgcgggtggcgccatcggcctgatcctcggcggggtgctgaccgagtacctggactggcgctggaccatgtacgtcaacgtggtcttcgcggtggtggcgttcgccggtggcgcagccctgctgcgccgcacctcgcgggacacgtcctcgaagctcgacatccccggcaccttgctggtctccgccggcctgttctgcctggtctacggtttctcgaacgccgagacgcacggctggggttcggtggcgacgtggggcatgctcgcggccggtaccgtcctggtgggcctcttcggctggtggcagagcaaggcggcatatccactgctgcccctgcgggtcctgctggaccgtaaccgcggcgcctccttcgctgccctcttcgtcagcggggcgggcatgttcggcgtgttcctgttcctgacctactacctgcagcagagcctcggttacagcgccctgaagaccggcttcgccttcctgcccatgatcgtggcctcgtcgtccgcctccgccgtggccgccaacgtcctggtgccgcgcataggccccaagccggtggtaccgctgggcatggccattgcggccgtcggcctggtctggatgaccgcgttggacctgaacagcggatacgtgacgcaggtactgccacaactggtgctcgtcggcatcgggttgggcgcggtcatcgcgcccgcgatgagcctggccacctccggcgtggcggcggccgacgccggggcggcgtccgccgccgtcaacaccgtccagcaggtcggcgggtccatcggcgtcgccctgctcagcacgatggcctccgacgccgtcaccgactacctctccggccgcaaccccaaggaccccgacgtcctggcccaggccggcctcgagggctactccactgcctactggtggtcggcggccgtcttcgtcatcggcctgggcgtgaccgccctgctctaccgccgcggcgtgccgcagcaggacgagaacgccgcgcctgtcgttcacatg

SEQ ID NO: 546 - DNA, 678 bp, Streptomyces avermitilis; identical to SEQ ID NO: 543
  CDS (1)..(678)

SEQ ID NO: 547 - DNA, 1020 bp, Streptomyces avermitilis
  CDS (1)..(1020)
atgggcaggcgacgccctggcgcgccgacgctggaggaggtggccgcccacgccggagtggggcggggcacggtctcccgcgtcatcaacaacgcggccggcgtgaaggagtcgacgcgccgggctgtgcagcaagccatccaggaactgggctacgtgcccaatctcgccgcccgctcactggccgggcaacgggccgacgccgtcgccctcgtcttgacggagccggactggaggcagttcgcggagccgttcttctccgagatcgtccgctcactcggggacgcgctggcagacaccgggatgcaactgctgctgaccttggtccgctcggacgccgagcggcagcgcttcctcgagttcgcgcgtggcggtcgggtcgacggagccctgcttgtgtccgtacacgacggcgatctactgccggacatgctcgtcgaggccgggttgccgaccgtactgctgggccgccgctcgggcgacgagtacgtcagctacgtcgacgcggacaacgtcggcggtgcccgcagcgccgtctctcacctgctgaaacggggccgcagagcgatcgccaccgtcaccgggccactcgatatgcacgtcgcccagtgccgactgcgcgggtaccaggaggccctggcgatggcgggtctcaggggcgagccgtcctgggtcgccgagagtgacttcacggaagagagcgggcgccgcgccatggccgagctcatcgaacggcatccggagatcgacggcgtcatcgccgcgtcggacaccacggcggcgggggctcttcaggcgctgcacgcggcgggacggcgggtgcccgaggacgtcgccgtgatcggtttcgacgactttccgctggctcagcagaccaagccgcgactgacgacggttcgtcagccgctggaggagatcgggcgggccatggtccggctgctcctcgaggaggtggaggagcctgccgtggcctggcaccacgtcatcctccgtacggagctggtggtgcgcgagtcggcc

SEQ ID NO: 548 - DNA, 1125 bp, Streptomyces avermitilis
  CDS (1)..(1125)
atgcgaccgtcaccgccccatgcccgcagcgcgcgtggcctgttcggtgccctgctcactgcgctcgtctcgctggccgcgttgctgaccaccgcctcggtggcgcaggccgacaccagcatctgcgaaccgttcgggtcaacgacgatccagggccgctacgtcgtccagaacaaccgctggggcaccagcgaggcccagtgcatcaccgccaccgactcgggattcaggatcacccaggccgacggctcggtacccacgaacggcgccccgaagtcctacccgtccgtctacaacggctgccactacaccaattgctcgcccggcacgagccttccggcccagctcagtaccgtctccagcgcgccgaccagcatctcctacagctatgtcagcaacgcgatgtacgacgccgcgtacgacatctggctcgaccccacgccccgcaccgacggcgtcaaccggaccgagatcatggtctggttcaacaaggtcggatccgttcagcccgtgggctcgcaggtcggcacggccaccgtggccgggcgccagtggcaggtgtggtccggcaacaacggctcgaacgacgtgctgtccttcgtggcgccgtcggcgatcaccagctggagcttcgacgtcatggacttcgtccggcaggccgtttcccgcgggctggcgcagaacagctggtacctgaccagcgttcaggcgggcttcgagccctggcagaacggcgccggcctcgccgtgacctcgttctcctccacggtcaacaccggcggcggcaaccccggtgaccccggcagccccacagcctgcaaggtggcctacgcgacgaacgtctggcagggcggcttcaccgccgacgtcaccgtcaccaacaccggttcctcccccgtcaacggctggaagctggcgttcaccctgcccgccggacagcagatcaccagcagctggagcgccggcgtctccccgtcatcgggagcggtcacggcaagcagcctcgcgtacaacgcgcagatcgcgaccggcggccgggtgtccttcggcttccagggcagctactccggcaccttcgccgcgcccgccggcttcagcctgaacggcgccgcctgcaccaccgcc

SEQ ID NO: 549 - DNA, 408 bp, Streptomyces avermitilis
  CDS (1)..(408)
gtgacctggatgaagagcgcctcgcaggagccgatcaacgacggcgacggcaaggctgcgctcttcccgtacgggtacgggctgacgtacgacgccacggacccgaccccgacgcagggcgcgtgcaccgcgcagttccgcaccgtttcctcctggcagggcggctaccaggcggaggccaccgtcaagaacaccggctccgccgcgctgacgggctggactgtcgactgggatccggccggctccaccatcaccagcctctggaacggctcactgaccaccgcccaggaccgagccaccgtccgcaacgccgccttcaacggctccctgcgccccggcgccaccaccccgttcggcttcaccgcgaacggccccacggacacaccggccccgcactgcacgagcagc

SEQ ID NO: 550 - DNA, 2223 bp, Streptomyces avermitilis
  CDS (1)..(2223)
atgacacaccgaaccggccgagcaccggaacacgggccgagaccgggccgtcgacggcgccggacgacctcggtcgccgcggcgctcgtcaccctggcgctgggcctggcagggcagctggccgggcatccggcggccgccgccgaagcccacgccgacaacccgttcgccggagcgagcttctacgtcaaccccgactacaccgacctcgtcggcacctcggcggcgcagacctcggacgccacgctcaaggccaggatgcagaaggtggggacctatcccaccgcggtgtggctcgaccgcatcgccgccatcacgggcggtgccgccaacgccggacgcaagagcctcgccgaccacctcgacctggccctggcccagaagaagcccggtcagccgatcaccgccacgttcgtggtctacgacctgcccggccgggactgctcggcgctcgcctccaacggcgaactcccgctgacccaagcggggttggaccgctacaagagcgagtacgtcgacgccatcgcgaacgtcttcaagaacccgaagtaccgtgacatccgcatcacgacggtcatcgagccggacggcctgcccaacctcgtgaccaacaccgccgacccggagtgcgcccaggccaagagcagcggcatctacgtcaagggcatccagtacgccctcgacagactgcacgccatccccaacgtctacacgtacctggacttcgcgcactccggctggctcggctgggacaacaacctttcccagaccgtgcagctctacaccgatgtcgccaagggcaccgcggccggattctccagtgccgacgggctgatcacccacgtctccaactacacgccgctcgaagagccgttcctgaccgatcccgacaagaccgtcggcgggaacatggtcaagtccagcaagttctacgagtggaaccccaacttcgacgagtcggacttcaccgggaacgtccaccgggcgctcgtcgcggccggctggcccgcttcgacgggcatggtgatcgacacctcccgcaacgggtggggcggcaccggacgccccaccacggagagcagcagcaccaccctcgacacctacgtcaatgagtcccgcgtcgaccgacgggcacaccgaggcctgtggtgcaacgtcagcggcgccggactcgggcagcccccgcaggctgcgccctccggctcccctgactcccacctcgacgcattcctgtggatcaagccgccgggtgagtcggacggcgccagctccgacattcccaacgacgagggcaagcgcatggaccccatgtgcgacccgacatacacggcgcccaacgcgggcggcaacaagaccggcgcgctgccgaacgcgcccctggcgggccactggttcgccgagcagttcgcgatgctggtgaggaacgcctacccggccgtgctcacggacggtggcggcaccccgggcggtgacaccaccgcgccgaccgcaccgaccggcctgaaggccaccgcgaagacgccgtccagcgtctccctgtcctggacggcgtccaccgacgacacgggcgtgagcgggtacgacctctaccgcggcggcacgaaggtcacggcctcgccggtggccggcacagcgttcacggacacggggctcagcgcgggcaccgcgtacagctacaccgtccgcgcccgtgacgccgccgggaacgtctcggcgccttccgcctcgctgagcgtcaccaccgacacgtccggcggcacaccggacccctcgggcggcctcaaggtcctctacaagaacaacgactcctcggccaccgacaacgccatccggccaggccttcggatcgtcaacaccggcagcggctccctcgacctgtccaaggtcacggcccgctactacttcacccgggacagcggctcgcccaccgtgaacgcctggtgcgactacgcggccgtcggctgttccaacgtcagcctgaaggtcgtacccctgaccacgcccgtgccgggagccgacgcctacctcgaagtcggcttcaccggcggcaccctggccgtcggccagaacaccggcgacctgcaactgcggatgagcaagtccgactggtcgaacttcgacgaggtcggcgactacagccgcggcacctccactacgtacaccgaagccgcagcgatccccgcgtatctcagtgccacgcccgcctggggagccccgcccgcc

SEQ ID NO: 551 - DNA, 459 bp, Streptomyces avermitilis
  CDS (1)..(459)
atgaagctcacgaagcgcatttctctcgctgccgcctccgctgcggtcgcgggtggcgcccttctcggcgccgggggcaccgcctcggcggcggttcccgagtctgcgcacattgagcgcccggccgtaagcatcaaggccgacgactaccgcgaggaccgcggtgtcaactaccgacacaactccgaggaggactaccgccgggacgggtaccgcgcccgacagcacagcgaccacttcagcgactcggaccgctacgaccgccgcggtcactcctattactgggacgacgaggaccgttgctggaagcacgacagcaactaccgctacgactgggaccggtccgaccgccgcgactccaaccgggatgaccgcgactggaaccggtatgaccacgactggaaccggtatgaccacgactccaaccgatccaaccacgaccgagtcctcgacaaccgg

SEQ ID NO: 552 - DNA, 1143 bp, Streptomyces avermitilis
  CDS (1)..(1143)
atgacagccgcgcccacggccaccggcggcctccgctcccgatggcgacgcacatccggctcgatgggccgcgccgagtggggccgcgcagccgggatggccgccttcatcatcgcgctccatgtcatcgggtggttcacgctggtggcgatcgtggccccggagcactacagcgtgggcaccaagggcttcgggatcggtatcggggtgagcgcttacaccctgggcatgcggcatgcgttcgacgctgaccacatcgccgcgatcgacaacaccacccgcaagctcatggacgaagggcaacgccccgtgtcggtcggcttctggttctccctggggcactccagcatcgtgttcgtgctggccctcctgctctccctgggcgtcaaatcccttgccgcaccggtccgcgaggacaactccgagctgcaccacgtcaccgagctgatcggcacgaccgtctccgggacgttcctctacctcatcgccatcatcaacatcgtcatccttgccggcatctggaaggtgttccggcagatgcggtccggccacttcgacgaggccgcgctggagcagcagctcaacaaccgcggcctcatcaaccgcctgctgggacgcgtgatgaagtcgatcaccaagccgtggcagatgtatccgctcggtctgctgttcggtctcggcttcgacaccgccaccgaggtcgctctgctggtgctggccggctccggagccgcctccggcctgccctggtacaccatcctctgcctgccggtccttttcgcggccggcatgagcctgctggacaccatcgacggttctttcatgaacttcgcctacggctgggccttttccaagccggtacggaaggtctactacaacctcaccatcaccggcctgtccgtcgccgtcgcgctgatcatcggcaccgccgagctcctgggcctgctcgccgacaaggccggcctgcacggcgtgttctgggactggatcagcggcctggacctgaacaccatcggcttcgtcatcgtcggcctgttcttcgccacgtgggctgccgccctggccgtgtggaagctcggccgtatagaggagaagtggacggctggactgcggccccccgagcaacaggccgaccgacagcgg

SEQ ID NO: 553 - DNA, 615 bp, Streptomyces avermitilis
  CDS (1)..(615)
atgaccgaccgcgaaccgcaggccctcgatgtcctcgacgacgccggacgaaaggtgctgttcaccgaggcccgcaccgcgaacacctttgccgaggtggccgttgccgacgacgagctcgccatgatctgggaactcgcccgctggtcgccgagcgccgccaacggtcagcctctgcgtgtgctctttgtgcgcacccccgagggcaaggagcgactgggccggcatctcgacgagggcaacagggccaagacgctcagtgcgccggccgtggcgatcctggcgtacgacgtcgacttccacgagcagatgccgaccgtcttcccggctcgcggcgagatgctgcgagcggcgttcgccgaccagacggagaagcgcgagagcctcgcggcctacaactcggcactgcagaccggggtcttcctgctcgcggtgcgtgcggcggggctggcggccggtcccatggcgggcttcgacagggccggcgtggacgaggagttcttcgccggtaccagctggcgttcgcatctggtggtcaacatcggtcaccccggcgccgacccgtggttcccgcggctgccccgcgtgcccgtcgaggacgccgtcgcctatgcc

SEQ ID NO: 554 - DNA, 2016 bp, Streptomyces avermitilis
  CDS (1)..(2016)
atgaccaccccgcaccccgcgccgtatccggaacccttcttcactcccgacccgaagtcggccgcccacagccgtatcgcggacttcgcccgatgggcggcccggcaccagggcgccgaagggatccaggaccccacggactaccgagccctgtaccagtggtccgtcaccgacctcgaagggttctgggccgcggtgtgggagtacttcgacatcgacgcgacgactgagtacgagggggtgctggccgaggagaccatgcccggcgcccgctggttccccggcgccaccctcaactacgtccatcacgcgctacgcaacctgcagccggacgctcccgcgatcaccgccctggacgagaccggagccggctatgagatcacgggccgggagctgcgcgcccgggtcgcctccgtcgctgccagcctgcgcgacctgggcgtcgcacagggcgaccgggtggtgggctatctgcccaacaccccccacgccgtcatcgccttcctcgccaccgcaagcctgggcgcggtgtggtcggtgtgcggccaggactacgtacccaaggccgccgccgaccgcttcgcccagctcgaacccacggtgctcatcaccgctgacggctacctcttcaacggcaccacacacgaccgccgcgccgcctcgctcgaactcgccgtcgccctgccgacgctgaaggccacggtgctcgtggatcacgtgggccttgcctggcccgagggcggggacttggggctgacagttccctgggaggacgcggccacccgcgccgagtacctcaccatcgccccggtgccgttcgaccaccctctctgggtcgtcttctcctccggcaccaccggactgcccaagggcatcgtccacggccacggcggggtcctgctcgaacacctcaagatgctcggcctgcacaccgatctgggcatcggggaccgcctgctgtggtacaccaccacccactggatgatgtggaacctggtcgtctccaccctgctgaccggtgccaccacctgcacctacgacggcagcccggcaccgcaggcgcgtccggacgtcctgtgggagctggcggcccgtcacaaggtcaccgtcttcggcaccagtcctcagtacctgctggccatgtccaagctgggcatcgcaccctccgtgtacgacctgtcggccatccgcgtcgtcggctgcaccggctccgctctgcccgcctccgcctacccctgggtccgcgaccacgtgggcgcaggcgtccagctggcctccaccagcggcggcacggacatcgtctccggcttcgccggcagtgccgccacgacccccgtctgggcgggggagctgtccgcccccggcctgggcgtggcgctggccgcctacgacgaggaaggcctccccgtcacggaccgggtcggtgaactggtcgtcacccgccccatgccgtccatgccgctgtacttctggaacgaccccgacggcagccgctaccgcgacgcctacttcggcgcctaccccggtgtgtggcggcacggtgactggatcacgctcacctcgcacggctcggtgatcgtccacggccgctccgacgccaccctcaaccgcaacggcgtgcgcctgggcagcgccgacatccacgacgtcgtcgaacgcctccccgagatcaccgaggccctcgtcatcggcgcggaggaacccgacggcggctactggatgccgctcttcgtggtcctcgccgacggggtcggcctggacgactccctgcgcgcgaagatccgcgacgcgatccgcgccggcgcctcaccccgccacgtccccgacgagatcctcgccgtaccggccctcccgcacacgaagaccggcaagaaactcgaggttcccgtcaagcgcctgctccagggcgctcccgccgagcaggtcctgaacccctcggcggtcgacaaccccgacctgatcgcctacttcgcccgcctgggcgcggagcggaacaagcggtcagcacaccacaca

SEQ ID NO: 555 - DNA, 1608 bp, Streptomyces avermitilis
  CDS (1)..(1608)
gtgaaggccgcatcccagaggccggtggtgatcatcggtgggggacccgtcggggtcatggccggcctgctgctcgcccggtacggagtgcgcagcttgctcctcgaacgccatcgggacatctaccctctgccgcgcgccgtcgtcgtggacgacgagatccgtcggatcctgcaaagcgtcggtgtccacgaggatttcgctgctctcgcccgcccggcgctcgggctgcggctgctggacgcccggcgccgcgtgatcaccgagttcccgcggtccatgcacggacaccacggcttcccggagaccagcatgttcgaccagcccgagctggaacgcgtgctgcgcagcgccctggcgcgccgcccggagtgcgagctgcagggcggggtggaggtcgtgtccgtcacccaggacaccgacggaccgaacgatccgacgggtccggcccgggtcaccttccgccgcgacggcagcgacgaggaggagcacgtgtgggccgatgccgtcctcggctgcgacggcgcgggcagcctcacccgtgactccatcggcgccgtgtgggaggacctgcacttccaggagagctggagagtcatcgacgtgcgcaccacccgccaggtgcgcacctgggaaggcgccgagcagatctgctgccccaaccgaccggccaccttcatgcgcgtcggcgaggaccgctaccgctgggagttccggctgcccgaggacgaaaacctggacggcccggacggatgggagcgcctgcgcgagctggtcgccccctgggtggacctgccgcccgacgcctcggcgggcgacgacttcgaggtggtgcggcaggcgcagtacaccttccgggcccgcctcgccgaccgatggcgcagggggcgtgtcttcctgctgggcgacgccgcccacctcaccccgcccttcgtcgggcagggtctgtgcgcgggcctgcgcgacgcctacaacctcacctggaagctcgcccgcgtgctccaacagggcgcacacgacgggctgctggacacctacgaacgcgagcgcaagccgcacgcccgccatgtgatccgcgtcgcggtcgccgtcggctgggccatgaccggcggacaggaccgcggtgcggcgttccgccgggccgtcgtgggcacggcctctcgcatccccggcgtgaccgcggcggtgagccgtgacctcagccccgccctgaccgccggtccactcgtacggcgccgccccaggctgaccggccgcgtgctggccggcacgatctgcccgcagccctgggtacggcatgacggcaggcgagtgcgcctcgatgacgtcctcggggactccttcgccgtcgtgaccgctgtgccgcccacggcgcagatgacggccgtggctacggcactgggcgctccgacggtccacgtcgaggacctgcgcgacgacggcaccctggccggctggctggcacgcggccgtgccgacgccgtcctgctgcgccccgaccgcgtcgtgatggacaccgtccaggccggcaccggcgacttcacggacaccgtcgcctgggcccccctgctgcacacggcccgccataccgccgacgcccggcccgcc

SEQ ID NO: 556 - DNA, 936 bp, Streptomyces avermitilis
  CDS (1)..(936)
atgagcaccaacgttctgcgcaccaacgacggctggtgggtcgtccgggacgagcgcgccgtccgcgtccagaccaaggcggtcaccaccggcgagctgctcgccgaccgggacgcggtccgcgaggccgccgcctctgccgagagcggcactcccgtcgccgacctggtggcgctgcctccggtcaccaccccgtgccgggtggtcgcccagatggtcaactaccgcagccacgccaaggattcgggcttcaccggcgacatcccggccaccttcttccgtaaggcgtccggctcggtcagcggcccccatgacacgatcatccgccccgcgcacgtgaagttcctcgactacgaggtggaactcggcctcgtcatgggcgcgacccttcccgtgggcaccgtcgtcgaggagcaggacctgccgcgctatgtcgccggccttgtcctgaccaacgacgtcagcgcccgcgacgtccagctgaccaagacccagttctacgagagcaagtcctatccgaccttcacgccgacgggtccgtacctggccctgctggagcccgaagacttcgcccatctgctgaacctgcggttgcagctgtcggtcaacggcgtgtcccgccaggaccgcacgctggccgacatgatcgtacggcccgcacaggcgctcacgctgctcgcccgcttccagaccctcgacccgggtgacctgctgctgaccggcactcccggcggcacggccctgaaggctccgcccaaggcggccgagaagatcgctgcgctgctcccgcccgcactgaagtggaaggcgttcttcaagggccaggccaagaaccccaagtacctgcgcaacggagacctcatcaccgccacgatcgccaccccggacgggcggatcgacctcggtgagcagcgaacccccgttacggacgcagcg

SEQ ID NO: 557 - DNA, 1143 bp, Streptomyces avermitilis
  CDS (1)..(1143)
atgtcccacacccccgttaacagggccgctccccagacgccccaccaagacctccacagtgagcagggcgccctgcgcggagagcatcccggacgttcccggaatcccgtgatcaaggtggccgacctggcctggctcgagttcgagaagcccgacctggaccaggccgaggtcttcgcccgtgacttcgggttcgcgatcgccgcccgcaccgagggggagctgtggctgcgcggtaccttcgccggctcgccctgcatggtgatccggcgggggcgtgcgtcccggttcatcgggccggcgttccgcgcggccgagcgggccgacctggaccggctggccggcaccaccggcagtaccgtccgggacatcggcgtaccgggcggtgggcagtcggtcgccctgctcgatccctcgggcctgccggtccgggtcgtgcactgcgccgagcagctgcccgcgctgcccgagcaggagccgctgatcctcaacttcggtaccgatcaccgtcgtacgaacgccacccagcgtccgccccgtgagccgtcccgtatccagcggctgggccatgtggtgctggagacccgggtgttcgcccgcactctggactggtacctggacaccctcgggatgatcgtgtccgacttcctgttcctggacgggcagcgcgggcgcgggccgacgatggcgttcgtccggtgcgaccaggggagcgtggccgtcgatcaccacacgctggccctgcacctggggcccggtaccggctacgtccactccgcctaccaggtcaccgacctcgacgcgatcggcgccggcggggagtacctggccgagcgtggttaccagcgcagctggggcatcgggcggcacatccagggcagccagctgttcgactactggcgcgaccccgatcacttcatgctggagcacttcgccgacggcgacctgttctcctgcgacctggagcccggctgggcgccgatgtcggcgagcggcctggcccagtggggcccgcccgtcacccgcgacttcctgggcgccagcccgtcccccgccaagctgcgcgaggtcatgacggccctgcgtggcgacaacgaactcgaccccgcacgcctgctgggcctgatgaaagcgatgagctca

SEQ ID NO: 558 - DNA, 633 bp, Streptomyces avermitilis
  CDS (1)..(633)
atgccgacgtcagccccgcccaagaaccgcttcgagcggcgccgcgccgagacgcgtcaggcgctcgtccgtgcggcccggcagatcctcgcggagaccggggacaccagcgccagcatccaggccatcgccgagcgcgcggacgtcggtttcggctccttctacaaccacttcgagtccaagacggagctgttcgacgccgcggtgacagacgccctggacgagttcgggcaggtcatcgacgagcgcgtagaaggaatcgacgacccggccgagctcgtcgccgcgggcttccggctcaccgcccgcatggccgactcccaccccgaactcatgcggatcctgcgtgaccgcggtctggcctacatccactccgcccgcggactcgccccgcgagccctgcgcgacctggagaacggcatcgcctcgggccgcttcacctgccgcaacgcgaccaccgccctgtccgccttgggcggcaccctgatgtccctcgtggcgctgcggctggcccgccccgacctcgacggggacgaggccgcctcggacctggccgagatggtcctgcgcatgctgggcgtcccgccggacgacgcccaccaggtgacccggcgcccgctgcccgacctggat

SEQ ID NO: 559 - DNA, 1443 bp, Streptomyces avermitilis
  CDS (1)..(1443)
gtggacctcaccgcggacagtcttctgtcccgtgccgcgcatgaactcagcccgcgagcggacgaggtgatccacgacgtagagcaatgcctgcggcgcgagatccccgagctgtgggacgaacccgacatcgcacagatgacgagggagaacgtcgccgagcacgtcgtcgccctgcttttcggcatcgagcacagcatcgagccaaggcggatcgatcagccggccgccgacgcagagcgcgcgcgtcggctggctcagcgcggaaagccggtcacggcaatgctgcgcgccttccccctcgcgcacgcccgtgtcctcgaccggctgctcgaagagctgccccggctcaccagcgatgccgagtcgatcaacgcggcggcacgcaagctgatcgcactgtcgatcgcgtacatggcccgcacatcggagacgggcgttctggccttccaggaggagcgggatcgccagctgcagtggcggctgtcggtggtgaacgaggcgagcgtacgcgtcggaacgaccctggacatcgcccgcaccgcccaggagctggtggacctggccaccgagcacttcgccgacgccgtcaccgtcgacctcctcgacatgccttccggagacgagcctcctgcgaagggcacactcgtggtccgccgaatcgcccagcagtcggtgatggacggttaccccgagacgacctccctagaagcgatctacggggaattgccggtttcgccgcagcaggtccacaggtatccggacggatcaccaccggctcgcgccctggccaccggccggccctcacggcaccacctcggcccgtccgcatcaatgctgctggtaccgctgtgcgcccgtggcaccacgctgggtgtcgttcagttcttccgtcaccacaggcccgacgcgtacggggacgaggacctgctcctcgcccaggaggtcgcggccagggcggcggtcgccatcgacaacgcccgccgatacacgcacgcccgtgccaccgccctcaccctccagcgcagtctgctcccgcgcagacacccgcgcagtccgccgtggaggtcgcctgccgctacctgcctgctgccgcccagctcggcgtgggcggcgactggtacgacgtcatcccgctgtccggtgcccgggtcgcactcgtggtgggcgacgtggtcggccacggcatccacgccgccgccaccatgggccggctgcggaccgccgtgcgcaccctcgccgacatcgacctgccgcccgacgaactcctcacccacctggacgacgtcgtcatccgcctgtccgccgaagtctcttccgaagcctctgcccaaacggacaccgaatccgcaggggacatcggggccacctgcctgtacgccgtatacgatcccgtcgccggccgctgcaccctcgcccgcgcgggccacgtgctgcccgtcg

SEQ ID NO: 560 - DNA, 1017 bp, Streptomyces avermitilis
  CDS (1)..(1017)
gtggtgggcgacgtggtcggccacggcatccacgccgccgccaccatgggccggctgcggaccgccgtgcgcaccctcgccgacatcgacctgccgcccgacgaactcctcacccacctggacgacgtcgtcatccgcctgtccgccgaagtctcttccgaagcctctgcccaaacggacaccgaatccgcaggggacatcggggccacctgcctgtacgccgtatacgatcccgtcgccggccgctgcaccctcgcccgcgcgggccacgtgctgcccgtcgtgatggcccgggacggaatcgccgacatcctcgagctgcccgccggcccgccactcggcctgggcggcctgccgttcgaggcggcggagatcgacctgcccgagggcagcctcatcgccctctacaccgacggcctggtcgaggccctcgaccacgacatcgaggcgggcctcacccgactgtgccacgccctcgcgcagccctccgcctccctggaggcgacctgcgacaccgccctcgatgcgctgctgcccgcaggccgaccgcacgacgacgtggcactcctcctggcccgcacccacaccctcggggaacgtcaggtcgtcacttgggacgtggatgccgacccggccgaggtcgcccgggccagagcgcatgtctccgagcagctgaccacctggggactggaggaactcgacttcaccaccgaactggtcgtcagcgaactggtcaccaacgccatccgctacggccggcctcccatccagctgcgtctcatccacgatcgcaccctcatgtgcgaggtagcggatgccggcagcacgactccgcacctgcgccgggcccgtgtcttcgacgagggcgggcgaggtctgttccttgtcgcccaactcgccgagcactggggaacgcgccatgcccgacgtggcaagacggtctgggcggagtgcgccctgggcgcgccggagctcttctcgacagggctggacctggaaggtattcccggggtcgta

SEQ ID NO: 561 - DNA, 756 bp, Streptomyces avermitilis
  CDS (1)..(756)
atgtgtgaggcttttaccctacgaaggagctcgtccatgcctgcagttctgatccacggcgtccccgacacccaccgtgtgtgggacggcgtgcgccggcacctgatccggagcgacgtcgaggcttgggatctgcccggcttcggcacgccccggccgcgcggcttcggctccagcaaagaggagtgcgtcgattggctcgtcgaacggctggagcgggtgggcgagccggtggacctggtcggtcatgactggggctgcatcctcaccgcgcgcgtcgcttcgatacggccggacctggttcgtacgtgggccggcagtagcgctccggtcagtactcagtacgactggcatccgctggccaagatctggcaggacccggtcgagggcgaccggttcatggacgagcttgacccggcgtccttcgccaaggatctgatggagaacttcgatctcccggctgaggtggccgaggagatggtccggcgcgtagacgggaccatgagggacagcatcctcaagctgtaccgctccgccgagacggtgggcgcggagtgggaaccggaactgacgaatgtgtccgcgccgtccctggtcctgtgggggacgctcgaccccgcctgtccgatcgcgttcgccgatgaactcggtcaagctgtgcgagcgtcccaggtcgtcgaactcgactgcagccactggacgttgatccagaagccggccgaggtcgccgcagcccttgaggcgcactggaatgcc

SEQ ID NO: 562 - DNA, 804 bp, Streptomyces avermitilis
  CDS (1)..(804)
ttggaacgagggcaacgccgacacggacctgtaggtcgtgcggatggtgctgagctcggccaaagcgcaccgtgtcggcgagtcggcgcttccacatcgcccgcgagcacgcgcgcacctaccctgccttcgaccagcagaacttcgacctcaccgcttgatcacgagcctgcttgcggacagactgcggcccatgaagttcacgggcgtgcccgcctgcgcgcaggccaccggggtcgagacgggcctctctttgcagcggcaggctcagcagtgagcgtcagcctgccccacttccgctatcaccccgaccccgtcgccagcgggtccatcggcgagagcgccgaggtctgcgcctgctgcaaccgcagcacggggtggatctacacggcgaccttctacacggcccacgacgtcagcggcagcttctgtccctggtgcatcgccgacggcaccgccgctgaacggttcgaaggtgaattcaccgacccatacggcctcgacggcatcagtcaggagaccctggtgcaggtcacccgccgcacccccggcttgcacgcctggcaggatccgcactggcttgtccactgcaacgacgccgccgccttcatcggcgaagtcggatacaccgaactggcggcccaccccgaggcactcgaccagcttcgactcgaccttcggatgggcggttggaacgacgcgacccagctcgagcacttcctgacccacctcgggcagggggcaagcgccatgctcttccgctgcacagtctgcggcacccatctcgcctacgctgacgcttca

SEQ ID NO: 563 - DNA, 852 bp, Streptomyces avermitilis
  CDS (1)..(852)
atgacgtcagcatcagaacggggccgacgccccctccgcgtcgggaactgctccggcttctacggcgaccgcgcctcggccatggccgacatggcccgagcgggcggcatcgacgtcctcacgggtgaatacctcgccgaggtcacgatgctggtcctcggcaaggcgcgcgccaaggacagcacgaagggctttgcgatcaccttcctgcagcacctcgacgcggcgcgcgagcacctcgtcgccaaccggatcaggctcgtcgtcaacgccggaggactccaccccgccgggctggccgccgcgacgcgcgaactgatcgcacgccacggtcacgacctgcgggtctcccacatcgaaggcgacgacgtcttcggcagcctcgacggtctggggcaagcgggccattgcctgccgcacctgacgagtggtcagccgctgtcggactggccgcaccagccagtgcagatggtcaaggaagacgctggagatctcggcgagatggtcgatctgctctgctgtgagagggtcgacgaacaggcgccgcactacctgggcatggctttgggggctgcttcttccaaggctgtgcgtccttctggcgtgagcgccgcatacatggcgcgtgacggtccgctctggcgctccaccaggccgcgcttgcacaggcgggtgagctggtggtggaggcggctctctcccagcccagcccagctcatcgctgagctcatatgcacgcatgggcccgcccggggtttccgacagggcgacgagcgccgtgtgatcggcgttggctgcggatccttggaagggaacgcgtgtgctgagctgggccgtcatgaagcgtcagcg

SEQ ID NO: 564 - DNA, 465 bp, Streptomyces avermitilis
  CDS (1)..(465)
gtgatgtccagtcggggcggcaaccgccggcgcccgactcaagggactcaccagcaggcaagtggtgtcgtcggcacgcattcctgtcggccgagcgcgggcgagaagtgtgtcggccatgtcgtccagcgggccggtggccttgcagagcgctgtcgcgaagggatcgtcctgctcggcgacttcgcctggtgcatggcccctgtactccgggcagggtttggcataggcatcgcgggcaccgaactgctggcccggctgctcgccgaacacgaccacctgcccgccgccctcggcgtgcgggagcaacggctgcgcccgttcgtcacccgccatcagggggaggccctgcgcatgcggcacttcttcatgcccgcccaccgcttcgggtacgccacccgccgcaccctcatccgcgcggccgacacccctgtcggctccgcgctcaccaagacccttgtgaac

SEQ ID NO: 565 - DNA, 681 bp, Streptomyces avermitilis
  CDS (1)..(681)
atggcgggtgacgaacgggcgcagccgttgctcccgcacgccgagggcggcgggcaggtggtcgtgttcggcgagcagccgggccagcagttcggtgcccgcgatgcctatgccaaaccctgcccggagtacaggggccatgcaccaggcgaagtcgccgagcaggacgatcccttcgcgacagcgctctgcaaggccaccggcccgctggacgacatggccgacacacttctcgcccgcgctcggccgacaggaatgcgtgccgacgacaccacttgcctgctggtgagtcccttgagtcgggcgccggcggttgccgccccgactggacatcaccggagggcgacagccgggccgcgcgggggatcaggcgtggttgagcccgtaccgggcgccgagaacggcgaccgccttcttgagtttgcaggagttgtagtgtccatcaattatcaggtcggggacacactcccacggctcaagcacacggtcacgacctttcagctgttccgctacagcgcggtcacctggaacccccaccgcatccacttcgacgagccctacgcgcgcgaggagggccacggcggtctcgtggcgcactcccacctgcgagcggcgcttgccttgtgtcaccgaggctctcggccccaagtggcacgtgacgaaggttgcctaccgcctgcg

SEQ ID NO: 566 - DNA, 1044 bp, Streptomyces avermitilis
  CDS (1)..(1044)
atggacaccatgctcgccggacgcttccacctggacagcaagaagttcgccgtggaggaggtccccgtccccgtgcccggccccggcgaggtcctcatcgaggtcaaggccgcaggcgtctgcctctcggatgtccacctcatcgacggctccctcgtcccgctgttcgccacctccgacacggtcaccgtcggccacgaggtctccggtgtgatccacaccctcggccccgacctcaagcgcggcctgaccgtcggtactcgcgtcaccctggaggccggcaagacctgcggccagtgcgccggctgcgtgcgcagccgaccctgcactcagatgcgcaccgccggcatcgactacgacggcggctgggcccagtacaccgtcgcccgcgaggacaccctcatccccatccccgacaacctgcccttcgaccaggccgcgatcatccccgacgcggtctccaccccctacgccgccgtcgtcaccaccgccggggtgcgccccgcccagtccgtcggcgtctggggcgtgggcggagtcggcgcgcacaacgtacgcctcgcccgcctggccggcgccgcgccgatcatcgccgtcgacccgctgcccagcgcccgcgaacgcgccctggccttcggcgcggacttcgccctggacccggccgccgacgacttcgccgaccagatccgcgcggccaccgccggacgaggcctcgacttcgccttcgactgcgccggcgtgccggccgtccgcgagcaggccgccgccgcactcggcctgggcggagtcctcatcctggtcggcatcagccccaggcccctcaccatcaccgagggcctgaccttcaactacctgggcaagcaggtgcgcggccactacggcggcagccccgagtccgtcaccgagctggtccgcctcgccgaggtcggccgtctcgacctggccccctccatcaccgaccacctcccgctcgccgaggccgccgacgcggtcaaccggctggagaacaagatcggcgacccgatccgcctcatcctcgtcccc

SEQ ID NO: 567 - DNA, 3219 bp, Streptomyces avermitilis
  CDS (1)..(3219)
atgaccacacagcccgagaccgacctgcggcccatccggtctccgcggggcgtcccgctcttcggccacacgccgcagatccccagcaccaacccggtggagtacttcggcaagctgtccaagcagttccccgaggggctctacggcatggagatcgccggcatcgagcaggtcttcgtctgggacccggacctggtggccgaggtctgcgacgagacgcggttcttcaagcagatcgacaagacgccgctggcccatgtccgggactacgcgggagccggcctgttcacggcccaccagcacgaagaggaatggggcatggcgcaccgagtcctcctcccggtcttcagccagcgggcgatgaagggctacttcgggcagatgctggagatcgcccagaacctggtgggcaagtgggagcgtaaggagggccagcccgtcaacatcaccgacgactacacccggctgaccctggacaccatcgccctgtcgggtttcggttaccggttcgactccttcgccaaggaggatctgcaccccttcctcaacgcgctgctgcaggcgctggttgagtcgctgcggcgctcgcaggagctgccggtgatgaccaagatgcgcaaggccgatgacaagaagtaccgcgagaacatccggctgatgcgggacctggtcgagaatgtgatcaaggagcgccgtgaggggaagggcacaggtgaggacgacctgctgggcctgatgctggaggccacggacccggagaccggcaaggggctggacgacgacaacgtccgtgaccaggtggtgacgttcctgatcgccggtcacgagaccaccagtggtctgctgtcgttcgccacgtactcgctgatgcgcaacccgcacatcctggcccaggcctacgccgaggtggaccgactgctgccgggtgacacggtcccggactacgacacgatcatgcagatggacgtgatcccgcggatcctggaggagaccctgcgcctgtgggctcccatcccgatgatcggcaagtccccgctggaggacaccgtcatcggtggctgctacgggctgaagaagggagcgcgggtcaacatcctcgagggtccgctgcacacccaccccaaggcgtgggagcggccggaggagttcgacatcaaccggtggctgccggagaaccgggtcaaccaccacccgcacgcctacaagccgttcggcaacggtgtgcgtgcctgcatcggccggcagttcgcactcaccgaggcgcgtctggccctcgcgctggttctgcagaagttcaagttcgccgacaccgacgactacaagatggacgtcaaggaggcgctgacgcgcaagcccggcggcttcgaactgaacgtgcgggctcgtcaggagcacgagcggaccgtgttcggcgccgcggacctgcagaccgacgacacgcaggcgcaggccgcggtcagcggtgtcggggtgaacctgaccgtcgcctacggctccagcctgggctcgtgcgaggacctggcgcgcaccatcgccgaccgcggtgagcgctccggattcggcaccaccctggtcggcctggacgagttgggtgacaacctgcccaccgagggcctgctcgtcgtcgtggcctccagctacaacggcaaggccccggacaacgcgcagcgcttcgacgacctgctcgccgccggactcccggagggctcgctgtccaacgtgcggttcgcgctgctgggtgccggcaacacgcagtgggtggccacctaccagggcttccccaagcggatcgaggcaggcctgctggccgccggcgccacccgcgtcatcgagcgcggtatcgcggacgccgccggtgacttcgacggcatggccacccgctggatggacaccctgtggaccaccctggccgaggagtacgccgccgacacctccgaaaccaccgggccgcgcttcgaggtgcagctgctgaccgaggcggaggtgcgtcccgcgatcgtctcggagcaggcctaccccctcaccgtggtcgccaacgaggagctggtcagcgacgcgaccgggctgtgggacttcagcatcgagccgccgcgcccggccgcgaagtccatcaccatcgaactccccgacggtgtcacctatgacaccggcaaccacctggccgtcttcgccaagaacgagcccgtgctggtcaaccgcgccctcgcgcggctcggcgtcgaccgcgaccaggtgctccggctcgaccagcccggcggtggccggacccacctcccggtgggcacccccgtcaccacaggcctgctgttcaccgagttcgtcgagctgcaggacgtggccacccgatctcagatacaggagctggccgagcacacccagtgcccgtggacccggccgcagctgcaggcctacacggccgacaccgccgaagccgaggagcgctaccagaaggagatcctgggcaagcgggtctccgtactcaacctgctggagcgcttcccggcggtcgaactgccgctggcggtcttcctggagatgatgggcccgatccgcccgcggttctactccatctcctcctccccgctggccaacccgcgccacgtccggctgaccgtcggtctgctggaaggcccggccctgtccggcgacggccggtaccgcggcacctgctcctcctacatcgcaggcctcgagtccggtgacgtcttctacggctacgtgcgcgtgccctccccgacgttcgccccgccggccgaccccgccacgccgctgctcctcatcggccccggcaccggcatcgcgccgctgcgcggcttcctggaggagcgtgcccaccagcacgcgcacggcacccaggtgggcctgtcccaggtcttcgtcggctgccgccacccggagcacgactacttctaccggcaggagatgcaggactgggagcaggccgggatcgcccaggtgcacaccgccttctccgcggtgaccggacacccggcccggttcgtccaggacgccattgtgggtgccgccgacaccgtgtggcaggccatccaggacggcgcgtacgtctacgtctgcggtgacggccgccgcatggcacccgccgtgcgcgaggcgctcgccgccatctaccgaaagcacaccggcagcgacgacgaggccgcccagcagtggctcgcccagctggaagcggacgagcgctaccagcaggacgtcttcgcc

SEQ ID NO: 568 - DNA, 654 bp, Streptomyces avermitilis
  CDS (1)..(654)
atggcgactgaacggaagccccctcggggcacaagaaagagagacgtaccgctcaccaaggacggcatctgcgccatggcgttgcagctcatcgacgccgacggggtcgaggcgctcaccatgcgcaaactcgcgaccgcgctcgatgcgaacccgatgtcgctgtaccaccacgtgccgaacaaggacgccgtgctgcgcggcgtggcccaccgggtcggttcgcagttcagcgcggggcagcgggaggacgtcccctggcaggaccagctgcgtgaactggcccgggacttccgcgaactgtcgcaccgtcatccgaaactgatggggtattccttcacgcgccccgactacgtgcagccggaggaccccttctggcaggcactgatcgacatcctggccgccgcgaaactgcccgacgaggagattccgcgcgtcgccgcgaccctggtcggtgtgttcacgggtctgctgctcggcgaactgaacggggcactgcagcggtgggccaccctgccaccggcaccgtcgggccccgacggggaagacgcgcccccgccctccaaggacgtgatcgacaccatgttcaactccgcgctggacgctgcggtctccggagtggagaaccatgtcgcacgagtccgcgagggggcg

SEQ ID NO: 569 - DNA, 795 bp, Streptomyces avermitilis
  CDS (1)..(795)
atggaaagagcgaagcgtacccctagaggtactcggaagagggatgtgcctctgaccgaggcagggatctgcacctccgccctgcggctcatcgacgcggacggggtcgaggcactcacgatgcgcaaactcgccgccgcgctggacgcgaacccgatgtcgctgtaccaccacgtgccgaacaaggaagcattgctgggtggcgtggcgagaatggtcggcgcccggttccgcaccgtgacactcgaggacgctccctggcaggagcgcgtgcgcctgcttgccacggatttccggacgctggcacaccgccaccccaacctcatggcctactcgttcagtcagccggacttcatccagcccgaagatcccttctgggtcgcgctgaccgccgtactggccgccgcaggggtgccgcagtcggagatcccgcagctcgccgcgctcgtgtgcgccgtcgtcatcggcgtgatgatcgccgagctcaacggcgcgctgcaccggtggtcgaacctccagcccgccacacccgcctccggcgaggacggcccgacgaacgagggctttggcgaggaccggatgttccgcctggtgctggacacgatcatcagcggcctggaaagccggctcacagccgatcacgccggtgggcgcgagggccagcccccgcagaactccgggtgcgcctccggacgcatcccccgtcaactccgaccaccggccgcacactgtgaaggagagtccccggggaatcctgtctcgggcatggcggccggtctcgatccggaagttcag

SEQ ID NO: 570 - DNA, 180 bp, Streptomyces avermitilis
  CDS (1)..(180)
atgtgcacgtggaggtggccgacggaggccctgccgccgaccgaggtcgactggacggccggcctcgacgccgacgaacacggccgcgggctgctgatcatcgattgcctcgccgacgcacacggcgactggcaggaggcaggccacgccgtccactgggccgacatcaccaccctgtcg

SEQ ID NO: 571 - DNA, 327 bp, Streptomyces avermitilis
  CDS (1)..(327)
atgtcccagtaccagcttcgtgtctacaccctgcgcagccctgaggcgctcgtcgcctacgagaacatctggtcccagcacattcccggtatggccaagcacaggatcaccacacacggcgtttggacggtgcctgcggcccccgggagtgaggagccccagctgtacgccctcgtttcttaccgggacgccgacgacgttcaggagcggctggaggcgtacctgtccagccccgaattccgggcggacatggagggcttcgacatcagccagatcgtcggcgtcgccgagtccgtgctgacgcccaccgccgactcacccttgcgg

SEQ ID NO: 572 - DNA, 417 bp, Streptomyces avermitilis
  CDS (1)..(417)
atggagtctttgaagaccgtcatgcaggaggtggccgtgcagcttgtcgtctcgcgcacctactcgctgtccatgtgtatgagcctgcggtacgagcccactgacccctatgtcgtccgtgccacctttttcacccacaccgacgagccgaccgagtgggtcctggggcgtgatcttctggccgatggcctaaggggttccgcaggctgtggggacatccgggtctggccggccgtcggccgtggtgacaaagcgatgtacatcgtcctcggggctcccgcgggcaccgccttgctcgaggttcccgtgcaggacgtcaagaccttcctggagagcgcggaggcgcttgtgccgcggggtaccgagtccggacacatcgactgggaccgagaagtggcgaacctgtttgcaaaaggc

SEQ ID NO: 573 - DNA, 342 bp, Streptomyces avermitilis
  CDS (1)..(342)
atggaagggtttgcccaggccgcgccagatgccgcacatcgcctgcatgcagccgatggtgcggaccgcacccatcaggaaggaaagaccatgaagaggctcacgaggcgcgttgccgtcaccgccttctgcgtggcggtcgcgggtgtcgccgcgctcggtgccgggggtaccgcttcggccgcgacttccgcatccgtgcacggccaacgcccggccgtcagcgtcgacgccggcgactaccgctgggaccacggtgtcggctatctgctcgaactgggctactcctgggacgagatccgcggctggcaccacgacggccgggatgagatcagcggttgc

SEQ ID NO: 574 - DNA, 207 bp, Streptomyces avermitilis
  CDS (1)..(207)
atgcagaccgttgtggatctcacgcgctgccagggctatgcgcagtgcgtcttcctcgcgccggaggtgttccagctgcacggggaggagggcttgctgtacgccacagccgtccccgacgaccaggtcgagcgcgtgcgccaggccgcggcggcgtgcccggtgcaggcgatcctcctcggtgaggaggtgagcgccggtgcccgg

SEQ ID NO: 575 - DNA, 1362 bp, Streptomyces avermitilis
  CDS (1)..(1362)
gtgcccggtgacctcaaggacggacgtatcgtcatcgtcggcgcgtcgctggcggggctcagggccgcggaggcgctgcgtgaggagggcttcaccggctcactgaccgtggtcggggacgagccccacccgccctacgaccggccgccgctgtccaagcaggtgctgctcggccaggcgacggcggacagcaccgggctgccgatgcgccaggacccgaacgccgattggcggctgggcgtgcgcgccaccggcgtggacctgctcgcgaaacaggtgctgctggaggacggcgagtcactgccgtacgaccggctgctcatcgccaccgggacccgcgcgcggccctggcccaacccggcggaagccgccctggacggggtgttcgccctgcgcacccgcgaggacgccggaggactggcgcagcggctgaccgccggtccggagcgcgtgctggtgatcggcggcggcttcacgggctcggagatcgcctcggcctgccgagaacggggactggaggtcacggtcgccgaacgcggccccgctcccctggtgggcgcgctcggcggcaccctgtcgaagctcgcggccgccatgcagcgcaaccacggcgtggacctgcgcaccggggtgacggtcaccgccctgaacggcaacggaagcttcaccggtgcggagctgtccgacggcagccgcgtcgacgccgacgtctgcgtcgtggcgctgggcgcggtacgcaacgtcgaatggctggcggagtccgggctggcggcgggcccgcgcgggatcgcctgcgacgccggatgccgagccttcaacatgtacggaatcgtcaccgacgacgtcttcgtggccggcgacgtctcccgcttcccccacccgctgttcggctaccagatgctctccctggaacactggggaaacgcggtcgagcaggccgaggtggcggcacacaacatggtcaacccggggcctctgcagcgcccgcacctggccgtcccgtcgttctggtcgacccagttcgggctcaacatcaaatcggtgggcgtgcccacctactccgaccacgtggtcatcgcccagggctccctggaggcgcgccggctggccatggtctacggctaccagggacgggtcaccgccgccgtcaccgtcgacatggccaaggcgctcgactactaccggcacctgatcgagacggccgctccgttcccgcctccgcccggcgcccaggaccgtgcggtcgcggccgacctcgcgattccgtccgacgtgccggatccgaaggggctgtcgcacggccccaccgtggcgctcaccggatacctgccggatcgccggctgacgctggtgcagcccggc

SEQ ID NO: 576 - DNA, 1197 bp, Streptomyces avermitilis
  CDS (1)..(1197)
atggcctccgacaccctgctggcccggatcaccgactacgccaaccgccccgacccctacccgctgtacgccgaactccgcgaggcggggcccgtggtgcggcaggcggacggcagctatctgatcggcacctaccacgagatcgtcgcgctgctgcacgacccccggatgagcgccgatccgcgctcgcgcaccgctcccgctccgtacgaggtgacacgaaaaccgtcgttccttcggctcgacgaccccgagcaccaccggctgcgcaactcggccatgcggccgttcggcccgccgcacagtccgggccgggtcgactccatgcgcggcgagatcgtccagctgaccaaggaactggcggaagtgttccaggagggcaggcagatcgacgtcgtcgacgacttcgcctacccactgcccgtgaccgtgatctgccgcctgctcggcatcccggacaaggacgagcagctcttccaggactggaccgataccctcgtcgcgtccgccgacatcgggcccgaaggtgacaccgccgaacgggaccaggcggccgaccaggcgcagcaggagatgggccagtacctggtccaactcgccgaacagcgccgcggtcggcccaccggcgacatgctctccgacctcgtcaacgaaccggacccggccgcacggctcagcgaggaggacctggcggcgaacaccatcctgctgttcatcgccggacacgagaccacggtcaatctgatcgccaacggcgtcctcaccctgttgcgccggcccgaccaactggaccgtctgcgcgaagaccccagcctgctgccgcgagcggtggaggaactgctgcgctacgagcccccggtccacatgcgcgagcgggttcccctcgtcgacatcgacgtcgccggcaccacgatccccggtggcacgtccgtcatcctggcgctggcctcgggcagccgcgacccgatgcggttcagcgaacccgaccggttcgaccccacccgcccggacaaccagcacgtcggcttcggcagcggtatccacctgtgcttcggcgcgccactcgcccgtatcgaagccgaggccgcgctcggcgcgctgctcccccacctcggcacggcacgcctggtccaggacccgcctccctaccggcagaacgccatgctgcgcggaccccgccacctgcccatccaactc

SEQ ID NO: 577 - DNA, 633 bp, Streptomyces avermitilis
  CDS (1)..(633)
atgccgatgccagccccacgcaggaaccgattcgaacgccgtcgtgccgagacccgccaggcactcgtccgcgccgcgcggcaggtcctggccgagtccggtggcgccagcgccagcatccatgccatcgcggaacgcgcggacgtgggcctcggctccttctacaaccacttcgcgggcaagccggacctgttcgacgcggccgtggccgatgcgctggaggagtacgcccaagccgtcgacgaacgcctgcacggcgtcgatgatccagccgagcgcgtcgctgggggcgtgcggctcagcgcgcgcatggccgcgtcatacccggagatcatgcagatcctgtgtcacagccagctcggtcggatatacgccggggacggactggctccgcgcgcgaagcgcgacgtggagcagggcatggccgcaggccggttcaccgtggccgacccggtgatagccctgaccctgctgaacggcggcctgctggcgctcctggagctgtggtgcaaccagcccgaggccgacagtgaccaggccgcgggcgcaatggcagagacaatcctgcatatgctcggcctttccccggatgaggcccgggacctcgcctggcggccccttcccgccgcagcg

SEQ ID NO: 578 - DNA, 2577 bp, Streptomyces avermitilis
  CDS (1)..(2577)
ttgacgataaagggatcgtatctgactatttcgtcagaagtggacaaagccgtccattgggccgacgccgcgcatgccgaggctgtcgcacacctcagcaccgatgggaagaaccggatgacgaagaccgaccacacgccactcgccgagccggtgagcccccgagagacacccgatgccgcaatagcgatgctcgacgcggaggggaccgtggtggggtggacgcacgccgctgagcagcttgtcgggtactcggccggggaagtggtgggccggtccgccacacacgtgctgccgcccgccgaggacgtcccgagtgcttcagtgttcgccgagcagggccgtgccctggatggctggtccggcgccgtgacggtccgccaccgcgacggccacgccatcaaaatgacgctgcggatctcgctgctgtgggggcaggacgccggaacccggtggctggtgtccgtgaccgacataggcaccctgtcctcggggacgtccgacgaagccgtgcgggagtcgctcctggcccacgcgccggtcggcatcgcggtctatgacccgcggctgcgctgcacctgggtcaacgacgtcatggagcgccacgacggcactcctcgtgagcgacggttcgggcgccgcctgcgggactcactgcccgccgtggaggccgaagcgctcgaggtggtgatgcggcaggtgctggagagcggcaccaccatggtccacgagtaccgggcgtggtcgtcgacggaccagcgccgggagcacgcgttctcggcctcgttcttctgcctccaggacgcggacggcacggcactggccgtgtgctcgatgagcgtggacgtcacgggcaaccggcgggcgcgcgagcgtcttgccatcctcagcgaagccagcacgcgcatcggcagcaccctcgaggtcatgcggaccgggcaggaactggccgacctcgccgtgcccctgctggccgaccacgcaatcgtcgacctgatggagtcggttccgttcggcgtggatccctcggcggggaccggcacggcggcgaacgaccgcccacctgtgctgcgccgtgccggtgtggcctccgtcgacccgggcatcctcaagttgctgatgcgccaagaggtgatccgccccttcccgacctcgctgttcgccaccgtcctgcgcacgggcaggtcttacctggaatcggtgctggacacctattcaggcccctggattcttcacgacccggcgcggacgcagatggtccgtgacagcggcgtccactctttgatggtcgtacccatccgtgcgcggcgctgtgcgctgggactggcggtgttctgccgctccgaggagccgacgccgttccaggaggacgacctcctgctcgcagaggaactcgtcacccgggccgcgctcagcctggacaacgctctccagtacgctcgccaacgcaccgcggccctgacgctccaacgcgacctgctcccccaccatgtgggaggtggcgccgccctcgatgtggcctcgcgctacgtgccggctgacatagaccacggcgtggggggcgactggttcgacgtgatcaagctgtccggcgccagggtggccctcgtcgtcggagatgtggtcggacacggcatcaacgccgcggtgacgatgggccgattgcgcaccgccgtccgcacgctcgcgaacatggaactgcctccgcacgaactgctggcgcacctcgatgacacggtcaagcggctgagcgaggaagacgccgacgctccggaccagctccccccggcggtgggcgccacgtgtctgtatgccgtctacgacccggtcacccggcggtgcacgatgtcgcgggccgggcatcccccgcccgcgatcatcgacccgcagggccgtgccactttccccgacatgcccgccggggccccgctcggcctcggcctcggtctggtccccttcgagtccgtggaactggaactgcccgagggcactctgctcgcgctctacaccgacggtctggtcgagtcccgcgacgacgacatcgacgtgggcctcgaccgcttgggcgccgccctggcagagtccggttcggccctggaagacctgtgctcccaggtgatcgagaccttgccgactcaggccccggccgacgatgtcaccttgctccttgcgcggactcgcggactcgaaccggcccaggtcgcctcctgggagctgccgaacgagccggccgccgtccgcatcgcccggcaggcagccgcccgtcagctcagcgaatgggggctcgatcatctggtgaccaccgagcagctgatcgtcagtgaactggtcaccaacgccatccgctacagcggcgggccgatccgcctacgactcatccagcaccaggtcttgacctgcgaagtctccgacagcaaccccagccacccacgcccccgtcagccccacaccatcgacgagaacggccgcggcctttccctcgtcgcccagttgtcccaccggtggggctcccgctccgcaaccgacggcaagatcgtctgggccgaacaagacctgccctccaaagccctcgcggcg

SEQ ID NO: 579 - DNA, 2427 bp, Streptomyces avermitilis
  CDS (1)..(2427)
atggataaagagaatgccaagaacgcctactcggcaggcgcctcccaaggatcgacgggcgtctccggttccggtcccggcggcaggcgatgcgcctgtgacggcccggcagccgccgtgctcgacgatcgaggcgcggtggtggggtggaccgagacggcggaggacctgacggggttccgcgccggggaggtctgcggccgccccgtgcaggaactggtggccgacctcccggaccaccttcgcggcgccacggatatgccggaatccgggcgggtacggctgcggcaccagtgcggcgacaccatcgacgtcactttccggaccacaagggtgcagggctcggcgcaggtcctcgtcctggcggcacccacacaccacgtcgccgaccacaagcagggcacagcgctcctgcgcgcactgtccgcacagaaccggatcacgatcgccctgtacgacaccgacctggccactgtgcaaacgaacgccaagccggacactcccgacggccttccagtacagcccggcactcggctgagcgacgtgctgtgcgccgatgacgccgagaacctggaggcagtactgcgccaggtgctcgagacgggtgtcccggtggtccgcagaacccagcaagtgagctggcggcacaattcggcgcggcggcacacgctgtcgctgtctgcctttcgtctggaggacgtgcgagcacgccccacgggggtcgcagccctgtacatcgacagcgacgacctgcgtgcccgccgtcatctggatctcgcccgcgaggtggccgagcgagtaggaggatccctggatgtcgtgcgcaccgcacaggaccttgcggacgttctcgcacctgcgttcggggatctcgccgcagtcgaccttgcgtactccgttctcgacggggaagaaccctcgaagcagctgaacggtggaaacatgggcaacgcggcccttgcgccggccaccgcggtgtggccggccggcatcaagcgcggcgagtccatcccgccccttcccgaccaccccctgtggcgcagtttccgacacggcgagccagccgtcttcagccttgacgacttcatcgccatggtcggcgacccgcagctggtcaagtatctcgccccgaaggacgcccattcgatgatggtggcaccgttgcatgcccgcgggctcacgctcggcgccatatcggtctggcgctgcggccgatccgaccccttcaccgaggacgaggcggatctcatgaagcagatcgcctcacggggtgcgctcgccatcgacaacgcccgccgttacacgcgcgagcaccgggcggccgtagcgctgcagcagctcctccttcccccggccaccaccgacacgccggccgccgagaccgccggcgtccacctgcccgcaggcggggaagcggacatcagcggcgactggtacgacgccatcgctctgccctctctccggctggcacttgtcgccggagacgtggtcggccacggcatgtccgcaagcgccgccatgggcagcctgcgcgccgccatccggacgctcgcggacctggagctcgaaccggacgagctgctcacccggctcgcggacctggtccagcgcctcgcggccgaagccccgtccggcgactgcgacatcgtcggcggaacgtgcctgtacgcggtctacgacccggtcacccgccgctgcgccatggccagcgccgggcatccgccacccgtcctggtgcggcccgacgggaccgccgaagcagtcggtatctccccggggccaccactcgccctgagcggcatgccgtacgagaccaccatcatcgacgtcgagccgggcagcgtcctcgctctctacaccgacggcctggtcgaacggagcgatcgcgacatcggccaaggcctgcggcgcctgacggaagccctcgccgcgtactgccgtccggatcgcgccctggacgaaaccggccgtgctctcctcgccgatctggcagaccaggcgccgcgcgacgacggggccctactgctggcccgcacccgcgccgtcccagcggcggacaccgctcactgggagatcccggccgatcccgccgccgtcgcaaaggctcgagagtggacaacccgtcaactcaccttgtggggcctggacgacctcctcttcgccaccgaactcatcgtcagcgaactggtgaccaacgccatccgctacggtcgtccgccgatggacctccgtctgattcgccacaacgccctggtgtgcgaggtcaccgactccagcagcacccagccccgcctgcggcgtgcccgcacaaccgacgagggaggacgcggcctgttcctcgtcgctcaactcggcggacgatggggctgccgccacgtccagaacggcaagacgatctggtccgagcaagtcatccaggattcctcc

SEQ ID NO: 580 - DNA, 444 bp, Streptomyces avermitilis
  CDS (1)..(444)
atggccgtgaatcttgacgacgttgactgggcgatcatcgggcagctgcaacgggaggctcgcatctccctcagcgagttgggacggcgcgtgaatctcagctcctcggccaccacggaacgggtgcggaatctggagtcgttgggcgtcatcaccggttaccacgccgtggtcgacctggccaaggtcggctatcccgtgctcgccgtcgtccggctgaagtaccccggcaaccgccaccagccgttgcgtcggctgctcgccgagcggggggagatcctggagtgcctgcgcaccaccggcgacgactgttacaccttgaaggtggccgcgagctccatggagcacttggagacgctcgtggatgagctggctggttttggcagcacgaccacgagcgtcgtctacagccagacgctgccctatcgctcacccagccggccc

SEQ ID NO: 581 - DNA, 816 bp, Streptomyces avermitilis
  CDS (1)..(816)
atgcaacttggcgtcaacgtaccgaacttcgggcccggaaccgatcccggcgtactgcgcgattgggcgcggctcgctgaggggctcggcttcgacctcctcatggtgtcggaccacgtggccgtcaccccggacgtggccgagcggtacccggagccgttctacgagccgttcaccacgctgtcctggctggctggcctcaccacgaggctgcggctgggcaccacggtgctcgtcctgccctaccggcatccgctgctggtggctcggatggctgccaacctcaaccaactcagcagcggccggttcgtcctcggggtaggcgtcggctgggcgcgtcaggagttcgacgcgctcggcgttccgttcaccgcgcgcggccgactggccgacgagtacctgggtgccctgcgggatgcctggcgcacggagaccggggacggcaccgccccgatacctgtctgggtcggcggccacagcgaggcggcaatccgacgcacggtcaggttcggcgacgcctggcacccgctgcggctccccctccccctgatgcgctcagtcctggcgaaccactcgctgccggcgttcgcgccccggatcgccctgcggatgaccggcacaccggtcgacgaccgcgagcggcccgccggtgtcggcaccatcgagcagatcctcgacgacctcgaccagctccgtctgctcggcgcggccaccgtcgtactcgacccctaccacggagatccggaggagacccgccggccccacgcggcctggcaggcactcaccgccgtggccacacactggaggaccccatcg

SEQ ID NO: 582 - DNA, 435 bp, Streptomyces avermitilis
  CDS (1)..(435)
gtgatcaccattgaggacgagaccctcctgcggcgtgccatcggcatcgcggcccacgcggtcaccctgggggacgcaccgtacggctccctgctgaccggcccggacggcgcgatccttgccgaagcccacaacacggtacggcgcgacaacgacatcgccgcccacccggaactgaagctcgcccgctgggcggcccgcgaactcgccccggccgcggccgcccgcaccaccatgtacaccagctgccagccctgcaccatgtgcgccggcggcatcgtccgctccggcatcggccgggtcgtctacgcgctctccaccgagcaactcgtcgaactcaacccgcagtcgggcgactggccgacggtgccccaggacggcccggtcctcttcgaggaggcgcgcgcccccatcgacgcctactaccgacccacc

SEQ ID NO: 583 - DNA, 408 bp, Streptomyces avermitilis
  CDS (1)..(408)
atgacgcccgacaccccccgtcaccaaggccgctccgacgaggcggccgacgcggctcccggtcccttccgcctgttccccgccgctccgcaggacgtccccgcgtcgggcaacgagagcccaccccatccggcctcccggatcaataccgaccccgacaccgtggaacgagatctgatcaagctggtactcaccctggtcgaactcatccgtcagctcatggaacgacaagccctgcaccgcgtggatgccggcgacctcaccgaggaggaggaagagcgcctcgggatgaccctgatggtcctgcacgaccgcttgaacgacctttgcggtcgctacggcctgaccatgcaggacctcaatattgatctcggccccctcggcacactgctcccgccttccgactac

SEQ ID NO: 584 - DNA, 285 bp, Streptomyces avermitilis
  CDS (1)..(285)
atgatgaccgacccctccgatttcggccctgcgaagccccgcccaccggaccgcgggtccctgcctgaccgccaggtcgcgctcatcgacctcctggaccgcctgctcaccggtggcatcgtcatcaccggcgatgtcaccttgtcgatcgccgacatcgacctcgtacggatctccctgcgagccctcatcgcctccatcggcaccacgaccccaagcccctggagccgtggtgggccgctcccggtcacgtcacccggccaccccgaccagctcccctcacca

SEQ ID NO: 585 - DNA, 813 bp, Streptomyces avermitilis
  CDS (1)..(813)
atgacggcgacggtcagctacctgtacggcgtgtcggcggtccctggcggctcgtacgacgtggtggccgccctgcgaggaatcgccgacgcgccagtgcggctggtgccggacgaagacgcgaacctggcagcgatcgtcagtagtgtcccggccgacgacttcgacgaggcaccgctcgccgctcacctggaggatctcgactggctggaggccgtggcccgggcacaccaccgggttgtcgacgcgatggcggcccggaccaccgtcctgcccttgcgacttgcgaccatctatcgcgacgacgaccgcgtccgcgccatgatcagagccggtcaccgcgcgttcgcgcagcgcctcgcccacctcgccggccacatggaatggggagtcaaagtctatttcgatcccccctcggcccctacggcctccacagcggccgcacccgcggccgaactgagtcccggccgggcctacctgcgtagccgccatcaggaacgggactcacgacaggacgcctaccgagccgcggagcaggccgcgcgacgcgtcgaggccgcggcccgtacccaggccgtcgaacacgtccggcaccgcctgcagcaaggccccctctcccacggctccggcgagaacatagtgaacaacgcctacctggtggccgacggccaggccgaggacttccgggacgcggtccagctggccgccgagcagtccgagaccatccgcgtcgagatcaccggaccgtgggcgccgtactccttcgtctcccggcagaacgagccgggtgaaatgagcgaggaggcgatcacc

SEQ ID NO: 586 - DNA, 447 bp, Streptomyces avermitilis
  CDS (1)..(447)
gtgaccgaacctgtcccgagcaacctcggctccttcccctcccgggcgtccccgtcctacggccagggctcctcggccaacctggccgacatcctggaacgcgtactggacaagggcatcgtcatcgcgggtgacattcagatcaacctcctcgacatcgaactgctcaccatcaagctgcgtctcctcgtggcctcggtcgacaaggccaaggaaatgggcatcgactggtgggaacacgacccggccctgtcctcccacgctgacggcggccgtgagctggccgaggagaaccgaagactgcgtgaagagatagctggcctgcgcgacgcccaggcccttccgtcggccgagggccccgctgagaaacccgagcgtcccaagaagcgtgccagtacggccaagtccacccgcgccggcaaccggcggacaccgaggacagagcga

SEQ ID NO: 587 - DNA, 222 bp, Streptomyces avermitilis
  CDS (1)..(222)
atgaggttctcagcgggcggtggatgtgcggaccaggaggtgtcaggaggagcccccacgatgatgaatgccgcagcaggcgcggtgctcctcttcggttgcctctacgaggaagccgaagaggggcacgacgcggagccccgtacgcagagaacgtccgcgccgtgccgcgagtcggcgctgaccgacaccgccgacgccgaatcgaggtctgaacggccg

SEQ ID NO: 588 - DNA, 249 bp, Streptomyces avermitilis
  CDS (1)..(249)
atgggactgttgactcacctgctgactctcccgctggcccccgtccgaggcgtcgggtgggtcatgcagcaggtggcgcaggtcgcggaagagcagtactacgaccccgatccggtgctgaaggaactcgccgaactggaacgggcactggtgtccggccagatcgatcaggagaccttcgaccgacgtgaggacgagctgctggaccggctcgaagagatcactcgcttccgggagggcaccggagca

SEQ ID NO: 589 - DNA, 720 bp, Streptomyces avermitilis
  CDS (1)..(720)
atggccgtctatgtctacgccatcacagccgcgagccaccccctacgcctggacggcgtcaccggcgtgggagaaccgccggagaagctgcgcaccgtgaacagtcggtcgctggcagcggtggtcagcgatgcgccggacgggctcagagccaagcggcgcgacgtcctggcgcatgaggcggtgctggaacggctgatggccgagggcagtgtgctgcccctgcgtttcggagcggtgacctccgacgatcaagcggtgctccaggtgctggatgagcgagccgcctcgtatcaggagcggctgacggccctggacggctgtgtggagttccacctgaaggcatcctgcgacgaggacgcgctgctgcgggagatcctgctgcaatcacccgaggcccaccagctgaacgagcagatccgcagcggccgggccggcccggatctgcagatcgcgctgggcgaacgggtagctggggaggtccagttgcgccacgagtcctttgccgcgggagccgtcgaagcgctgcgtcccctggcacgcgacatccgggcttcggatccgaaaggcggtgacttcgtgagcgtctcgttccttgtggacaaggcccggcaggagggcttcacggccgcggagcaggatctggcgaacgagcgcggagcggacttcgacttccgtctgcacgggccgctgccgccctacagcttcgtcgaggcaacg

SEQ ID NO: 590 - DNA, 447 bp, Streptomyces avermitilis
  CDS (1)..(447)
atgactgtggtgccgcaaagcggtggaggcggcgtcgcccagggcggcggctcgggaacgctgtacgacgtcctggaactggtcctggatcgcgggctcgtcatcgacgtcttcgcccgcgtttcgctggtgggcatcgagatcctgaagatcgacgcccgtgtggtggtggccagcgtcgatacctacctgcgcttcgccgaggcctgcaacaggctcgatctggagagcgggcgcaaagccccggcacagctgaccgacctcgtcggagaggtcaccgaaggcggagccaagggaaagagcaagggcgccctcaccggcgcggtggaggccgtcacggagtcgttccaccaggggcatgaggaggaccgagaggaagagcgcgagccggcagcggagcggaagaggccacggccgacgcgccgccctgctcggcgccgggaagag

SEQ ID NO: 591 - DNA, 366 bp, Streptomyces avermitilis
  CDS (1)..(366)
atgcctgcggatcgaaacggcgatagcgcgaggccccgtaagcgcacgcatcgcgggaccgaggagtctcgcgtccgcagccgaggtgagagcccgcgcccctcgcagcggctttcagcgtcgcgagccatgctctcggcgatgcagcagctgaaggagctgctgggaaaggcgccggaatccgtctcagcggttcggcccaccgatgacggatgggaagccgaggtggaggtgctggagatcgagcgcatacctgagacgaccagcgtgatggccagctaccgggtgacgctcgacgcggatggcgagctgatggcgtacgagcggatccgccggtacacacgcgcccaggtcgaccggcgtgcc

SEQ ID NO: 592 - DNA, 744 bp, Streptomyces avermitilis
  CDS (1)..(744)
gtgcagctggaggccgccaagggcgacatcgtcggactcgtgggccccaacggcagcggcaagtccaccctgctccgtacggtctaccgctcgctgcgcccggccgacggcgtggtcagggtcggcggcgacgacgtatgggagctgtctgctcgtaccgccgcccgccgcacggcggccgttctccaggacgccggcaccacgaccggcctgaccgtaaccgagatcgtcgccctgggacgtacgccccatcacggcctgatgggtcgggacggcgccgaggaccgcgaggccgtgaccgaggcggtcgaacgctgcggagtcggccccttcgcggaccgggactacgccaccctgtccggcggcgaacgccagcgcgtcctgctggcccgtgccctcgcccagcgtccgcagcttctggtcctggacgaactcaccaaccacctcgacatccgcgcccggttcgaactcctggacctgatccgcagcaccggcatcaccaccctggcggtcctgcacgacctcgacctcgccgcccgactctgcgaccacctcgtcgtgctccacgaaggcgcggtggtcgcggcgggacccgtgctggaggtcctgacaccggacctcctgcgagaggtcttcggcgtacggggcgccacggagcggcatgccgacggcgtcgtccgcatcacctatgccgccgagccgctcgccctggaccgggaggccgagcccgcgcccgcagagcgg

SEQ ID NO: 593 - DNA, 969 bp, Streptomyces avermitilis
  CDS (1)..(969)
gtggtggcggtgagtatcggagcggtgaacatcccggtggcggatgtgtggggcattctcctgcaccacgtcaccgggcggggagccgccggtgacccggcgctggaccagatcgtgtggaccttccgggctcctcgcgtcgccctggccgccctggtcggcgcgggactggccgtcgccggagcggtgctccagaccctggtctccaacccgctcgccgacccggtcgtcctcggcttctcctacggcgcctcgctcggcgccgtgctggtcatcaccctcggcggcgtcgcactcggcgggctggccggtctcggcgtgtcgggcgcggcattcgtcggcgcactggccgccggggcactggtcttcgccctggggcaacgtcagggccggctggcccccacccggctggtcctggcgggggtcgcggtcggctatgtcctgctgtccgtgacgagcttcgtccaactgctggcgacgcccaccgagctgcggaccgtgatgttctggatgctcggcagcgtcgccggcgcccagtggagccaactgcccaccgtcacggcggtggtcctgacgagcaccgtcgtgctgaccctgttcggccgccgcctcaacgccctgctggccggtgacgagtccgccaccgcgctcggggtggacgtcaaccggctgcgcgccgtcctcctggtgatcagcgcgctgctcaccggcaccgtcatcgccgtagcgggtggcgtcggcttcgtcggcctgatgatcccccacctggtccgcctcaccaccggagcggaccaccgcagactgctgcccctgaccgcactcctgggcgccgtgtacctcgtcctcgtcgacctgctctcccgcaccgtcaaccgccccaacgaactgccgctgggcatcctcaccgctctgctcggcgcccccttcttcctgtggctgctgcgccgcgacaagggcctggacaccgta

SEQ ID NO: 594 - DNA, 1041 bp, Streptomyces avermitilis
  CDS (1)..(1041)
atgtcgaagaaacggccggtcgccgtcgccctggccggcgccctctgtctggtcacggcggcatgcgccgactcgtcgaccgaccaggacggcgccaccggcgacaaggcgtccgcggccgccgcgaagtccggttatccggcgatcctcgagaactgcggagtgtccgagaagttcaccaaggcgcccggccgagtcgtcgtcatgaacggcgcctcggtcgccgaggtctccacgctgctctccctcggcctcggcgaccgcgtcgtcgccaaccagcagagctacggaatgtccgaggtccccggccgcgccaaggccatcaaggccctgcccaacggcaaggtcaagctcaacgacgcctacgacatcccgcgcgaggcgatgatcgggctgcggccggacctggtgctgtccacgacgtcgtacggcttcgacgagaagaacggcttcgccacccgcgaccagctcaaggaggtgggcgcccacacctacgtctccccgcagggctgcgaccaggacacctccaagatgaccgtcgccgacagctacacgctgctgcgcgacatgggcaagatcttcaacgtccgtgaccgcgcagagcagctgatcgccgcgtcggagaagcacatcgccgagatctccgccaaggtcaagggcgagaagcagccgaaggtcatggttctgttctccaacatggccatgggcggcaacgacttcagctcggtcgtcgccaagggcatctacaacgacatcctcgccaaggccggcggcagcaacgccttcgcgtcggcctccaagacctccttcgccgacctgagcaaggagaaggtggccgccaccgatgtcgacgcgctcgtcgtcatcggctacaacgacccgaacccggcggcctacgccaagaaactgctgaaggagttcccccagtggccggccgcgaagaacaacacgtacgtggccctgtccgactcgatgtacctcggccccagcaacgacctggccgtcgagaagatcgccaaggctctgcaccccgacaagttc

SEQ ID NO: 595 - DNA, 4320 bp, Streptomyces avermitilis
  CDS (1)..(4320)
atggatgacacagcgcggcgtcatccgttgctggccgctcaggaaggcatctggaccggccagcagctcgacccggacagtcccgcgtacaacacggccgagtacgtgctcatcgaaggaccggtggacacggccgtcttcgatgcggccctgcaccacgtggtcgccgagacggaggccctgaacgtcgtcttcgtcgtcgacgaccagggccgcccctggcaggcaaccgccccggtcggcgactggcgcctgcacacggccgacctcaccaccgagcccaatccgcacgcggcggccctggcctggatgggcgaggacatggcccgccccgtcgacctcgcgcgcggccccgtcttcggccacgccctgctgcgcaccgcgccggagcagtacctctggtaccaccgcgtgcaccacatcgccctcgacggcttcggcctgtcgctggtcgcccgccgagtcgcccaggtctacacggccctggcggcgggcgagcgggcggcggccggcggcttcggcacgctggcctcggtgcgggacgaggaacgcgcctaccgggagtcgccccgcttcgccaaggcccgcgcctactgggcggaccggttcgcggaccggccgcccgtggccactcccgccggccgtacggccctgcccgcgcgcacgttccaccggcgagtggcggacctcgacgcggcgcagacgcaggccctgcgtgccgttgcccgggacctccaactcacctggtccgaggtgctgttggccgtgaccgtggcccagctgcaccacgcgacccgtgcaccggagatcgtcctcagcctgccggcgatgggacgtctgggctctgtgtccctgcgcgttccctgcatggtgcgcaacatcctgcccctgcgcgtcgccgtcaccgcctcggacagcctgcgcgacctcgcggcccgcatctcccgcgagctgcgcgccgggctgccgcaccagcgctaccgctacgaacagctgcggcgcgacctcaagctcgtcggcggacagcgccggctctccggtcctggcgtcaacatcatgcccttcgagtacgacctgcgcttcgccggacaccggagcacggtccacaatatctccgcgggccccgtcgacgacctgtccgtcaacgtctacgaccgttccgagggcgcgggactgcgcatcgccgtggacgccaaccccgacctctacgacgaggcggacgtcgccgcactccaggaggggctgctagccctgctcgaggaggccgtcgcggcccctgaccgggcgctcggcgacctgtgtgcgcgcgagcccgtcccggtcctggacggtgggccgctgcccggccccgtgcgcccggttctcggcctgatcgccgaccatgccgcccggcatggcggattcgtcgccgtcgagcacggcggcaccagcatcacgtatgcccgactcttcggatcggcgcgtgcactcgcgcgccgactggctgcccgtcaggtcggccacggcgacctggtggccgtcgccctgccgcgcggtatcgacgcgatcaccgccatcctcggagtcctgctgtccggtgccgcctacagcccgctcgacccgacggcgccccgggcccgcagggcggaactgctggacgacgcccggcccgacctcgtcctcaccaccagcgccttcgccgaccgcttcggggaccgggccgttctgcgacacgacgagccgggaccagattccgaagcggcccagtcgacggcaccgacgcccgaggacctcgcctacgtcctccacacctcgggctccacggggcgccccaagggcgtcgaagtcggccaccacgccctcgcgcacttcgtcgccggcgccacgcaccgctacggccttcaccaccgggaccgcgtcctgcagttcgcccccctgcacttcgacaccagcctcgaggaaatcttcctcacactgtgtgcgggcgccacgctcgtcgtccgtaccgacgacatgaccgagtcggtccccggattcctggacgcctgcgcacggctgcggatcagcttcctcgacctgcctacggcctactggcacgaactggcgtacgccgtttcgaccggtgcggtcactctgccggccgaggtgcgcaccgtcgtcatcggcggtgaggcggccctccccgagcgggtcgaacgctggcgcacggccgtcggcacgtcggtccggctgctgaacacctatgggccgaccgaggccaccgtggtcgccaccgtcgccgacctccacgacccctcgctcgctccgggagacgtcccgatcggactgccgctgcctggcacccgagccgcggtcgtcgacggcgaactccacctcctgggcgacaacctggccatcggctaccgcggagaccggccaccggacacctcccgcttcgcccctctggaccagatccccggagcgccccgcgcctaccgcacaggcgacctggtacggatcggcgacgacgggcagctgcgctacctgggccggtcggacaccgagttcaagatcagcggacatcgagtgcacccggccgaagtcgagggcgccctccttggccatccgcgagtccgtgacgcggttgtcgtagggctggtgctgggcgacgggacgcggcgcctggtcgcgtacgtcgtcccggacgggcccgccccggccgtggccctgatcagggaccacctccgggagacgctgcccgcggccatgatcccgtcggccgtcgagttccttgaccgcctgccccggacgagctcagggaagatcgacaggaacgcgctcgccgcgacgacccccgacggacatgtgccggagcccggtgcgcaggccgcgacgtccgacagtgcactggtgcgcaccatcgccgccgtctggcaacaggtgctcggcgtggccgccgtctttgcccgggacgatgtgttcgacctgggggcccactcgctccaggccatccaggtcgccaaccgcctcggcgtcgaactgcaccgtgacctcaaagtcgcctggctcttccagcacccgaccccggccgaactggcgagattcctggaacagcaggagcagcctcgctcggcccctcccggccttccggcggccctgctcgccgacaccgtcctcgatccggacatccgccccggcgacggtccccgggcgagcggcacgccggacagaatcctgctcaccggagccaccggcttcgtcggcgcacatctgctggccgaactcctgacgagcaccggcgcggaggccgtctgcaccgtgcgcgccgctagccccgccgaggccaccgcccgcatccaccaggccctggaaacccacctgatccacctcccggacgcggcgcgcgaacgcatcacagcggtccccgccgacctcgcccgcccccgcctcggcgtggacgaggcactcttcgccgacctcgcccggacctgcggggcgatcatccacaacgcggcgaccgtcagcatcatgcgcgaatacgccaccctccgcgccgccaacaccgagtccacccgggacctgctgcgcatggcggctgtgcgctccattcccctgcacttggtgtcgaccctctccgtcgccccgcccctcgacctcgccccggaggtaccggaggcgttccttgcggcccaccccggactgcgccacggctaccagcagtcgaagtgggcggccgagcgcctgctggaacaggccgccgaaagaggcctgccggtcaccgtgcaccggctcggccggatcgtcggcccacgcaccactggctacgtgaacgaacgggacttcctctggagcgtgctgcgcgcggggatccccgcgcgcatcgtccccgacctgttcgacgaggagacatggacacccgtcgaccacgtcgcccaggccctcgtccacctctgcctcggacagcgcccgccgggagcgacggttttcaaccacgccaccgcccgcccggtgcggctggccgacgtctacgactggctggaggactacggctatccgctgcggcgcatgccgctggcccagtggcgtgccgaactgccgcgatcctccggtgactccggcgtggcggcgaccatgctcgccttcttcgacgcctgggaggcgaaccccgacgacgcgaccgggccggagctacgcctgggacgcgtccgtgccgacaacgtcgtgaacggcctgcacggcagcggcatcacctccccgcccgtcgaccgtgacctcgtcttccgttacctcgaccactgcgtcaccaccggaacgctgcccgccccggccgggaagcagagccatctcgcaaccccggcaaag

SEQ ID NO: 596 - DNA, 255 bp, Streptomyces avermitilis
  CDS (1)..(255)
atgcctgctcccctcacgctggagggcttccgcgcggacctggcggagttcctgtaccagcggcccgacgaagtcgacctcgaagagaaccccatggacgcgggactggactccctgcgcatcgtcaccctcctcgaacggtggcgggagaccggcgccgacgtgaccttcgtcgaactcgccgagtgcacctcgttcgcccagtggtggcaactgctctccgcacggcagaggggagcggaccatgccgacgca

SEQ ID NO: 597 - DNA, 1554 bp, Streptomyces avermitilis
  CDS (1)..(1554)
atggacaggctccaccatccggagcttcagacgctcgtccagaccacgagcttccacgcacggaaccagcccacgacccccgcggttctcttcgagggccgcacggtcacgtacgagcaactgcaccgagagagcaaccgcatcgcccacgccgtccaggccgccggactcacgccgggcgaccgggtcgcgtacctcggcaaggagtccgagcactactacgagatcctcttcggctgtgccaagagcggcaccgtgctcgtacccgtcaactggcggctgaccgcgcccgaggtcagccatatcctgcgggactccgggacccgactgcttttcctggaggaggagttcgggccgatcgtcgagaagatgccgaccgcaccccccgaaacggtcgtcgggctcggagagcccttcgtcgcctggaaggcatcccaccccgacaccgacccgacaccgcacgtcacccccgacacccccgtcgcccagctctacaccagcggcaccaccggactgcccaagggcgtcgtcctcgcccaccgcagcttcttcgcgatccgtgacgcgctggcgagcgaggggctggactggatcgactggcgcgcaggcgacatcgcgctgatcggtatccccggattccacatcggcggtctgtggtgggccacacagaacttcaacgccggaaccacgatcgtcgcgatgcgggccttcgccgcccgccaggccgtcgacctcatccgcgacctcggcatcaccaccgcctgcgtcgtcccggcgatgctccgcatgatgctgaccgaaccccgcgtcagcgccaaggacttcaccaccctgcgcaagaccgtctacggcggctccccgatctccgaggcactgcttgaggagagcctcgccgttctcgactgcgagttcgcccagatctacggcctcaccgagaccggcaacaccgctgtgtgcctgcccccggccgcccatgtccccggcggttccctcatgcaggcggccgggcggccgtatccgggtgtgggcagcaaggtgatcgacggcgaggggcgcgaactgccgccgggcgcggtcggggaggtctgtctggccacgccggcccacatggtcgagtactggggactgcccggcaagaccgccgagaccctcgtcgacggctggatccacaccggggacgccggctatatcgacgaggacggctacatcttcatccgcgaccgcatcaaggacgccatcctcgtcgccggcgagaacgtctaccccgccgagatcgagaacgtactggagcaccaccccggcgtagcggaggccgtcgtcgtcggcgcccccgacgaacgctggggcgagtacgtgcacgccttcgtcgtccccgcgcccggacagcggcccagcccccgggacctgcacaccttcctcgtcccgcggctcgcgagcttcaagctgcccgcccgctacgagttcatcgagagcgtcccgcgcaaccccagcggaaagatcctgcgccgcgagctgcgcgaccgcttctgggacgactccgcacgcaaggtcaac

SEQ ID NO: 598 - DNA, 516 bp, Streptomyces avermitilis
  CDS (1)..(516)
atgacgacggcccagcaccccacggacgaggacctgttggcgcgcgtgctggtgccctacaaggaccactgcaagtatctgcgctcggccgtcgtgaccgagagcgacaccggacgggccgtcgcccgctgcgagttcgcgattccggagtcgtgctatatcgacgacaccggccatctgaattccgtcgaggtgaacatctgctacaaccagatgatgtactacctcgtcgccaagtccgtgaaagaagggctcctggcggggttcgaatcctggacgctggacgacttctggaagcatcagctcccggacatcctgatcgcccgcttcgcctccaacttccggcggcccgtcaacccacgtgcattctccggggagatggaatttcagtccgtcacccggcgcgcccccgcaggcggcatcccgttcctgcacgccgagaccgcctaccgctactgggacgccgactcgggccggtgcgacggcgaggccgtcctggcgttcgtcaacatcccc

SEQ ID NO: 599 - DNA, 888 bp, Streptomyces avermitilis
  CDS (1)..(888)
atgcggatcaatgaacggcccggcaccgcgatcggcgcgacggtcgagggcttcgaccacgccaccgcctcggacgccgacatcgccgcactcaaaagcaccgtctacacgaagaagatcgccgtcctgaagggccaggacctctctccccaggagttcctcgaactcggcaagcggctggggcgccccgagacctactacgagccgatgtaccaccacccggaggtcacggagatattcgtatcctccaacgtgccggagaacggaaagcagataggcgtaccgaagaccggaaagttctggcacgcggactaccagttcatgcctgaccccttcgggatcaccctgatctacccccaggtcattccgcggcagaaccgcggcacgtatttcatcgacatgggccgggcatacgacaggctgcccgaagatctcaagaaggagatcggcggaacgtactgccggcactcggtgcgcaaatatttcaagatccggccccacgacgtctaccgccccatctcggagatcatcgaggaggtcgagcggaagaccccggccgtcgtccagccgaccacgttcacgcaccccatgaccggggagacggtcctctacatcagcgagggcttcaccatcggcgtcgaggaccaggacggcgagccgctcgacgacgagctgctcaagcgactgttccaggccaccggccagctcgacgagaccttcgagcacgacaacatccacctgcagagcttcgagcagggcgacctgctggtctgggacaaccgcagcctcatccaccgcgcccggcacacgaccacccccgagccgaccgtctcctaccgggtcaccgtgcacgacgagcgaaagctacacgacgggatcaaggtggca

SEQ ID NO: 600 - DNA, 237 bp, Streptomyces avermitilis
  CDS (1)..(237)
atgagcaccacctacgaccgactggtcgacatcctcgcgaggttgcacgacgccccggcggaccggatccgccccgaggcgaccctcggcgaactggacgtcgactcgctgacgacggtcgagatcagcatccgcatcgaacgcgacctcggagtcgccgtcggcgatgacgaactccagcccgacctcaccctcggcgatctcgccggactcgtcgacgcccgccaggcaaccgtc

SEQ ID NO: 601 - DNA, 990 bp, Streptomyces avermitilis
  CDS (1)..(990)
gtgaccaacgagcacctcgcacgacggctcgacaccgacgacgcatggatccgcacacggaccgggatccgccgacggcatgccgtcgaccccggacaggcgacgtccgacctggctgtcgaagccggccgccgggcgctcgtctgcgccgcgacggccagcgtcgacgccgtcgtcgtcgccacgacgacgccggaccacagttgcccggccaccgcgcccgccgttgccgcacggctcggtctgacgggagcggccgccttcgacatcagcgccgtgtgcaccgggttcgtctacggcctcgcctcggccgccggactcatcgcggccggcgtggccgaacgggtgctgctcatcggggcggacacctactccacgatcgtggatcccctcgaccgggccaacgcgatcatcttcggcgacggcgcgggagccgtcgtcctgcgcgccggacaccccgacgagcccggcgcggtcggccacttcgacctcggcagcgacggcgctcacgaggacctgatcatggtcgcggccggcggctcccgacagcgctcccgtccgggcgaacccagtcgccaggaccggcacttcggcatgcggggcaaggaggtctaccgccacgcggtgacgcgcatggccgagtcggcgcgcgccacactgtcccgggccggctggaagaccgacgacgtcgaccacttcgtaccccaccaggccaatctgcggatcctgcactcggtggccgacgacctcggtctcccacgggagcgctgcgtgacacatgtcgagtccgtcggcaacacgggcgccgcgtccatcccgctcgcccttgccgacgcggccgccggacagacactccggcccggcgaccgggttctgctcaccgccttcggaggcggcctcacctggggctcctgcctcctgacctggcccacgctccccgcgccggccccaccgtacgacccgcacgcccaaggagaacggacgacgtca

SEQ ID NO: 602 - DNA, 1395 bp, Streptomyces avermitilis
  CDS (1)..(1395)
gtgacagagccggcgaaggctccgctccgaaagtccatcggacttcctctgcttgttctggcgtcgggtcagctcgtcatctcgctcgactacaacatcgtgtacgtcgctctgcccgacatcggtgcagggctgggattctccgaccacgacctgcagtgggtggtgagcgcctacgtcgtggccaccggcggcttcctgctgttgggcggccgggccgcggacctgctcggccggcgccggatgttccttgtcgcggcgtcgctgtacgcggggtcgtccctcgtgggcggcctggctcagacgcccggcgtcttggtcgctgtccgggcggtccagggcatcggcggctccctcctgttcccggcgacgctgtctctgatcaacaccctgtacgacgaagggcccgaccggaaccgggccttggcggtgtggggtgccgcgggagccggcgggctctgcttcggatctctcctcggtggagtcctggtggaggcgttcggctggccgtcggtgttcttcgtcaatgtgcccgtggcgggaaccctcgcggtggccggatggcggctgttccccgcggacggcccgtgggaccgctcacggcacttcgacgtggcaggcgcgctgaccgcgacgggcgggatcacactcctggtgttcctgctggtgcaggcccccgcggagggctgggacacacccgcggccctcgcgagcgcggtgctgtccctcgggctgctggcgctcttcgccgtcgtagagaggcgatcccgtgatccgctcgtaccggcaaggctgttcgccgaccgcggcctgctcgcggcgatgggggtgaccgccctgttcagcgccacattcagctcagtgccgtacttcctgaccctctacttccagaccgtccacggataccgggcggtcgccaccgggttcgcgttcctcgtgcccgctgtggtggtggccgtcggtacgcaggccggtggacgggccgtgtccgctttcggggtgcgccggatgctggtgggaggcatggcgctgggtgccgccggagccgcggcactcggcctggcgctcaccgccgacggctcgtatcccgcgctcctgccggggatcgtgctgctgagtgtcggccagggggccgcgtggacggggatgtggatcgccgcgtccgccggggtggcccccggtgaccagggcatcgcctcgggactggcgtcgaccaccctgcaggtgggcggcgcggtgggcctcgccttactggtcggggtcgccggcggggttgggcagaacgcctccgggcctgggctcctcgacggcatccgtaccgccgtgttcgtgatagcgggcggcatcggctgcggcgcgttcgcactgctcgcccttcgcaggaccacgagtcct

SEQ ID NO: 603 - DNA, 750 bp, Streptomyces avermitilis
  CDS (1)..(750)
atgacaccagagatagagaacgccttcgccgcgatcagagccgagttcggtgcggaatcgatcaggcgggtcgagcagatgctggagccgagcgggagcgagcggcatccgctgcagaaagcagccaagtggatcatgccgggactgtctcccactccctggcacgacccgtacgcctacgccgaactggcccccgtcgtccatgaactggaggccagccatcaggcgatcaaggaagagctgaaggtcgcatggtcggcgcgacgggaggcgttctcggactacgagcactacctgacccgccaggacaactggcaggccctctacctcttccgtgaaggaggtatcaccgaagagtcggccgcaacggttcccatcgcatatcaggtgctgaaagacgtcgccgtcgacacgggaaaaatatgccctctcctggaatgtcatttctctactctgttgccgggggccgtcatcgaaccccattgcgacctgtggaacttcagcatcaacctgcatctcgccgtggacatccctgacggttgcagcatcacggtcgccggggagactcgctcctgggaagagggcaagtgcctgctcttcgactactccttcgagcacgaggcgcgcaacacgggcacccgcccgcgtacctgcctgctcatcgacctctggcatccggagaccactgttccggagcgccgggcgctggtcgccctcatcaccgagatccgtcggctcatgggggaggac

SEQ ID NO: 604 - DNA, 717 bp, Streptomyces avermitilis
  CDS (1)..(717)
gtgcgaggcaggcaggtcggcaggtcggagcgcggaacttcgggcgaaggtggttcggcacacgtggaacgcagacgtctgttgcagtccgccacgacggcgatcggcgccgtctcggcggccccgctcgccgccggcaccgcccacgcggccgtcccggcgcgtgcccgcggcgaagacggcgaggtgctacgcatccgcactgtcaccttcgacggcgtggaggagctggacggcgtggagaagttgcaggtcttcggcccgttcgaagtcttctccgtggccgcccgggcccatccggtgacggtgaaaccggtgaccggcggagaagcggccgagatgacctacagcttcggcacgagggtggcggcagcggcctggtccccgcgcgacgccgctctgatcgtcgtacccggtggaggcttcggccgacgggacagccccggcgtctgggcggagttcgacaaggagcggctgccgtccgccccgcgccacctggccaggagtcacctcgccgaacggggagcccgggtcgtggaccagcgagtcgtcgacgacggtgacctggtgacggccggcggggtcgtctcgtcgggcatcgacggcgccctgaggctgctggagggggagttggaaggcgctgccgccgctcacgcggaggcgatcgtggaggtcgagcgccggggaacggtgctgcggacatcgaccgctggccag

SEQ ID NO: 605 - DNA, 519 bp, Streptomyces avermitilis
  CDS (1)..(519)
atggagccgagaagcctgatgcgtgtgatgcgcccgacgcgcaacacatggttcgtcaacgccttacggaccgtcgcgccgccgttgggcgcctcctgcggtgcgctggccctcatggtcgcgtacaccgcgaccggcgcggcaggcgatccgccgcccaggatcacggtcgtcgacgcacacatcgtcgcggtgtccgcgggttccggctcgaccgccgcgtatttcgagatccgcaacaccggcccgtcgaaggacacgctgctgtacgcggactcaccggacctgggcgtcagcctcctgcgacgtacagtgcgccgcaccgggacggggcgtacggagcccgtgtgggccgtcgacgttccggcgggcggcacggtgcgcatggcgccgggaggtctcggggtcgtgatcctggatccccccgtactgaaagccggtcagaaggtgccctaccttctgtggttccgtcagagcgggaaggtcgccgtccgggcgaccgtgaccgcgggcgtgaga

SEQ ID NO: 606 - DNA, 651 bp, Streptomyces avermitilis
  CDS (1)..(651)
gtgatcactcctgtcctccccgtgtcgcgcgagaagcgcgacgcggggcgcaaggcggcggatcagcccggcgccatggcatggcccgacgatgcggccaccgcctgggccctcgccgcccgcgccggcgaccccgacgccgtcgaccgcttcgtgcgtgccctgcaccccgacgtcgtccgctacatcacgcacctctcctccgaccgtcagctcgccgacgacctggcgcaggacacgttcctgcgggcactcggcagcctgcaccggttcgaggggcgctcgtcggcgcgtacgtggctgctgtccatcgcgcgccgcacggtgatcgacaacgtgcgctacaccgcggcccggccgcggctgcgtgacacggacgactggacggtatgggccgagcgggcccagccgagcggtctgcccggcttcgaggacggtgtggccttgctcgatctgctggacgcgctgcctgctgagcgccgtgaggcgttcgtcctcacccagctgacgggactgccctacgaggaggctgccgaggccagcggttgtcccgtcggcacgatccgctcgcgggtggcacgagcccgggcgaccctcgtcgcacttcttgtcgaggccgaggagtcgcgggcccccgccgccgtcgccgcg

SEQ ID NO: 607 - DNA, 675 bp, Streptomyces avermitilis
  CDS (1)..(675)
atgactgctgggtggtgtgcgcgcgcgatacgggccgcggtgttcgcggcagtctgcgtgctgctcgccgccctcggtcacgtactgatgtcgggctccaccgtgccctggtggacgatgaccgccgggttcgccgccacgaccggcgtcggctggtgtctggcgggccgtgagcgcggactcgcgctggtggtgcccgccgcggtcgtcgcgcagggagcgctccactcggccttctcgctggcccagtcggcggcatcggacaccggcgcgggcggtgtggcgcacggcatgcgtggtatgtccatgagcgccacgtccatggacgccatggacatgaggtccgcgcccatgggctgttcggagcagccagggcaacttggccatctggtacacgacatgggcggcgggtcgtcgttcggcatgctcgccgcccatgccctggccgctgtgctgagtgggctgtggctggcctacggcgagagggccgctttccgcgtgttgcgggccgtcgcgggatggctggccgctccgctgcggctgtcgctcgctctgcccgccccgccgtgtcggccgcgtctggtgccgacgcgcgaacgttcggagcgggtgccgcggctgtcgctcgcgcacacgatcatttctcgagggcctccggccgggatggctgtcgcc

SEQ ID NO: 608 - DNA, 519 bp, Streptomyces avermitilis
  CDS (1)..(519)
atgaccggacaacaggtctggcggcccacccggcgcaggctcaccgacaccctgatcgccacgctctcgcccgtcgccgtgtgcggcctggccctcggcggtctgagcacgtggaccgcgtatggcaacgcgggcagcccggcccgtatcgcggtcaccgggggccgggtgtacctgccctacggcaacgcccaggacacggcggccttcttccggatcaccaacagcggcggctcggcggaccggctgctgaaggtgacgtcccgcgcggtcgacggcgccggcaccttcagtcgccatcgcatgaccggcgctcggtcggcctccgcgcagacggtggcgtcggtcgccgtcccggccggtggcagcctcgccatgtccccgcacggccttgatgtgacggtgccggcgaatgcgggctggcaggccggcgatctcgtctcgttcacgttgcgtttcgcacgcagcggtgctgtgaagaccctggctgtggtggtccgtccgggccaggacggcacg

SEQ ID NO: 609 - DNA, 2253 bp, Streptomyces avermitilis
  CDS (1)..(2253)
atgggcgccgaaccgatgaccgccctggtgacgaccgatctgagcgtcggcggcatgacctgcgccgcgtgcgtgacccgtgtcgagaagaagctcggcaagctcgacggagtgacggcgaccgtgaacctggccaccgggcgggctcgcgtgagccatccgacggaggtcagcgtcgggcaactcgtggcgacggtcgagaaggccggctatacggccgcgctccccgagccgcccaagaagcagccgcgtgagggcgggcgggagaccgaggaggcgcggcaggagcgcgaccggctgctgggcaccgcgttgctcgcggtgcccgtgctcgtgctgtcgatggtgcccgtgctgcagttccgcaactggcagtggctgtgtttcatgctggccgcgccggtcgcggtatggggtgcctggcccttccacgcgcgggcggtacgggggctgcggcactcggcggcgaccatggacacgctggtgtcgctgggcgtggtggcgtccttcgcgtggtcggcgtacgcgctcttcctcgggggtgccggtgatcccgggatgcggatgccgttcagcctcgttccctccgcatcggacggcgtcgcgcacatctacctcgaagcggccgtcggcgtaccgctgttcgtactggcggggcggttcctggaggcgcgggcccggcggggcaccggggcggcgctacgatcgctggccgaactcgccgccaaggaggtgtcggtacgggacggtgattccgaacggctcgttcccattgcggagttggagggcggtcaggtcttcgtcgtgcggcctggcgaacgggtcgccaccgacggacaggtggtggagggcagttcggccgtggatctggccctggtcaccggggagagcgagccggtcgaggtcgggccgggctcggccgtggtcggcggggccgtcaacgccggcgggctgctgctcgtacgggccacggccgtcggtgccgacacgcagctcgcccggatcacccgtctggtcaccgaggcgcaggccggcaaggcgcgtgcccagcggctggccgactcggtggccggtgtcttcgtgccggtcgtgctggcactggccgtcaccgcgctcggattctggctgggcgccggggccgatccacaggcggcgatcaccgcgtgtgtggcggtcctggtggtggcctgcccgtgcgcgctgggccttgcgacgccgaccgcgctgatggccgcgaccggccggggtgcccagctcggtgtcctcgtcaccggcccgcaggcgctggaggggcttcagcacatcgacgccgtcgtgctcgacaagacgggcacgctcaccaccgggcacatgagcgtcgcccgggtcaccgtcgtaccggacgggctcggccgcgacgcggtactgcggctggcgggcggtgtcgaacaaggctcggaacaccccctcggccgggccgtctccgcctacgcccggcgggagctgcgcgagcagcggctgccggacgtgggcgagttcagtgcaatgccggggcggggagtgcgcggccgggtcgaggggcggctggtggaagtcctcgccccggacgacgagttgcccgcagccctcgcggatgccctgccggtggcggaggccgccgcgcacacgcccgtactggtccgtgtggacggggtggccgaggcgctgatcgaggtcggggatgtcgtacgccccggaagctaccgggccgtcgaccggctgcggcggctcggcgtgcggcccgtgctcgccaccggtgaccgcgaggcgcccgcccgggccgttgccgcgaccctgggcatcgacgaggtgcacgctcgctgcacgcccgagggcaaggccgaactcgtacgggagttgcaggagcagggctaccgagtcgcggtgatcggcgacggcgtgaacgacgccgccgcgctggccggcgccgacctcgggatcgccatgggcaccggcaccgacgtggccatcggggccgccgacgtgaccctcgtacgcggcgacatcgaggccctcgcggacgccgtccggctggcccggcgcaccctgggcaccatccgtgccaacctcgtctgggccttcggctacaacgtcgtgaccgtgccgctcgccctggtcggcctgctcaaccccatgctcgcggcggcggccatgtccgccagctcggtgctggtggtcggcaacagcctgcggttgcgcggctggcagccctcgcccgcccggaggcgtacccga

SEQ ID NO: 610 - DNA, 309 bp, Streptomyces avermitilis
  CDS (1)..(309)
gtggctggtccgactactgaactggtacggcgcgatccgaccgacgccgtccgacgtgacctggagacgcggttgatggaagagtcccggcaatcctccttgaccggcgcgggtacggccctgcggagggcggcgcccccgcccgcgctctgcggcttccttctgctgctggccctgatcttcacggtgtcctacgcggtgggtgccggcgccggtcctgtcgcacccggtatgcacggcggcggcacgaaccgcgacggcggcggcggaggtatggacgacatgggcaacatgcaggggggacacggc

SEQ ID NO: 611 - DNA, 297 bp, Streptomyces avermitilis
  CDS (1)..(297)
atgccgtcaagtcagctgcatgtgtgccgtgtagcgtggcccgcctgttcgaacgggcggggtgggacgttggtcgacgtggtgcgtgtcatggaggcgctggccgagcagggcgtcacggtgctgttcaaggcggacgcggaacgcatgcgtgacggagtgagaccgtggaccttcgtcgcgaacggtctccccttccacgaagacctgctcgtgcgtactgatgccgcctcggtggaagcctgcttgaagatctgcctgccgcagctgcgtgcccgcggtctggtcatccctgag

SEQ ID NO: 612 - DNA, 831 bp, Streptomyces avermitilis
  CDS (1)..(831)
atgcccaaggccaccggcacgctcgccgttcccggcgccgtcctgcactaccagatccgcggcaccggcccgctgctgctcatctcgcagagcggagagggcgacgccgaccgcaccaccgacctcgtcgcccacctcaccgattcctacaccgtggtcagctacgaccgccgcgggctgtcccgcagccggctcgacgcccccgagcgaggcgcgacactggccgagcacgccgacgacgtccaccgcctgctggcctctctcaccgacacccccgccctcatgctcggctgcagcctcggagccgtcatcggcatgcacgcgatcgtgcggcaccccgaacagatccgcaccctcatcgcccacgagcccgtcgccccacgcctgctgcccgacgacgaacgcgcccgccatgagcacgaactcgtcgcccttcaggacctctacctccgagagggcctggccgccgcgctcccggagatcgccaggaccctgggcatcgaccccgccgccacggacaccgaacccgatctgacaccccagccgatgaacgccctgcgcaccgccaacttcgactacttcatccgccacgacttcaccgcggtcatccacgacaccctcgacatcgccgcactgaagggcgtcagcacacacatcgtgcccgccgccgggcgcaccaccccgcggaccgtcttcgactaccgggccgcgacagccctggccacactcctcgaccgcgaactgcaggagctgcccggcggacacaacggaaacaccagccatccccggacctgggcaacccgcatccgggagatcctcaacgccgcggga

SEQ ID NO: 613 - DNA, 513 bp, Streptomyces avermitilis
  CDS (1)..(513)
atgaatctagttcgatgtatgttgggtggtgtgaacggagtcgagctgttcctgctgggacgcgtcctgatgaagatcggcgaggaagccctgccggagcctccgggcggcgccggccgctatgccggcagcgcccggctggtgttgatcgtggctagcgatatcgccgctcatcccgacaccgctgtcggcgagatcgccgcccgcaccggtctgccgcagagccaggtgtccgcggccgtcgcccggctcaaggaagcccggtcggtgcagacggcgccggatcccgccgaccggcgccgtgtgctggtgcgtcaggctgccgaggtgtccgagcgagtggcgcaggtccgcgcggtcggcatcgaggatgctctcgccagggcactgggatctgatgccccgcaccggctgagggaggtctcggaagcgttggatgtgctcgcccggaacctcctgccgcagtcgggggccccggagtccccccaggcagacatcgttccgccgtcgcgg

SEQ ID NO: 614 - DNA, 456 bp, Streptomyces avermitilis
  CDS (1)..(456)
atggccgaacacatcgcgggactctgcaccacccgccacaccccttacgcccctcgcgctctcttgcgccgcccactcggctgcccaaagcctgaaaaggatctgggagggaggcccatgaccgagaacgagaacgaacgtgccaccgaactcggcgacgccatcgaggcagtacgccaggggttgctgaaggcagccgcacaaggcagcgacgacctacgcttcctggtcaaggaaacagagctcgaattcatcgtcgaactgcggaagacggggtcgaccggcgcgggtgtgaaggcctgggtcctctccggtgacggacgcctcgagcggtctgccggccaaaccaaccggctcaccgtccggctggggatcctggccccggaatcacacccgatcgacgagacccacttcggcgacaagaaggacaagggccacccgggaccgcggcagatg

SEQ ID NO: 615 - DNA, 294 bp, Streptomyces avermitilis
  CDS (1)..(294)
atgctggagacgatggggatgaccgcgttcgccgagcgtgccggccgcgaactgcgggccgccggcggaaccgcccacaagcgcaccgccccggcccggcatgaggaactgaccgctcaggaaagccagatcgcgcggatggcccgcgacggcctgtcgaacccggagatcggcacccgcctgttcatcagcgcacgcaccgtccagtaccacttgcgcaaggtcttcaccaagctcggcatcacctcacgcagccagctcgaccgggtcctgccaagcggccctggcggcgca

SEQ ID NO: 616 - DNA, 564 bp, Streptomyces avermitilis
  CDS (1)..(564)
gtgcctgcttcccctgccgcttccgctcaggccatcgcgctcctgcgcgaactcggcgccacagagatcgcccatccgggcggcactctcctcgcgcacctccagcgcgtccaagagcaactcgccgtatgggaggcacgcaccgccctccagcttgcgggcctgtgccatgcgttctacggcaccgacggcttccccgccgcattgctgtccctggaccgccgcgacgaactcgcagcggcgatcggcgtcgaggccgaaggcatcgtgtacctctacgcctcgtgcgaccggaaggccacctatccgacgctcgcggatgccgacgcctccttccgcgaccggttcaccggccgtgcccgtattccggagccgcagctgcgccgggacttcgctgagctgtctgccgccaacgaactcgacctcgcccgcatcgatccggccttccgtgagaagtggggatccgaactcctcgccctgtgcactcgattccgccccctgctgagccaaccagcctggtcggcctgccacgtggtgcttgctccggatccccctgcgcaggac

SEQ ID NO: 617 - DNA, 909 bp, Streptomyces avermitilis
  CDS (1)..(909)
atgactttggaggacctgcgcgtcttcgtggccgtgtgcaaagcgggaagcctcagcgccgccgcccgggacctggactgcacacagtcagcggtgagccagcatgtgaagcggttggagcgagagaccggcgtgagcctcgtggagcgccagccacgaggcgtcctgcccacacacgcggggcgcgtcttgtgcgatgccgcctcggacagcatcgccggtctggatctggccctgcgtcgtctcggggaccttgtcaacggggacagcggctccgtgcgcgtcaccacgggcggaacaaccgtgcggcacttcatgtccgaggccatcgtcgccttccgtcagcgctacccgaaggtcagtctggagttccagacagagacctccagccgcaactgcttcgacgccctcaccgccggcaacctggacctcgcctgggtcacgatcgccggcccggtgcgcggtatcgagcaacgccccgtcgtcgccctgccctgggtactcgctgtccgcgccgacgatccgctcgcgggccggccctgtgtcaacacagccgaactcaccgacatcagcctcatccggctcccccacaactccacctcaggtgcccgcctcgacgccgcgttcgccgagctcggggtccggagcagctccgacaccagcgtcgccgactgggacaccgccctcctgctggcagagctcggcctcggtcacgccgtcgtgcctgtcctgcccggctggcaggtacccggtgacggccccctacggctcgtccccatccccgacctgcccccgctcccggtcggctgggccgtccgccgttgggacgctctcaccccactggcccgggtcttcgccgacactgtcgcccgcagctgcaaggagaagaccgccaacactcggcccaag

SEQ ID NO: 618 - DNA, 804 bp, Streptomyces avermitilis
  CDS (1)..(804)
atgtcggtggcgggcatgccggggctagcgttgcgccccatggatgacaaggatcttccgccgcgccttacccatctcacctttcacggtcccctttccgaagcccgagccgcacggatcatcggcagacttgcccgagcggcaccctcgactgtcctcgacatcggttgtggctggggggagctgatgctccgcaccctcgagacggtggagggggcgaccggtctcggtatcgacctcaatggccaggacatcgcccggggacgcgagaacgccaaggcccgtgcactggctgaccgcgtgaagttcgtcgaagaatctgcagccggaacggcacgtgggcctgctgacctcgtcctgtgcttgggagccagccacacgctcagcgacgcacagccacctcagcacaccaccgccgcactgcacgcgctgcgacggctggtccagcccgggggacgcgtcctcctcggtgagaatttctggcagcgcacccccacctcggccgaactcgacgcgatgtggccgggcgcccgcgccgaagagttccacgacctggccggactcgtcgacctcgctgtcgcctccgggttccgccctgcctggatcgagacggcgagcagcgacgaatgggacgagttcgagtccggctaccagtccgacgtggaggagtggctggccgcccacagcgaccacccgctggctgctgagacgcgggagcgcgtggaccggcaccgggcgagctggctgaaaggctaccgaggagtactcgggctggcctatctcacgttggtccccgttgaccac

SEQ ID NO: 619 - DNA, 1473 bp, Streptomyces avermitilis
  CDS (1)..(1473)
atgcactcaaaggcaagaagaacacgcatgctcggggccggcctgctcgcgaccgtgatgtccctggctctcctgatcccggcatccggaagcgccgaagccgcgaccacagcagtccaggcgaccgtctgcaacaagtactgcgacggccgtgacccgtcgctgtccccgcaggaccgccggccggtgaccaccagcatctactcccgcaccatcgccctgcacttcgacgacaccgacgccatgggctgggcctcgatcaccaacggcagccccaccgacgaggtctggctcgaccgctccttcgacggcggccgcacctggacctccggcagcaggctcggcgacaccacgatcccctcgggccagaccggctggcgcaccctgatgtacaacgtcgacgattggaacaacctcggcgtcggcgccctccgcgcctgcggcaaggccggtaatcgcaccgagatcgcctgcacggcctgggcccgtacgacctggaacgccggcagccgcccgaccgcggcggccaccgcgctgatgcagtcgtacaacctcagctccggcctgttcgacagcaccggctggtggaactcggccaacgcgctgaccgccctcatcaacaacattcaggtcactggcatgagcagctacaagtacgccatcgccaagacctacgacctcaacctgcacgcccagggcggcaacttcaccaacgactacatcgacgacaccgggtggtgggggctggcctgggtcgccgcgtacgacctgaccggtgacagcaggtacctgaacaccgcccgcgccgacgcggaccacatgcatcggtactgggactcgacatgtggcggcggcgtctggtggagcaccgccaagacctacaagaacgccatcgccaactccctctacctggagctgaacgccgcgctccacaaccgcgtccccagcgacacgacctacctcgcccgtgcgaacgcggagtggtcgtggttccagggcaccgccatgatcaacagctcccatctggtcaacgacggcatcaacgtcacgacctgcaccaacaacggcgacacagcctggtcgtacaaccaaggcgtcctcctcggcggcctcgcggagctctatcgcgccaccgggaactccgccctgctcaccaagggccgccagatcggcgacgcctcgaccacctccaccgcactgaactccggcggaatcctgcgcgaaccatgcgagacaggcggctgtggcgccgacggaccctccttcaagggtgcctacatccgaggcctcaacgccttcaacgcccagctctccgaccgcccctacacctcctacatccaccgccaggccgactccgcatacgccaacgaccgcacgcccctcgacgcctacggcctccactgggccggccccctcgacacgtccgacgccgcccgccagcagtccgccgtcgacttgatgaacgctgcctcc

SEQ ID NO: 620 - DNA, 1608 bp, Streptomyces avermitilis
  CDS (1)..(1608)
atgaccgtcccgccatccttcctgagacccctgagcgccgccttcgcgatgctgcttctgctggtcctcgctccggccctgctggtgctccgcgcggcaccgcccgcgcaggccctcgacaacggtctggccaggacgcccccgatgggctggaacgactggaacgccttcggctgcaacgtcaccgagcagttggtcaagcagaccgccgactacctcgtctcctccggtctgaagggcgccgggtaccagtacgtcaacatcgacgactgctggatgacctcggcccgcaactccgtgggccaactggtgcccgacccggtcaagttccccgacggcatcagcggaaccgccgcctacgtccacagcaagggcctcaagctcggcatctacgagagcgccggcaccgccacctgtcagggctaccccggaagcctcggccacgagcagacggacgccgacagcttcgcctcctggggcgtggactacctcaagtacgacaactgcaaccaccagaacgtgcccgaccagcagcgctacaccgccatgcgcgacgccctggtcaacaccggccgcccgatcgtctacagcctgtgcaactggggtctggccagtgtgtggacctggggagcgggggtcgggaacagctggcgcaccaccgacgacatcaacgtcaacttctcgacggtggtgtcgatctacaaggccaacgtcaagctcgctccgtacgccaagccgggcgcctggaacgaccccgacatgctcgaggtcggcaacggcatgtcgttcaccgaggaccgttcccacttcagcctctggtcggagatggccgcgcccctgatcgccggaaccgacctgcgcaaggcctccgccgccaccctcttcctctacggcaacaaggacgtcatcgccgtggaccaggactccctgggcaagcagggcaccgaggtgtcctcctccggcggcctccacgtgctgaccaaaccgctggcgaacggcgacgtgtcggtggtgctcttcaacgagaactcctccgccgccaccatcaccacctccgccaccgcggccggtctccccgcggcatcctcctaccggctcgacaacctctggtcacacgtcgtcagcagcaccggcggaagcatctcggccagtgtccccggccacggctccgtgatgtaccgggtctccgtcggcagtggcaccagcgccgggagcacccacccgctggtcggcgcctcctccaaccgctgcctggacgcgtacgacaaccagaccgcccccggcaccaagatcgagatctgggactgcggcggcgccaaccaggccgtgaccatcaccgccgccggtgaactccggctctacggcggcacccagtgcctggacgcctacgacaacgggaccacttccggcaccaaggtgcagctctacacctgcaacgggggagccaaccagaagtggagcctcaaccccaacggcaccgtcaccggcacccagtcaggcctctgcctcgacgtcacgggcggcgaccaggcctccggcaacgtcaacggcaccgcgctcgaactctggacctgcaacggcggcgccaaccagcagtggcgcctgggc

SEQ ID NO: 621 - DNA, 393 bp, Streptomyces avermitilis
  CDS (1)..(393)
ttgacgaccttgccgaccacatcggcagccgcggcggagcgcttgggcccggcccgggcgttgacgcgcgccgtcgccgcgtactccgcgctctggagacccttcggaacgaacgacggttccgggctggtccgcgagcaggttccggtggccgccgacgacaagccgtactcgtacgaatggccctactcgcaggtgcacatcgccgcgctcgacctcacggccgtggacgcggcgtacgagtcggagccagccgaacggacaaaggcgcaggagcacttctggcacgtcggcaaaggcacgaccgggtgtcccggatacgcctcctaccctgtcgtcgcgtgcggcgagggcggcgagggcggcgcagcgccacggcggcgaccagcccca

SEQ ID NO: 622 - DNA, 1053 bp, Streptomyces avermitilis
  CDS (1)..(1053)
atggaaggttggtcttcaactcacgtgagcagtcgtcccccgcaccgccagaacaccaggcccacgatgcgcgatgtcgcggagcgggccggagtcgccctcgtcaccgtctcccgcgttgtcaacggcgtcggaacggtccgtgaggagacggccgagcgtgtgatggcggcgatcaacgccatcgggtaccagcgaaacgagctcgctcgctcactgcgtcccgggcagaactccatgaccatcgggctgctgctcggcgatctgaccaacccgttctacgcgtccctggccaaggccgccgtcgaagtggccaaccgggccggctacgcggtcctcctcagtacggccgacgaggacccggaggtcgaacgccgcgcggtgggcgagctcatcggacggcgcgtcgccgggctcatcatcgtccccgaccagggcgaccacgccttcctcaacgagatcaacggccatgaccacgtgcctatcgtcttcgtcgaccggccggccaccggcgccgaggccgatgtcgtcctcgtcgacaacgaggacggcggacgcaaggccacccagcacctcatcgaccagggccaccgccggatcgcgatcctcggcgccccctcctactacagcaccggccgacggctgcgcggttaccgcaaggcgctgcgccgcagcggcatcactcccgacagcaacttggttgtcaccctgcgccgtggcaccaccgaggaggcctcggccgccacccacaccctgctcacctccgcggatccccccaccgcggttttctccacgacgggcttcctcaccgagggtgtcctgcgcgcctgccggcagctccagacctccgtcgcgatcgtcggcttcgacgacttcaaactggccgacatgctccccaccccggtcaccgtggtcacctccgacaccgaggagctcggccgccatgccgcccgccttctgctggaccgcatcgacggcgacgacgctccctcccgccgcacggtcctgccggtccagttgatcgcgcgcggcacgggcgagatcgggacccag

SEQ ID NO: 623 - DNA, 513 bp, Streptomyces avermitilis
  CDS (1)..(513)
gtgcggtcggtgaccttgaaggacctgcgcgacgggacgcatcgcaccctcgccgcgcgttacgtcctggacgccaccgagacgggcgaactcctccacctcgcgggcgtcgagcacgcgaacggggccgagtcgcgcgccacggcgtgcccgctcgccgacctggcactcggccgcatcgtcttcccgaccgcaccgttgccgcccggtatgacggacccgagggccgcggtcgacggcgacgccggcaccgcatggtcccccggtcctgacggtcgcatggtcgtcgacctggacgccgaacagcacatcaccgagatccggacccagtggcgaggaggccatgccccggcatcccaagtcgagttcagccgggacggccgtacgtacggtggcgctgcgcagctgtcggcgcgtggcgtcctgcgcaccgacagcaccccccgcgacgtggcactacgggtcatcacttcgtccgcgggacccacctcactcatcgccctcactattgcg

SEQ ID NO: 624 - DNA, 369 bp, Streptomyces avermitilis
  CDS (1)..(369)
gtgcgatgcgtcccgtcgcgcaggtccttcaaggtcaccgaccgcacgacatcgttgtcggactccgcggagcaaggtcctcaaatacctcgactccaccgtgtggaccaaggtgctgcccgactccccgctgcggccccggcctacctcccggcgcaggacgcctacttcggtgccctcgacagggccggcctgacgaccgtcgcgtccaccgtcaagacgggactgaacacgtcgtccagcatcggcgtgcgcttcaccacccagtgggccagccagtcgaacgacctgatcaccgcctactggccggatatcctcgacggcacaaagccgctctccgacctccagaccatgaccgacaagagcaac

SEQ ID NO: 625 - DNA, 462 bp, Streptomyces avermitilis
  CDS (1)..(462)
gtggaagccatcatcgccagcgccgtagccgttctgggcaccctgctcggctcagggatcacccttgcatttcagcgcagcacagccgagagaagccacgagttcacccgccgcgagaagctccgacaggaacgcctcgatgcctactcggcctacgccggcgccctggtcaactaccggcgctgtctggtccacctgtggttctgcatccatgagcagccgccccccggggacgcagacgaagttcgaatacgcgcctacgacctccgatcaaacacccaagaggccctgttccgcgtgcagatgctcacggatgacgaggctctgagccagtccgcagaagctgtactcactgacgtgacgggcctctacaagacggacagtcgaagcgagctcgacgagcgcagagcgcaaacccgagatgacatcagccacttggtacgcgcggccaagcaacatctc

SEQ ID NO: 626 - DNA, 1062 bp, Streptomyces avermitilis
  CDS (1)..(1062)
atggcagacgagacagcggtgatcggcggcgtcgacacccacaccgacttcaaccaggccgccgtgatcgatcccatcggcaggcaccttgccacccaggcctttcccaccacccccgacggctatcaccggctgctgggctggctctgctcccacggagaggtgatcgccgtcggcgtcgagggaaccggggcctacggcagcgaactcgcccggtacctgcaggacagccagatcaccgtcatcgaggtggaccgccccgaccgccgggcccgcagggcaggcggcaagtccgaccccattgacgcctacgccgccgcaaccgccgtcctcaccggccgagccggcgggatccccaaagcccgcgacggcatcgtggaggccatacgcaccctgcgcgtggtccgtcgctcagccgtcaaggcccgcacccagatcatcaaccagatccgcagcctcatcatcaccgcgcccggcgaggtccgcgaacagttgcgcaccctgccccctgcccagctgatcaagcatctggcccgctcccgccccggcacgcagaccagcgaacccgcctgcgcggccaagatcgccctgcggcgcctcgcccgccgtcaccaatacctgaccgcggagatcaacgatgccgatgccgagctgcagacactgatgaccgaagcagcacctgagctggtcgcattacccggcgtggggatcgagaccgccgcccagcttctgatcaccgcaagcgacaaccccgaacggctcgcctcggaagcgtccttcgcccacctgtgcgcagcggcaccagtcccggccagttcgggccgcaccaacaggcaccgcctcaatcgcggtggcgaccgccgggccaaccacgcactccacatgatcgcgctggtccgcatgcgctacgaccaacgcacccaggcatacgtcgcccgccgcaccgccgaaggcatgtccaagaaggacatcctgcgctgcctcaaacgcttcatcgcccgtgaggtctacaagtacctcacctaccaacacaccccatcgaagccgctcatcccaaccgct

SEQ ID NO: 627 - DNA, 855 bp, Streptomyces avermitilis
  CDS (1)..(855)
atgacaggaggaccgaagatgaccgcctcgtacgaaaccatcaaggccaggctggatggcaccgtcctgtctgccacgttcaacgcgccgccgatgaacctcatcggtcccgaggtcgtgcgggacctggtcgcactgctcgaggaactggcccacccgaccgccccacgcgtggtgatcttcgacagtgcggacgccgacttcttcttcccgcacgtcgacatgacgaaagtccccgagtacaccgctgaggccgcgaaggcgggaggccccggcgatgcctccctgggaatgctgttccgcaagctgagccagctcccggctgtcaccatcgcaaagctgcgcggccgtgcccggggagcgggcagtgagtttctccttgcctgcgacatgcgcttcgcttcccgggagaacgccatcctgggccagccggaagtgggaatcggagcaccccccggcgcgggcgcgatccagcacctcacccgtctgctgggccggggccgtgcactcgaagccgtgctgacgtcgtcggacttcgacgccgacctcgccgaacgctatggatgggtcaatcgtgcggtccctgacgccgaactggacgagttcgtagcaggcatcgccgcgcgcatgagcggtttcccccgcgatgcgctgatcgcagccaagtcggcgatcaacgccatcagcctgccggctcctgccgaagtacgcgcggacgccgcgctgttccaacaactcgtccgaggcgagaaagtacagcagcgcacggctgagctgttcaagcagggcttccagacccgtggtgccaccgaactcgacctcggagatgccctgggccacttgaaggccgtcgac

SEQ ID NO: 628 - DNA, 606 bp, Streptomyces avermitilis
  CDS (1)..(606)
atgcaggtagccgtggtcacctttgatggattcaacgagctcgacagcttcatcgcctccgcgctgatcaaccggtgtcgaaaggacggcttggaggccttcatcacgacaccgacgccggtggtcacgtccatgaacggcgtcgacgtgaccgggcagcgcccgatggagttcgtgaccgaagccgacgtcgtactgatcggcagcggggtgaaggcgcgagaggtggtcgccgacgaccggctgatctccaggctgccgctcgacccttcgcgacagctgatcggtgcgcagtgctccggcgcgctggtgctcgcccggctcgggttgctggatggcatgccggcttgcacggacatgaagagccgaccctttgtggaggcccgcgacgtcaccgtgctggacgcgccgttccacgccgaggggaacatcgctacggcgggcggttgcctggcgtcccagtatctcgccacgtgggtgatcacccgaatgctcggggaggatgccgcgcgcgacgtcatcggctacgtggctccggtgggcgaaaaccaggagactgtcgagcgcgccatgcgcgccgtccacgcgggcgaggttgtactgcgc

SEQ ID NO: 629 - DNA, 438 bp, Streptomyces avermitilis
  CDS (1)..(438)
gtgacggcgaccttcggccctggtggtcatgtgttcttgagctggcccctgcggtccggcctctttcgcggcgggactggatctgcgtccacgaggtggcaccgcttgtacgctcagtgggattcagcactcctcgtggaacggaccggccctatggacgtcgtcttctccagccatgtgatcgaatggcgcgggccttccccgttctacttcgtccctgtaccggaggagcagtctgccgacatacgggaggtagcgtcgatggccacgtacgggtggggcgttgttcctgttgaggcccggatcggtgagatcgcctttgcgacgtcactcttcccgaaggacggcgagtacctgctcccgatcaaacaggccgtgcgcaaaccacagggtctttcgacaggggacgaggtcaccgtagaaatgaccgttcgcctc

SEQ ID NO: 630 - DNA, 951 bp, Streptomyces avermitilis
  CDS (1)..(951)
gtgcaggaagtgacgcgccatgaggtcagcggacagcacatagcccacgcgctcgacgacatcagccggcggacccggcggcggtggcatgggatgcgctatgacgacccgtccctggagaagttgcaggagatgcgtgatgagctcctcgaccacatcgccgcccgtaccgtggaggaccccgcgctcgacgagtcatctcgagcggcactgcggaccgcggcggagtgctccctgggggttctgagcgttggctgcttccccgacggcgaccaggagatcgtcttcccgctcatcggcgagaggctcggcagcgaggacatcgccttcggtgacgtcgtagagcaggcccccacggccggaacgtgggttgacacgtttgcaatatgtctggtcagtggcctggtgtgggactggcagcgggtgatcggtctgctgctgcgggaggactacgcgcccgcgatccgcgacggggtgccgtactcgaagctgaactcggcgtcggatccggcggacctggctgcgatggacgcactgtgcggctacctgacccaggcgcaggggcacctgccccgcgactggcccaccgtgcccctgtgcaagccggacaccgacgagcgcgcagaggcggcccggaaactggacgcagccggccccctgacatcggaccagcgcctccttcgtgtactcctcgaagatgaccagcacgcctttgagcagactctcgtggcccatctcagcgagcaccgggagagcgtgggatccgatcccgcccccaggactctgctgccggtcggcgcccttgctctgaccgctctggcggtccaagtgcacggctgggagctggacgttcggtccggctatctgccgcacggcatgcttggttccccggacaccctgcgccgagcggcggacgccggcgggaacgacctgggccactggaccgccaag

SEQ ID NO: 631 - DNA, 534 bp, Streptomyces avermitilis
  CDS (1)..(534)
ttgctgttcaccaacctggacggcgtccgcaacgtcgtgccggtcggtcatcgacagcggcgagcacgaccagtgggcgctggtgatgtccgtgccgagaagtccctgcgctaccacctccaggagcacggccggctgcccctcaacgaggcggtcgccgtcctgtccgacgtcgccgaagcactcgccgacctcaaggaccgcgagatcgtccaccgcgacctcaagccggagaacatcctgctgctcggtggccgccggtgcctcgccgacttcgggatcgcccgctacgccgaagccaccatcgcgaagcacaccctcaaactcgcgggcaccctcgcgtacatggcccccgaacgctggaataaccagcgggccgccagcgccagcgacatctacgccccgggagttgtggcgtacgagctcctggaggaaaccccgcccttcacaggaccgtacgagcacgactaccacgaccagcacctgcacgggcccgtccgcccctcaccacagctccgcccgtcctggcggcgc

SEQ ID NO: 632 - DNA, 522 bp, Streptomyces avermitilis
  CDS (1)..(522)
ttggtcatggcgaagccctccggtgtggtggaggtgctgagccttcaccgcaccgagatcttcgtggaccactgcaatgcccggctgatcgttcacggcgggcggctgctgttcgaagcgtgcccccggcgccgggggcacgactctcaaggggagggaacccacatgcgtatccgacgcgcactcgccaccactgcggcgactgccgcgctcgccggcggcctcgccgccgcacccgccagcgccgacaacagcggtgagatcaatgccgcggcagtctgcgacctggtgcccaactataaccagtgggactcggtcgtcgttcgccacgcgaccgcccccttccgcgacggaccctacgccgagtgcgatgggaccaccaggagcgcctcgtcctacctcgacgcatactgccgatacaagaacagccacggcaacgtctggtacttcacctactacggctgggtgtacggcacgcacgtcacccgccccaacggtgaacccgtctggtgcgacatgtcc

SEQ ID NO: 633 - DNA, 306 bp, Streptomyces avermitilis
  CDS (1)..(306)
gtggtgggtgcgccagcagcaccagccccgcgaccatggccgaccagctgcgggtgctcgttcgagcacatggtggacgcgttcggctatgggcccgaggtcttcgaggagttccgggtcgccgcggtcgagtccgcgttcctgccgctgccgaagcgccgtcgcctgattgaccaggtgatccgcctggggtacggggcgcttcgggccgacgggcgcggacgggccgcgcggcggaccacgcgcggtcgcgtcggggccggcagccggcggctgaaccccgcggttcagccgccggtctgcgta

SEQ ID NO: 634 - DNA, 3231 bp, Streptomyces avermitilis
  CDS (1)..(3231)
atgagggggccgagggggcagtggtttgcgcgccgtttcgggcgtgtccctcatacggtcgtcaaccgcatggacggcggttacgtcgagaacctcatccaggccggcgcgatccacggcggcgtgcacttccatgtccatcgcccggagagcccccagatccatgggctgctgcggcccgtggcggtgctgttcctggccctcgccgctgtcgcgctgatcgtgtcggacctcggccgacgccgccccggccccgcttggacggtcgctgcctgtctgctggtcgtggccgcgtatctcggcgtcgcccacgtgcgggcacgccggggccggcgtggcgtgttctccgagcgtcaactagacatcgccgcaacgcagctggccgggaggctgcgcacgatgtacgaccgggaggaacggctttcccgggtgcacgatcccatcccgctgcgggtccgctggagcgagggcgatcccgaactcgtcgaccactgggagaacatcagccgggacagtggccagatacccgacatcgagggggagttcgccgagatcaacgaggtgtacaagcgtattccctcgcgtcggctcgtcgttctcggcccgccgggcgggggcaagtccgcgctggcactgcgcttcgctcggcaggcgctcaagggtagtcccgtgcccgtgatcttcccgctcgcctcctgggacccgcggcagcaggggttgtggcagtgggccgcggcgctcgtctccgaccgccatccgagccttgccgcccgcggcgcccagcgacgggcgatcgcacaggcgctcctggagaccgggcggatcctgcccgtgctcgacggcttcgacgagatcccgacggtcacacaggccacggcactggccgagttcaatgcgagtctcggccgcgacgcatgcttcgtgctcaccagccggagcacggcctttgagcaggccgtggcacagagcgatgtcctcacggcaacggccgtggtcgagctggaacggctcaccgtggatcagctcgccgagtatctgccccgcaccagccgcaaggtcaagtcgggggaggggaccttgacaacgtgggacccggtgctcgcgcggctgggcgaggaggacgggcaggcgaggcacgtgcgccgagcactgtcgaccccgctcatggtcggcctggcccgtgcggcgtacagcgacacacgggccgatccgatggagctgctcgacccgcggcagttcccggacagttcggccatcgaggcccatctcttcgaccggttcatcccctccgtttacggcggcgcgctggccgaccgcacctgggaggcggagcaggcagggatctggctgcgtttcctcgcccgccatgtgagggccggggggacgcaggagctggagtggtggcggctggacacgacgacaccccggtgggtcggctggttggctttcgtgccgttgatcgcggccatcacgggcgtcacctactggtccggcctaggggaggctcatgcgaccttttggccgggaggtccgatctggctcaccgaggcgctgctgtttctcgccctgctgaccacggtgtggttcgccaccgacccgtcggccttcccgggccccaagcatgtgcgcggctcccgggccctgccgttcctgcgcagtgaaccgtcggacacggagtccgtgagcagcccctgggaactgctgcgacgggacaggaccgcggcatgggtcaagggcgccttctgggtacttcccttcaaggaaaggggcggccccttggacctcttctccttggctctgttcctcatcctgccgatcacgtggctctggcagtccaacatcgacatcctggagcctgagcagaatgttgggcgcgtgacgctcctgctgaataccttcgcctggctgctgtacgaagtcggagggtcggcctggggacggttcaacgtggcccggatctggcttgcggcgacgggccggctgccttggcgactcggggcctttctccaggatgcacacgggcgtggcgtactgcggcagagcggcggacggtaccgcttccggcatctggaactactcaacagacttgccgggaaggacttttcacagcggaagaagcactcgcttcgtataagacggcttgcttttgtcgtgcatatggttatttgggtaggactggtcgcgtggctgctcgcagcggctgagaacgcaattggcccttccgggccgtactcctccgtggctccggcgtgctcactcctgaggggagaacagctggaaccggcgatcaccgatccttgggcgcgggcggacggctccggccgttgccactggaccgaacaggcgccgttcaaccgcgacggtgaagtgacactgtccgtcaccgtcgcgcgtcccggcaatggggtgagcgccgtgatggtggccgaccggcagctgaacgtcgtcagcacccttgaactggccggagtgggcgaccgggccgtgatcagcccgcgagagaacgagccggggagcgccgggtggtcggcgagggtgggcgcccgaaccgggaatgtgtttgtcgatctcacgtacaccgaggtggcgagggacggccagcgcgtcaaggccgtggcggccatcttggtcaggcaggttctggccaacgccggtctgggagaatcccccggcaccgccctcgtggccgtcccccgtcccccgctgcccggcgacgcgccgtacacccgctaccgcaggggtgtcgcacgatccatcgacggtcccgtctggcgaccgggtgaccggtcccagctcaacggcatccaatctctcccctttgtgttccggggaccacggatgagctgcgccatgcaatggatatgcgggatcggcatcctcggacatccccgtcccgtgtacggcatcatcgtctttgacctgcgggagtgcacgggtgggccctgcagccgcaggacgatcgacggctatgtgcgggacccgaagaacaagcatgcggccggggcgccctggaagtgggccgatgcgtcgacgaaaatcgccgacttctcgtgcagccggaagccgtccaaggaatggcccgaccagaacgacctccactgcgtcgagatggtccgggctttccgcatcggcggcaaggactacctcctcgggctgcgtacggccgttgccaagcagcacgccgacctgatgcgcaagacggtgaacgacatctatacgcagaccggcggc

SEQ ID NO: 635 - DNA, 225 bp, Streptomyces avermitilis
  CDS (1)..(225)
gtgtccagcgccctgctgcaccaggccgtcctacaggcccgcggacccgccgacacccgtgttcaggatgcccccgaagcagccgcagccatcgtcaacctgtgcgggcctgcccctggccttgcgtatcgccgccaccctgttcgccgctccggcctgtcgacagagagcgacgctgttcttgccgacctggatgacttcaccgtcgaggagaacctccagggc

SEQ ID NO: 636 - DNA, 408 bp, Streptomyces avermitilis
  CDS (1)..(408)
atgcttcgacaccgtgtcgtggtgcggcacctgacccgcgccaccgtgacctcgtgctgcgccgctgctctcgccctcacacagacggtgcaggcccacgcggcgagccgcacggtcaacttcaactaccaacacatctggaagacacccgagttcgaaacgggtatccgcggccgcatccacttcaccgtcaagaagtgcgaccaccccaacggggacatgaccgtgctgctgaggcgcactgatggcttcaactacgtcgtgggcagccggaacatcaagtgccgcgctggccacacggccaactgggacgacgatccggcggggacctacgagttcgagctcggcaagctcgacgactacaagttcttcaagggcaccgccacctactcgttcaacgccgccagg

SEQ ID NO: 637 - DNA, 177 bp, Streptomyces avermitilis
  CDS (1)..(177)
gtgtactgcgacgcgaagttcggcatctcctgtgcccaggagtaccggctgctcgacgtcgcccgcgtcctgggcgccatccaggccgccgtcgccgcctccgatccgtcggcggaccccgcgcttgccgcgctgcggcacgtcgtcgacgaccttgccgtcaagggcctggccggc

SEQ ID NO: 638 - DNA, 702 bp, Streptomyces avermitilis
  CDS (1)..(702)
atggaagccacccgacgcttcaccgccgacgccggccacgagctacgtacccccctcaccagcctcggcatgaccatcgagaccctccagcgcaaccccaccctccccgcaccacagcgcacccgcgcactggaggccatgggcgcggagcaccaccgcatcactgccctcctcaccgggctgcagaccctcgcgcgcggcgacgcgcacgccctgcccgaccgtgtccccgtcgacctcggtgcactcctccacgaggctgtcagccacgcggcccgccgccaccccaccacctatcgcctcaacggcagcacccccgcgacgctgaccggctggcccgtaggactgcgcctggcggttgacaacctgctcgacaacgccgccctccacggccgccccgacggcaccgtcgacatccagctcacccacgaggccggcacggtccggatcaccgtcagcgacgacgggcccggcatccccccggaccaacgccacgcgatgaaggagcgcttcacccgcggcccgcgaacccgcgcgccgggctccggcctcggcctcgccctcgtcgaacagcaggcccatctccaccatggcaccctccacctcggccaaagcccagccggaggactccaagccaccctcagccttcccgcagccgacgagcctgggccccctggcgagcctatggctgacgcttcaagc

SEQ ID NO: 639 - DNA, 696 bp, Streptomyces avermitilis
  CDS (1)..(696)
gtggtcgcgctcgccggactggtcatcgtcgcccgcatcgaccaccgtgaccgtaccgacgtcgaccgccagctcaccgcacgcgccgaaaaggtccgccaggacgccgacaagctcctggggcagggggaccacgagggtgctgacgagggccgggacgactacggcggcctgctggccggcagccagagcctggtccgcctcatctccgacgggcaggtcatcgcccagcgcggcgagactccgcccaccccgcccccgctgcccagccgtgacggctacagcaccatcgaggccgacggacagacctggcgcaccctgacccagcccctcaacgccacaggggaccgcctcgaagtcctccaggacatcgaccacatcgaacgccgtgtcgccgacaacaccgccatcgtcgtcgccgtcaccctcgccgccgctctggccacggccgtcggcgtgtggctgatcaccaggatcatcctccagcctctccaacgcctgcggaccggcgcgctcgccatcagtgccgacaccacaggcccccaactccccaccgtgacaggcccccaggaagtcgctgacctctcccgcgccctgaacggcatgctcgccaactgcgcaccagcatggaagccacccgacgcttcaccgccgacgccggccacgagctacgtacccccctcaccagcctcggca

SEQ ID NO: 640 - DNA, 684 bp, Streptomyces avermitilis
  CDS (1)..(684)
gtgctcgtcgtcgacgacgacccgggcgtacgcgaggcactggacctggggctcgggctggagggcttcacggtccgcctcgccgaggatggcgagaacgcgctggagcaggtcgccgaccggctgccgtcggtgatcgtcctggacgtgacgatgccgggcctgtccggcgttgaggtcgtacagtccttgcgagcccagggccggacgctgccggtgtgcatgctctctgcccgcgacgaggtcgacgaccgggtcgccggactcgcggcccgcgcggacgactacgtcgtcaagccgttctccatcgccgagctggccgcccgcctgcacgcgatagtccgcctgcacgcgatagtccgcctgcacgagtcgaccgccgtacggcccctggtcatcggcgacgtcaccatcgagccggcccggcgggtggccgcccgcgcggggcgggacctgcacctgaccacccgcgagttcgacctgctgctcgccctcgcgcaccggcccggccaggtcctctcccgtgcccagcttctggaacaggtatggggctacacctgggacgtcgacaccaacgtggtggacgtcttcatcggctacctccgcaagaagctcgaggccgacggccgcccccggatcctgcagaccgtccgcgggatcggcctcgtcctgcgcaccggcccg

SEQ ID NO: 641 - DNA, 618 bp, Streptomyces avermitilis
  CDS (1)..(618)
gtgacacagccgaccagtcctgaacctcgccctgaccaggcgatctatctcatcaccggcatcccggccgcaggcaagtcgacggttgcgcagatgctggccgaacgactcccgcagtccgtgcacgtgcggggcgaccagttccggcgcatggtcatcaacggccgtgccgagatgacggcagatccatctgacgaagcactgcggcaactccgactgcgtcacagcctgacggcgaaggtcatcgaccagtacttcgaggccggcttcaccgtggtcgctcaagacgtcatcctgggtgaccacctcacccagatgatcgcgcagatccgcaaccgccccctgcacgtcatcgttctcgtgccgcagcccaaggccatagcggcacgagacgccgcgagacccaagaccgcctacaacgcatgggagatcgatccactggaccggattctccaacgagagacgccccgggtcggattgtggatcgacacctccgagcagtcacccgcggagactgcggacgagatcctcacccgagccacagcggagacgcagacccaggaattcaacgcgcgaaccgccaggcattcggacagttcccatacccgactccaccgt

SEQ ID NO: 642 - DNA, 903 bp, Streptomyces avermitilis
  CDS (1)..(903)
ttgagcgttgtcgggttcatgcgggcgccgcgcggcggcgcgctcttcatcacggaggtggcacagatgacgcagtgttccggggcggcccagcacccgatcccgcctgcggtccaggaagcgtacgggacggccgatctcagttcgatgcccttgttcggcggggggttcatcaatttcggctattggcaggacatcgacctcgaccagccgctgagcgaacatgaccggatctgcagccagcaggccctgtaccgtcacgttctcagtgctatggcgcccaccgagggactacgggcactggaggtcggctccgggctgggggttggcgccgcggtggcgctcgaggagtacggcttcgcgcacgtcaccggcatggatatccatccacagcagctcaggcgggctgaacaggccaactccgcactgctggctcgccgccccgaacggttgctcttcgcccacggcgcagccgagaacatgcccttcggcgacggcacgttcgactgcgtgtacagcgtcgaggccgcccagcacttccgcgacctcggggcattcgctcaggagaccgcacgcgtgctgcggcctggcggtcgcgccgtcgtcaccagtttcttcgtccccgacgccgatccggcccggaccgggcggctggctgaactgctcgacaccttcgccaccggcctggacgtcgcgcataccgtccccttgctgaccagcagcctcgagcgggtcggcctgacgggggtctctgtaacctcgatcggggcgtcggtgtggcccggctgggaccgctggctggcgggaatgtgggagcctggcacctggcctcgcaacttccttcgggccttccgcgaaggcaccctcgactacttcacggtcaccgcggaacgcccggcggtc

SEQ ID NO: 643 - DNA, 159 bp, Streptomyces avermitilis
  CDS (1)..(159)
gtgagcgacttcggccggatctacggcgaagaggcggccacgtatgcggagatgctccccgacagcctcgcggcccgcccgctggacagggctacaccctggaggacctggcggcacaggcggcggcgctggacgccgaggtcctcgcacagccgaacg

SEQ ID NO: 644 - DNA, 1233 bp, Streptomyces avermitilis
  CDS (1)..(1233)
gtgcgaaggaaaacatcaatcaccctgctgtccgtcgggcacgcctgcgtcgacatctaccagggcgccgtggcgtccctggtgccgttcttcgtcgccgaacgcgcctacagctatgccgctgtctcgggcatcgtgctcgccgcctccctcctgtcgtcggtggtgcaaccggtgttcggtgtcctcaccgaccgctggacgatgccctggctgctgccggtcagcacactgctcggcggcctgggtatcgcgctgagcggggtgggtggcccctacgcgctgaccctcgtgttcgtggcggtgtccggagtcggagtggctgcctatcaccccgagtccgcgcgggtcgcccggatcgccggccggggcagccacggtgggatgggctggttctctgtgggcggcaacctcggctttgcggcggccccgctcatggtcgccgctgttgttgctaccgggggtctgcgcctgacgccgctgctggtgctgccggcgctcgttggtgccgtgctgtgtctgcccgtgctgcgtgcgctggagcagcagcagtccgccggggccggtgcggctgtgtgggccggggtcgacgacagagcttcgttcgtgaagctgtcgctggccgtggtgtgccggtcgatcgtcttcgtcggcctgagcaccttcatctcgctgtacgccaaggagcgcatgggcggcagcacggcggcgggcaccgcggcgctgttcgtgctctacctgggcggcgcggtgggctctgtgctgggcggcgcgctggccgaccgctgggaccggatcaccgttgcccgctggtcgtacctgctcacagccggatcggtcgcgggggtggtgttcgtacccgggccggccctgtacctgtgcgtggcactgacctcggccggcctgtacgtcccgttctcgctgcaggtcacgctcggacaggactacctgccctcgcgcgtcggcaccgccagcgggatcacactcggtctgaccgtcagcatcggcggtctggcgagccctctcatcggcagcctcgccgacgcgacatccctccaggccgccctgtcgccactcatcctcatgcccgcactgagctggctgttgttccgcactcttcccgaacccgtcgtgccgcagcccgaacccatcgtgccgcagcccggggctacggcacatccgaagggagacgacaccgatgccaccctctctcacgcccggcccgatcacgac

SEQ ID NO: 645 - DNA, 789 bp, Streptomyces avermitilis
  CDS (1)..(789)
atggtcggcgccggacaccgtgtcgcgcttccgataaactgccagacgatgacgaaaatccgccatgaaccggtcgcgccgacccgcacccagcggctggcgcccggcgccgcgatagacccccaccgccacgacgaccaccagatcgtctacgccggccgcggtgtgctggccgtcaccaccagcgccggctcctgggtcgccccgggcacccgtgcaatctgggtaccggccgggacagtgcacgcccaccaggcccacggcgagctcgaactgcacctggtggggctgcctgcggacgagaacccgctcgccctggagacaccggctgtactcgcggtgagcccactgttgcgcgaactgatcgtcgcctacacacgcacccaggacgaccacagccccgaacgggcccgcctgcgcgcggtgttgctcgaccagttgcgggcctcgccccagcagccactgcacctgcccacaccgaccgctcccctgctgcagaccctgtgcgacatcctgcgcgccgatccggccgacagccgcaccctcaccgaactgggccgcgagatcggggcgagcgaccgtaccctgtcccggttgttccgcagcgaactcggcatgaccttcccgcaatggcgcacccaactacggctccaccacgcactggtcctactggccgacagcacgcccgtgaccgcagttgcgcacctgtgcggctggtcgtccgccagcgcgttcatcgatgccttccgccgcaccttcggccacacaccgggcgcccggccgagggac

SEQ ID NO: 646 - DNA, 993 bp, Streptomyces avermitilis
  CDS (1)..(993)
atgcagacacgaaccctgggcagcaccggcccggccgtttccgcgctgggcctgggtgcgatgggcatgtcgggcgcttacggcgcgaccgaccgcgcggagagtatcgccaccgtgcacgccgcgctggaggccggtgtcacgctgatcgacaccggcgacttctacggcatgggccacaacgagctgctgctcgccgaggtgctgcgcggccgggaccgggacagctaccaactgagtgtcaagttcggtcagctgcggggaccgggtcatgagttcggcgggcaggacggccgccccgaggcggtgaagaacttgctggcctactcgctgacccggctggacaccgaccacatcgacatctaccgtcccgcccggctggacccggcggtgccgatcgaggagacggtgggcgcgatcaaggagatgatcgacgccgggtacgtgcggcacatcggcctctcggaggtcgacgccgcgacgatccgccgggcgcacgccgtacacccggtcgccgacctgcagatcgagtactcgcttctgtcccgcgcggtggaggctgagatcctgcccacgctgcgggagctcggcatcggcctgaccgcgtacggcgtcctcggtcgcggcctcatctccggccactggtccgccggtcacagcgccggccccggcgacttccgcgccttcagcccgcggttctcgagcgagaacgtggaacacaacctcgccctcgtggaggcgctgcgccgggtcgccgaggcgaaggggtgcaccgtcgcccagttggccttcgcctgggttgccgcacagggcgaggacattgtcgcgctggtcggcgctcgcacccgcgagcggctggccgaggcgctgcccgcgatggagctgaacctcaccgcggacgacctcgccgagatcgagaaggcggtcccgccgggtgcggcgcgcggcgaccgatacccgtccgcgttcatgtccggcctcggcgtgggtaac

SEQ ID NO: 647 - DNA, 858 bp, Streptomyces avermitilis
  CDS (1)..(858)
atgcaacgtgaccaactcgccgacttcctgcgccaccgccgcgaggcgatcagcccgggcgaggtcggtatcgccgacggcccccgccgccgcaccgccggcctgcgccgggaagaggtggccacgctcgccggcatgtcggtggactacgtcgtacgcctcgagcagggacgcagcagtcagccctcgacccagctgctcggcgcgctggcccgggcgttgcgcctctccgacgacgagcgcgaccacctgttccacctggccggccaccggcccccgcccgccgacggggtggcccgcctggctcgcgccggcatgatgcgcatgctcgatctgctcggcgacaccccggccctggtgctgtccgacctgggcgaggtcctcgcccagaaccgggcagccgtcctgctgacgggcgacctcaccggcttcctcggcgaccggcgctacgtcgtataccgctatttcaccgaccccgccgcccgcgccgtccacccgcccgaagagcgggagtaccacgcccgccagctcgtggccgacctgcgcgcggtcgccggccgccggtccggcgaccccacggtcgccggactcgtcgaccggttgcagaccgcgagcgccgacttccgccgactctgggccgagcacgaggtggcggtccggcgcgccgaccgcaagaccttccagcacccgcgggtgggccacctggtgatggactgcgagaccctggtcactcccgaccagggtcagcaactgctggtgctcaccccggcggacgccgaggcccgcgagcggctggagctgctgcgggtactcggcatcgaggaattccccgcggcggcgacggacacgcccctacgg

SEQ ID NO: 648 - DNA, 486 bp, Streptomyces avermitilis
  CDS (1)..(486)
gtgccgccccctctgcgtaccgagacgagacaatgtctccccttgctgacccgtcatgcgccggaaatacgcagtgagggctgcaccaagtgtccaccagcccttgaccttcgtcccgaaaggcaagtgatgacagggtccatcgccccggtcgtgtggacgttcgccctggacgaggacgaggactgggtcgcgtccagggagcccgccggagacgagaatctccggcgggcggtggagaccctgcttctggggatcgcctccgccaaggccgccgagacgtacctggcggcgtggcacgccgactcgcagcagtgggggtcggggttttccctggcgacctcctccgccacggccgagcgcgtcagcaccaagaccgtccggctgatcgacctgtacgggcagttccaggactgcgacatcgcggcggacgagttcggcgcgatgctccaggggtacgtggcggccgggcgggcggccgagaat

SEQ ID NO: 649 - DNA, 390 bp, Streptomyces avermitilis
  CDS (1)..(390)
atgatgtcggctcacggggcgcgtagggaggcggggcacgtcagcggcatccaggccggccgggatgtgcgaatcgagcagagcatggtcgccttgggccgtgccacggtgacgggcactcagacgccggccgaacacgccgaggccgtcacggaactgtgcgccgcggtcggcctgttgctggacgaactccgccgcaacgaggagtactacgaggacggggcggagctggtcgcggccgccgaacaggtgcagacggaactggcccgcgacgagccgcgccgtaacatcctcctacgctggcttggcttcatcgcccctggcgtccacgcgaccgccgcggtcgcagcagacctgacgatgattcaggaaggcgtgaatgccctgttc

SEQ ID NO: 650 - DNA, 1428 bp, Streptomyces avermitilis
  CDS (1)..(1428)
atgccgcagccgccgtccgcggcgggggcaccccctcacttctcctacgacgtcacccgatacctgtgcgccgcgatgcacaccgacatcgggctcgctcgcaaggcggtcgcccggatcgtgcacgagccgcggcgtgccgccgcttcctcgcccggcgtggaccttggctgcgtgttgcgacacgccctggccgcccacactcgccagcagcggcgggatgtcgtactcctcctcctgctggtcgtcatggtggtcactctgccgttcacttacggggcatctcttctcctgggtctgctcgtggcctgggtggtcgtggccgccgagttgctttcggtgcactacggcgtcgtctcccggaagttgaagcgggaaaacttcgatccgaagtacgccccccgaccaccaggggtcagggatgccgcacgccttgaggccatcgaactccgtgaccgcggcaacgtcatagtctcctcgcgcttcgagcctttcgtcgggcacggggagaccttcagaagctggtcgttcgccctgaacaccggacgtcccgaggcaggcaagcaggtcatccctttcaccatccacgagctcaacgcccatatctccgcccgggtcggggccctcaagctgccgggcatggacatctccgatgtgctcctggtcaacggggccgacctgctgatcggaatcgacgaccgcacccgcggcgaggtgctgcgcaacttggccggaccgcccggggcgcaggtttcggacgcactcctgcgcgagctgcgtgaggacggcaagggccaggcgcgaccctatctggcgatccgggtcaccggctggagcggcgaactagtcagtaccctgttcttgagatgcgcgttgctgtccggccgcgacaccgcgttcatcgagggcagcaactgtctgctcgcgccagtgcgggagaagtaccggaccgtggacaggctgttggattcacccaccttcgggcagtggtgccagctagttgccgaggccggggtacgcaccccgatcctactggtccgtgcgcccttcgcgatcctcggagacctctgtgcgccgttcgccaggcgccgcgaacaacgccgacaggagcgttggatccgcctgcggtccttcgactacggcgcggagttcagtctccgggaggatgcgagcgactggctcttctgccggtacttccaggcgctggaccgggagttgtacgccaagacgatcgaacaccgtgtgctggacgccctcgtgcagttcctggaggaccacaacatcgactccagcgacctgatccagcggcagacttccatctacaactccggtctgttcgcggggcgcgacatctctatcaaggactccagcgtgcgtgccggaggcagcggccaccagtggaacaacccgcagccggtaaaacagagg

SEQ ID NO: 651 - DNA, 747 bp, Streptomyces avermitilis
  CDS (1)..(747)
atgccgacggcgagcatgccgacaccagggggaacgtacgcggcaacggtcacgaagggcggcacaggagcagtgtggcacgaatggcacgaatcctgcgatgagaggcagcagtgccactcgtcagtggccgacccgcccggaaggatgggggacatgacagacgcaccgctcggccgcagcgccgtgtacacgatcctcaccaccggctacgtcggctccaccggacctggagtcgccgccaccgtctcctacgtcgccgacggcggccggcatgtggtcttcgacccgggcatggtggcgagccgcgaccacatcctcggcccgctcgcggagttggggctcggccccgacgacatcaccgatgtggtgctcagtcaccaccacccggacaacaccatgaacgtgggcctgttcggacgggccacggtccacgaccacaaggtggagtacctgggcgaccagtggaggaaccgggacgcggagggctacgaactgaccccgtcgctgcggctgatccgcacgccgggacacagcctcgaggacatcaccctgctggccggcacggacacgggcgtggtggcgttcgccggcgacctgtggtggcactcggacggccccgcggacgacccggtagccccggaccgcgaggtactccgcgcctcccggctccgcgtgctggccgccgcggacctgatcgtgcccggccacggcagccccttcaaggccgacatcaccgcgccacgc

SEQ ID NO: 652 - DNA, 1047 bp, Streptomyces avermitilis
  CDS (1)..(1047)
atgtcccccatccttccgggcgggtcggccactgacgagtggcactgctgcctctcatcgcaggattcgtgccattcgtgccacactgctcctgtgccgcccttcgtgaccgttgccgcgtacgttccccctggtgtcggcatgctcgccgtcggcatcgttgccgaggtgttcggccctcacggggaggggctgcccggcttcgacttcgtgctgtgcgcggaccggcccgggccggtccctaccgacctcggcgtgccgctcacggtcgcgcatggcctggaccggctggctgccgctgatctggcgatcgcattgccatgggccggtttccgtacgccacccggtcccgctgtgcttgacgcgctgtcggccgcacacgagagcggctcgctggtcgcggcccactgcgtcggcaccttcgcgctcgccgctgctggcctgctcgacggccgacgggccaccacgcactggcgattcgccgaactgctggcccgccgccacccggacgtcgttgtggaccccgacgccctgtacatcgacgaagggcggatcaccacgggtgcgggagccgccgcgggcttcgatctgtgcctgcatctgctgaggcgggagtacggggccgcgatggccaacgccgtcgcccgcgacatggtgctgccctcccacagggacggcggtcaggcccagtacctgacctcccccgtccctgacgactgccaggacgagcgtctcgccgaggtgctcgcctgggcccgtgagcacctccacgaaccgcttcccgtcgcggaactggcccgacgcgccgtgatgagcaaacggtccttcgcccgccgcttcgccgccgcgaccggcaccaccccgcacgcctggctccggagcctgcgactgagcagcgccgaggaactcctggaaaccacggacctgacgatcgaggagatcgcccaccgggtcggatacggaagcgcggccgtcctgcgcgaacagttcgtgcgccgccgtggtgtgccgccccgttcctaccgccgctccttcaccaacgcgcca

SEQ ID NO: 653 - DNA, 678 bp, Streptomyces avermitilis
  CDS (1)..(678)
atgctccttccgcggcagaccgttcaatgtgcgctgcgtgaccaaagcgcctgtggactggccagccacggcgcgacgttctggccaacgaccaagcaacacgagtccacgaccagccgcgcttcgggaagcactggccaactgcggcacaacgtcaccacggccccggggaagagccgctgttgcctggtgggcgcaactgccggactgcgcgcatcaccgcccagcggctgccgttcccggtgccggacgagcgcccaccacttcgtcgacagttacgccgacatgcacgacctcgctgaggacctgcccgtgcccgacggcgtacccgaggccgcggcgacggtcctgcacacggcccgcgagctgctgcgccactcgtacgtctgctacgagttctccgccgtggcggtcatgcacttcctgatcgcggtggagatcgtgctgcgcgaccgcatcccggacgccggcaagaagccgctgcggaagctcatcgagcagggcgccggggcgggggtcctgacggcccggcaggcggagtacctcgactacggccgcaagatccgcaacggcatggcacacggccagaccacccacacggcgatgcctccggccgtggcggtcctgatggtgaccacctcgttcgcgatcgtcaccgagccgtgcgcccctgccctg

SEQ ID NO: 654 - DNA, 372 bp, Streptomyces avermitilis
  CDS (1)..(372)
atggccactcaggtgacggcgacagcgaacgcacagcgcagcgcctcgttcctgcagatcgcgatcgccctgcagaccctgaccatcttccttcaggcggtctccgccggactgctgctgacctcgtcctacggagagacgctgcacagtgtcggagcccgtgtgatgtacggggcgtcgatgctgtatgtgctcgccgcggtgctggcgtggaagccgggcggcggctcgccccggcctgtctggcacgcctccggtttcctcgtacttgcctcggtccaggtcctgctcggcatcgcgcacgtcccgtcggtccatctccccctgggagtcctgatgttcggtctgagtgtgctggcgctggcccggcgc

SEQ ID NO: 655 - DNA, 912 bp, Streptomyces avermitilis
  CDS (1)..(912)
atggggactgtcgggagcaccgatgggatagccggcgagcgacaccaactgatcaatgtcgcttaccggttgctcggttcggtgaccgaggccgaggacgcggtacaggatgcctacgcacgctggtacgcgctgccacgaagtcggcaggaggagatcctgtcccccggcgcctggctgacgacggtgaccagccgcatctgcctggacctgctcggctcggcgcgggcccgtcgtgaacgctatgtcggcgcgtggctgcccgagccgctgcccgaccgcaccgagagggaccgcgcgggcggcgccggccccaccggccctgcggaccctgtcgaccagatcgtcctggacgagtcggtggccatggccttcctcgtcgtcctggagtcgatgacgcccgccgagcgggtggcgttcgtcctgcacgacgttttccggtacccgttcgccgagatcgccgacgttctcggccggacccctgcggcctgcaagcagctggcggcctccgcccggcggcgggtgagcgtcgcgcgcactccggtgacggcgaccggccaggccgacgtggtgaggcacgtcaaagaggcatgggagaccaaggacatcgcagccctcgtcgatctcctcaacccggccgccgtgatgaccgccgacggcggcggcatggtcggcacggtcctgcgcccggtcgagggcggcgcgcgcatcgcccagtacatggtggccattgccgacaaggctcctgggctcgaactcctggagcggtcggtcaacggtgtgccgggcctggtggcccagcgcgccggcgtcgtcgtgaccgtagcctctttcgacgtctccgacgggcgcgtcacccggatctgggcggtccgcaacccggagaaactgcggccgtgggcgcgggagggc

SEQ ID NO: 656 - DNA, 774 bp, Streptomyces avermitilis
  CDS (1)..(774)
atggaacgcataaccgatgtgcccgagagtcccgcccagtctgccgatccggcccgggtgaatgactacgacagcttcgccgaggcgtactcggcggaaaccgagaacaacctcgtgaacgcgtactacgcgcggcccgcgatgttagccctcgccggagacgtggccggccgtcggatcctggacgccggctgcggctcgggccccctgtccgctgcactgcgcgaccgcggtgccgttgtcaccggcatcgacgccagcgccgggatgctggcgctggccaggcggcggctcggtgacgacgtagccctgcacgtggtcgacctgagcgaccgcctgccgttcgacgacggtgcgttcgacgacgtggtcgcgtcgctggtgttgcactacctggaggactgggggccgacgctggccgagttgcggcgagtgctcaggcccggcggccggctgatcgcgtcggtggaccaccctttcgtggcctacacgttccaggatcctcggcccgactactttgcgaccaccagctataccttcgactggacgttcaacgggcagtccgtcccgatgaagttctggcgcaagccattgcacgcgatgaccgatgccttcaccaccgccggtttccgcctttccgtcatcagcgagccgcagcccgacccggccgccattgagctgttccccgacgccttccatgacctttcgaccaaaacctgcttcctgttcttcgtcgtcgaggtaccgccgtcggctaccggctcggacgactac

SEQ ID NO: 657 - DNA, 843 bp, Streptomyces avermitilis
  CDS (1)..(843)
atgaacgcggtggacccgcttatgttcgaccgtcgtgtagcggtggtgaccggtgctgggcgtgggctgggccgggagcacgcgatgctcttggcgacgcggggcgcgagggtggtggtcaacgacgtgggaaccgggattgacggtcgtgggtcgtcagcatcgcccgcgcatgcggtggccgaggaaatcctcgcgatgggcggcgaggccgtcgcggacattcacgacgtctccactacggccggcgcgcaggcactggttgccaccgccgaccagcagtgggggcggctggacatcgtggtcaacaacgcggggatctcgatcctgcggccgctcacggagctctccgacgacgagtgccgccgggtgctggacacgcacgtgggcgggacgttgaacatgttgcgtgcggtctggccgcacatggtcgcatccggttacgggcgcatcgtcaacacgtgctcggatgcgctgttcggcgacactgggctcagtgtctacgccgcgggcaagggcgccgtcctggggctgacgacttcgctggcggccgagggcgcagcgcacgggatcaaggtcaacgcggtcgtccccatcgccggtacccgtatgtccctggaggcggtccagggcgacgaacagatgaccagcctcctcacgtcactgttccccgcccggcatgtcgcgtctgtggtggcgtttttggcccacgagcgggtgccctgcaccggggagctgctccacgcggccggtcgccgggtggggcggatcttcctgggggccacagacggcatgctcttcaaggaagacccgactccggaagcgatctgcgagcacttcctc

SEQ ID NO: 658 - DNA, 153 bp, Streptomyces avermitilis
  CDS (1)..(153)
gtgaccgcggacacgacgacccgcagcctggacggcggccaggtcgcgaagcaccgccccgacccctgggtacagggccagctgctggcgttcaacccctggatccaagatcagctggcgctgttcgcgcactacggcgaacccggtcatcgg

SEQ ID NO: 659 - DNA, 1437 bp, Streptomyces avermitilis
  CDS (1)..(1437)
atgaacgagacagcccgcacctacgacgtgatcgtcatcggcggggggccggtcggcgagaacgtggccgaacgcgcccgcgccgcagggctcagcgccgtgatcgtggagcgcgaactccttggcggagagtgctcgttctgggcctgcgacccgagcaaggcgctgctgcggccggtggtggcacgtgccgacgcgagccgcgtccccggactcgacccggcggtggcggggccgctggacgtcgaggcggtcctcgcacaccgcgacatgatgtcctcgtactggaaggacgaggaccaggccgactggctgaacgcggtctccgtcgacctcatacgcggccacggccgactcaccggctgcaaggaggtggccgtgcagacctctgagggcgacaccatcgccctgaccgcccggcacgccgtcgccgtctccaccggcacccgcgccgccctgcctcccatcccaggattcgacaccgtgcgcccctggaccagccgcgaggccaccagcgccgacaaggtgcccgaccgcctcgccgtcgtcggcggtggtgtggtggccgtcgagatggccaccgcctggcaggccctcggctcccaggtgaccatgctggtcctcgagaacgggctcctcgagcggatggagccgttcgccggcgaactggtcgccgacggactgcgcgaagcaggcgtcgacatccgcttcagcaccaccgtcacctccatggcccgcgagggcggcgaggacggcgaggtgcggatcacgctgtccgacggcagggagctggccgcggacgagatcctgctggcgaccggccgcgccccgcagacccgcgacgtcggcctggagaccgtcggtctcacccccggcgactggctgaccgtcgacgacaccttccgggtcaccggcgtcgacggcggctggctctacgccgtcggcgacgtcaaccgccgcgccctgatgacgcatcagggcaagtaccaggcccggatcgccggcaccgtcatcggcgcccgcgccaagggagagcccatcgacgacgccccctggggcgcgcatgtcgccaccgccgaccacgcggccgtcccccaggtcgtcttcaccactcccgaggtcgcctccgtcggcctgaccagccgcgaggccgagcagagcggacgccgcatcgaggtcgtcgactacgacctcgcccgcgtcgccggcgcccaccagtacggcgacgactaccgtggccgggcccgcatgctcatcgacaccgaccgcaacaccgtggtgggcgtcaccttcgccggccccggagtcggggaactggtgcactcggccaccatcgcggtcgccggcgaggtgcccctcgaccggctctggcacgccgtccccgccttccccaccctcggcgaagtctggctgcggctgctggagacctaccgcggc

SEQ ID NO: 660 - DNA, 468 bp, Streptomyces avermitilis
  CDS (1)..(468)
atgaatctgaagctcgaaatgatcgtgctgcccgtctccgacatcgaccgggccaaggccttctacgagaaggtcggattccgcctggacgtcgaccacacggccaacgaggacttccggatcgtgcacttcacgccgcccggctccgagtgctcgatcatcttcggcgaggggatgacccccatcgcacccggctcgttccagggcctgtacctcatcgtctccgacatcgaggaggcccgcgcggagctcaccggccgcggcatcgaggtcagcgagatcttccacgacgcaggcggcgtcttccacggccacgagggcggggacgtcacccaccgcggccccggccaggagcggctggccggcctgcaccccgagcgcgcctcctacggctccttcctcaccttcagcgacccggacggcaacggctgggtgctccaggaggtctcgcagcgcctgccaggccgc

SEQ ID NO: 661 - DNA, 588 bp, Streptomyces avermitilis
  CDS (1)..(588)
atgcgggccgacgccaggaagaaccgcgaccacctgctcgcggtagcgggcgccgccatcaccgagcagggcgtggacgtgtcgctgcgcgacatcgcgcgcagggccgaggtcggactcgcgacgctgctgcgtcacttcccgacacgcgaggcgctgctcgatgccctgctccacacgagcttcgacgagctgaccgccaaggcgggcgccctggaaacgtccagctcgcccgacgacgctctcgtttcgtggctacgcgactgcgtcgcgtggaccaccgagtaccggggcgcggtcgtgctgatggcagccgccatcgaggacaccgagtccgcactccacgcttcgtgcgtcactctgcgcgcggccggcgcgcggctcctcacccgtgcccaggccgcgggcatggcgcggaccgacatcgacggcgccgacctgttcgcgctggtggaggcgctcgcctggctcggcgaccaaccctcgctcgcgccccgcgccgatcacctcttcgccgtcgtcgcaggcgcgatcctgaccagcacagcgagcagcgataccgaggcaggaacgccaccctcgcacccg

SEQ ID NO: 662 - DNA, 1290 bp, Streptomyces avermitilis
  CDS (1)..(1290)
gtggccgcaggtcacagcgtagaccctgcctgctggcgggaggccttcgagggcctgatgagccggatagcgggacgcttcacacgggtcgaatcccgacgccgggcccggaagttggtactcggcctgttgtcggacctgccgcgcaagaactgctggaccatcgccgagtgggccggggacaggaccccggacgacatgcagcacctgctcgagagggcgaagtgggatgccgaccaggtccgcgacgaggtgggtgactacgtggtggagcatctgcacgacgacgaggcggtgctggtggtcgacgagaccggcgacgtgaagaagggcaccgacaccgttggagtccagcggcagtacaccggcaccgcgggcaggatcgagaacgcccaggtcgccgtctacctggtctacgccggccgccgcgggcacgccgcagtggaccgggaactctatgttccgcgttcctggacctccgatcccgaccgctgccgggccgccggcctcggtgacaatacggagttcgcgaccaagccggagctggccgctcgcacggtcacccgattcctcgacgccggccatcgggccgcctgggtcgcgggagacgaggtctacggcgacaacccgaggctgcgcaccgcgctggaggaacgcggcaccggctacgtcctcgcggtggcctgctcgcacgaagtcaccacaggcgccgggaggtttcgcgccgacatgttggccaggaaggtgcccaagagcgcctggcagaagctgtccgcaggggccggagccgagggccaccgcttctacgactgggccgccatcgacctcaccgatccccggcccgggagccggcagctgctgatccgccgcaaccgcagcaccggcgaacgtgcctactaccgctgctactcgcctgccgcagtgccgctgaccaccctggtgcgcgtcgctgggtcaaggtggcgggtcgaggagttattccagtccggcaagggcctggcggccctggacgagcaccaggtccgccgctacccgtcctggtcccgctgggtcaccctggccatgctcgcgcatgccttcctcgctgtcctccgcgcgaacgaacacgagggtcatccctcgcccgacgagctgaaaccgctcacttgtgacgagatccaacgactgttcatcacgctcgtcaaccggaccgtctttgaccctgtccaccgacttcgctggtccgtctggcgacgccgccaccaggcccgatcccagaccagccactaccggcgtcaagccgctcaagca

SEQ ID NO: 663 - DNA, 474 bp, Streptomyces avermitilis
  CDS (1)..(474)
gtggccgcacccgtctccacaccgcgtcaggtcgcgcagcgtctgcctgccgtcctgtgtatcggagggcttgtgcaacgtggcgaagtctggtgggtccagttcgacgagcggaggttggtcgtactgctgtcaggagacgacgcgtccgggttccaggtgatgcaggtcgtcgctccggcgggcctcgacatcagcggtctgggcatcgaagtgacggtcggcgccggtgaagggctgccgctcgaaggcgtgctgcggctcgcgttcccgcgtccgggcttcaccccgtgcacgtggctgaccaccgtgtcccgggacgacctgatagagcgggcggccgtcctgtcctccaggaagctcagcgagatcgacgatgccctccgacttgctgaacaagcacaggagcggaccccggcaacgaccgcgaagctcagcgagataagggacgccctccgtcgcggtgaactcggt

SEQ ID NO: 664 - DNA, 372 bp, Streptomyces avermitilis
  CDS (1)..(372)
gtgatcatccgacacattcccggttcgccggaatcgcgatgccgggccgggattgcctcactgctggtctgggtgatgcagcggagggtcgtgctggccgatcgcgccgaacggctgcgcaaggagctcgccgagatcgatgccgaggtggcccggctggaggcagcggaggtggtgatcgggcagttcatcgaggccgaggggaacgggcaggccgacgacccggctgtggtgcaggagttggagcgagtgacgacgactcctggtgcaggcgggatgctgctggtcccacatcgcgagccggacatggacgagagcgcgctgcgggaccagcagcatcccggcatcggcccccgccagccctgtgacctg

SEQ ID NO: 665 - DNA, 831 bp, Streptomyces avermitilis
  CDS (1)..(831)
ttgtcggtgcggtgcgcttcactgtccgccatggagctcacgcaagcgaccgtcaacgacctgctggcccaactcggcccaggagacagctacatgtatctgcccagcgacctggacccgcaggacctgaccgacctgctcgacggcaggtacggcgccgcgcgcacccttgtcctcgatggcttcaccgatccgacggtcgacgagtccaggggcgcggctcttctcgtccccttcgaggaccgggccgtgaagataagggcgtgggcgtacggggatcagtgggtcggcacgggtacggcacgggacgccaagggagccgagcggccggtgttggtggtcgctcacagggaagtgccagaacccttggcggtcgctccggatgaagacgaggacgtcgactggatggagcggctcatacggatcaccggctggacacggcccgcccagcggccggacgtggactgggcggaggtggaatcgcgtctgggcaccgcgctgccgagcgactacaaacgcatggtcgagacgttcggcgaaggcgccttcgacggatacctggacctgaaccaggagccgtggacggatctcagaagggacggtctgctcatctgggcgggcactgaacacgaggacctgtactgctggagggccgacggtgacgaccccgaccgctggcccgtcgtggtccggtcctttgacaacaaggacgtcccctttgactgccaggccgcgaagttcgtctgccgcatcctcatcgacccgcaccacccattcacgatggcccgctatttcgacacccactggttcatgaactaccgggaaagcggc

SEQ ID NO: 666 - DNA, 219 bp, Streptomyces avermitilis
  CDS (1)..(219)
gtgccggatgatcacccgctaccgatcacacccacgaccggcacgagcatctcagcccccgtccacgccagccccatgaccagcgaattcaggttgaacaacgctcaatggagtgcggggatcgtcgaggggcatgtgaaccgggtgaaagccctcaagagggctatgtatcgcagggcgccctttgaactcctccgcatccgcatcctcacccagcca

SEQ ID NO: 667 - DNA, 789 bp, Streptomyces avermitilis
  CDS (1)..(789)
atgcgggccgacgccaggaagaaccgcgaccacctgctcgcggtagcgggcgccgccatcaccgagcagggcgtggacgtgtcgctgcgcgacatcgcgcgcagggccgaggtcggactcgcgacgctgctgcgtcacttcccgacacgcgaggcgctgctcgatgccctgctccacacgagcttcgacgagctgaccgccaaggcgggcgccctgggtacaggtccaggaacgtacgcagcagggccagttggcggtcgagagggcgggcgatgtcggcgccgagtagccacagccaggcggaacaggcgaggtcatgcgggggtcaggagcggcctggtcgaaggcgaaggcggagacaggaaggccgtcgacgaaggcgacgtcgagcggggagaaaccgttgtggcacaccgtctcctcgccgcccgcgatcggcgtgtcggcggtcgcgtcgtgcagtcggcgcagcaattgcgccgcagcggtgatctgggcgggcgaccagtcacgtgcccggaagtcagtccggttctcaccgtgctgaaagccgaggctctcgcggaccttggcagggccccggtcaaaggagtctccagctcctgttccatggtgcgtcagcataggcaccctgccggcccgccgacctcacagttggctggccgccgtgcactctgcgctccccgccatccccacaaccatcaactcgtaatcaactcaggaaaggggagcgcccctcgtcgtttacaagactctgtctgcagttccgccaagatcgcgatcacaggg

SEQ ID NO: 668 - DNA, 993 bp, Streptomyces avermitilis
  CDS (1)..(993)
atgagggcggtccggctccatgagcacggcggccctgaagttctgcgttacgacgaggtgccgattcccgagccgggaccgggcgaggtgctcgttcgcgtgcacgcggtcggcgtcaatcctccggactggtacctgcgcgacgggctgaccaacctgcctccggagacgaggcccaagttcagcttgcccgtgattccggggacggacctgtcgggcgtcgtcgaagccgtcgccgcggacgtggacggtctctccgtcggtgatgaagtcttcggcctccttcgcttccccagcttcgacggcagcacatatgccgagtacgtggtcgcgcctgcgtcggacctcgcactcaagccggccggcatcgatcacgtgcacgccgccggggcgcccatggccgggctcaccgcgtggcagttcctgatcgagctcggccacgatcacccgtcgcccttccaggcggcacagcatcgtccggtgccactcggcgccaacatgacagtgctcatcaacggtgccgcgggcggcgtggggcacttcgcgctgcagctggcgaaatggaagggtgcacgtgtcatcgcggtggcgtcgggcgcgcatgaatcgttcctgcgcgagctcggcgccgacgagttcatcgactacaccaagagccgtcccgaggaactcgtgcacgacgtcgacctcgttctcgacgccgtcggtggccccgacagcaagcgattcctgcgcacgctcaagcgcggcggctcccagttccccgtgttcttcggcgagttcgacgaagaggagaccgtgaagctgggcgtcacagtcacaggcacccaggtccgctcgaacggcgcgcagctcgccgaactgggacgcctgctcgacgcgggcacggtccgcgtcgcgatcgacagcacgttcgcgctcgcggatgcccgagccgcgcacgaacgcgccgcccgagggcacatccagggcaagatcgtgctcacggtcgct

SEQ ID NO: 669 - DNA, 915 bp, Streptomyces avermitilis
  CDS (1)..(915)
ttgatcacccccgagcctgtgaccagcctaatcggcatgacacagaatgctgttgagaagacacccgtcacgatgctgggactcggcgcgatgggcaccgcgctggcccgtacctggcttgccgccggccaccggctcaccgtctggaaccgcacgccggcccgtgccgcggcgctcgccgccgagggtgcaagggtcgcggacagcgccgctgaggcggtcgcagcgaacaccctggtcattgtttgtctgttggacgactcttcggtcgacgaggtgctggctggcatcgacctggccgacacggacctggtcaacctgaccaccagcacccctgcccaggcccgcgcccgcgccgagtgggccaacgaacgcggcgcccgctacctggacggcgggatcatggctgtccctccgatgatcggcgtcccggaagccggcagctacgtcttctgcagcggctcgcgggagctgttcgagcggcaccaggagaccctgggcatcccggccggcaccacctacgtcggcatggacgcgggcttcgcggccctgcacgacatggctctgctcagcgccatgtacgggatgttcgccggggtcgcacacgcctttgccctgatccacaaggaggacatcgaccccacgtcactcgccccgatgctcgccgactggctcgtcgctatggccccggcagttcatcagaccgccgaccatctgcggagcggcgactacaccaagggtgtcgtctccactctcgccatgcaggtggccggcacgccgaccttcctgagcacagccgagcagcagggcgtcagtcccgaactgctcagcccttacttcgagctgatgcgccgtcgcctagccgagggcagcggcgaggaggacctcacgggtgtgatcaacctgctggtgcac

SEQ ID NO: 670 - DNA, 360 bp, Streptomyces avermitilis
  CDS (1)..(360)
atgacgacactgaaccggccgggcgcaccagacggacacgtctgcgggatcgacaccgtgatggaggtgatcggcggcaagtggaaggtgctgatcctctgggcgctccacgagcgcccccactgccgcttcggcgagctgcgtcggctgcttccggggatcaccgagaaggtgctgtcctctcacctacgcgagatggaagcggacggcgtcgtgcaccgcgtctcctacgacgaggtgccgccccgcgtcgagtactcgctgaccgaggacggcacgcgcctcaacgacgcactccagccgctggccgcctggggacgcgagcggtcgaccgctcgaggactggaagagggggcgggc

SEQ ID NO: 671 - DNA, 213 bp, Streptomyces avermitilis
  CDS (1)..(213)
gtgaccgtgagcaagaacatcaacaaccccgtgggcatgggcggcggccagcgcaagaagctgtcccgcgccgaacggcagaacaacggtccgcaccggaacctcgaccgccagggtgcagccgaccagaaggcggagctggtgcgcaagatgcgcgagaaggcaggcgcagctgagggcgccgggcaggcgggcgacggctccgcacagagc

SEQ ID NO: 672 - DNA, 660 bp, Streptomyces avermitilis
  CDS (1)..(660)
atgcagccgcctcaggatccgtcgaacgtcacgcatgtccttgtggcagcctttccggcacgtcttgccggtgccgtgcagagcgtcttggcggtgatgccggacgccaggctcgcgccagcggagtcattcgaggttgttgaggtgcagggcgagaccgtcgccatcccctaccggatctacaacgaggagccggagaccggcggctcggagcggccactgaccgaaacccagcagatgatcttgcattgcctgtactcacggcacagtgatgggagggtccgccagcgccacctcgaaaagatcatggcgtcgagcgagccatgggtggtcccattcgtggtgcagttggccggcgagtacgtgctggagatccttgacgcgatcggcctgggtgttcccggcctcgctgccccggggtcggctgaccgcaggctctatggcgagttcatcgagcgcaatccagacttcttcgcacgcacggagcgacgcgtggtgagctactggtcgtgctactaccgtcggaaatatgaagtgttcgggacgtatccggggtcagcgctgatggaggcgttccgggccgccgcgtcagaacacgccggcgtgcagtggccgcggcgcacaccgccgccgtcggcgacatgttcggcgggtccgcct

SEQ ID NO: 673 - DNA, 744 bp, Streptomyces avermitilis
  CDS (1)..(744)
atggatgaggtcgaagtcgttgtcgcccattccgagcgcgcgaccctgcgcgtcggcgacgtgtttctgaaggtggacgccgatcaggcgcgcatcgacgtcgaggtcgaggcgatgtccctcgcgccggtcccgaccccggaggtcctgtggcgcaagccgcccgtgctcgcgatcgccgcactcccggggacgacgcttgggcgcctcggcgggccgtcgaccgggtcgtcggcggcgtgggccgcggcgggcaccgccatccggaagctgcacgacgcgccgctgccgccccgggccggccgggccggccggagcatcgtcgcgttggcggcggaactcgacgcagagtgcgagttgctcgtgacgaacggcctcctgcccgctgacctggtcacccgcaaccgccaggtcgccgaggccgcgctccggccgtggactgcggcgttcacgcacggcgacctgcagatcgcgcacgtcttcgtcgagggcaacgaggtcacgggcatcatcgactggtccgaggcgggccagggtgatgccctgtacgacctcgccaccttcacgctcggacacgaggagcacctcgacgacgtcgtcgccggctatggcaccgacatcgacctcgacgtgatccacgcgtggtggtcgttgcgaagcctgctggtggttcgctggctgaccgagcacggcttcgacccgttcgcgccgggctgtgaggtcgacgtgctgagatcccggatg

SEQ ID NO: 674 - DNA, 216 bp, Streptomyces avermitilis
  CDS (1)..(216)
gtgtaccgctgggtcgcggaaggagcgatcgcgctgctgcactggttccgccgcctgcgcatccgctgggagatccgcgacgacatccaccacgcgttcgtcaccctcggctgcgccgtcatctgccggcgacgactgcgcaccgcactttgtcgggaggaagggcgggcgatcgctccaggggggtggcctgctcgatgcgtcagaacgcggtcg

SEQ ID NO: 675 - DNA, 279 bp, Streptomyces avermitilis
  CDS (1)..(279)
atgacctgctggcgacggctgcgggactggaacgaggccggggtgtggcagcgccggcacgagctgctgctgtccgagctgcgggccgcagacctgctggacccctcccgcgcagcggtcgaccccggccacatccgcgcgatgaagtgtgggccggccgccggtccgtccctggtggccgggggcaaggtcggcagcaagcaccacctgatggtcgaggcgcacggcatcccgctcgcggcaatcaccaccggcggcaaccgcaacgacgtcagcaac

SEQ ID NO: 676 - DNA, 174 bp, Streptomyces avermitilis
  CDS (1)..(174)
gtggcctggatagaggcgcacaaccgctcgcacaggcaagtcggcgcccgtgtcgagcatgtcttcgcccgcatgaagacctggaagatcctgcgcgactgccgcctcaatggcgacggcgtccaccacgccatgctcggcatcgcccgcctacacaatttcgccctcgccggg

SEQ ID NO: 677 - DNA, 429 bp, Streptomyces avermitilis
  CDS (1)..(429)
gtggatagcccagttcacggggccgagtccgcgtccgcgacagctccgggggctggtgagcgcactgcggcgcgagggcgccgatgtggtccgctgcggacggccctggggccgccgttccaggaccgggtcatgctggtcgtaacgtactggcgtaccaacttgacgatgcgccagttggcacccctcttcggtggctggaagtccgctgccgaccaggtcatcgaccagctcggtccgcatctcgctctccaaccccgcagacgtttccggaatgacgctgtgctgatcgtggacggcactttggtgcccactcgcgaccgcacggtggccaagcagtccaagaactatcggcactccaccaaccatcaggtggtcattgacgccgacagtcgcctggtcgtcgtgatcggccgaccactaccccgg

SEQ ID NO: 678 - DNA, 267 bp, Streptomyces avermitilis
  CDS (1)..(267)
gtgagcctgctccttcaacgaccacctgctccttcgacgagggcctgctccttcaacaacggcacctgggcaccgaaacagatcaccctgcccgaggatctcctgaccgtgcccgccaccggcgaggccgggcacggcactggccgcaccggtgggagcagcacgtcaccagccggctctgtgcgcagcctcacagcgctcgcacctgccaggaacacgtcgggcccggtcctccggtgggagggccgggaactcgcgcgtttggcg

SEQ ID NO: 679 - DNA, 561 bp, Streptomyces avermitilis
  CDS (1)..(561)
gtggtgaacagatttttcaaccctgcatcgggtacacggcgtcagggcggacagccgctccgcccagtgaccggcgtgaaggagaacctgatggacgggatcgtcctgctcaaagacgaccacaagacggtggagaagctgttcaagcagttcgagaaggccggcgacactgcccacaccgaaaagcggaagatcgccgaccaggtgatccaggaactcaccacccacacctggatcgaggagaaagtcttctacccggctgcccgggaagccgcaccggacaccaaagaccatgtcctggaaagcatcgaggagcaccatgtcgtgctgtggatgctgtccgaactcaagaacctcgatccggccgacgagcggttcgacgccaagatgactgtcctcatcgagaacgtacgccaccacgtcgaggaagaagagaaggagtggttccccgaggtccgcaaggccatgggccgcaaccgcctcaccgaactcggcgagcagatggaggaggcaaagaagaaggccccccatgaccccttggccgtacccagcgccgacgaa

SEQ ID NO: 680 - DNA, 252 bp, Streptomyces avermitilis
  CDS (1)..(252)
atgcgcgcacccgaggggactgcttcgctggtcaggcccgctctccccgttcacaaaggagtgatcatgagcgcaacagaccctacccgtggttctgcccagcaaatgcggcagaaggtccaggagatggaagaggccgcccagcgcgcctccgaccctcaggagcgccagaagctgcaggacaaggcccgcaagctgcgcgagcagagcgagcggcagggcggccagtctgagggcatcgaccccacgatc

SEQ ID NO: 681 - DNA, 471 bp, Streptomyces avermitilis
  CDS (1)..(471)
atgaggtggcgcttgcgtcctttgatcttcttgccggcgtcgatgccctggctggtctcggcgacgtttgccgacgtcttcacgctctgcgcgtccaccacggccgcggtgggccccgcactgtggccttgcgcccgccgggtcttgtcgcgtagcgggtcgaggacctgctgggtcgtgccgtccgattcccacttccgcccgtaccgcagtgacgtgtccgacgcccgctgggcttgggccggacccggcacagcggcccgggtgcacgacctgcgagagatcgtcaacgcgatcctctacgtcaaccgcaccggcatcccgtgggagtacctgcggcacgacttcccgcctttcaagaccgtctacgactattacgcggacgaacactcacaccccatgcaacaaccaccaacggcgccagtcacaaagacatcccagaacaccaactacccagatcagaagccccct

SEQ ID NO: 682 - DNA, 273 bp, Streptomyces avermitilis
  CDS (1)..(273)
gtgcacgacaccaccggcggcaaacaactgctcgacgacctggccgcagcacctcccagtgtgaccaaggtctgggccgacggcggctaccagaacagcatcttcaaccacggcgccgggctgggcagcgatgtcgaggtggtgcaggggccgcgcgccaaagggttcgagccgctgccgaagcggtgggtgatcgagcggaccttcggctggtcgatgcagcaccgccgcccggcgcgggactccgagccctcccgcaaagatcccgcacga

SEQ ID NO: 683 - DNA, 645 bp, Streptomyces avermitilis
  CDS (1)..(645)
atgagcgacgacagcactcccacaccggcctccttcacggccacggccaccgccatcgaggccatcgcccaggccatgcgcacagcacacaccgccgacgtcgcctccaccgacgacccccagcaggccatagcagcgctgctgctcctgcgcgaagtacgtgaacagctggcccgctgggagccccaactgatcgaaacggcccgcaaggccggcgccagctgggccgacctggcccaccccctcggcgtctccagccgccaggctgccgagcgccgctacctgcgcgtgcgtcccggtgaaaccggcaccaccaaggaacagcgcgtacaggccacccgcggccgacgtgccgcggaccgctccgtagcgtcctgggcccatgaacacgccgccgcgctgcgccagctcgccgggaccatcaccgctctgccggatcttcccctcgccgcgacggacgcgctcacggctctgcacaccgcactcgggaacagcgatccggcccaactcctgggtcccctcaacgaggcaggccctcacctgcgctccgctcatcccgacctcgcggatcgcgtcaccgacatcggccgccacacccaagaggtgcgcgagagcgagcatcgtcagcgctcttccggcgggccg

SEQ ID NO: 684 - DNA, 429 bp, Streptomyces avermitilis
  CDS (1)..(429)
gtgttgatgcgcaccgacccgttccgtgaactcgaccggctggcccagcatctgatgggtccgggaacgtggtcccggccttccgcgatgccgatggacgcctaccgagacggcgaccagtacgtcatcgccttcgacctgccgggcatcgaccccgacgcgctcgacatcgacgtcgagcggaacatgctcaccgtgagggcggagcgacgccccctgccgaggtccgagagcgcccagacggaactgtccgaacggcctctgggtgtcttctcccgccagctcgtcctggccgacacgctcgacaccgagcgcatctgcgcggactacgaggccggcgtcctgaccctgcgtatcccgatcgccgagcgagccaagccccgcaagatcagcgtccgcagcaccggcgaacgccaggagctcgacggc

SEQ ID NO: 685 - DNA, 774 bp, Streptomyces avermitilis
  CDS (1)..(774)
atgagctccttctccctcgcggtacgcgactcctccacgatgctgcgccgcaacctcctgcacgcccgccgctatccgtcgctcaccctgaacctgctgctcactccggtcatgctgttgctgctgttcgtgtacatcttcggcgacaccatgagcggcggcgcgggccgctccgcctacatcgcctacatcgtccccggcatcctgttgatgaccatcggctccaccacgatcggcaccgccgtctcggtctccaccgacatgaacgaaggcatcatcgcccgcttccgcaccatggccatccaccgcagctccgtgctgttcgggcacgtcgccggcagcgtgctgcaagcgatcatgagcgtggtcctcgtcggggccgtcggcgtcgccatgggcttccgctccacggatgccaccgtcctggaatggctggcagcattcgggttgctcgcgctgttcgccctggcgttcacctggatcgcagtcggcatgggcctgggcagccccaacgccgaagccgccagcaacaacgccatgccgctgatcctgctgcccctcatctccagcgccttcgtcccgctggactccatgcccggctggttccagccgatcgccgagtaccagcccttcacccccgccatcgagaccctgcgcggactcctgctgggcaccgagatcggcaacaactggtggatcgccctcgcctggtgcctgggcctgaccgtcctcggccaccgctggtcgaaggcgcagttcaaccgcgaccccaaa

SEQ ID NO: 686 - DNA, 963 bp, Streptomyces avermitilis
  CDS (1)..(963)
atgaccaacctggccatcgcggcgaacgggctgcgcaagtcctacggcgacaagaccgtcctcgacggcatcgatctgagcatcccggccgggtcggtgttcgcgctgctcgggcccaacggtgccggcaagaccaccgccgtgaagatcctgtccacgctcatcaccgccgacggcgggcaggcccaggtcgcgggccacgacctggccgcagaggcacatgccgtgcgggccgcgatcggtgtcaccgggcagttctccgccgtcgacgggctgatcaccggcgaggagaacatgctcctcatggcagacctgcaccacctgcccaagtccgagggacagcgcgtcaccgcggaactcctggaacgcttcgacctggtggaagccgcaaagaagcccgcttccacctactccggcggcatgaagcgccgcctggacatcgcgatgaccctggtcggcagcccgcggatcatcttcctcgacgaaccgaccaccggcctcgacccccgctcccgccacaacatgtggcagatcatccgcgagctcgtcacgggcggcgtcaccgtcttcctcaccacccagtacctcgaagaagccgacgaactcgccgaccgcatcgccgtattgagcgacgggaagatcgccgcccagggcaccgccgacgagctgaagcggatcgtccccggcggacacgtccgcctccgcttcaccgacccggccgcctaccagtccgccgcctcggcactgcgcgagggcacccgcgacgacgaagcgctgtcgctgcagatccccagcgacggcagccagcgcgcactgcgctccctcctcgaccagctggacgccgccggcatcgaggccgacgagctgaccgtgcacacccccgacctcgacgacgtcttcttcgctctcaccggctccaccaccgtgcccgcccagccgaaccagcccaaggaggctgtccga

SEQ ID NO: 687 - DNA, 669 bp, Streptomyces avermitilis
  CDS (1)..(669)
atgcagaagttcgacacccccgccccggtctccgccgtcgtcgacatccccgcgggacgcatccagttcattgccgccgaccgggccgacaccaccatcgaggtcctgcccgcgaacgccgccaagagccgcgatgtgaaggcagccgaagagatcacggtctcctacagcgacggcgtcctgcggatcggggccccgcaggccaagaaccgggccctcggacactccggatccgtcgaggtcaccgtccagctgcccgccggctcccacatcgaggcgaaggcggccgccgccgaattccgcggcgtcggacgactcggtgacgtcgtcttcgcgggcggctaccgctcggtcaagctcgacgaggccgcaagcgcccgcctcaccggcctcgacgccgacatcacggtcggccgcctgaacgggcccggcgagatcagcacccagaagggcgacctgaacatcgccgaggccgcccgcggcacgctcacgctgagcacccagatgggcgacatcgtcgtcggtgccgcccgcggagtctccgccgccctggacgccggcacctcctacggccggatcaacaacacgctccagaacaccgacggggcggccgccggcctgaccatccacgcgaccaccgcccacggcgacatcaccgcccgcagcctc

SEQ ID NO: 688 - DNA, 732 bp, Streptomyces avermitilis
  CDS (1)..(732)
atgccgggaggcagactcacccaggaggaacgccagcagatcgcgctgggactggccgacggcctcgcctacgcggagatcgcccgaggcatcgaccgtccgacctcgacggtcacgcgtgaggtgatgcgcaacggcggccccaccgcctaccgcgccgacctcgcccaccgcgccaccgaacaccgcgcccaccggcgcaggcaggccgcgccccgggacccgaaggcgcccccgcagccctacggacgcgacgaggaagcggtgcgcgagtacgaggaggtgttcaccaccgtcatcatggcttcgggcgcgcccaagatgatgtcccgggtgctggcctgtctcttcaccaccgacgcgggcagcctcaccgcgtccgaactcgcccagcgccttcaggtcagcccggcgtccatttccaaagcgatcgcgttcctggagagccagggcctcgtccgccgggaacgcgacgaacgccgccgagagcgctacgtcgtcgacgacgacgtctggtaccagtccatgatggccagcgcccgctccaccgcccaactcgtcgaaacctcacggcagggcgtcagcatcctcggccccggcacccccgccgccatccgcctcgagaacatcgcccgcttcctcgacttcgtctccgaaagcatcgcccgcgccgcggaacaggcccgcgaaatcctccacacgaaacccggaacaaccccagacagcaccacc

SEQ ID NO: 689 - DNA, 1572 bp, Streptomyces avermitilis
  CDS (1)..(1572)
gtgacggccgtcggccggcccggagactccctggcgcaataccggcccggcgctggcgggtcccggagggcccccggggaggccagggaagaaccggccgatgaccgatcaccgccgcccgctgggcaccggaccgccccgagccggcctgccccgcgcgggagacaccgagctgtcgaccgcgccacgagcccgccccgccgccgaaggaacggcgcgcccgccccgtccgcctcgggtgggcgccacgccgtgcggagcgtgctgatgctgcgtagcgtggaagatatagggccgccgaggccgaggatgcgcacggggcggaagcgtgtgaggcccgagctggactacaggttgctgttcggcgcgacgccgagcccgtatctggtgctggcgccagatctggtgatcgtggatgtcaatgaggcgtatctgcgggcgaccggccgtacccgggaggacttggtcggccagcatgtgttcgaggcgttcccggacaacccggccgacccggatgccgacggggtgcggaatctgggggcctcgttggagcgggtactggccacggggtccgcggacgtgatggcggtgcagaagtacgacatccccgtggtcgcgcggccgggggtgttcgaggagcgctggtggtcgccggtgaacacccccgttgttgaccgggacgggcatgtggcgtggatcatccaccgggtggaggacgtgaccgcgtttgtgcaggcccgccgctttcggagccgcggggagggcgggcggctgtccgagcgggaggaggggatggaggccgagctgtatgcccgggcccgtgagctgcagcggctgaatgaggagttgcgggcggcgcacgcgagggagcgggaagtcgcggtcacattgcaggaggcgatgctgcactccccggatctggcccgtcatgaaaatgtggcggtgcggtacctgcctgcgatcggctctttgaacgtgtgcggcgactggtacgacaccgttgacctgaccgaggggcggttcaccgttgccgtcggtgacgtcgtcgggcacggtctggaggccgccaccatcatgggcatgctccgcagcgccctgtctgcggcgagccggggggtggccgggcccgcccaggccttggaggtgctgggcatgtacgcccgctcggtggagggcgcactcgcggccaccgcggtcacggtgctcattgactcccggtcgaaactgctggtctactccagcgccggccaccctccgccggtgctcttgcacgccgacggcacgtgcgaactgctggacaaggccaccgatccgccgctgggtgcgcggcccgagcctgtgccgcgcccgcaggccagcgccccttatcgccgtggtgacgccctcgtcctgtacaccgacgggctgatcgagcgccggggggaggacatcgacaccggcctggaccggctcggggaaacgctgggcggcttgaccgacctcgttcccgagcggcttgcggacgccctgctcgcggggctcggcgtcgccggtggcggccgcgacgacatcgccctggtcgtcgtccgcctc

SEQ ID NO: 690 - DNA, 921 bp, Streptomyces avermitilis
  CDS (1)..(921)
atgcgtgacatcggtagtgtcggcgggcacagctcccctcctggcacaccactgcgcggacgggtcgcagtcgtgaccggcgccgcacgcggagtcggtgaggccctggcacagcgcctgtccgccgccggaatgctcgtcgcactgctcgggcgcgaggaggagaccctgcggcgggcggccgcctccttgccgaaccgaaacatctacgtcgaagccgacgtcaccgaccacgccgcgctcgaggacgccgcccgacatgtggacaacgaactgggcccggcaagcgtggtcgtagccaacgccggcatcgccgccggcggtccattcacccgcaccgcggccgacctgtggcagcgggtcatcgatgtcaacctcgtcggatccgccaacaccgccagagccttcctcccgcagctcacccacacccgcggctacttcctccagatcgcctccacggccgccttcggctccgcacccatgatgagcgcctactgcgcctccaaagccggcgcagaatccttcgcccaggcactgcgcggcgaggtcgagcgcgacggcatcaccgtcggcatcgcctatctccactggaccggcactgccatggtcgccggcatcgacgaccaccccgtcctgcaagccctgcgacggaaccagccccgcttcgcacgccgagtccacacccccgcccaggtcgccgactggctcaccaccggcatcacccaccgcgcccaccacatctacgcaccaccctggctgcgctggtgccagcctctgcggccgctcttccccgcggtcgtcgcccggatcacccggcgcgaactgcggacccgttcccacaccgagctggcagccgacgtcacggtcctgggcgccggcggtctcgccgactggaactccttcctgtcccgcaaacacctc

SEQ ID NO: 691 - DNA, 645 bp, Streptomyces avermitilis
  CDS (1)..(645)
gtggatggcgcggaacggttacggggtgggcccgccgcagcagtacgtgacccgcagctcttcgaagagttctaccggcggcacgtggacgcggtgatgcgtttcgtggcccggcgcgtcgacgacccgcacaccgcggccgacctgacggccgaaatcttcctcgccgtcctcgactcggtccatacctatcgcccacacctcggcagcgagactgcctggctgtacggcatcgcgcgcaacgtcgtgtcgtcggagcgccgccgggtcgcgcgggaggcggaacgcgatctgcgcttctccggacggcggttgctggaggctgacgacatcgtccgccttgaggacaggctcgacgcggagagccccggccggcatgccctggcggcgctggcgagacttcccgagggcgagcgggccgtcatggagctcgtcgcggtggatcagctcacggtcacggaggcggcggccgcgctgggcatacgccaggtcacggcccgggtccggctgcaccgggcgcgcaaggccctgcgggaggaggcggacgtcaaggccgcgaagacgaatcccgtggccgcgcaggcaagctccccgggagcggagacgccggacgcatcgctgttgtacgtcacaaggggagaagca

SEQ ID NO: 692 - DNA, 621 bp, Streptomyces avermitilis
  CDS (1)..(621)
atgagcatgaggacgacgttcgaggaccggctactgggtgagctgaagcgggagatcgagctgcgcgaggccggagtagccagcaccggaacggctgagttcaagacgggcgagggcagggcgaaggctgccgtgggtcgtctgttcgctccgctcactccgcgccggatggctgccgttgcggcggcctgtacagcggcctggctcgccgcggtgatcatgcccggttcgccggccggctcgaacgcgtgggcggtggatccggtcggagacggcagcgtcaagctcaccgtccaggaccagaacatcagtgtcgcggcccagcgcgagctcgcgaggaaggtgcgcccatggggcgttcacgtgaccgttgacgtgctcgctcccggctacgtctgtgagcgcagcaaagtcgcctctccgctcgtggcgagtgatgaacacggcaaccgtgtacccgtcattccttttaagtccagctgggacgtcacactgcgccggggcaacgtgctgaccttcgagaacaccaaaggcagctcccagcctcgcgcggtcgagttctacgagaccaggagcgaggccgagccctgcgttccgatgaaggttgtcctgccggacgac

SEQ ID NO: 693 - DNA, 1263 bp, Streptomyces avermitilis
  CDS (1)..(1263)
atggaacccccacccctcgtccctccttccccaaatcggacacgctctgtaatgcaacaactacccccagctaccatgtcggccggtctgtcgcggttgggctggctggatgcgttgcgcggcatcgcggcactggttgtggtgttcgaccactcttcgtacgccttcatggcggagttccggcgggagttgatgccgcagttcaacaccagccggtacggcatcatggtgttcttcctggtgagcggctacatcatccccgcgtcgctggaacgccggggctgtgtccggacgttctggatcggacgagtattccgcatgtacccactgtgggcggttgccgtcaccgcggtcctcgccctccacctgatgggaatcgccgagattcgcaccggcttgggcaggcagagccttgccgccgtgaccgtcgcccatgtcaccttgctccaagagctgctggggacgcccagtctccttcttgtcctgtggacgctctcgtatgagatggccttctacctgctggtggttgctctcttcacggtccgccttcatcggcggtcggcagcggtcgccgtcaccctggccgtgctcgccgccgtatgcgggacggcaggggtcgtgctgccggtctccgccctctctggcgcggtgggcaccggcccgctggtcgcggttgcctcgatcaccatggtggtcgccctctgctgtgcgagtgccgtgtcacccgcgcttcgcgtgttcgggggcgtgttgggcggggtgctggcgcttgtcctggcccccttcaacggcacggtccctctgtgggagggcctggtgatccttgccgtgatgttcctcggcaccgccgcctaccgggccgagcacggtcagagcacctggcggtacgctgcgtgcacagccgtcgtggtggtggcctgcgcggtggggagtgcgtaccgatacggcgacgggcctcatttcacacggcgcggctggatcgtggcattcctgctggcagtgctcaccttcggtgccggactggcgttgcgccgccggcgggtaccgcgctggctgaccgggctgggaacgatcagttactcggtctatctggtgcatccggtgctgttggcggtgaccgacggcacgatcggccggtggcggcgggacaatctcatgctcgaagtggcgttcttcgccgtgctgcttcccctgtgcgtgctgacttaccgttacatcgaagcaccaagccagacatggggccgaaagctggaacaccgcgct

SEQ ID NO: 694 - DNA, 561 bp, Streptomyces avermitilis
  CDS (1)..(561)
atgatcaggctctcgctgcccatcaccactgaacggctcacactgcgtccgttcacaccggacgacctcgaagacctgtatgcgtaccagagcctccccgaggtcgcccgctacctctttcggccgccgctgacccgtgaccagtgcgtgcagagtctggcgcggcgcgtggccggcacggcatgggccgaggacggtgatgatctggtggtagccgtctgccgcacaggcggggcaacggtggttggcgaggtcgtcctgaaactggcgagcgcgcgggcctgccaggctgaaatcggctggatcttcaaccccgcgtacggcggccggggttacgcgaccgaggcagcatccgcgaccgcctcgctggcctttgccgagctgggcgtccaccggctgttcgcccgactcgatgtgctcaatagcgggtcggtgcgtgtgtgcgaacgccttggcatgcgccgggaagcgcacctcgtcgagaacgatctcgacggcgagcggtggggcagcgagtacgtctatgcgacgctcgcccacgagtggaaggccgatcgggcc

SEQ ID NO: 695 - DNA, 495 bp, Streptomyces avermitilis
  CDS (1)..(495)
atgctcgggctgcgcaccttggaatcagacgactggcccctttggcgggagttgcgactggcagcgcttactgacgcgccctatgcgttcggatcgacgctggccgagtggcaaggctccggtgatcgagaggaacgctggcgtacccgtctgtcgatccctggcgcgcgggatctcgtcgcgctcctcgacggccttccggtgggcatggtcagcggagtgccgggcggggaagcagagaacgtggagttgatctcgttgtgggtcaaccccacggctcggggccaaggcgtgggtgactacctgatccaggcggtcgaacggtggggggcggagcgcggtgccaggacgctgcggttgtccgtgatgccggacaaccgcaaggcggtcgcgctctatgagcggcacggtttcacggacacgggtgagtccggcaatcttctgcccgccggcgttcgcagggagcgggtcttggcgaagagcctggccaccgtc

SEQ ID NO: 696 - DNA, 1002 bp, Streptomyces avermitilis
  CDS (1)..(1002)
atgaaccgtcgtgtcgtctacacccgtggcgggtcgccggccaacgtcctgaccgtcatcgaggagccggagccggcgcccgggtccggtcaggtcctcatccgcaccaccgccttcccggtgcaccctggtgatctccaggccgtagaggcctaccccgaggaggcgacaaagccggttcccgccggggtggaggccaccggcgtggtggaggcgatcggcccgggaacacgggtggcgccgggcgtcacggtcggcggccgcgtaacggtcttcccgcagccgggggcctggtcccagtggatcgtggcggatgccgacgcgctcgtcgccgtaccggacgagctgtcggacgaggtcgccgcgcagatgctggtgaacccgctcaccacggtgatgctgcgccgtgaggcgcaggagcacccggccttcggatacgacggtcttctcgtgcagaccgccgcgggctcgtcggtcgggcggctgctgacgggcgcgtccctggtgcacaacctggcgctcgtcaacgtcgtccgcagcgaccgcggcgccgccgaactgcgcaagcgattccccgacgtgccggtcgtggcgacagagcatcctggctgggcggacgaggtccgcgaagccgccggcggccgtccggtcagtgtggccctggacccgatcggcgggaagctggcggagagccttctggacctgttgacgccgggcgggaagctggtcagctacgggcagatcggcgaggagccgatctcggtgcatgcgtcgacgctgctgcacaagtcgctgacgctacggggcaagaacatcggccggtggctgtccgaggcctccgccgacagacgggcatccgacgtcgccaccgcgaagctgatcgcgctcacgctcaaggaccagttcgacgtggccgcaacgtacggccttgacgagctgggcaacgccgtggagcacgcggtacggcccggcaagatcggcaccgtcctcgtccgcccctgg

SEQ ID NO: 697 - DNA, 663 bp, Streptomyces avermitilis
  CDS (1)..(663)
atgccgggcagcccgcgcggtctctgcacacgatcaaggaagagcaccatgagcacacacggcaccattggcgtactcggcgcaggagaggtgggacaggcggtcgccgacaaggccgtccgccacggtcatgaggtactcatcggcaacagccggggtcccaggactctcgaagccctcgtgggcaggctggggccgaaggcccgtgcggtaacggccgaggaggcggtgcagccggagctcgtcttcctctcggtgccgttcttcgccgtgccggaactgacaggcctcaccacttgggccgggaagatcgtcgtcgacacgacgaatcagttcgcggcggccaacccctggcggggacggtacgacgtcggtgacctcacgggcagcgagtgggttgcccgccaccttcccggcgcccggctcgtgaaggctctcaacaccctgttcgccacgttcatcgccgcggacccgcggcatgccgagggccgacaggtggccttctacgcgggcgacgacgccgacgcgaagacggccgtggccggcttgctggacgaattcggattcgccgccctggaccttggcggtctgcgggacggcgggcggctgatgcagctggacggtgcgctcagtgcaaagcacctgctgctgcaggacgtcggc

SEQ ID NO: 698 - DNA, 981 bp, Streptomyces avermitilis
  CDS (1)..(981)
atgagttccatgctcgccattcacctcacgcagttcggcgagccggagcagagtctgaaggtcgtggacgttcccgagcctccggctcctgccgccgggcaggcgctgatccaggttgagtacgccccgctcgaccaccacgacctgctcctggcgaggggcgtctatccggtccgccccgaactgccgagtgtcatcggcaacgagggagccggcacggtcctggcggtcggaccgggcgtcacccgcatccgccccggcgatacggtcctgcttcccttcggcaccttcgcctggtccgaacaggtcctggcggaggccgcgaagctgaccgccgtggaccgggccatcagcctcgaacaggcggcgatgctcaccatcaaccccactaccgcaggcctgctggtggagtcgcgtgaccttccggccggctcttgggtggtgcagaacgcggcgaacagcggggtcggtcggtccgtcatcgccttcgccaaggagcgcgggcttcgcacgatcaatatcgtgcgccgcgaggagctcgtcaccgaactcgaggcactcggcgccgacatcgtgctgatcgactccccagacgtggccgtgcgcgtgcgtgcggccatcggcgacgatcccgtgctgctggggttggacggcgtcagtggaaaggccacctcgctcctgctggacgtgctgaccgacggcgccctgctgctcatctacggctacatgagcggcgagcccttcacgcccgaccgtaacgtgctgagggcgaagaacatcaccacaacaaagttctggatgtaccaggacgagtacctgccccgtcatccggacatcggcgcggagtcggcgcggctggtcgcggcgggaaagctcacgttgccctccgcccccgtccaccaggccaaggacttcgccgaggccctcgcgtacctgcagaaaaacggcaaggtcctgctggacttcaacccgcaccgcgag

SEQ ID NO: 699 - DNA, 468 bp, Streptomyces avermitilis
  CDS (1)..(468)
gtgtcaacgccgagatcgacgccttccttgccgccctgcctgccgcagcctgatcggaaggccaccaccatgacagacgacaccgcacaagcgacggccgtgcccagctgggtcctgaagttcatggacgccatcgacaccctggagttcggtgagggcttcgcgcccctgaccgagaacaccgacatgttcttcggcaccgcgcacatccacggcgccgaggccatcaaagcgttcttcgtcaagatcgacgcgccgctgatcatcacccatgaggtcttggagttctggaccgcggacgacggcgtccgcctgctgcgcggcgaggcgaccatggccaggaagagcgaaccggacaaggtggtgcgcgccccgttcacgcacatcttctacctcgaccgggaagagccggtccgtatccggacgctccgcatcactgcgggcccgcttcagaccgacgccgtgatg

SEQ ID NO: 700 - DNA, 201 bp, Streptomyces avermitilis
  CDS (1)..(201)
atgagggacatgcccgtcctgaacaccgccggcgaggaggacagccagttccccgtgcacgtggtgcggaagatgaccgacgccatcgagggcagtaccttgcggctgctccagcacaccgcccacctcgccgcccgcacgaaccccgaaggtgtcaacgccgagatcgacgccttccttgccgccctgcctgccgcagcc

SEQ ID NO: 701 - DNA, 519 bp, Streptomyces avermitilis
  CDS (1)..(519)
gtgtccgaccgcaggagtcacgtcaccttccagcacgggcaggagttcctggccgcgatctccgagcgctggaactaccagatcctgcgggaggtgttcttcggtgtcggccggttcggcgaaatcaagcgagccctgggcatctcggcgaacatcctcactgcgcggctcaacagcctgaccgagctgggcctgctcaccaagcgcgcctaccgctcggacaagccgtggtacgagtacgagctcaccgacagcgcccgcgaactcgtcgttcccgccatcgcggccatcacgcgttgggccgagacccatgcgaccggcggtgacatcacacatcacccactgatgcacacagtgtgcggcaacccgaccaatccgtatctcgcgtgcagcagctgtcaccagccggtggaggcctcgacgctgcggccggtgtccgccgaggagggcggtgaccaggggacgggcgggaggggagcggcctccgcggcgccgggcgaccccggttcgggacgccgt

SEQ ID NO: 702 - DNA, 153 bp, Streptomyces avermitilis
  CDS (1)..(153)
gtgctgggcacccacttcccgcatcccaccgccggccgcgtgatcacgcacggggacgcctaccggctctcgcctgtcttcgcgacccctcaggcgtggctgccccggacaagggttactagtaacgtttcagaactacttctgattcaaaac

SEQ ID NO: 703 - DNA, 207 bp, Streptomyces avermitilis
  CDS (1)..(207)
ttgtcactggacgaccgcatgctgatggtcacggcgtactggagcacgaacttgacgatccgccagctcgccctgctgtgcggcatctcgaagtccgcggtcgaccgcatcatgaagcacctcggtccgctgccagcactacaaccccggcgccgcttcgcgaaggacacggtgctcatcgtggacggcacccccggttcgaggatg

SEQ ID NO: 704 - DNA, 684 bp, Streptomyces avermitilis
  CDS (1)..(684)
gtgattggtgaacctgctcagcctggagccaagaagtatgtcctgttcgatgtcgatggcacgttgatcgatgctgtggacaaccagcgccgggtttggagggtgtgggcggagcgatacggactcgaccccggtgaggtctaccaagtggccttgcggacaaggccgatggagaccttcgcgcaggtcgctccggaccgtgacccgcaggagtgcctggccgcgctgcatgaactcgaggacgaggacgtccggtccggcgtgtatgcggccttcgacggtgcttccgagctgctggacgctctgccgccggagtcttgggcgctggtgacgtcgaattacgagcaccgggtgcgcggccgcttcgcccggaccggcttgccggtcccgagcatcatcgttgatgccgcctccgtcgaggagggcaagccctcgcctgtcccttatctactggctgccaagcggctcggtgccgacccgcaggactgtctggtcatcgaggacgcaccctccggtgtgcggtccgcactgcgtgccgggatgacggtgtggggggtcaacgcacccgtcgcggtggacggcgtgcaccgccacttcggaagcctgcgcgaagcgatccgcgacatcctcgccgtcacttccggaacccgccctcacgagccgaggggatcagcggcagtggaa

SEQ ID NO: 705 - DNA, 903 bp, Streptomyces avermitilis
  CDS (1)..(903)
gtgacgcaacgccaggaaagactgttcgtgctcgaggccagcagtggcggtcgcttgttctccgtgaaccccgacggctccgacaagaaggtcatcgtcaccgggtgcaggatccccgacggggtcgccatcgatgtcctggccgggcacgtctactggacgaacatgggccttccgccggagaacgacggctcgatcgaacgcgtggacctggacggaggcaaccggacaacgatcgtcccgagcggcgtcacgcacacgccgaagcagctgtatctcgaagccgtcggccggaagctgtactggggcgatcgcgaggggatgcgcgtgatgcgctgcgacctcgacggctcgcacgtcgagaccctcgtgcagacggggcagggagaggatgaccgccgcgacgagaccaggtggtgtgtgggagtcgccgtcgacccggccggcggacacctctactggacacagaagggccccagtgacgcgggactcggaaagatcctgcgggccggaatcagcctgcccgccggggaaagcgcggccgaacgcggcgacatcgaggtgctgttcgaggggctgccggagccgatcgacctggagctcgacctcgcggagcgcatgctctactggacggatcgcggggacccgccgcggggcaacagcgtgaaccgctcgccgatgcacccgccggacgcgcagcggacacccgagatcctcttgacccacctgatggaagccatcggcatcgccctcgatccggacggcggccgcatgtacgtgaccgacctcgccgggaacgtctacgcggccggtctcgacggatcgaaccgcagggagatcctcgtcgcgcagggcaacctcaccggcatcgcgcatgccgtgctgccgactggaacgagtttc

SEQ ID NO: 706 - DNA, 984 bp, Streptomyces avermitilis
  CDS (1)..(984)
atgaacgtacacacacccgtccaccgcgtggcgatcgtgggcaccggcacgatcggtgcgagctgggcgacgcactatctcgtccgaggcttcgacgtcacggcgaccgaccccggccccaccgcggagacggccctgcgttcgtacgtggaggcggcatgggacgcggctgcctcgatcggactcgcgcccgaagcctcgcccgaccgcctgagcttcaccgcggacctgcgtcaggccgtcgcggacgccgatttcgtacaggagaacgcgccggagcgcccggaactcaaggtcaagttgttcgccgacatcgacgacgccaccccgccggacgcgatcatcgcgtcgagttcgtcgggcatcacgatgagcgtcatccaggccgagtgccgacgtccggagcggaccgtcatcggtcatcctttcaacccgccgcacatcgtcccgctggtcgaggtcgtcggcgggacgaggaccgccccggagacgatccgggacgtcatgtcgttctacgccgcgatcggcaagaaaccgattcacctcaagaaggagcttcccgggcacgtcgccaaccgcatccaggccgcgctgtaccgcgaggtcgtgtacctggtccaagagggagtgctcgacgtggcggactccgacgacgcggtgtcctgggggccggggctcagatggggggtcatgggtccccatctgctgtggcatctcggcggaggagagggcggcatccagcacttcatggacaccctcatgccgcggatggtggcgtcctggcaggaactgggcatccccgagttcacgcccgagctcaaggaggagatcgtgggcggcgtcctggaggaggcgggcggccgctcggtcgatgaactggccgcccggcgcgacgcgatgctctcggccctgctggccgtgcgcgcccagcacgacccgtccggcccgagcgccacagccggtcgcgggccgaaggaggaagcg

SEQ ID NO: 707 - DNA, 780 bp, Streptomyces avermitilis
  CDS (1)..(780)
atgagcacggcgcccgaagctgccgacttggtgctccacgagcgtcacggcggcgtactgaccatcaccatcaaccgccccgcgcagaagaacgccgtcgaccacgaggccgcggtacagctcgcggcggccgtggatctgctcgacgcggacccggagctgtcggtcggcgtcctcacgggcgcgggcggggtgttcagcgcgggcatggacctgaaggcgttcgccaagggcgagctgcccttgctgcccagccggggcctgggcgggctcacccgcgcgtcggtgcgaaagccgctggtcgccgcggtcgagggctgggcgctcggcggtggcttcgagctggtcctcgcctgcgacctgatcgtcgccgcggaggacgcccgcttcgggtttcccgaggtcatgcgtggtctcgtggcggcggagggcggactggtcaggctgccgcgccgacttccgtaccacgtcgccgcgcgcgtactgctgacgggcgagccgctgaccgccgtcgaagccaaggagtacgggctcgtcaatgagctgaccccgcccggcgccgcgctggacgcggcccgggagctcgcgggccgcgtcgcgcggaacgcaccgcttgcactggcggccgtcaaggaggtcctgcgcgagacacagggcctgaaggagagcgacgcgttcagacgccaggacgagctcacgagcggactggccgccagcgaggacgcgcgggaaggcgcacaggcgttcgccgagaaacgcgccccggtctggcacggccgc

SEQ ID NO: 708 - DNA, 1230 bp, Streptomyces avermitilis
  CDS (1)..(1230)
atgaccaacgaatccgtcttcaccggcctgaaggtcctcgacgtgtcgagcttcatcgcgggaccggccgcggccaccgtgctctccgacttcggagcggacgtcatcaagatcgagccgccgggaaggggcgacccccaacggcggctgagctcggtcccgcccagcccccgggcacaggccaactacagctggcacctcgccaaccgcaacaagcgcggcatggtgatcgatctgaagtcaccggcggccaccgaggtactcaaacgcctcgtcgattgggccgacgtggtgatcaccaacttcccgcacggcacgcgcgagaagctgcacctcggctacgaggaggtcgcgggctggaacccgcgggtcgtctacgccgacatcacgggcttcggcgacgccggtcccgacgccgggcagccgggcttcgacctgaccgccgcctggtcgcgcagcgggctgctggcctccacccgggacgccggggccccgccgacggtcccggtctggggcagcggcgactacatgtcggcgatcgcgatctacgcggcggtcgtgaccgccctgtaccgccgtgagcggacgggacaaggggccagtgtcgggacgtcgctgctcgccgggggcgtctgggccacgggaacgcttgtggccggcgcactcgccggcggcacaccgttcgagctgcacgaccggaaggcgccggcgaacccgctgatcaacccctaccggaccgcggacgacgagtggttcatgctggtcgcctcacccccgcactggccgggactgacgcgggccatcgggcaccccgagctgctcgaggatccccgtttcgcggacatcgagggcttcgtcgagaacgccgccgcgctgagcgaactgctcgacgccgagttccgctcgcagcccttcgcccactggcgggacgccctgacccgggaacgcgtcacgtacagcctcatccagacgccggaggaggccgcgcaggacccgcagctgcgcgcgaacgacatcgtcgtgccgctggaaggagtcagcgggctggcggaaaccatcagcagcccggtcaacatccgaggggtgccgaaggtgccggcgaagcgagcgccggacctgggcgagcacaacgacgagatcctcgccgagttgggattcggccccgccgagatcgccgagctgcgcgcccagggagcgattcccggcccgacggaagccgaggggccgcga

SEQ ID NO: 709 - DNA, 1239 bp, Streptomyces avermitilis
  CDS (1)..(1239)
ttgagggagactgcagtgagcggtacaacgaccttgccggcaccgtccggtccctacctggacaaggggctgctgcccgccgacttcttcgcctacgaggaactgctgtcggacggggagcgagagcagctcgagtccgtccgcgagttcctccgcacgcaggtcgcaccgatcgtcgatgattactgggccagggccgagttccccttccagttggtcgagggcttcgggaggctcggtcttatggactgggccgacccggactccccggaatccaggccgagcaacctcctcgcgggcttcctcgcgctggagttggcgcatgtcgacgcgtccgtggccacgttcgccggcgtgcacacgggtctggccatgggcaccatcctcacctgcggctccgacgaacagaagcggcggtggctgccggcgatgagccgcttcgagaagatcggcgccttcgggctgaccgaaccgcacggtggctccgacgtggccggcggcctccagacaaccgcgcgccgcgacggcgacacatggatcctcgacggcgcgaagcggtggatcggcaacgcgaccttcgccgacctggtcgtcatctgggcccgcgatgtcgagacccgtcatgtgctgggcttcgtcgtggagaaggacactcccgggttcaccgcgacgaagatcgagaacaagatggcgctgcggatcgtgcagaacgccgacatcgtgctcgacggctgccgcgttccggaggccaaccggctgcagaacgcgcactcgttcaaggacaccgccaagatcctgcgccagacacgcagcggcgtggcgtggcaggcggtgggcgtgatgttcgccgcctacgagatcgccctgcagtacacgaaggaacgggaacagttcgggcgccccatcgggggcttccagctcgtgcaggacctgctcgtgaagatgctcggcaacgccacggcctcgtgcgggatgatgacgcgcctggcccagttgcaggacgccggggtgttccgggatgaacagtccgccctggcgaaggcctactgcaccgtgcggatgcgcgagaacgtggggtgggcgcgggaactgctggccggcaacggcatcctcctcgactacaaggtcggccgcttcgtcgccgacgccgaggccatctactcgtacgaaggcacccgggagatccagaccctcatcgtcggacgcgccgtgaccggcggcctcagcgccttcgtgagg

SEQ ID NO: 710 - DNA, 402 bp, Streptomyces avermitilis
  CDS (1)..(402)
gtgaggcaggactgcgaggtgcccgggacggacgcgggcaagcctgccggtgagcgggaggtctaccgggtactggaggaagtccacaccctggccgggtgccgcatgcgggatccagtgcatcgggtgcgcgggatcctggtccactccaccgccgtcgcggcgggcccgcggacgggggctgccgagccgggccatgtcctggccggccgtgcgtactcctcccggaagatccgcgagtacctgcgcgagcggcagatcccgcacgcctacccggagaagcctgaccgggccggacaccgcctccccgcggctcggccggatgacgtccgcccggattcgaccatgggtgatctccttcgaggctggttgccgcctcgtgctcgcgccccgccgggtggg

SEQ ID NO: 711 - DNA, 294 bp, Streptomyces avermitilis
  CDS (1)..(294)
gtgcgccggcaggttcacgaggacagttcccgggcaggcgaggcggcgcgcatggcgtggccgcgacaggcgctggtcgaggacttcacggaccgggtcggtgcgatcgacgtccccgtcctggtgctggccggcagcgacgacaaggtggacccgccgcagatcctgcgggaccacctgcttcctctgatcaccactgccaccctcaccgaactcgacggtaccggccacctgtcgccactggaggtgcccgaccaggtcgcctcccacatcagcgcgttcgccgcccgcctg

SEQ ID NO: 712 - DNA, 240 bp, Streptomyces avermitilis
  CDS (1)..(240)
atgtggcgccaggaaaccggcatcaccccacaccagtggctgctcaccgcacgcatcaaccacgcccgcgaactcctggaagtcaccgacctcggcatcgaacagatcgccgcccaaagcggcctcggaaccagcaccaacctccgtgctcgattccgcgacaccctcggcaccacaccttccgcctaccggcggaccttccaggaaacaaccatggcggggccccaaacccgccagaag

SEQ ID NO: 713 - DNA, 168 bp, Streptomyces avermitilis
  CDS (1)..(168)
gtggcggcggctcggatgtcccgaaaggacgtcgaggacaccatggcgttcagcgccctgcacggcatccgccccatgaccgaaatcgtgccactggaccgcgcggacgaggcctaccagaagatgctcgccggcaaggcccgcttccggatggtgctcacggccggc

SEQ ID NO: 714 - DNA, 1050 bp, Streptomyces avermitilis
  CDS (1)..(1050)
gtgatccataggcgatgtgtcggtggccgccggaaccatgggggtcgagttgcccaagggagcagccgcagccgccttccacagcaagggacccccgtcaccatgtcatccacttcctccaccccgccatggaatgtccaacggctgcccggtgccgatggccgcgtcttcctggtcaccggcggcaacgccggcatcgggtacttcgtcgcggagcagttgtcggcaaccggagccaccgtcgtactcggcagccgaaatccggccaaggccgaggccgccacggcctcgatccgtgcgcgtgtccccggttcgcgggtgcgggccgtacggctggacctcgccgacctctcgtcgctcgaaacagcggtggaatcgctggaggtggagcgtcttgacgcggtagtccacaacgccggcgtcgcgcttgacgaccctccgcgcgaggagaccggggacggtcacgagctcatgttcggcacgaaccacctcgggcacttcgccttgacccagtggctgatgccgctgctgtcggctgcgccggctgcccgcgtcgtgaccatgggcagcttcgcggcaaagtccgagcggctcgacctggacgacctgcagtcccggaaggactaccagcccaagcgcacctacgggcgctccaagttggcacagatgtacttcggcgtcgaactcgaccgccgcctgcgtgctgccggcagcacggtggcgagcgtggtggtccatcccggcggcgcgctggactccctcaccccgtcgcggccaccggtccatgtgcgaagtaccggcgcccggctgagcgcggcacctgcggccctcctcctccagggcaagcacgccggcgcatggcccgcggtccgagcggtgctcgacccggccgtgcgtggaggccagctgtggggaccgcgcgtcttcggcctgcgcggcgagccccgacgtgaaccggtgtgggaccacctcgcggacccctccgtcgcggcgcggttgtgggacgcgagctgcgatctgatgggcaccgacctcagcaccatctccgga

SEQ ID NO: 715 - DNA, 819 bp, Streptomyces avermitilis
  CDS (1)..(819)
ttgccgggcaagtcttcccggcaactggagatcgacggtgaccgggatggggaagcggctcgcgtggtcctgaacggcggcgaccaggccgtggtctgcgagcaccggcgggttgagcccccggatgagactgcgcagctcctggtgggcagcggagagctgctcctcggccgcggtgagctgggcgacgagcggagaaacctcggggatgtccagacgcgcgtgcgggcggagttgcgcgccaactcgcgccgggcggcctccctcaccgctccggtgatcgcggcagtcggcttcgccgtcatgctcagcggcgtggtggagaccatgcgcgtgccgtacccggcgggcgacgcggtcacgctcacgggacaggtgatcgtgacgccggacgggacgccggccaacaccgacgaggtggtcgccgccaacccggtgggcaaggccgcgctgcccacccgagccttcgcccgcgacgagggtggcgacctcgccgtgatcgacgcgctcggctcgcgcgacacgcggtggaacaagccgggccagacgctgctcggcaagcggatggcgaccttcctgggcgatgaggcggggagagcgtggagcccgcctgatctcgttcggctgcctgcacctcaacgacgggccaccgcccacggccgtccgggtcgaagacgtccgcgaccgcctgcacgacccggcagccgcccgcgacatcctcgacctcgacgccttccacccacgcgtccagaccgtcgtgctgcacaccccaggtgcccaggaactgctcgccaacctgttggccaacgcgcgcgtgcc

SEQ ID NO: 716 - DNA, 1005 bp, Streptomyces avermitilis
  CDS (1)..(1005)
ttgagttccgccatggagcgcatggagatcctggtcctcggcggtacggcctggctggggcgtgaagtgtcccggcaggccctcgaccggggccaccgcgtgacgtgcctggcccgtggcgacagcggtcccgtggcggaaggcgcgcgcctggtggccgcagaccggcgagaccccgccgcgtacgcgtccctgcccggccgggaatgggacgctgtgcttgaagtttcctggcaacccggtttcgtacggaaagcagttgcggccctgggcgcacgggcacgtcactggatttacgtctcctcggtcagcgcatacgcctcccacggtgagcccggtgctgacgagtccgccgccctgctgcccgccacagaccgcgaagaggtcgaccgtgaccggtacggcgaggccaagtccgcctgcgaaacgctcacccggacggccctggccgaccgcctcctgatcgcgcgcgccggactcatcggcgggcccggcgaccacagcgaccgctccggctactgggtcgcccgcgccgcccgagccccccacgcgccgctgctcgtccccgacaccccgaacgccccgacgcagaccatcgacgtgcgcgacctggcgacatggctcctcgacatcgcagaacaccgaaccacaggcacctacaacgcgcttggcccggctgtgcccttcgccgagtggatcgagctgtcccgcagcgtcggcggacacaccggagcggtcatcaccgtgccgtcccagcagctcctcgcgcacggagtggcccagtacatgggacccgactcactgcccatgtgggtggtcgaaccggggtgggagggctgggcggcgcgcgacggatccgccgccactgccgcgggcctgcgccaccgctcccgcaccggcctcctcgccgacacactgcgctgggaacgcgagcagggactgcaccggccacgccgcgcgggactcgccccggacagagagcgcgaacttctggcgtccttcgga

SEQ ID NO: 717 - DNA, 603 bp, Streptomyces avermitilis
  CDS (1)..(603)
gtgtcccgacctctcgagagatcgttgctcgcaccgccactgcggccgcaccataagagtccggatgttatgggctccagctcagacctggtgcgaggcgtcattgacgatcggcgcatgatggccgtcatggagaacgtggtcgagaagatcaaggtccgcttccggttcatccctcgcgaggggtggttcccgcaggacaccgagggcctgtgggcgacgaaactcggcgacgagacggcgagtgtgcagaacgctcccttccttcaggacgggatcgccgagggcgatgtagtgcggtaccgaaccgactccgacgggctccactgggctgtccaccgggtcagttcctccggcaactgcacgatccgtgtggtgcccgtgcccaccggtcccctcggacgtaggccgcaggcggtgcgtcagcgcctttcggcgttcgggctcggaggcgaggtcttcagcgaggacttccccatggtggctttcaccgcaccggcaggcgcggacttcgccgggatcaaggccctcctgaagcgggggcgagacgaaggatggtggcactacgaggtcggctgtggcaccgacgaatggtggaacgcc

SEQ ID NO: 718 - DNA, 261 bp, Streptomyces avermitilis
  CDS (1)..(261)
gtggggtgctccgtcctgatcgttcacgcgacggagcgtccgcggctcgtcgagatccgcgacgacctcctcgcacggattctggaagccgaacgcgagggctggctcggcgagatcgaaggattgcagagcagcctcacccacgccgacgaaacgatcgcccaactcgacgcgcagatcgcccggaagcagggagccgtcaatctgggtgtcccgacctctcgagagatcgttgctcgcaccgccactgcggccgcacca

SEQ ID NO: 719 - DNA, 951 bp, Streptomyces avermitilis
  CDS (1)..(951)
atgatgctggtgaacagcccagagccggtcatcgacgccaatctcgccatcgcgctggacgccctcctggccgagcacagcgtcacccgcgccgccgcccgcctgcacacctcgcccgccgccatgagccgcaccctcgcccgcctccgtcgcatcctccaggaccccctcctggtccgggccggacaggccatggtccccaccccacgcgcccagtccctgcgcgacgaagccgccgcggtggtacgcagcctcggagcactgctcagcccaggcacaggcgtcgaccccgccgacctgcgcagcaccttcaccctccaagccgccgacctggtcggcgcggcactggcgcctggactgctgcacctggcccagcaggaagcgccgggggtctcgttccggctccgggccgaggaactggaggccggaaccgccctgcgcgacggccggatagacctggagatcggatccatcgaccacgtggaccccgaaacccaggtcgaagaactggtcagcctccgcatgatggcggccgtccggcccggccaccccctcaccgaaggacccctgaccccggcccggctcgccgccgccgagcacgtcgcggtcagccgccgcggccggttcagcggccccctcgacaccgccctggcggagcagaacctccaccgccgggtcagcttcgtcctccccagccacctggccgcaatgaccctcgccacccgcagcgacgtcgtctgcctcgtacctgccgcaccccccggcgccgccccctcccccctcaccgacgacgccatcgccctcggactgtttctcctcgacatccccctggaactgcctccactgaccatcggcatggcctggcacccccgacacacagccgacggagcccaccactggctgcgcaacgccatccgccgaaccctccgcacacccggaagcccaaccaca

SEQ ID NO: 720 - DNA, 891 bp, Streptomyces avermitilis
  CDS (1)..(891)
atgatcgttattaccgctcccaccgggaacatcggccgtcacctgctttccaggctcctggagtccgcccccgccgcgggtgaggaactgcgcgtgatcgtgcgcgaccccgcccggcttccggacgcggcgcgcggacgtgtcgaggtgatcaccggctcgcacgcagacaccgaggtcctcgaccgggccttcgagggtgcggacgccgtcttctggctcgtccccccggacgcctccctggccccgcacgacgcctacagcggcttcacccgccccgccgtgaaggcgctcgccgtccacggtgtcggccatgtcgtcggggtctcggcgctcggccgcggcaccccggtcgccgaccgcgccggcctggtcaccgcctccctcgccatggacgacctcatcgccggtaccggtgttgcctaccgggccctggccaacccgtccttcttcgagaacctcctggaggagtccgactcgatccgcgacaagggcgtcttcaccgacaccgtcgacgccgaccgcaaggcccccctcgtcgctgtcgccgacatcgcggccgccgccgccggcctgctgctggaccgctcgtggaccggcaccggcagcgtcccggtcctcgggccggaggacctgtcccccaacgacctggcccgcatcatgaccgcacagctcggccgccccgtccgctacgaacgccagccgctcgacgagctgtacaccaccctcgtcggctacggcctcaacgaggcattcgtccagggcgtcgccgacatgaagcgagccaaggacgagggcctcgacgccggtgtcgcccgcaccccggacaccgcctcccccaccggcttcgagcagtggtgcgcccagaccctcaagcccgccgtcctctcc

SEQ ID NO: 721 - DNA, 363 bp, Streptomyces avermitilis
  CDS (1)..(363)
atgcccactgaggaaaccgaaccgccggtcacggcgttcatgctcgtcaagaccacacccgagtggctcgccctgaccgtccaggaacgtgtggacgccttcaccacccaggtcctgcccgcgatcgaggccaggaccagcggcgtcaggtcacgcttctacgacacggagttctactccgctcgcgtcaccgacgtctgggtgtgggaagcggaagaccaccacgcctaccagctcctcatcgacgcactgcgcgaaaccccgttctgggaccgctacttcgaggtcgtcgacctcctcgtcggcaccgagaacggctacgcccgcacctacggcctcgaacccgtcgccaccatcaccacc

SEQ ID NO: 722 - DNA, 231 bp, Streptomyces avermitilis
  CDS (1)..(231)
atgcgccggcggaccttggccagtcggatcagctcagagatggccgtgtcggtcggcaggttggacaaccagtactcggtgggtgcctcggcgccgtcgggccattcgatcagcagccggcagtccggcaggatcccgtcccaccagccttgttctgccgatgccgtggctttgatcgggcgctcgacggctttgccggccgtacggacgtatggcggcgaagcgggaacg

SEQ ID NO: 723 - DNA, 630 bp, Streptomyces avermitilis
  CDS (1)..(630)
atgaactccatcgcctccgtcacccttgaggtggccgacaccacggccgccgcccgcttctactccaccgccttcggactggactcgtcgcacgtgcgcctgcgcgcctccgaggcccccaccaccggtttccgtggtttcacgctgtcgctcgtggtgtcccagccgggcaacgtcgacgccctcgtcggtgcggccctcgacgccggcgccaccgccctcaagcccgcctcgaagtcgctgtggggctacggcggcaccgttcaggccccggacggcacgatctggaagatcgcgacgtcgacgaagaaggacactggcccggtcacccgggacttcgacgagctcgtgctcctgctgggcgtcgaggacgtgaaggccagcaagcagttctacgtcgagcagggcctcaccgtgggcaagagcttcggcggcaagtacgtcgagttcgccaccgggtcgggccccgtcaagttggccctgtacaagcgccgtgctctcgccaaggacgcgggtgtccccgccgacggcaccggatcgcaccggctcgtgctctccagcgccgccggcccgttcagcgacccggacgggttcgtctgggaagccactgccccgctggccgccaccgcc

SEQ ID NO: 724 - DNA, 1443 bp, Streptomyces avermitilis
  CDS (1)..(1443)
gtgctcagcaggaactcaccggtcgaagaagccagggcgcccaggtggcgagcaaggagcaggcgcgccacggccgttgttctgctcgccctggtggccggcacggagctggctgccggccctgtcgctgccgcgccgcatgcagccgaccgcgtggatggcgtgtggcgcttggacggctacggcaccgtgctgtccgtcgaggacgggcggctgcgggaataccagacgaccgccgtcagctgcctgcgcggcgacaccgcacggcgcacaggccaggccggcaactcggtgatctataccggcgacgacacgaccgtctaccggatacgccccgcagcgggcaaagccggcgcgaccctgcacttcgacggctcggtcggcgaccgccggctgcggcgccttccggcactgcctgccagatgcaccgaggctgcaccgacgggagcgctggcgaccttcgacgtcttctggcagaccttcgaggaaaactatcccttcttcgcagccaagaagaccaactggcagacagtcagggaccgataccgtccaagggtctacgacgggatgccggacaccgagcttttcgcccttctgcgggagatggtgctgccgctgtacgacgcgcatgtgggtatcgacgccggtgacaccgggagcttcgcgcagagccgccccggcactatgccccccggccccggactcgaccagcaggcccagcgcttcgtcgagcagcacgacctcgccggcatgcggctgcggaccttcgcgaacggccgtatcgggtacgcccggttgccggacggaaccggctacctgcgggtctccggcttcggcggatacgacggcgacagccctgcctacgcgcgcaacagcgccgtcctggatgagacgctgagccaggtgatcaggccggggctccggggtctggtgctggatctacggatcaacgggggcggttccgacgcgctggcgctgcagattgccgagcgcctgaccgatcccgcgtacgtggcctacgccaagcgggcacgcaacgacccgatcgacccaggtcgccacacccgcccgcagccggtacgcgtccggccggcagccgaccggttccggtacaccggcccagtcgcagtgctcaccggcggtgagacctacagcgccggcgagaccctcacccaggccctcatacagcgcccggcgaggaccgtacgcattggacagaacacgcagggcgtcttctcggacgttctggagcgcaccctccagaacggctggtccttcggcctgccgaacgaggagtacctcaccccgtccggcggcaagaccttcgacggcgagggcatcccccctgacatccgcaccggcaacttccttgaggagatcgccaacggaacccacgactccgcgttcacacaggctctcgcggtaatacggcgccgcgccgag

SEQ ID NO: 725 - DNA, 180 bp, Streptomyces avermitilis
  CDS (1)..(180)
gtggttcgtatcggcatcccggagccgtacgccactcggcgcaccgaggccatggccgaccgggacaacgccttctggggcgaggccatccccaccatggaggagataaccggcaggaaaccgcgttcgctggccaacttcctgtccgactacgcgaccgcattcgcccggcagccgatc

SEQ ID NO: 726 - DNA, 204 bp, Streptomyces avermitilis
  CDS (1)..(204)
gtggatgtcgatctgcgcaagctgcgctactgcctggtggtggccgaggagttgcacttcggtcgggccgccgagcggctgcacatcacccaaccggtgccgtcccggcagatccgcgcgctggagcaggagctgcacgcgcggctgttcaccaggaacaagcagaccacggtgcgcgcctcaatccgactctggctccgccga

SEQ ID NO: 727 - DNA, 831 bp, Streptomyces avermitilis
  CDS (1)..(831)
gtgggttgcggcttggcggcgcgatggtcggcgacgttgatgcggttgccgcacaggtcgtgcggttcgggaatcagggtgcttcccgctgcgttcggtgaacagccactcctacgcccctgcttcgtccaggagacctcgcccatgtcagagctggagatcgatgccgtcgtgttcgacgtgctcggcacgctcgtcgacgaacccgccggtatccgcgccggcattcgtgaactcgacccatccctcgacgatcccagggtcgagcagcttttgtcgctgtggcagcagcacatcgaccgcgagcaacgtcgcatcctcgacggcgtccggccctacctcaccagcgacgtcctcgacctggaagccgcccggctcgtcgccgacgccgtcggagtcgacgacccggccgccgtagcggcgctggccctgtcggggcgcaggctcccgccgtggcctgacaccgtggcagggctcgcccggctcgccgaacggttcccgctgatcggactctccaatgcgagccggacggcgctgctgggtctcaacgcgcacgccggactgcgctggcaccaggccctgtccgccgaagacgcccggacctacaagccggacccagcggtctaccagctggccgtcaccgtttccgggcgaccgccggagcggctcctgatggtcgccgcccacgcctgggacctgcgcggagcacagagccttggcctgcgcaccgcctacgtcgcccgccccgtcggcgacccgcccacctcctcggacgggttcgacctgcacgccgacgacctggccggcatggccgaccgactcgaccatgcc

SEQ ID NO: 728 - DNA, 174 bp, Streptomyces avermitilis
  CDS (1)..(174)
gtggctgcggacgagaaggcccaggccaacggcgagcaggccaagggcaaggtcaagaaggtcgtcggcggtgcggcgggcaacgagtccctgaagggcaaggggcacgccgaggagtccaagggcgacctgcgcgcggccaaggagaaggccaaggacgccatcaagcgcaag

SEQ ID NO: 729 - DNA, 168 bp, Streptomyces avermitilis
  CDS (1)..(168)
atggttcctgttcttctcgttcttctgctcgctctgatcctcttcggtgccggtttcgcactcaaggccctgtggtggatcgctgtcatcgtgctggtcgtgtgggtgctcgggttcgtgatccgtcctgcgggaagcggcggtaagcggggccgctggtaccgctgg

SEQ ID NO: 730 - DNA, 351 bp, Streptomyces avermitilis
  CDS (1)..(351)
atgagtgacagcatctggggctaccagccgaccaccggccacaccgcgggcaccgacctgatcggatacaaggtcgaggccaccgacggcagtatcgggaaagtcgacaagcactcggacgacgtcaactcctcgtacctcgtcgtcgacaccggcgtgtggatcttcggcaagcacgttctgctgccggccgggaccgtgaagacggtcgaccaggccgagcgcaagatctatgtcgacctcacgaaggagcagatcaaggactccccggagttcgacaaggacaagcacgccggtgacgccggctaccacgagcaggtcggcagctactaccagagccaccgacgcgtc

SEQ ID NO: 731 - DNA, 837 bp, Streptomyces avermitilis
  CDS (1)..(837)
atgacagtgaccgaggcaacaagagcgcggacggtggcgctgccggagatagcggacccctcgggggtcgctcccaaggatgcccgtcaattgtcccggctgttcttcgacaggctcgccgttctggaagagggcacgcccgaataccagtacgcacgtaacaccctcatcgagatgaacgtcaccctcgtccgtttcgcggccgcgcgcttccgcagtcgcagccaggacgagatggaggacatcgtccaggtcggcacgatcgggctgatcaaggccatcgaccggttcgaactcacccgcgaagtcgagttcacctccttcgcggtcccctatatcgtcggtgagatcaagcgcttcttccgcgacacctcgtgggccgtgcacgtccctcgccgcctacaggaagcccgcatccagctcgccaaagccaccgaggagctccaaagcaggcttgaccgcatgcccacggtcaaggaactctccgagctgatgtgcctgagcgaggaggaggtcaacgaagcacgtctggcttccaacggctacacctcctcctccctcgacgccaccatcagctccagcaacgacggcgaagccgcgctggccgacttcatcggaaccgacgacaacgccctcgaactcgtcgaggacttcaacgccctggcccccatgatcgccgaactcgacgaccgcgaacggcgcatcatccacatgcggttcgtcgacgaactcacccaggcccagatcggcgaacacctcggcgtctcccagatgcacgtgtcccgcctgctctcccgtaccctcgccaagctgcgcgaaggcatgctcaccaccaac

SEQ ID NO: 732 - DNA, 993 bp, Streptomyces avermitilis
  CDS (1)..(993)
atgaacggaatgatcgggagcgtgttccggactgcggacgtgcctgcggacaaccggttcgactattggtgggaactgatcggccggacccgctcaagcgagatcatcagtgctcacgccgctgacttctgggcggagtaccggctgatggagttaggtccggtggccgtgtggtcggcgtcgttcctgccgtcgcgttaccggcggagcccgagaatggtacgtcagtccgatcccgagacgtaccacctgacgctgctgctggacggcggactggctctcgaccatgccgggcggaccgacacgttcggtccacgtgacctgcacctggccgacagctcacggccgtacgatctccggtcgacgggcgatcgagagcaccacgtcgtcaagggagtggccgtggacttccccaaggcgctgctgcccctgccaccgcacctggtccgggggttgctgggccgggggttgtcggggcgggagggcctcggtgctctgctgacggacttcctcgtcggcctggaccggcaggccgacactctccagccgtccgacgcgccacgtctgggcacagtcgtactcgacctgctgtccgcctggctggcccaagtgctggacgcggagaccgccctgtcccaggagacccgccgggtggccacggcggaaagcatccgggcgttcatccgacagaatctgcacgatccggagctgtcgccacccgtgatcgccgccgcgcatcacatatccctcagctacctgcaccggatcttccagcaacaggcgcagggcgaaacggtcgcggcctatatccgcagtcaacggctggaaggcgcctgccgcgacctggccagcacctcactgcgcaccactcccatctacgccgtcgccgcccgctggggcttcctccacgcctccgacttcacccgcactttccgcaccgcctacggccgctcccccaaggaataccgccttcaggcgctgtacgtgccggag

SEQ ID NO: 733 - DNA, 399 bp, Streptomyces avermitilis
  CDS (1)..(399)
atgatgtggaaacgcatattcgcaacgtccgcagccacgctgacactcctcggtggcagcatgctggccactgccgcaccggcacaagcagatggcacctgcccttcgaacgccctctgtatatgggattcgacgtccttcggcggcctcagaatcctgacacgcagcaccaacacctgcttcaacatggggaagttcgacttcggttacatccggtcctacgacaacaacctctccgtcaacggctacgtccacaactacgccggatccggtgtctggtaccaagcccgcactcttccggccggcgggttcagcagtgacatcggtgttccgggactcggcggtctcgcggaggactgggtctgcatgggttcagcagatctgagcgacttcgtctac

SEQ ID NO: 734 - DNA, 555 bp, Streptomyces avermitilis
  CDS (1)..(555)
atgacgccgccacacgcccgcacctggggccggcgcggacagactcccgtagtcagagtgcgcggacggtcccggcgacgcatctcggtcgccgcactgtgctgctaccggcccggcgaaaggtcccggctgatctaccggccccgcttccacctgctcctcaaaggagcacgcaagagcttcgcctggcaggactaccgcgacctcctggtccgcgcgcacctgcagctcggcgccccgatcattgtcgtctgggacaatttgaacacccaccgtgctgccggattgcgggagtacgcaggcagccacgaatggctcaccatcatccagctgccctcctacagcccggacttgaatcccgtggaaggcatctggtcgtggttacggcacgggccgatggccaacaccgcattcaccgaccccgaccacctcacccgcaccctccgccgagggctcgcccacatccagcgtcaccccgagctcattgacggctacctcaccgaaaccggactgaccctcaccccagatcccccgaagccaatccgaaaaggtcag

SEQ ID NO: 735 - DNA, 537 bp, Streptomyces avermitilis
  CDS (1)..(537)
atgcggtacgcggatggtgggggcctgaccgctgagcggcgggctgcgcgtgaagggatccggctggaggccggggtgaggttcgcacgaggtgacaggacttcggacatcgccaaagacctgcgggtgagcgagcgttcggtggagcaatggcgccgcaactggcgtgaaggcggtatcgagggtctgaagtcgaagggacctgcgaaactgccgaagctgtcggacgaacggttcgccctgctggaaaaggagctggccaaagggccggccgcgcatagctgggaagaccagcggtggacattggaacgcgtcagaacgctgatcggccgccagttccaggtcagttgctcgatcgcgggagtgtggcggctgctgcaccgccacggctggtcctggcagagcccggcccgtcgcgcgctggaacgcgacgagcatgcggtcgagctctggaagaaggacgtgtggccgcaggtggaagtgccgcggcggcgctcggggcctacatcgtcttcgaggacgaggccgggttcgcga

SEQ ID NO: 736 - DNA, 972 bp, Streptomyces avermitilis
  CDS (1)..(972)
gtggcttcggcggacaacggaacggtcacccgtaccgcactcgcctccgacacggaattcaccacagggggcgctgtcgaactgatcggacgatcgataacgctgggcgccggtgaatcgcggcacgtgcgcgcccggttggaggcgacgagttcgacgaccgcggtcgtggggatgacgaacgccatccgatgtgtgaactcgtcaggcgtcaccgtaggtgtcaagtcggcctccgcacgcaatcacgagggctacgacacgacctcgtatgcgacggcaggacacctgccgatctacgcggacctgctcttcaccgcgccgtcggcgggtacgtacaggtgtggccttgtcgggtcgacatactcgacctccggttccgcctaccacctcaccgcggttgcgggaaacacctggatcgagatcagcgacaccgcccaggtcggcgcgggatggtggcagaacccctcgtgcgaaagcgccgataccaacggtgcctgcacatacgtcggcggaggggcggcggattccgaggcatgggtcttctacggcgacggcacaccggcgtccaaatgggaggctcacccctccgcgagaaccgtcgacgcgcaggcgaacctcgagctgacgacatgtcccgtcggcaccgcttcctgcgcgagtgcgatgcaggatcaccctcgcggcgagaacgcggtcgtggaccttcgattcgacttcatccagctcgacacgactgggcacgcctgcgcgactcatcagcagtcgtcacgtaaaaccatcacggacgacgcccatcactccgtgagctacttcgcgctctccgacatcccgatcaactcggcctgcggcacacggacattcatcatgcgcatctacgtcaaacacgtcgaggggcagaccctcaagatcgacggcgtgcagagcggggtcacttcgctgacgaacggaatcgcgttcaatcgcttttcc

SEQ ID NO: 737 - DNA, 1131 bp, Streptomyces avermitilis
  CDS (1)..(1131)
atggcgagcgtagacatggtgggaggggatgccggtgagcggtacccctgggtcaccatcgaggcgtgggccaagggtggggaggctgagcggatcggcgcggtcggtgaggcgctcgccgcggaggctcagcagatcgaggaacgactgagggtcctgcatcgcgacctcacgttcgtgcagcgggtcctggcactcactccggggcgaccgttcatggagcgacttctggccctgagtcgtcaggtgcgctattcgggggcgagcgacgagcgcctgctcgcgtcgctgatcgcggaggcgcagtccctcgacgacgcgctgtacgtcctgcggcatccggaaggcgaagagcaccatgcgctacgggcctgtctcttccacgagttgctcttgcgcggggcagcccccgacaagctggtcccccacgccacccagcgccccgatttccgcccgttccactggagcggcctttcctggttgccggcccggctctcggagatggaggggccggacctgagggcgtggttgccgaaccgtcgctatcaagggggtgcctccggaaccgtcccgacgatgaaatcgccgacgcctgtcgatgtggctgcacgccgggccggcgccgcccaccgcgtccgggaggccacgcccgcgcatctggccgacctgatcggccggccggccaaagacggcagatggtgcgaccacgaagcacgggtcttcgttctggacgagcccgtctctccggagaatctgccgggagtcgtgaccacgttgccgttggactgcttgcaagggctgggtgagcgggaccggttcgagggtgaggcatgcacgctcgactcggtctggctgacgttgttcatgactgcctcggccggcggattcggctcagcgggcgtccacggtgcctgggggcgtttcagcgcgtggctctccctcgcgggactgtgcggagccgagtaccccgaggcaagcgcttccgaggtcgaggagctggcccgggcctgtacgtggtaccggttcgaggccgacaccgaatggttccacaacgacctggacgactacggcatcgtcgccctctcccccgacggccgccgtatcgccgtactcgccgcgacggacaccgac

SEQ ID NO: 738 - DNA, 1359 bp, Streptomyces avermitilis
  CDS (1)..(1359)
atgggtagatttagttcgagcggacgggccgtcgtccgcactgtcacagcattcctgctcctcgccgccacggccgtggccggtcccaccgccaccgccgatagcggcagccactcggcgccgtcggcggatcccgcggcgatccgcgagtggaacgtcatcgccaccgacaccatcaccgccagcctcggcgcccgtccctccgggcaggccgccatctggcacgggttcgtctcggccgccgtctacaacgccgtggtcggtatcgaggggcgctacgccccgtacaagtggcatgcgcgcgggccctccaccgcatcccccgaggcagcggccgtgaccgccgcgcaccacgtactgctcacctacttccccgcctcccgggccccgctcgatgccgcatacgccgggtcgctcgccaagatccccgagggccaggcgaagaggcagggcgtggccttcggggaacgtgccgccgagcacctcatcgaactgcgcgaaggggacggccggttcgcaccggtggagttcaccgcttcgcccgcgcccggcgtctggcggcccaccccgcccgcctacctgcccttcatcgacacctggctcggcaggcttcgcccgctgctgctcacttccccggatcagttccggccgggcgggccgcccgctctttcctcggcccgctacgccgaggatgtgaacgaggtgaagaccatgggggcgaagagcggctcgtcccgcactgccccgcagaccgaaaccgccctgttcttcgggggcaacctggtggtgcagttccaagaggcgttccgggactacaccgcccggcaccatctgggcatcgccgagacagcgcggctgttcgtcgcggggaacgcgtcggcgaccgacgccgtcgtcgccacttgggacgccaaactccactacggattctggcggccgatcacggcgattcatctggccgacaccgacggcaaccccgcgaccgaagccgacccgcagtggcagccgttgctcgtcacaccgccgcatcccgactacgtcagcggccacgccgcggtcgccggcgccgtgacccagaccctgagcgggattctcgggaccacacgcctcgacctcaacgtctcctccgagatcaccggcaccacacgacactacgaatacgccgaccagttcaacaaggacatgatcaacgcccgcgtctggtccggaatccactcccgcacggcggacaccgcaggctgccgggccggcaaccgcgtcggcgcctggacattcacccactacttccaaccgctgcactcaccgcgcctgcacgccacgccgccgatccagccgacgtgcccgctcggcagcgcgagc

SEQ ID NO: 739 - DNA, 444 bp, Streptomyces avermitilis
  CDS (1)..(444)
ttgcacacgcacttcgcagggctcgatgagttcgtggccgagctctgcctcgaccggttcgcgcggacggcggcgaaggcgcaggcgctgtcggggctcgccgggcagggcactgtggcgcggaacctcgacgccgtcgccctcgcgctgttcgactccggcggcccggccatgtcgggcctcgccatgacccgccccgccgccgcgctgcgcatccgcgaggctctggtagacggggcgcccggcttcaccgcgatccaggaggccatcaccggctacctgaaggccgagcgggggctcggccgggtggcggagaccgtcgacccgcgcaccgtggccctcgccatcgtcggcaccgcccaccacctactgatgaccagctggccgggcgcacctgacccacgaccgcatatggcgcgcctggtggccgcgttggtggacagc

SEQ ID NO: 740 - DNA, 792 bp, Streptomyces avermitilis
  CDS (1)..(792)
gtgcgtgtgcaacagccccttggcgcagcccgcctcggcggtgacggaccggcccgcgcggagcgggagggcatcgccaacgcctccttcacgcgaggcgacgtgcaggtgtaccccttcgaggcgggcgcgttcgacgtggcgatcagccgctacggggtgatgttcttcgccgaccccttagcggccttcgtcaacgtcggccgggcgctgagacccggcgggcgcctggcgttcgtctgcccggccgatgccacgctcaacggctgggtggcggcggtggcgtcactgcgcgacttcctgccgctcggcgacttcgggagaccgggacagcccttggccgccccggaccgtatccgccacgtcctcaccgtggctgggttcaccggcatcaccatcaaccaggcgcagacgtacggggcatggggacacggagccgaggacgcggcggagttcctgctgggaacgggccccggtcgccacctgatggagcaggccgacgcgactgcacgggcccgcgcccgccgcaccctgacgggccttctgcgcgaccacgaggcggcggacggcacggtccggctacgcagcacgtcgtggctggtcacggcggaccgcccggccgacccatcggacacgccccagggccggccgccggccaccggcagctcagccgaacaggccgagatctacctggcccactatgccgccgtgcatggaccctcccgaggggttggttcgaggccgccggggccgccacaagtggccccggcggcgtgctggacggtcatgcct

SEQ ID NO: 741 - DNA, 1086 bp, Streptomyces avermitilis
  CDS (1)..(1086)
gtgcggactgtcggagtggaggaggagctcctcctggtcgacccggagaccggagagccgaaggcgctgtccaccgcggtgctcgcccgggctgagcaggtcgatccggaccaggacgtgttcgagaaagagctgcacggccagatgctggagttcgccacgcatccgcagacggacatggcggccctcggtgcggagatcgtccgttgccgcaaggaggcggctcggcacgcgggggaagccgggtgtgcggtggcagcactggccacctctcccctgccggtcagcccctccatcgccatgaaccgccgctaccagtggatggccgagcagtacggcatcgccatgcaggagcagctcacctgcggatgccatgtccacgtagctgtcgagtccgatgaggagggcgtcgcggtcgtggaccgcatccggccctggcttcccgtgctggtcgcactcagcgcgaactccccgttctggcagggcagggactcgtcctacgagagctaccgcagccgcgtatgggggcgctggccgtcggccggtcccaccgagctgttcgggtcgccggagcggtaccaccggcaggtggcggacatggtggccaccggcgtcatcctcgacgacgggatggtgtacttcgacgcacgcctgtcccaccggtacccgacggtggagatccgggtcgcggacgtctgtctgcacccggacaccgcccagttgatcgccacgctcgcccgcgggctcgtggagagcgccgcgcgcgactggcgggcgggccgggaaccggaagaccacagcgtgagcctgctgcggctggccgcatggcaggccgcccgggccggcctgtcgggggagctgctccatccggtgaccatgcggcggctgcgggccgagtcggtagtgcgtgctctgctggagcacgtcggtgacgccctggctgacgcaggtgaccttgacctggcccacgaggccgtggccgagctgctggagcgcggcaacggtgctcgggtgcagcgcgagctgctggagcggaccgggagcctgcgcgacaccgtcaccgagtgcgtacgccaaacccagggg

SEQ ID NO: 742 - DNA, 387 bp, Streptomyces avermitilis
  CDS (1)..(387)
ttgcagatcaccgcgtccaccgtctcgctcaccgtcgccgacgtcgccgcctcccaggcgttcctcaccgcccacctgggctacaccgtccaggccgccgccgacggcttcgcctccctcacccgcgccgacgcggtggacatcgtcctgctcgcccgcggcacccaggtcctgccgcccgaacagcgcgaccggcacgccgccggcctgatcctggccttcaccctcgccgacggcctccacgaccaggagaagcgcctgcgcgaggcgggagtcgagatcaccatgccgctgcgcgaggaaccctggggtgagcgcctgttccagatcaccgaccccaacggagtgatcatccagttcgtcgagtgggccacgtccgacgacacc

SEQ ID NO: 743 - DNA, 189 bp, Streptomyces avermitilis
  CDS (1)..(189)
atgttcgaactcgaccgcaccacggtttctgccctcacgatcggcctcggcgaagtcccggccgggcgcgacgtccgcgaccccgcgccgcgcgggggctacgaccttcgccgcctggccgccgaccgggccgtgcggggacggcgtgagccccgggtcgtccgcaacatcccccgccgccgcggctac

SEQ ID NO: 744 - DNA, 651 bp, Streptomyces avermitilis
  CDS (1)..(651)
atgggtaccgagatcacatcgcccgcacaacccgtcggcctgcgggaatccaagaagcacgagacccggcagctcatctccgaccacgccacccggctgttcctcgcccagggcttcgagcagaccaccatcgcggagatcgccgccgccgcccgcatggccaagaagaccgtcaccaactacttcgcccgcaaggaagacctggccctggaccaccaggaggagttcaccgcttcgctggccaacgccgtcgccgaccgccgccccggcgaatcggccctggccgccctgctccgcgccttccacgactccctcgccacccagaacccggtcgccgggttctccggcccggccttcgcccgcatggtcgccgacagccccaccctgaccgcctgcctgcgcggcctgcacgaccagcgcgaacaccgcctcgcccaagccctggccgacgccaccgacaccacacccgacgacatcaccgtccacatcgccgccgggctgctgggcaccgtccaccgcgtgctgttccagcgcatccaggacctcaccctggcgggccaccccaatgaccggatcgcccacaccatcaccgccgaagccacccaggccttcgacctgctggaacccgccctcgcccactacgccaccgcc

SEQ ID NO: 745 - DNA, 1038 bp, Streptomyces avermitilis
  CDS (1)..(1038)
gtgacttcgccgaagaggacgcggacgactacctcgcccgtcgcctgtcccgcgacgggcagcccctcatcgcaggcgacatccgcgccgtcatatcccgccgttcgcacggcttgccgctccacctggacctgtcggtcacgagatatccggagacccgccgcaccggccgtaccccgcagtccgcagtccgccgacttcgaagccgacttcccggcgctggtctcccgcaccctgtccgacctcacccctggcgaacggcacgtcctgcgctccgtcagcctcctggactccttcgacgtgccactcgtgacccgggccgcggggacggcccacgacgcgccagccctgcggctcaccgagcggcccttcgtccgcgaaaaccctggtacgtgccgtggagcagcgcggcccgcgccgccaggtgctcacccggatcgctgggcagtttcagggaggccagcacggtcggacggacctgctcccacgtctcgccgtccagcagcttcgcccgcgggtcgcccgaaccaacaccgcgggagcgccgtcgtcggcaccatggaagccgtcaccccgaaggagtggctggctgtcctcgcggtcagcctcgacgccgtccaccacaccggccgagccgcgctccggcacctgcgcgccgcgcggggctccaacgtcggatcggcgggagggcttggcggcgactacggcatggccgcctacaacgccgccaagggcgcggtggtcaacctcacgcgcgcgatggcccttgaccacgcccccgaagtccgcgtcaacgccggccaccccggattcacgctccactccgggatcaccgcgggcgccacccctgacacgcccgtcgtgcggtccttcgcggaacgcatccccttgggccgcgtcgccgaacccgacgagatcgcgagcgtcgtcgccttcctcgcgggccccgatgcgctatatgaccgacgctcaaatcccggtcgacgggagcctcaccgctgctaccgggcagccccgcatcgggatgtgaacgcgtcc

SEQ ID NO: 746 - DNA, 1968 bp, Streptomyces avermitilis
  CDS (1)..(1968)
gtggaacgttcgaaggaccggcggccggtttcgttacaggaccgggcacgctactggttcgaccgcacgctggcccgcagtaccggcaccctgatgggctggctggtgatcatctgcctggccgtcgtcgtcccggtgagtgcgctgctggtgtggacggaccccggctcgccgcggtcactgtcgggccggctggcggccgtgtggcggagcagcgcggagacactgcgactgggcacggtgaccggcacaccgctgcgcatgctgctgtcggccctgctcgggctcgtcgccctgctgtgcgtgtcgacccttgtcggggtgatcaccacaggcctggccgagcggctggcggagttgagccgcggacggtcgacggtgctggaacagggccatgccgtcgtgctcggctggtcggaccaggtgtccacggtcgtgggtgagctggtcgccgcccagtcgtcgtaccggccacgggctgtcgtcgtgctcgccgagagggacaagaccgagatggagcgggcgctggccgctcacgtcggtccggccggccggacccggctcgtctgccgcagcggtcccgccagcgaccccggcgtgctcgccttggtcagcccgcagacggcgagcaccgtgctggtgctgccgtccggcgaaccgacggccgacgccgaggtgttgcgcgttctgctggcactgcgggcggtgctcggcgaggggaccggcggaccgccggtgctggccgcggtactggacgaccgttaccgggcaccggcccggctggccgcaggcccgcgcggcactgtcctggaaaccgacaccgtcacggccaggctgatcgcgcagtgcgtcggccgccccgggctgtccctcgtcctgcgcgatctgctcgacttcgccggcgacgagttccacctcgccgaagcgaccgccttccacgggggtcccttcggagcggcccttctgggccatgccacgtcctgtgtggtcggattgctcaccgccgagggacgtacgctgctgaatccgcccgccgccacactcgtagcaccaggaagtcgcctggtagtcctcacacgcgacgacggttcggcacggccggaggactgccggcaccttgtcgagccgtcggcgatcgccatggcccagccaccgccggaggatgccgcgcacctgctgctgctcggctggaaccggcgggcgcccctcgtcgtcaaccagttgcggcgcacggcccggccgggttccgtcctggacgtagtcacggacagggccgtgcccgggccgacgcgggaaccggaatcgggggccgcccggctggccgtgcggttccagtccgccgacctgtcacgccccgagaccctgctcgggctcgacctcgccccctacgacgggctgatcgtcctcggccccgagccgggtgacggtcctgaccgccccgacgaccggacattggtcaccctgctggccctgcggctgctggaagaacgtaccggacgcgaaatgcgcgtgatcaccgaactcaccgacgaccgcaatcggcccctggcacccgtcaatcccggctccgacgtcatcgtcagcggagagctgaccggactactcctggcgcaaatcgcgcagaatcggcatctggcgcccgtgttcgacgagttgttctccgccgatggcagcacgatctgcctgcgacaggcagggcactacgtccggacgggctgcgaaaccaccttcgccactgtcgtggccgctgcgcgcgaccgcggtgaatgtgccatcggctaccgccgtcacgaccgccgggcgattcccccggaccacgggatccggctcaaccccgacaagagcgagcgccgcgaatggagtgccgacgaccaggtggtcgtcgtagcaaccgaaccaacggaacccgcccctgccgccgggcaggacaccgaggaacaccaaccgggaccggcagacaccagggcg

SEQ ID NO: 747 - DNA, 174 bp, Streptomyces avermitilis
  CDS (1)..(174)
gtgttcgtgctcggcgcggccgtgctgtggttgctcggcaggccgaccgccggccgacgcaaggccgaccgcgctcgacgcgcccagccggagcaggcgcagaatgctgccggcgtgcctgtacgggccacgcaggagctacgggcactgcctccctggagcaggccgtgccgg

SEQ ID NO: 748 - DNA, 936 bp, Streptomyces avermitilis
  CDS (1)..(936)
atgctggtaggcgcgagtgcctgcggcgggggcagcggtgacaaggcgaacggggacgacgcaaaggcgtcgggaaagccgggggcgagcgcctctccgtcaccgaagaagcccgcgggcccgccgatgctgctggagacgatcaccccgcagacgggaaccacggtcggcgtggccatgccgatctcggtggtcttcacgaacccggtggcggcaaaggcacgggccgcggtggagaagcacatgaaggtgagcgcctcacagccggtgtccggcgcctggcactggttcggcgacaagcgcgccgactggcgaccgaagacgtactggccctccggcacgaaggtgaagatcgacgctgacatgaagggcgtcaacaacggcaacggacgctacggcgtgcacagttacacgcacaccttcaagatcggtgacgacgtgcgcgcggatgtctcggtgaccggccacaccatgaaggtgacccggaacggcaaggtggtgcggaccctgtcgatcaatgcgggcagcgctcagtatccgacgtggaacggcacgatggccgtcatcgacaagcaggagaaggtccacatgacctcctgcagcgtgggcatcagctgtgagaagggcagccccaactactacgacctgacgctgccctgggacgtccacctgacccagtccggcacgtacgtgcactactcgaccggggaccccactccgggcagcggcagcgcccgcggctcgcacggctgcgtccacctgtccatgtcggacgccaagtggttctacggccaggtcaagcagggcgaccccgtcaccatcaccggctcgccccgcgccaaggccccggccgacaacggctacgccgacttcaacctgggatgggaccagtggctcgcgggcagcgcgtccggggagaagacgaccgcgacgctg

SEQ ID NO: 749 - DNA, 603 bp, Streptomyces avermitilis
  CDS (1)..(603)
ttgcagagagccgtaccgcgagcaatcatggccgtcatggcgcgaccgaggcagatcatcgagtgtggagacttcgttctgcgaagctggcgggggcagagagacttcgctccggcattcaagttgatcgaggagtctctggaccacctgcgcccctgggagccgtgggtcgcccgtcacagcgaggagagcacccgggacttcctcgcgaagtccgagtcgaagtgggcaaacggtgacgtgtacaactacgccatcgccaaagacgggactctcatcggcatgtgccagacctaccgcggggccgaacctcagggccggcgcatcgggtactggctgcaccctgccgccaccggccagggcatcgccacgagagcgaccgcagccatggtcaccgagatgttcaccctgccggacgtggagtacctggaagtcgcgcacgacttggccaacacctccagcgccgccattccgcgccggttgggcttcaccgaagtccggcgtgaacaggtaacgccgcccgcagctccctctggcagtgggatcgacgtggtctggcgactgaaccgccctacgccgcccgttgacggctctcgccgccct

SEQ ID NO: 750 - DNA, 579 bp, Streptomyces avermitilis
  CDS (1)..(579)
gtgcgctcgcgtgcgccaacgcgttgctggtggccgggcagcacccgtccttccgacgccacggctctctgctggcggtggcggtggcggacgggttgtacgggtactggcccgaggcggttcgaccggatctcggccgcctgtttcttccgcgcggtacccccggccctgctcacgcaggcccggcccggcgggaagatcctgctcactctgtcgggctggctctacggatacgcacgggtgctgctcacggtggccgatgacggaaccgccgagggccaactgcgcggtgacacagtgtcgttcatgtcggcgcgcagacacgcggcgccgacgtatggcaacccggctcactgggccacgggtctgccggagaaggcccgtacgacgcggcacagtcccgagcggatcaccatcgccaccgatgaagcgctccacctgcggttcctcgcccaaagcgccgtgtccgacgcgcagatgaccaccgtcggggacgtggtgcacctggtggacgtcgtcactggctcccgcgaccctcacccctggcgaggacagttgggctgtacgcgagggggccgg

SEQ ID NO: 751 - DNA, 669 bp, Streptomyces avermitilis
  CDS (1)..(669)
atgcaggcgttcagcccgcacggcttccatgccgaggactacgccaccctggaaccgagccgggccaaacccaacgaagcgatctacggctacaccaaccacgaccgttcgtgcatgctctggtatcacgatcacgccatggggatgagcgctctcaacgtctatgcgggccttcccggtctctacctcgttcgtgaccccgtggacgagcggctcgggctgccgcgaggcgcattcgaggtccccctcatcctgcgggaccggaccttcaaccaggacggctcgctcgcctacaccatgaccgcgagggaaggcgaggacaccccggtcttcaacgggaaggcgtacccattcctggcagtggagccgcgacgctaccggctgcgcattctcaacgcctcgaacgagcctttctggcggctgaggttcgacgttcccagagacgtacttcttcagccccaactgccgttctggctgatcggtacagacggcggcttccgcgctccgttgaaaatgctcgatttcctgatcagttcagccgaacgatacgacctgatcgtcgacttcagtgggatgcccaggacacgctcgatccgctgccacagcttcaccggccccctcgcgtacagcccaactgtcctcgccaggggtgagggtcgcgggagccag

SEQ ID NO: 752 - DNA, 1308 bp, Streptomyces avermitilis
  CDS (1)..(1308)
gtggaagcgccacgagccctgccgcatcgtgagctcgtagtagtcggcacccggatagacgtaaggatccgagatggctgtcagcggcctgggcagcgggtcgacgtacttctccagcggaggggtgcttggcgtccccgggggggccgtacaccctgccggcgggtgagccggcgccgcatacgcccgcgctcccggaacaccctttggaagcatggccgcacccaccgctcgccgactcggctgcttcgtgtgccgcgcccctgggtccgattggctcaggcacggcgcgcctcggccgtgcgggcggccgccggtggaggatcggtggggcggcggcctggcgacgggccgtccggcatcgcccaccgcgtgaagaggtccggccatgaaacagttcgacgacccgctgttccggtctctcgccgaccgggcactggaactcatcaaggacgacaccctcggcgtcacgccccccgcgacgtgaccgccgctccgtgcggggacgcgccgggcggcggccgctacggcgaggccgtcttccgtcccgaagaggcgggcgagggcgagcgcatcgacttcggcgccctcgcctacgacggcatcaccatggcgcggctgcgggcgctcggggtcggcccggggtggcgctgcctcgacgtgggtgccggcacgggcacggtctcccgtcggctgctggccgaggccggggtggcgagcgtgctcgctgtggaccgcgacgtacgttttctcagcgcgcggcccgtgcccgggctcgacgtgctggagtccgacatcactgcccccgacttcgcccccggccggttccggctcgtccacgcgcgcttcgtgctgatgcacctgcccgggcatgaccgcctgatcacagcattggccgaactcgtcgcgcccggcggtgtgctggtgctcagcgacgcgatcgacctgacgagcgaccgaacacccggcacgccgtacagcgcggtgatgcgggcgatgtggcaggggctgcgggccactatcggcaccgatgtctcctgggtgccgtcgtatccgcatctgctgcgtggggcggggctcgtgtccgtcgctgccgaggtccatgtgccgccgctgctgccgggcagtcccatcagccacttctgggcggacacgtgggagcgaagcagagtggcgatgctcgccaccggcctggtcgacgacgcggccgtcgacgcggcgctccggtacctgggctccgacgaatgcgccgcgctgtcggccggcatgctctccgcctggggatggaaacccgaggagggcccgcga

SEQ ID NO: 753 - DNA, 303 bp, Streptomyces avermitilis
  CDS (1)..(303)
atgttcgccctcggcccgcgcgaagagctcaaggagcacggggccgatgtcaccaccctcatgcccggcgccaccgacagcgccttccacgcccgcgccggcatgaacaacaccgccttcggctccggcatgaagaagaacagccgcaaggacgtcgcccgccaggggtttcttgccctgatggacggccgagccgaagtcgtcggcggtgacgccgccaccaagcgcaccgccctcaagcaccgcttcctgcctgagacgtggaaggccacgcagcacgcccgcaaggccgagccacagccc

SEQ ID NO: 754 - DNA, 795 bp, Streptomyces avermitilis
  CDS (1)..(795)
ttgctgggggccacgttcctgctctcgggcgccgaccgcctgcccccgcgcgcgatcctttccggcctcgccctcgccttcgcggccggtacggcggtgctggcgctgcccggtctgccggtccgggcggtcttcgccgtcgtactcctgcagggcctggtcgcgtcgctgggcgggggagtgcgcgggggactgctgaacgagatcctgccgaaagacggctatgtcctgggccgttccgtgttcaacatgctctggggcctggtgcagatggccggtttcgcgacgggcggcgcactgctggcgctcctgtccccacggacctgtctgctcctcgcggcggcgctgtacgtgatgtcggccctcgtcacccgcctgggtctcacggcccgcccaccgcgcttcttgggccgcccgtccctctcggcgacctggcgcgccaacgccctcctgtggtcctcacgcccccgccgcctgacgtacctgggcctgtgggtccccaacggcctggtggtcggcagcgattcgctctacgtctcctacgccccccaagccgccggcacgctgtacgcgtgcggggcgctgggcatgttcgtgggcgacatggcggtgggtcgcctggtaccacccgcggtgcgctctcgtctcgcgaccccgctgcgcctgctgctggcggctccctatctgttcttcgtcctacggccgggagtggcgatgtcggccgtggccgccacggtcgcctccgtcggcttcgccgcgagcctggtcctccaggaacgcctgatggccgcatcc

SEQ ID NO: 755 - DNA, 207 bp, Streptomyces avermitilis
  CDS (1)..(207)
atgagcaaacaaggtccctgggccgctccgagactccgacgcatgcgcagctaccgaaccctgttccgcgccccggagttcgccccgttcctgctctccttcgccgctttcgccgcggcccagacggtcggcggactggccctcgccacgctggtcttccgggccaccggctccccgctcctgtcggcggtgagcatgttcggcccg

SEQ ID NO: 756 - DNA, 234 bp, Streptomyces avermitilis
  CDS (1)..(234)
gtgctaccggaggagcgggatcaccgccttcacggccggggtgagcggcgcctcctggccgaagagggcggagccgacgccgatcgcgacgtgcgcgagagctgtcgtcgcggcgcacaggacgcggcctgggtcgcggtgagcgcaccgccggtcgcgatgacgaggaaggcaatggtgatcgcggcggcggtgacgagcaccgcgatcagcgcggggacgggcagtggaaca

SEQ ID NO: 757 - DNA, 2070 bp, Streptomyces avermitilis
  CDS (1)..(2070)
gtggtctcggtgtctgtcccgcatgagccaccacggccgtatgaggtgcagccgggcggcctgcccgcggcggcagccgacgatggcctggccatcgcgctcgtcgatcctgcgggccgtatcggtctgtggagttccgaggcacagacgctgaccggccatccgccgtcggagatcatcggtcgcgatgtgtccgtactcgcggaccgagccaccagccacggcagtgaactcgtcgctcagttggtgcgggctggcgatggtgtccgcacggactggctgcgctgtttcgacggtacttgccgtagcgtccgctggcgggccgtgccggtccggctcgttgccggtacgggtctggtcgccgtagcgagccttggcggccagcggatccatcagggtgatcccgcggcagtcgaccttcttctgcaatcgtcgccgatcggtctggccgtcctcgacaaagacctgcgataccgcttcgtcaacgacgccctcgcccgtctcaacggcctgcccgtcgctgcacacctgggtcgctgcattctggatgtcctggatctccccgatccgcaggcgtacgaggacatgctgcggcgtgtcgctgacggcggtgaaacgatcgacagtctgcacgtcgccgcgatcagagccgacggcactccgtacgcggccgtaggaaccctcttcccgcttcgggacgccgacggccacatcgtgggtcaggccggcgtggtgcacgacctgggtgacgcgagagcggaactgctggacaccgcgcgaagccagcgccgcctggaactgctcagccggatcagcgccgccctcagtcagggcctggacgtggccagcgtcgctgcgaagctgtcggcagtctgcgtccctgcattcgcccggacggtcaacgtcgatctcctcgcaggggcagtgcatcgcgacccggacttgccgacgcgcactgccaccgagagagcgggctctgccggcccagacgcgtccgacggcctgcgggtccaccctctgagcacctccgcaggcagcggccatcgcgagccggaacgggatctgccgccgccctgcgcggcatctgcccccgtcggtgagtgcatcagctcggtcgccgttgtgccctttcgcgtggacgaggcccaggaacagccgcaccacggaatcgccgtaccgctcctggccgccggacaggtcctgggagcgatcgccttcacaagaccgggcggcttcgatcctgatgatgtgctcaccatgcgcgacatcgccgctcgcaccgcgatggccatcgacaatgccctgctctatcggcgggaacggctggccacgttgaccctccagcgccagctgctgcccgcacgcctgcctgacatcccctgggctgaatctgcacaccgttatctgcctgcccagaacggcaccctggccggcggcgactggtacgacaccgtgcaactccccggcgggaggatcgggttgaccatcggtgacgtgatgggacacgggctgggcgcggcagcagccatggggcgctaccgctcatcggcacgcgcactgctggccgtgggcctggaacccggccagctcctcacccgcctcgacggtctggacgatggagccgacaacgacctccccgccacgtgcgcctgcgccgtctacgacggcgtcaccggagacctgcggctcgcactggccggccacccgccgccgctgctggtccgcccggacgggtcggcggacatattggcggccgaccccgggccgcccgtgggtatggggcttgaccacgtgtacgaggacgcccaccacgtcgtcccggccgggagcctgctcgtcctctacaccgacggcatgatcgaagaccgcagcacgttcctggacctcgaacaggggatcgccatgctgcgtcgggccgtacacaacaccgaggcttccttggacgaggtgtgcgacgctctcatggccgcacgccccaccaactcggcggacgacgcgactctgttcgtcacccggctcacccgcatccagcctgtgactgtggccaaccgtgatgctcatttggccaat

SEQ ID NO: 758 - DNA, 387 bp, Streptomyces avermitilis
  CDS (1)..(387)
gtggccggctactgcgcccgctacggcgcttccctccccggcgccctcgtacagcgcgccgctgagcgcgggatgacgacactcgcgccgaccggccgggacaccgtcgcaggtacggtccgcttcctcttcctcacggccgccgcggcagccggcagccggcccgtcctcggagtcgacgtcgcccgtcgcccctctcggcccgccgggcccgtctgccggacggccgcgtacgcccgtacacggcggcgtgcacgtgacggagccgcccctgcggaccactttgctcgcacagaacttgctcgcacagaacgcggccgggtggacctggctgtgcctctggtgtccgccgcgcacgccgaggccgacggcgccctgccggtgtcc

SEQ ID NO: 759 - DNA, 381 bp, Streptomyces avermitilis
  CDS (1)..(381)
atggcatgccgcatcagtgagctggtcatcgacgtcgccgaccccgagcggctcgccgcattctggagcaaggtcctcggctacgtcgaactcggccgggaggacgacggaagcatccagatcgggccgcccgacgccggcttcggcggcccgcagcccaccctcgtcctcagcgccagcagcgacccgcggcccgggaagctcccactgcacatcgacgtcaacgccaccgaccgcgaccaggacgccgagctggagcggctgctcgctctcggcgccaggcccgccgacgtcggccagaccggcgccgagagctggcacgtcctggccgacccagaaggcaacgaattctgcctcctgcgcacccggctccagcccctc

SEQ ID NO: 760 - DNA, 843 bp, Streptomyces avermitilis
  CDS (1)..(843)
atgagcgagagcgccaaggtctggctggtcaccggcgcgagcagcggtttcgggcgggccatcgcggaggccgcggtcgccgccggtgacacggtgatcggcacggctcggcggaccgaggcgctggacgacctggtcgccgcgtacccggaccgtgcggaggcgatcagcctggacgtcaccgacggcgagcggatcgatgtggtggccgccgacgtcctggcccgttacggcagggtggacgtgctggtgaacaacgccggccgcacccaggtaggggcgtttgaggagaccaccgagcgggagctgcgcgacctgttcgagctgcatgtgtttggccccgcgcggctgacccgggcgctgctgccgcagatgagggagcggggcagcggatcggtcgtgaacatcagcagcttcggcggccagctgtccttcgccgggttctccgcgtacagcgcgaccaaggcggcgctggagcaactgtcggagggcttggccgatgaggtggcgcccttcggcatcaaggtgctgatcgtggagcccggcgcgttccgtaccaacctgttcggcaagggtgcggcgtacttctccgaggagaacccggcgtacgcggagaaagtcggcccgacccggcagctggtgcagggcagcgacggcagtcagcccggcgacccggcgaaggccgcggcggcgatccggctggctctggacgccgagaagaccccgctccgccttgccctcggcggcgacgcggtcgacttcctgaccggccacctggactccgtgcgggccgagctcaccgagtgggagaaggtctcccgggggacggacttcgacacggag

SEQ ID NO: 761 - DNA, 912 bp, Streptomyces avermitilis
  CDS (1)..(912)
atgaacatccatgggcgcgatctgcgctacttcacctcggtcgccgaggaactgagcttcacccgcgccgccgagcgcctgttcatctcacaacccgcgctgagcaagcagatacggatgctggagaagcaactcggcgcggtcctgttcgaacgggaccggcggacagtgcggttgaccgcggtggggaaagccctgttaccgcacgcccgcgaggtactggccgcctggcaggccgcggaggcggcggtagaggaggtgaagaccgccgagcgatgcactctggtgatcggcatgtccaccagtccgggccgcgggctgctgcccgccctgcggacccgcctggtctcccggcatccggacgcgcagcccgtcctgcgccaggtcaactgggcggatcccagtgccgggttggcggacggatccagcgacgtcgccttcgtctggctgccgctgccggacgatgaccgataccagtatgcggtggtggcccgcgaacctcggctggtcgcgctgccggacggacaccccttggcggcgcgggccgcgtccgaccccgaagggaaggtggacttcaccgacctgctggaggagcccttcctcgccctccctccggaggccggcccgctgcgggactactggctggccctggacgcccgggacggtcgtcagccgcggatcggcggggtggtggccagcgccgaggagacccacgaggcggtcgccagcggccagggggtggcgctgctggccaccggtaacgcctcgctggttgtccgggacgaggtgatcgccgtgccggtccggggcatttccccatcccaactggcggtggccgccggccgggacgacacacggccactggtcctcgcctacctggccgctgcgcgggaggttggggccacaacctgt

SEQ ID NO: 762 - DNA, 735 bp, Streptomyces avermitilis
  CDS (1)..(735)
gtgcacccgacgtcagaaccgcggctactcgacgccgacgaggtccgccacttcgaggagcccttcggcacgctgatgctcgaactgccgccccgcgagcccgggttcgtcctgccgacgtggaaggagctgaccgccgtggtcgaggccgcgcgggagcgggatgcgggcgtccacttcgacgggacgcggctgtgggagcgcccccgcacttggggcgtcctcttgagtccagcagtacccggtggtgttgagcgcgcgctcctcggtctggagcgggagctgccccggctgccggagtacgtggcgcacgcggaggtggtcgggaaggcgctcggggcggcaggggtgccctggttccgggtgaacccggaggtcccgcacacccaccggttccaggtgtggctgtcgtacgacgcggatgtgctggcggatgttgcggtacggcttgccgaggagacacgggtgactctgttccaccggtggttcccggcgccgaagcgaccgccgggactgtcggtcacggaggtagcggtggcagccgaagggctggagtggactgagcgcatttctactccagtagctttcacctggtgcagtagtttgccaacgccgcctggaatcaacagctgccgcgtagcagagcaaccggagagtcacctatgccccgagaggcgccgtaccttgcattggccgacgtgctgcgtgcacggattctcgcgggagagtggggga

SEQ ID NO: 763 - DNA, 1590 bp, Streptomyces avermitilis
  CDS (1)..(1590)
gtggacgtgaccgtggtcggcgccgggccggtgggcctcgtgctcgccgcggagttggcgctcaccggggcgacggtgcaggtactcgagcgacgggccgagccggacgaggcgatgaaggcgcagtcgatcaacatgccgacggccgaggcactcgaccgccgcggcctgctgcctgccgccgaaaaggtgcagcgagagatgctcgagcgggtgggatcgttcacccgcatggtcgacgaccggacacccggtgagggccggcgagcgcccgactcgcggttcaccgggcacttcgcggggatggtcctcgacgccgacctcgtggactggtccgatcccgacctcgccgcgcacaccgcggccgacggagcgaggttggtgccgcagcgtgagctggaagagctgctcgccgaccatgtcgcgcgactcggcgtaccggtgcgtcgcggagtggaggtcaccacgctcgaagacaccggcgacggcgtgctcgtcggcactgccgccggcgccgtgcgcaccgggtggctggtcgggtgcgacggcgggcacagcgccgtgcgccgcctcgcgggcatcgacttccccggcaccgaccccgaactcaccggacatctggcggtcgtcgacatcgccgacccggagaagctcgccaacggatgggcgtggtcgacccggggggcgtaccgctacgggccgcagcccgggcgggtggtcaccgtggagttcgacggccctcccgcagacctcccccacgctcggcttcgctcgcgcggggggacccccgtggcgccggtcaccctcgaggagttgcagaccagtttgcgccgggtctcgggcaccgacgtcacgctgaccgcgctgcgcggtgccgcgacccgctggaccgacaacgcccgccaggccgcgacctaccggtcggggcgggtgctgctggccggcgacgccgcgcacgtgcacccgccgttcggcggtcaggggctcaatctcggggtcggcgacgcgatgaacctcggctggaagctcggcgccgtggtcgccgggtgggcacccgaagggctgctcgacacctacgacgccgaacgtcgtccccttggcgcctgggtgctggactggacgcgggcccagatcggggtgctgcgcggggacgccaagtcggccgcgctccgggaggtcgtcggcgatttgctgagcactcgggcgggcacgacctacgcggtcaagaagatctccggagtcgaccagcgcatcgacctgctcggcgaccatccgctggtcgggcggttcgtccccgacctgtggctgagggacggctcccgtctggccgaccacggtcacgacggcgggttcctgctgctcgaccgcactccggaaggcgcgttcgcccgcctcgccgcggcctgggacgggcgggtgagcagcgtgaccgacgaccacgcgacgccgaccggggtgttggtacgcccggacggggtggtcgcctgggcctccgacaccaccggcaacgctgccgtcaccggcctcgaagccaccctgcaccgatggaccggcgcgccgtcgtcctcacccgagcatgagccggtgggc

SEQ ID NO: 764 - DNA, 624 bp, Streptomyces avermitilis
  CDS (1)..(624)
gtggaacaggtcatcgacaccgcgctgggcgtcatcgccacagagggatacgaggcactgaccatgcgccgactggcaggcgcgctcgacaccggacccgcctcgctctacgcccacgtggtcaacaaggccgacctcgacgagttgctcatcgggcgactgtgcgccgaactcgtactacccgaacccgaccccgcagcctggcgggagcagatccgcggcgtgtgcacccaggtacgcgaccagtacctgaaataccccggaatctcccgcgccgcgctcgccatggcccccaccgacctcgagaccctgcgcgtcagcgaaggaatgctggcgatcctgctcgccggcggcgtcgccccgcaggccgccgcctgggccatcgacgccctcttgctgtacgtggccgcctactgcctggagatctccatcgcgaagcagcgcagggtccacgacgaggcggactgggtcgtcgacaccgacgagctccagcgccgactggccgcgctgcctgccgagaccttccctcacaccacccgctacgcggccgagctcaccgccggcgagagccacgaccggttcgacttcaccctcgccctgatgatcgacggcctcgcacgccgc

SEQ ID NO: 765 - DNA, 489 bp, Streptomyces avermitilis
  CDS (1)..(489)
atgaagccactgaccgagccagagatccgtaccgcgttcgtgaactgcaccaagggtgaggcgaagcgcctgtccgtcccccgcgacctggccgaacggccctgggacgacttggacttcctcggctggcgggacccccaggcccccgaccgggcctacctcgccaccgagcgggacggacgcccggtggcgctcgcgttgcgctgccccagtgccacttcttggcagacgcggcgcagcatgtgctcgatgtgcatgaccacccacaccggcggcgtctcgctgatggtcgccgcgaaggcgggcaaggccgggcagcagggcaactccgtgggcgcctacatatgcagcgacctcgcctgctcgctgtatgtgcggggcaagaaggatgcgggcgtcggtgcgcggcttcccgagtcgctcaccttggatgagaagatccagcggaccgtcgcgaacctcgccgcgctcattgccaaggtcaccgcg

SEQ ID NO: 766 - DNA, 1029 bp, Streptomyces avermitilis
  CDS (1)..(1029)
gtggccgaggcccagccctccggcgtgcggttggccttccgcacccgggccaccaccatcgaactggacacgctgccgaccaagcgggtctaccgaggtttcccggccccggcggacggcgtgtacgacctgctggtggacggccgactcgctgcccaggccacggtggccgacggtaacgtccgcacgattgtcgacatggtcacccagtccaccgaactgcgtgaagggcccgccggtaccgcccggttcaccgatctgccggcgggtggcaaggacatcgagatctggcttccgcatacggagatcaccgagctgatcgccctgcgcaccgatgacccggtcgagccggcgccggacagcgggcgcagggtgtggctgcaccacggcagttccatcagccacggctcgaacgccgcccacccgaccgccatctggccggccctggccgcagcccagggcggagtggagctggtcaacctggggttcggcggcagcgcgctgctcgacccgttcaccgcccgggcgatgcgggacacccccgcggacctgatcagcctcaaaatcggcatcaatctcgtcaacaccgacgcgatgcgcctgcgcgccctcacccccgcagtccacggtttcctcgacaccatccgcgaggggcatccgaccacgccgctgctggtcgtgtcccccatcctgtgcccggtccaggaggacacccccggccccctcgcacccgacttcgacggcgggaccctgcggttcaaggccacgggcgatcctgccgaacgcgccgccgggcgcctgacgctcaacgtcatccgcgacgaactcgcccggatcgtcgaacagcggacggctgacgacccgaacctgcactacctcgacggccgtgacctttacggcgagaaggactacgccgaattcccgctgcccgacgaggtccatcctgatccctcgggacaccgccgcatcggcgagaatttcgcgcggctcgcgttcggcgacggcggccccttcgccgccgaggccgac

SEQ ID NO: 767 - DNA, 171 bp, Streptomyces avermitilis
  CDS (1)..(171)
atgcgttctggcaccggctgctgggcggctcgatcgcgaagaccggacatcgcccgcctctcggcgttcgtacggcatcacatcaccatgcacggccggtactccctccagctccccgacctgcccggcggcctgcggcccctgcgcgaccaggacgcccccgacgacgaa

SEQ ID NO: 768 - DNA, 921 bp, Streptomyces avermitilis
  CDS (1)..(921)
atggctataggagtagcgctcaacgcgaccgacgccgacaaccagatcgacgccacagtgcggcttgctcacgaggccgcagcggcggggctgcggtccgcctggttcgggcagaccttcggcgccgactcacctcagctcgcggcggtcgtggggcgggaagtgcccggtctgcacgtgggtacgtccgcgatccctgtgttcggccgccacccgctgctcgtctccagccaggcccagaccgcccaggcggccacgcacggccgctaccatctcggactggcgctcggcaccaagcttctgactgaggcgggtttcggcattcccttcgaacggcccatcgcgcgcctgcgtgaattcctcaccgcactacggcagttgaccgagaccggcgccgccgacttccacggcgagctgctcaccgcggctacgccgatctccgcgcgtgtgccgggcgccgagggcggcgtgccgctgctcgtcgccgcgatgggcccgcaggcgctgcgtgccagtggtgagctggcggacgggatcctgccctatctggccggcccgcgtgccctggacgaacacatcgtcccggccgtcaccgcagcggcagaggccgcaggccgccccgcgcccaggatcgtcgcgatggtgcacggtgtggtcactgacgatgccgactccgtacgcgaaaaggccgtcgaacagctcgcgttctacgagcagatcccgtcctatgcacgggtcatcgaactctccggcggtcaacgggctgccgatgtgtccgtgatcggtgacgagaggagggttgccgccgaggtgcggcgctaccgggacgccggggcgacggaggtggtgttctcgggcacggaaatcgccggagactccgaccggcgccgtacctgggcactccttggagagctggcgggt

SEQ ID NO: 769 - DNA, 420 bp, Streptomyces avermitilis
  CDS (1)..(420)
atgacccagatgcccggcacggccagatgcgctcgcgccatcctcgtcgtcgtgggcacagtgaacgccgccaccgtcgcatggctgacggcagccgccgccacgctcgagaccggcgccctgggcgagctggtcctgggcatcctgctcctcgccgcaatcgtgtctgcggcactcgccatcgcctcgttcaccatcgcggcgaaattcacccacggcagcagcaagacccgcaccggcgcggccgccgtcggctggatcaccatcctcgccggcaccatcgcccttctgaccgaccaccccatgggggccgccggcgccgcagcgggcacactcctcacagccctctccaccagaaccggcaccagagactggttcgaccgcccacgcctcccccgaccaccccgcaacgcaaaccac

SEQ ID NO: 770 - DNA, 273 bp, Streptomyces avermitilis
  CDS (1)..(273)
gtggtcgtccgccacctgctcaaccgtctgctcggccagctccaccactgcgtgatgacgacccgccagaagtacgacgaagcgatcggcttcgccccgccggtcccgcctcagctagcgacgaccaccgtcgctggcctggatgtcacgggtgcctgtacccggcgtcctggacgtggccggcaccgaacgtgtcaccgtgagggtcgacgaggttcacgaccggcggtcatggtccgcggatcggtcacgaccgggaccgacatgccggga

SEQ ID NO: 771 - DNA, 372 bp, Streptomyces avermitilis
  CDS (1)..(372)
atgcgcacattcactcgaaagagcattgtcgtctcccatctgtcagcgaaaggcatgatgaggcgagacgaagcccccaccagccggaaccgaccgcccagcctaggaccccgccgggccgggctcctactgctgttgctgatcctgctgctggtcttgttgctgctggtcctgctgttgctgatcctgctgttgctgatcctgctgttgctgatcctgctgctggtcctgctgctggtcctgctgctggtcctgctgctgccctgttccggcaggcgcggacccgtcattctgcggcgccacactctcaggcgcagaagtctcgggctcgacctgcgaggaaggctccgcgggagtcggcgcctggggcat

SEQ ID NO: 772 - DNA, 546 bp, Streptomyces avermitilis
  CDS (1)..(546)
gtgccctccgacggcgtcgactccctgcccgactcagacgaccccgactccgactccttatccgactccttatccggcttcgactccttatccggcttcgacgaggacggcttacccggttccgacggcttcgacgacttcgactccttgtccggcttcgacgacttgtccggcttcgacgactccgactccggggacttcgactccttgtccgacttcgacgactccgactccgacttcccgcccgactccgacgggttcgacgacttcgactccttgtccggcttcgacgacttgtccggcttcgacgactccgactccggcggcttcgactccttgcccggctcggacgactgcgactccctgcccgactccggcggccgctgcaccggcggcgccgtcttcttgtcgtgcgtgccccgctcgtcgccctgctcccgggtgaaccagtcccccttctcagggcccgccaccacaaacttcttcaccgcatggggcgcaggcgcgacaacgacagcacccgagggccggtatccgggccacgca

SEQ ID NO: 773 - DNA, 483 bp, Streptomyces avermitilis
  CDS (1)..(483)
atggcggcatgtggctgttgccattgcctgcgcggctgctgctcccggcacagtggggccatgaacgcagatgacaggagccttctggccggggcacgcgtagcgaccaggctgccggcccaggacttggagcgggcgcggcgcttctaccgtgagcagcttggtctggagccggtcgacgaacggcctggtgggctgctgtatcggtgctcaggcgcggacttcgtggtgttccagtcgacgggctcctcgcccggcaccttcactcagatggcgtgggaagtcgacgacatcgaggcagtcatgacggaactcagacggcgcggtgtggtattcgaggaggtcgacgtgcccgggtttcgaacgaggggccaagtcgcggagatcgaagggaactatccgagcaagggcgcgcggggtgaacgcggtgcctggttttgtgacagtgaggggaacatgctcggcatcggcgagccggtcctt

SEQ ID NO: 774 - DNA, 2772 bp, Streptomyces avermitilis
  CDS (1)..(2772)
atggcgagccgtttcgcccgttttcgacgtctttcgtcacggtcactggtcagcaggagcccgcgcagcgtagccgggcaggtgttggtcctccaggtggctctggtagtgctgctcgtggcctgcggcgtgttggccgtcgccctgcagtcgaagcgggacacagatgccgaggccaagcgccgctccgtagccgtagcgcagaccttcgcgcactctcccggtgtcctggcggcgttgcagagccccgacccgaccaagattctccagccgctcacggaggcggggcgcaaggccgccggcgtcgacttcatcgtggtcatggacaccaagggcatccgctacacgcaccccgtgccgagccgaatcggaaagcggttcgtgggcaacatcgggccgtcgctggaggggaaggtctacacggaaagcgtcaacggcccgctcggccgcgaggtacaggccaccgtccctgtcgagaacaccaacggcaaggtggtgggcctcgtctccgccgggctgaaggtcaagagcgtgaccaatcaggtggcccggcaactaccgatcatcctgggtgccggagccggggcgctcgcggtggccaccggcgggacagcgctgatgggcaggcggctgcgacggcagactcacagcctggccccggacgagatggcccgcatgtacgagcaccacgacgcggtgctgcactccgtgcgcgaaggggtggtcatcgtcgccggcgacgggcggctggtgctggcgaacgacgaggccagacggctgctggagctgcccccggacgtcgagggacggctcgtgtcggagctgtcgagcctcgaccccgacacattggcgctgctcgtctcgggccgcgaagccaccgacgaggtgcactttgtcggagaacggctgctggccgtcaaccagcggcccacggatcgcgacggaggccccaaggggacggtggtgacactgcgcgactccaccgagttgcaggcggtgaccggaagggcggagatcgcaggggagcggctcaagctgctgtacgacgccggactcggcatcggcaccaccctggacgtgctgcgcaccgccgacgagctggcacaggtcgccgttcctcgcttcgccgacttcgtcaccgtggacctggccgacgccgtgctgcacggcgaggagccggcccccacggcaacggacctccgccgcacggccgtgtgcggtatccgggacgaccatccgctctacgaactgggtcagctgatcgactttctgccttccacgccccaggcgcgcggctacggcagtggctactccgagttggtgaccgacctgtcgaccgccacgggctggcacgcgcaggacccggagcgcaccaaggcgatcatcgactacggcatccattccctcatcgccgccccgatccaggcccgcggcgtcgtgctgggcatggccaacttctggcgctccaagcagcacgagcccttcgtcgaggaggagatgtcgctggcggaggagctggtggcccgcgccgcggtcagcatcgacaacgctcgccgctatacccgtgaacacgccctggcggtcacccttcagcgcagcttgctgcccagggccctgcccgaggtgagcgccctcgacgtcggctaccgctacctccccgcccagtcgggcgtgagcggagactggttcgatgtgattcccctgccggggagtcgggtggcgctggccgtcggcgatgtggtcggccacggcctccacgcagccgccacgatggggcggctgaggaccgcggtgcacaacttctccacactcgatcttccccctgacgagctgctgagccatgtggacgacctggtcggccgcatcgaccaggacgaggcgggtacggagagtgccgcgggtgtcgtgggcgccacctgcctgtatacgatctacgaccccgtgacgcgccgctgcgtcatggcgagtgcggggcacctgccgcccgcgctcgtccaccccgacggcaccgtcaccttcgtggacctgccgaccgggcctcccctcggcctcggtggcatgccgttcctgaccgccgagctggacctcccggagggcgccgagctggtcctctacaccgacggcctcatcgaggaccgcaagcgcgacctggacgtgggaatggaactgctgcgcgatgcgctggcgggtcaccctgaccggccgcccgaggagagctgccaggctgtgctggacgagctgctgcccgggcgccccaaggatgacgtcgccctcgtcatcgcccgcacccggggcctgccggccgaccggatcgccgactgggatgtgccgctcgacccggccgccgtcgcggggatgcgcgacgccatgtcccaaaagctcgacgagtggggcctgtccgagctcggcttcagcatggagctcgtcctgagcgagctcatcaccaacgccatccgctacggttccgagccgatccatgtgcggctgatccgtgaccgtacgctgacctgcgaggttgccgacggcagcagcacatcgccgcatctgcggtacgccgcgacgatggacgagggaggtcggggcctgtttctggtgtcgcagatgtccgagcgctggggcacccggtacaccccccagggcaaggtgatctgggccgaacaggcgctgccggaggtcatcgaggagcctggcgtggcgtcggctgctacggacgcggccctctcgggcgaaggggcagccggcccggaagcctggcgtgaagacggctcggcc

SEQ ID NO: 775 - DNA, 654 bp, Streptomyces avermitilis
  CDS (1)..(654)
atggcgatcgaggcggttccgggcaccgcggacctggtccacgcgaggatccccgacaccacagccgcaggcatggtcatcttgctcaacggcacgtccagctccggcaagaccagcatggcccgcgcactcctcgacatcctggacgggacgtggttccacatgccagtggacgcgttccacgccatgcgctgcaaacgcgacatatccgatgaggaactccagcctgagatcgaccgcaccgccaaggggtttcaccgcgcggtcgccggtatggccgcgggcggcaacaacctcgtcgtcgactatccgctcagccgacgctggagactgctggacctcctcgacttgctcgtacccgaagacacagtcctggtcggggtccgctgtccgctgcccgagctggagcgccgcgagagcgagcgcggtgaccggcagccgggactggccgcgatgcagtacggcgcggtgcactcccacgagctgcatgacctcgacatcgacagcagcctccacaccccggcggaatgcgcccttcgcatccgtgactttctgccggaccggccacgccccaccgccttcgaaacgctccggcggacattgcggaggccgcaccgccccaccgcgcacacgcccgcagaagccggccccgac

SEQ ID NO: 776 - DNA, 471 bp, Streptomyces avermitilis
  CDS (1)..(471)
atggacgctcgcttgaacctcttcggcaacccggtcggagccaagttcctgaggtacatcaactcggcaggcaaggcggtctcggactcgacgctgccggccgcgacgcaggaactggtgaagatccgcgccagtcagatcaatggctgcggtttctgcaccgacatgcacaccaaagacgccacgcacgccggggagacctcgacgcgcctcaacctgatcgcggcctggcgggaggccacggtgttcaccgacgccgagcgcgctgccctggagctgacggagcagggcacccgcatcgccgacgcggccggcggtgtcacggacgaggcttgggcgaatgccgccaagcactacgacgaggaccagctcgccgccctggtgtccctcatcgccctcatcaacgcctacaaccgcgtgaacgtcatcgtccagcagcccgccggcgactaccagcccggccagttcgga

SEQ ID NO: 777 - DNA, 1437 bp, Streptomyces avermitilis
  CDS (1)..(1437)
atgagcagcacgttccgcaactacatcgacggtgcattcgcggacgcctcggacggccgcacgctcgatgtggtggaccccaccaccggtgacgtctacgcgacctccccgctctccggggcggcggacgtcgacgcggcgatggcggccgccgccgcggcgttccccgtctggcgcgacgccacgccctccgtgcggcagcgcacgctgctgaagatcgccgacgccatggaggcacgggccgacgagctggtcgccgcggagagccgcgacaccggcaagccgctccacctcacccgcagcgaggaactcgcccccgccatcgaccaggtccgcttcttcgcgggcgcggcgcggatgctcgaaggccgatcggccggcgagtacatggagggcatgacctcgatcatccgccgcgaaccggtcggggtgtgcgcacaggtcgcgccgtggaactaccccctgctgatggcggtgtggaagttcgccccggcgctcgcggcgggcaacgcggtggtcctcaagccctcggacaccaccccggcctccaccgtgctgatcgccgagatcatcggcggtgtcctggaggagctgggcctgccccgcggaatcttcaacgtggtctgcggcgaccgtgagaccggccgcctgatggtggagcacccgaccccggcgatggcctccatcaccggttcggtacgcgccggcatccaggtcgcccagagcgcggccaaggacgtcaagcgggtccacctggagctcggcggcaaggccccggcggtggtcttcgaggacgccgacctggcgaaggcggtcgaggacctcgtggtcggcggcttcttcaacgccggtcaggactgcacggcggcgacccgcgtcctggtccacgagtcggtccacgacgagttcgtcgccgccctcgccaaggccgcggccgacacgaagaccgggcagccggacgacgaggacgtgctgtacggaccgctcaacaacgcgggccagctcgcccaggtcagcggcttcatcgagcgcctacccgagcacgcgacgatcgaggcgggcggccaccgggtcggcgagaagggctacttctacgccccgaccgtggtctccggcctgcggcaggacgacgagatcgtccagaacgaggtcttcggcccggtcatgaccgtccagtcgttcacggacgaggcccaggccgtgcagtacgccaacggcgtcgactacgcactggcctcctcggtgtggaccaaggaccacgcacgggcgatgcggatgtcgaagaacctcgacttcggctgcgtatggatcaacacccacatggcactcgtcgccgagatgccgcacggcgggttcaagaagtccggctacggcaaggacctctccgcgtacggcttcgaggactacacccggatcaagcacgtcatgacatcgctc

SEQ ID NO: 778 - DNA, 399 bp, Streptomyces avermitilis
  CDS (1)..(399)
atgagcaccaccaccgtccgggaaatccaggacgccgcggacgcgctcgtcgccgccttcgccgagggccgcctcgacgactacttcggcgccttcgccccggacgcgaccttcgtcttccacaccaccccggagcgcctcggctccacggccgagtaccgcgcgctctggcagcagtgggtggagcaggacggcttccgcatcctcggctgcacctcgtccgcacagctgatccagcacttcggcgacacggccgtcttcagccacgacgtggagacccgggtcgccaccgacgccggcgaggagacggtccacgagcgggagaccatcgtcttcgcccgcgccgacgacggccgctggaccgcagtccacgagcacctgtccgcccgtaccgccgcc

SEQ ID NO: 779 - DNA, 1533 bp, Streptomyces avermitilis
  CDS (1)..(1533)
gtgacgacctcgatcaccgaaatcgagacctatggtgtcgagcggatcccggacgaggaccgcacggcccgcccgatcgatctgttccgcctcgccttcggcggcgccaacaccttcgcgacctgtgtgctgggcgccttcccgatcctcttcggcctctccttctggcagggactcgcggcgaccgtcctcggcctcgtcgcgggtgcgctgctgctggccccgatggccctgttcggccccgccaacggtacgaacaacgccgtctcctcctccgcgcacctgggcgtgcacggccgggtcgtcggctcgttcctctccctgctcaccgccatcgcgttcttctcgatctcggtgtggtcctcgggcgacgcgctcgtcggcggcgcacaccggctcgtcgacgtccccgagtcggacgtcacctacggcatcgcgtacgcgatcttcgccgggctcgtactggccgtctgcatctacggtttccggttcatgctgctggtcaacaagatcgcggtgctggcggcgtcggccctcttcgtgctcggtgccttcgccttcgcgggcgacttcgaccccggttacgcgggagccttcgcctccaccgccgacccgctgttctggccgtcgttcatcggcgccgcgctgatcgtgctctccaacccggtctccttcggcgcgttcctcggtgactggtcccgctacattccggccgggtccccgcgccgccgggtgatgggagccgcgttcctcgcccagatcgccaccctgctgccgttcctcttcggcctggccaccgcgtcgatcatcgcgtcgaaggccgcgaagtacgtcgacccggccgcccccaactacgtgggcggactcctcgcgatctcgcccggctggtacttcctgccgctctgtctgatcgccctgatcggcggcctctccaccggcacgacggccctgtacggcacgggtctcgacttctccagcgtcttcacgcgcttcagccgcgtccaggccaccttcttcatcggcgccctgtccatcgcgttcatcttcgtcggccgcttcgcgctgaacctcgcgcagtccatctccaccttcgccacgctgatcatcacctgcaccgcaccgtggatgatcgtcatggcgctcggctatgtcacccggcgcggctggtacgacgcggaggcgctgcaggtcttcaaccgccgccagcgcggcggccgctactggttcacgcacggctggaactggcgcggcatgtccacctggctcgtctccgccgtcgtggcgctcctcttcaccaacctgcccggccagttcgtcggcccgctcggcaacctcgcgaacggcgcggacatctcgctgccggtcggcctcgccctcgcgaccgtgctctacctcgccctgctcgccctgttccccgagccgcgcgccgtgtacggaccggccggcccccgcttcgtccgggcgtcggacgccgcggtgccgccgatcaccggtggcaccgaggagcccgtcaccgagcccgccgcggcccac

SEQ ID NO: 780 - DNA, 1389 bp, Streptomyces avermitilis
  CDS (1)..(1389)
gtgaaggccggcagcgacggtctgggccggtccgtgtcctgggcgcacgccagcgagctcgccgatccgacgccctggctcctgggcgccgaggtgatcatgacgacaggtctggcggtcccccgtaccgcggccggacagcgcgcctatctggagcggctggacgacgccggcgtatccgctctcgcgctctccgcgcagctgcacatgcccccgctccacgacgcgttcttccgggcggcggaggagcggggcttcccggtcctcgaagtgccgctcgccgtcccgttcatcgctgtcgcccaggaggtcgcggcctcggtccaggaggacgcccggcaccggctgggcgcgcagctccaggtcttcggctcgctgcgctggctggtcgccgagaacctcgacacgcccgcacttctgcgccgcctcgaagccctgtcgggttacgacgtctacctctgcacaccgcagggacgcccgctcctgcccggcgttcccacaccggatcccggtgtcctgcccgcttccgtcgacgctccgccgaccgtccccggcggattcgtcctcccggtgcccgcgcccggcggccccgcgggctttctcgtcgcgtacgagcgtcagggcgcccagcccgcggggctcgccgtcgtccagcacatcgccaccgtggcggcgctgcggctggcgatggtgcgcaacgagcgcgagacgctgcgccgcgagggcgcggagacgctggccgagctgttgcaggaggtgctcgacccggagacggcgcgccgccggctcgcccggcacgcgatcgagggcgacaccgtgctcctcgtggtgcgccacaccaccgacgaggcgctgctgcgctgtctggaggaccatccccatctgctgctcacctggggcgaggaccgctacgtcctgggggcgccggagctggcggtggccgtcggtgagctgccggtcgtggcagccgggatgagccgccccttcctgccgggcgccgcactgaaggtcgcccagcgcgaggcactctgggcggtctccaaggccgtggagtcgggccgtcccgtcgtccggtacggcgacgactcgacgggccggtggctgcccgacgaccccgctgtcctgaccgcactggtcgagcatgtgctcggcgaggtcctgcgctacgacgagacccacgactcgcagttgctggtctccgcccgcacctggatggagcgcgaccgccgtaccgagacggccgcggcggcgctccacatccacccgaacaccctcgcctaccggctgcgccgcttcggcacgctcgcccaccgtgacctgacgtcgacgggggccctggccgaggtctggctggcgatccaggcagcgggggcgctgggcctcaccgac

SEQ ID NO: 781 - DNA, 552 bp, Streptomyces avermitilis
  CDS (1)..(552)
atgcgagtgaccgctcagcgactccgggccacttccggtccacgtgatacggctaccaccccgacatccttttccgccgccgacgccggcatccttctgctccgactcgccgtgggtctgctgctggccggccatggcgcccagaaactcttcggaatcttcggcggcccagggctcagcgcgaccggcaagggtttcgcggacatgggctaccgtcccggggacttcttcgccggcctcgccggcgcttcggagttcctcggcggcctcggtctggccgtcggcctgctcacgccgctggccgcggcggccgtggtcggagtgatgatcaacgccatggccacgacggcaccaaagggcctgtgggcagagaagggcggcttggagtatccgctgtgcctggcggtggccgccatcgccatcgccgccgtgggccccggcctcctgtcgctcgaccgcccgttccgctggcgccacggaggatgggggccggccgccgtggccctgttcctcggcggcataggcgccgccatcgtgctggccttgaaggcg

SEQ ID NO: 782 - DNA, 1401 bp, Streptomyces avermitilis
  CDS (1)..(1401)
atgcacgtcaccggaaccgtcccacagtcggctccggccccccaggagaccgtcgcggcccccacaccggccgaagactccaccggcgccactagcaggcacacccgccgcttcgggctacccgtcgccaccgccctggtcatgggcaacatcatcggcggcggaatcttcctgctcccggcctccgtcgcaccgtacggcacggtcagcctggtcgccttcggcgtcctgaccgtcggcgccatcgccctcgctctggtcttcggccggctcgccgaacgtgacccgcgcaccggcgggccctacgtctacgcccgcgaggccttcggtgacttcgccggcttcctcgccgcctgggcgtactggatcaccacctgggtgtcgaacgcggcgctcgccgtcgccgccgtcggctacctcgacgtgctgatcccggtgaacgaccaccgctggaccgcctgcctggccgcgctcaccctgcagtggctgcccgcgctcgccaacttcgcgggcacccgctacgtgggcgccgtccagatcgtctccaccgtgctgaagttcgtgccgctgctgctcgtcgcggtcggcgggctgttcttcttcgacccggacaacctcggcccgttccacgcgagcggcggcagcgtgcccggcgcggtgtccgcctgtgccgcgctcctgctcttctcctacctcggcgtggagtccgccgccgtcagcgcgggagaggtcaagaacgcccggcgcaatgtgggacgagccaccatcatcggcaccacgggcgcggcgctcgtctatctgctgggcacgctgtccgtcttcggcacggtcgcgcacgaccgcctggtgcagtccaccgcgcccttctcggacgccgtgaacgccatgttcggcggcacctggggcggctgggccgtagcgctcgccgcgctcgtgtcgatgaccggctgcctcaacggctggacgctgctgagcgcccagaccccgtacgcggcggcgcgggacggcttgttccccgccgccttcgcgcgacggcggcggggcgtaccgaccgtcggcgtcggcgtcaccgtcgtcctcgcctcgctgctcaccgtctacaactacacgtcgggctcggccaaggtcttcgagatcctggtcctcgtcaccacgttcaccgcgaccgtgccgtacctgctggccaccgccgcgcagatcttccacctcctctcggggcggcgggagctggtcgaccggacgcggctggtacgggacgccgtggtcacggcggtcgcggccgccttctcgatgtggctcgtcgcgggcgccgggtacgcggcggtgtaccagggcgtgctgttcctgttcgcgggggtcatcgtttacgcggtactggcggcccggcggcagagggcggcc

SEQ ID NO: 783 - DNA, 720 bp, Streptomyces avermitilis
  CDS (1)..(720)
atgacttcccacctccacgcgctctgcttcgatgcgaacgacccgctccgtctcgcgcgcttctgggcgggcgtcctgggctgggagatggccgacgactcctacgacggcatcgcgctcctgccgagcgacgacactgggttccggatccggtttctttcgacccgggagcagaagacaggccagaaccagatgcacttcgatctgacgagcacgtcccttgatgaccagcagcaggttgtggagaggtcgctcggactcggcgcccggcacatcgacatcggccaacgcccggaggagggtcatgtggtgctcgccgaccccgaaggcaatgagttctgcgtcatcgagccgggcaacaacttccttgctgactgcggattcatcggagcgcttgcgtgcgacggttcgcaggacgccgggtacttctggagccaagcgctgggctggccgctggtctgggaccaggaccaggagaccgcgatccgctcgccgcacggcggtccgaagatcacgtggggcggcccgccactgatgccgaagaccgggaagagccggctgcatttcgacctcgctccacctgtccagggtgatcagcaagcggaggtcgaccgtctcgtctccctcggggcgactcgaatcgacatcggtcagggcgaggtcagctgggtggtgatggccgatcccgacggccatgagttctgtgtgtcgacgccccga

SEQ ID NO: 784 - DNA, 615 bp, Streptomyces avermitilis
  CDS (1)..(615)
atggcggagatgcgggcgttccgggacgcggtcagtggctgggcgaccggcggtcccgaggggccggcgagtgatctggctgtgcggctgggcgtgcggacggcggtgctgctggaaggactgagtgacctcgcggccgttgaggcgctggccgcccggcgtggccgggacctggccgccgaaggggtgtgcgtcgtgccgatgggcggggcgatgagcgtcggccgctacgccggcctcctcggtccgcccggcctcggcctgcgcctgacaggactgtgcgacgagggcgaacagcgcttctacgaccggggcctgaagcgggcacgggcgccgcgccggggcttcttcgtgtgcgtgacggacctggaggacgagctcatccgcgcgctgggcacggcaagggtcgaggagatcctccgggccgagggcgactttcgttcctggcagaccttcatgcgccagcccgcacaccacggtcggccccggcagcagcagttgcggcgcttcctcggcacgaagagaggccgcaagatccgctacggccgcctcctcgtcgaggccctcgaccccgaacaggtaccggccccgctcgacgatctcctcgcgagcctg

SEQ ID NO: 785 - DNA, 381 bp, Streptomyces avermitilis
  CDS (1)..(381)
atggccggcctgccgttcgagctggacacggaagtcgccttgcacctcgtggacgccttcctgagcgcctgtggggatcccgatgccaggaagttcctttccccgctgttctccgaggtgccgcgcggaggccagacgctgtgcttccggtcggcggaggagccggcgggcgggttctccagttggctgatcacctgtgcgccggacggcgtgcaggtcacccggaatctcccgaccaccagcgtggccgatgccaccgtggtcgccgcgccctcggacctgctgctggtggtcaagggccggctgcggccggagaagccgcgcatgacggtcctgggcagccgcccgctactggatctctggctcagtcacgccatcgcc

SEQ ID NO: 786 - DNA, 588 bp, Streptomyces avermitilis
  CDS (1)..(588)
gtggccgggctcggcctgatcccggtgatcctccaggcactcttcctgccccgcctcccggtcaccaaggccgtcaccctgcgctccctgggcgtcctgctcaagagcggccgtgcgcgcgtcgcgctcgtgatgaccttgctgaccatcacggcgcagttcgccgcttacaccttcgtggcgcccttcctgcagcagcagaccggagccggccccaccctgatcagcacgctgctgctggtcttcgccgcagccggaatcctgggcaatttcgccgccgcgtcggcgctcaccaaggcattgcggcccacggtgccggccgtgctggcgctcctcgccgtgtcgcaactgctcatgcccctcttcgggacgtggacagtcggggcgttcctcgtcctcgccctgtggggcctggcctacggcgcagtgccggtcgcgctgcagacctggctcttccatgccggcggaccggctggtcggggcgctcgagggggtggacctcgacgtgccggtctgggcgccgcgcggaaagcagaacaaggagttctggtcgcgctgggcgctcttcgaggcggccgtacaccgggg

SEQ ID NO: 787 - DNA, 312 bp, Streptomyces avermitilis
  CDS (1)..(312)
gtgcgcacagccgttgaagccgggctcggtgaacagctggccctgcccgtcgaagacgccgagcagccgctggcgcccgactactccgccatgctgggcgcccgtgccctcctcggcatcggcatcggcggcttctgggccatcgcggtaggggtcggcacccgcctggttcccgagcagctcgcgccacgggccaccgccctcatcttcggcggcatctccatcgggcaccgtcgtgggcgtacccgcgggcccgctcctgggccaccagttcggctggcgcggccttcttcatcgtggccgggctcggcc

SEQ ID NO: 788 - DNA, 276 bp, Streptomyces avermitilis
  CDS (1)..(276)
atgacggccagcgcggaggtacggcccggcagcccggtggagggcgccgccgaccggtaccggctgtgggtgcggaccatgttcacggatctggcccgggaggccggcgtcgccgacgccgagggcctggcgcggcagctgcaccttctgtacgacggcgcggggatttcggcgcggatggaccgcgacccgtccgcagcgacgaccgcccgcgcggcagccgccgcactgttcgacgctgcagtcaaggacaaggaactggtcgacgccgggcag

SEQ ID NO: 789 - DNA, 1452 bp, Streptomyces avermitilis
  CDS (1)..(1452)
atgtctaaggtcctcacctcccttcccgccggcgagcgcgtcggtatcgccttctcgggcggcctcgacacctcggtcgcggtcgcgtggatgcgcgacaagggcgccgtcccgtgcacctacaccgccgacatcggccagtacgacgagcccgacatcgcctcggtgccgggccgcgcgaagacctacggtgccgagatcgcgcggctggtcgactgccgcgcggcgctggtcgaggagggcctggccgcgctcacctgcggggcgttccacatccgttcgggcgggcgtgcctacttcaacaccacgccgctcggtcgcgccgtcacgggcaccctcttggtccgggcgatgctcgaggacgacgtacagatctggggcgacggctcgaccttcaagggcaatgacatcgagcggttctaccggtacggcctgctcgccaacccgcacctgcggatctacaagccgtggctggacgcggacttcgtgaccgagctcggcggccgcaaggaaatgtcggagtggcttctcgcccacgacctgccctaccgcgacagcacggagaaggcgtactccaccgacgccaacatctggggcgccacccacgaggccaagaccctggagcacctggacaccggcgtggagaccgtggagccgatcatgggcgtgcggttctgggaccccgcggtcgagatcgccaccgaggacgtgacgatcggcttcgaccagggccgcccggtgacgatcaacggcaaggagctcgcctcccctgtcgacctggtcatggaggcgaacgcgatcggcggtcggcacggcatgggcatgtcggaccagatcgagaaccggatcatcgaggccaagagccgcggcatctacgaggcgcccggcatggccctgctgcacgcggcgtacgagcgcctggtcaacgcgatccacaacgaggacacgctcgcccagtaccacaacgagggacggcgcctcggccggctgatgtacgagggccgctggctggacccgcaggcgctgatggtgcgcgagtcgctgcagcgctgggtcggcgcggccgtcaccggcgaggtgacgctgcgactgcggcgcggtgaggactactcgatcctcgacaccacgggcccggcgttcagctaccacccggacaagctgtccatggagcgcaccgaggactcggcgttcggcccggtcgaccggatcggccagctcaccatgcgcaacctggacatcgcggattcacgcgtcaagctggagcagtacgccggcctcggcctgatcggcaccggcagtcccgccatcggtgccgcccaggcggccgcgaccggcctgatcggcaccatgccgcagatgccggagggcagcgccgaggccatcgcctcccgcggcgaggtctccggtgacgacgagatgctggaccgcgccgcgatggagttcggcacggac

SEQ ID NO: 790 - DNA, 852 bp, Streptomyces avermitilis
  CDS (1)..(852)
atgcgcatgcgtacgctgctcacctccctggccaccgccaccgccgtcaccggcggcctggccctcgcggctcccgccgcgcccgccagccctgttcccaccgccgcgggcgtcgccaacacgcccagcggccagggcagtacgaacgtcgtcgcctcccccatggcggatccgtccgtcgcgcccggcgggaatttcgacctctcggtatggcagcttcaggagccggtgggctcccccggctcgccgacgacgatcccgtcctcccggcttcagggagccaacgggttccaggacgcgtacttctacacggacacccgtgacggcgcgatgaccttctgggcaccggagaagggcgtcaccacaccgaactcgaactacgcccgctccgaactgcgggagatgaaccgcaacggcaccgccgccaactggtcgctcagcggcacgcatcagatgaaggcgacgctgcgcgtcgtatcggtcacatcgaacgtctgcgtcggtcagatccacctcggtacgggaggctcgtccaccaagccgctgctggagctgtactaccggtcgagcggtgacatcgtcctcggcacggagaactcgccctccggagggcagacactgcacaccgtcggccatgtatcggtcggcaagacatggaactacacgatcggggtctcgggcggccacaccatcgacttgacggtcaacgggagcaccacgcactacgccatcccgtcgtcgttcgacgcctacaagcagtacttcaaggccggctcgtacaaccagtcgtcctccgacagcaccaccaagggcgctcgggtcgccttctacggcctcaccgtctcccacagt

SEQ ID NO: 791 - DNA, 1668 bp, Streptomyces avermitilis
  CDS (1)..(1668)
atgcagcatgagcgagcgggcacgtcggcgggacccgaggacctcatcgacgttgccaagctggtcacggcgtactacgcgctgcatcccgacccggccgaaccggggcagcgcgttgcgttcggcacctcgggacaccgcggatcgtcgctggcgacggcgttcaacgaggaccacatcgccgcgaccagccaggccatctgcgagtaccgcgacagccagggcaccaacggccccctctttctgggcgccgacacccatgctttgtccgagccggccagagtcaccgcgcttgaggtgttcgcggccaacggcgtgaccgtgctcatcgacagcgatgacggctacacgcccactccggcggtctcgcacgccatcctcacctacaaccggggccgtgcctcgggcctcgctgacggtgtggtggtcaccccctcgcacaatccgcccgccgacggaggcttcaagtacaacccgccgagcggtggcccggcaggttccgaggcgacctcctggatccaggaccgggccaacgagatcatcacgggcggcctcaaagacgtacggcgcgttccctacacccaggcgctcgccgcacccggcaccggccggtacgacttcctgggcacctacgtcgccgatctgccgagtgtgctggacctggacgcgatccgcgcggcgggcgtacgtatcggtgccgatccgctgggcggggcttcagtcgcctactggggccgcatcgccgaacagcacgggctcgacctgacggtcgtcaatccactcacggaccccacctggcggttcatgacgctggactgggacggcaagatccgcatggactgctcgtcgccgtacgccatggcctcactcatcgagcagcgcgaccgctaccggatcgccacgggcaacgacgccgacgccgaccggcacggcatcgtcacgccggacgccgggctgatgaatcccaaccactacctcgccaccgccatctcctacctgtactcccaccgggagcggtggcccgcgggcgccggggtcggcaagacattggtgtcgtccgggatgatcgaccgcgtcgccgcggacctcggccgccgactggtcgaagttcccgtggggttcaagtggttcgtggacgggctggccgacgggtcgctcggcttcgggggcgaggagtcggccggtgcgtccttcctgcgccgggacggctcggtgtggaccaccgacaaggacggcatcctcctggccctgctcgcctccgagatcacggcggtcaccgacaagacgccgtcggagcactacgccgcgctgaccgcccgcttcggtgagcccgcgtacgcgcgcatcgacgcccccgcgtcccgtgaggagaaggccctgctcgccaagctgtccccggcccaggtcggcgcggacaccctggccggggagccggtcaccgcggtcctcacccgggcgccgggcaacgacgcgccaatcggcggcatcaaggtgaccaccgacaacgcctggttcgcggcccgcccttcgggcaccgaggacgtctacaagatctacgccgagtcgttcctcggtcccgaccacctcagccaggtgcagcaggaggccaaactcgtggtcgacgcggcgctgggggctgacgcgccgggtgcgggcagcgacatggcg

SEQ ID NO: 792 - DNA, 249 bp, Streptomyces avermitilis
  CDS (1)..(249)
atgagcaagttcaagaaggccgcggccgtagcggtcatggtcggtggcatggctctcggcggcggggtcgcgcacggggacaacaaccagacgatcggcaactcctgcacggtgatcgggcctgacgccggcgatggccaccgctacggcggccaggctgacgtcatcatcggcaacctgcaagccgtgcagtgcaaccaggacttcgacggcggcgcggtcttcgcacccattcagggcctgagcacc

SEQ ID NO: 793 - DNA, 126 bp, Streptomyces avermitilis
  CDS (1)..(126)
gtgcggccgaagcgggaggcgaggccgcccgcgccgcgccagggagcacggccgggtgctcaggtgccagggtgcccgcggtgtccagggcacggctcacgcaagtgccgcaattgcaacgctaag

SEQ ID NO: 794 - DNA, 1740 bp, Streptomyces avermitilis
  CDS (1)..(1740)
atgcgccccgcccacgccctcaaggagggacacatggacgacatggactactacgatctcggcacccacagccgctccgtgaccacctcgtcccccgaggcccagctgtggttcgaccgagggctggtctggtcgtacgccttccatcatgaggaagccgtcgcctgcttcgaagccgcggccacggcggatccgggctgcgccatggcctactggggcatcgcctacgcactcggccccaactacaacaaaccctgggagttcttcgacgagcaggacctcgtacggaccgtcgagcgcacccatgccgccgtggagctcgcacacgcgaaggcggccggtgccaccccggccgaacgggcgctgatcggcgcgctgcgcgcccgctacccgcaggcggaggccgtcgaggactgctcggtgtggaacggtccctacgccgacagcatgcgtaccgtgcacgaactcgcgcccgacgacctcgacgtcaccaccttgtacgccgacgcactgatgaacctcacgccctggcagctgtgggacctgcccacgggcgagcccgccgaaggcgcccgtacagtcgaggccagggccgtcctggagcgtgccctcgccacggacgcgggcaggcggcacccgggaatcctgcacatgtacatccatctgatggagatgtcccccgccccggaggcggcgctgcctgccgccgaccggctgcgcgacctggtgcccgacgccggccacctccagcacatgccctcgcacctggaggtgctgtgcggcgactaccgcggcgtggtggcggacaacagcagggcgatcgccgccgacgagaaggtcctcgcccggtccggggcgatgaacttctacaccctctaccgctcgcacaactaccacttcaagatctacggcgcgatgttcctcggccgttcccaggtcgccctggagaccgccgcccggctggagtcgtccatctcggaggagctgctgcgggtggagagcccgcccatggccgactggctggaggcctttctcgccatgcgggtccatgtactgatccgcttcggccgctgggccgacatcctgcgcctgccgatgcccgcggacccgcagctctacagcatgaccaccgccatgctgcgctacgcccgcggcgtcgccctctcggcgaccggccgggtcgcggaggccgaggccgagcgcaccctgttccacgcggcggtcgcccgggtccccgagacgcgcatgctgttcaacaacacctgcgccgacattctcgcgatcgcgtcggcgatgctcgacggtgaactggagtaccgcaggggcaacttcgacgccgctttcgcggcactcctgcggtcgatcgaactggacgacaacctcccctacgacgagccgtgggggtggatgcagcccacccggcacgcgtacggagccctgctcctggaacgggggcgcgtggcggaggccgaggccgtctaccgggccgacctcggcctcgacgacaccttgccccgcgcctcccagcaccccggcaacgtctgggccctgcacgggttccacgagtgcctcgtccgcctcggcaagacgggcgaggcgcagatcgtggcccagcagctcaggatcgccgcggcgcaggcggacgtaccgatcgaggcgtcctgcttctgccgcctcgaagccgtctcgggcagcggggaggcggacggctgctgtgcgacggaagccggtcggggtcag

SEQ ID NO: 795 - DNA, 237 bp, Streptomyces avermitilis
  CDS (1)..(237)
atggctgacctttcgcagttgctgcaacagggcatgcgccgccgtcacctgaccgcgcaggctctcgccgagcggaccggcatccgcactccccgcatccgcgtcttcgctcaggacggcgcccgtggtcccgtccatcccacggaagcggagctggctgaactcgccgccgcgctggccctgcctttgccggaggtcctcgacgctgcccgcactcccgccgaagcgtcgcaggtc

SEQ ID NO: 796 - DNA, 1317 bp, Streptomyces avermitilis
  CDS (1)..(1317)
gtgacagaggatcgcctgtgcgccaggacaggagcagcgggaggacccaccgacgatgctgaaaggactggcacggagcctgtgacaccgcagatcgattacgaggcgctgttctcggccgtgcccacgccatacctggtgctgggtcccgacttgatcatcctcgacgtcaacgacgcttacctgcgggtggctggctggagcaggcaggatctggtcgggcggtacctgtttgacgccttcccggacaatccggcggaccccggcgctgacggagtgcggaacctggatctctcgctgcaccgggtcctgcgctcgaaggagccggacacgatgacggtgcagaagtacgacatccccgtcgcaggtcaggcgggggtgttcgaggagcggtggtggtcgccggtcaacatccccgtgctcgccccggacgggcaggtggtgtggatcattcaccaggtggaggacgtgaccgcgttcgtcgtgccccacaccgaccgcccccaggcggacggcgaggcgctcagcgggcgggaggcggtggaggagctgtacgcgcgggcgcgggagctgcagcggctgaacgaggaactgcgcgaggcccacgcccgtgaacgccaggtcgccgtcaccttgcaggaggccatgctccgctcgccggacctggcccgacaccgggatgtcgcggtgcgttacctgcccgcggtcggttcactgaacgtgtgcggagattggtacgacgtggtcgatctgcccgacggccgcatcggcgtcgcggtgggtgatgtcgtcggccacgggctggaggccgccgccgtcatgggcatgctccgcagtgcgctgagcgcctccgtcagagccgtcgacggacccgcgcaagctctggaggtcctgggtctgtacgcccggtccgtagagggagcactggtcaccacagtggcccaagcggtcatcgacaccatcaaccaccggatcatctacagcagcgcgggccatctgccccccgtcctgctgcaccccgacggcacctgcgacctgctgaaccgggccaccgacccgccactgggcgcccgcctcgaacacgtcccccgccccgaggccgatctgccctacacccaaggtgacaccctcgtcctgtacaccgatgggctcatcgaacgccgcggcgaggacatcgacaccggcctgcaccggctcaccgaggccctggcccgccacaggcgcctgagcccagaacgtctggccgacgccctgctggcccgcctcgacgtggccggcggcgcccgcgacgacatcgccttgatcctcgtacgtcta

SEQ ID NO: 797 - DNA, 525 bp, Streptomyces avermitilis
  CDS (1)..(525)
gtgttcgtgctgcgcgaggtgttcggcttcgattacgacgacatcgccgtggcggtgggtaagtccagggtgacggtgcgccaggtggcgcaccgcgcccgcaagcacgtgcgggcgcggcgtaagcgcttcgagcccgtcggcgcggcgaaggccgcgcggatcaccgagccgttcatgaccgcggcggcaaccggtgacctggaggggctgctctcgctgctcgcaccggacgtcacctggactgcggacagcggcggcaagaccaccgcggcgcgtcggccggtggtgggggcggagaaggtggccgcggtcctcatgagcattttccgcatgggacggctgacggacccgcggatcaaggtggtcaactgcaacaacacgcccgcgatggtgatctacagcggcgaccacccagaaggcgtcttcctggtcgagatcatcgacgggaggatcaccagcatctacgccgtccgcaacccggacaagctcgtcgcggtggcggttccgcgtcggatcagccgg

SEQ ID NO: 798 - DNA, 1128 bp, Streptomyces avermitilis
  CDS (1)..(1128)
gtgacagctctggcacacgcgagcggcctgcgatcgctggtcaatccccgcccgaagttcgtcgaacgcatccggctgcaccagttcgtggcccgtagcggcgacgccacgattgactacggcacgctgctcggcgggggccagctggtcgtcgacagcgccacgcgcatcgacaccgccgcccgcaccgtgcggctggcgtcgggccgcgccctggactacgactacgtcatctacgcggtcggcagcaccgcagcgacaccgtcaatggtgcctggcgcggtcgaattcgctttgcccatcgctgaattcgagtccgcgcagcggctgcgcgccaggctggaggaggtgccccgcgatgctccggtcaccgtggtcggcggcgggttgaccggcatcgagacggccgccgaactggccgagcaaggacgcacggtcacgctcgtgtgtggccggaccctggccccctccctgagcgcgccggggcgccgatacgtcgccaagtggctgacccggcacggtgtcgccgtgctggaggccggcgtggtgaccgaggtccggccggatgcggtcgtccttgccgacggttctgccgacggcgcggtgcgtccgagcgcactgaccgtctgggcggcaggtttcggcgtgccggagctggcggcggcgagcgggctgcgcaccgacccgctcggccggctgctcaccgacgagacgctgaccagcgtcgacgacgcccgcatcgtcgcggccgacgacgccgccgcaccgtcgggccggccgctgcggatgagcggctacgccgccgggccgctcggggcacaggcggccaacaccgtgctgagccccattgcggggaccgaaccgacggtgatcgacctggccttcacgggggcgtgcgtcagcctcggccgacgcgccgccatccgacagctcgcccgcaaggacgacaccgcggtgaacgtctacatcggcggccgcatgggcgcggcgctcaaggaggtgacctgcaagttcgtcgtgccgaagaggatccgccgcgaggcccgcaagccgggttccatcggctggcccaagggcggccctcgccccgagcggccgacttccgcttcgcaggaggtcacctccccg

SEQ ID NO: 799 - DNA, 393 bp, Streptomyces avermitilis
  CDS (1)..(393)
atgggtgcagtccgctcttcgcgtcgagcaaaggaagggaattctgttgtgagtgaagagatttggggctaccacccagcctcgggataccagacgggaacggatctcatcggtttcaaagtcgaggcgaccgatggcagcatcggcaagatcgacaagcactccgacgacgtcggagccgcccacctcgtcgtcgacaccggtgcttggatcttcggcaagcacgtgcttctcccggccgggaccatcacacgcatcgacactgccgagcggaaggtctacgtcgaccgcaccaaggacgagatcaaggatgcgcccgagttcgacagggacaagcacacgggcgaccccggttaccttgagcagttcggcaagtactacggccagcacatg

SEQ ID NO: 800 - DNA, 207 bp, Streptomyces avermitilis
  CDS (1)..(207)
atgagcgccgcaggcgaatccggcaaccgagcacagcagatgcgcgagaaggcccagaagctgaccgaagccgcggagcgcacgaccgacccgcaggagcgtcagaagctccaggagcaggcccggggcctgcaggagcagagcaagcagcagggccagcctggtcagagcaggtccaagggcactgctggcggcgggcggaaccag

SEQ ID NO: 801 - DNA, 354 bp, Streptomyces avermitilis
  CDS (1)..(354)
atgattcacgcagccgatgtccgcgagtggcgcaaccgagacgtcgtcgacaccgagggccacaagatcggtgtcctcgaagcggtctacgtggacaccaccaccgacgagccggccatggccaccgtacggaccggactgcccacccggcaccggctgaccttcgtccccctcgaggacgcgatcgccgggccgggctatctcaaggtcggctatgtcagagcactggtgaaacaggccccgtcgatcggcaccgacgacgtgctgcccgccgaccaggaggaagcgatcttcaaacactacggcctgccctacgaacccggtgccgccggtgaacggcaactggcgcgccgc

SEQ ID NO: 802 - DNA, 276 bp, Streptomyces avermitilis
  CDS (1)..(276)
gtgttcgttctgcttctcatcctcatcgtggtcttgttcggcctcggcttcctcagccccctctggtgggtggccgcagccgtgttggtcttcggcgccacccggtacggccgcggtggtggcgggggctggatctctggtgacggttccgatttaggggagtaccgggactacgagaaccgccgggatcgtcaggaccgctgggaccgtcgctacagccgtcagcaccgggcgcgctggacgcgcgaggaccgtcgggaccgtgaacgccgcgga

SEQ ID NO: 803 - DNA, 177 bp, Streptomyces avermitilis
  CDS (1)..(177)
atggtatggattcttctccttctgctgatcctggtggtgttcgggttcggtttcaccatgcaggccctgtggtgggtcgccgccgtattgctggtcgtctggatcgtcggcgtcgcgatgcgcggacgtggcggtggcgggcgtggcgtcggccgccggtacggccacagtcgcagg

SEQ ID NO: 804 - DNA, 171 bp, Streptomyces avermitilis
  CDS (1)..(171)
atgagcgtcggacagacgatcaagcacaagacgcaggcattcaagggccgggtcaccgaacgcatcggccggaccacccgcaacaggcgactgcagcgtgaaggcaggaccgaccagatctccggaaacctgaagcagtccggcgacaaggccaaagacgccttcaagcgc

SEQ ID NO: 805 - DNA, 282 bp, Streptomyces avermitilis
  CDS (1)..(282)
atgtacgcagcagtccggcggtacgaaggggtgaccgatccggccgaggcggcacgcctcgtgaacgagggcttcgtggggctcatgcgcgaggtccccggcttcgtggcctactactgggtcgatgccgggaacggagtgatggtctcgaccagcgtcttccaggaccgggccggtgccgaggaatcgatctcgagggcgtcggacttcgtgcgggacaacctcgcgtcactcctccccaaccctccccaggtcatggccggggcggttgtggcttccgcg

SEQ ID NO: 806 - DNA, 1074 bp, Streptomyces avermitilis
  CDS (1)..(1074)
atggaccacccggaccctcggcacagggcacgccgggccacgtacggatccgtttccacgcacttgtcgctgctgagtgaccatcgactcggcgaagtcgtggccgcagccacccctctcggttccggcatcgggggcaggtcggcggagctcgaggtcggtgggacccgagtcttcgtcaagcgagtccctctgacggacatcgagatgcggccaaagaacgtgcggtcgacagcgaacctctttgggctgccgatgttctaccagtacggggtgggctcagccggcttcgggacctggcgcgagctggccgtgcatacgatgaccaccaattgggtcctcgggaacgagtacgagggctttccgctgatgtaccactggcgagtcctgccggacatccctccccagggattcgccgacattttcgggggcatcgacggggcggtcgcgcattgggaaggctcgtcagccgtgcgtgagcggctggaagccatcggccggtccaccttcagtctggtgatcttcctggaacacgtcccgcagacacttgccgcgtggctgggcgaccagcgaggggccgcttcggaaggcgaagacagccaggggtacgcgtgggcggaggaggccctgacgcgcggagccgccttcatgagctcccgcgggctcgtccacttcgacgcccacttccacaacgtcttgaccgacggccggttgatctatttcgcggacttcggtctcgccctgagctccgggttcgaactctcgcaggacgaggccgagttcctcaccgaccatctcgcctacgacggctgctacatcgcgaaccatctgctgcgccaccatctacccgacggcgtgcgcggcaaggtggagcacgaggcgtttctgcacaactggatcgcgggtgagaggtccgagggggtcccgcccgcgatcgccgcgatcatcgaccggcacgcccgggctgccgtcgtactggacggcttccaccaccgcctgctcaatgtgagcaaacggacaccgtatccggccgccgacattgagcgggccaggccgggtggtcgttcagcgggg

SEQ ID NO: 807 - DNA, 1221 bp, Streptomyces avermitilis
  CDS (1)..(1221)
atgaccaccgcagtggctcttgtcgtcaccctggccgtcggctcgggcacggccgcctccgccgcctcctcatccggcccgataccctcggcggctcatggtgccgtgcggtttgacctgcccgagccgacggggcggcaggcggtcggaaccactgaacttcatctcgtcgaccgtgaccggcccgacccctgggtcgccgacagggaccgggagctgatggtcagcatctggtatccggcgcgttcgacaagcggatactcccgccagccgtacatgcagccaggcgccgcgcgcttcgtggacgagtcgggctcgttcggactggcccgtcccggcgaggtggactgggccgccacccggacggacgcggcctcgatggcccccgccgacgaccggagcaggcggccgatcgtgctgtactcgccgggcctggggatcccccgcgcgctgggcacctcgacggccgtggaactggcgagccgcggctacgtggtagtcaccgtggaccacacccatgagaccactccggtggaattcccggacggccgcgtcgagttgcagaaggagccgatggccggagccgagacggtcaagaaggcggtcgacacccgggtacgcgacacccgcttcgtcctggaccagcttgccgtgctgcgggccggccgcaaccccgatgctgaggagcgccgtctgccccgtgggctgggcagggcgctcgacctggaccgggtcggaatgtacggccactcggctggaggtgtcaccgcggcggagaccatgcgggtggaccgtcgcatcgacgcgggcatcgacatggacggcacgctccagtacaacagcaccgaattcctcccggtggccctggaagggctcgaccgcccgttcatgctcatgggcaaggcgagccagactcatctgaacaagccgtcctggcagtcgttctgggaccgctcgaccagctggaagcgcgacctgagcctggaacggggtggccatttcagctacaccgacgcccagacgatcgtgcccgccgtggacgagcggctggacatcccggcgcagacccgcgagcagttcatcggcaccgtggatcccgagcgcagcaccgcagcccagcgcgcctacgtcacggcgttcttcgaccagcacctgctgggccggccccgacatctgctggacaggccttccccgacccaccccgaagtgcgcttcgtccga

SEQ ID NO: 808 - DNA, 288 bp, Streptomyces avermitilis
  CDS (1)..(288)
atggtccctcactgcgccgagcacccgttccagttcgcctacagccgcggcgggttcgagcagacgtacttcaacgtcggtcggcgccgcgagtcacggcgtgccggaggcagggccgacctgctcgtacgcgagctgctggacgctcggatcgtcggccgggacacccccgagtacgacgccgatcccggcttcaacgcggatggcgcccacacggtgcggatcatcgccgaccacttcggacttccctcacccccgctcgatctcgggcccgtggactcatcgaca

SEQ ID NO: 809 - DNA, 426 bp, Streptomyces avermitilis
  CDS (1)..(426)
atgtcaccgcgctgggaaccggatcccgatatccgacgaggaaatcatgtcgttttcaacctccatgcacacttggtgttcgtcacgaagtaccggcgggagatcttcaacggcgagatgctgacgcgctgcgaggcgatcatgagcgacgtgtgcgagagcttcggcgcggaactgcgggagttcaacggcgaaggcgatcacgtccacctgctcgtgcactacccgccgaagatcgccctgtccaggctcgtcaacagcctcaaaggcgtcagctcccgctacctgcgcgcggagtacaccggccggatcaaccggatcgggacgggctcggtgttctggtccccgtcctacttcgcggggtcctgcggcggcgcaccgctggacatcgtcaaggactacatcgagaaccagaagcgcccggca

SEQ ID NO: 810 - DNA, 1212 bp, Streptomyces avermitilis
  CDS (1)..(1212)
atgatccgtgcgtacaagttcctcctgcggcccaccgtccgccaggcccaggcactcgccgagatgctgcgcgaccactgctccctctacaacgcggcgttgcaggaacgccgcgacgcctggcggcacccgtcgaagaccaccgtcaagtacggcggccagtccgcgcagctcaaggacatccgggcgttcgaccctgagcgtcagggccgctggtcgttcagctcgcagcaggccaccctgcgccgcctggacaaggcgttcgccgcgttcttccgccgggtcaagtccggtgagacgcccggctatccgcgctttcgcggggtgaactggttcgacacggtggacttccccaaggacggcgacggctgccggtggaactccaccccgcacgacccggccacccgcgtccgtctccagggcgtcgggcatgtgaaggtcaaccagcaccgcccggtggccggccgcgtcaagaccgtctccgtcaagcgcgagggccgtaagtggttcgtcgtgctcaccgccgaacaggaccagcccgaaccgctgcccgcgaccggcagcgcggccgggatcgatctgggcatcgcgaacttcctcgccgactccggcggcgggttcgtacccaacccgcgccacggccgccgagcggccgacaagctccaggcagcgcagcaggccctcgcccggttcccgcgccgcaaggccaaggaccgcaccgccaaccaccggcgcgcggtgggcaaggtcgcccagctccacggcaaggtacggcgccagcggctcgaccacgcacacaagaccgccctcggcctggtccgcgcacacgacttcatcgcgcacgaagacctcagaatccgcaacatgagcaaggcccccgcacccaagcccgaccccgacaagcctggcaccttcctgcccaacggggccgccgccaaagccgggctcaacaagtcgatcaacgatgccggatggggggtgttcctgacgatcctgcacgccaaggctgaaagcgccggacgggaagtgatcgccgtggacccccgcgacacctcccgcacctgccccgaatgcgggcacaccgccaaggagaaccggcccacccaggaaaagttccactgcgtcgcctgcggccaccacgcgcacgccgacaccgtggcagccaccaacgttctacgggccgggctggtccgtcgcaacgccaacccggca

SEQ ID NO: 811 - DNA, 543 bp, Streptomyces avermitilis
  CDS (1)..(543)
atgaccaactggatacagggccccttccccggccacgaggtgaatgtcgtcttcgcccggggcataccactggacacgctcacccgaggccttcgcgaccggctacgagaacccctcgtgtacggcgaggcgaacggttgggcgtgggctgtgcacgacatgcacaactgggatgccgaggactacgacgacgtcgactacagcggcatgtgcccggagggcgcggagatcgttgtgttcgtgaccgagccctgcagtgccaaggccttcccgcccgcattcgagtaccaccgggacggccgcgcgatcctctgcttcagcttcgaggacatccagcagcgggtgggcgagaacccggactacctgtctgccgaactcctggccgcgaacctcatcggtcccactgcggaatgcggacaacaaggcgacgacgggcacgactgtttcgaccaccactacgacgatcacgagcgtctcgtcacagtgatcgccgactgtttcgcgctgcccgcgccgcctctgtccgcggaggtgaccgcgaag

SEQ ID NO: 812 - DNA, 270 bp, Streptomyces avermitilis
  CDS (1)..(270)
atgctgcgaaaggggccgttcagcggtacgaggttgagcggtgcttcgaactggatccatcggccggggcggagccctggctccgtgaaccactcagcttccaagtcgatgcgccgcatcacctgctgcaagtgccggagccgagagcgttcgggatctttagacggctccaggtcgacgccgccgatgggggtggcgaccctgatcgtcccctggcgtccgaagcggcggggttcgggaacgaactgcctcagcttcgcatcggagaga

SEQ ID NO: 813 - DNA, 897 bp, Streptomyces avermitilis
  CDS (1)..(897)
ttggcaaccggaagaactgcggacacccgccccgccatcgatgccgcgctggtcaggcgcctggtcgagacgcagttcccgcagtgggccgagctgtccctggaactgctcgacccggccggctcggaccatgtgatctaccggctgggcgaggagctttccgtccggctgcctcgccacgccggggcggccgggcaggccaggaaagaggccgagtggctgccccggctcgccccgcatctgcccctggccatccccgtaccggcgggcgtgggggagcccgacttggactatccgtggccatgggcggtgtcccgctggctggacggcgaggtggcgaccgccgaggcgctggccgactcgtccgaggccgccgtcgaactggcccagttcctgaccgccctgcagcggttcgcgcccgaggacgtcccagccgagggtgccctcaaaaacgtcgccgtccggccgctggccgaccgggaccgcgcgacgcgggcagccatcgcgaaagtcgacgacgtgttcgacacggcggccatgaccgagctgtgggacgctgcactgagcgctcccggatggggtcgccctccggtctggttccacggcgacttccacaccggcaacctgctgaccttcgacggccgcctcagcgcggtcatcgacttcggcgaactcggcatcggcgacccggctcgcgacctgaccatcgccttcaccctgatgtcggcccggagccgggccgccttccgcgccgcgctcgatgtggacgacgccacctgggcccggggccgcggctgggccctggccaccggcttgaacgcctacaccacgtacgccgccgtcaacccccgggtcgccgcgcagaccacccgtcagatcaccgaagccctcatcggc

SEQ ID NO: 814 - DNA, 201 bp, Streptomyces avermitilis
  CDS (1)..(201)
atggccaccggcaccgtgaaatggttcaacgcagaaaagggcttcggattcatcgagcaggagggcggcggccccgacgtcttcgtgcactactcggccatcaacagcgctggtttccgggaactgcaggagggacagaaggtcaacttcgacgtcacccagggcccgaagggcccccaggcggagaacgtcaccccggcc

SEQ ID NO: 815 - DNA, 1017 bp, Streptomyces avermitilis
  CDS (1)..(1017)
atgaagttcaccaacgatctgtatatcgcctcggccgcgtcctggctgccggacgtggtctcggtggacgaggccatcgcggcgggactggtcgacgacgagcaccggaacctgggctacgagtcgatcgccgtggccgacggcgtcgccggccccgagatggccgtccgcgccggccggctggccctggagcgggccgtcgggatagagcgggacgaggtcggtctcgtcctgcactcgtcctgcggtttccagggacacgagatgtggcccgcggcggcctacgtcgcgaacgagacggtgggcccggccgctcccggcttcgacctccagcagcgctgcaacgccggactgggctcgctgtgcctggccgccggctacgtcgacgccggtttcacctccgcggtcctgctgaccaccggagacaacttcgccccgccctgggtcgaccgctggaacgtacagctcaacttcatcttcgcggacggcggcaccgctctggtgctgtccgggcggcagggcttcgcgcgcgtcgtctccgccaccctgggcgccgacaactccctggagcggtggaaccgggggacggccccgttcgccaccgcgcccggcctcgaaatgccgctgccgttgcgcgaacgcggccttcagcacgcggtcactccggaggccgagggctcctgggaacgctatgaggccgccctcatggacacgacccggcgagcgctgagtgaggcccaggtgggcgtcgaggacatatcccgtgtggtgatgcctctcatccaccgcggtgtctcacccgagaactacgaactgctcggcttcaccgagaagcagagcacctgggacctcggccgcctggtgggccacgtcgccgcgggcgaccagttcctcggcctcgaacacctggtcaagcaaggcacagtgggaccgggcgacctcgtcctgctcgtcgcggccggcgagggattcagctattccgccgcggtcgtggagatcctcgacgtcccgtcctgg

SEQ ID NO: 816 - DNA, 3090 bp, Streptomyces avermitilis
  CDS (1)..(3090)
atgagtgccttgcgagtcacctctccgagcgtcgaatacgttcagcgaccactgggcctggacgcggcccacccgcgcctgagctggccgatggcctcggccgcaccgggccggcgccagagcgcgtatcaagtgcgtgtcgcatcgagcgccgcgggcctgtcccacccggacgtgtgggacagcggcaaggtcgtctcggacgattccgtcctcgtcccgtacgccggtccgccactgaagccccgtacccgctacttctggtcggtgcgggtgtgggatgccgacggtggcgcctcggagtggagcgcgccctcgtggtgggagaccggcctgatgggcgcgtcccagtggtccgcgaagtggatctccgctcccgcgcccctcacggaggccccttccctggagggcagttcgtggatctggttccccgagggcgaaccggcgaacagcgctccggcggccacccggtggttccgccgtaccgtcgacctgccggacgacatcaccggggccacgctggccatcagcgcggacaacgtctacgccgtctccgtcgacggcgccgaggtggcgcgcacggacctggaggccgacaacgagggctggcgtcgtccggccgtcatagacgtcctggaccacgtgcactccggcaacaacaccctggcggtctccgcctccaacgcctccgtcgggcccgccggctggatctgcgtactggtcctcaccacggcctccggcgagaagaagatcttcagtgacgcctcgtggaagtccacggaccacgagccggccgacggctggcgcgagccggacttcgacgacagcggatggccggcggcaaaggtggccgccgcatggggagccgggccgtggggccgggtcgcgccggtcgcgtccgccgcgaaccaactgcgccacgagttccggctgccgcacaagaaggtgagccgcgcccgtctgtatgccacggctctcggcctgtacgaggcgcatctgaacggccggcgcgtgggacgcgaccaactcgccccaggctggaccgactaccgcaagcgcgtgcagtaccagacctacgatgtcaccagctccgtccgcccgggcgccaatgcgctcgccgcctatgtggcccccggctggtacgcgggcaacgtcggcatgttcggtccgcaccagtacggggaacgcccggcgcttctcgcccagttggaggtggagtacgccgacgggaccagtgaacgcatcacgtcggggcccgactggcgtgccgcctcgggaccgatcgtgtccgccgacctgctgtcgggcgagacctacgacgcgcggaaagagacagccgggtggacctcaccgggcttcgacgaccgggcgtggctcgcggtgcgcggcgctgacaacgatgtcccggagcagatcgtcgcgcaggtggacggtcccgtgcgcatcgcgaaagaactccccgccagaaaggtcaccgagcccaagccgggcgtcttcgtcctcgacctgggccagaacatggtcgggtcggtgcggctgcgcgtgtcgggcgacgcgggcaccacggtgcggttgcggcacgcggaggtcctcaaccccgacggcacgatctacaccgcgaacctgcggtcggccgcggcgacggacacgtacaccctcaagggacaaggtgaggagacctatgagcctcgtttcaccttccacggattccgctacgtcgaagtgaccggattccccggcaagccgtcgacgacgtccgtgaccgggcgggtcatgcacacctccgcgccgttcacgttcgagttcgagacgaacgtgccgatgctcaacaagctgcacagcaacatcacttggggtcagcgcggcaacttcctctccgttccgacggacactccggcccgtgatgaacggctcggctggacgggcgacatcaacgtcttcgcgccgacggccgcctacacgatggagtcggcccgcttcctcaccaagtggctggtcgatctccgcgacgcgcagacgtcggacggtgccttcacggacgtggcacccgccgtgggcaacctcggcaacggcgtcgcgggctggggagacgccggtgtcacggtcccgtgggccctctatcaggcgtacggcgaccgacaggtcctcgcggacgccttgccgtccgtgcacgcctggctgaggtatctggagaagcacagtgacggcctgctgcggccggccgacggctacggcgactggctgaacgtgtccgacgagacgcccaaggacgtcatcgcgaccgcctacttcgcgcacagcgccgacctggcagcgcggatggcaacggagttgggcaaggacgccgcgccctacaccgacctcttcacccgcatacgcaaggcgttccagacggcgtacgtcgcatccgacggcaaggtgaagggcgacacgcagtcggcctacgtcctcacgctgtccatgaacctggtgccggacgccctgcgcaaggcggcggccgaccgtctcgtcgccctcatcgaggcgaaggactggcatctgtcgaccggcttcctcggcaccccacggctgctgcccgtcctcaccgacaccggtcacaccgatgtcgcctaccggctgttgcaccagcgcaccttccccagctgggggtacccgatcgacaaggggtccaccaccatgtgggagcgctgggactccatccagccggacggcggtttccagaccccggagatgaactccttcaaccactacgcctacggctcggtgggtgaatggatgtacgccaacatcgccggcatcgctccgggccgagcgggttaccggcaggtcgtcatccgcccccgcccgggcggcgaagtcacctccgcccgggccacgttcgcctctctccacggtccggtgtcgacccggtggcagcagcggtccggcggcttcgtgctgacgtgcagcgtgccgcccaacaccaccgccgaggtgtggatcccggcggatcaccccgaccgcgtccagcacacgcacggaacgttcgtgcgcgcggaggacggctgcgcggtgttcgaggtcggctcgggaagccaccgcttcaccgtg

SEQ ID NO: 817 - DNA, 375 bp, Streptomyces avermitilis
  CDS (1)..(375)
atgcacttctatgtcgacgtctcctggctgctcgacgtccaggaggccgccctcggccgtgaggacatgtcggtctcggactactccgcgcttgtggcggcgatcgcccgccacaagaccaagctgccgacgctcgccgcagctgacccggacgccgcgtggcgggcggccgcgctgatgcacaccatcgtgcgcctggagcctctcccgcaccgcaacagcctgttcgccgcgttcatcgccgcccagtacatggaccagtccggtgagggcatcgacccgccctacggcgccctgtccgacctcgtcagcaagatccgcgacacccgcctcggcatcctcgccgtcgccgaccaactgcgcacctggaaggtc

SEQ ID NO: 818 - DNA, 222 bp, Streptomyces avermitilis
  CDS (1)..(222)
gtgtccttcaccgacgaagagctcgagggtgtgcgcgcggctgccgcggccgagggcaagagcctcaagcagtacctgcacgacctcggcgtccgcgagatgcagcgcaagcagttcgtcgctggggctaccgcgtgggccgaccggttgcggcgtgagttcgacgacgcgttcgccgacgaggtgccgccgtccgagcgccgggacggggccgcggccgcc

SEQ ID NO: 819 - DNA, 1044 bp, Streptomyces avermitilis
  CDS (1)..(1044)
gtgaccggacggtcccaaggacaacgccccacgctcgaggacgtggcccggcagtccggggtgtcacggtccaccgtgtcgcgcctgatcaacggctcgccgcgagtgagccccgcggtcgccgaacgtgttcgcaccgcggtggccgagctcggttacgtgcccaaccaggccgcccggagcttggtcacccggcgaaacgacgcgatcgctgtcgtggtgaccgagccgcagaatcgcctcttcgtcgacccgttcttcgaccggcacctgcgcggcatccgtcaagaactcgtccgccagggcgcgcagttggtgctgctgctgatcgaggagccggacgactacccgcgcgtgggcaacttcctgggcggcgggcacgtcgacggcgcactgctgttctcgttgcgcggggacgacccgcttccggagatggtcgatcggatgggcctgcctgccgtcttcggcgggcgcccggtcctcagcccggaggaccgcggtcaccggtacacgtacgtcgatgccgacaatcgcggcggagcccgggaggccgtccgccatctggtcgcgcagggacgcgaacgcatcgcaaccatcaccggcccgctcaaccaggcggccgcggtcgaccggctcgacggctaccgggacgtgctgccggacagcgcacccgatctgatcgtcgagggcgacttcaccttgcggggcggggtggacgccatggccgagctgctggcccggtgtcccgacctggacgcggtcttcgccgcgtcggacctgatggcctgtggcgcgctgcgcgtactgaaggagcacgggcgcagggtccctgaggacgtcgctgtcatcggtttcgacgacctgccaccacttgtggagaccaccgaaccgtcactgacgaccgtgcaccaggacatcgagggcatgggacgcctgatggcgcgtctgctgttcgaacggatcccggccacgcccctggacgatggcgaccactcgcttcaccgtgtcatcactcccacccggctgatcctccggaaaacggcc

SEQ ID NO: 820 - DNA, 1032 bp, Streptomyces avermitilis
  CDS (1)..(1032)
gtgatgcgagtgggaatcataggcgccggcaacatcggccacatgcacgccgaagcggtggcggcctgtgagaacacgttattgacaggcgtattcgacctggaccgggagagagcacagtccttggcccgcgcgtcgggaacggtggcgttcgcgtcccccgacgagctgtacaaggcgtccgacggtgtggtggtcgcctcgccgaaccgaacacatgccgactacgcgcgtgaggcggtcgcgtacggcaggagcgtgctgtgcgagaagcccatggcagtctccctgctgcaagcggccgacatgcgcgccctggccgcggtcgcaccaggcgtgtgcgccgtgggattcaattaccgctacctcaacgtgatccgagaagcccgcaatcgcatcggtgaagggatgctcggacgcgtcgtccacgtcgacgtcgctttcaaacgtgccagcgcgctcacccgtcagcacttcacctggcgcgacagcgcggcggaaggccataccagtggcgcactcggtgacctcggagtgcacttgatcgacatgctccatcacctcttccggagccccgtcgatctcgcgagctgccaagtcgcgctccggacgaaggtcgccgccaagggcggtcacgccgtggaggtggacgatcatgctttcgtcagcggccggatcgagggcggcccgtccttcacgctgaccgcttccaaggcctcacagcccgaagagaccgggttcacgctggctgccatgggaagccgcggcgacctttcccacgactcgcaggacggtccggtccttcatctgcggaccgggatcgactgggagcaggtgaagctcctcgggcccagccggctcgacgatccacggggagaagtcaccggctggggagactccttcctcgaccaactccacgactgggccggtgccgtaaccgcatcccagagatcgggaactctggcagacttcgaggacggctaccaggcccagcaggttctgcaagaactgctccggatcggaggacgcatg

SEQ ID NO: 821 - DNA, 849 bp, Streptomyces avermitilis
  CDS (1)..(849)
atgccgcattccgtgccaccgctcactgacataggcccgctgccgacagcgtcaaccgtccggaccgtggtgttctccgacttcgacgagacgtacctggcgcacagcggcacacctgaacaggtgcgttctcggcaagcgctggagaactacctcgaggacgccggcgagcggcacgggctgctgttcggctgggtgaccggcagctcgttgtcgtccgtgctgggcaaggcccgtcggcacggcctccgtttcctgccgcacttcatagcctgctcgctcggcaccgagttgcacgtcatcagcgaggcggggatacagccggagccgggctggcaacggcggatgctcaccaccggcgagcacttggaaggccttgcggaggaggccttccgggaactgcgcacgcggggagtgccgctcgttccacagtcctgtcgcgctcccggcagccgcgtgatcagttactactacttcgcgcaggatcccgagcgggacgctcgtcaactcgctctgatcaggcgcaccgcggacaggctctcgctcggtgtgaacctgagccgctgcaatccggccgccggggatccggacgactgctatgacgtcgacttccttccccgggactgcggcaagcgtcacattgtcgagtacatatgccgcctgtacgcggtgagtgaggcggacgctttcgccttcggggacagcggcaacgacctggagatgctcaccgccgtcggccggggacttctggtcgggaactgtaccgaggaggcccgagcccggtatccgcaggtgtccgcgagatctcacgccgacgcaatcttgtccgagctcaggggggttctaccg

SEQ ID NO: 822 - DNA, 1347 bp, Streptomyces avermitilis
  CDS (1)..(1347)
atgaccaccttcctgaacgactccttcaccggcgacagcacaagcatccaccggttggtcggggaagtgcggcggcacgaggtcccggtgtaccggtgctcccggagcctcgccaaccgagccctgtccgattccctggccgaggacgtcgggcggctcgatccgtccggccccgactccgtcttcgccgtggatccccgtcgtgcggccggcgatccggtgccctttctgcccaagtcgcggctgtggacgcgggacgaacaacgcatcgccgtcgaacatttcgcccgcgtggtggccgacggcgaactgacgagcggatccgcgataggcgagttcgaggacgccctggcggagttcctcgcagtgccgcatgcggtggcgaccagcagcggcacggatgccctgatcatcgccctgcgagcggtcggcgtcagccacggcgacgaggtcatcatgcccgcgaacagcttcgcggccaccgagaacgccgtatgggcctgtggcgccaccccggtcctcgtcgacatcgaccccgtgcgccacactctggacccggctctcgtcgagaccgccatcactcccagaaccagggccatcctccccgtccatctctacggccgcttcgccgacgtcccgggccttgcggagatcgcccgtcgccacggcctgggtcttgtggaggacgcgtgccaggccatcggcgtcaccggagtcggacaacactcggacgcagctgcgctcagcttcaatccgtacaaaaacttcggactgaccggcaaggccggcgccgtggtgacccgtgacgctgaagtcggcgtatcggcacggaggttcgcctaccacggcttcgacccggagcggaagaatgtcaaggaggatgccttcggtctgaacgccaagatcgacaactcgaccgccgcagtcgccctcgggcttcttccacgcctgaccctgaacagctaccgcagggccttcctggccaagcgctatctcgacgccttggaggagctcgcggcagatggcacggctgtcctgcccgccttcacacccgaccacgcgtggcatctgtttggcgtgcaggtagccgccggacgggaggcgagggacgcaatccaagcacgtatgcggacggctgacgcagtggagacggacatctactaccccgtactcacccaccgtcagcagacaccgttgcaccgcaagcatttcgcacacgtcgccctgcccttgacggagcaggtccacgcgagggttctccacctgccactgcacaacaatctgtccctctccgaacaggaccgagtgatcgaagccctgcatgccgcattccgtgccaccgctcac

SEQ ID NO: 823 - DNA, 1143 bp, Streptomyces avermitilis
  CDS (1)..(1143)
gtgaaagtcagcctcgtcatccccacttacaactcgaaggaccttgtcgctccctgtctggtgtccctgaatcatcagcgactcgatgaggccgacgagttcgaggtcgtcctggtcgacgacggttcgacggacggcaccggcgaggtcgtcgactcgctgccgctcacctaccggatccggcgcgtttatgtgccgcgtaccgaaaagtcctgccgctccgcagcgcggaacgctggaatccgtgcggcggacggcgaattgattgtcttcgtcgacggcgaccagatcatcgacccgctcttcgttcaagagcacatccggtgtcaccgtggtcgccccgcgatcgtggccatcggcttccgggactaccaggcgcccggagccgtcgatctcgccctcctcgaacgctctttcactcctgaggcttttcccccggtcgccgatcaggacgagcgtgcccaggtcaccgccaccctgtcgcagaacatgggcaaccttgccaccggctggcacttcttctacggctgcaacgtctccgtacgcaaggaacacctgctggccgtcggcgggttcgacgagaacatacaaaagtggagcttcgaagacgttgaactcggctatcgtctgcaccgacgcggcctggccttcgttcacaacctgtattcccgcgtatatcaccagtttcatcccgaatcggaccaggagcgctacgcggactggcgggaaaacttcgagtacttcacttcgaagcacccggaactcgaagtcaggctgcaatgggtgctcgactcctacttcgatcctggtcgcacgagccgtcccagctggttcgacgcctatctccgcttcgagttcgcgtgccgagcggtcgccgagagactgccgatcgggcactcgtacgaggtcttggtcgtcgacgcggacaatctggacagcgccgaacgagagatcgccagggtcggggcggcgcacgacctgatcgtcgtcgacatcacggacgaccgggaactgccgacggccgtacaggcgatgcggacaggacgggaactgctctacttcaaggagcccagcccggagctgctccagcaggcagcgaagtccttcggctgcgctgcgctcctcaagtatgcggccgaggtg

SEQ ID NO: 824 - DNA, 1473 bp, Streptomyces avermitilis
  CDS (1)..(1473)
gtggggcgggcgcgagttgctcgacgcagacggtggaaccgcaatccactggattctcaaggtgagaatcactgcgggggatctgggggagcggagagaaacgtcatcgtgccaccaaaggtgaatttaggagttttctctctcagctggcccattttcctacagctgacctttacttactgcatggggcttgtggacacctgggccctggggcgtatatcggacgccgccgcggcttccgtcggatccgtcaacacagtcaccacctttgtgttgatgatgttctcctttctggggcagggcggcagcctcgtgtatgccagaatgcttggacaggggaaacaccgaaaagtccaggaatgctattcagtagccttgctcctgcacattctgctgggtgtggtcgcgagcgccgtcctgctcatatgggccagggagatggcgcagctgctgggcctgcgagggccgctactgagttatggcaccaccttcctgcaagtcgtggggggaagctgtgccctgcactccctggtggccatgttcggtggtgtcatggcggcgaacggattcacccgagcgggcatgttcgccgcagtgctcacgaacatcgtcaacatcgtgctgatctacctcctggtcctgcttccggcagggccccgctggggcgtgcgcggaatcgcgttgtccacagcccttgccaccgcggccggacttctgttcagcgcgtggctggtcttcttcagaattcggatccggtttcggcgtccgccgagtgcggagcggctgcgggagcacggcgcgttgctcatggcgttcgccctgcccaccatgctggagccggcgttctggcaagccgcccaaatcaccaccacgcgcatcatcgccgccgtgggccccgatgagcttgccgcacgcatgtacacgctgagtatcaccaacatgatcggtatgttcggctcggcgctttcgcagggactgcagatcgcggtcggccatcttgccggtgccggcgaactggaccggatcagacgcatcaccagaacgacacggctggtgggggtgggtgtggccctcaccctggcgcttctggccggcctgtcgggcgggtggatcatggatcagttcaccgattccccggaggtggcggagtccggacgcctactcctgtggtgcggcttgctctatcttccgggttcctctctgatcatgaccacggccagcacgttgcgcgccgtcggccatgtcacctatccggccgccgtcggaatcctcgtcctttggggagtcttcattcccctggcgtacgccctctcgctgccgctcggcctcgccatcatcggtgtcatgatcgccatggcgatcgacgagaatctccgagccctcctgctcagcatccgttggcgacacatctctgccccccaaagggcccatcgcatcgtggggaagccgaagagcgctcccgttgccggaagc

SEQ ID NO: 825 - DNA, 351 bp, Streptomyces avermitilis
  CDS (1)..(351)
gtgaccacgcctcggcgtcacgcggaccacctgccggcctccggagtgccggacgcccgagtgttcagagaggcgatgtcacggctcgcggcggcggtgacgatcgtgaccgcccaggacgaggcaggaggctactggggtttcaccgctacttcggtgacttcggcgtcctcgtgccggtccgtcactgcccactccaggttcccggaagggaagaaccacggcgcgccgtccccggcgaactcagagtgtgcgcgcatacccgcgaggttgagcgcgaagtacggctccggctccttgttagcgctgttgagtcaggcgaacgagttcgcggtggtgcccgctccgggg

SEQ ID NO: 826 - DNA, 1233 bp, Streptomyces avermitilis
  CDS (1)..(1233)
gtgatcgacctcgccgacctcgacctgttcaccgacggggacccacacgaggcatggcgagtcctgcgccgtgatcgccccgtccactggaatgccaccggcggcgacaccgccagtggcgtggggccgtccgggttttgggcactgacgcgttatcaggacgtccacgacgcctacgtcgacgcgggcctgttctcgtcccggtgggggacggtgatgggcgggtcgcacaggagggacgcggactccgcgtccggccgtatgctgatcgcctcggacgacccgcagcaccggctgatgcgccagcaggtgcacagggcctttctgcccgctctcatggaccgggcccgtcgcgttgtacgcgactatgtcaacgccgcgctcgacagggtgctgaaggacggcggcggtgatttcgccaccgacgtcgcacccgaactgccggccgggcttttggcggcgatgttcggcctggagcggagggacgccctgcacctcctcgcactgacccgctccatgatcggattccaggatcctcggtatcacagcgactcgacaccgccggcggtgctggtctcctcccaagtcgagatcttcgacgtgatgatggacctgatggagacgaggcgacgcgccccctcggacgacctggtgagcattctgctgggagcctcgatcaacggccgtcgcttcaccgaggacgaggtcctgtacaactgcctgaacgtggcggtgggtggcaacgagacgacccccttcaccgcgtccgccgccgtccaggccttcatggactttcccgaccaggcgcaacggctgctcgacgatggcggactcctgccgaccgcagtggaggagatcttccgctggacgtcgacgaacgcctacgtgcagcgcgtcgccacacgtgacgtcgagttgcacggtcaactgatccgcgcgggtgatccggtgacgctgtggaacgcgtccgccaaccgcgacgaggagaagttcccaaaccctgaccgattcgacgtacgccgcacacccaaccggcacatcgccttcggggtcggtgtgcatcggtgcatcgggatgggtgccgcgcagatggaaattgcgttgctcctgaaggagatcgtgcggcggggcatcacgttcgaacccgccggcccgccggcccgcctccgctccaacttcatgctcggtctcacctgtctcccggtccacgccacggtggcgcaggacgcgtcg

SEQ ID NO: 827 - DNA, 1806 bp, Streptomyces avermitilis
  CDS (1)..(1806)
gtgcccagcacgctgagcgaactgttcgaacggaccgcgctgcggcacccgacggccgtcgccgtcagcgacggcgacgcccgattgacgtaccgcgaactcgaagaagccaccagggcatcggcacgcgagctcatcgcgcgcggggtgtcccccggggacaccgtcgcggtccacatgccgcggggagtaccggtggttgtcgccgtgctggccatcctgcgggccggcgccgcctaccttcccatcgacgaggtgtatcccgcacagcgccgtgaccagatgcttcgcgacggcgcggtgacccacgtgctcgtcgcccccggctgggtggaacgcatggcgcagacaggtctgtccgtgctggagtggccatccacaccgagtggcccggccgccgacgggtcctgcggtgatgtcgacggccgggccgccgtaccgccggcgtcgctcgcgccttcgcagcccgccggcgcggcctgcgtgctcttcacatccggctccaccggaacaccccgcgcggtggtgctggaacatcgacagatggtcgacttcgcgctcgcggacacgttgccgctcctgcgcccgggggaccgcacagcgcagtcgtcgagcatctccttcgacaccttcaccttcgaggtgtggcgttccttcgccggaggagcggaggtcgtcgtggtgccgggcatcccggagctgatggagaccgacctcggcaaggagcttcgccgacgccgcatcaccgccatgttggcccccgccatcgccctcaaccaccttgcccgacacgaccgcgaggctctgtctggactgcggttgctgtgttccggcggcgacgtcctgctccccgcgacctgccgtgcgctgcgcgagggcggcttcaccggggagctgttcaatttgtacggccccaccgaggccaccgtcgcgtgcagcggcttccccgtgatcgacatcgcgcttctgggagagcaggtgccgatcggccactccttcggccgcgcccggctccacgtactggacgagcggctgcggccggtgccggcgggcgtgccgggtgacctgtacgtgggtgggccaggcgtcgggcgtggctatctcgggcgcccggggctcaccgcacggagattcgtggccgacccgttcgccggcgacggcacgcggatgtacgccacgggagatcgggtgcgctccggtgaggacggcgcgctggagtacctggggcgtacggacagccaggtgaagattcgaggtcaccgggtggaaccacaggaggtcgaacgggccctgtgccgctacgaggcggtgtcggaggcggccgtcctcagcgacggcgaaccgggggagaagcggctggtggccttcgtggtcgtcggccgggagaacttcctgctgcgggagctgcgcggccacctcagggccacggtgccggctcatctcgtaccggcggagatcatcgtcttggacgcgatgcctacggacgcccacggcaagagggaccggcaccgcctggcggacatgctcggggatcatgcctcccggcgcaaccggtacgtggccccgcgcaccgacaccgaacgttttctcgccacgatctgggaggacctgctcaacgtcgagtcggtcggcgtcctggacgacttcttcacgctcggcggacattccctcctggcggttcgggtgcgtctgttgctgcggcggcaactggacgtaccggtcaccccggaagcgctcttcgagcacagcgtgctggaggaacaggcccgcctgatcgacgggctgcggaaggaggcgctcacacca

SEQ ID NO: 828 - DNA, 801 bp, Streptomyces avermitilis
  CDS (1)..(801)
atgcaatcgaccggacggtggctgctcaggccgccctcgccggaggcccgggcccgcctcttctgccttccctattcgggcacgggtgcctcctcgtaccgccgatggccgacccggatcgggccgctggaggtatgccctgtacagctgcccggccgggagaatcggatccggcacaccccgtttcgcaccgtgccggagttcgccgcggagaccgccgaggccctgactcctcatctcgaccggccctatgtgctgttcggacactgcatgggcgccctgttggcccacgcgctggccacccgcatcgaggacctgggactgccccgggcgaccctgctcgtggtgtcgtccgccgccgcgccgcacctgcacgcacagcggcgataccgtgctccggagccgggagtgagcggcatctaccacccgtccatgacggacgaggagttcgccgacgaactgaaccacgtgtcgcaggcgttgggcggaggagagattctgcccgagcttctcccgctggccctgcgtgtcctgagggcggacgtggaactgtgctacggctaccggatcccggcgccgcgtccggtgcacagcccgctgacggccatcggctggaccgcggacccggaagtgtcacccgagaccatgcatcagtggaacgcgtacgggaacacgcgccaccgggtcctggagggcggcaagctcagctatctcgccgcgcccacggcactgacccgtgtgctggaggacgagttcgccgacgcgctgtccggcgcgaccaccaccaccggaggcgcacca

SEQ ID NO: 829 - DNA, 735 bp, Streptomyces avermitilis
  CDS (1)..(735)
gtgatcgaccttttccactgcttcggtgccaagcccgcccaccgtgtcgacacctctttggccgccgagatgctgcgcgccagcggctgccgacatctcgccgtgaacacccacaccatcgaccaggtcaccgcgggcgacgatctgcccgtgggctacgacacggcgacgctgggttccgtgatggcgctcgtcggtgaggaactggccttgagccccgtcctcaacatcaaccaccccaccagcgcggcggaggcggtcaagcggacccgtcaggccgcccagttgaccggtatccgggtcatcaagctggaagtcctcgaccccggcttcaagctcagtgtgaacgccgaagtggtggaagcggcccgggaactgaccgccgacgggttcgaggtgtggccgctgatcacacccgacgcccgaaccttcgcgcagtgcgtggaactggggagcacgatggtgcgggtgatgggatcgcccatcggggctcgacggggcatcgagccccagcacctcgaaccgatgggggagatgctcgtcgacagtccggtcccggtcatgctcgacggtggtatcggctccaccgccgatgtcgagcaggccttcgcgctcggcttccagtcggtcctggtcaactcgtgcctcttcgccgacggtacggacccggtcacggccttggccggcttccgcgcgacagtcgaccgggtcgcgtccggcacgcccgccgcccac

SEQ ID NO: 830 - DNA, 909 bp, Streptomyces avermitilis
  CDS (1)..(909)
atggacggactgtggcaggagcgggacctgccgttcgggagcaacagtgtccaacatggcacggccgtcttcgaaggcatccgcatgtacacgacgccggcaggcccggtgttgttccggctcgacgcgcatctggagcggctgctggactcggcggccctgctgggcatcccgcatgcctacgacctggccgccctgcgccggcacgtgcgggacgcggccgccggaagcggactggacaacgcctacgtgcggcccgtgctttacacccgagagccgcgcctcggcgtgaatctccgggacttccacttcactctcggcacggagatctgggcccttccccccgacgacaccccgtcccgacccgtacgggtcacggtgtcgccctggcgccgtccgtcacagctcacctttccggtgcgcgccaaggcgaccggcacgtatgtggtgtccgcgctggcccgcacacgcgccgccgcggacggattcgacgacgccatccagttggacccgaactccggcagggtcgcggagtccacgatcgccaacgtcttcctggttcgcgacggccgcctggtgacgccctggctcgaggacagcgtcctggcgggcatcacccgcgacaccgtcctgaccctcgccggagacctgggcatcgagaccgccgaggcacccgtgcagcccggtgaactgctcgccgccgacgaggtgttcctgaccgggacggcgagcggcctggtgtccgtggcgggtctcgacacccacacgtacgcggccggccgtcccgtgacggacgcgctgagccgcgcctatcgggaggccgtcctgggcgacggaccgcaccgtccctcctggctcacccccgtctctcgccccaccccatccacttcgcgcctccgaggagtatcg

SEQ ID NO: 831 - DNA, 693 bp, Streptomyces avermitilis
  CDS (1)..(693)
gtgggcggcggccgcggtgcgtactcccggatggtggcggaactgcgcgagcacgggcactgtcatctgcccgccctggcgggacgcgacagccgcttcgcggagaccgccgcggcgcgcttcacggatctggccgacgacctgtggaaccaattggaggcggagctcggcctgggtcgttcccccgaccgactggtgctgttcggattcagcatgggcgccctgatcgccacggagatggcggcgcggctgcagcaacgcggcaccggcgcgggcgggttggtcgtcgccggctgcccaccgcctcacctgctggccggacgtgccgtgcacacgctgccggacgaggaactgacagcggcgctggccgcgcagggcacggtgcccagcatggtcctggacgaccctgagctgctctccgtgatggtgccggtgtggcgggcggactgcgccgccgtggcgagccacccacgtcgtccggtggtcctggactgcccggtacacgccctggggggtaccgaggaccccttggcccgcgaggccgatgtgacggtgtggccgcgcctgggcggggccggttcctcggtacgcctgctccccggcgaccacgcggccgtccttgaccgacaggacctcatggcggcagccgtgctcgcggcggccgaccggccctcggaggtgggggcccgatgg

SEQ ID NO: 832 - DNA, 1287 bp, Streptomyces avermitilis
  CDS (1)..(1287)
atgacgacggacaccccacgatcctccctcgacgcactcggtcccgagcgccgccgtctggccgaacggctcctgcgcgagcgcacccgcgccaacgggacggcgacacccgagacgaccacaccgcacacggttgccacccccgaccgcgcggtgccggtcgccggcccggcgcccgaggccggcgcccccgcggcgggcattccgtcgaacggcgcggagtccacgcccagggtcagcttgttcttcttctccgccgacaccgacgaccacgcctgggacaaacacgccctcgtgctggagtgcgccgaactcgccgactcccttggcctggacgcgatctgggtgcccgagcggcacttcgaccccttcggcgccccctaccccagccccggcctcctgctggccgccatcgcggcgcgcaccagccgaatcgccctgcgttccggcagcgtcgtgctgcccctgcgcgacccgctgctggtggcggaggaatggggcgttctggactcgctcagccgggggcggatgggcatctccctcgcctccggctggcacgcggacgacttcgtcctcaaccccgagggctacgaacgccgcaaggacgtactggaagagaggctcgcagacctgcacaccttgtggaacggcgcaagcatcacccgcaaaggaccgggcggacgtcctgtcgaggtacggacctacccgcgcccggaacgcacccctgaggtgtggctgaccagttcccgcaatcccgacacctggcgcacggcgggccggctcaacctgcatgtcctgaccgcgctgctggagcagacgatcgacgagatcaccgagagggtcggtctctaccaccaggcgctcaccgaggcagggcaccccaccgacggccgccaggtcacctgcatgctccacacccacctggcatccgacccggccagcgtcgaacagcgcgtccgcggcccgctgatccggtatctctccgcccacatggacctgttcagcaagtacgccgcgggcgggggtgccggcatcgacccggacgaggtgaccgaagcggaccgccaagcgctcctggagcacgggctgcgccgctacatggggacctcggggctgttcggcagtgcggagagctgcctgccgaaggtcgagcggctcggcgccgccggcatcaccgaactcggctgcctcgtggacttcgggctgccgcgcgaacaagtcctggagagcgtcgaggagctgggccggctgcgtgtcgcgctgcgcgaaacggcgggtgcgcccaag

SEQ ID NO: 833 - DNA, 3156 bp, Streptomyces avermitilis
  CDS (1)..(3156)
atggcccgccgacaccctggcagctgcgacagtgaaggacgatcagtgactcggattcccgctcacgagcaccccgactccatcgcgatcaccggcatggcggctcggctgcccggtgcccacaacgtcaccgagtactggcgcaatctgcgcgagggcgtggagagcatcgtgcggcacagccgcgaggagatgctcgccaacggagcccgccgagacctggtggacgacccctattacgtcaacgcctccgcaccgctggaggacgccgaccgcttcgacgcggcgttcttcggctacgccgcgcgagaagcgtcgatcatggaaccgcagcaccgggtgttcctcgaatgcgcctaccacgcgttggaggacgccgcctacgacagcaggcgcgacgacgccctcgtcggcgtattcggcggctccaccatgaacacgtacatcctgcacaacgtgatgccgcacgccgaggacgtggtcggcctggtcggtgacctgcagacgatggtcggcaacgacaaggactacctgaccacccgcgtctcccacaaactcgacctgcgcggacccagtctcgccgtgcagaccgcctgctccacctcgctcgtggccgtgcacatggcctgtcgagccctcgtcgacgatgagtgtgacatcgctctggcgggcggtgcgtcggtgcgcatgccgcacgccgcggggtatctcgccaaccccggcggcacctcctccccggacggccactgtcgtgccttcgacgccgacgccggcggcagcgtagtgggcagcggcgtgggagtggtggtgctcaagcggcttgccgacgccttgcgggacggtgatcagatccacgccgtcattcgcggctcggccatcaacaacgacggtcaggcgaaggcgagtttcaccgcgcccagcgtggacgggcaaagccgcgccgtggcgcgtgcgctgcgccgagcgggagtcgacgcgcgggacatccagatggttgaggcacacggcaccggcaccccgctgggcgacccgatcgaagtggcggcgctcacccgcgcgttccgcgactggaccgaggacacctcgtactgctggttgggatcggccaagccgaacatcggccacctcgacgccgccgcgggcatcgccggtctcatcaagaccgtcctctccctgaagaaccgcaaggttcctcccgtggtcaacttccgccgccccaaccccaaactggccctggactcctcgccgttccgggtggcgaccgaactgacccgcctggagggggacgaaccgctgctggcatcggtgaactccctcgccatgggcggcaccaacgcccacgtcgtattggaggaggctccgccggtgcgctccggcggggcctcacgccggcgccgtcaccccgtcctgctgtccgcgaagtccggcgaggcgctggaggatctgagccagtcactggggcagtgggctcgggagaacccgcacgccgacgtggccgacgtggcccacaccctggccaccggccggcgtgaactcccgctgcgccgcgccctgaccgcccacgacctggacgacgtggcctatggactgtccacacgcggcagtcgcagccaacgcgaggcgcaggcacgcggatcggtgcgcaccgccttccttttccccgggcagggaacccagcttccggccatgggggcccgactggcgcaaggtgacccggtgttcgccgcccacctggaccgcgtgatcggtctgttccaggagcgcgccggggtcgacctgctgccggtactgcgcccggacgcgtccaccctggaggaggcgcgaaccaccctcaccgccaccgagtacacccaacccgcgctgttcgcggtggagtgggcccttggccgcaccctcatggactacggcgtccggccctacgccatgctcgggcacagcgtcggcgaactcgtggccgccacgctcggcggagtactggacctcgcgccggccgtcgaactggtggcccggcgcggccggttgatgagcgagactcccgagggcgccatgctgtacgtgaacctcgcggaggaagaggccgccaagctgctggacgacgtgcccggcgatctcaccctggccgcggtcaacgccgatcagctcgtggtggtgtccggtgcgccacaggaggtcgaggaactggccgcccgcctgcgcgccgacggcgtctcctgcgggcggctcgaggtcacccgagcgttccactcgcccctgatggacacggccgcggacacgttccggcaggccgccgactcccacgagctgcacgcgccgcagggactcgtcgtctccaacgtcacaggcgggtacctcaccgcgcaggaggccaccgacggcgactactggggacgacagctgcgccacaccgtacggttcaacgacggcctgaacacccttgtccgcgatggggtctccgtgttcatcgagctgggacccggccacacgctgacccgcctggccgccggtctgggaacgcaggcggcctccctgacaacgctcgcgggagagggcggcgaagagccacaggacctgctcgacctgctcaccgggttctggctggagggcggggacgtcgactggagcgagttctacgcccaagaggaacgccttcgattgtcgcttccgctctatccgttcgcccggacccggcactggctcgacccgctgcccgtgaagaccgtacgcaccgagcaggccgaggccgccccccgggcgcaggccacaccggaaaagcccgcgccccgcaaggagatcggcaccacgcccgcgcagcgctacgtcgccgcgctgtggacggaactgctcggcacggacgaattcgggctgaacgacagcttcttcgagatcggtgggcactccctcatggccatgcagatggtcacgcgcatgcgcaaggaaggtgccgaaggcctggagatgaccaccctgttcgaactgcccacggtcgtgggtctggccgagcagttggaacggctcggagtacccgtgccggacagcggtgcggcgcggacctccgaggacgacgaggagacggcggccctgctcgccgaggtcgccgccctgtccgacgacgaggtccaagcccggctggccgagctggaaggagacaccggcgca

SEQ ID NO: 834 - DNA, 1722 bp, Streptomyces avermitilis
  CDS (1)..(1722)
atgaccgccttcgccggcacatccgtccgcgccgagcaggactcgaccgccgcggccttggcgcggcaacaggccggtttgctgatcacgtctccggccgacttcgtcgtcgccctgtacggggcgtgggaggcgggactcggcgtcctgccattgcctgtcgacttccccgacgagcgactgcggcacatggtggaggactgtcgaccggcggccctgatcgcctccgccgatcaggccgaccgtgccgcccgcctcgcggcagtcgcgcagcccgccatcgaggtcgtcgtcctggacgccgtagcggatggggacgagcacgccccagggccttcgcgctcgcacgtaccggagatccccgacgccgcggccttcaccgtctacaccagcggctcgaccggtcggcccaagggcgtcctcatccgacacgagcagatcggccggctcatcgcctggtgcgccgacacctggcaactgggcccgtgggcgcgggtggcacagacactctccctcggcttcgacttcgggcttcaggaactcttcaccttcctgccgttcggcggctgcgtcgtggtgcccggtcaggaggaccggctcagcgcccgggcctatgcccgcttcctgcgccgcgaacgtgtctcggtgttgttcaccaccccgtcgttcgccgatgaactcattgccgcgggcgagccgttgcccgatctgcgactcgtcctcctgggtggtgaagtgctcaagggggtgaccgcggaaggcatgcgcgttctggcggcccccgactgccggctgttcaacgggtacgggcccaccgaagccacggtgaactgcctgatgtacgaaataccccgcccgcccgaaggagcggagccgccgcggttggttcccgtcggcagcgccaccgcggccgcccggatcgacctggtcgatgaacagggtcgtccggtaccggtcggcgctttgggcgagatccgcatcggtggccccggtgtcgccgacggctacctgcggcgaccggaattgaccgcggaacgcttcgtcaggtgccaggacacggacgaggtcctctatcgcaccggggacctcgcgtacgcacgacacgacggtgtcttcgtggtcgtcggacgcgcggaccgccaggtgaagatccgcgggcaccgggccgaactcggtgagatagagcgaacgctgcggagcgcaccgggtgtcgtgtccgcggaagtacgcgtcatcggcaccccggctcggctggtcgcctacctggtcggcaccggcatcgacctcggggccgtccgggatcacgtcgccgcacggctgccccccgccatgctccccgagcagggggtcctcctggagcggctgcccaccaccgccaacggcaagctcgacgaggccgccctcgagcggctggccgaggagcgccatgcgcaacgcctcccggatgccgcttccccggccgagatcgaggccgccgtgtgtgccgcctgggcggccgccctggccgcccccgacgtggcgccggacgtcaacgtcttcgacctgggcgcccactccctggtggtgacccgggtgcacggccgtatctccgccgcgctcggcgtggacttccccgtccacgaggtcttcgagtacccgcgcccccgcgacctggcccggcggttggccgccttgcggcgcgtcgaccgcgatggcccgccgacaccctggcagctgcgacag

SEQ ID NO: 835 - DNA, 3444 bp, Streptomyces avermitilis
  CDS (1)..(3444)
atgagggagacccggttgacacgcacatcgaccccgctcgacctcgtcggagcgatacgggcgcgcgccgagcgagagggcacagccgtcgcgctgtcctggctcaccgacctcaaggaccgcaccgactcacgcacgtgtgccgaactcgacgacgcggcggccgcggtggccgccgcgctgctcgccgaagccgccccaggcgaccgcgtcctgctggtccagccgcccggactcgacttcgtcacctcattcgtcggctgcctgtacgccggatgcgtcccggtccccgtgtaccccctgctcgacaccgcggaggaccgcgccaaggtacgccgcatccagcaggacagcggttcccgggtgacctggacctccgacgcgggcatggccgagtacgtggcggatgcgctcgccaccccggcgttgtggcgcaccggcgaggaccgatatgtcccgagcgagtccccggcccccgacacgctggccttcctgcagtacacctcgggctccaccgccgaaccgcgcggcgtcatggtgacgcacggcaatctcacggcgaacctgaccgccatccgcgacgcgttccggcacaccgcggacagcgtcgtgctgagctggctgcccgcgtatcacgacatgggcctgatcggaaacatccttcaccccctgcacaccgggtgccacgcctacctggcctcgccgatcgacttcatccgcaacccgacggcatggcccgccgccgtgcacacgtacggggtgaccaccagcggcgcccccgacttcgcgtacgaactcgtggcccgcaccgtcgaccgcgacggactgcccgccggcctcgatctcagcggctggcggaccgcctacagcggtgccgaacccgtatccaccaacacgctccgccgcttcgccgaggcgctcgccccggcagggttcagggacgacgctttcgttccttgctacgggctggcggaatccacgttgttggtgacctcggtgcccgtgggcgcgggcgcgagcacccgcatctgccgtgagggggaggaagtcgtcacctgtggagtgccgcgtgactgcgaggtcgccgtcggcggggcggacggcacgccgctgcccgcgggggaagtgggggagatcctggtgcacgggccggccgtcgcggccgggtactggaatcggcccgacctgacctccgaggtgttcgccgcgaacgtcagcggcagcgacaagaagtggctgcgcaccggtgacctcggctttctccaggacggcgaactccacgtcacgggccgcatcaaggacgtcatcatcgttcggggccgcaatcaccacccccaggacatcgaacggctcgtcgtcgacctctgccccgcggtgcgccccggttgcgttgccgcgttcgccgcaccggacgaccagggcgtggtgatcgtcgcggaactgcgcccgggacaaagcctgaccgacgacgaccgggcgcggatcgccggtgccatcgccacgtccttcggcctggccccgcacgagatcgtcggggtgccccgaggcactgtgcccaagaccaccagcggcaagctgagacgcggcgagtgccgcacccggtacctggcgggtgactacgccgaccaccgcttcgaccacggccggggccccactccgggcgacacggcccccacagccgctgtacgccgggccgtgcgggaggtgctcggcacgggtgtcggcgacgatcggccgctcaccctgcacggcctcgactcgctgggcgccgtacggctgacggaactgatcgcgcgccacgccggcgtggacatccccgtccgcgacctcttggaaggcgccaccgtcgcgggcctgatggagcgggtcggcaccgccgaaccggcgccggtccgggcaggcgacgaggcctccggcgcgctgtccaaggctcaggaatccctgctgttcctgcacatgctcgcccccgacagcgacgcctacaccatctccttcgcctgcgagcccggtccgggcaccgaccacgatctgttcgaacaggccctgcgcacggccctggagcaccaaccggagctgcacgtccgcttcacgtcgtccggggccgacggacgccgagaacccgtgtccacccggcgcatgcgcgatgccctcgccctgacgccggtgcccgtcgccgaggacaggctggcgcagcagctgtccgaggcggccgcgctgccctttgaccccgagcaaggaccactgctgcgcctgtatcggtggcagaccccgacgcggcgtgtctaccaggtcgtggtgcatcacttggtcaccgatctgtggtcgctgtccttggtgctccgtgacctcggatccgcctactccgccctgatcgccgggcgcccggtgcgcctgcccgagccggggtcgtacgacgcgtacgtgcgagaacaacgggcctacctcgactccgaggaagccggcgagcgcgacgccttcctgcgcgaggtgctgccacgccgcgccgcgtcgctcggcgtgcgcaccgacttcccccgcaccgccgtccgcggcagccggggtgcccgggtcgaggcgcgggtgcccgcccctgccgtccccgggccggcgggtcaggacccggtcagcctcctggccgtgttgtgggccgccaccttgcggcgctacggcacgccggcgcccgttgtggtgggtgtgccggtgaccggccgcaccggcgggcgccacggggccatcggcggtttgtgcacgaacacggtccccctggccctcgacgtcgagccggaccggctcctggaaccgttggtcgccgcagcccgcgcccagctcaccgccggcatggacgccggtctgtatccgctggcccgcgccgttgaggccgtccgtcccgaccgcgaacccggccgcacaccgctggtcgagacgctcatcacctaccaggagaacccactgccggacgtgaggggcctgctggaggcactgtccggcagcgagaccgaactcgcccttgacacactcgtgttgagaaccgtccccatcgagaggcgtagctgccgctacgacctggacctggtggtcacgcccggtcccgaaggtctccacctcacgctggactacgccgccgacctgttcaccgaacggaccgcccgtgcggtgctcgacacgttctgcgcggcactcgccgcgtcggagcggacctacggggcgcggctcgccgacctcaccgtcctgtccgaccacgacgccgcactcctcgaacgcatcggacggtgcgcgaccccgcccttggagccttcgctgcttcagcgggtcagggcggtggccgagcacacacccggtgcgcccgcgatccaggggccccaccaggtgtggagccacgccgagttcacccggcaggtcgaacgggtcgcccacgcgctgcgcctcgtcgacgacggaaggagc

SEQ ID NO: 836 - DNA, 1923 bp, Streptomyces avermitilis
  CDS (1)..(1923)
atgactgattcggcgtccgttgccgcgacggtcgaccaggtcccctccgcgtactccccaccgcctggaacgcagccccggacacagccggacaaccgggcttccttgcacgagcggttcgaggcatgcgtggtccgcttcccggaccgtaccgccgtcgtcgcggaggacggacgcctctccttcgccgaactcgaccgccgatccgatgccgtcgccgccgccctcgcggcccgcggcgcgggccccgagaccgtggtcggactgtgtctgggccgcggcacgggactcgtcgtcgggctgctcggcatcctgaagtcgggcgccgcctatctcccgctcgaccccgcccacccgagtgaacggctctcctacacgctcagggacagcggggcgctcctcgtcctggtggactccaccacggtgggccgcctgcccacggggtcggatgcacgggcgctgcgcgtggagcggctctccgtgccctccacgacctccggggatctgcgggcgctcccgcagcaccccgccggcctcgcgtacacgctctacacctcgggctcgacggggcgccccaagagcgtggccgtccaacacggatccctgccccgactgttggacgccctggagcgcggcatgctcacgggaacgcccccgggccgcgtgggctggaacgcgagcatctccttcgacgcgtccgtccagcagtggctgcggctgttccgcggcgacaccctcgtcctgctgggcgagaagacccgatcggacccggcggaactcgccgccgccatcgacgcccactccctgaccgacctggacatcactccctcccacctcgcgccgctcctcgaccacttcagccccgccccaggccgcacccccctgcggttgctcatcggaggcgaggccatcgtcccctccctgtggaccaggctgcgcgacctggccgccgccggcggggtgatccccgtgaacctgtacggccccacggagtgcacggtcgacgcgacttccgcgcccgtggccgacgcgccgcagccacacatcggagccccgctccccggcgtacgggtgtacgtcctcgacgccctgctgcggccggtgcgtcagggcgagaccggcgagatatacgtggccggcacgggagttgcccgcggctaccacgcccgggccggcctgaccgcccggcgtttcgtcgccgacccgttcgccgcggacggctcgcgcatgtaccgcacaggcgatgtggcccggccgggaccggatgggctggagtacctcgggcgcaccgacgggcaggtcaagctgcggggctaccgcatcgaactcggcgagatcgagggcgtgttgtcccgggagacggacgcccaccaggtgatcgcctcggtgcgggacgactgtccgggcgggcgcggtatcgccgtccactacgtccccggtcgcggggggcccggcgcggccgaactgcaccgtgtcgcccgcgcacatctgccgccctacatgatcccgtccgcgatcgtgcccgtggatcgcatccccaccaccgccgcgggcaaggccgaccgagccgcgctgccaccacccgcggaccacggccttgaccccgaacgcgagcgtccggaccatgtcccgccgcagagcgccaccgagatcatgctcgccgaagtgtggtcggacgtcctcggtgtccggcccgtcggcgcgacggacgacttcttccaactcggcggccagtcgctgttggccatccgcctggccggacggctgcgtcgcgcacggggccggcgagtccccctggtcgccgtgttcgagaacccacgcctgcgcgacctggccgcctacctggaccgatccggggccggtggcgaggggccgacggggcccgacgagcgacccgacccccgtgcccgagcaggtgaacga

SEQ ID NO: 837 - DNA, 1629 bp, Streptomyces avermitilis
  CDS (1)..(1629)
atggccggcctcgactgcgtggtcatcggctacaacgagggaaacttcgacgactatcgggtcatgagtgaacgggcgggccccagttcaccggagtcccagatcttccgtaaggagcatctggtcgtcgacgggcgaccgatgccgtggatggacgccttcagcaccctgcgcaatcgcgtcaccggacggcacgaccgctatcacgtcggagaggtcttcaacctcgcggcgctgtatctgaccagctttcttcgccggcgcggcgtgagcgccgaaccggtgtcgctctacagcggcgagcgcgatcgactcgcggacctgctggcgcagcggcccacggtggtggcggtcaccaccacgttctacgtcaacatccttccggtcgtgcccatcgtggagttcatccgggagcactcgcccgacagccacatcgtgatcggcggccccctcgtcgacaacctgtgcctgaacggcatcaccggcaccgtccaagacctcttcgacgcgatgggtgccgactcgtacgtgcaggaatcacaaggagagaccaccctcgcgaggctcgccctggccctcaaggaagggcgggacatctccgccgtcgacaacgtcatccactgcacggacggcatgtggcaactgacccggcgccgtccggagagcaacgatctcgacgacagctccatcgactggtcgggcttctccccggaactgataggtgtcaccgcccagttgcgcaccgcccgaagctgcgccttcaagtgcagcttctgcgactacccctcaagggccggtgcgttggcggcggcgtccgtggacaccgtgcgcaaggagctgcgcgccatggcggaactcggtgtcaagaacatcgtgttcgtcgacgacaccttcaacgtaccgcccaagcggttcaaggaaatctgccgcatgatgatcgaggaggacctcgggctgcggtggtactcctacttccgatgctccaacgcccgggacgaggaagcgttcgacctggccgccgagagcggctgctccggggtgttcctgggaatcgaatccggcgacaccgagattctcgccaacatgcacaagctcgctcaggacagccagtaccgcgtcgggctcgaacggctcaacgaacgtgacatcaccaccttcgcctccatcatcgtcgggtttcccggtgagaacgcccgcacggtgagcaacaccgtcgacttcctcaacgagacgaagccgaccttctggagggcgcaggcctggtgggccaacccccgctcgcccgtctaccagaacaaggaggcgctcggcatcgagggcgagggctacagctggagccacgccacgatgacctcgagcgaggcggccgacctgaccgattccatgttcgacagggtcaccggctccacctggctcccgctgtacgacttcgacttctggtcgctgccctacctcgcgggcaaaggcgtcggcgtcggcgagctgaccccgatcctgcagctctccgagcagatcatgcgcgtccgcgacaccggcggatcggacggcacctcccaactgcgttcgctggagcggcagttcgcagccgccgtgggcgcgctcgactcggcaccggctcgctttcgcttc

SEQ ID NO: 838 - DNA, 819 bp, Streptomyces avermitilis
  CDS (1)..(819)
atgcacaacccgcctgcgcgaagacctacaagccgccccggaacccgcgaccaggctcacctattcccgtgccatgcacggccaactcaacgcgcacagctgggactccatcaactaccccacccacacggcagcccactgaaatcggccgaccaaagcctggccgccaccgaatcgccttacactctccgcatgatcagagaggcgtatctgcagggggccgcggccgccgccgatctcatgggccgtccgtccgtggccgccgcatggaacgagccaagcgtccttcccgggtaccgcgtcgccggcctgtgcggccatctcgcgcgcaacatcgtgctcgtcgagccgctgctcgccgcccctgccggcggcgcgcaccccatccctctcctcgatcactacaccggcgacgactggctggacgcggaccctcagagtggggagcatctcgcgatccgcgagcggggcaagaaggcggcggccgacggccccgagagtctggcagagcgcgtgtccggcgccgtgagccggctgaatcgggccatccccgcgcagcccgcggatcgggtcgtcgacctgcccggtatgtggagcctgacgctcgacgacttcctgctgacccgcctggtcgaggtggtggtccactgcgacgatgtggcggtgagcgtcggcgtgccgacccccgaactgccaaccgcgtactacgaggagacgatcgctctcctgtcgcggctcgcgatgcgccggcacgggccgattgccctggtccgggcgctcagccggagcgagcgggcgcccggcacgatctccgccttc

SEQ ID NO: 839 - DNA, 216 bp, Streptomyces avermitilis
  CDS (1)..(216)
atgagcaacccgttcgacgacaccgacggcacctacctcgtcctgtgcaacgaggaggggcagcactcgctgtggcccgcggacctcgacgtgccgaagggctggagcacggtgcacgggccggcggggcacgcgtcgtgtgtggagtacgtcgaggagcagtgggtggacatgcgtccgcgcagtctcgccgcggccatggaccaaccggcgcgg

SEQ ID NO: 840 - DNA, 1650 bp, Streptomyces avermitilis
  CDS (1)..(1650)
atggaagacaacgcaccgctgtcgttcggtcaggaagcgctctggctcgccgaggaactcgttcccggcctgtcggcgtacgtgatgctcgccggctgggagctgaccggcccgctcgacccacaagccctgcagcgggcgttgaccgcgctcgtcgaccggcacgagttgctgcgatccgcactggtcccggtggacggacgacccgagcaggtgatccgtggctgcgcgcccttcgagctgcggcgcgtcgatctgcgcgaccgggacggacaggagcaggacaacgccatcgccggcgacctggcaggactgttggagaagccgttcgacctgtcgtccccgcccttgctgcgcggcgtgctgttccggctcgcagcaaggcggcacaccttggtgctggtgacgcaccacatcgtctgggacggcgactcggacgtcctgctgcggcgagaactgtccgaactgtacgccgcggaggtccagggaaggcggccccaactgcccgaactcaccgcgcagtacgcggacttcgcctggtggcagcgcgaggaggcgtcccccgccctggaggcctccgtcgagcactgggcgcaacggctgcgggatgtgcgcgcgccggaactgcccaccgaccggccaaggcccgctctgcgccgcttcacggcggccttctgccagatcccgatccccgctgccgcggtccgtggtgtgacgaagttggcccgcaccgcctcggtctccccgttcgtggtccacctggccgtcttcgacgtcctgttggcacggtgggcggacgagcctcgggctgtggtcggcacgccgctggcggggcggggcgagccggagctcgagaacctgctgggctacttcgtcaattccgtggtcctggtcgcggactgcgacccggggttgaccctgtccgaactgctcgtcgcggtccgcacggacctttcgagcgcgttcgagcacggggacgctcccttccaccacgtcgtcgaccggatcaacccggcgcgcgacagcagtcgccacccgctgtatcaagtcgccttccagtacgtgcccgaaagcgagcctctgcgtctgatcggcgtggacgtgacggaggtgagcgagcggttgctgcaccgcagcgaggtcaccaccgagttcgacctcctggccgaggtgcgggaggaggcggacgggcaacacatcctgaacctgcgctatgccacggacctgttcgacgccactaccatggacggcgtcgcccgggcttatgtcgagatactggacgccgccgtcgcgactcccgactcgactctcgcccggctcgccgaggcggcgatgtcgctgcccgccgcggggacgaagccatcgaggcgcccggagaacgtgccgcaccgcgtgccgtcgagcgatgccacgccttcggtcgcgccgcgcacggaactgcacggccgcatcgcggccgtgtgggcggaggtcctgggtctgccggaggtcgactgctcggccaacttcttcgccatgggcggcagttcactcctgggtgcgcagctcgtacgccggctcagcgcggaactgggtctgaacctcgagctgatcgatcttttcgacagcgagtcggtggacggccttgtggaattcctcgggacggcgaga

SEQ ID NO: 841 - DNA, 1590 bp, Streptomyces avermitilis
  CDS (1)..(1590)
gtgaacaccgcaccgctcggatcgtcccttcgcacgctgagcgatgtcctgcgccactccgcccgacagttcgtcgaacgcccggcgttgtccgcgggccctgtgcgcctgacctatgccgagctcgaccgatgtgtcgacgccttggccgccagagtgcgtgcggtggggatccggcccggtgaccgggtcggcctgagcgtggcccgcgggcccttggccctggtggcgtccgcggccctgatgcgcgccggctgcgcctacgtccccctcgacgccgcgcatccgtcccggcggctgcgccacatcgtcgacaacgccgggctgcacgtggtcgtctgcgacgagtccggtcgtgccgcacccgacatcgcggcgctgaccatgctgcacgtcgacggcgacgacctgatccccgggcctttcgccggtgccgccgccgacgacaccgtgcccggatcggggtccgtcgcgtacgtgatgtatacctccggctccaccggcgtgcccaagggcgtggaggtgacccacgccaacgtcctcgcgatgctcgccggcgccctgccgctgttcgacttcgccgaccgcgaggtgtggcccctgcaacacgcccacggattcgacgtcagcgtgtgggagatgtgggcggcggtggccatcggcgccaccttggtcgcggttccacgcgccgcccaacaggaccccgaatccctggccgagctgctgctgcgccaccgggtgacacgactccacatcgtgcccagcgtcttccaccacctcgccgaagtcgtggaggaggaggcggtgaacctgccgctgcgcaatgtcaccttctgcggcgaggcactcaactaccgggccatccagtcctggacgcgatcccagcccggaccgcagcccgcatggtgcaacgtctacggcatcaccgagaccacggtctacaacacgttcaagcggttgacggccgaggaagtgacccgggccgcatcggccacccccatcggcacggcctacgaccacagcccggccgtcgtcctggacgaggaactgaggccggtcgcgcctggccgcaccggggagatcctcatcggcggcagccaggtggcacgcggctatgtcgacatgcccgaactgaccgccgagcgcttcctccagctgcccgacagaccgggccgctggtatcgcaccggagacctcgcccacacggacgaggccgggcaactgcactacgtcggacgccaagacgaccaggtcaagatccgaggcttccggatcgagttgggcgagatcgaccacgccctgcgggccgtgccctggatcggcgacgcggccgcggtcgtccagagcacggcgcgaggggaaccggccctggccgcgtgcgtcgtcgtcaccgagcaggccgccgacctccgggacgctgcggacgacaggcaaaacgaggcgctcctggaccggctgcgcaaggagttggccgccgtactgccggatcacatgctccccggacgcgtcgtctgcctggaccggctgccgctgaacaccaacggcaagacggaccggcgcgccctggcggaagacctttcgcgaaggagc

SEQ ID NO: 842 - DNA, 2220 bp, Streptomyces avermitilis
  CDS (1)..(2220)
atgaatgccaccgcacccgctcggctacgcaccccggacggcatcgtcgaagtcgcctccgacgcactcgaccggccggtcgtgaccgcgcccagttggacggccgccgcgttcggcctcggatggacggtcgcccgacaccgccgcgaacaaatggacttcatgcgacgccgcagccacggacggctcgccgaagtactcggtcctcaagccgtgcaggccgacgtgcggcagcgcgtcttggggctcgcgcacgtcgcccgcgcctgctgggaattgctgcccatgtcgcagcggcacactctgcgggcgtacgcggacggcgtcaacgccgccgcaccgaacggcccgggcggtgcgtggacaccggtggactgcatcgcggtcacacagggggtgttccaagcgctctcgtcggacggacaggacgtccgcatggtcgaggtgatgcgacggacgctgccagcggccgtcgtggacttcctgctcgacccgcaggacgagttcgccgtcggcatcgacggcacggtgcccgatgtgtgccgatccgccctgccggtcgccgagttgaaggctctcatggccgaaccgcccggccctgccggaccgttggtggtctcggacggccgcccgatcggcagcaacgcctgggccgtcaccgacggagacaccgccgtcctcgccaacgacatgcacctggagctgaccagcccgtcgctgatgtacgccgcccggctcgtcgtcggggacaccggtgtcaccggcgtgaccgtacccggcctgcccgcgatcgtcgccggtaccaacggtcgaatcgcctggggattcacccggctcccggccgacacctgcgagttgcgggagctgaccccgggcagcacccccggcacatatcggcacgagggccgcgaccggcctttcaccgtccggcgggaacgcgtcagcgtcatgggcggtgacgacgtcgaggtggaagtacgcgagacccggtggggcccggtcgtcgaccaactgcgcggccgaccgctggtgttgagcgcgaacctcaccgaccccacggcactcgacttcgccctcgtcggactgtacgagagcgcgaacgtcgccgcggcggccgacctgctgaacgactgcggcatgcctcccctgaacgccgttctcgcggacacggcggccgacgtcgcctggaccgtgacgggccgccatccgaggcgtgcggggggaccacgcggcttctccgactcggaacgggacccgtggccgacgccacgcctcgccccccacgagctgccgcggctggtgacaccaccgagcggacacgtgatcagctgcaacaacggggacgcggccggtcgaaccgcgggcctcggctggaacttcttccccggcacccggtcccgccgcgccgccgcggcgctcgccgcgggcggaccccacgacgaggctcgctgcggcgcgctgcaactcgatgtggacgccgagctgtacgcgtactaccgcgacctggcgcttcgatacacgcccgagcgcgctcccgtgccgctgcgcgctctgcgcgacgaggtcctggcctggcgcggcacctcgcaccacgacgagtacggtctcgccctgctcgtgttgttccgggaactgctgcgcgaggagctgttcgccgccctgacccgtccctgccggcggtacgacgaggccttcacctactgctacaacggccacgaacggcctctgcgtcgactcctcgacgccttggccgcggacatggtgccgaagccttggcccgggccggccgcgttggtggtgggcatgctcggcagcgccaagacactgctgaccaagcgcaccggcagcgccgagcccacccgttgggggagcgtgaacgccctcgcgccgacacccctgggcggtgcgccggtccacggcggcccgccgggaggccacgcgggtgaacgcggcgtcggactgtccggttgcccggagagcctgcgggtcacacaacccgacttcggcgcggccatgcgcctggtcgtcgcacctgcccgtcccgaggacggtctgctgaccatccctggaagccccgccggcaccggccccgtagacctcgaccacatcgcccgttggacacagggcaagacgcaccccctgccgatgcgcgaggacacgccgtacggcgacggcgtacgcgggcctgggtcgctccgcaccccgacagggaggaccctg

SEQ ID NO: 843 - DNA, 1653 bp, Streptomyces avermitilis
  CDS (1)..(1653)
atggacacaggccccgtgccgcacgggcgacgcgacgcccgtacggtggccgacttcgcccgccgattctggcaggacctcctgcacgtccccgacgtcgacgacgacgcacacttcttcgcgctcggtggccactcgatgctcgccacccgtctgatgtcccgcatgcgcaaggcacttgacgccgatctgcccgccggactcatcttcgatcatccggtcttcgccgacttcgtcactcgaacgatcgccgcgctcggcgaggactcggcccccgccgacgaacggccgcgcacctcgggccgcgtcacaggtccggtgtcgccccagcaggagcggctgctgcgcatcgaggatgccctcgggccctcaccggtccacagcatcgtcgtgcccgtcgccctggattcgcccgtcgacggcgctgccctgcggctcgcgctgcacgcgttgctcactcggcacggcgcgctgcgcctggccttccccacgcccgacggaggcggcgcacaccagcaggtgatcgttccaccttgggcgcccgccgacgtcgaactggtggagcgggacatgcccgtgagcatcgaagggcaggccgaggacgcggccatcctcaaggacgtacgcctcgcgcacctcaagccgttcgacctcatgcggggcaacctgctgcgcgcccagctgttccgccgccgtcatgcggccgacctgctcgtgctgcatctccaccacctggccgtcgacggcgtgtcacaaacggtcctcctcgacgacctcgccgaggcctacacgcagttggtcaccgaaggccgtgtccacatggacaacagcgacgccctcacccacatcgactacgccctgcaccgcggaggccgacagggtgacatggcggccgactcccgccgccactggacgcgcgtggctcgtgatctcgcagcagacctggccgccgccgcggaacccgctccgcgcggcatgcggtatgtgcgccgcggtgccgaactggacacctccgtgctgcacgggctgcacgcatgggccggcaccgagggcgccaccgacttcgtcgtggcgaccgccgccgtcgccaccgcacttgccgctctcctgggccgccggcacgtcggcatcggcaccctgctcgacaaccgagcgcacgccgcccacgagcgcaccgtcgggcccttcgcgaacagcacactgctcgccgtaccggtgcccgatggcgcgacaccgcgcgacatcgtgcgggccacgcaggcccagctcgccgaggctcgccggtgcgccgacagcccactggacgacctgctcgggccaccctgcgccgcagtggggctgtgccccgacgacctggtggacgcggtggtcgccttcgaccggccataccgggcccccgccgaatccgccctgcggatgtcgccgctgtacgaccacggagacctcctggtgccctccgcgctcggcccgcggctgagcgtcaccctgttcgcccacgacaccggaacactgaggatcaccgtcgaacacacggaagatcccgcagacccccagaggccggacgcggtcctgagcgccctcgtggacaccctgcgactgttcgccgaagcgcctgacgcgaccgtcgcaccgtcccctgcggcggtgccgcga

SEQ ID NO: 844 - DNA, 795 bp, Streptomyces avermitilis
  CDS (1)..(795)
gtgcctacgcgtgacgacacccaccacggctcggccaccgcgacgggcctgtggttccccgcccctcccgcccccggcgactgcgccgtacgcctgctgtgcctgccctacgcggggggctcacccgtcatgtaccgcacctgggacaaggcactcgcgggcaccgcggacgtgctcccgctgtgcctgccgggcagggcccatcggtggggcgagccgctcgagcacgacctgcaccggatcgccgacgacgtggccgaggccaccgccccgctgcagaaggacctgccgctggcactgttcgggtacagcctgggcgcactcctggccttcgaggtcgcgcggggcctggcccgacgaggccgccctccgctcctcctcatcgtcgcggcctgcgcaccgccgcgtgagtgcggggcgctgtcccccaaacacaccctgccggacgaggagttcatcgctctgctgcgagagatgggggcgactccccaggccatcctcgacaacgaggagatgctttccctgctgcttccgatgctgcgatccgacttcgcgctggccgaccgctatcgccacacgcccggccccgtcctgtccacgcccatcgtcgccttggcggggcgcgacgaccccgaggccggacccgaggtgatggccggctgggcccgcgaaacgcagcagcccctgcgccgactcgacctggacggcggtcatctgttcatcgaggaggaccagccgacggtcatcgcgctggtgcgggccgcgctgcgcaccgcactggcacacaaagagcgc

SEQ ID NO: 845 - DNA, 1419 bp, Streptomyces avermitilis
  CDS (1)..(1419)
gtgacgtcgctcaccgcgcatcacgaggacttccccgtcgttcccgcggaaaggacggaaccgccgttgaagcaaggtgtcgatccacaacgggccaggctggtcgaggcgttgcgcgcccggcgacgaacgcagaccccccagacgctcccgatgaccgcgacccagcagggaatctggctcgccgagcagttgagcccgggcgtctcggggtaccacgacacggcggtcctgcgcatcgacggccccttggacgcggaggctctgcgcttggcgttgggcgacgcccgtgcggtccacgaggcgatgcggtgccgtgtcatcgaggccgatggagagccccgacaatccttcgacgcccccacaccggagttggctcacacggacctgggcgccgtcgatgcgcagacccgggcggctcggatcgaacgattgacagcgctgaccgctaccgaacctttcgacctggaggcgggcccactctggcgtgcccgactgatccgggtcgaatccgacgagcacgtgctgatcctcgtcttccatcacctgatcagtgatggctggtcccatggtgtgttgctgcgcacactgttgtcgcactacgcggcacgagcgcagaacacagccctgccccccactcccgatacatccgcctaccgcagatggctgctctcccgggtcacgcaggaacaggccgcggtggacagcggcagggcccgcgaggtggccacgcttctcgccgaggccccgtaccgggcagcactgccggggctcaaggggccaccgagcgatcggctggcggccgctgtggaactccccgtgtccgacgtgacatgggcctccttcgaccgggcatgcaggagagcgggggccactcgacacatggggctgacgggcctgttcggccacctcctttcccggaccctgagatccgagcgcacggtccttgcctcaccggtcgcgatccgggacgacccggacagcgcgcatctgatgggttgtctgatcaatgtggtgcccatggtgctcgtgccccgccccacggccgaccccgcggcggcactggccgcaggacgcgaggccgtcctgacggccctccggtacgcggacgtgccctatcgtgacgtggcccgggtcctggggccactgaccgcgtcggacgacccggtcaccaatgtcggtgtagaggagttcaacgctccgcaggagccggtgcgcgtgggcgatgtagtggtcaagccgatgccacgcggccatgtccggctgcggcacgacctcacactgagcgtcgcacgcagtggggcgagcgcccaactcctgcaccccgtccaaaactggaacgtgaacgaaatacagtccctcgcacagaacctggccgagctaatcagtgacactgcggcgtctgtcaccccggaaaaa

SEQ ID NO: 846 - DNA, 222 bp, Streptomyces avermitilis
  CDS (1)..(222)
gtgcccgtcgcggaggtgccggtcccggaggccgatccgcaccaggcgcgggaggtcttcctgaccggtaccgcatcggaactggtaccggcacgggagatcgacggtcaccgcttcgagccgtgcgggccggtgttcggccgactggcacgggccttccacgacaccgtccgtggccgcgcgttcggcgacctgggctggtcgaccggcgtctccgagcaa

SEQ ID NO: 847 - DNA, 1383 bp, Streptomyces avermitilis
  CDS (1)..(1383)
gtggtcggcgacgagcagatcgccgctctcgttcggcactacgccggccgtccggccgcgctcggcggatcgtctgccgcgaccgcactctcgccccagcagagcgacctgtggcgggcggcgcgcccgctcgtctccacgccggtgttcctggcgaccgtggtgttccggctgcgtggtccggtgcaccgcacggcgctggccgcggcggtccggcgactgtcgctgcgacacgacctcctgcgtaccgtgttcgagaacggcccggccccggccgcacacctcggcgagccgcctgagctgcgggtggtggaggcgcctgacgcggccgcggacacggcggaggaactcgttcgcggcatcgcccgtaccccgttccggttcggcgaggagccgttgttccgggtcacgctcgtctgccgcgccgaggacgactacctgctggtcctgacctgccaccaactggtgatcgacggctacggacagagcctcttgctgcaggagttcacgagtctgtaccgcgccgaaatacgcggggagccggatgacctgccggagatcaagcagccgtaccgggagacggctcgcctcctccggaacccggacccggaggtacgccgcggtgacgaggagttctggacgtcacggctccgcgatctgcccgtcatgagcctgcccggcgatcggccggggcccgagggggcgacgctggcgcccaccggggccgtcgagacggtgctgcccgacccggacggcgccgtcgtcgccgggttgcgccggcttcgggtgaacctgttcgcgctgttcgccgcggggacgatggcgatgctgcatggctataccgggcagaccgatctctgggtcgcgaccgtggtggacaaccggttgacacccgagtcacaggcacacgtcggcccactggccggaccgagggtcgtacgggtcgggttcgccgccgacgcgacgttcggtgtgttggcgcgggcggtgcagcgcgaggtctgggccaccatggaacgccagcacataccgttccacgacgtgatcaccgcggcgaccggagacggcgccgacatgcggaatctcgggtcggtcggcatcaccgtgaccccgtcgatccagctgcccgactggccgctcggcgacatggaacccctggagttcgacccgctggagggcgagccgagcactggttcgccgctggcgctgctcgtggaggagcaggcgggaaggtaccgcctgcgtctggagttcgatgagagccggttcagtcacgggcgggcgcacgacatgatgacgacgatcgccgatgccgtggtcgccgccaccgcggatccgcagcgttcgctcgcttcctggcggggtccgacatcagccgacgac

SEQ ID NO: 848 - DNA, 1623 bp, Streptomyces avermitilis
  CDS (1)..(1623)
atgatcgccgatcacccggctcggcacccgagtccagtcgaacagtggaacgagacgcggtacgactactccgcgaccagtcgcatcatggatctcatcgattcggccgcggtcaagtacgccgacgatccggccgttcgaacgacatccggagtcgcgctcacgcatggcgaactcgcggccgagagctcactgctcgccgagcgtctcgcggcgcacggcgtccttccgcgcacgccggtcggcctgctggtcgatcacgtcccggaggccgtcgtggcgatccatgcgattctgcgcgcggacgcctactacgtcccgctggatccacgatggccggcgcgccgcatggcggaggtactgaaggcgagcgacatcggccatgtcctcgtcacggaaccgtaccgcggcagggcgagcgacatcggcgacgacatgacgatcatcgcggtacgccacggcagtgaacccgaggtgctcgcgagatccgcctctcggccgtcggtccggcgacacgaggccgggcccgcggaaccggacgagttggcctacacgatattcacgtcgggctccaccgggcggccgaaggcggtggcggtccggcacaccagcgtcgtcaacctgatccagtggttcaatcggcgcaactccgtcgacccgagcgacatcctgctgcaggtagcggcgttcagcttcgatctgtcggtgtacgacgtcttcggggtcctggctgccggtgcgagtgttctcctgcttcccgatgccgagctggaagagctcgaggagatcgcgatcgccctcgtcgagcacccggtgacgctgtggaactccgcgccggccatgttcaccgccgtgacgctgctgctcgacgaatcgtcccgccagcaccgggatcgacttcgtcgggtcttcctcagcggtgactggatcccgctgaacaccctcgaggttctccgccgtgagttcccgcgcgcgactctggtggcgctcggcggtgccaccgaggcctgcgtctggtcgaacgacttcgttgtggacgaggtggacccgtcgtggcggagcatcccgtacgggcatccgatgcagaacagccggtactacgtccttcacgacgatctcacgccctgcgacatcgacgaaccgggcgagctgtacatcgccggtgtctgcgtagccgcgggatacctcggcgatccggccctgacggcggaccgatttctgccggatccgtgggaccagggcgatggtttcacgatgtaccggaccggcgatcgtgctcgctggacgtcgaacggatgggtcgaattcctcggccgcatggactcgcaggtgaagatccacgggttccggatcgagctcggcgagatcgagcaggtagccatgcgggtcctcgacgtcgacgaggcggtcgccctgaagctggacgacggagactcgccgtacctggccctcgcgctcagggcttcgggagagctggacgccaagacggtcaaggaaaagctgggtgaatggctgcccaggtacatggaaccccgtcgcgtggtcgtatgccggacctttccggtgggccagacgggaaaggtcgatcgcgcggcgctgcggaagctctttcagcccgccggg

SEQ ID NO: 849 - DNA, 891 bp, Streptomyces avermitilis
  CDS (1)..(891)
gtgatcggtgcgggagcggctggcctgaccgcggccaccatgctcggccgttccatgcgaagcacgctcgtcatctcacagccccggcgacgcaattcgccggcgagctcggtcaacaacgtcccgtacgccgacggggcggccccggcggacatctatcggaagatggaacaggacgccggtcggtacggcgtgaccctgctgtgggacgaggtcacatccgttcgcgcgtacgaggaccacgtcgtcgtcgagggcggcgcgaatcccggtctgcgctgcagaaggctgctcctcgccaccggccgcgtcgacgtcctgccggcctggctgccggacggtgtctggggcagatcggccttcgactgcccctactgccacacgtacgaacgtagtggcagcacgttcgtctgcgtgggcaccggggacgagacgctcaagttggcggccttgtcgaggcagttcgccaagcggatgacggttctcgtcggggacccgtcggcgagccggggaagactcgccggtctgctctcccgccatgacgtcgaagtgctgtgcgatgaggtggtccgtgcctccgcggacccggcgggcggcgtcatcctggagacggcccacgggcggaccctcagcgccgacaccctgctgctcggcgatgtggcccggccctatcggaaattcgccgaggacctcgacctcgagctgtcggcggacggcttccccgagacgagcctgtacgggatgacgtcgaatccgcttgtctacagcgccgggaacgtcgaaggatccccgtacttcatgtggaccggagcggcgagcagcgggatcaacgccgcccgcgcgatctgcgaggatctcgccttcgccagtgaactgctggacgactgggag

SEQ ID NO: 850 - DNA, 1968 bp, Streptomyces avermitilis
  CDS (1)..(1968)
atggagcagacgggcccgttcgtcgtccacacggcagccgattcgtacacgcgtgacctgcgcgatccggcgctcgtgccgatgctgggcgtcgacgacagccggcttgccgccctcgcgagcctgatgggagcacctgcccggcgcaaggacccggacgtctcgggcgcgctggtggtggcgccggccggctcggcggccacggccgtgggacgggcgctggcagatcgcttcggtggctcgttcgtgacgctgtccaccggcggactgggccggatcctcgacgcacgcctcgaagccacgcaggtggtcttcgtcgctctgcacgacgaaatcgatctcgacatggtcaccgagtcgctggaggtcgtcagcgcataccggcatgatggccggcacgccacgatcggattcgtgatcgggccggaccttcccgagctgagctggctgctcgccaagggactcagctgtcacctccggaaacctccggagcggagccggctgaccgtggtcccttggctgcgtcagcaggcggcggcgagcggaatcccggcctcggatggcgcggacgccgcgccggaatgggtcatcggcgaccgggcgagccgcgcggtgctcgagccgatgctgtccgagcagtacaccggactcgtgtccttcgcgtcggccgggcgagaacacgcactgatcctcagcgacaccgtgatctgcggcgaccatgccggacatcgggcgccgtctgcccagggcgcggccgcaccgagctgtgccttctcggaccgctgcttccgggacggcgtccgggcgcgggacgtcatcaaggcggcccgcgtccaggctgacatcgtgttcgcgaactcgtgcatggcctggcgccccggcaccggtctggtggcggccgagtaccaactggcgggcgcgttccagtacgggattccagcggcctacatcggtgccgttcatcagatgctgccgaacctcacgatcaacgacctggtcggcaccgcggtggcggcgggcacggacgccgggcggacctgcgccgcggtcaatgaccacctccgggacagcggtcgtgagctgccctacttcgcggtcctcggactgccctgggtgaccgcgggcggtggatccgagcccccgcccaccaccgacgccgggcccagcgtcgacgcgcacgagggcgtccgcgacgtgaagccgcaactgctgcgactcggccggaccgtgcgggcgctcagcgagttcgggccgaccggattcatgccgccggacggaatcgtcgccatggaagccgagatcctggaactggcccggacgctgaagaggacggccctcggcgcggatctcgccgagaaggccgtcggcccgctgcgccggctgggcagcctgatcgccgacgccgaactgagcgcggtcgccgacttccatgagttcggcaagatgagccactccgccctcaacgagatgtgggagggcattctcgacacgagtgtgcgcccgatcgacgatgcctgcccgtactgcaagggccggctggcggaacttgtcgcgcggcacccggtgtacgagcaggtcgggcgtcgcgcgctgatctgcaacgtgtgcgggccgacagccgactccccgctcgagccggtcatcggcgaggttgtcatcgaatgcccgagtatctggaagcggccgggcaccgtcaccgtcgacgtgctgatgacacccgccgcgagcgtctcgcaggagatcaccgcggccggcgccatccatacgtcgggggctgcgaacttcggcatgacgttcccggacgcgcagcggatcgccatccggccgggatctcctgcacggatgcgcgtcgacgccacgctgagcgccgaggcgttcacgcaccacgagcacttcgtcaggttcgtagccgtggcggaagggctcgtccactacgcctcgcggccggtagcggtcgcgccggccgcg

SEQ ID NO: 851 - DNA, 1305 bp, Streptomyces avermitilis
  CDS (1)..(1305)
gtgcttccgaggagcggacaggacatgcgtcgaggaaccgtggtcatcgtcgagccgtactcgtcgggaaacatgctcgcgccggccttccggcagggcggcttctcgccgtgcgccgtgacgttgtccgggctctcggcaccgaactccgcgacgcttcgcctgtccgacttcgacgaacacatcgcctacgacggcggtgaactcgggccgcccgtcggccggttgcgggctctcgatccggtcgcgatcgtgccggggacccataccggcgtcaaactggccgacgagctcgccgcggtgctgacaccgaagctggcgaacgcgccagacctcggatcggcgcggcaccacaagggcgacatgatcgccgccgtcgcggctgccgacttgccgacgatcaggtctctgtgtacgtccgacgtcggcgacgcgctcacctggatcacccgtgagcgattgtccggccgtgatctggtggtcaaacctgtcgactcggccggcacggacagcgtccggttcgttcccggcggacatgacctgcgtgccgtcgtcacagggttgctcggctcggcgaaccgatacggttcgcccatttccgaggtgctcgtacaggagcacgtcaagggcgtcgaatacgccgtggacaccttcagctacgagggcaggcacacggtgaacgacatcgtgcggtaccacaaggtctccagtcggcgacacatcgccctgtacgcgagcatggagatcctgccgatggacgcaccgggcaacgacgcgatcatcggctacgtcaaaggggccctcgacgcgctcgggatcacgttcggcgcggcgcacaccgaggtgatggtcaccgaggacgggccgctgctcatcgaggtcaacgcccggctctcgggcggcgggcacccgtggacctgcgagctggcgaccggtgacaacagcgtcgaccgcatggtgcggtacttggccggggaccggaacatcccggacggctacccgctccaactgaccaccctcgcgatcttcttcgccgtgcgatccgccggagtcgtcagcggcctctcccgcctggacgccatcgtggacctgcccagctgctaccacctccaggtcaacgttcaagacggagactatgtcccggagacgtccgacctcttcgacgcgcaacggctgggcatggcggtcctggcgcacagcgaccccgcacaggtcgccgccgatcatcgagaagtccgcagaatcgcggccgaagcggggcgtccgggtggcttcaccatcgatccgaaccgaggcggaatggag

SEQ ID NO: 852 - DNA, 246 bp, Streptomyces avermitilis
  CDS (1)..(246)
atgagcgacgacgagccgacgtccaccgtcgacaccacagcggtactgctggggatctggcagcagctgttccgggatcagcaggtcggtctcgaggacgacttcttcgacctcggcgggcattcgctgctcgccactcgcgtgatctcccaggttcgtgcggcgctcggcaagcgggtcatgttcaaggacatcacggaatgtcgcacgatcgcgctcctgtcggcccggatcgacgagaagagg

SEQ ID NO: 853 - DNA, 2748 bp, Streptomyces avermitilis
  CDS (1)..(2748)
atgtccgtaccggatactccggtccagtcgctgcgatcctccagcgaaccggtgctgtgtgagatgttcgcgagcctgttcgggctggacagcgtcgacgccgatgcggacttcttcgacatgggcggcacttccgcgctggccacccgactggtcggccagatccgaacggtcttcccgggggatatcacgttcggcgacgtcttcgagaagcccacccccaggggtctggcgagggtgctcgaccaggcggccgcggcgagcccgcgcccccggccggccggccgcccggcgaggatcccgctgtcccctgggcagtcgacgttctggttctacgaacagctgcgtggacccagcgcggatcacaacatcctgctgtcgctgaagctgaccggaccgctggatcgggacgcgctcgcctgggcgttcgatcggctgatcgacaggcacgagatcctgcgtacggtgtttccccgcgatcaaggcgagccccaccaggtcgtgctcgacccggccgccgcccggccggggcttcgcgtggtggacgtcgccggcggccagatctccgaggagctgtcgcggcgcgccgcgctgccgttcgacctcaccaccgagcctccgttgcgtgcctggcttctggcgatcagcccggaggaacacgtcctgctgatctccctgcaccacatcgccggcgacggctggtcgacggccccgctctggcgtgacctgtccgccgcgtacctcgcgaggcgcgacggactgcaatggcagccgcagccgcttgccgtgcagtacgcggactacagcatctggaagcgggacctgctgggccgcgagtccgacagtcagagcatcatcgcccgccaggcgcggtactgggcacagaccctcgccggtctcccggaagagctgccgctcccggtggaccggcagcgtccggcgcggttgaccgcacgtgcggacggcgtgcggttcaccgtctcgccggatgcgcatcgccggcttctcgcacaggcggcggccgcacgggccaccctgctgacgaccctgcgcgcggccgtcgcggtcctgctcgccaaactcgggggcggcggcgacatcccgatcggcggcctggtgtcgggtcggaccggtccagggctcgaggacggcatcggcttcttcgtcaacacccaggtgctgcggtgcacctgggacggagacccgaccttcgagacggtgctcgcccgcgtccgccaggccgaaatcggggcgtacgccaaccaggacatgccgttcgaccggatcgtcgacctgctgaacccggtccggctcgcgtcgaggaacccgctgttccaggtcatggtcgtcctcgacgaagggatcggcgccggtcgcgaccttttcggttgcgtcgccgagcgacaggaggtggacctcctcggcctcccgacattcgacctgtccttcaacttcgccctgcccgaggcgcacgaaggcgccggtgccggtatcgcgggctggctcgggtacagtcccgacctcttcgaccgctcgacggtcgagcgcatcgccgattacgccacacacatcatcgacgcagtgaccgcgaatccggctacgccgctcagtgcgttcgccgtaccgcttccggtcgacgcccggccggcgagaaggaccgctgtcgacacgacggtcccggtgaccgcggacaccgccacacgtccccgcacaccgcggctggacgccctctgcggcgcgttcgcccagatcctcggggcagagaaggtcggggtcgacgacaacttcttcgggctcggcggacactccctgatggcggtgcgcctggtgagccgcattcgctcgacgctcggcacggaactgccggtacgcgtgatgttcgaacagccgacaccggcggggatcgatcggtggctggaccaggccgaggcgggatccggcacgccgggtccggccgccgacggcctggacgtggtgctgcgcatccgtcccgagggcgaccggacgccggtgttcgtcatgccccccgccctcgggctgagttggtgttacacaccgatgagccgctggctggcggacggatttccgatgtacggcctgcaatcacgtggaatccgcggggccggacctgtcggccggacgctgacggacatcgcgacggacttcgtcggcgagctgcgccgcatccagccgaacggcccgtaccagctcctgggctggtcattcggcggcaacgtcgcacacgccatggccgtgatactcgaagccgctggagaagaggtctccatgctggcgctcctcgacagctacccctgggacggcgagcagaccgacccgacgctgaacgtcgagtccgcggcggccgacccgcagctgacaacggaggagctgcgccgggtgctccaggcgtcgcccggcacggcggcggccgtccccgacgagtaccttccggcgcttgctcaggtcttcgcgaacaaccgcggcgccctgctgcagcaccgatccggccgcttcggcggggacgttctcatgttcacggcggcggacagcgtcgcacagggaatggatccgcgctcgtggcagaagttcgtcgacggcagcctgaagacctggtccgtgaacggcaaccactacgaggtcttcggcccggagccattggaaacgatcatgtccgtcgtcaatgcggagctcaccgcgcaccatggccggaatcgggcacgtgcgacgcaggagagaggagtggccgga

SEQ ID NO: 854 - DNA, 465 bp, Streptomyces avermitilis
  CDS (1)..(465)
atgaagaacatgtcggccacggccatcgatcttgatgatctcgacctgttcgtctccggcgacccgcacgccgcctgggcgcggttgcgccgtgaggctccgcttcactggaacgccggcccggacggcacaggtcatggggcgttgacccgctacgcggatgtcgagacgatccgggccggcgacaccgtgaccctgtggaatgcaccagccaaccgcgatccggacgcctttgccgaacccgatcgactggacctggggcgcactcccgaccagcacctggcgttcggcgtcgcgcatcaccgttgcgtcggcatgggggcggcgcgcagggagatcgcgctgctgaccgaggagatcgtgcggcgagggctccgctgcgaaatacccggtccggtgcgacggccgcgctcgaacttcatgccgggcatcacgcacctgccggtgacggtcacggatgtctgg

SEQ ID NO: 855 - DNA, 1962 bp, Streptomyces avermitilis
  CDS (1)..(1962)
atgcgacggggaatgtgccgagggagagcttacgtgccactcagcgaggtgagcggcgggcagaaatccgccggggagtccgccggggccgaggaaggcggcatgcgccgacgcacgccgccgatcgccgtgctcaccggtgagatgctgaccatggaccgcctcggcaccctgggcctgtcgggtctggtcgccctcgcggcggtgctgcccgcctccctcgccgtcacctctggcgcacttgcggggaggctcgccacctcccacgggaaggacctgttcgacggcgggggcggcgcggccgcgctcgcactcggcgccgtgttcctgctgatgcaggtggtgcctccgcttgcccaggcggtcgccgagtccctcggcaggcgactgcaccgagggctggccgagcgtgtgctgaccgcgctggaacgccccgccgacctaggccgcctggaagaggcgcgaaccagggaaatcgtctccgccgcggaccgcggactgaacggcacctgtgtccgggacgccgtggtgggagctgtcaacgtcggcatcgcgcgcggcggcgcggcgtccggtgtgctcctcctgctcgcttaccgctggtggctcgccgtgctgctggcagtggcctacggctacgccatggtcatcgtgtcgcgcatgtaccagcgggccctggagtccgccgaaggcacccccgccctcatgcgccgcgcaatgtacctgaagaacaccctgtgcggcgcctcggcgggcaaggaggtgcggaccttcggactgaccgactggctgctcgaccgctacaccacggagtggcgcaaggccatcgccaggacccgtggtgaccgcgcgggtgccgcacgggtcagcctggtgagcggcgtggtggtcctggccgcgcagggactcgcgttcgtgctgctggtggcggacgcggtcgacgggcgggtgggcgtcggcaggttcgtcatgttcgccgtggcaggcgtcgggctgctggggctcggcatcgtcacccccgatctgctgaacatcgaagtcggcggcacggtactcgcggccgtgcggcaactggaggcgcacacggcaccaccggacgcggccccgccgacgccccgtggaccgggcaccggcggcggtgacgccctggtcaccccgtccctcaccgctccgccgtccaccgccatgccgcagcggtccatcgtcttcgaagacgtcggattccgttaccccgggtccggcacctgggtacttcgccacctcgacctcaccgttccggcgggcacgtccctcgccgtcgttggtgtcaacggcgcggggaagaccaccctggccaaactgctgtgcggtctgtacacgccgaccgagggccgtgtcctcgtcgacggcaccgacgtgcgggaccttccgcccggcacatggtggaactgctgcgccgccctcttccaggactgggtcaggtggcggctgccgctgcgggacaatgtcgcccttggcgccccgcaccgccctgcgaccggaccggagctggcggcggtcgcccgcgccgccggactcgacgaggtgttacgggacctgcccgacggctggtccacggtcctcagccgcgagtacggcggcgtggacctctccggcgggcagtggcagcgtgtcggactcgcccgtgcactgtgggcactgtccgcgggcggcacgaccctggtgctcgacgagcccagctccgctctcgacgtgcgcggcgagacggagctgtacgacctgctgctggccgcggccgagggcaggaccatcgtgctcgtctcccaccggttctccaccgttcggcacgccgacacgatcgtcgtcctcgccgacggagcggtggccgagagcggaagccaccaggagctcatggacaagggcggtcggtacgcacacatgttcacggtgcaggcggaccgttacgtcgagcggggtgaggac

SEQ ID NO: 856 - DNA, 1800 bp, Streptomyces avermitilis
  CDS (1)..(1800)
atgacgcgtcccggccgaccgcgctgcggcccgctgcgtgccgcgctggcgctctcccttgaagccgatcgccgcgccaccctgatcaccttcgtcagcttcggcctacggcccaccgtccccgtggtcatcctctacctggtgagagtcgtcgtcgacgccatcgtctcgcacgaccaaaccgccctgtggaccgctgtcggtgccgccactctcgccaccggtctgtccatgggcagtatcacctacgccatcgaactcaacgtccgcatgatcgaggccaccgccgcggtggtcgaccggcggctgatgcgaacgatcggtggtctgccgggggtggcccacctggacaatccggaggtgctcgaccgcgtcgagatgctgcggcaggaacgcgtccatctctccgagggcggtgacgtgttcgccctcgtcgtcggcgccgtggtgcgcgcactggtcaccggcctggtgctcgccatggtgcagcccctcctgctgttcctgccgctgctggccctgccttccctgctcgcctcccgccgcggccagcgcaagcggtccgacgccgtcgcccggtcggcgacgacctcccggctggccggccacctgtacaccacgggaacctccttgcccgcgggcaaggagatccggctcttcggtctgggacccgcgctgcgcgagcgctatcgcaccgccgccgcggacgccgacgccaccgtcacccgcgctgtgtggggcggcctggccctgaactgcgcgggcggggcgctgttcgctgttggctattgcggcgccctgttcttcgtactgcacgacttcgcccgcggcacgacctcgctcggggatgtcgtcctcgtcctcgggctcgtcacgtccatcagcacccagctcggccaagccgtcgtcttcgccggcttcctccaccaggtcctctccgcgtcccggcggctgctgtggctggagcggtatgcggccgacgtggctcggccggcccctaccgcacccgcccccggcccccggctgtccacggggatccgcttcgaaggcgtccacttccagtacccggacaccggcacctccgtcctgagggacatcgacctggagctccccgccgggaccgtggtcgctgtcgtcggggccaacggcgcgggcaagtccacgttgatcaaactgctcaccggactctacgaacccacgcggggccgcatcaccgtcgacggcgtggatctcagggaggcgcccctcgaggcctggtacgcgcgcaccagtggctgcttccaggacttcagccgactggagttcaccgtccagcacagcgtgggcgccggatcggttccgcacgccgacgaagccgcgcgggtgtgggaagcggtgaagcgtgcagccgccgcggacctcgtcgagcgcctcccgaacggccttgccaccgaactcggcgcctccttcgacgccggtaccgagctgtccggcgggcagtggcagcgcatcgctctcgcccgcgcctgcatgcggcgcgccccgtgcctcctggtgctcgacgaaccgaccgctgccatcgaccccttggccgaggacgccctgctgagcgcctacgtcgacgccgctcggcagagtgcggcagcagcgggcggcatcacgctgttcgcctcacaccgcctctccacagcgcgtggcgccgatctcatcgtcgtcgtcgacagcgggcgcatcgtccaactgggccggcacggcgacctgatggcacagcgcgacagcatctaccgcgacctctacgagagacaggctcgcgcgtacgcg

SEQ ID NO: 857 - DNA, 1602 bp, Streptomyces avermitilis
  CDS (1)..(1602)
atggccgacggcgtcgccacaacggtgggagcagtgttctgcgacctcctgaacgtgcccgcctgcgcagagcacgagtccttcttccaactcggtggagactcggcgctcgccaccagggccctggcactgctcggcaaggagtacggcgtccgtatccccttcgccgaactgtaccgggacgcctcaccggcggcggtcgcccgggtgatacacgaactgcgcgcagcgcccgtcgcaccgcggcgctccctcgccgatgtggcccggcgccggcgccgcacctggttcccgctggcactcagccaacgcgcgctgcacaagatgaatgccgccaccgggggcgcggggctcttcaacaacgtgggcgtcctgcggttcaccggcgatatcgacgtcctggcgctgcggggcgctctggaggacaccgtctcgcggcagtccgcactgcggctggtgttcggtgttcacgacggccggccggcccagcgcttcgccgacatcggtcccgacgtcaccgaggccgatctgcgcgacggcggtgagccggcgttgcgggcacgggtgcgccgcgagcggctccgcggcttcgatctgaccggtgccggtccggccgcgcgtttcgttctcgcccggaccggcgagcgcgcgtgggtactcgtgtccgtcttccaccacatcgtgttcgacggcatgtcccaggggctgttcgtcgacgacctcgcccacgcgtacgcctgccgcctgggcgaggccagtgcgcggcccccgctggccatggactacgccgacttcaccgaatggcagcacgccaccttgtgcagtgaccgtcttgaagctcacctggacgccatgcgcgcctcgctgcgtcgctcgcccacgccctcgctctccccggcgggggcttcgggacgggctcgcagcttcatcagcagggcacggccgttcaccgttgacgcgcacctcacccgcgccctgcgcgcgctggcggcacgctgcgacaccactctgttcgtcgtcctgctgagcgctgttctcgacttcacggcacggcgtaccggcgacggcactccggccgcggccatccagacctcgaaccggggcctggccggaacggagggcaccgtgggctgtttcgccaactccgtccacgtcaccgtcgaccgccccggagggacaacggccgcgcacctcgtcaggctgacgaaggaggcgatggccgaggctcttactcaccaggagatgccgacggaggtaagcctgagcatcctggcagaacgtggcaaactgcccagcggaccgaacactctgccgcaggtcgccttcgccctgcagcccccgcgcgacgagcgccgcgacctgccgggagggcggctcgacgctgcttatgtcacccaggagggcgacgcggtggacccgacttcgctggccctggtgctcgaactgttcaccgagaacggacaactcaacggggtgacacaccaccggctcgccgactggtcgggcacggcgttcgccgcggcggaacaagacctgctggctgccttcgcccgctgcggcggggccggttcggacctcgaacacctatcgcgacagaaaggc

SEQ ID NO: 858 - DNA, 219 bp, Streptomyces avermitilis
  CDS (1)..(219)
gtgcccacgtcattttcccgcatcctcaacgaggacgatctcaccgaagtacgcaaccagtacctggaggcactggaggcgctggaggcggaggagaacgccgagcagaggggcgaagagcgcgacgagcagcccgccagaacccacgaggcgggggccgcatccgtcactgcccccaccgagcaagccgcagccgcagaagcagacgcggaagaggag

SEQ ID NO: 859 - DNA, 933 bp, Streptomyces avermitilis
  CDS (1)..(933)
gtggacttcgtgaccatcgacgacccgtccgtcaagtcccgcctggaacgcgacggtgtggtcctcatcgacagcctcctcagcaaggacgaggtcgccgagacccgggcgcagctcgagcgctatgagagggaggtgctcgcggacgtcccccgtgtgcactacgaattccatgaggacggcgtactgcgcaacatgacggagatacagcgctacgacgagtggttcaaccgcttcggcaaccaggaccgcttcttcgatctgttccgtggggtcgtcgactgggatccggcgctgttctacctggagaccttccccaagcgccccggctgcaagccgctgcgcatgcaccaggagctgttcgcggggcccgtcgacccgccgcagtacctgcacctgtggatagcgctcgacgacgtcaccaacgacaactcgggcatggtcttctaccggggcagccaccgcttcggcctcgcaccccacatcttccacccggacggtctaccggaggtccagcccgaactgctcgagcgaatcgagcacatgcgcgtggaacccgacatcccggccgggtcagcagctctgttcgacggcggcaccattcacggcagcaaggcgaacatcaccgaccgcaggcgcctgtccctcgtggtcgcggtccggggcagggacaccgtcgtccacggtgacctggacattttcgcgagcatcatcacgcggttcttccgcgaggagatcggcgtcgccaagtgttcggcagaagacgacttctactccctcggaggggacgagcctgccaggagccgggttctcaaacgcatcgtggactactacggcgtcgagctcactgccgatcagctggaccagcggcgcacccccagggcgctggccgagaaactgatcgaactgaccggctggcacgagctcaacacc

SEQ ID NO: 860 - DNA, 963 bp, Streptomyces avermitilis
  CDS (1)..(963)
atgcgccaccgtaccctcggagccggcggcccggtcgtcagcgaggtcggcctcggcacctggcgccccctgtcgcgggacgggcggcgcggcgccgcccgcctcgtgggtgccgcccgcgacctcggcatcacgttgttcgacactgccggctcgtacggtgacgcggaggaggcactgggcatcgccctgcggggtgcgccgagagagtcctacgtgctgtccaccaaggtctactacgagcccgggggcacggtggcggggctgtcgcgcgcagccgtcagagcaggtgtcgagcgcagcctgcgggctcttcgcaccgaacacatcgacctgctcagcgcccaccggttcgacgaccgcacacccttggcggagaccctcacggccttcggggaactcctcgaggaaggcaagatcgcccactacggattcagtgagtggacggcgcagcagatcgccgcggcctgtgcggcggcaactgaagtgggtgtccggcctccggtcgccagtcaaccgcagtacagcgtcctgtggcgggtcccggagaaggccgttgtgccgctgtgccaggacctcggcatcggcacggtggccttctggcctctcgcacagggcctgttgaccggcaagtacgcgcccggcgaaccgcccccggcagattccagggccgcggaccccaccgggaggctcgtgatggaccacttcatggcggagccgatcctggagcgggtgcaactcttcgccaggctcgcccggcaccaaggtatgacgccagcccagctcgcggtgtcgtgggtgctcaaccggcccggtgtcacttcagcactggtcggtgcctccacccctgaacagcttaaccagacggcgtctgcagccggggtgctcctctcggaacccaccatggaactcatcgacaagatcttcgccggatgtgtgtatgacgatgtcgccggcacaggg

SEQ ID NO: 861 - DNA, 288 bp, Streptomyces avermitilis
  CDS (1)..(288)
gtgcccgctactcgtcacctccgccggcgtcgtccgtcaaggtgtgacgccgtcgtcgaccacgtggacgccggctgccgggcgcgctgcatgatcagggaccgggatgggaagttcccgcagttgttcgacgaggtactcgaggacgcgggcatcgaggttgtgctcagcggcgtccggataccgaggatgaactcggtcatgaagcggtgggtgcagacctgcgggcgagaactgctggaccgcacgttgatctgggaccggcgccatctcctgcgtgcactgtac

SEQ ID NO: 862 - DNA, 1785 bp, Streptomyces avermitilis
  CDS (1)..(1785)
atgttcagcgccggcggctgtacctacctcgccgtcaacacgcacaccatcgccaccgtgacccgcggcgacgacctggcggtcggctacgcgagcgccatgctgggcgccgtgcacggcctggtcggcgacgagctgggggcttactccggtgctgaacatcaaccgagtgaagggatcaccgtggagctgaacgactcgaaccggacggccgtcaagccgggcggcacctacgtgcatgcggtcggaaacaccccgcccaactggaacctgctctcagcggtcggcaacgtcgtcgagacgggcatggtgctgcaactgatcacgccgagcccgtacgtcgcgttcccggacctgcagaaccactggaacgaggatctgttggccagtgagccggagctggtcgcgacggacccgcagaccatcgtgtaccggctgcgaccagaagcctgctggaacgacgggaccccggtcggagtcgaggacttccgctacacctggcgcgtgtccagcgggcaccacagccccgcgtgcctgccgtcgacccatgccgggtacgagctgatcgagtccgtggagggcgaccacgacggccgcaccgtcgtggtcacgctcgcgccgggcaaggcgtttcccgactgggacgcgatgttctcgtacctgtatccggcgcacatcgcggcgcgcgccggtgacctcgggacagccgacggtcttgctgcggcgttcgcctcgttcgaccaggtggtacctacctggtcggcggggccgtaccaggtggagcacatcgagcccggcgtcgaggtggtgctggttgcgaacccgaactggtacggccgagtcgtgccgagcctcgaccgcgtcgtgttccgggtggtgagcgacccggtggcgctcgtcgacgcggtgcgtcaccgggtggtgcacggcatgtccaccccgcatccgaccaaggcgctcgtggacgcgttccgtgacatgcccggtgtccggtacgagctgagccaggggctgatctgggagcatctggacctgaacacccgcaatccgttcctcgccgacgcgggcctgcgtcgggcgatcctcacggctgtcgaccgggacgagatcctggccgagaccgtcggcaccttccatccggacgtcaaaccgtcgaacagccacaacttctatctggggcagcccgcctaccgcgacgtgatcaccggcaccggccagggcagtggcgacatcgcggcggccgagcggctgctgcatgccgccggatacacgatccgcgacggccgcctgcggaccccggacggctcggccgtcgccgtgttgcgattcaggcacgcgcccggtgacgtcatgcgccggcgcaccggcgagctggtgcgcgatcagttgcgccacatcgggctggaggtccgcatcgaaccgaccgaccggcccggcacgatggtggccggcgactacgacatcgtggcgttcaattggatcggcagcccgttgcgggtcgggccggcccgtgacatgtggaccaccggcggcggtatgaactttggtcatttctcccacgccgaggtggaccgcctgatcggcgaggcgaacgagacgctcgacttggtcaaggcccacgaactgctcaaccgcgcggacgaggtcctctcccacgaggcgtattcgctgcccctgtgccagaaaccgagcctgctcgtcgtggatgaccgcttcgccaacgtgcgagcgaacccgaccaacgggctggtcatctacaacgcccaggagtggggcctgcgcgcg

SEQ ID NO: 863 - DNA, 963 bp, Streptomyces avermitilis
  CDS (1)..(963)
atggcccagccgttcccgcccgtcgaaccgtacgcgcacggcctcctcgatgtcggcgacggcaatcggatctactgggagaccagcggcagccccgacggaaaggcggccctgtgcgtgcacggcggccctggcggcggaggacgccgcggcagccgcaggatgttcgaccccgaggtctaccggatcgtcctgttcgaccagcgtggctgcggtgagagcctgccccacgcctccgacccggccgtcagcctcgtccacaacaccaccgaacacctcatcgccgacatggagcggctgcgcgagcacctgggcatcgagcgctggctcctctacggcggctcttggggctccacgctgattctcgcctacgcggagcgccaccccgatcgggtctcggagatcgtcatcgtcggcgtcaccatgaccagaccggaggagaccgactggctctaccacggtgtcggacgcctgctgcccggcccctgggaggcgttccgcgacgcgttgccggtggcggaccgggacggcaatctcgtggcggcctacaaccggttgctgaacagtcccgatgacgcggtccgaaccaaggctgcgcgggactggtgcgcttgggaggacgcggtcatcgcccacgaggcactcggcaagccgggccagtacagcgacaaacccgacgatgcgctgatggccttcgtccggatctgcgcgcactacttcgcggacgacgcctggctcgaagatggacaactgctgcgtgacgcacaccggctggccggaatccccgcagtgctgatccacggccgactcgacctgggcagcccgctgaagaccgcgtgggagctgtcaaaagcttggccggatgcggagctcaaagtgatcgacgactccggtcatacgggcagcccctcgatgcaggacgcgatcctggagtcgactgagcggttcggcaagaacgggcgc

SEQ ID NO: 864 - DNA, 429 bp, Streptomyces avermitilis
  CDS (1)..(429)
atgtccaaagccgcacctacgaacacgcgcaccgtggttgaggagttgctgcgcagaatcggcgagggcgaccccgagcgcatcgccgatctgtatgccgagcagggcgattggaagcttgactggccagaggccgagcacggccgtactgccacgccgtggatccgtcaccggtccacccgggccgacgtggccgcacactttcgcgagcttgccgcgcaccacgtgccggagcacgcggcgaccgaggtcgagcgcatcctcatcgacggaaacgacgtggtcgtgctcggcgagatccgccagaccgcccggcccaccggacgtgcatatcgcgcgcggttcgctctgcacctcaccgtcgaagacggccttgtcacgcggcaccatgtctacgaggacagcctcgccgtcgcccaggcgttcgcg

SEQ ID NO: 865 - DNA, 528 bp, Streptomyces avermitilis
  CDS (1)..(528)
atggctgacgtgatcgttctcaacggtggttccagctcggggaagtccgggatcgtccggtgtctgcaggcggtcttgcctgatccgtggctggctctcgggaccgacacgctggttgacgcgatgcccgcgtccatgcaggcctctgatgcggggatcgagttcgctccggacggagaggtgatcgtcggaccggagttccggacgctggaagcggcatggatcgagggggtcgccgcgatggcccgtgcgggcgcccgggtcatcgtcgacgaggtcttcctcggcggagcggactcgcagcagcggtggcagaaggctttgcgcgacctgcgggtgctgtgggtcggcgtccgctgtgacggtgccgttgccgcaggccgtgagatcgcacgaggcgatcgggtcatcgggatggccgcgtcgcaggcggatgtggtccaccggggcgtggtctatgacctcgaggtcgacaccacacatgccgagtcgatggagtgtgcacgggccatcgccacacatgtcagg

SEQ ID NO: 866 - DNA, 495 bp, Streptomyces avermitilis
  CDS (1)..(495)
atgacgttcaccagtgccccgaagcccgtcctcgtccgcgccggcgaggccgagacactgcaggacggtgcaaccagcctgatcacgctgctggccgacgcgaacaccaccggcagtgcgctgaccgccaaccgcgcgacgctgcacaagggctcgcccggtgctcccgcacacttccacacccgggcaaccgagatgttctacgtgctcagcggatccatgcggatcctgctcgacgaccaggtcctcacgctcggccagggcgactttctgaccgtcccgccgaccgtgccgcatgccttcgccccggccccggacagcgaggccgagatgctcgtcgtcttcactccggggatggaccggttcgactactaccggctgctggagcgggtgtaccagggcgaggcctcggtacaggacatccgcgacagctccgagcagttcgacaaccactacttcgagagccccgtctggcagcaggaactcgcccggcgc

SEQ ID NO: 867 - DNA, 957 bp, Streptomyces avermitilis
  CDS (1)..(957)
atgccccgaaccatctggtcaggcgcgatcagctttggtctggtgaccgtccctatccacgtggtgagtgccacggaggaccacagtgtgcgttttcaccagtaccacctggaggacatgggccgggttcgggtgcgcaagtactgcgagctggaggaccgtgaggtcacgcaggacgagatcggcaagggctacgagttgtcgaaggacaccgtgatcccggtgctggatgaggaactgcgcgagctgccgctgccgacggcgaaagcgatcgagatcgaggcgttcgtgccgctggcgtcgatcgacccgatggggatcggggagggctactacctgcaaccggacgggcaggtggcggccaagccctacaaactgctgcgccaggcgctggagcgttcgtcgaaggtggcggtggcgaagtacgcctggagtgggcgcgagcgtctgggcatgttgcgggtgcgggaggaggcgatcgtgctgcatgcgatgcgctggccggacgagatccgcgacccgtcggaactggccccgcagggaatagagctgtccgaggatgagatcaccgaggccgagcagctgatcgaccgcctgacccgcgacgacctcgagggcgaggagttccaggatcactacaccgaagccctgcacgaggtcatcgaggcgaaacaggaggggcacgcccctcctgaagcgcgtgagacggaggaggagccgggcaaggtgctggatctgatggccgccctccggcagtccgtggccaaggcgaaggcctcccgcggtgaaagcggcgaggcggacgtgcacgagctgccgcggaagaagaccgcggccaggaagacggcgaagcagcagcccgccaagaaaacgtcggccaagaggactgcggcgaaggagcccacgaagaagacggccgccaagaagacgacgccgaagaaaccgcggcgcagcgcg

SEQ ID NO: 868 - DNA, 267 bp, Streptomyces avermitilis
  CDS (1)..(267)
atgcccgactctccgaccgttggccgtcgtgagcgcaagaaggccgcgatgaggcggaccattgccgacgccgccccggagctcttcctggagcacggcttcgaacgagtgagcgtccgcgatatcgccgaagaggccgacctatcggcgacgaccctcttcgcgcacttcccgaccaagggggcactggtcttcgaccgcgacgaggacgtcgaggcggaactggccgccgcagtccgtgaacggctcaagggccacagcgtgcgg

SEQ ID NO: 869 - DNA, 1122 bp, Streptomyces avermitilis
  CDS (1)..(1122)
gtggactctccgacgcccgcaagtgcgcggatcagcatcatcggtgccggcccaggaggcctcacgtgcgcgcgcatcctgcagcagcacggcattccggtgacggtctacgaccgcgatccggaggcgaactcccgcaaccagggaggctcgctcgacctgcacgaggaagacggccaactcgcactccgtgaagcgggcctgctggaggagttcttcgcgctcgccaggctcgagggccaggaaatgcgccagatggacccggcggggcgcgtccttgaccaccatctgccggacgagggcgagacggtcagccccgagatcgaccgcggacagcttcgcgatctcctgctgcgctcactcgtcgcggggacggttcagcgggggcgcactctcgaatcggtgagcggaccggccgacgggccgcgaacgctgacgttcaccgacgggacggccgttgaggcggatcttgtgatcggtgcggacggtgccttctcccgcgtccgcactgccgtgtcgtcggcgacaccgcgctacaccggggtcagcttcctcgaggcatggttcgacgacatggagcacgcgcaccccgagctttcccaactggtcgggaaaggcagtgctcacatcgccgacggcgagcgtggcctcttcgcgcagcgcaacagcggaggccacatgcgtgtctacatcatgcagcgcgtccccgtggactggatcgcggcgaacgggcttcgccccgaggacaccgagggcatccgcgggcatctgctcagcgagtacgcggcctggtcaccgcagatactccggatgatcactgacaacgacggcgcctacgtcgaccgtccgctctttgccctgccggtgccgcacatatgggagcactcgcccagcgtggcgctcctgggagacgccgcacacctcatgccgccgctcggcgtcggcgtcaacctcgcgatgctcgacgccagcgaactcgcgctcgcactcgtccactcctccaccatcgacgacgctgtacacagctacgagaagtcgatgctcccgcgctcggccgacatggcccagaagctcgaaggcggcgctgagcatcttctgtccgtgcccgactccgacgagatc

SEQ ID NO: 870 - DNA, 816 bp, Streptomyces avermitilis
  CDS (1)..(816)
ttgggttctcccgacactatttccgctggaatcgcttcaacggtaacactggaaattccggtggaaccaaatcttcggtaccatcggttcatggctacgcgcgactccaccgacacccctcggcgccgcatcgtcgaggcggccgtcgagctgctggagaacggtggccctgacgcgatgagcacccgcgcggtcgccgccgcggccggaatgcagccgccggcgatctaccgcctcttcggcgacaaggaggggctccttgaggccgtcgccgagcacggctacgcgcagttcctggagagaaagcgcgcgcagctcgaccccgctccgcaggacccggtggaggagctgcgccgcggctgggacatggtggtcgagttcggggtctgtcgccccgagttgttcgcggtgatgaacagggccaccggccggggatcggacgcagcacaccgcgcgggcctggagatcctccatgggcgggtgcgtcggctggcggccgggggatggctgcgggtcgacgaggagctggccgcccagatcatccaggccaccggccagggggcggtcaccacctggcactccacccctgcggaccgccgcaatccggcgctgttgaccgtcctgcgcgagtccatggtcgcggccgtcacccgcgccgagccgacagtccccaccgcggagtccggtcccgccgcagcggcccgcgcgctgcgcgccgccctccccgacgacgccgatgtcctgagcgacgccgagcagcgcctgctgcgtgagtggctcacgcgcctggcggcggacggtggcgcgccgcatgcc

SEQ ID NO: 871 - DNA, 858 bp, Streptomyces avermitilis
  CDS (1)..(858)
atgatcatcgtgaccggagccaccggaaagctcggccgccgcatcgtcgagcgcctcctggagcgcgtccccgccgaccgcgtcggcgtcagcgtccgcgacccccgcaaggcccaggacctcgccgaccgcggcgtccgcgtccggcaggggagcttcgacgaccccgcctcgctcgtgcacgccttcgagggcgccgagcaactgctcctcgtctccctcgaccgcacgggccaggagtgcgtcagcggccaccgcgccgccatcgacgccgccgtgaaggccggcgtcggccgcatcctctacaccagccagatgggcgccgcccacgactcccggttccaggcatgccgcgaccacgcccagaccgaggacctgctgcgcgccaccggcctgccctggaccgcgctgcgcaacggcttctacgcctccagcgccctgcagttcctggagtccgcccgccacaccggcgacatcgcccttcccgccgacggccccgtcgcctggaccggccacgacgacctcgccgaggccaccgcggcgatcctcgccgaggagcaccgcttcgaggggcccaccccgccgctcaccggcccggcggcgctggacttcgacaccgtcgccgagatcgcgtcccagaccaccggacggcccttcacccgcaccgtcgtccccgacgacgccttccgcgagcaggtcctggcgcacggcgccccggccccgatcggcaacctgatgctgagcatcttcgccgcggcgcggaatggcgagttcaccgctgtcgactcgacgctggccgagctgatcgggcgagagcccgccaccttccgcacccagctggagcatgcctgggccgaa

SEQ ID NO: 872 - DNA, 981 bp, Streptomyces avermitilis
  CDS (1)..(981)
gtgccccacccccatgcccggctgaccgtccacggcagacggctcctcgtcgaccgggtccgcgctggcaggcccatcgcccacgtcgccgaagaaatgggcatctcccgcaccacagcccacaaatgggtccggcgctggcgagccgaaggcgatccggggttgtatgaccgttccagtcgacccctgacgacaccgcaccgaacccctgccgatgtcgagaatcgcatctgcgagctacgacgcgaccgcaagctcggtcctgcacggatcggcccggtcctgggcatacccagctcgacggtccaccgtgtcctgacccactacggcctgaaccggttgcgctggatggaccggcccaccggtcagatcatccgacgctacgaacgatcacatcccggcgaactggtcgacgtcgacatcaagaagctcggcaacattccagacggcggcggacatcggatcatgccccgccagcaggccgcgggcaatcggcaggccacaactgacgtgcgtaggggcggcagtcccgtgatcggctacagcttcgttcacacagccgtcgacgatcactcccggctcgcgtacagcgaggttctgaccgacgaacgcaaagagaccgcggcctccttctggcagcgcgcgaataccttcttcgccgagcacggcatcagcgtcgagcgcgtcctcaccgacaacggctcctgctacagatcccgcctgttcggccagactctcagcgccaccggcatcgtccataagcgcacgcgcccctatcgcccgcagacgaacggcaaggtggagcgcctaaatcgcaccctgctcgacgaatgggcatacgtgcgcccgtactccagcaacgccgaacgcaccgaagccctgacggacttcctccacacctacaactaccaccggtgccacaccgcacttgacggccaaccacccatcagccgcgtcaacaatcctgcgggtcaatacatc

SEQ ID NO: 873 - DNA, 327 bp, Streptomyces avermitilis
  CDS (1)..(327)
atgagcgtagtcaagatcaacgtactgaccgtccccgccgagcaacgggagacgctggagaagcgcttcgccgcccgtgcgcatgccgtggagagttccgacgggttcgaatggttcgaactcctccgccccgtcgaaggcaccgacgactatctcgtctacacgcggtggcgcgacgaggagtccttccaagcctggatggagggccccatgaaggcggcccaccaaggcggcaacgcggagagcggcgaacggcccaagccggcggcgagcggctccacgctgtggtccttcgaggtcgtgcagcaggcggcaccgaagagctcg

SEQ ID NO: 874 - DNA, 594 bp, Streptomyces avermitilis
  CDS (1)..(594)
atgcggatcacgaaatacacccacgcatgtgtacggctcgaacatgatggccgggtgctggtcatcgaccccgggatgtggagcgagccggctgccctgaccggcgcggacgccgtgctggtgacccacgaacacgccgatcacatcgatgtcctgcgcctggccgggctcggcgtgcccgtctacgccccggccgaagcgaacattccacggctggaagtcaccggggtgccctccgatgcggagttcaccgccgccggcttccgcgtacgagcggttggcgggcgtcacgcgttcatctacggcggccaaccggactgcgcgaaccccggctacatcatcgacgaggcgatctaccaccccggtgactcactgcacgtccccgagcagccggtcgagacgctcctggtcccggcccagggatcgtggatgaagacggcggaggcgatccacttcgtgaagacgatcaaaccgcaacgggcgttcccgatccacgacgcccagatcaacgatcgcggcctcagcagcgtcaacggctggctcgccggggagaccgacagcggctaccgatacctggcacccggtgagtcggtc

SEQ ID NO: 875 - DNA, 4062 bp, Streptomyces avermitilis
  CDS (1)..(4062)
atgtcgactcagccgccgcgcccttcccgtcgctcggtcctggccaccggttcaactctgcttgccggcttcggacttggcgtcacactcccccagaccagctacgcggtcacgccgtcgaggcccaccggcgagcggggtgaactcgccacctatcgcccggtatccgtttcgtccaccgactacgcgcccacgcccgccgagttcgtcgtggacaaggtcaactccgtgggcgtgaagggcacaggctggcgtgccgccgacggtgatccgcagtggatatcggtggatctgcagacggactgcacggtcgactccgtgcacctcaccttcgaggcgacggccgacgacccggtcttcgtgccctccaccagcggcaatccccgcgatcgcacgaccggtcaggaggtcctgtccagttgcgcggtggagttcgtcgtcgagacgtcgcgggaccaccacgcgtggaccaccgtccaccggaccacgtccggcaagggcggcatggtggagatcccgctggacaagccggtcaccgcgcgctgggtgcggttgaccgtgaccaaacgctccaacgccaacccgctgggcctcaacggcttcgaggtctacggctcggcggggggacaccgcccgtcggccaccggctggaccgactggggcacccacgaccaccgggcgcccgcgctcaaggcggccgccgacggcacggtcccgttggagtccggctggacgctgaccatggacgactgggccggcgggaagggcgcgcagctgtcccggccggacgtggacacgagccgctggctgccggcgaccgtcccgggaacggtactggcctcgctggtggaccagggccatctgccggacccggtggccggcttcaacaacctgcacattccggaggccctgtcccggcactcgtggtggtaccgacgcggcttcgagctgccgcgcgccttgcgcaccggtccgggccggcacatctggctggagttcgacggtgtcaaccacaccgcggagatctggctcaacgggcagaaggtaggcggtctgacgtaccccttcgcccgttcctcccacgacgtgacgaagatgcttgccgggaacggcgagcaggccctggccgtcaagatcacccccatgccgttccccggcagcccaggggacaagggccccgccgggctcgccttcgtggacgccggcgccaccatgatgaaccagaactcgccgacgtacctggccgcttccggctgggactggatgccggcggtgcgcgaccgtgtctccggcatctggaaccacgtacggctgcgctccaccggccacgccgtcatcggcgacccccgggtggacacgaagctccccgacctgcccgacacctccagggccgaggtgacgatcgtggtgccggtgcgcaacgtgggctccgcgagcaaacgggtcaccgtcacggccgccttcgacgacgtacgggtctcccggtccgtgacggtggccggcggcgagagtgccgacgtcaccttcgcgccctccacgtacgccgcgttgcggctgcgcgaccccgagctgtggtggcccaacggctacggccgccccgacctgcacgacctcacgctgaccgcctcgatcgacggcgaggagagcgaccggcgcaccacccggttcggcatccggcagttcggctacgagtacacggtgccgctgccgttcggcgggagcagcgaccggtacacccagccggtgctcctgggcgtgcagaaggcgcggtacgtacggatcaagtgcctgacccgggccacagattggggcttctcgctgtggaccctgtcggtggtcgacagtacgtcggccggtaccgacctggccctgcacaagaccgccaccgcctccacggaggactccggcaacacggcggccaaggtcaccgacgccgaccccggctcccgctggtcctctgccttcgaggacggccagtggatccaggtcgacctcgggtccgtcgccgccttcgaccgggtcgatctgacctgggagaaggcgtacgccaagacgttcgtcgtgcaggtgtcgacggacggctcgacgtggaccgacgcacggtcggtggacaacggtgcggttccgctgccgttcaacagcggcgccgcgagccttcagacggtggacttcgccgcccgcacctcacggtacgtgcggatcaactgtggtgctcgggcgaccagttggggcatttcgctgtggacgctgtcggtggtcgacagctcctcccccggtaccgacctggccctgcgcaggaccgccaccgcctcgacggaggattccgggaagcccgcctccaacgccaccgacggcaaccccgactcccgctggtcctccgagtatcaggacgaccagtggatccaggtggacctgggctcgtccgtctccttcgaccgggtcgcgatcgtgtgggagcaggcgtatccgaagacgtacgtgatccaggtgtcggacgacggtgacgcgtggacggacgtgaagtccgtggacaacaccccggacccgttgaagatcagcgtcaacggtgtccgggtcttctgccgcggtggcaactggggctgggacgagttgctgcgccggatgccggccgcccggatggacgcggcggtgcggatgcaccgcgacatgaacttcaccatgatccgcaactgggtcgcgtgcagcaaccgggaggagttcttcgccagttgcgacgagcacggcctgctggtgtggaacgacttccccaacgcctgggcgatggacccgccggaccacacggcctacaacgacctggcgcgggacaccgtgcggcgctatcgcatccaccccagcgtcgtcatctggtgcggcgccaatgagggcaatccgcccgaggccatcgacaagggcatgcgcgaggcggtccggtccgaggcgcccgacgtcctctaccagaacaactcggcgggcggcatcgtcaccggcggcggcccctacggctgggtggaacctgagcgctacttctcccccgccacctacgggagcggcgatttcggcttccacaccgagatcggcatgcccgtggtgtccaccgccgagagcatgcgcaacctcgtcggcgacgagccggagtggccgatcagcggcgcctggctctaccacgactggagcacccggggtaaccaggccccgcagaactaccgggcggccatcgagacccggctcgacaccgccgaggacctcgacgacttcacgcgcaaggcgcagttcgtcaactacgagaacgcccgcgccatgttcgaggcgtggaaccagaacctctggcaggacgccagcggcctcatgctctggatgtcccacccggcgtggcacagcacggtgtggcagacgtacgactacgacttcgacgtcaacggcatgtactacgggtcccgcacggcatgcgaacccgtccacgtccaggccgaccccaagaactggcaggtcatcgcggtcaatcacaccccgcggaggctcaaggacgtgacggtcacggcccgcgcctacgacctgggcgggaagcagctcggttcgacccggcgcgccacggtgagtgtcccctcctccgccacggccgaggcattcaccgccgcgttcgcgagctccctgccggacttccacctcctgcgcctcagccttcaggacggccgaggtcgcctcctgtcgcagaacacctactggcgctaccgccgggcatccgacatgaaagcgctcaacaaggcgcggacggtgcgggtttccgccgacatcgggcaggtgacgcgtgcgggatcgcggcgcacggcgacagccaggatccacaaccgcggctcggccgtcgcggcgatggtgaggctgtcacttctggacagcaggaccgacgcccgcgtgctgccgacgctgtacagcgacaactacgtgtggctgctgcccgacgagtcacgtacggtcacgctctcctggcctgccgacgcactcccttcgggccggcccgcactgcgtgtcgagggctacaacgtgccgcggacggtggcccgttcg

SEQ ID NO: 876 - DNA, 1518 bp, Streptomyces avermitilis
  CDS (1)..(1518)
atggggctgccgcggagcatcagcgaagctcgtctgcatgatgaagatcaagacaaacgcggcccttctcgccgcctccgcggtcgtcctcagtctcaccgcgccactcactgcgacggcttccaccacaggtgcgcccgccccctggactgggcgacatgcgagggaagcgggctcgacccccgccagcagtgcgcgactctcgaggtgccgatggactacgccaacccgggcggcgcgaagatcagcgtggccatctcgcggattcccagcgagaagccgcaggcgcgtcgtggcgcactgctcctgatccccggcgggcccggcggctccagcctcaacaacccatcgggcaaaggccaaaagctgccgcaggaggtgcgggacgcgtacgacctgatcgggttcgaccccagggggctgggccgctccaccccggtcacctgcggcctcgagtacggcgacctcgccacttcgaagctacggccctggcccgcccccgacgggtcgatcaccgaaaacatggtcaccgcccagcgaatgtcggatgcctgcgcacgcaacggcggcgacctgatccgccacatcagcaccgccaacaacgctcgcgacatcgaccgcatccgcgcggcgctcggcgagcagaaactgtccgcgtggggtgtctcgtacgggacgtatgtcggcgccgtctacagccagctgttcccgcaccgcaccgaccgcatcgtgctggacagcaatgacgaccccgaccacacccgggtggcccgcgcctggctcgccgggcacgaagccggcgtcgaggacaccttccccgagttcgccgagtgggcctcggcgcccggcaacccggaccggctggccgagaaggcgtccgaggtacggccgctcttcctccgcctcgccgagaagctggaccgcgagccgatcccctggcccggcgccaatccgcaggagctgaacggcaatgtgctgcgccagaccatgctggacagcctctacgcgcccagcggcttccccggcctggcccggctgatcctggccgcccagcagggcaccgtaccgcccgcgccccaggcgccgccggagtcggtgctgcagaacgccgcggcggtcggcgccgggaccctctgcaacgacatcgaatggcccaagacggcagccgcgtacgagaaggacgttgccaagagccgggccgcgtaccccttgaccgccggcatgaccaggaacgcgatgccctgtgccgcctggccgttcacaccgcaggagcccccggtacggatcaccggccacggcccgtccaacatcctgctcatccagaaccggcgggacgtggccaccccgctcagcggcgccctgaaactccgcaacgccctcggcgaacgcgccaccatggtcaccgtgaactccaccggtcacgacgcctacctcgccaacggcaacgagtgcggcgaccgaaccgtctcccactacctggcgacgggggagcgcccccaccgggacacctactgcggc

SEQ ID NO: 877 - DNA, 357 bp, Streptomyces avermitilis
  CDS (1)..(357)
gtggccgatcagcccggcctcacggcgggcggcaactgccaactgttcgcttacgaggtgctcgggctcttcggcctgaccccgccacccttgcgctccagcgaactgtggggcgacacagagaccaccgtccgtgtttcggccccccagccactcgacctgctcctcttcaacgcctctgccagtgcctacggcgcccacgtcggcgtttgggccggtgacgacgcagtcctccacctctgcgcggaggtcggacacccgaccgtgtggggcctggccgacttcgcggcacgggagcgttaccgagtcctggtaggcaccaaacgggtgatcgggaggagctcgaacaccctcgaa

SEQ ID NO: 878 - DNA, 1821 bp, Streptomyces avermitilis
  CDS (1)..(1821)
gtgagcgcccaggaagagcgcgacgcgctcaccctcccgcttgccctgtacgactacgccctgcacctgctgcgggagtcccgcgacggagtcccgcccccgcgtggttactccctcccccagaggcccgaacccgacgaggccccaccgtcccacgaagcggcggagatcgccgtccgggaagcactgagcccactaccggaagactccgccaccctgcaccgccgcttcgcccggcacggcatccgggacctccacaagcacctgatccggtccgccgtcttcaacctgtcgctgccgaacgggcagcatgacgcggcccgttcgctgggccgacagctgacccggaccggcaccaccgtccccgccgtcaccgcgggccttgccctgctcatccgatacggcgagcccgaagacgtcccgtatctctccgccctcggcctgctccgggagttcacccgcccggcggtcgacgccctcgaccccctcgaccgccagtccgcggccatcgtctggcttgtcacccacaccggccgcgacgaactgcggccactccttcgcgccctgtggacaggggatcagcaagccatccgtacggagctggaggcgttccctgccacacccaggttcctcagtaccacggccgcccgccggatcgcggaggccacccggctgcccgatctgcttgaccaccacccctccgacgctgccctgctcgcccgggcgggcaggctcctcgtgcggatgggatgcacgcgcgacaacccgaccgacctccttgtctaccgtgacgcgctcaccgtgtacgaacgtgtcgtcacacgggccggcctcctgccgccgaccctcgaccaccacgccaccctgctctcgctcgcgctggatctgagcagcggcccaggcgtgctgctggactggcctccgggccggcgcgcggcgctgttggaatcactcgggctgctgctggccgaaccccgatgggcctcgctggcggacaccggcgcaggcgaggcggaccagcggctgcgggccggctggatccagcgcactgggcggcagcccttcacacgcccagccacgcccggcaggctgcgcgtggaggtcgtggcgggcgaccccgtggaccgggaacctgtcgagacccgcatcctggtcgacgggcgtcctctcgtcccggcggtcttcgcccgcggtcccgcccgttgccccgagtacctgctggacgagggccggctcagggccgggccggagccccgtgaggtacagctcgcagtggcctcctgcaccgaggggtgctgtggcgcgctctatgtcaccatccgacgcgacggggaccaggtcgtgtgggagggctggcggcggccaccgaccatgccgggttcccgggagcccgcgcccgcactgcctgcctaccggttcgacgccgccgcctacgacgcggaggtcgcccgggcggagaccgaccgctcctggccctggccggcccgcagcacggcccgcctgatcaaagcggggctgatggaacggccggagttgctgagccggtgggatgcccgtcggggctggatcagcagtggcttcgacgacccggacaccaccgtggtgaccttctggtacgtgccgggactcgccgccgggaagccggtcggcgacccgctccagttccgctgggtcgtgccggacgacggcacgccgcccgaggcacaggccgccgccgccctgcgccggctggccgaggaggacccgaagacctacgggcaggtgtgcggcggcagccgcgaacgcgccgaagagctcgggttcggctggcccgatcgcgcc

SEQ ID NO: 879 - DNA, 612 bp, Streptomyces avermitilis
  CDS (1)..(612)
gtgggctggttcgtgaacctgggcatcatcgggcaggcagccggactgttcgccgtcaccaacatcgacgacatcctgatcctggcgctcttcttcgcccagggcgccgggcaccgcggatccacccgcaagatcgtgatcggccagtacctcggcttcaccgccatcctcgccgtggccatcgccgcggcgttcggcgccacgttcctgcccgaatctgcgatcccctacctcggactgctgccgctcgccctgggcctcaaggcagcctggcaggcctggaagaaccaccgcgacggcgaggacaccgaggaagctgatgccaagggaggcgggccgagcccgctggaggtcgcggccgtcactttcgccaacggaggcgacaacatcggtgtctacgtcccggtgttcgccaccgccggcgtcggcgggatgagcgtgtacgccgtcgtgtttctcgtcctggtcgccatctggtgcttcgcgggcaggttcttcgccacccgcccggtcatcgccaaggccctcagccgctggggccacgtcctgctgccgctggttctgatcaccatcggcctgctcatcctcgtccagggcggcgccttcggcatc

SEQ ID NO: 880 - DNA, 375 bp, Streptomyces avermitilis
  CDS (1)..(375)
ttggtggacgtgagctctgaacgcaccggtaggggactggccgtggccctggtcgtcgtcgagatggcaatcctcgccttgatcggcctgtcctggatggggtcctactggtcatgggacccacagcatcatggcgacccgccgggcccctacctgaagaaggccgcggtcgtaccgatcgccgccctggttgccatggccgtggccgggatccggcgcatgcgcgcggtcgctgtcagccaggctgtgatgttcatcgtcatctgcgggaccacgctgtgcctgaaagctcccggggagcgcgtttacgaggactcttatcggaacgcatgtcacgcgggcatgggctgcggcgacgactcgccgaccacgcgg

SEQ ID NO: 881 - DNA, 201 bp, Streptomyces avermitilis
  CDS (1)..(201)
atggccagcggtaccgtcaagtggttcaactcggaaaagggcttcggcttcatcgagcaggacggtggaggcccggacgtcttcgcccactactcgaacatcgccagctcgggcttccgtgagcttcaggaaggccagaaggtgaacttcgatgtcacccagggccagaagggcccgcaggcggagaacatcacccccgcc

SEQ ID NO: 882 - DNA, 501 bp, Streptomyces avermitilis
  CDS (1)..(501)
atgccagcactccatgcgcgtcccacgagcaatgcgttcaacccggcccccgcgggcgagacaccagtcgtcggcctggggagtggcaggcaccggcggaaggctcggatcaccggccgactacgccttcggatgatcgcctaccgcgatgtcgagttcctgtcctcccgcaccccgggggataccggcggtggtgaggagtacctgctccttgtccacgtccgcaaagtcgtcgggcgggtcgactaccgcatctgtacggcgtgtgcggaggccgtggtcaccggcgtggtcatcgaggagcgcttccatgacactggactgggcgcccgggccctggctcacctacggttccggcatcccggtatggcctggcgcagcgccctgggtctgccaaccacacgtgatttcaagcggcggatgcgccttccgacgaagggggaggacgggctgtgctcccacgtacggcgggcactgcctgtcccggccccggttgccgcc

SEQ ID NO: 883 - DNA, 231 bp, Streptomyces avermitilis
  CDS (1)..(231)
atgctgggcctggctcgctccgcccacgacctggtggtgttcctcgaggccgccgccggcccgcccgaccccggcgagctgctcgacgatcccagtggggtggagtggcggggcgggcgcccacttcagtggacgtcgattgcctgcggccggacgcccgacgccggacgccgaatgcgcagcgtcggccgtggcgccgccgacggcgatgtccggcgctggacagacggc

SEQ ID NO: 884 - DNA, 573 bp, Streptomyces avermitilis
  CDS (1)..(573)
gtgggagtttccctgtccaaaggcggcaatgtctcgctcagcaaggaggcgccgggcctgaccgcggtcctcgtcggcctgggctgggacgtgcggaccaccacgggcaccgactacgacctcgacgcgtccgcgctgctggtcgacacctccggcaaggtcctctccgaccagcacttcatcttctacaacaacctgaagagcccggacggctcggtggagcacaccggcgacaacctcaccggtgagggcgagggcgacgacgagtccgtcaaggtgaacctcgccgccgtgcccgccgaggtcgacaagatcgtcttcccggtctcgattcacgacgccgagagccgcggtcagagtttcggccaggtccgcaacgccttcatccgcgtcgtcaaccaggcgggcggtcaggagatcgcgcggtacgacctgtccgaggacgcctcgaccgaaaccgcgatggtcttcggggagctgtaccggaacggcgccgattggaagttccgcgccgtcggccagggctacgcgtcgggcctgtccggcatcgcctccgacttcggcgtcaacgtc

SEQ ID NO: 885 - DNA, 357 bp, Streptomyces avermitilis
  CDS (1)..(357)
atgaggcggttcattcgttcaaccatcacggggctgacggcaggcttgctcgccgtgtcgtccggcgtggcggcgcaggcggcatcccgcgaggcagaggaaggctgggacagcccgcccgcttgcgtgcacatcaactcggactggcgctacacgtttgtcaccaacgactgctcgagtgcgtatgacgtgactgtcgtctatcgcgacggagccaacgtcccctgccgtgtcgcttccccgggtgacatcatctcgttcccgggctatggaacacagggcaacacggtcctcggcgtcgccctgtgcgcggtcgcaggtcggaaggacggccgtttggaggcgactccccgcctg

SEQ ID NO: 886 - DNA, 612 bp, Streptomyces avermitilis
  CDS (1)..(612)
gtgatcacttctgccctgcccacctcgcgcgccgcatacgaccgaccggcgtcggctgacgagtccatcaccgcatgggcgctggccgcccgcggcggtgacccggaggcggtcgagcgtttcgtacgcgccctgcaccgcgatgtcgtgcgctacgtcgcccatctcagtgcggacccgcaggccgccgacgacctggcccaggacacattcctgcgggcgctcggcagcctgcaccggttcgagggacgttcctcggcccgtgcgtggctgatgtccatcgcgcgccgtgccgtggtcgacagttttcggcatgccgctgcccggccgcggctgagcgatatccccgattggcagttggcggtggagctggcccagccgtgcgacctgcctggcctcgacgacggcatcgcgctcctcgatctgctggccgtgctgcccgacgaacgccgcgaggcattcgtcctcacccagctgatggggcttccctacgcggaggcggccgaggtcagcggctgtcccatcgggacggtccgctcccgggtcgcccgcgcccgggcgaccctcatcggtctgctgaccgaggccgacgcgtcggctgctctggccgcc

SEQ ID NO: 887 - DNA, 684 bp, Streptomyces avermitilis
  CDS (1)..(684)
atgactgctgggtggtgttgtcgcacggtacgggccgcgttgttcgcggccgtctgtgtgctgctcgccgccctggggcacgtgatgatgtccggtaccgcagtgccctggtgggcgatgacggtcgcggccctggtgacgggtggcacgggctggtgcctggccggtcgtgagcgggggcttgcgctgatcgtgtccgtggtggttgtcgcccagggggcgctccactcggcgttctctgtcgctcagtcagctgcccactctgcgggctcggttggcgcggacagcatgccgaagggctccatggggtccgacatgagttccgtgcacatggactccgtgcacatggactccatggacatggggaacatgggcgcgggccacttggctcacctgggccacgacatgggcggcggctcctcgttcggcatgctcgccgctcactcggcggccgcgctgctgtgcgggctgtggctggcgtacggcgagcgtgccgccttccgcatcctgcgagccctggccggccgcctggcggcaccgctgcggctgctgctcgccctgccgacgccggcgcaccgtccgcgtatccgcgtacgccgaggctcctcggaccggacgccgcggcgactccttctcgtgcacgcgatcacttctcggggcccgcccgtggggaccgctgtcatc

SEQ ID NO: 888 - DNA, 396 bp, Streptomyces avermitilis
  CDS (1)..(396)
atgaacttcgtttcgatccgcgtgatcaccgacgacgtcgctcgtcttgtcgagttctacgaacaggtcaccgccgtttcggcgacgtggtcgacccccgacttcgccgaaatcgtgacgccgtcgtgcacgctggcggtcgcgagcagccgcaccgtggcgctgttcggctctggttccgcccgcccggcatccaatcgctcgctgatcaccgaattccgcgtcgccgacgtcgacgcggaataccagcgtctgacgcccctcggctgcgagttcgtccagacgccgacgaccatgccgtggggcaaccgatccctcctcttccgggacccggacgggaatctgatcaacttcttcacgcccgtcacccccgacgccgtgcggaggcaggaccgc

SEQ ID NO: 889 - DNA, 1050 bp, Streptomyces avermitilis
  CDS (1)..(1050)
gtgactacatcgaccgcccgagtgctggccctgctggagatccttcaggaaggcggcatccgcaccgtccctgacctggccgcccgcctgaacgtcgacgaacgcactgtccgccgttacgtcggacacctgctggatctcggtgtgcccgtcgactcggtacgtggccgttacggcggctaccggctcgctcctggctatcggatgccgccgctgatgctgaccgacgaagaggccctggccattctgctcggcctcctggccgggcaaagggccggtctggtcaccacgtcggccgcggcgagcgagagtgccgcggcgaaactgcggcgggtactgcccaaagccctcgggcggcggctggagtcgctgctggagacggccgacttcacggcgcgtccccgttccggcaccgcaccggaagcaggtgtcctgctcgacctcgccgaggccgcacgtcatcggcggccggtggcgatcagctacaccgaccgaaagggccgcggcagcgaccgcaccgtcctgccctacggtctcgtggcgcattccggacggtggtacctgaccggcgccgacccggccggcggcgaggtacgcaccttccgcctggaccggatcgctgccatgaccgtgcagtccggttcgttcgtcgtcccggcgggattcgacccggcggccacagtgctggaaagcctcgcgcacacgccgtggacccacgaggtgtctttgcgcattcaggacagcgtccagcacatccgcagccgtctcccggcggacatcgcgaccctgtccgtgatcccggccacggccacacccgacgacgccaacctggccgataccggcgatacctcgtccgacggcccaagtgccctcgcggcagccgacgaacgcgtcggatgggtccacgtcgggatccgggccgaacggctggactggattccccccgtactcgccgccctcgaccgcccattcgtcatcgaacgccccgccgccctgcgcgatctcgtgcgcgcgctcgcccgccgcctggatgagcacgccactgccggc

SEQ ID NO: 890 - DNA, 549 bp, Streptomyces avermitilis
  CDS (1)..(549)
atggctcacctgactgcgtgtgggtatccggtgccgaaggtgtacgaggtcagtgacagcgacctggtgcttgagcggctgaccggaccgacgatgctggaggccctggcacagcgcccgtggcgggtgcgtgggctcggtcgaatgctgggcgacctccacgatcgactccatgggctgccggcaccggcatggctgcccaagcggttcggcactggaggagatgaccgggtgctgcacctggacttgcatccaggcaacgtcattctgaccgggcgcggccccgtggtgatcgactggagcaatgcgggcgctggtgatcccgctgccgatgtggcgatgaccatggtgaccgtcggcagcgccgacgtccccgggctcgccgcacgtctggggcgggggctacttctgcgagctatccaggacggctgcgcaactgatcccaccccgcgggtccaggaggcggtcaacgccaagctggccgacccgaatctcacaaccacagaggcagcgtggttgcgaaaccgtgctgctgtctctgccggtccc

SEQ ID NO: 891 - DNA, 1092 bp, Streptomyces avermitilis
  CDS (1)..(1092)
gtgggcaagggtggggagtccataccggacgaagagtgggagcgcttccttcgcgaagccgaagcggggaccgagggcgcgcccgaggagccgtcggcgcgagcccgcatggcggcgcggcgccgggaggagaccgaccgaccggagccgaggcggagtcatcaaccggcccggcggcaaagaggcaagggctggtacgcgatcggtctgctggctgcggtcgccctgctggtcgtggctctggatccagggcgggtgactggatggttcggcggcgggggtggcgagagttcgccgctcgccgtggaatcggaacgcccggatcaaccgccaccgacggaagcagcagcccaacaagcgaccttggaggagccgttcaaggggtcgcccgcggcgcagtggggtgacgggacggatgggatcggtctgcccaagccacaggcgaccggctggatgagcaaggcacaggtcgcacaagcactcgagaggacccgggacttcctcaacgcgtccagtctggatcctggcgtgctgcgcggggacaagccgaagaaggcgatcgcgttgatcaatcctcatcagcaggatgtccaggactacctggcgaccgcgttccgttcgccaagccgtgagaacgatcctcggctgctgttcagtcggttcgagaaggcgaaagtgcggcttgtcggggatgtggtcaagacacgagggcggatcacctaccgagaaggcaagcgcggtgcggtcgaggtgaccaccgacgtcacgtacgtatatccggtcgtacgcgctgcagcgggaagcgacgaagtcgcgcgcacgatcgtgcgccgtgaggtcgtgatgagttgggacgacccggcgaaggtcgtcatcgagccgggtacgttctccctcgtctcctacaaggtggacaccaccaacggcggctgcgataccctcaccggctacctcacccccaagttcgatgcggagcgcgcgacttcgagcccaggagacggccccgaggtcgacccctacaaccggagcaagtcgatggagacgcgcatgcgagaggccggcgatgcggggtgcggaacggccacccgatca

SEQ ID NO: 892 - DNA, 1008 bp, Streptomyces avermitilis
  CDS (1)..(1008)
atgcgatacatcaaactcggaacgaccggactggaagtctccgccatcaccctcggctgcatgagcttcggcgagccggaccggggcggcgagccctggtcgctgggcgcggacgccagtcgggacatcatcaagcaggccctcgagggcggcgtcaacttcctcgacacggccaatgggtacagcgccggaagcagcgaggagatcgtcggccaggcggtcaaggacttcacccggcgcgaggaggtcgttctctccaccaaggtctggatgcggatgcgccccggcccgaacggcgccgggctgtcccgcaaggcgatcttcgccgagctcgacgcctccctgaagcgactggggaccgactacatcgacctgtaccagatccaccgctgggactacgacaccccgatcgaggaaaccctcgaggcgctgcacgacgcggtcaagtccgggaaggtccgctacatcggagcctcttccatgtacgcctggcagttcgccaaggccctgtacctggcggacctgaacggctggacccggttcgcgtcgatgcaggaccactacaacctcatccaccgagaagcagagcgggagatgatcccgctctgcgccgaccagggcatcggcgtgatcccgtggagcccgctggcgcggggcaggctgacgcgggcccgggacaccgccacggcgcgtgccgagaccgacgcgggcggcaagatcctctaccgcgacgaggaccaggcagtggccgagcgcgtccacgagatcgcgggcaagcggggtctgtccccggcccaggtcgccctggcctgggtcatgcgcaacccggcggtgacctcgcccatcgtcggggtcaccaagccggcccagctggccgacgcggtcgccgcggtggacgtcgaactcgacgaagacgaggccgcctacttggaggagccctaccagccgcacgaggccgcctacctggaggagtccttctacaagcggcagcctgtggcgggctcccgg

SEQ ID NO: 893 - DNA, 318 bp, Streptomyces avermitilis
  CDS (1)..(318)
gtgtccatcggcacctgcgctcgcgccttcggatccccttgtgttcatgagcacgcttgtgtcagatgctcactcctccgaccggatccggcccaacggacagggctcgtcgacatccgcgacaacctcatcgcgcgcatcgacgaagccgagcgcgaaggctggctgggcgaagtcgagggactccaggtcagcctcaccggagcagaggagaaacttgcccagctcgaccgccgccgcggcagtcacgccgtcgtcgacctcggcattcccaccccatccagaggcgcgaaggactcaacagcaaagggagactgc

SEQ ID NO: 894 - DNA, 1539 bp, Streptomyces avermitilis
  CDS (1)..(1539)
atgagtgacgcacatccgatacgaagccgcgaaccgggcctctcggtcggcgcgcgcatcatcgccgtggtcgtcctcgtcgcgatcggggccgtcagcgcctggctccagcacgacgctcgcggccgagatgcggagccgcgtacggagttcaccgcgagcaacccgcccgccggtctgcccaccgcgctcaccaccggccagcacctccgctggtcccgctgcacctcgccgcccaccgcgcgcacgggctacgactgcgccaccatgaaggcccccctcgactaccggaaaccggacggcaggacgatcgacgtcgccctgatccgccgcaaggccaccggcccgaacgcccggcgcatcggctcgctcgtcctcaacttcggcggccccggcgtgtccggcgtgagcggactgcccgagttcctcaaccagtacgagccgctcctcgaccgctacgacctggtctccttcgacccgcgcggcgtcggcgcgaccatccccgtgcgctgcgggaagaccgcggacgacggggccgacgcctgcgccgagcactccggggcgctcctcccgtacatcggcacctcgcacaccgcgcgcgacctcgacctgatgcgctacctcctcggcgacgagcggctgcactacttcggcgtctcgtacggaacggcgctcggcgcggtctacgcccacctgtacccgtcgcacgtcggacggctcgtcctcgaagcatccgtcgatccgaccgaggacctcgacgaggagcaggtgtcgcaggtcaaggcggtccaggcggcgttcgaccggttcgccgcgcactgcgctgcccgtatccgccactgcccgaccggcgacgggcccgaggaggccgctcgacgcatggcgcgcctggccgaccgtctgaagaagaagcccgccccggccggcggcggaaggaacctcgacgccgacgacctcgcgcacgcagtcagcgagcatctccgcctcggcacggacggctgggcgccgctcgccaaggctctgaccgcgctgatcgaccacagcgacggccgtccgctgagcaagagcgcggacgacatcggctccgccgaccgagcggcgaccccacgcgacgacagccacgccgcccggaccgcgatcacctgcgcggactccagcctgcgcccggacttcgaacgtctcgaccgggacaaggcccgcgtcacagccgcctcacccgtcttcggcgctgcctggtccaccggcgtctacctctgttacgactggccgttcgacggcgagcgcaccacgctccaggtgaacgccgacggcgcggcccccgtcctggtggtcggcggcaccggcgacccgatcaccccctaccccggcgcccgccacatggcccgcgccctgggcgacggcgtcggcgtcctcctgacggccgaggaggagggccacggcacctacccgcagaaccgctgcgtcaaggagacggtcgaccactacctccgcacgggccgcaccccggccccggggacggtgtgccggggcagcatgtcc

SEQ ID NO: 895 - DNA, 621 bp, Streptomyces avermitilis
  CDS (1)..(621)
gtggcgtccccggtcgcatatgctgaggccgtcgcttctgatacccggcgccccgtcaaggaaggccagttgactccgcattcccttgcgttctacatggacgtggtcgcctccggaacggtgctcggtgcccatccgacggacagtcccgaccgggtgaccgcgatgctgggttccgatttcgccgagaactcccttgacgaccacagcatgtggcgcgactacggaatggctgagttcttctggattcgggaaacaccggaccatccttgggaggggcaccacttcaccttgcaggtgcaccggctgtcgtactcgggcggcagcatcgtcaacagggcaattcgcgaccggtacgggcgcttcgaccgccacctccggttcgacaaactggagcggctgctggggaagcacggtgcacccctggaagacgccccggacgtgaatgctccgaccttcacacggcactggcagcctgcttcacaggtgtccgtcatggtgttccgggctcacgaagaatggcgacagcgtcggcgcggcgacgaccgtatcggagatgtgtacgccatccagtcacccgcgcgacaccgaggaccaggccgtgctgcgcccgctgccccg

SEQ ID NO: 896 - DNA, 936 bp, Streptomyces avermitilis
  CDS (1)..(936)
atggtcatgcgggtgttcgtggcgggcgggaccggggtcctgggacggcggctggtgccgcagctcgtggctcgtggccaccaggtgacggccacgacgacgagcgcagccaaactcggcctggtggagcgcctgggtggcgaggcggtggtgatggacgggctggacgcggtgtccgtcggtgaggcggtggcggccgcccggccggacgtgatcgtgcaccagatgaccggcatttccatggcgcacgccggcaagcccgacctgaagcatttcgaccggtggtccgtccccaccgtccggctgcgcaccgaggggacggaccacctgttggccgcggccgaggcgaccggcgtagcgcacttcgtcgcgcagggatacgccaactggaacggaatccgcgagggcggatgggtgaagaccgaggaggacgcgctggacctgcacgaggggacggctgcgtatacggcgatggcggcgctccgccacgtcgaggacgcggttctcaaggccgacggcgcggtgatgcgttacggcgcgttctacggaccgggcgccaccgacgaccagctcgtgctcgtgcgcaagcggcagttcccgctggtcggggacggcaccggctacgcctcgtgggtgcatctcgacgacgcggcgagcgccacggtcctggccgtggagcagaagacgagaggggtgttcaacatcgtcgacgacgaaccggccccggagagcgaatggctgccctggctggcggcgtgcgcgggggcgaagccgccgatgcgggtccccaggtggctggcccggctgctggccggagatgtggtggtgacgatgatgaccgagggccgcggcttctccaacgccaaggccaagcgggagctcggctgggagctgcgctatccgtcgtggcgacagggcttcaaggaagggctgtcg

SEQ ID NO: 897 - DNA, 921 bp, Streptomyces avermitilis
  CDS (1)..(921)
gtgacccggaccgaggagttcgaagagctgcggccgctgctgttctccgtcgcctaccggatcctgggcagcgtgagcgaggccgaggacgcggtccaggagacctggctgcgctacgagctctccccggccaggcccgcgtcagccagggcgttcctgtcggccgtggtcacccgggtctccatcgacgtgctgcgctcggcccgcatgcggcgggaggagtacgtcgggccgtggttccccgagccactgctcaccgacccctacgaggacccggagcagtcggcggagctggccgactcgctgtcgatggcggccctgttgctgctggagcggctcagcccgctcgagcgggcggtcttcgtgctgcgggaggtgttcgccttcggcttcccggagatcgcctcggcggtgggcaggtcggaggcggcgtgccgccagctcgcggtgcgggcgcgccgccacatggacgcgggccggccccggttcgaggccgaccgcaaggagcgcgaggagctcgccgagcggttcttcgaggccttgcgggaggggaacgtcgacgggctgcgggaactcctcgccgccgacgtgtcgctggtcggggacggcggcggcaaggccccgcagtgggccaggggcttcttcggcgtcggccaggtgtcccagatgctggccaccctcttcccgccgttcttccggatcggcggcgtcgtggacccgcaccaggtgaacggtcagccgggcgcgctcttccgcgaccgggacggcaaggtcctcaacacctggacactcgacatcctcggcgggcagatccaggcgatccgcacggtgagcaaccccgacaagctcgggcacctgggccccgtggcggacgcgtgggcggtcctgcgcgaaacgcagcaggtccgtccggacccggag

SEQ ID NO: 898 - DNA, 579 bp, Streptomyces avermitilis
  CDS (1)..(579)
atgatcaggatcggcatcatcatcggcagcacccgccccggccggaacggcgaccgggtggcccaatgggtgcgggatctggcggctgaacacgcgggcgacgccgcggacttcgagctcgtggacctgaaggaccacgcgctgccgctgctcgacgagcccgtgccggcggccatggcgccgggccggcagccgcacacccggcgatgggccgagcggatcggctcgtgcgacgccttcatcgtcgtcacacccgagtacaacaccgccccgcccgccgccctgaccaatgccatcgactacctctacgaagagtggggcggcaaggcggtcgcttacgtcggctacggcatcttcggcgcggtcatggccgtacagaagctgcgcgcgcaggcgggcccgttgcgaatggcggacatcgggcctcaggtggcgctgtcgctacgcgaggacttcgtggcctttgccgacttccagccgcaggaactgcatgtcgcggaggtacacgggctggtcgacgagctgctggcgtgggcgaaggcgctcggcccgctgcgcgcggcatccccggctgctgcc

SEQ ID NO: 899 - DNA, 765 bp, Streptomyces avermitilis
  CDS (1)..(765)
gtgatcgaacacgccacacaccagaagatcgcgctgatcaccggggcgaacaaggggatcggccgggcggctgccgagcaactcgccgcgctgggcatgacggtcctgatcggcgcccgagacccacggcgtggcgaggaagccgctgcggcgttgcgcgcggcaggcggcaacgcgcaccaggtcaccttggacgtcaccgaccaggccaccgcccgggcggccgcacagcagatcgacgagcgcttcggccacctcgacgtgctgatcaacaacgccggcatcaccggctccggacaggtctcacccgaagacgcccacgatcaagtccccagctccgtgaacctggacatggtccgggcggtgttcgagaccaacgtcttcggggtgatcgcggtgaccaacgccatgctcccgctgctgcggcggtcaccggcgccgcggatcgtcaacgtcagcagcgccgccgggtcgctgaccatcgccagtgacccggacggcccgctcacggggctgccgacgtcggccgcgtacacgccctccaagaccgcgctgaacgcgctgaccgtgcaatacgccaacgaactgcggaagaacggctttctcgtcaacgccgccgaccccggctacgtcgacacggagatcaacaaccacagcgggtaccttacggtcgcgcagggcgccgcggccctggtgcgcctggccacgctcggcgcggacgggccgaccggcgggttcttcagtgaggacggcccggtgccctgg

SEQ ID NO: 900 - DNA, 1128 bp, Streptomyces avermitilis
  CDS (1)..(1128)
atggacaccaccccactccccgcccgcaccgaggtcgccatcgtcggcgccggccccgcgggccttgcgctcgccgtcacgctcgccgcctccggcatcgacttcgtcgttctggaccggctggcggagggcgcgaacacctcgcgtgccgccgttgtgcatgcccgcaccctggaggtcctggacgagctgggagcctccgaggagctgatcgcgcgcggcatccaggtcacccggttcgccgtccgtgacggctcccgccggctgctgaccgtgccgttcgacaagctgcccacagcccacccgtacacgctgatggttccccagtacgagaccgagagtgtgctgctggcccggctgcgggcgctcggcggtgatgtgcaccgcccgcacgaggtcacttcggtcgtccaggacgaggacggtgtgacgctcaccatgagcaccgggcagacgctgcgcgccgggtacgccgtcggcaccgacggcatgcacagcactgtgcgtgaagcgtcgggcatcgggttcaccggtagtgcctacagcgagtccttcgtgctcgccgatgtcgtgatggactgggctccgggccccagcgaggtgtcgctcaccttcggcaccgcgggtctcaccgtcgtcgccccgctccccggcggccactaccgggtcgtcgccaccgtggacgacgctccggacacccccgacctcgccttcgtccagcagctgttggacgagcgcgcccccggccaggccaaggtcacgggccttgcctggtcctcacgtttccgggtgcaccaccgggtcgccgaccactaccgggtaggccgtgtgctgctggccggagacgccgcgcatgtgcacagccccgccggtggtcaggggatgaacaccggtatccaggacggccacgccctgggccgggcgttcgccaccgggcagctcgacggctacgaggcccggcgccgcccggtcgcccagcgggtggtcgccttcaccgaccggatgacccgcatcgccaccacccacagcgccatcgcccgcggcgcccgcaacatcgtgcttcccctgctcggccacacgggcctgcccaagaaactcgccaccgaactcgccgagctcaactaccgg

SEQ ID NO: 901 - DNA, 579 bp, Streptomyces avermitilis
  CDS (1)..(579)
atgacgtcgggtactgagatcaccagcacagacaagcgttccgaccggaccagggccgcgatcctgcgcgccgcacgtgagcgattcgccgcccagggctacgaacgcaccaccatccgcgccgtagccgccgacgccgacatcgacccctcgatggtcatgcgctacttcggcaacaaggcacagctcttcgacatggcgctggccatcgacctgcgactgccggacctcaccgccgtcgcgccggacgagctggcacgggcgctggtgcggcacttcctcgaccgctgggagggcgacccggccgacgacgcgctgctggtcctgctgcgctcggcggtcaccaatgaacatgccgcggcccggatgcacgagatcttcgcgacccagatcgccccgtcactggcctccgccctgggccccgagctcgccgcacgccgggccggcctgatctcctcccagctcctcggcctcgggctgacccgctacctgctgcgccttcctgcggtgaccgcactcacacgggacgagatcgaagacggcctcgcgccggccatcaaggccactcttgagtcgagc

SEQ ID NO: 902 - DNA, 582 bp, Streptomyces avermitilis
  CDS (1)..(582)
atgggactcggatatccgtgtggttgcgcaccgaggggtgatcgagcgatgggcgatgtcgaggggcggcgcatcgttgccggagtaagtggttcgctgggcagcctggcggccttgcaccgggccgcccacgaggcccgtcgtagccgcgccgagctgctggccgtactggcctgggaaccgcctggcggtgatctcgcccaccggcgatcgctgctcgcgtcgccggcgaccgactttcggcaggaggcgggcgagcgactgctcgccgctctccgcacggccttcggcgacgcggggcctggggttccgttccagggcctggtcgcacggggcactccagggcgcgcactggtggagaccgcggaccgggccgacgacctcctcgtggtcggcgcggggtaccgcgggaggatgcaccgtgctctgttcccgtcggtcgcccggtactgcgtcgcccacgccgcctgtccggtcctggccgtaccgccctcacccctacagggcgagctcgcctccgtgcaccgccgcatcagccttcgactgccgctcgatgcccgggaattgacggacggcaggccc

SEQ ID NO: 903 - DNA, 414 bp, Streptomyces avermitilis
  CDS (1)..(414)
atgtctccagtcgagtattccgaggaccccgagccctctgaacgcttcccggccggacttctccacgtccctgtccggtcggggcccgcgggctgtacggcccggttcttccgcacccccctgggcggccgtacggccgtcggtttcacctcggcggcgaagctcaccgccacgctgggcacggaccaggcctgcatcaggctttccgagcccgcgctgcgcgcactcgccgcacccctgggtgtcacggccctcaccgtcgacccgcccttctccgcccccgcggccgaccgcaccgcggccacaatccgtgagcacgagaattcctggcgacgcctgcatccccggcgcgtcggtgccctgcgggtgactggtgccgctgccgtcgtcgcgtgcctgaacctgctgatcggc

SEQ ID NO: 904 - DNA, 1398 bp, Streptomyces avermitilis
  CDS (1)..(1398)
atgtcagtttctgttccgtcgtcccttccgtccgcgcttccgccgtcggtcccggccttgccgccctcggatccccagaccctgtcccggctcctcggcgacaccgacggcctgtccgtctggccccgctccgcacgccccgaagccgacggcgacgtctgtgtcggcggtgtctccctcaccgaggcggccgaccgcttcggcacccccgtgtacgtgctcgacgagcaggaggtacgggaacgctgccgtacgtaccgcacggcgttccccgaagccgacgtcgtctacgcggccaaggcgttcctgtgccgtgcgatggcgcactgggtgcaggaggagggcctcggcctggacgtctgctccgccggggagctggcgctcgccgtcaccaccggcttcccgccggagaagatcgtgatgcacggcaatgccaagagccccgaggacctgcgcaccgccctgcggctcggtgtcggacgcatcgtcgtggacagcgcctcggagatcgcgcgccttgccgcgatcacaccctgcgacacccgccagaaggtcatggtgcgggtggtgcccggcatcgcggccggcggacacaccaagatacgcaccggcaccgacgaccagaacttcggcctgtccctcacggacggatccgcgcagcacgccatcacccggatactggaccagccgcacctcgaactcgtcggcctgcactgccacatcggctcgcagatcgccgccgtgaagccgtacgtcgccgccgtgcggcgcatggtcggactgatggcccgggtaagggaccagcacggggtcatcctgccgcagctgaacatcggcggcgggcacgccatcgcctaccggcccggcgacgagaccatgaacgtgggcgtgctggccggccgggtccgcgccgagctggaggacggctgcgcacgggcccgacttcccgtgccgcggctcaccatcgaacccggccgggcggtcgtcggccccgcgggcgtcgccgtctaccgtgtcctcgcggtcaagcgcaccggcgagcacaccttcgtcgccgtcgacggcggcatgagcgacaacccgaggcccgcgctgtacggagtgcggtacgcgccccggctcatcggccgcccctcctccgccccgtcccgtttcgtcactgtcgtgggccggcactgcgaggcgggcgacgtcctcgccgacggggtggcgctcccgggcgacgtacgccccggggacctgctcgcggtgcccgcggccggggcctaccacctgtccatgacctccggttacaacctggtcggccggcctccggtcgtcgcggtgtccgacggcatcgcgcgcgttctcgtacggcgtgaatcgctggacgacatgagccgtcgggacgtcggcctg

SEQ ID NO: 905 - DNA, 666 bp, Streptomyces avermitilis
  CDS (1)..(666)
atgaacaactcggttacgaacacggcccggttgctctgggccggcctgcgatccctcctggtgctcaccgtggtgacaggcgtcctctatccgctcgccgtcaccggtgtcgcccagggcctgttctcggaccaggcgaacggctcggagatcaaggcggacggcaaggtcgtcggctcctcgctgatcggccaggcgtacaacttgccgctgaagaagggccaggagaccccggagcccgacctgaagtggttccaggggcgtccggcgaacgggctgggcaccaacagcgtcaacacccagtactcgctgatcctgtccggtgcgaccaaccgttccggtgacaacgccgatctgatcaagtgggtcaaggacgccaaggccgcggtcgtcaaggacaactcgaccgccgaccacaaggtcaagccgtccgacgtccccgccgacgcggtgacgtcgtccggctccggcctggacccggacatctcccccgagtacgcggaccttcaggtgcaccggatcgcggagcagaaccacctggccgtcgccccggtgcagaaactggtcgacgagcacaccgacggccgtaccctcggcttcatcggtgagccccgcgtcaacgtcctcgaactcaacatcgcgctcaaggaactcgtggcgacgagc

SEQ ID NO: 906 - DNA, 2082 bp, Streptomyces avermitilis
  CDS (1)..(2082)
atgtccacagccactccgacccgggcaccgcacagcgatgtgccgaccggccacaaggacgaaggacgtgtcggcgcggggctcttcgaccccaagcaactgctcaagtcgctgccggacgccttccgcaagctcgacccgcgggtgatggtcaagtcacccgtgatgttcgtggtgttggtcggttcggtcctgacgacggtgttctccttcaaggacccgggcgactggttcggctgggcgatcagcgcctggctgtggctgaccgtgatcttcgccaacctggcggaggcggtcgccgagggccgaggcaaggcgcaggcggacaccctgcgcagggcgaagacggacaccgtggcgcgcagggccgacgggaccgtggtccccggcaccgagctgcgcgtcggtgacctggtcgtgtgcgaggcgggcgacatcatccccggcgacggtgacgtcgtcgagggcgtggcgtccgtggacgagtcggcgatcaccggcgagtcggccccggtgatccgcgagtccggcggcgaccgctcggccgtcaccggcggtacgaaggtcctctccgaccgcatcgtcatcaagatcacgacaaagcccggcgagacattcatcgaccggatgatcgccctggtcgagggcgccgcacggcagaagacgcccaacgagatcgctctgaacatccttctcgcgtccctcacgatcgtcttcctgctcgcggtggccacgctgcccccgttcgccgactacgcgggtacgcacctcacgatggtcgtgctggtggccctgctggtctgcctgatcccgacgacgatcggcgccctgctctccgcgatcggtatcgcgggcatggaccggctggtgcagcgcaacgtcctggccatgtccggcagggcggtcgaggcggcgggcgacgtgtcgaccctgctcctcgacaagaccggaaccatcaccctcggcaaccgccaggcctccgagttcgtaccggtgaccggcaccaccgaggccgaggtcgcggacgccgcccagctctcctcgctggccgacgagacgcccgagggccgctccatcgtcgtactggcgaaggagacgtacgggctgcgcgagcgccaccagggcgagctctccggcgccgagtggatcgccttcaccgcccagacccggatgtcgggtgtggacatcgacgggcgcaagatccgcaagggcgcggccgggtcggtcatcgcctgggtgcgggaacagggcggggaggtgtccgaggacgccgacacgctggccaaccggatctccgaggcgggcggtacgccgctgctcgtggccgtcgaggacgccgacggtgcgcggatcctcggcgtcatccacctcaaggacgtggtcaaggagggcatgcgcgagcggttcgacgagctgcgccgcatgggcatcaagaccgtcatgatcacgggtgacaacccgctgacggccaaggcgatcgctgaggaggccggcgtcgacgacttcctcgcggaggcgactcccgaggacaagatggcgctcatcaaacgggagcagtcgggcggcaagctcgtcgcgatgaccggcgacggcacgaacgacgcgccggcgctggcccaggccgacgtgggtgtggccatgaacaccggtacctcggccgccaaggaggccgggaacatggtggacctggactccaaccccaccaagctcatcgagatcgtggagatcggcaagcagttgctgatcacccgtggcgcgctgacgacgttctcgatcgccaatgacgtggcgaagtacttcgcgatcatcccggcgctattcgcggtggtctatccgggcctggacaagctgaacatcatgcagctgtcctcgccggactccgcgatcctgtccgcggtcatcttcaacgcgctgatcatcatcgcactggtgccgctcgcgctgcggggtgtgcggtaccggccggtgagcgcggacaggatgctccgccgcaacctcgggatctacggtctcggcggcctcgtcgcgcccttcatcggcatcaagatcatcgacctgctcatctccctcatccccgggctg

SEQ ID NO: 907 - DNA, 1662 bp, Streptomyces avermitilis
  CDS (1)..(1662)
atgagtcccgtcctcgccggcgtgctccagctggtcgctctcatagcggcactggcactcgcctaccgtcccctcggcgactacatggccaaggtctactcctccgacaagcacctgcgcgtcgagaagtggatctacaagggcatcggcgccgacccggacacgcagatgcgctggcccgcgtacctgcgcggcgtcctcgccttctccgccgtcagcgtgctcttcctgtacgtgcttcagcgtgtccagggttcgctgcccggctcgctcgggttccggtccatcgacccggaccaggcgttcaacaccgccgcgtccttcgtgacgaacaccaactggcagtcgtactacggcgagcaggccatgggccatgtcgtgcagaccggcggcctggcggtgcagaacttcgtctccgcctcggtcggcatcgcggtggccgtcgcgctggtgcgcggcttttcccgctcccgcaccggtgagctcggcaacttctggtccgacctggtgcgcggcaccgtccgcgtcctgctgcccgtctcggtgatcgccgcgatcgtcctggtcgcgtgcggcgcgatccagaacttctccgggatccactccgtcggccagttcatgggcggctcgcagcagtggaacggcggcgcggtcgcgtcgcaggaggccatcaaggaggccggcacgaacggcggcggttacttcaacgccaacagcgcgcaccccttcgagaacccgggcccgttctcgaacctcttcgagatcttcctgatcctgctgatcccgttcgcgctgacgcggaccttcggccggatggtcggctcgctgcgccagggctacgcgatcctcgccacgatggtcaccatctggatcggcttcacggcgctgatgatgtggaccgagttcgcccatcacggcccggcgttccagatcgccggcggtgcgatggagggcaaggagacccgcttcggcgtcggcggctcgtcgatcttcgcggtggcgaccacgctgacctcgaccggtgcggtggattccttccactcctcgttcaccggcctgggcggcggcatcaccctgctgagcatgcagctcggcgagatcgcacccgggggtaccggctccggcctctacggcatcctgatcatggccgtcatcgcggtgttcatcgcggggctcatggtgggccgtacgcctgaatacctgggcaagaagatcggcacccgtgagatcaagttcgcggcctgctacatcctgatcaccccggcgctggcgctggtcttcacggccgcggcgatggcgctgcccaccccgggccactcgatgacgaactcgggcgcgcacggcttctccgagatcctgtacgcctacacgtcgggcgccaacaacaacggctcggcgttcgcgggtctgaacgcggacacgcagtggttcaacaccaccatcggcatcgtgatgctgctcggccgcttcgtgccgatggtgttcgtgctggccctggccggttcgctcgccgagcagaagcccatcccggcgaccgtgggcaccctgcgtaccgaaaagccgctgttcacgggcctgctggtgggcgccatcctgatcatcaccgggctgacctacttcccggccctggcgctgggcccgttggccgaggggctggcgtca

SEQ ID NO: 908 - DNA, 483 bp, Streptomyces avermitilis
  CDS (1)..(483)
gtgcctgccttccgcgtcccgcgcgtacgccgggcccagcacgcggaggtcgccctcggtgccgtactcggtgtgatgctgatcggcctgtcggtgctgatctcgcgcttccatctccagcccgtcgagggcgtcacggtcctcgcgcagctcgcggacgcctcgctcggccacaactgggcgttctacgtcgttcagttcgcgacgatgatcctgctggcgctgtcggccaacacctccttcggcggtcttccggttctgctgaagctgccggcccgcgacaactacctgccgcacgtcttcgcgctgaaagccgaccgccaggtccaccggcacggcgtgctcacactggccggggtcgtcgccgcgctgctcgtcttctccggcggcgacaccaacaccctcgtgccgctcttcgccatcggtgtcttcatcggcttcacgatcgcccaggtcggcatggtccggcactggcgcgcggaa

SEQ ID NO: 909 - DNA, 417 bp, Streptomyces avermitilis
  CDS (1)..(417)
atgactgacatgagcccgctgacgatcaccacccgagacgcccctaccggtcccgtactggagatcaccggcgacctcgaccacgagacatccccggaactgcgtcacgcgatcgaccgcctgaccctggcccgcggccagctgctggtcctggacctggcaggtctgcggttctgcgactccagcggcatcacgctgctgttggcagcgcgcaacctggccatcgaggcaggcgtcgacacagtcctggccgcggtcccggccaacaccgcccgggtcctgggcatcgtgggcctcgaccaggtcttcgcgttctacccggacacccgagcggccaccgccgcacacccgcccaccgcagtgatcgccgacaccacaccgcgcggcaccggatcccgcgcggaccaagtggagtcg

SEQ ID NO: 910 - DNA, 1245 bp, Streptomyces avermitilis
  CDS (1)..(1245)
atgtgccgcgaccgggacgtagagcaggacgccgacgccaccgacacggtgttcacgtcgctgctggaggacagtgccgaggaactgtacgagcaggcgccgtgcggttacctgtccacgctgatggacggcaccatcgcgaagatcaacaccacgctgctggactggctgggcctgtcgcgccgggacgtggtgggccggatgcggttcaccgacctgctcaccgtgggcggcaagctctaccacgagacgcacttcgcgccgctgctgcaaatgaagggcgaggtcaacggcatcgccctggacctcaaagcggccgacgggcagcggctgccggtgctggtgacctcgaaggtcaagaccagccacgacggtgagccgatgctggtacgcagcaccgtcttcgacgcccgcgaccgccgcgcgtacgagaccgaactgctgcgcgcccgcaggcaggccgaggccgaccgcgagcgcctccaggaagcactcgccgtcctccagcagagcctgctgccctccaccctgccgacggttcccggcctggaagtggcctcgcactaccacaccgcctccccggacctgatcggcggcgacttctacgacctgttcccgctggacggcaccaggtgggcattcttcctcggcgacgtgtgcggcaaaggccccaaagccgccgccgtcacctcgctgacccgctacaccctgcgcgccgccgccttgcacgagcccgaccccgtcaacgtactggccacgctcaacacggtcctgcacgagcggtacaccggcagcgagccccgctactgcaccgccgtattcggcttcctggaaccccagagcgacggctgcgccgtccacctggcctccggcggccaccccccggcactggtccagcgcgccgacgcctacgccgactacctccccacccccggtgggatgctcatcggtgtcctgccccgggcgcagttcacagccgcccgcacggtgctgctgcccggggacacgctgctgctctacaccgacggcctgaccgaggccaggatcgggccgcggcgtgagctgtacggcgacgacgccctgcgcgccttcaccgccgcccggacgcctgcgggcccacaggccctgatcaccgccctgaccggcctgctcgccggcttcggtgagggcctcgacgacgacaccgccctgctggccttcggcgtgcccgcttccctgcccgaccagcccctgcgagtagatgac

SEQ ID NO: 911 - DNA, 801 bp, Streptomyces avermitilis
  CDS (1)..(801)
atggatatacgccggaggaacaacgtcgtcgtcaccggccgcccggacgggccggtggtgctgctcgcgcacgggttcggctgtgaccagaacatgtggcggctggttgttcccgcgctggccgacgacttccgggtggtgctgttcgactacgtggggtcgggccgctcggatctgtcggcgtggagcgagcagcgttactcctcactggagggctacgccctggatgtgctggaggtctgcgaggagctggacctgcgggatgtggccttcgtggggcattcggtcagcgcgatggtcggggtgctcgcggcgcagaaggcgccggagcggttctcccgcctggtcatggtcgctccctccccgcggtacatcgacgaggacgggtaccggggcgggttcagcgccgaggacatcgacgagctgctgacgtccctggattcgaactatctgggctggtcggcgacgatggccccggtgatcatggacaatcccgaccggccggagctgggggaggagctgaccgcctcgttctgcgcgaccgatccggacatcgcgcgggccttcgcacgcaccacgttcctgtccgacagccgccaggacctgaagtcggtggcggtgccgacgctggtgctggagtgtgcacaggacgtcatcgcgccgcgcgaggtgggcgcctacgtccatgccgcgatccccggcagccgcctggtgacgttggacgcgacagggcactgcccgcagctgagcgcacccgacgccacggcacaggccatcaccgccttcctcggcgcaacacgg

SEQ ID NO: 912 - DNA, 2484 bp, Streptomyces avermitilis
  CDS (1)..(2484)
gtgcggcggcgtgagactgtggtgctatggaacaggccccccgaggggatccacaccatggcgacacagagcacggcgcacgaatacctggatgagccgttcgacatcacccatgcggctgtggtccgcatcgacgcgcacggtctgatcgagggatggagcaagggcgcacagacgctcctcggctaccgggcaagcgagattctgggacggcctgccgcctcgctgctgaccggcgaggcagacctcgcttccgccatgtcggagccacgccgtacaggcaacggctgggaaggcctgatcgccgtcaggcatcgctccggccaccacgtggagctggcactgcgcgcctgcccgttccaggacgatggtgggcgccgaagctggcttgccgtggtcaccccggtgagcgcgccccgcaggtgggcactggagcaggcggtgctgcacggcctgctcgaccagtcgcccatagggatagccgtggtggacaccgacctgcggtaccagatggtcaaccgcgtactggaagacatggacggcgtgcccgtccagctgcgcatcggccgcagagtcggggaggccgtgcccggggaagccgactccaccctcgagtggcaggcccggcaggcgctgggcagcgggcagacgctgctgatgttccagcatgccgtcccggaaccgggcgagccctaccgacaggaccgtgagcgcgtcaggctctgcgcgtccttccggttgcaggaccgtacaggccacctcctgggcgtgtgccacaccacggtggacgtcaccgaccatgaccgggcccgccagcgactcgccctggtgaacgaggcgagcagccgtatcggcaccaccttggacctggaccgcaccgtgcgcgagctggccgagatcgtggtgccccaggtcgccgacttcgtcgcggtcgacctgctggacacggttctggcagcccgcgacctcacgcccgtcgcggtggacggcgagacagcgctgcgccgagcggcgcacctctcgatccaggaagatcaccccgaggtcgtggtcgcagccggggaacccacccgctacccgccgacctccccgcagagccgatgcctggctaccggtcgctcgatccgccacccggtcatcgacgggtcgacgccgtggctggcccaggacccgctgcgcaaggcaaaactggacctcctgggcgtgcactcccacctggtcgtccccctccaggcccgaggcatgaccatgggcgtggccacgttgctgcgctggaagcacgcagagcccttcgacgacgacgaccagcttcttgtcgaagaactggcagcccgcgcggccgtctgcatcgagaacgccagacgtttcgcccgcgaacacaacaccgcactcgccctccagcacagcctgctcccccacgggctgcccgaacagagcgcggtcgaggcggcctaccgctaccttcccaccgacaccgaagccggggtcggcggagactggttcgacgtcattccgctgtccggcgcacgggtcgccctggtcgtcggggacgtcgtcggacacggcatccacgccgcggccaccatgggccggctgcgcaccgccgtgcagacactcgccgacctcgacctgccccccgacgaactcctggcccgcctcgacgacctggtgatccggctcgcggacgaagccgatgccgccgccggcggcgccctggtgatcggcgggacctgcgtctatggcatctacgaccccatctcacgcaaactcgtcgtggcacgggccggacatcccagccccgccatagcgcacctccgtgaaccagtggaattccctgacatacctgccggcccacccctcggactgggcggcctgcccttcgaatccgccgagatcgacgtcgaggaaggaagcgtgatcgccttctacaccgatggcctcatcgaagcctccgaccgcgacgtggacgtcggcttcgaacggctctgcttcgcactggcccaccccgaccgcccactcgacgaaatctgcgacacgatggtccggatgctgctgcccgagcacccacacgacgacgtcgccttcctcgtcgcccgaacccgtgcactcggcgccgacaacgtcgcctcctgggacatacccgccgtcccctcggcggtccacaccatccgacagatgaccaaccggcaactgagcgcctgggatctcgacgatgccgcattcaccaccgaactcatcgtcagcgaactcgtcaccaatgccatcaggcacgcctccccgcccctcagcctccgtctgatccgagaacgcgccctcatctgcgaggtgtccgacagcagcaacacctcaccacacctacgccgccccctcggcaccgacgaaggcggacgcggactcttcctcgtcgcccaggtcgcccaacggtggggaacccgctacacccctcaaggcaagaccatctgggcagaacaaccactaccctca

SEQ ID NO: 913 - DNA, 687 bp, Streptomyces avermitilis
  CDS (1)..(687)
atggcgctccctcgttcgccggccgctgccctgcccggtccgcagtgggccgaacaggacagctggtcctaccgggatctcgaccaggctccgctgtcggccgagtgccgtgacgaactcgaaacgctgcgggccgaggcgggcggcggccggccgccgggcggctggccggccgggtggcccgcaccgccgctggtcgtgcgggagtcccttttcctctgcctgttccgcgcggcgctggcccggggggagctgcggtacgggcggttcgtgtggcaggacctggacagcgagttgggcgtccattaccaggagagtcgcgcggctctgctcaacggcatcgtcctgatcggactgcgtaccttctgcgaccagatctccggtggcgaggcggcgcagatggagcttgtggtgccgatggccgtggggactccgaacgagccggccggactggtcgtggcggccgagacgaccgctcgcgggcccgagctgctcgtggacgtctggggcgagacggccgtggcggcctgctggcaggccctgatcgcggtgtgccgctacgtcgcttcgctggccggtgaggaccagtactgccggccgctcgtacccgggggcgtccacgccgccgacggattcctcaccgtggtgcctcaggccatgcacgccgtcgaccgtcaggggccgcga

SEQ ID NO: 914 - DNA, 10014 bp, Streptomyces avermitilis
  CDS (1)..(10014)
atgaccctcccgaccctgcctccggagctggtccaactcgccgtcgcgctcggggttctcaggcgggagccgggggacggcgcggatccccggctggaggtggatcaggccttcttcgcggatcccggcaagcagttgtccggtgtgctcagcgatccggtacggcgtgcggccgcgctggagctcgccgcggcgctgctgggcagcgcgaagaacgcggccctcgaaacggagggcgcccagcccggccggacctggatcccgctgcccacgggcgacggtgccacggccggacgtctctatctggtggtggacgcgtccggcgacacggtggcgctgtcgctggccggccgcgccacgctgcgggccgccgaggtggagtgcgccgcctcggtcgtcgtaccgatggtggcgaccggccccggcggtacgcgattcctgcccggtaccgcggacggtgacatccgcgtcgccgtcagcctgcgactccccccggcacccggcgacttcggcctgggcggcctgcgcgtcggggcggacgtccccacccatgccctcggccgcccccggctgcggctgagcctgaccgggctgcggctcccgggcgaacccgcccgcgatctggacatcgacgacgggtcactccccggccggctgggtgagctgatcccgctgctcgccgacctgctcaccggcctgctccggtcgagggggacgatcgatcccgccagtgccgggcggctgcggctgctgctcacgctgttcgggctcggcgacacctccgtcattccgccgcttccgctggccgaactcccgggctccggccccctggtgttcgccgactggctgcgcgcggtgttccttcccaagcccggcgaaccggtgccgccacccgcggcacgggcgtggctggagaccctcgggcagctgctcgggctccggctgtcgctccccctgcggggcgaggggaccacggcttcgccgtatctgctctgcctgagcccactgcccggggtacgggtctgtgtacggctcgtcgcccaggcggcggacgacgggctggagctcaggctgggcctgtcggccgcggccgaggtgtccggggcggtctccgcccatgccgcggccgatctgctggccctgcgactgggcggcggggccgatgtgctgtggctgcccgaggtacgcgtacatgtcgaggtgtccggcgccgagggacacctgctgcgccgcccggccccgccgcagccggtcaccttgatggtggggacgctgtccgccggcttctcgatcggctcggaccgtgcggtgcggctcctgctggaggcggccgacgtcgtcctcgacggacatccgtactcacgtctggacctgtccagcgtcgaggcgctggccgcggccgccgcgcaggtgggcgtcgacgccctgcacgatgcgctggagacactgttctcaaacgacgaggacggcggcggacggcgtgccacggccctgctcgtcctgctggccctgcgcaaaccggccctcgactggccggtcggcctgccgcccctcaccgagatcgtcggcaaccctgcgtacgcgctgctgcgttaccactcccgggtcctcgccgacgccccgcaccgatggggcgccatcgccgcgcagctggccgtcctggtgcgggcccccgccccgaccggcgagggcagcgccgtagacccctgggtcgtctccgtgggcgacgtgggcctgcccgcccggccggccctcctcctgtggcaggacgacgccgaaggcgcaccccggctgaccgtcggagtccggctggtttcggctccgctgcccatcagcggcggggctgtgcggctgtccgccgcgctggacgccgtacggctgactctgcccgctgtggacccgccgtccgccgtcgcgctgaccgccgcggagctgcggctggcgtggggggaggatctgtcgttcgacgccgggcccgtacagctgaaggcgggttcgctcctcctggccgccgggtggcggcagggggccggatggggggcccgcgcgcgggtcaccggtgcttcggtcacggtcgagggcgacgaggtggccctgccggatccgctcgaactcgccacaggggtagacccgttgctcccaggccccggatccgcgctgtggccggcgctcacccgcctcgccggtctcgcgctgctgcgtacgacaccccgcgagggtctcgacccgcggagcctgctcgccgcgctgctcggctggctgccggcgcgtggacggctgcgggtgccgggtgaggaggacaccggcatcgacctcgccgcgctgatcgccgactggccgccactgccgctggcgggccttgtcaccgatcccgtggagacggtccggtcctggctcggcgacgttctggcgggcagtggtggggcggaccgcagtgtggccgccatcgcgttgctgcgtgaacttttcgcccgcggcgggccggagcggatcaggcaggtggcggtcgcgggcgacggaacgcacgagcggccctggcggctgcccctcgacgactcggggcccgagctgctcatatggctcgatcccgacgggcccggtctggacggtctcggcgaggtgctcgacgcgctcgtcccggccgatctcaccgccgctctggacggctcggcgccgctccccggcgtcgagcggctcacggcggtgctcagcggtgccgcgcgcttcgacagcgacctggccgaactcctcgacgagcggccggactcggcagccgatctgtgggcgctgctgaaccatgcagcgggcagcgacgggctgctgcccgtctcggcgcaggtactgccggggaccacgcaccccaccgtcgttctgccgcgcggtcacctctgcgcgccggagacgttcgaactgagcgaccatctgcccggcgcggaccccacccgcacggtgtacgtctccagcgacctgcccgggatacgaccctggcccggtcagccgggggcggccggggcacacctgctcgatctgcggacacccggcctggcggccgagtcgttcggtctcggcgggctggcggcgaccggcccgtggtacgtactgcttccgccgaccgaggaggcaacggtccgtctgcgcccggccgttgccgagttccgacgcctggccggcgcgccggtcgtgctcgtggcgcactcgctggccgcccgggcggcggtccaggtctggtccgaggggggcctcgcgcagctcgtcacgctgggcgggccactgtccgacaccgcccggcccgggcctctcgacggactggaacagccgggcgtacacgatgccttccggctgttgcagtccctggtgggcctgctgcccgcgggcagctccaccgacggctcgccgctggcggaactggtggcgacctgggcggccgtgaccggtgacgctccctcgggcctacgttccgttccgttcccggtctcggcgttcacacccgtcgctctgccgtccgcggcacccgctccggtgctgagcgtcgtcacccagttcacccgcgaagaactgcatggcgcgctcaccgccctggtcgccgcggtggccgcccaggtccgtcgccggctgcccggcggcggggccgtgccgggccgctcccgggccacccacctcggtcttggactgagcttccgcagcacggccgctgccgccgagggcatcgtctgcggcagtgaactgcgcctggacgcatggcgcgtcccgctgcccgccgcgcagcggtcggcgccgacggtcactccccggctccacgtacgactgacactgcggcggcccggcggctggctcctcgacggcaggccgggggccggggcgcggaccgggccgcaaccgcgactgcgcggcgcggatctcctggtcggtatcggcccccgcctcgacgacgcctccgtgtcggccgtgctccatgacgcggcactcgacggagtgggccacggccggctcgcgatcaccccgcacacgctggacgcggcggcccgtcggttcctggggctgctggcggacacgttgtcgccccggccgacggcagggcccgtgcgcgacctggtggacctcctcgtgcaggcgggcgtggccgtcctgacggccgaggagcgcgtggagctccgcccggacaccctggagcgtgtcatcgcggatccggcagggctcatacggactctcctttcggacccggctgtccgtggcacgctgcggcggctggccggactgccggacggcggtgcggggttgctgtccgccggcggactggaggtcggcgtcacccccgactgtgtgatcaccgtcagcacaccggagcggggtctgccgctcgccggcatcgccaccgtgcacggcacgctcgtcgtcggcccggagcgcgccccggccctcaccctcagggtgcgctccggacaggtggaggccgccgtgctgccggagcccgatcttccggctctggcccgattggtcatgctcaccacgggcggcgaggcgatccgctggggtctgcagtccctgcgcgaccgtggcatcctcctcgacccgctgctggatgttctcggcctgctggcgcacgacccgcggcgccccgacgccccgggatcggtccgctcccccgtgcctctgatcaccgcgccggggcgccggctcgtggaggttctcggcgcggaccggcccggcgagcccttcctgctcgcacccggtcacctcgcccggctgatcgacgcggtggcccaactgatcggcttaccgggcgggttgactgcgctgtcgctgcccgggggcggttcggtcagtgtcgccgaggacggcacggacctggaggtcacgctgcggctgcgggacgggtccgggcccgctgcgctggagtccgccgtgcactggcggctgcggcccgggccgaccgtcacggcgtggctgacgttgtccgccgagcagtccgggccgggcgggttcggcgccggtctggagctggaggtcggccccgaggtgaaggtggccgcccggctcacgccgcgggccggcgcgccccggctggacatcccgctgtatccgctgacgccgggactcggcgcgctcgcggagctcggtcagcaagcggcgcagtacgcccttccgatgctcctggacgttttgcgggacctggccgatccggccgatcccggcgatccgcggctcaagcagatcgccgcggcgctcgccgggctgctggccgcgctggagctgaccgatgccgacggcgcggcctcgatcgagcagttgaagctgctggcgtccgctcccgccgacgagttcggtgcgcggttccgccggcatccgtccgaggtgaccgccgcgctgaaggcgctggcgcgcgccctgatcggggacgcggccgcgcagccgcccgtgctctggcgcagccccggtggccgcgtcgtcgtcgacctcgacgcggcgcccgggggcgtgccgcggctcaccgtcaccgcggacggcctgcatcccgttcccggcacggacgccgaggtgtcgttcgccgccaccacggccggacccgccccctgtcacctgtcgtggtccgtcgtcgatccggacgcgctctttcccggcccggtcgacctcatgccgttcgtgcgggtcacgctgggcggcgtcgacgaccgggtggaggcgggcctgtggctcgatccgcccgggacgaccgaccgggaggccctggtcctgcggctgccgggcagtccgacgctcgtgcaccgccgtggagccgccgactccgccgaggtcgcggcggccgtgcccaagctgatccgccgtatcgccgtacccctcgccgccgacctggcactcactccggccccggtcacggacctgctgaaggcgcccgtgggcaacgacagcactgtggggaaggtcctgcactccgcgcggatcctgaccgggaccggcagcccgcccggcgcaccgtggcggctggccgacgggctgctcgacgcgccgactccgcgggtgctgagcgctctggccggcttcctcaccgcgctcgcgccacggctcggaccggtacggctgcaactcctcgaagccgaggacgggccggggcaaaggcggtacgggctcggtctggagctcgtcgagacgccctacccgctcctggagctgggcgatgtcgtcgtcgcgctctcggccgacggttcctgggagccaccggcggccggagcgggcaccgctcacgtagaggtgtggctcggcagcctgccggacaccctgccgggcccggacccggagttctcccccgcgctgcgactgcggggactcgggcttcaagtgggcggcgcgaaaggcccgttgctcgaccagggtctgcggatcgacgcgctgtcgctgcacggctcatacgcacgcgacgcgtccggcttccaacacgccggtgcacggctggagttgcgggggctggccgtgccgttcggctcggccggaggtggcacgaacccggtcgccgcgaagatcctgcaaccggaagccgcgggcggtgacgccactgcggccgcgccgggcttcgatcccgcgctggtcgtgtggaagcagggccaggacccggtggcgctgcggctgagcgcgggcgcggggtccggtccgtggtggctgtccgtggagaagcagctcggtccgctctacctcgaacaggtcggcctctccgtggcctacgacggtgaccggctgcgcgaggtgggtgtgctcgtcgacggcggagtggcgctcggcggactggccgtcggtgtcgacgacctggcgctccacgtcccctgggccacaccggccgatccggcgacctggcgtctgggcctcgccgggctggccgtctcctacagcgggccgagcgtcagtgtggtcggcgggctgcgcaggcgcgagcgcgacggcggtgtggagtacgcggggatgctcaaggtcgaggcggcgggcttcggcctcaccgccgtcggcgcgtacggcacgtaccccgtcgtcggcaccgcggagcgctacacgtcgatgttcggcatcgccgcgatcgccgcgccgatcggtggtccgcccgccttcttcatcacgggcatcggtgccggactcggcctcaaccgcggactggtgttgcccggcaaggtgaccgacgtcggagagttcccgctcgtggcggccatggatccgagcagccaactggtccgcgagccgatgaaggcgctggactcgatgggccggacgttcccgccgcggcgcggggcgttctggctggccgcgggtgtccggttcaccagcttcacggtcgtggagtccgtggccgtgctggccgtgaccttcgaccacgacgtcgaggtggtcctgctcggtctgtgccggatggaactgcccaaccccgcgaagcccatcgtctccatcgagctggcgctgcgggcgcgcttctccgcgcgcgaggcggtcctgtccgtcgaggcgcagctgaccgacaactcgtggctgctgaaccgcgactgccgggtcagcggcgggttcgccatggtgatctggttccgcaccggcgagttcgtcctgtccctgggcggctaccatccgcgcttcgcgaaaccggcccactatcccgacgtgccccggctgggcattcactggcgggtcagtgacgccatcgcgatcaagggcgagagctacttcacgctcacctccagctgcgtcatggcaggggcccgcgtggaggccgccttcgacggcgggttcgtccaggcgtccttcgtcgcgggcgtggacgcgctggtctcctgggatcccttcttctacgacgtcggggtgtacgtcgcggtcagcgcccgtctggagatcgacatccgggtgtggttcgtgcacgtccggatcacgatcggcttctcgatcgcggcccaactgaccgtgcagggcccggacgtacgcggagtggccgtcctggatctcgatgtgtccaaggtcgaggtcgccttcggcgccgtcgacgccccgggctctccgccgccgctgggctgggcggcgttccacgacaagtacctcgtcgccggtgacccgcacggcgagacgatgagcctgaccgtacgggcggggggcgccgcccgcgatccgggcggcgcgacgggcgcacccgaggacggcagccgggagcggccgctgctgctcacctcggagttcaccctcgcctccaccacgcgtaccgcgagcaaccgggccggcggcgaggtgctgagcggtccggcgctggacctcggcccgatgcggcgagtcgacgtggtgtccgaacaccgcgtggagatggtccggctggacgccgacggcaagccggtcggcaccccggtcgacctggcgtcgacggcggtacgaggcaatgtgcccgacggcgtgtggcgctggttcgacgacgtggagctggacgagggcggcgtccgcgaagcgttcaccggcctggttctcagcgcggtcacccgcctgggcggcggactcaccaccggctccgtcgatgaggtcgaccccggtccgcgacggcccctgccgctgagcgacgaccgcgacccggcgggcgtccggtccgccgccatggaggccgccgtgcggtggtcgcgcactcagtccggtgcgaacacgctggaccgggcgactgagttcctcgtacgcggtgccgggttcgcggccttcggccggtgtctgagcggcgagccgagcaggccgagcgacttcgccctcgcgctgctgccggccgaccgcatctcgccgccccggctggccaggatcaccgagggcctggtgacgccggcccggccgcccctgccgctcaccccgcggcaggcgccgcagcagccggatcccgagccgccgcgcgtcgcgcctccggtgttgctcgcgtccctgcggccgccggtcggcccggtccgccgcgacgggcggaccaccgtgcgcgtcccgcggtggccgcgccgagccgcgcccaccctggccgaggcccgtgagcaggcgctgcccacggccgcccagctcttcacccggcccgcgctcgcggaccgggtcggggcctctggggcgaccgcacgggaccgcgggcggcgtttctcccgcagtggggaggaacgggaggtgctgcgtggcctgttgagcgtcgaccgctcggcgccgtggctgcgttcgggtgagcgggacatcgtggacggtggtccggtgcggctcggggcgggccagatccaggtgtggcggctgcggcgcgccgccgaggacgtccgggccgaacggccgcggctggccgtcaccggcgatcagcgggtgcggatcgtggcgctcgaccgggccggggccgcgcttgtcgactccgaggtggcgggcacggcggaggtcccggttccccggggcacccaactcctcgccctcatcggcctgggcacgacgccgacggcgaaccggcccaggcgcgcgggcctctccggctggcacccggggtcgttcggcgcacaggtgatgccgggcaccgtcctcgtgcccggcgcccgggtcagcaccgccgcccccggctccaagcgcggactgcgcccggcacgggtcgccctcgtcacgggcttcgacctggtcggacggcaggggctgaccaccaccgaactgcccgcctccacgcactcggtcgtcgtcgtgctgtccgccgcggggccggtcaaggacaccgacgggctgctgctgggcctcgacggtgcccagcgggcccgcggcgccacggagccgacgccgcccctcgcggtcgagcagggcgggcagaccgtgctgctctacccggtgacaccgcagggcggatccccggtgtcggtcacgaccggccacgacgaacggtggcgtccctcaggtgtgctgggcagcgcgcagccggcggagcgggtggcccgcgcgatcctccggtacggcctgcccgccctcaccggcgacctggcgggcgagggctccggccgctcggccgtgacgtggatcggagacgtg

SEQ ID NO: 915 - DNA, 1566 bp, Streptomyces avermitilis
  CDS (1)..(1566)
atgacagagctcggcgagggacagttccgcctgcacggcttcgcccggccgccggtgacggcgggaccgcacctggtgcgcatgacacagtcggtcgaccagggcgatccgatcgccccggtggaacgtcacgcgctcgtcaccgctccccagttcgcgctccctccgggggagttgcgcagcgtctttcccccgccggaggcggtcggccctttcgacacccgcttcgcccaggtggcgctgcgccgccgcaccctgccctgggagcggctggtcaccgtcggcctcgatccgcagcgccgcccgtggctggccctcgtcctgctcacgcagagcgagggcgacgtcgtcaccggggtgccggtgagcaccgcggtccccgcgtccctgcacggcgcactcggcatcagcggggcttcggggacctgcgaccggctggacacgaccagggacgtggtccaggcgctgttcccgcgccccgacgaactggaactgctgtgccacgtgcgtgaggtgtcgctcggcgactcggagctctcggtcggtgacgacgacggattcctggccgtggtgatctgtgcccggctgccccgcccgggactcgcgtaccgggcgtgtctggtctcgctggagggccggatcgcggaactgcccgccgccaccggggatccggccagcggtcccggaggtgccgaggccgctcccggtggcgcgggcgtcagcttcccggtcctcgcccactggcggttccgttgcgcggcggagcccggcgacttcgactccctcatgaaggggctccatgtggggtcgctgggcaccgtacggggcaagtgcccggccgtcgcgcccagcgggcacaccgtcatcggtcacaccacgcggcgcggcgaggagacggccgcctggtaccggggaccgctgaccccgcgcgaggtgccccgccggcctgcgggcagcccctgtctgacggcggaccagggccgggctgtcgccgccgacgggctggaggacctcacggtggccgccgcccacgaggtcggccggctgctcgcgctgtcgtccccgcggttcctcgcctcgctgcgcgactggcgcaggcggaccctggccgccgacgcggtggccgccgccctcgaactgcttccggaagtacgggacttgggcctcacccggctcacggtgggccagggtctgggcctggcgctgatcggcacgctcgtcgacggccgcgagccgctgggcgccccggtcccgctcgccgacgccgagtgggcactgccgcagttcccgcccgatgtcatcgtgtccggcacgggtctgccacgggatctcgtacggcagatcctcggcgacctgccggtgctcaccgaccccgaccccacaccgcccgcctcgcccctcgaccagaccttcgacggcctgcggcagacccccgaccagctcgccccgctccgtgacgccctgcgcgaacgggtccggtggatcgcccggcaggcggggctggacccggacaccacgctgttcgaccccgcctacgcgcccaccacgttggaggagctcttccca

SEQ ID NO: 916 - DNA, 861 bp, Streptomyces avermitilis
  CDS (1)..(861)
atgagcacccgataccgttccgaggccgccgtcgagcaggtgctgaccgccgccgccggcaaggtcagcgcgggcgagccacccccggacgacgtactcgactggctcgcccggctgcgcctgctggaaggggtccccttcgcctacctcgtcaccgacgaacgtctcctgccgctcgaatccgcgcgtttcttcttcctcgaccggaactggacggacgcggccgtggacggcgcgctctcggcaggcccctccaccacgcgggaccgggcccatctcgtggcgcggcacggccggatccgcgacgccgtggatgcctcggaacgcaatgtgtggatcaaggcggcgcgaccgggcctgtcctacgacgcggaaccggtcggcacggtcacgggtttcctgctgcgctcccgtgcggtctccggctggccggggctgcgcgcgcaggcattccacgaggggcagccggtcaggccgctgcggatcgaacgcctggcgcccgccgtgctgttggcgctgttcgacggcctgcccacccgcgtcctggtcgaagagccgcaccaggggctgcagttcggcgtggacctggcggacggcggcgtgttcaccgtcgcgcgccgcccgccggagccagaaggcgccgccaccgtgctgttccgtccctcgggctgcggtgtcgtggacgtgcgcaggctttgggccgatctcggtcacacgacagccgccgacggcgccgcgaccttcgcgctccacctcgtgcagcgcccgtatcagcaggagttctccgggacgggagaaggcccgctgttcagcccgtcgatctccctggacgacctcgccgcggccttcgaggagtcgccg

SEQ ID NO: 917 - DNA, 3594 bp, Streptomyces avermitilis
  CDS (1)..(3594)
gtgaccgaggcgtttcccctgcacccggccttcgcggtcaccgcgcgcaccggcctgaccgccgcggcctcccgctcctgggcggccggactgcaccgcgggccccggctgctggtgccggtcgacgtgcaggcactggtcgtgcacgaaggccacgcggaagccagggccgacatcggactgcggctgttcgacgggctgtccagggacccgtccgcgccgggaccgcgcacgtccgcgcccttcactccggccgccccgctcggccccggtgtccatctgcactgggcgctgccggacgcgctgacccacgcggtggcggacagcccgggggcggagccggtctggcagccgctgcccgaccgctgggtcgtggtccggctcggccactacaccgggcagccccgcgcggtgcaggcgtgggtcctggaggcggagaagggcggcagcggcgcgctcgacggatggcagccgggcggcgcccgcgcctatcgcaccccgcagctccgcccggagcagctcaccgccgtctgcggcggcgacccggcctgggccgccgcatacgacaacgtggccgagcggttcgcccattacgacgactggtccacggttcccgcactgcaccgcagagcgctggcctacgtcgtggtcggctggtactcccgccccgaactcgacccggtcgcggcggccgacactcccgccgcgttccgtgccctcctggaccggctcggctggcaggtggacaccgcccggctcacccgcgcccaggccgaggccgagcgctccacgacgcaggccgaggcgctcggccgacggtcggccgacctgccgcccccggcctcccccgcgctcgccggcctcctcggggcacagcagcccgccgccgacccgcacgcctggtggccccggcagaccgtcttccacggcgtggtgtacggggtgcacgcggattccgcttcggccgtggatccccggcccgagccgggggcaccacgggtggcgatcggggccacctccgcggaggcgctcgccgccctcgtcgccggtgaactgaaccgcccggacaccgagatcctctaccaggccttcgcgcacgggctcgccacgacgctcggcgaacccgacgggctgcctcggatcgaggaggagatccacgcccggggcttcgtggcgcgccccggagcggcccgcgcggaacgcgtcgccaccggcgacccgttcaccggtctgcggcccaccacacccccgaccccggccctggaccgggtccgcgcggataccgcgtccggtatcccggacttcgtggtgggccgtgccgtcctcgcggacctgcacctgatcgagaaccaaccggaacgggtggcaccgcccgccgatcctcgccgcaccgagacagtgcaacggcccctgccccggcggttccacccccaggaccccgtgctcgtgatgcggggcctgcgccggtccctgcggcacgggtacgacggggtccgcaccccgggtgaacgcctggcctgccggctgaccggggacacggtgacacgcctggcgggtgtcatcgacgggcgggacctgctggcacgcggactggaccacggctcgctcccggccgaggccgaggcgctggtcgtcgaggcggcggtcgaggatccgtacgccgattacatcgaagcgctcggccgtctccaccggtacgggctgccgccggaggaggccgcgcggcggctgcgggccgagggggccatgatggtctggtccctggccttcccgagccgtgccgcgccgctcacccatctgtccctcaaggacggcacgggatcctcgccggtagggatcaccctgtggcgccaggcatgggtgccgctgtggtgcgagtgggaactggaatggaatccccatccggacgccggggactgggagttgggtgaactcgacttcgatccgcactccgctgccggattctcccagaccggtgccaccgtgctgcggggacggtcctcactcgtctcggcgccgtcgcgggcgctcggggacgagatctcccggttcctggccgaggaggaccggctcgatctgcgcggcgagggcaggatcgacgacgcgctcgcgagccggttgcgccggctctcggccgatcagggggtgcccgacctggtgtcggcgggcttcgacgggctgcgtgagcgcatgctcggcttcaccgacgacgtggcgctcacccccggtgtcccgccggcaccgacggaaccgcccgacctgctgcgggccgggttcgcccggctgcggcaactgcgggtggtggacgcgttcggccggaccgtggatctgctggacccggcgaccccgcccgcgtacgtcgggtcggggctgcgcggcccggcccgggacgtcttcgcactgccgccgcgcgtcaaccagcccgcgacgctgtccttccggctcgtcgacgcctccgacgaactgcgcgaggcgggcatcgaccagcaggagggcgcggcgagcccgctggccggctggctgctcgccgaccacgcggacggggcggtggagttcttcgcgcccggtggccgtgcgctcggtcagctcgcacacgacgcgctgtccggtgccgtggtctgggagggcccgccgggacatcgtgcgccggtgggcgccccgccgtcggcggccttcggcggacagccgcgcctgcggcatctcctgggcctggccgaggggttgatcgaccgcgacagccgggaacgcgccaccggtgtctcccggtccgacaccccgttggacgcgctgctgcgtatcgtcgacacgacctcgacgacggtcggagcgggcggcctgaccggcagcgaacacaccgcgcagctcgtgggaaggccgatcgctgtggtacgtgcccggctgatgctggacatcgaaccggagggcgagcatcctgccctgtccccggccgcgcgggccgggcgcgccgcggcctgggcgtggttggccggacggcggttccccgttcgtctcggcgcgctgacccgtctcgacgacggcctcctggcctacttcgtggacgacgactacggcctgatccaccccgtccacgccgacgtggcgcgggtcgccactccctcgggcaggcaccggggtgatttcgccgccctcggacaacgcgccacgactccccggccgatcggcaccccgaccgtggccgacggttccgcgctgtccctgctgcccggccggtccctgaggctcaccctgctcatggatccggccgccaaggtccacgccacctccgggatactgccccgcaagagcgtggatctgctgcgcgactggttcgcggaggatctggcccggctggtgccgtcggtgcgggtcgggcccgtcctcgtcgatccggccaccatccgtatgccgctcacgcccgcgccggacggcgagcggctgtggacccggcgcaccgcgcccctgtcctggcgcgacgaccccgtcgtggccgccacccagcaggccttgctgccggaggtaccggcatgggcccaggaaggctatctgcgcctcgcaccggaagcgcgggaagcgcctcaggacgggggcaccggg

SEQ ID NO: 918 - DNA, 2484 bp, Streptomyces avermitilis
  CDS (1)..(2484)
gtgctgatccggccgcgcgtaccgcgcccggacgagcctgcgctgaccgaggtcgaccagttcggcagcctggccgggctcgtcgtcgggccgctgcccgccgacttcacgctggtgacgatcggccgggtgaccgtggacgggcggggcacggacgcgttgcgcgtggcggccgaagtcgaccgggcctacctcaccggggagacggcctgggtgctgccgcccacctcggccggctacttccggcaggagacccgcgtcgatctgcggaccgacctgccgtctcctcgctacctggactaccgaatcctggccggcactccccggcgtgtggccgccgaacagccggtccgactggagacggcgaccctcgacggtttcctcgaactcgccgaggagggcgagagcgagcgtcccgcgggcaggacccacctcgagtacctgacctcggtgcgcaagctccgggtggattccgaactggaccagtaccggcagcggatgatccagaaccggcggaacatccccccgtacgaccagacgccgggctcgtcctgggagctgccccgccgggccgcccggctggccgcgctgctgcgggtgcagcacggcttcgagcggctcgacctggcgcaggtgctggccggcatcgacggggccgaccggcagacgcccggccccctggacccggcccctcgagcggatctcgccctcacctggagcggtgacctcgggcgcgccctcgccgcgtacgtccgcgcccgccacgcgcccggggtgccggccgcggaccgcggtcggtcgctggaccactgggtcgcccgccacgcttcgacgccgcggctgctgggcgacatcgacggggtgaacctcggcgagtccttcgacccgcaccgctcgctggcggcgcagctgcgtgagtactacgacggcgccgtggaccggcgttgcaccgcgttcgtcgccgccaccaggaccagtgccggagcgccggcgctccccctggcacctggcttcggcccgcctcgcttcgccgacgccgcggtcggcttcgtcgccggggagatcgtcgcgttcgccgtcgacttcctgcgcttcgcactcggcggcgcgttcgagagcgtgcgcagccgtgccgaggccatgctcgcgccggactctcccgaggtactgcaactgacacaccgcttgctgcacttcgtcgaggcggggctggccgccgaactctcaccaccgtcggacacggccctggtgatcctgcgccgcgacggcagcccgatccccggattcaccgtacggctcatcccgccatcgggaggacggcattccgggatcgcggccacgacggacgcgctgggcaccctcatggttcccgacgccgggacgcgtgcctggacggtcgcctgcgccgaccacgagctggcacccgccgccgaagccaccgaccccgtgcccgtgaccgaactgcggcccggccgcacgccactcgatctgccccgccaccaccggctcccgcccggtacgacgacggagctggtcgcccgcgaggtgctcgttctcgtctgcccccggtgcgatgcggcgctcagggtcgtggaaccgccgccgcgctccctcgaatgcccccgcgacggctacgacctgtcggaactccgcaccaccgtgatcaccgacatcggccggttcaacgcgccggtctcggggcagcgcccgcaccggactcccctgaggctgacgtcctgcggcacccggccggtcgacaccgcgcacggccccgtcgccgcctgctgggacgagtcgcgcttcctgcatccggcgagcggcgactacgagttgtgggccatgacaccgcgagggccgctgaccgtgtccgtcgtcggccgcgccacctggggggcggccccgccgcagatcgaccccccgctgcgtacctgggatttccacgaggccgcctccggccccctcgcgccaccgccctaccgcggcagtcccgtaccgctcagcgagaaccggcccctggcctccgtctaccgctggatcaccatccaccactcggccgaccccgtcacgtacacgcatgagggcccgcgcacgatccagcgggcgcacttcgcggacgacaaggccgacatcggttaccactacatcatcgacggcgccgggacgatctacgaggggcggccactcggcatcgagggctcacacgctgaactcttcaacgccggcaatctcggcatcgtgctcaccggcgacttcggaccgcgctggcagaaccagtgggcacgctacgaccacccgacgcccaagcaactcacaacactcgacgtcctcgtggacgtcctggccgtccgcttcggcatcagcagcgtctggggccaccagccgcgcaagaagcagtcccgggccccggcatccacccagtgccccggtgagtacctcatgagccatgtcgacgaactgcgcctcgtgtacccgggtgatccattc

SEQ ID NO: 919 - DNA, 705 bp, Streptomyces avermitilis
  CDS (1)..(705)
atgacccggcccgccgatccgcccggtgccccggtccgggtcctcatcgccgacgaccaggcgctgctgcgcggcagcctgcgggtgctcgtcgacaccgagcccggcctggtggccacgtcggaggcggcgaccggcacggaggcggtgcggcttgcccggcaggatccgccggacgtggtcctgatggacgtgcggatgcccgaaatggatggcatcgaggcgacccggcagatctgcggttcccccgagaccgcggacgtcaaagtgctgatcctgacgatgttcgacctggacgagtacgtctacgccgcgctgcgggccggtgccagcggcttcctgctgaaggacacgccgcccagcgagttgctcgcggcggtacgggtcatcgccgccggcgaggcgctgctggcaccggccgtgacgcggcgcctgatcgcggagttcgtccaccgcccggagccctcgcgaccgctgcgtcgcaccctggacggcgtgaccgagcgcgaacgtgaagtcctcaccctcatcgcctgcggcctgtccaacaccgagatcgccgagcggctgtatctcggcattgccaccgtgaagacccacgtcagccacctgctcaccaagctcgccacccgcgatcgcgctcagttggtgatcgtcgcgtacgagagcggcctggtcacggtggcgcgaccaccgatcggttcc

SEQ ID NO: 920 - DNA, 1023 bp, Streptomyces avermitilis
  CDS (1)..(1023)
atgcgcggccgcgggtggcggtcattctccaaccgggggtggagaaggggcagtcagccccgagcgggacgcggcgggagcctgtcgtcacggaccatcaccggcatgatcgaagtcacggatctgaccaagcgctacgggaccaccaccgttgtggagggtcttaccttccaggtacggaccggtcgggtgaccggattccttggccccaacggcgccgggaagtccaccgcgatgcgcatgatgctgggcctggaccgcccgacggccggcgaggtacgcatcgacggcgcgccctaccagcggctccgcgacccgctgcggacggtgggggcactgctcgacgccagggcggtgcaccccggccgaaccgcgctgaaccacttgcgctggctggcccgcagcaaccggatcccgccccgccgcgtccgtgaggtgatcgagctggcgggcctgcggagcgccgtgcgccggcgggcggggacgttctcgctgggcatgagtcagcggctgggaatcgccgcggcgctgctcggcgaccccgccgtcctggtgctcgacgagccggtcaacgggctcgacccggaaggcgtcctgtggctgcggcacctcatgcgggacctggcggcacagggacgcaccgtcttcgtgtccagccatctgatgagcgaggcggcgctcaccgtggaccacctcgtcatcatcggccgcggtcggctcctcgcggacaccagcatgagcgagttcatcgacaggtacacggacgtgggggtgcgggtgcgcactccggaaccgcggcggctgcgcgacgtgctggtcggcgcgggaatcacggtcaccgactgctccgacggcagcctgaaggtggccgccgccgcggagcggatcggcgaactcgtcgcggcgcacgccgtgacggtgcacgaggtgacgcggaagaccgtgtctctcgaagaggcgttcatgcggctgaccgctgccgcggtcgagtaccgggcggagtcgccgggaggagtacgccga

SEQ ID NO: 921 - DNA, 1302 bp, Streptomyces avermitilis
  CDS (1)..(1302)
atgaccgccacccgcggccgcgcatcaggctgcaggaggagcggctttgaccaccgctggacggaggcggagcggcgtacgcctggatatggtcgagcggtgcatgcaggtaccgcggtggaccccgacgaccatccgatcctggcccggcgactgagccggcgccgactcatcgccctggacggcgtgctcgtattcgcctacgcatgcgcgctgctgtcgaccgggccgacaggcatctcgtcgtcgtccgcgccgccgctcccggccccggtgccgtgggagcggctcgtgctcatcgccgcggccactgcgcctgtcgccgtacggcggatctggccgttgcccgtgttcgcggtcgtgctggcggtgaccgccgtggccgtcgtgcgggacgcggcgtgggacccgttcctgtcggcggcgttcgccctctacaccgtcgccgtcacggtgccctcgcgccactggtggcaacgctggttacccggcctggcgatcgctttgctgaccgtggccggccttgccggagcagcgcgtgccggcgaggccttctggtggcgcggcagccccggtctgctgctgctcggcttcgccgcactgctcggcgcctggcaactgggacgcgccgcgcggcagaggcgcgcattcgccgtccgggcggccgagcagctcgcacaacgggccgtcacggaggaacgcctgcggatagcccgcgaactgcatgacgtcgtcacgcacagcatgggcctgatcgcggtcaaggtcggcgtcgccaaccacgtgttgcacatcaggccgcaggaggcgtacgacgcgctccaggtcatcgaacgcacgagccgcaccgcgctgaacgacatgcgccggatgctcggtgtgctgcgtacgtccgagggtgagcggcagtcagcggctctcggcccgctgcctggcgcccttgctctccctgacctcgtcgggcaggccggcgcgcagctgactatgcgcggtgtcgagagtctgcccgacggagtcgcgctggccgtctaccggatcgtgcaggaggcgctcaccaatgtcgccaagcacgccggcccggaggcccgctgccgggtggcggtcgatgcgaacggccacggcgtccggctcgagataaccgacgacggaggcgaccggagccccctcgcgccgaagcccggcggccacggaatcgtcggcatgcgcgaacgcgtcgccctgtacggcggcaccttcgccgccggaccgcgtccagagggcggcttcgcggtacacgcgtccctgccgtacgaggagaacaca

SEQ ID NO: 922 - DNA, 771 bp, Streptomyces avermitilis
  CDS (1)..(771)
atgaccagcaactcgccccgagcggttctcgccgccgagtggatcaaggtgtggaccgtacgctcgaccagcttcaccctgctgctggccttcgtgctcagcaccggcctcggcaccgttgtcgcgttcagctggcgtggccacatcgagcgcgtcgtcaacttcagtccgctcttcgccggcctgtacggcgtgaccctcgggcagctcgccctcgttgtgttcggcgtcctgctcgtcggctccgagtactcttccggatcgatccggacgtcactgtccgcggtgccccggcgtgggctgctctacggcggcaaggtactggccggcacactggccgccctcgccggctcgacggtcaccgtgatcgtcacgttcgcgggggcgcaggcggccctcggcccgtacggcatcacgctcactgcgcacggggtcccggctgcggtggtcggcgccattgtctacctgacgctgatctgcaccttgtccatggggatcgcggccatcgtgcgcagctcggccatctcgctcggcgtccttctcccgctgctgttcctcggctcccagggactcggcaacgtccccgccctgaagcccgtcctgcagtacctgcccgaccaggccggcctggaactgatgcgtattgccggacctcccggcgacggacgcttcggccccgactacgggcccagcacggctctcgtcatcctgctggcctggactgccgccgccctgaccggcggctacctggtcctgcgccgacgggacgcc

SEQ ID NO: 923 - DNA, 2847 bp, Streptomyces avermitilis
  CDS (1)..(2847)
atgcagggagtttcctgtctgcacccccctcggaaaccagaagaactcacgctcgtcgaccgggaaacacagttccgcgcgctgcggctggcccttaccgaatgcgcggccggcacggtgaaactgctcgtcgccgagggcggaatgggctgtggaaagagtacgttcctgggcgaggcactgcacaccgccgccgcctccggcttcgccgtcctgcgtgccgccgggcttcccgcggaccaccggcaacccctcggcgtactgcagcaactgctgaacgaccccgcccccgaggacaccgcccgcaccgccgtccgccccatgccggtgcaacacgtccgcggcgccctcgaacgcctcgccgccggcgccccgctggcgatcggcatcgacgacgtacaggacgcggacccggagtcgctgcactgtctgatgcgcctcacccgccactcccccacctcgcggatcctgctgctgtgcaccgccctggcgtgcagtccggccgccgacccggtactcgaagccgagctgatgcgtcagaccgccttcgaacgcatcacgctggactgcctgtccctggacggagtgaccgggctggtctcggaccgctgcgcgcggcccacggcgcccccgccggcggactactgcctgaccgtcaccgggggcaacccgctgctgctgcgggccctgctcgaagagcacagcgaggccgacgccccctcggcaccccgcccggcggagccctccgcgctgcactccccgccgcaggccgccccgccgcgcccggtcgtcggcggccgcttctaccagtccgtactggcctgcctgtcccgcacggagacggcgatcaggcagacggccggcgccctcgccgtcctcggcgggcgtgcgcgcgccgacctgctcccccaactgctcggcgcgagtcccgcgtcggtcacccgggggctgcgtgcgctggaggcgacggggctgaccacctccggccgtttccggcacccggtggccgaggccgccgcgctcgacgcactggacccgagccgccgtgcccacctgcaccgccgagcggcggcgctgcagcaccacgacggcgcggcgccgcgggacgtcgcccgccaccttctcgcggcccgccatgcggcgggcccctgggcggtgtccgtgctgcgtgacgccgccgagcagtcgctggcgcaggacgacgtggcgtcggcggtctcctgcctggaactcgcctacggggcctgtgtccgggaacgggaacgtccggagatcaggatcaggctcgccgccgctttcgggcgcaccaacatcgcggtggcggaagagcacctcgccgacctggtcgccaccttgcgggaaggagaattgaccggccatcagacggctttactcgtccctctgctcgtcaaccacggccgcctcggcgaagcgcgggaggcgatggaccggctcaacgccgccgacgacgcgcgcggcctgtgcgcggacggcggcttcccgatggccgctccgtggccgtcgaccgcacacctcgccgcacgccgcgatcccgccgcgcgccgcgatcccggcacccgccgcgatcccgccgacaagccgttcctgccccggcagtccggtgccccgcagccccggccggaggacggccgtggccagcagccgacagcggccttgtgggccctgcccggaaacggcaccagcgaggcggccgcacacgccgcggaacaggtactgcggtcctccccgctcaccgacagcaccctcgtgctcctggtgaacgccgtgcggatcctcgcccgcacgggccggtacgacaccgcggacatctggtgccaccgcctgctcggcgaggccacccgtcgccgttgtcccggctggcaggcgcacctcctggcggtgcgggccgaactctcgctgtgccgtggcctgctcgccgacgccaaggagtgcgcccagcgcgcactgacacacgtaccggggcacagccgcagcgtcttcgcgggcggtccgctggcctgccaggtcctcgcctgcaccgcgatgggacgctacgacgaagccacgcaactgctcagccatccggttcccgaggcgctgttccacagtgtgtacggcctggggtacctgcgggcccggggccatttccacctggccatgaaccgcctgcccgccgccgtccgcgacttcctcaccgccggccgggtggcgcgggagtggggactggaccatccggtgctgctgccctggcgtacggacgccgcggaggcgttcctccggctcggggaaacgaagagggccgaccaactcctcaccgaacagctcgtctccccgcacagcggcaacccgtacgtccgcggcaccgcgctgcgcctgcgggcccagaccgcggcgccggcggaacggctccggctgctgagcgaggcggtcagtgacctccagagctccggcgaccgcctggcgctggcccgcgcactggccgatctcggcgccgcgtatcacagccggaacgagcccgtacgggcgagcgccacggtccgccgcgcctggcagctggccaaggagtgcggagcccaggccctgtgcgacagcatcctgcccagtcgcggcaccaaggaccgggggcccgacggaagggcggccgcgaccgaggccctgctgagcgagtccgagatgcgagtcgcgacactggcggcgggcggcaacaccaaccgtgagatcgccggccggctctgcgtcaccgtcagcacggtcgaacagcatctgacgcgggtctaccgcaaactgaacatcacccgccgcagggagctgccgacccgtctgcgacacctcgcggaccaggccaac

SEQ ID NO: 924 - DNA, 906 bp, Streptomyces avermitilis
  CDS (1)..(906)
gtgcgtgagtgcggccgcggtattcccgttgccgtcactcgaatggtggaatcgctcatcacttcaggaacaccgtgcctgctttccgaaaaggggaatttcatcgtggcggatctcaagggaagggcggctctcgtcaccggagcctcacgcggaatcggcagggcgattgcccaacggctcgccgcggaaggtcttctggtggccgttcactacggcagccaggaaaaggcggccgcggaaacggtcgaggccatcgaacgggtcggcggggaggccttcccggtccgggccgacctccgccgcgacgacgccgtcgacaccctgttcgcagaagtcgagaaccgtctggacgggcgcccgctccatgtcctggtgaacaacgccggggtgcagtcgccccccgcaccggagggagccgggggaaagggtgaggacgtcaccagcgtctccggcgtcaccgccgcggagttcgatcacctgttcaggatcaatgtgcgggccccgttcttcatcatccagcgggccctgcggctcatcggtgagggcggacgcgtcatcaacgtctcgtccgccctcacccggatcgcctggccgctcctgccgtacgccatgagcaagggtgccctggaaatgatcgcgccgcgcctggcccttgagctcggcgcgcgcggcatcacggtcaacaccgtcgctcccgggatcaccgccaccgacatgaaccgcgcgatgcgcgatgtgcccggggtcgaggaacgcatttccgccctcaccgcgctgcgccgcctggggcgtccaggggacatcgccggtgtggtggccttcctcgcctccgacgaaggccgttgggtcaccggtcagttggtggatgcgagtggggggctgtgcatcgcgcccgccatgtcg

SEQ ID NO: 925 - DNA, 849 bp, Streptomyces avermitilis
  CDS (1)..(849)
atgatggccgtcccggagcagaccccgccctcttccctggaagtgggggactactacgaccgtttgaccgacctcatgaatcgtgcgctgggtgggaacacccacctcggatactggccgcagccgggggacggcagttcaccgggcaaggccgccgaccggctcaccgatctcctcatcggcaagctgagaggcatcacgggccgccgggtcctggacgtcggctgcggttccggaaagccggcggtgcggctcgccctgagcgcgcccgtcgatgtcgtcggcgtgacggtgagcgaggttcaggtcgggctggcgaccgctctcgcgaagcagtcgcacgtggcggaccgggtcgtgttcacccgtgccgacgcgatggaactgccgtttcccgacgggtccttcgacgcggcgtgggccctggagtgtctcctgcacatgcccagccccgcacaggtgatccgggagatcgcccgggtgctccgccccggcggccggctggccgtcacggacgtcgcactgcgcgccttcgggcggaccggcatgaagcgcggggagtgcacgtcccagttgctcgcggtcccggccctggtgcacatcgacgagtacgccggaatgatcgccgacgccgggctggaactgcatgagctgaccgacatcggcgatcaggtcgtcggcccctctttcgccgcgctgcgtgaccacgtgaacgagcacctcgacgagtacgcggcggccttcgggatcggcgtcgcggagatgcggaaggtggttgcacagtgcacgacgctcccctggacgccggacatcggctatgtcgtgctgaccgcccggcgcccgggggag

SEQ ID NO: 926 - DNA, 11916 bp, Streptomyces avermitilis
  CDS (1)..(11916)
gtgcagaggatggacggcggggaagaaccccgccctgcggcaggggaggtcctcggagtggccgacgaggcggacggcggcgtcgtcttcgtttttcccgggcagggcccgcaatggccgggcatgggaagggaacttctcgacgcttccgacgtcttccgggagagcgtccgcgcctgcgaagccgcgttcgcgccctacgtcgactggtcggtggagcaggtgttgcgggactcgccggacgctcccgggctggaccgggtggacgtcgtccagccgaccctgttcgccgtcatgatctccctggccgccctctggcgctcgcaaggggtcgagccgtgcgcggtgctgggacacagcctgggcgagatcgcggcagcccacgtctcgggaggcctgtccctggccgacgccgcacgcgtggtgacgctttggagccaggcacagaccacccttgccgggaccggcgcgctcgtctccgtcgccgccacgccggatgagctcctgccccgaatcgctccgtggaccgaggacaacccggcgcggctcgccgtcgcagccgtcaacggaccccggagcacagtcgtttccggtgcccgcgaggccgtcgcggacctggtggccgacctcaccgccgcgcaggtgcgcacgcgcatgatcccggtggacgttcccgcccactcccccctgatgtacgccatcgaggaacgggtcgtcagcggcctgctgcccatcaccccacgcccctcccgcatccccttccactcctcggtgaccggcggccgcctcgacacccgcgagctagacgcggcgtactggtaccgcaacatgtcgagcacggtccggttcgagcccgccgcccggctgcttctgcagcaggggcccaagacgttcgtcgagatgagcccgcacccggtgctgaccatgggcctccaggagctcgccccggacctgggcgacaccaccggcaccgccgacaccgtgatcatgggcacgctgcgccgcggccagggcaccctggaccacttcctgacgtctctcgcccaactacgggggcatggtgagacgtcggcgaccaccgtcctctcggcacgcctgaccgcgctgtcccccacgcagcagcagtcgctgctcctggacctggtgcgcgcccacaccatggcggtgctgaacgacgacggaaacgagcgcaccgcgtcggatgccggcccatcggcgagtttcgcccacctcggcttcgactccgtcatgggtgtcgaactgcgcaaccgcctcagcaaggccacgggcctgcggttgcccgtgacgctcatcttcgaccacaccacgccggccgcggtcgccgcgcgccttcggaccgcggcgctcggccacctcgacgaggacaccgcgcccgtaccggactcacccagcggccacggaggcacggcagcggcggacgacccgatcgccatcatcggcatggcatgccgtttcccgggcggagtccggtccccgaaggacctgtgggagctggccgcctcgggcggagacgccatcgggccgttccccaccgaccgcggatggcccacggaacagcgtcacgcccaggaccccacgcagcccggcacgttctatccgcagggaggcgggttccttcacgacgcggcgcacttcgacgccggcttcttcggaatcagtccacgtgaggcactggcgatggatccgcagcagcggctgctgctggagacgtcctgggaggcgttcgagcgggcgggaatcgatccgctgtcggtacgcgggtcccgtacgggcgtcttcgcgggcgccctctccttcgactacggcccgcgtatggacaccgcgtcgtcggagggcgccgcggacgtggagggccacatcctcaccggtaccacgggcagcgtcctgtcgggccgtatcgcctacagcttcgggctggaagggccggcgatcaccgtggacacggggtgctcggcatcgctcgtgacgctgcatctggcgtgccagtcgctgcggtcgggtgagtgcacgctcgcgctggccggcggcgtctcggtcatgtccaccctcggcatgttcatcgagttctcccggcagcgcgggctgtcggtggacggcaggtgcaaggcgtactcggctgcagccgacggcaccggctggggcgagggcgtcgggatgctgttggtggagcggttgtcggatgcggtgcggctggggcatcgggtgctggcggtggtacgcggcagtgcggtcaaccaggacggtgcgtcgaatgggctgacggcgccgaacggtccggctcaggagcgggtgatccggcaggcgttggcgaacgcggggttgtccgtggcggatgtggatgtggtggaggggcacgggacgggcacgacgctgggtgatccgatcgaggcacaggcgttgctcgccacgtacgggcagcgggccggtgacaggccgctgtggctggggtctctgaagtccaacatcgggcacaccatggctgccgcgggtgtgggtggggtcatcaagatggtgatggcgttgcgggagggggtgttgccgcggacgttgcatgtggataagccgtcgccgcaggtggactggtccgcgggggcggtgcggctgctgacggaggcggtgccgtggccgggggacgcggcagggcggttgcggcgggcgggagtgtcgtcgttcgggatcggcggcacgaatgcgcatgtgattttggaggaggcgccggcggcggggggctgtgttgccgggggtggggtgttggagggtgctccgggtcttgccatttcggtggctgagtcggtggccgctccagtggctgtgtctgcgccggtggctgagtcggtgccggtgccggtgccggtgccggttcctgtgccggtgtcggctaggtctgaggctgggttgcgggcgcaggcggaggcgttgcgtcagtacgtggcagtccggccggacgtttcgcttgccgatgtgggtgcgggtctggcctgtgggcgggctgtgctggagcatcgtgcggtcgtcctggccgcggaccgtgaggagctggtgcaagggttgggggcgctggcggcgggtgagccggatcggcgggtgaccacgggtcatgcgccgggtggtgaccggggcggtgtcgtcttcgtgtttcccggacagggtgggcagtgggccgggatgggtgtgcgtctgctcgcctcctctccggtgttcgcccggcggatgcaggcgtgcgaggaggctctggcgccgtgggtggactggtctgtggtggacatcctgcgccgggacgcgggggatgcggtgtgggagcgggccgatgtggtccagcctgtgctgttcagcgtcatggtgtctttggctgctctgtggcgttcctacggtatcgaacccgacgcggtccttggccattcccagggcgagatcgcggccgcgcatgtgtgtggggcgctgagcctgaaggacgcggcgaagactgttgcgctgcgcagccgggcgctggccgctgtgcggggccggggcggcatggcctcagtgccgctgcctgcccaggaggtggagcagctcattggtgagcggtgggcggggcggttgtgggtggcggcggtcaacggcccccgctccaccgccgtctcgggggatgccgaggcggtggacgaggtgctggcgtactgtgccggcaccggggtgcgggcccggcggatcccggtcgactatgcctcgcactgcccccatgtgcagcccctgcgggaggagttgctggagctgctgggggacatcagcccgcagccgtccggcgtgccgttcttctccacggtggagggcacctggctggacaccacaaccctggacgccgcctactggtaccgcaacctgcaccagccggtccgtttcagcgatgccgtccaggccctggcggatgacggacaccgcgtcttcgtcgaagtcagcccccaccccaccctcgtccccgccatcgaagacaccaccgaagacaccgccgaagacgtcaccgcgatcggcagcctccgccgcggcgacaacgacacccgccgcttcctcaccgccctcgcccacacccataccaccggcatcggcacacccaccacctggcaccaccactacacccaccaccacacccacccccacccccacacgcacctcgacctgcccacctaccccttccaacaccagcactactggctcgagagctcacagccgggtgccggatccggttcgggtgccggtgccggttcgggtgccggttccgggcgggcagggactgcgggcgggacggcagaggtggagtcgcggttctgggacgcggtggcccgccaggacctggaaacggtcgcgaccacactcgccgtgcccccctccgccggcctggacacggtggtgcccgcactctccgcctggcaccgccaccaacacgaccaagcccgcatcaacacctggacctaccaggaaacctggaaacccctcaccctccccaccacccaccaaccccaccaaacctggctcatcgccatccccgaaacccagacccaccacccccacatcaccaacatcctcaccaacctccaccaccacggcatcacccccatccccctcaccctcaaccacacccacaccaacccccaacacctccaccacaccctccaccacacccgacaacaagcccaaaaccacaccaccggagccatcaccggcctgctctccctcctcgccctcgacgaaacaccccacccccaccacccccacacacccaccggcaccctcctcaacctcaccctcacccaaacccacacccaaacccacccaccaacccccctctggtacgccaccaccaacgccaccaccacccaccccaacgaccccctcacacaccccacccaagcccaaacctggggactcgcccgcaccaccctcctcgaacaccccacccacaccgccggaatcatcgacctccccaccacccccaccccccacaccctccagcacctcacccaaaccctcacccaaccccaccaccaaacccaactcgccatccgcaccaccggcacccacacccgccgcctcacccccaccaccctcacccccacacaccaaccacccacccccaccccccacggaaccaccctcatcaccggcggaaccggcgccctcgccacccacctcacccaccacctcaccacccaccaacccacccaacacctcctcctcaccagccgaaccggcccccacaccccccacgcacaacacctcaccacccaactccaacaaaaaggcatccacctcaccatcaccacctgcgacaccagcaacccagaccaactccaacaactcctcaacaccatccccccacaacaccccctcaccaccgtcatccacaccgcaggcatcctcgacgacgccaccctcaccaacctcacccccacccaactcaacaacgtcctccgcgccaaagcccacagcgcccacctcctccaccaactcacccaacacacccccctcaccgccttcgtcctctactcctccgccgccgccaccttcggcgcacccggccaagccaactacgccgcagccaacgcctacctcgacgccctcgcccaccaccgccacacccaccacctccccgccaccagcatcgcctggggcacctggcaaggaaacggactcgctgattcggacaaggcccgcgcatatctcgaccgccgcgggtttcgacccatgtcacccgagttggccacggcagcggtcacgcaggcgatcgcggacaccgaacggccgtatgtcgtcatcgccgacatcgactggagcaagatcgaacacacctctcagaccagcgacctggtgagcgcggcccgggaaagggagccagctgtccagcgccccactccaccggcggagttgcacaaaacgctggcccatcagacgtcggccgaccaacgggccgcattgctcgagctcgtacgagaccatgtggcggcagtgctccggcacgcggacccgaaagccatcgcgcccgaccagtcgttccgtgcactcggcttcgattcactcacggccgtcgagttccgaaacctgctgatcaaggcaacaggactccgccttcctgtctcgctggtcttcgaccacccgacccctgccaaactcgccgtacacctgcagaaccaactgcggggcacagcagcggagtcggctccttcagcggcagccgttaccgccgaggcttctgtcaccgagccgatcgccatcgttggcatggcctgtcgtttccccggcggagtgacctcggcggacgacttctgggatctgatctcctccgagcaggacgcgatcggcggattccccaccgaccgcggctgggacctggacacgctctacgaccccgaccccgaccaccccggcacctgctacacccgaaacggcggattcctctacgacgcaggccacttcgacgccgaattcttcggcatcagcccccgcgaagccctcgccatggacccccagcaacgactcctcctcgaaaccgcctgggaaaccatcgaacacgccggcatcaacccccacaccctccacggcacccccaccggagtcttcaccggcaccaacggacaggactacgcacttcgcgtgcacaacgcgggccagtcaaccgatggtttcgcactgaccggaaccgccggcagcgtcatctccggtcgtatctcgtacacgtttggttttgagggtcctgcggtgtcggtggacacggcttgttcctcgtcgttggtggctttgcatctggcctgtcaggcgttgcgtgcgggtgagtgctcgatggcgcttgccgggggtgtgacggtgatgtcgtctccgggtgccttcgtggagttttcgcggcagcggggtctggccgcggacgggcattgcaaggcgttctcggcggcggcggacgggaccggctggggtgagggtgtggggatgctgctggtggagcggctctccgacgcccatcgcaacggtcaccgtgtcctggccgtggtgcgtggcagtgcggtcaaccaggacggtgcgagcaacggtctgaccgcgcccaacgggccgtcccagcagcgtgtcatccgccaggccctcgccaacgccggcttgtcggccggtgatgtcgacgcggtggaggcccacggcaccggcaccactttgggcgacccgatcgaggcccaggccctcctcgcgacctacggacaggaccgtgccggcgaggggccgctgtggctgggctcggtcaagtccaatgtcggtcacacacaggctgccgcgggcgtcgccggggtgatcaagatggtgatggcgctgcggcatggtctgctgccgcggacgttgcatgtggatgagccgtcgccgcatgtggactggtccgcgggtgcggtgcagctgctgacggagacggtgccctggcccggcggggaggggcggctacggcgggcaggagtgtcatcattcggcgtcagcggcaccaacgcccacgtcatcctcgaagaagcacccgccgacgacgttccggggggaccacccgccggcgagggtgacgcgggcagcgacgatgaggctgctgccggcagtcctggggtgtggccgtggctggtgtcggccaagtcgcagccggccctgcgcgcccaggcccaggccctgcacgcccacctcaccgaccaccccggcctcgacctcgcggatgtcggatacaccctcgcccacgcccgcgccgtgttcgaccaccgcgccaccctcatcgccgcggaccgcgacacgttcctgcaagcactccaggcactcgccgcaggcgagccccaccccgccgtcatccacagcagcgccccgggcgggaccgggaccggggaggccgcaggaaagaccgcattcatctgctccggacagggcacccaacgccccggcatggcccacggcctctaccacacccaccccgtcttcgccgccgcactcaacgacatctgcacccacctcgacccccacctcgaccaccccctcctccccctcctcacccaaaacgacaacgacaacgaggacgcggccgcactgctccagcagacccgctacgcccagcccgccctcttcgccttccaggtcgccctccaccgcctcctcaccgacggctaccacatcaccccccactactacgccggacactccctcggcgaaatcaccgccgcccacctcgccggcatcctcaccctcaccgacgccaccaccctcatcacccaacgcgccaccctcatgcaaaccatgccccccggcaccatgaccaccctccacaccaccccccaccacatcacccaccacctcaccgcccacgaaaacgacctcgccatcgccgccatcaacacccccacctccctcgtcatcagcggcaccccccacaccgtccaacacatcaccaccctctgccaacaacaaggcatcaaaaccaaaaccctccccaccaaccacgccttccactccccccacaccaaccccatcctcaaccaactccaccagcacacccaaaccctcacctaccacccaccccacacccccctcatcaccgccaacaccccacccgaccaactcctcaccccccactactggacccaacaagcccgcaacaccgtcgactacgccaccaccacccaaaccctccaccaacacggcgtcaccacctacatcgaactcggacccgacaacaccctcaccaccctcacccaccacaacctccccaacccccccaccaccaccctcaccctcacccacccccaccaccacccccaaacccacctcctcaccaacctcgccaaaaccaccaccacctggcacccccaccactacacccaccacgacaaccaaccccacacccacacccacctcgacctccccacctaccccttccaacaccaccactactggctcgaaagcacacagcccggtgccggcaacgtgtcagcagccggactcgaccccaccgaacaccccctactcggcgccacattggaactggcgactgacggtggagcgcttcttgcagggcgcttgtctttgaggtcgcatccgtggctggctgaccatgccgtcggcggcacggtgctgctgtcgggcgccaccttcctcgaactcgcccttcatgcgggcacatacgtgggctgcgaccgagtggatgagctgacgctgcatgcgccgctggtggttcctgtggatgggggtgtgagtgtgcaggttggggttgcggctgcggatggggaggggcggcgtttggtgagtgtgtatgcgcggggtgggagtgcttgtggtgggggtggtgcgtcgggtggggtgtggacgtgtcatgcctcgggggtgctggttgaggctgctgctggtggtgtggtggtggatggtctggcgggggtgtggccgccgcggggtgcggtggcggtggatgtcgatggtgtccgtgaccgtttggctggggctggttgtgttttggggccggtgttttcggggctgcgtgcggtgtggcgtgatgggggggatttgctggctgaggtgtgtctgccggaggaggcgtggggtgatgcggctggttttgggctgcatccggcgttgctggatggtgtggtccagccgttgtcggtgttgcttccgggtgggacggggtttggggagggggcggggttcggggagggtgttcgggtgccggctgtgtggggtggtgtgtcgcttcaccgggcgggtgtgaccggtgtgcgggtgcgtgtgtcggctgtcgggcggggcggcgggcgtgaggcggtgtcggtcgtggtcggggatgaggcgggtgtgccggtggcgtcggtcgatcgtcttgagttgcggcctgtggatatgggtcagttgcgtgctgtctcggtttcggcggggcggcggggttcgctgtatgcggtgcagtgggctgaggtgggtcctgtgccggtgtgtgggcaggcgtgggcgtggcacgaggacgtgggtgagagcggtggtgggcctgtgccgggggtggtggtgttgcggtgcccggatgccggtgccggtggcggtggcggtggcggtggtggcggtggtgtgggtgaggttgttggtggggtgttgggtgtggtgcaggggtggctggggctggagcggtttgcgggttcgcggctggtggtggtgacccggggtgcggtggtggccggcccggaggacggcccggtggatgtggtgggtgcgtcggtgtgggggctggtgcgttcggcgcaggctgagcatccggaccggtttgtcctcctcgacctcgacaccgacaccggcaccgacctcgacaccggtgctggtgctggttggggcgtggatggtgggcgtgtggcggcggtggtggcgtgtggtgagccgcagttggcggtgcgtggggagcggttgctggccgcacgcctgaaacgacttgagtcatccggtgatgttccagcccagcggtccggtgacacacgagcccggcggtccgacgtgcctgcccagcgctccggtggcgtgcctgctcggcggtcggttgatgtatcgggtcgggaggtgttgccgtggttgtcgggtgggtcggtgttggtgacgggtgggacgggtgtgctgggtgcggcggtggcgcggcatctggctggtgtgtgtggggtgcgggatctgctgttggtgagccggcgtggtccggatgctccgggtgcggagggtctgcgggcggagctggccgcgttgggggcggaggtgcggattgttgcgtgtgatgtgggggagcggcgggaggtggtccggctgctggagggtgttcctgccgggtgtccgctgacgggtgtcgtgcatgcggctggtgtgctggacgatgcgacgatcgcctctctcacgcccgagcggctgggcacggtgttcgcggccaaggtggatgccgctcttttgctggatgagctgacgcggggtatggagctgtcggcgttcgtgctgttctcctcggccgcggggatcctggggtcggccgggcagggcaactacgccgcggccaatgccgctctggacgcgctggcgtaccggcggcgggcggcgggtctgccgggggtgtcgctggcgtgggggctgtgggaagaggccagcgggatgaccgggcacctggccggcaccgaccaccggcgcatcatccgttccggtctgcatcccatgtcgaccccggacgcactggccctcttcgatgcggccctggctctggaccggccggtcctgctgcccgccgacctgcgtcccgccccgcccctgccgcccctgctgcaggacctcctgcccgccacccgccgccgcaccacccgcaccaccactaccggtggtgcggacaacggcgcccagctgcacgcccggctggccggccagacacacgaacaacagcacaccaccctcctcgccctggtccgctcccacatcgccaccgtcctgggccacaccacccccgacaccatcccccccgaccgcgcgttccgcgacctcggcttcgactccctcaccgccgtcgaactacgcaaccggctctcccgcaccaccggactccgcctccccaccaccctcgccttcgaccaccccaaccccaccaccctcacccaccacctccacacacaactccagccacaaccggacaacgctgtcgcccccgtgttggcggagctcgacaaactcgaatccgccctctccgccctcgacaaaaccgacagcgccagcgaaagagtcaccctgcggctgaagtcactcatgttgaggtggaacgcaccccagcatccgacagccgaaagcgctgatgacgacgagaagttcacatcggcaacagaggctgagattttcaaattcattgacaacgacctcggcctgtcc

SEQ ID NO: 927 - DNA, 18717 bp, Streptomyces avermitilis
  CDS (1)..(18717)
atgcaattggcgaatgaagcgaagctcctggaatacctcaagcgcgtcactgcggacctggaccgcactcgccgtcgcctgtacgaggtggtcgagcgtgagcaggagccgatcgcgattgtggggatggcgtgtcgttacccaggcggggcgacgtcacccacgcgactgtggcatctcgtcaagtcccagacggacgctatcggggagttcccgaccgaccgtggatggaacctggagcagctctacgacccggaccccgaccgctcaggaaccagttacacgcgcagcggagggtttctctatgacgcgggcgacttcgacgccgcgttcttcgagttgtcaccgcgtgaggcgctggcaatggacccgcagcagcgcctgctgctcgaaaccacttgggaaacgttcgaacagggcggaatcgacccgaggtccatgcgcggaagccggaccggggttttcgtggggatcaatccggaggactacaccaccggatacacacatcagccctcaaacgcagtcgagggctacctgctcactggcagcgcggcaagcattgcgtcaggccgtatctcctacaacttcgggctcgaaggccctgcgatcactatcgacaccgcgtgttcctcctcgctcgtcgccctgcatctggcctgccaagcgctccggtccggtgaatgcaccatggcgctcgcaggcggcgcctccgtcatggccactcccttcgtcttcaccgagttctctcgccagcggggcctggccgcagacggccggtgcaaggcgttttcggcggcggcggacgggaccggctggtccgagggtgtggggatgctgctggtggagcggctctccgacgcccgccgcaacggtcaccgtgtcctggccgtcgtccgcggcagcgccgtcaaccaggacggcgcaagcaacggcctgaccgcacccaacggtcgttcacaagtcaaggtcatccgccaggctttggccaacgcacacctctcccctgccgatgtcgatgcggtggaggcccacggcacggggaccaccctgggcgacccgatcgaggctcaagccctcgtcgaagcctacggtcaggaccgccccaacggccgccccctctggctcggaaccctcaagtccaacatcgggcactccatggccgctgcgggtgtgggcggggtcatcaagatggtgatggcgctgcggaatggtctgctgccgcggacgttgcatgtggatgagccgtcgccgcatgtggactggtccgcgggtgcggtgcagctgctgacggagacggtgccctggcccggcggggaggggcggctacggcgggcaggagtgtcatcattcggcgtcagcggcaccaacgcccacgtcatcctcgaggaagcacccgcccacaacatcccgtcagacacacccgccgacgacgtcccgggagaatcagccgccgacgaggatgccggtagtggcgatgaggctgctgccggcagtccaggggtgtggccgtggctggtgtcggccaagtcgcagccggccctgcgcgcccaggcccaggccctgcacgcccacctcaccgaccaccccggcctcgacctcgccgacgtcgggtacaccctcgcccacgcccgcgccgtgttcgaccaccgcgccaccctcatcgccgccgaccgcgacaccttcctgcaagcactccaggcactcgccgcaggcgaaccccaccccgccgtcatccacagcagcgccccaggcgggaccgggaccggggaggccgcaggaaagaccgcattcatctgctccggacagggcacccaacgccccggcatggcccacggcctctaccacacccaccccgtcttcgccgccgcactcaacgacatctgcacccacctcgacccccacctcgaccaccccctcctccccctcctcacccaggaccccaacacccaggacaccaccaccctcgaagaagcggccgcactgctccagcagacccgctacgcccagcccgccctcttcgccttccaggtcgccctccaccgcctcctcaccgacggctaccacatcaccccccactactacgccggacactccctcggcgaaatcaccgccgcccacctcgccggcatcctcaccctcaccgacgccaccaccctcatcacccaacgcgccaccctcatgcaaaccatgccccccggcaccatgaccaccctccacaccaccccccaccacatcacccaccacctcaccgcccacgaaaacgacctcgccatcgccgccatcaacacccccacctccctcgtcatcagcggcaccccccacaccgtccaacacatcaccaccctctgccaacaacaaggcatcaaaaccaaaaccctccccaccaaccacgccttccactccccccacaccaaccccatcctcaaccaactccaccagcacacccaaaccctcacctaccacccaccccacacccccctcatcaccgccaacaccccacccgaccaactcctcaccccccactactggacccaacaagcccgcaacaccgtcgactacgccaccaccacccaaaccctccaccaacacggcgtcaccacctacatcgaactcggacccgacaacaccctcaccaccctcacccacgacaacctccccaacacccccaccaccaccctcaccctcacccacccccaccaccacccccaaacccacctcctcaccaacctcgccaaaaccaccaccacctggcacccccaccactacacccaccaccacaaccaaccccacacccacacccacctcgacctccccacctaccccttccaacaccaccactactggctccaaccacccggcaagccgagcgacccgtcaccgagcgaaggccgtgagcaagccacgaccccatcaaccccgctgcgtgatgtcctcgtgggcaagtctccgcaggagcgagacgaagagctgttgcgcctggtgcgcacccatgcggccgctgtgctgggccatgccactcccgaagtgatcgttccgaacaaggccttcaaagagctgggttttgattctctcgccgcaattcagcttcgtaatcgactgcttgctgacgttgacctgccgcttccggccacgctgatcttcgattaccccactccgatggcgctttgccagttcctccgggcggcgatcgtcggagcggacacaggcacgaccactcgtctgccgctaactgcggtccccgccgacgagccgatcgccatcgtcggcatggcctgtcggtaccccggtgatgtacggacggtcgatgatctctggcaggtggtcagtggtggccatgacgcgatcggcggattcccgacgaaccgtgggtgggacctcgacacgctgtacaacccggacccggaccaccacggaaccagctacacccggagcggcggattcctttacgacgcaggcaatttcgatcccgacttcttcggtatcagtccgcgtgaggcactggcgatggacccgcagcagcggctgctgctggaaacagcgtgggagagcatcgaacacgcctgcatcaaccccgacagcctccgtggcacaccaaccggcgtcttcgccgggctgacctaccacgactacgccgcgcgctttcccacagctccggcagggttcgaggggtatctcgggcacggaagcgcaggcagtatcgcctcgggtcgtgtcgcctacgctctcggcctggaaggtccggccctcacagtcgacactgcctgctcttcgtccctggtcgctctgcacctggcctgtcaggcgctgcggtccggcgagtgttccatggccctcgcgggtggcgtcacggtgatgtcaaccccggccgggttcgtggagttttcgcggcagcggggcctggccgtggacgggcggtgcaaggcgttctcggcagcggctgacggcaccggctggggtgagggtgtcggaatgctgctggtggagcggctgtcggacgcgcggcggctcggtcaccgaatcctcgcggtggtgcgtggcagtgcggtcaatcaggacggtgcgagcaacgggctgacggcgcccaacgggccgtcccaggagcgtgtcatccgcctggccctggccaacgcggacctgacccccgccgacgtcgatgcggtggaggcccacggcaccggcaccactttgggcgacccgatcgaggcccaggccctcctcgccacctacggacaggaccgccccggcaacgaaccgctgtggctgggctcgatgaagtcgaacatcggccacgcgcaggctgccgcaggtgtgggcggggtcatcaagatggtgatggcgctgcggaatggtctgctgccgcggacgttgcatgtggatgagccgtcgccgcatgtggactggtccgcgggggcggtgcagctgctgacggagacggtgccctggcccggcggggaggggcggctgcggcgggcaggagtgtcatcgttcggcgtcagcggcaccaacgcccacgtcatcctcgaagaagcacccgcccacaacatcccgtcagacacacccgccgacgacgccccgggagaagcagccgccgacgatgttccgggggaagcggccggcgacgacgccggtaccggcggggaagcgactggtcctgctgccggcagtccaggggtgtggccgtggctggtgtcggccaagtcgcagccggccctgcgcgcccaggcccaggccctgcacgcccacctcaccgaccaccccggcctcgacctcgccgacgtcgggtacaccctcgcccacgcccgcgccgtgttcgaccaccgcgccaccctcatcgccgccgaccgcgacaccttcctgcaagcactccaggcactcgccgcaggcgaaccccaccccgccgtcatccacagcagcgccccaggcgggaccgggaccggggaggccgcaggaaagaccgcattcatctgctccggacagggcacccaacgccccggcatggcccacggcctctaccacacccaccccgtcttcgccgccgcactcaacgacatctgcacccacctcgacccccacctcgaccaccccctcctccccctcctcacccaggaccccaacacccaggacaccaccaccctcgaagaagcggccgcactgctccagcagaccccgtacgcccagcccgccctcttcgccttccaggtcgccctccaccgcctcctcaccgacggctaccacatcaccccccactactacgccggacactccctcggcgaaatcaccgccgcccacctcgccggcatcctcaccctcaccgacgccaccaccctcatcacccaacgcgccaccctcatgcaaaccatgccccccggcaccatgaccaccctccacaccaccccccaccacatcacccaccacctcaccgcccacgaaaacgacctcgccatcgccgccatcaacacccccacctccctcgtcatcagcggcaccccccacaccgtccaacacatcaccaccctctgccaacaacaaggcatcaaaaccaaaaccctccccaccaaaaacgccttccactccccccacaccaaccccatcctcaaccaactccaccagcacacccaaaccctcacctaccacccaccccacacccccctcatcaccgccaacaccccacccgaccaactcctcaccccccactactggacccaacaagcccgcaacaccgtcgactacgccaccaccacccaaaccctccaccaacacggcgtcaccacctacatcgaactcggacccgacaacaccctcaccaccctcacccaccacaacctccccaacacccccaccaccaccctcaccctcacccacccccaccaccacccccaaacccacctcctcaccaacctcgccaaaaccaccaccacctggcacccccaccactacacccaccaccacaaccaaccccacacccacacccacctcgacctccccacctaccccttccaacaccagcactactggctcgaaagcacacagccgggtgccggatccggttcgggttccggttccgggcgggcagggactgcgggcgggacggcagaggtggagtcgcggttctgggacgcggtggcccgccaggacctggaaacggtcgcgaccacgctcgccgtgcccccctccgccggcctggacacggtggtgcccgcactctccgcctggcaccgccaccaacacgaccaagcccgcatcaacacctggacctaccaggaaacctggaaacccctcaccctccccaccacccaccaaccccaccaaacctggctcatcgccatccccgaaacccagacccaccacccccacatcaccaacatcctcaccaacctccaccaccacggcatcacccccatccccctcaccctcaaccacacccacaccaacccccaacacctccaccacacccgacaacaagcccaaaaccacaccaccggacccatcaccggcctgctctccctcctcgccctcgacgaaacaccccacccccaccacccccacacacccaccggcaccctcctcaacctcaccctcacccaaacccacacccaaacccacccaccaacccccctctggtacgccaccaccaacgccaccaccacccaccccaacgaccccctcacacaccccacccaagcccaaacctggggactcgcccgcaccaccctcctcgaacaccccacccacaccgccggaatcatcgacctccccaccacccccaccccccacaccctccaccacctcacccaaaccctcacccaaccccaccaccaaacccaactcgccatccgcaccaccggcacccacacccgccgcctcacccccaccaccctcacccccacacaccaaccacccacccccaccccccacggaaccaccctcatcaccggcggaaccggcgccctcgccacccacctcacccaccacctcaccacccaccaacccacccaacacctcctcctcaccagccgaaccggcccccacaccccccacgcacaacacctcaccacccaactccaacaaaaaggcatccacctcaccatcaccacctgcgacaccagcaacccagaccaactccaacaactcctcaacaccatccccccacaacaccccctcaccaccgtcatccacaccgcaggcatcctcgacgacgccaccctcaccaacctcacccccacccaactcaacaacgtcctccgcgccaaagcccacagcgcccacctcctccaccaactcacccaacacacccccctcaacgccttcgtcctctactcctccgccgccgccaccttcggcgcacccggccaagccaactacgccgcagccaacgcctacctcgacgccctcgcccaccaccgccacacccaccacctccccgccaccagcatcgcctggggcacctggcaaggaaacggactggcgactggtcaagtcagcgaacatctccgccgccgcgggatgttcgccatgccgcccgagttggcggtcacagctgttgacggcgcgatcgcgagcgggcgcccgagtctcctcgtcgccgatatcgactggaagaaattgggaccggttctctccagcaagtcgtcggtcttgctcgaggaccttccccaggcacagggaactgaggaggcgcgcagtaccgttgagcagacggagagcacaaacctccggcaactcctcatgggtcggtcacgttccgagcaggaagaagagctgctcagcctcgtccgcatccactccgcggcagtgctcgggcgcgacgactccgaggccatcccgcccggtcggctgttcagggatctagggttcgactcgcttgcggcggtggagcttcgcaaccacctcgcagcacagacggagctggctctgccgacgactctcgtcttcgattaccccagccccaccaagctcgcccaatttctgctctccgagatcgcggagttccagcccgacaactcaactccgcttccgcgaccccgggcagagctcgatgagccgatcgccatcgttggcatggcctgtcgcttccccggcggagtgacctcggcggacgacttctgggatctgatctcctccgagcaggacgcgatcggcggattccccaccgaccgcggctgggacctggacacgctctacgaccccgaccccgaccaccccggcacctgctacacccgaaacggcggattcctctacgacgcaggccacttcgacgccgaattcttcggcatcagcccccgcgaagccctcgccatggacccccagcaacgactcctcctcgaaaccgcctgggaaaccatcgaacacgccggcatcaacccccacaccctccacggcacccccaccggagtcttcaccggcaccaacggacaggaccacgcggcacacatccgtcaggccccgagcggtaccgagggattcgtcctgaccggggcagccaccagcatcgcctccggccgaatctcctacatcctcgggttggaagggcctgcggtcaccctcgacacagcgtgttcctcctcgctcgtcgccctgcacctcgcctgccagtccctcaggtccggtgaatgcaccatggccttggccggcggggccacggtcatgaccaccccgatcaccttcaccgaattcgcccgccaacgcggactcgcccccgacgggcgttgcaaggcgttctcggcggcggctgacggtaccggctggggtgagggtgtggggatgctgctggtggagcggctctccgacgcccgccgcaacggtcaccgtgtcctggccgtggtgcgtggcagtgcggtcaaccaggacggtgcgagcaacggtctgaccgcgcccaacgggccctcccagcagcgcgtcatccgccaggccctcgccaacgcggacctgacccccgccgacgtcgatgcggtggaggcccacggcaccggcaccactttgggcgacccgatcgaggcccaggccatcctcgcgacctacggacaggaccgtcccggcaacgggccgttgtggctgggctccgtcaagtccaacgtcggacacacacaggccgcggcgggcgtggccggagtgatcaagatggtgatggccctccgccaccggacactcccaccgactctccacgcggatgagccgtcgccgcatgtggactggtccgcgggtgcggtgcagctgctgacggagacggtgccctggcccggcggggaggggcggccgcggcgggcaggagtgtcatcattcggcgtcagcggcaccaacgcccacgtcatcctcgaagaagcacccgccgacgacgttccggggggaccacccgccgacgaggatgccggtagtggcgaggaggctgctgccggcagtcctggggtgtggccgtggctggtgtcggccaagtcgcagccggccctgcgcgcccaggcccaggccctgcacgcccacctcaccgaccaccccggcctcgacctcgccgacgtcggatacaccctcgcccacgcccgcgccgtgttcgaccaccgcgccaccctcatcgccgccgaccgcgacaccttcctgcaagcactccaggcactcgccgcaggcgaaccccaccccgccgtcatccacagcagcgccccaggcgggaccgggaccggggaggccgcaggaaagaccgcattcatctgctccggacagggcacccaacgccccggcatggcccacggcctctaccacacccaccccgtcttcgccgccgcactcaacgacatctgcacccacctcgacccccacctcgaccaccccctcctccccctcctcacccaaaacgacaacgacaacgacaacgaggacgcggccgcactgctccagcagaccccgtacgcccagcccgccctcttcgccttccaggtcgccctccaccgcctcctcaccgacggctaccacatcaccccccactactacgccggacactccctcggcgaaatcaccgccgcccacctcgccggcatcctcaccctcaccgacgccaccaccctcatcacccaacgcgccaccctcatgcaaaccatgccccccggcaccatgaccaccctccacaccaccccacaccacatcacccaccacctcaccgcccacgaaaacgacctcgccatcgccgccatcaacacccccacctccctcgtcatcagcggcaccccccacaccgtccaacacatcaccaccctctgccaacaacaaggcatcaaaaccaaaaccctccccaccaaccacgccttccactccccccacaccaaccccatcctcaaccaactccaccagcacacccaaaccctcacctaccacccaccccacacccccctcatcaccgccaacaccccacccgaccaactcctcaccccccactactggacccaacaagcccgcaacaccgtcgactacgccaccaccacccaaaccctccaccaacacggcgtcaccacctacatcgaactcggacccgacaacaccctcaccaccctcacccaccacaacctccccaacacccccaccaccaccctcaccctcacccacccccaccaccacccccaaacccacctcctcaccaacctcgccaaaaccaccaccacctggcacccccaccactacacccaccaccacaaccaaccccacacccacacccacctcgacctccccacctaccccttccaacaccaccactactggctcgaactacccagcgcccaaaccagccccggtcaaaggcgttctcgccgctcggctccagacaccgccgagtcggagttctgggacgcggtgaacgaggaagacctccagagcctcgccgaaaccctcgacatcgacgcctctgctctggacacggtggtgcccgcactctccgcctggcaccgccaccaacacgaccaagcccgcatcaacacctggacctaccaggaaacctggaaacccctcaccctccccaccacccaccaaccccaccaaacctggctcatcgccatccccgaaacccagacccaccacccccacatcaccaacatcctcaccaacctccaccaccacggcatcacccccatccccctcactgtcaaccacacccacaccaacccccaacacctccaccacaccctccaccacacccgacaacaagcccaaaaccacaccaccggacccatcaccggcctgctctccctcctcgccctcgacgaaacaccccacccccaccacccccacacacccaccggcaccctcctcaacctcaccctcccccaaacccacacccaaacccacccaccaacccccctctggtacgccaccaccaacgccaccaccacccaccccaacgaccccctcacacaccccacccaagcccaaacctggggactcgcccgcaccaccctcctcgaacaccccacccacaccgccggaatcatcgacctccccaccacccccaccccccacaccctccaccacctcacccaaaccctcacccaaccccaccaccaaacccaactcgccatccgcaccaccggcacccacacccgccgcctcacccccaccaccctcacccccacacaccaaccacccacccccaccccccacggaaccaccctcatcaccggcggaaccggcgccctcgccacccacctcacccaccacctcaccacccaccaacccacccaacacctcctcctcaccagccgaaccggcccccacaccccccacgcacaacacctcaccacccaactccaacaaaaaggcatccacctcaccatcaccacctgcgacaccagcaacccagaccaactccaacaactcctcaacaccatccccccacaacaccccctcaccaccgtcatccacaccgcaggcgtcaatctcttcgcccccgtgtcggaaaccgatgccgaatccttctcttccgttacggcagcgaaggcaacgggcgcggcgattctgcatgagttgctgctggaccatgaaacgcttgaacacttcattctcttctcgtcgggcgccggcgcttggggcagcgggaatcagtgcgcatactcggcggccaacgcatacctggacgcgctcgcgacgcatcgtcagacacatggacttcccggggcatcgatcgcctggggcccctgggccggaaagggcatgtcggccggtgatgcggctcatggttacctggaaaagcgcggcattctgccgatggagccacgcatggcgctcgcggcattccatcgtgcgcgggcgcagcggccgaattccaacctgatcatcgcggacatcgactgggagcgcttcgtccccgccttcaccgctcgacgccacagcccgctcatcgaggacattccggaggttcggcaagcggctcaggagctggaagcagctgcgtcgacggcaaagacgaccacagctcagccgattgcgacgtctctccgtgagcgattggcccgactgacgtcctcaaagcagaaccaggtgctgctcggcctgattcggacaggcatctgcaccgttctcggccttcgtaatccggaaggcatcgaggaccaacgagccttccgcgacctcggcttcgactcgctgacgtcggctcagttcagcaaggaactcgccaaggaaaccggactgccactccccccgtccctggtcttcgactatcccaccccgcaggaatgtgctgcccatctgcgcacacaactcgtcgacctagacgacgaagaggacgcggcactgtcgaatgctctcccgcaagtggcccatcggcgtaccgtcgaggacgaaccgatcgccatcatcggtatggcatgtcgcttccccggcggcgtacgttctgccgacgacctgtgggaattgctcgcttcgggtaaggacgctatcggcgtcttcccgaccgaccgcggctgggacctggacacgctctacgaccccgaccccgaccaccccggcacctgctacacccgaaacggcggattcctctacggcgcaggccacttcgacgccgaattcttcggcatcagcccccgcgaagccctcgccatggacccccagcaacgactcctcctcgaaaccgcctgggaaaccatcgaacacgccggcatcaacccccacaccctccacggcacccccaccggagtcttcgccggaatcaacgctcaagaccacgccgcgcatatccgccaaagccgtgatgtggagaccatcgagggctacgccctgaccggcagttcgggaagtgtggcgtccggccgggtggcctacacgctcgggctcgaaggccccgcggtgtcggtggatacggcgtgttcgtcgtcgttggtggcgttgcattgggcggcgcaggcgttgcgtgcgggtgagtgttcgatggcgcttgccgggggtgtgacggtgatgtcgtctccgggtacgtttgtggagttctcacgtcagcggggtctggccgcggacgggcggtgcaaggcctattcggcggctgctgacggtaccggctgggccgagggtgtggggatgctgctggtggagcggctctccgacgcccgtcgcaacggtcaccgtgtcctggccgtggtgcgtggcagtgcggtcaaccaggacggtgcgagcaacggtctgaccgcgcccaacgggccctcccagcagcgtgtcatccgtcaggccctggccaatgcgggactgaccccggccgatgtcgacgcagtggagggccacggcaccgggaccactctgggggacccgatcgaggcccaggcactcctggccgcctacggacaacaccgcccccaccaccgccccttgtggctgggatccctcaaatccaacatcgggcacgcacaggccgccgcgggcgtgggcggagtcatcaagatggtgatggccctgcgcaacgggctgctgccacagaccctccacgtggacgagcccaccccccaggtcgactggtccacaggcgcagtacaactcctgacacaaccggtgccctggcccgccgacccggccggccggccacgccacgccggcgtgtcatcattcggcgtcagcggcaccaacgcccacatcatcctcgaagaagcacccactccccaggacagcgataccgacgacgaaccgcctgccaacgcaccagccctgccccatcccctccctcttcccgtgccggtgtcggcgaggtctgaggccgggttgcgggcgcaggcacaggcgttgcgccagtacgtggcagcccgcccggacatgtcacctgccgacattggtgcgggtctggcccgcggccgggccgtactggaacaccgcgccgtcatcctggccgcggaccgcgaggaactggcgcaggcactgacagccctggcagccggcgaaccccacccccacatcaccacaggccacacccggggcggtgaccgcggcggcgtcgtcttcgtcttccccggacagggcggccagtgggccgggatgggcctgaccctgctcacctcctcacccgtgttcgccgaacacatcgacgcatgcgagaaagccctcaccccctgggtgccctggtccctgaccgacatcctgcaccgcgaccccgacgaccccgcatggcaacaagccgacgtggtccagcccgtgctcttcagcatcatggtctccctcgccgccctgtggcgctcctacggcatcgaacccgacgcggtcctcggccactcccagggagaaatcgccgccgcccacatctgcggcgcactcagcctgaaagacgccgccaaaaccgttgcactgcgcagccgcgcactggccgccgtacgaggccggggcgccatggcctcactgcccctgcccgcccaggacgtgcagcagctcatttccgaacggtgggaagggcagttgtgggtggcagccctcaacggcccccactccaccaccgtctccggcgacaccaaggcggtggatgaggtgctggcgcactgcaccgacaccggcctacgggccaaacgcatccccgtcgactacgcctcccactgcccccacgtccaacccctccacgacgaactcctgcacctgctgggagacatcaccccccagccgtccaccgtgccgttcttctccaccgtggaaggcacctggctggacaccacaaccctggacgccgcctactggtaccgcaacctccaccagcccgtccgcttcagccacgccatccagaccctgaccgacgacggacaccgcgccttcatcgaaatcagcccccaccccaccctcgtccccgccatcgaagacaccaccgaaaacaccaccgaaaacatcaccgcgaccggcagcctccgccgcggcgacaacgacacccaccgcttcctcaccgccctcgcccacacccacaccaccggcatcggcacacccaccacctggcaccaccactacacccaaacccacccccaccccaacccccacacccacctcgacctgcccacctaccccttccaacaccagcactactggctccaaccacccaccacaacaaccgacctcaccaccaccggcctcacccccacccaccaccccctcctcaccgccacactcaccctcgccgacaacaacacacaactactcaccggccgcctctccctacgcacccacccctggctcaccgaccacaccgtcgccggcatggtcctcctgccgggcaccgcgctcctcgaactcgccctccaagccggcgaacgggtggactgccctcgggtggaggaactgaccctgcacgcaccgttggtgatcccgcacaccgaggacgtgacgttgcaggtcaccgttcgggcagccgatgagagtggccatcgcgccctcgcgatccactcgtactccggcaccgcgtcgtcggcggaccgggagtggacccgtcacgccacgggcctcctcacacaccacgccgacaccgatcaccgtgccgacacgcacacggacgcgtgccttggcgggagctggcccccgcccggcgcgcagcccatcgaactgggcgacgtctacggtcgtatggcggcggactcggacatcgcctacgggccggtcttccaggggctgcacgccgcctggaggttcggcgacgatgtcctggccgaggtgcgtctgccggaagaggctctgcgcgatgctccggcggcggccttcggtgttcacccggccttgctcgacgcggccctgcacgccacggcgctcaccccccagaacggggacggctcgacggagaacgtcgcccaggagagcatgcctgaccgcgcagcccaccaggcgcgactgccgttcagctggagcggcgtgtccctgcacacggcgggcagttccgtgttgcgcgtacggctgtcgcgcagtccgcagcacggtaatgccgtggccctcaccgcggccgacgaggacggtcggccggtggtgacgatcgagtcgctcgcgctgcggccggtgtccaccgaggagctgcgcgcggccgcggatcgtacgcccgagcacgagtcgctcttccgactggactgggtttccgtaccagtgcccgccaacgccccttcgcccaccgcggaccggccctgggcggtcatcggcgcgggccttccccacctgcccggcctgacggagcacgagcacgtgaccgcgtatgacgagccggcggacctgcttctggctctggaccgcggtgctccgccgcccggtgtgctggtcgtaggtggtgtcgcccacaccgaagcccgggagtattccgccgaagcccccggggagcgcgggaccgaggcctgcgaggcccggccggacgtcgtgcacgtgggcgtcgtgcacacggctgccgtgcacgcggctgccgcgcagatgttggccaggctccaggcctggctgggcgacgagcgcctcgcagacagccggctgctcgtcctgacgtgcggcgcggtcgcccgcgcctccggcgacgatgcgacggacctgcccggggccgccgtgtgggggctggtgcgttcggcgcagtccgagcacccggaccgcatcacgctgctggacttcgagcggggcacagaggcggagcccggtcagctggcgacggcgctgaactgcggggagcggcagcttgccgtccgccccggagggctgttcacgccacggctggtgcgcgcgccacgtgtcgccgacgccgtacccgccgtacccgccgtggccgtaccgtcagcgggtcacgcagccgtaccggcagcgggtcccttccttccgggcggaacggtgctgatcaccggcggaaccggtgtcctgggccggctcgtggcccggcatctggtggaggcgcacggcgtacggcatctgttgctggcgggtcggcgcggaccggacgccgagggtgcgccggagttgcgggcggagctcggtgggctcggcgcgacggtggaggtcgtcgcctgcgacgcggcggaccggcagcagctggccgacctgctgacacggatccccgacgatcggccgctgaccggtgtcgtgcacagtgcgggcatcctggacgacggcgtgatcacgtcgctgtcgccggagcggctcggggccgtcctccgggccaaggcggacgctgcgctgcttctcgacgagctgacgcgcggggcagagctgtcggctttcgtcatgttctcctccgcgtcggcggtggtcggctcgcccgggcagggcaactacgccgccgccaacgccgtcctcgacttccttgctcatcgccgccgcgccgaggggctgcccgccgtctctctcgcctggggcctgtgggaagagggcacagggatgacgggccacctcgacgtcgacgaccatgcgcggatcagccgcgcgggaatgcggccgctgccgactgccgaggctctggcgctgttcgacgcggccttggccgacggcgagccgttcctgatgccggctcggctcgacctcacggccgtacggtctggtgccgcgtccgcaccggtgccgccgctgctgcaaggtctgcttcagctgcctcggtcccgctcggccgccgcggcccccggccatggggccccggcggcggacgaggcggcggcctggcgtgagcgtctggcccggcagagtgccggtgagcgcaggcaggcgctgctgcgcctggtgcggtcgcatgtcgcggcggtgctcggccatagcggtgccgacggaatcgacgcatcgcgggcgttccgcgagctggggttcgactcgctcacggcggtcgagctgcgcaaccgtctcacggccgcgacgggcctgcggctgcgggccacgctggccttcgatttcccgaccccggcagcgctggccgagcacttgggcgagcgtctgcttcccgaccaggaggccacgggcgagcaagccggcgatcagctctccggcggcagcgaggaggacgtacgcagcctcctgacgtccattccgatcggcaggctgcgggacgcggggctcctcgggcccctgctcacgctcgcggacacgggccgcggcgcctcgggcgccgccgcaggtccggaggacgcgccgccctccggccaggacacaccggctcccgtctcgatcgacgagatggacatcgacgacctgatggatctggcgcacgggcatggcaccgcacccgcccgtgagcccgccgacgcagaggactcgtcgtcatcacgaaaccggacacaccacacacacgaaggtgagacagcg

SEQ ID NO: 928 - DNA, 1041 bp, Streptomyces avermitilis
  CDS (1)..(1041)
gtgaacccatccgagccgctcggcctgcccaacgaacgtgtagtagacacccgaccgtccgatgccacgctctcacccgaggccggcctgaacaggtcaggagcgctgccccgtgaactgctgtcgttgccggtggtggtgtgggccggggtcggcctgctgtttctggccctgcaggcgtacgtgttcagccgctgggcggccgacggtggctaccggctgatcgagacggcgggccagggtcagggcggcagcaaggatacggggactaccgatgtggtctatcccgtgatttccgtcgtctgcatcaccgccgcggcggcgtggctcttccggaggtgccgtgtcgaacgacggctgctgttcgacgcccttctcttcctcgggctgctgttcgcgagctggcagagcccgctcatgaactggttccattccgttctcgtctccaacgcgagtgtgtggggcgcggtgggttcctggggtccgtatgtgcccggctggcagggggcgggcccgggtgcggaggcggaaatgccgctggcgtcggcctccgtctgcatgtcggctctgatcgtcaccgtgctgtgcagcaaggcactggggtggatcaaggcccgccggccggcatggcggacctggcggctggtcctggccgtgttcttcatcggcatcgtgctcggtctgtccgagccgctgccgtccgcctccgggatcagcgtatgggccagagcgctgcccgaggtgaccttgtggagtggcgagtggtaccagttccccgtgtatcaggcggtcggttccggcctggtctgctgcatgctgggctcgctgcgcttcttccgcgacgaacgcgatgagtcgtgggtggaacggggagcctggcggttgccgcaacgggcagcgaactgggcgcgtttcctcgccgtggtcggtggggtgaatgccgtgatgttcctctacacctgtttccatatcctcctgtccctcgtcggtggacagccgcccgaccaactgccggactccttccaagcgccggccgcttac

SEQ ID NO: 929 - DNA, 1368 bp, Streptomyces avermitilis
  CDS (1)..(1368)
gtgatgtcccagtcgacgagcagcattcccgaggcgcccggcgcctggccggtcgtcggccatgtgccgccgttgatgcggcagcccctggagttccttcgctccgcagcagatcacggagacctgctcaagctccgcctcgggccgaaaaccgcctacctcgccacgcacccggacctggtgcggaccatgctggtctcctccggatcgggcgatttcacccggagcaagggcgcacagggcgcgagccgcttcatcggccccatcctcgtagccgtatcgggggagacgcaccggcgacagcggaggcggatgcagccagggttccaccgccagcgcctcgagagctatgtcgccaccatggcggccgccgcgcaggagaccgctgattcctggagcgctgggcaggtggtggacgttgagcaggccgcctgcgacctgtcgcttgccatgatcacgaagacgctgttcttctccgacctgggcgcgaaggccgaggcggcgctgcggaaaaccggacacgacattctgaaggtggcccggctgagtgctctcgcccccaccctttacgaggttcttcccaccgcgggcaagcggtccgtgggccgtacgagcgcaacgatccgggaggcgatcacggcgtatcgcgccgatggccgcgaccacggtgacctgctctcgacgatgctgcgcgcgacggacgccgaaggtgcctccatgacggaccaggaggtccatgacgaggtcatgggaatcgcggtggccgggatcggcggcccagctgccattacggcgtggattttccacgagctcggacagaacgccgagatcgagagtcggctgcacgcagagctcgacacggtcctgggcgggcggttgcccacgcacgaggacctcccgcggctgccgtacacacagaacctcgtgaaagaggcactgcgcaaataccccggctgggtggggtcccgccggacggtgcggcccgtacgactcggcggtcacgacctgcccgccgatgtggaggtcatgtacagcgcgtacgccatccagcgcgacccacgttggtaccccgaacccgaacgtctcgaccccggccgctgggaaaccaagggatcgagccgcggagttcccaagggggcgtgggtgcccttcgcgctcggcacctacaaatgcatcggcgacaacttcgcccttctcgagacggccgttacggtcgcggtcgtcgcctcccactggcgactacacgcccttccgggcgacgaggtccggcccaagacgaaggccactcacgtcttccccaaccgactccgcatgatcgctgaaccgaggagtgtggtgcgtctggaggagcccgccgccatgggagcg

SEQ ID NO: 930 - DNA, 16596 bp, Streptomyces avermitilis
  CDS (1)..(16596)
atggacacgtccagcgaaaagctcgtcgacgcgcttagggcgtctctgaaggcgaaccagaccctgcgggcacgtaatgagcaactggcagccgccatggaggcgtccagcgagccgattgcgattgtggggatggcgtgtcgttttccgggtggggtgtgttcgccggaggagttgtgggagctggttgcgtcgggtggggatgcgattggtgaatttccggccggtcgggggtgggatctggaggggttgtttgattcggaccctgaccggtcggggacgtcgtacgcgcggtatggcgggtttttgtatgaggcgggggagttcgatgcggacttcttcgggatcagtccgcgtgaggcgttggcgatggatccgcagcagcggttgttgctggagacgtcgtgggaggcgttcgagcgggcgggtatcgatccgctgtcgatgcgtggctcccgtacgggtgtcttcgccggggtgatgtaccacgactacggatcccgcctgggtaccatccccgagggattcgagggctacatcggcaacggtagcggcggcgccgtcgcgtcgggccgcgtcgcctacacgctcggtctcgagggccctgccgtctcggtggacacggcatgttcgtcgtcgttggtggcgctgcatctggcgtgccagtcgctgcggtcgggtgagtgcacgctcgcgctggccggcggtgtgacggtgatgtcgaccccgcacctcttcgtcgagttctcacgccagcgcggactgtcggtggacggccgctgcaagtccttcgcgggtggagccgacggcaccggcatgggcgagggcgtcgggatgctgttggtggagcggttgtcggatgcggtgcggctggggcatcgggtgctggcggtgctgcgcggcagtgcggtcaatcaggacggtgcgtcgaatgggttgacggcgccgaatggtccggctcaggagcgggtgatccggcaggcgttggcgaacgcggggttgtccgtggcggatgtggatgtggtggaggggcatgggacgggcacgacgctgggtgatccgatcgaggcgcaggcgttgctcgccacgtacgggcagcgggccggtaacaggccgctgtggctgggatcggtgaagtcgaacatcggccatgcgcaggctgccgcgggtgtgggtggggtcatcaagatggtgatggcgttgcgggagggggtgttgccgcggacgttgcatgtggatgagccgtcgccgcaggtggactggtccgcgggggcggtgcggctgctgacggaggcggtgccgtggccgggggacgcggcagggcggttgcggcgggcgggagtgtcgtcgttcggggtcagtggcacgaatgcgcatgtgattttggaggaggcgccggcggcggggggctgtgttgccgggggtggggtgttggagggtgctccgggtcttgccatttcggtggctgagtcggtggccgctccagtggctgtgtctgcgccggtggctgagtcggtgccggtgccggtgccggtgccggttcctgtgccggtgtcggctaggtctgaggctgggttgcgggcgcaggcggaggcgttgcgtcagtacgtggcagtccggccggacgtttcgcttgccgatgtgggtgcgggtctggcctgtgggcgggctgtgctggagcatcgtgcggtcgtcctggccgcggaccgtgaggagctggtgcaagggttgggggcgctggcggcgggtgagccggatcggcgggtgaccacgggtcatgcgccgggtggtgaccggggcggtgtcgtcttcgtgtttcccggacagggtgggcagtgggccgggatgggtgtgcgtctgctcgcctcctctccggtgttcgcccggcggatgcaggcgtgcgaggaggctctggcgccgtgggtggactggtctgtggtggacatcctgcgccgggacgcgggggatgcggtgtgggagcgggccgatgtggtccagcctgtgctgttcagcgtcatggtgtctttggctgctctgtggcgttcctacggtatcgaacccgacgcggtccttggccattcccagggcgagatcgcggccgcgcatgtgtgtggggcgctgagcctgaaggacgcggcgaagactgttgcgctgcgcagccgggcgctggccgctgtgcggggccggggcggcatggcctcagtgccgctgcctgcccaggaggtggagcagctcattggtgagcggtgggcggggcggttgtgggtggcggcggtcaacggcccccgctccaccgccgtctcgggggatgccgaggcggtggacgaggtgctggcgtactgtgccggcaccggggtgcgggcccggcggatcccggtcgactatgcctcgcactgcccccatgtgcagcccctgcgggaggagttgctggagctgctgggggacatcagcccgcagccgtccggcgtgccgttcttctccacggtggagggcacctggctggacaccacaaccctggacgccgcctactggtaccgcaacctgcaccagcctgtccgtttcagcgatgccgtccaggccctggcggatgacggacaccgcgtcttcgtcgaagtcagcccccaccccaccctcgtccccgccatcgaagacaccaccgaagacaccgccgaagacgtcaccgcgatcggcagcctccgccgcggcgacaacgacacccgccgcttcctcaccgccctcgcccacacccacaccaccggcatcggcacacccaccacctggcaccaccactacacccaccaccacacccacccccacaaccaccacctcgacctccccacttatcccttccaacgccagcactactggctcgacgctcccacgggagcaggtgacgtcgccgctgctggcttggagccggccgaacaccctctgctcgcggcaacagtccaactcgcagacacggacggctgcctactgacgggtcgcctgtccttgcgctcgcatccgtggctgggcgattacgaggtggggggtgcggtcctgctgtcggggtcggcgttcgtggagctggcggtccaggttggcgaacgcgtgggctgcacccgaatcgagcaactcactgtgcatgcgccgctggtggttcctgtgggtgggggtgtgagtgtgcaggttggggttgcggctgcggatggggaggggcggcgtttggtgagtgtgtatgcgcggggtgggagtgcttgtggtgggggtggtgcgtcgggtggggtgtggacgtgtcatgcctcgggggtgctggttgaggctgctgctggtggtggtgtggtggtggatggtctggcgggggtgtggccgccgcggggtgcggtggcggtggatgtcgatggtgtccgtgaccgtttggctggggctggttgtgttttggggccggtgttttcggggctgcgtgcggtgtggcgtgatgggggggatttgctggctgaggtgtgtctgccggaggaggcgtggggtgatgcggctggttttgggctgcatccggcgttgctggatggtgtggtccagccgttgtcggtgttgcttccgggtgggacggggtttggggagggggcggggttcggggagggtgttcgggtgccggctgtgtggggtggtgtgtcgcttcaccgggcgggtgtgaccggtgtgcgggtgcgtgtgtgggctgtagggcggggcggcgggcgtgaggcggtgtcggtcgtggtcggggatgaggcgggtgtgccggtggcgtcggtcgatcgtcttgagttgcggcctgtggatatgggtcagttgcgtgctgtctcggtttcggcggggcggcggggttcgctgtatgcggtgcagtgggctgaggtgggtcctgtgccggtgtgtgggcaggcgtgggcgtggcacgaggacgtgggtgagagcggtggtgggcctgtgccgggggtggtggtgttgcggtgcccggatgccggtgccggtggcggcggtggcggtggtgtgggtgaggttgttggtggggtgttgggtgtggtgcaggggtggctggggctggagcggtttgcgggttcgcggctggtggtggtgacccggggtgcggtggtggccggccaagaagacggcccggtggatgtggtgggtgcggcggtgtgggggctggtgcggtcggcgcaggctgagcatccggaccggtttgtcctcctcgacctcgacaccgacaccgacaccggcaccgacctcgacaccggtgctggtgctggtgctggtgctggttggggcgtggatggtgggcatgtggcggcggtggtggcgtgtggtgagccgcagttggcggtgcgtggtgagcgggtgctggccgcacgcctgacgcgacttgagtcgtccgttgatgtacctgctcagcggtccggtgatgttgctggtcgggaggtgttgccgtggttgtcgggtgggtcggtgttggtgacgggtgggacgggtgtgctgggtgcggcggtggcgcggcatctggctggtgtgtgtggggtgcgggatctgctgttggtgagccggcgtggtccggatgctccgggtgcggagggtttgcgggcggagctggccgcgttgggggcggaggtgcggattgttgcgtgtgatgtgggggagcggcgggaggtggtccggctgctggagggtgttcctgccgggtgtccgctgacgggtgtcgtgcatgcggctggtgtgctggacgatgcgacgatcgcctctctcacgcccgagcggctgggcacggtgttcgcggccaaggtggatgccgctcttttgctggatgagctgacgcggggtatggagctgtcggcgttcgtgctgttctcctcggccgcggggatcctggggtcggccgggcagggcaactacgccgcggccaatgccgctctggacgcgctggcgtaccggcggcgggcggcgggtctgccgggggtgtcgctggcgtgggggctgtgggaagaggccagcgggatgaccgggcacctggccggcaccgaccaccggcgcatcatccgttccggtctgcatcccatgtcgaccccggacgcactggctctcttcgatgcggccctggctctggaccggccggtcctgctgcccgccgacctgcgtcccgccccgcccctgccgcccctgctgcaggacctcctgcccgccacccgccgccgcaccacccgcaccaccactaccggtggtgcggacaacggcgcccagctgcatgcccggctggccggccagacacacgaacaacagcacaccaccctcctcgccctggtccgctcccacatcgccaccgtcctcggccacaccacccccgacaccatcccccccgaccgcgcgttccgcgacctcggcttcgactccctcaccgccgtcgaactacgcaaccggctctcccgcaccaccggactccgcctccccaccaccctcgccttcgaccaccccaaccccaccaccctcacccaccacctccacacacaacttctgggctcggacagcactgcctccatcccagctccccgtgctgcggctgtgcctgcagaccaggacgagcccgtcgcgatcattggcatggcgtgccgctatcccggaggcgtcacctcagccgaggagctgtgggaactgctcgcatcggggagggacacggtcggcgagtttccgacggaccgtgggtgggacctggaagcactgttcgatccggaaccgggtcggccgggcacctcgtacacccgctgtgggagtttcctctacgacgcgggggagttcgacgccggcttcttcgggatcagtccgcgtgaggcactggcgatggacccgcagcagcgattgctgctggaggcctcatgggaggccatggagcaggcaggtattgaccctacgaccgtacgcgggagccagacaggcgtgttcgcgggcctcattccgcaggcctatggacccaggctgcacgaaaacgccgcagccgacaccgagggctatgtcctgaccggcacatccgggagtgtggcctccggtcgtatctcgtacacgtttggttttgagggtcctgcggtgtcggtggacacggcttgttcctcgtcgttggtggctttacatctggcctgtcaggcgttgcgtgcgggtgagtgctcgatggcgcttgccgggggtgtgacggtgatgtcgtctccgggtgccttcgtggagttttcgcggcagcggggtctggccgcggacgggcattgcaaggcgttctcggcggcggcggacgggaccggctggggtgagggtgtggggatgctgctggtggagcggctctccgacgcccgtcgcaacggtcaccgtgtcctggccgtggtgcgtggcagtgcggtcaaccaggacggtgcgagcaacgggctgaccgcgcccaacgggccctcccagcagcgtgtcatccgccaggccctcgccaacgccggcttgtcggccggtgatgtcgatgcggtggaggcccacggcaccggcaccactttgggcgacccgatcgaggcccaggccctccttgcgacctacgggcaggaccgtgccggcgaggggccgctgtggctgggctcggtcaagtccaatgtcggtcacacacaggctgccgcgggcgtcgccggggtgatcaagatggtgatggcgctgcggaatggtctgctgccgcggacgttgcatgtggatgagccgtcgccgcatgtggactggtccgcgggtgcggtgcagctgctgacggagacggtgccctggcccggcggggaggggcggctacggcgggcaggagtgtcatcattcggcgtcagcggcaccaacgcccacgtcatcctcgaagaagcacccgcccacaacatcccgtcagacacacccgccgacgacgttccggggggaccacccgccggcgaggatgccggtagtggcgaggaggctgctgccggcagtccaggggtgtggccgtggctggtgtcggccaagtcgcagccggccctgcgcgcccaggcccaggccctgcacgcccacctcaccgaccaccccggcctcgacctcgccgacgtcggatacaccctcgcccacgcccgcgccgtgttcgaccaccgcgccaccctcatcgccgccgaccgcgacaccttcctgcaagcactccaggcactcgccgcaggcgaaccccaccccgccgtcatccacagcagcgccccaggcgggaccgggaccggggaggccgcaggaaagaccgcattcatctgctccggacagggcacccaacgccccggcatggcccacggcctctaccacacccaccccgtcttcgccgccgcactcaacgacatctgcacccacctcgacccccacctcgaccaccccctcctccccctcctcacccaggaccccaacacccaggacaccaccaccctcgaagaagcggccgcactgctccagcagaccccgtacgcccagcccgccctcttcgccttccaggtcgccctccaccgcctcctcaccgacggctaccacatcaccccccactactacgccggacactccctcggcgaaatcaccgccgcccacctcgccggcatcctcaccctcaccgacgccaccaccctcatcacccaacgcgccaccctcatgcaaaccatgccccccggcaccatgaccaccctccacaccaccccccaccacatcacccaccacatcaccgcccacgaaaacgacctcgccatcgccgccatcaacacccccacctccctcgtcatcagcggcaccccccacaccgtccaacacatcaccaccctctgccaacaacaaggcatcaaaaccaaaaccctccccaccaaccacgccttccactccccccacaccaaccccatcctcaaccaactccaccagcacacccaaaccctcacctaccacccaccccacacccccctcatcaccgccaacaccccacccgaccaactcctcaccccccactactggacccaacaagcccgcaacaccgtcgacatagccaccaccacccaaaccctccaccaacacggcgtcaccacctacatcgaactcggacccgacaacaccctcaccaccctcacccaccacaacctccccaacacccccaccaccaccctcaccctcacccacccccaccaccacccccaaacccacctcctcaccaacctcgccaaaaccaccaccacctggcacccccaccactacacccaccaccacaaccaaccccacacccacacccacctcgacctccccacctaccccttccaacaccaccactactggctcgaaagcacacagcccggtgccggcaacgtgtcagcagccggactcgaccccaccgaacaccccctactcggcgccacattggaactggccgaaggggacggctgcctactgacggggcgcctctcgttgcgcacgcatccctggctcgccggccatgcggtaggcggtgtcgtgctgctgccgggtacggccttcgcggaactggcccttcatgccggagaaagtgtgggttgcgaccacgtggacgagctgacgctccacacaccgttggtcattcctgaggtcggagacgtgacccttcaggttgccattgcggcgccggacgagtcgggtcgccgcatgatgaccatccactcacgcggtgagggcggcagtggtggagccgatgcgtcggccagtgcgtggacgcgtcatgccgcgggtgtgctgagccctgccaaggacgatgacactgcctcgtacgagctgcttgcgggaccctggcctcccgttggagctacgcctgtcgacctgaacacggcttacgatcaaatggccgacgccggctttgcttatggcctggcattccaagggttgcgcgcggcctggcgctacggcgacgacatcctcgtcgaggcacgtcttcccgaagaagtgtcgggagacgcggcggcgtacggtctgcacccggccctgctcgacgctgcccttcagggcaccggcctgctttctgtggcgggtccggggacgcccgtcgtgccccatgtgtggaacggtctgcggttccgtacgcatggtgcagtctccgtgcgcgcgtgcctgtcgacgcttggagcgacaggggcggccgtgtgcgtgcgcatcaccgacgacaccggggtgccggtggcgtcggtcgatcgtcttgagttgcggcctgtggatatgggtcagttgcgtgctgtctcggtttcggcggggcggcggggttcgctgtatgcggtgcagtgggctgaggtgggtcctgtgccggtgtgtgggcaggcgtgggcgtggcacgaggacgtgggtgagagcggtggtgggcctgtgccgggggtggtggtgttgcggtgcccggatgccggtgccgatggcggcggtggcggtggtgtgggtgaggttgttggtggggtgttgggtgtggtgcaggggtggctggggctggagcggtttgcgggttcgcggctggtggtggtgacccggggtgcggtggtggccggcccggaggacggcccggtggatgtggtgggtgcggcggtgtgggggctggtgcggtcggcgcaggctgagcatccggaccggtttgtcctcctcgacctggacaccgacctcgacagcggcgctgacgccgatgccggcaacgaggccggtatggggtctggtctggatggtgggcgtgtggctgcggtggtggcgtgtggtgagccgcagttggcggtgcgtggtgagcgggtgctggccgcacgcctgacacgacttgagtcgccggttgatgtatcgggtcgggaggtgttgccgtggttgtcgggtgggtcggtgttggtgacgggtgggacgggtgtgctgggtgcggcggtggcgcggcatctggctggtgtgtgtggggtgcgggatctgttgttggtgagccggcgtggtccggatgctccgggtgcggagggtttgcgggcggagctggccgcgttgggggcggaggtgcggattgttgcgtgtgatgtgggggagcggcgggaggtggtccggctgctggagggtgttcctgccgggtgtccgctgacgggtgtcgtgcatgcggctggtgtgctggacgatgcgacgatcgcctctctcacgcccgagcggctgggcacggtgttcgcggccaaggtggatgccgctcttttgctggatgagctgacgcggggtatggagctgtcggcgttcgtgctgttctcctcggccgcggggatcctggggtcggccgggcagggcaactacgccgcggccaatgccgctctggacgcgctggcgtaccggcggcgggcggcgggtctgccgggggtgtcgctggcgtgggggctgtgggaagaggccagcgggatgaccgggcacctggccggcaccgaccaccggcgcatcatccgttccggtctgcatcccatgtcgaccccggacgcactggctctcttcgatgcggccctggctctggaccggccggtcctgctgcccgccgacctgcgtcccgccccgcccctgccgcccctgctgcaggacctcctgcccgccacccgccgccgcaccacccgcaccaccactaccggtggtgcggacaacggcgcccagctgcatgcccggctggccggccagacacacgaacaacagcacaccaccctcctcgccctggtccgctcccacatcgccaccgtcctcggccacaacgcgccggagatgatccccgttgactcggcgttccgcgacctaggcttcgactccttgacagcggtggaactccgtaaccgcctgggtgaggcaacgggactgcgactgccgaccagtctggtcttcgaccagccgaatgcagcgaccctggcgcgtcacctacgtcgtgagctgatgggcgacgacgcggaaggcgagacgccatcgcaggtcgcacttcatcaggttgccgcggatgagccgattgcgattgtggggatggcgtgtcgttttccgggtggggtgtgttcgccggaggagttgtgggagctggttgcgtcgggtggggatgcgattggtgaatttccggccggtcgggggtgggatctggaggggttgtttgattcggaccctgaccggtcggggacgtcgtacgcgcggtatggcgggtttttgtatgaggcgggggagttcgatgcggacttcttcgggatcagtccgcgtgaggcgttggcgatggatccgcagcagcggttgttgctggagacgtcgtgggaggcgttcgagcgggcgggtatcgatccgctgtcgatgcgtggctcccgtacgggtgtcttcgccggggtgatgtaccacgactacgccgcgcgtctccaccatgtccccgagggtttcgaaggcctcatcgccaacggcagcgcaggcagcgtcgcgaccggccgggtggcctacagctttggccttgagggtccggccgtgaccgtcgatacggcgtgttcgtcgtcgttggtggcgttgcattgggcggcgcaggcgttgcgtgcgggtgagtgttcgatggcgcttgccgggggtgtgacggtgatgtcgtctccgggtacgtttgtggagttctcacgtcagcggggtctggccgcggacgggcggtgcaaggcctattcggcggctgctgacggtaccggctgggccgagggtgtggggatgctgctggtggagcggctctccgacgcccgtcgcaacggtcaccgtgtcctggccgtggtgcgtggcagtgcggtcaaccaggacggtgcgagcaacggtctgaccgcgcccaacgggccctcccagcagcgtgtcatccgtcaggccctggccaatgcgggactgaccccggccgatgtcgacgcagtggagggccacggcaccgggaccactctgggggacccgatcgaggcccaggcactcctggccgcctacggacaacaccgcccccaccaccgccccttgtggctgggatccctcaaatccaacatcgggcacgcacaggccgccgcgggcgtgggcggagtcatcaagatggtgatggccctgcgcaacgggctgctgccacagaccctccacgtggacgagcccaccccccaggtcgactggtccacaggcgcagtacaactcctgacacaaccggtgccctggcccgccgacccggccggccggccacgccacgccggcgtgtcatcattcggcgtcagcggcaccaacgcccatgtgattttggaggaggcgcctgcggcggcgggcggtgctgccggtggtggggtgtcggtgggtgctccgaatccagcccttccggtggctgagtctgagccggtgccggtgccggtgccggtgtcggcgaggtctgaggccgggttgcgggcgcaggcacaggcgttgcgccagtacgtggcagcccgcccggacatgtcacctgccgacatcggtgcgggtctggcccgcggccgggccgtactggaacaccgcgccgtcatcctggccgcggaccgcgaggaactggcgcaggcactgacagccctggcagccggcgaaccccacccccacatcaccacaggccacacccggggcagtgaccgcggcggcgtcgtcttcgtcttccccggacagggcggccagtgggccgggatgggcctgaccctgctcacctcctcacccgtgttcgccgaacacatcgacgcatgcgagaaagccctcaccccctgggtgccctggtccctgaccgacatcctgcaccgcgaccccgacgaccccgcatggcaacaagccgacgtggtccagcccgtgctcttcagcatcatggtctccctcgccgccctgtggcgctcctacggcatcgaacccgacgcggtcctcggccactcccagggagaaatcgccgccgcccacatctgcggcgcactcagcctgaaagacgccgccaaaaccgttgcactgcgcagccaggcactggccgccgtacgaggccggggcgccatggtctcactgcccctgcccgcccaggacgtgcagcagctcatttccgaacggtgggaagggcagttgtgggtggcagccctcaacggcccccactccaccaccgtctccggcgacaccaccgcagtagaagaactcctcacccactgtgccgacaccggcctacgggccaaacgcatccccgtcgactacgcctcccactgcccccacgtccaacccctccacgacgaactcctgcacctgctgggagacatcaccccccagccgtccaccatgccgttcttctccaccgtcgtagggcacctggtctggtacaccacaaccctggacgccgcctactggtaccgcaacctccaccagcccgtccgcttcagccacgccatccagaccctgaccgacgacggacaccgccccttcatcgaaatcagtccccaccccaccctcgtccccgccatcgaagacaccaccgaaaacaccaccgaaaacatcaccgcgaccggcagcctccgccgcggcgacaacgacacccaccgcttcctcaccgccctcgcccacacccacaccaccggcattcggacacccaccacctggcaccaccactacacccaaacccacccccacccccacaaccaccacctcgacctgcccacctaccccttccaacaccagcactactggctccaaccacccaccacgacaaccgacctcaccaccaccggcctcacccccacccaccaccccctcctcaccgcaacactcaccctcgccaacaacaacacacaactactcaccggccgcctctccctacgcacccacccctggctcaccgaccacaccgtcgtcggtaccactcttgtgccaggaaccgccctcctcgaactcgccctccaagcaaccacgaccgaccacctcgaagaactcgccctccacacgcctctcgtcatcccccgtgagggtgccgtcgacgttcaggtgcacatcaatccaccggacgacaccgacactcgttcactgacgatctactcgcgaagcgagaacgcccccgcagcggctccctggcgtcatcacgccacggccgttctgggaaccaagacctcgcgcattgagacaggccgtagccacgatgatctgtcgatgtggccgccagcgggcgcagttcgctgtgctgatgaggaattggcagccttgtatggcgactacgaggcaaatggctttgtctatggccccgcattccgggggctgactgctgcctggcgtctgggagacgaggtgtttgccgaggttcgccttccagaacaggtgcacggcgaggcatccgcgtacaacctgcacccggcactgctggatgctgccttgcacgcagcggcctttgcgccgtcgggcagtctgccgcagggatccgtaccgttctccttcaccggtgtgacgctgcacgccgccaatgcgtcgtcgttgcgcgtgcgactctcgccggccgatccgaacagcggccacgccgcagtttccgtgctggtcacggatgacaccggtacgcccgtggcgtccgtcgaggcgttggcggtgcgcccgttggcggcggacgaattgcgagctgccgagcgcgccgtacagcgcgctgagctcttcgacatgaagtgggttgaggtgccctcagatgtactggtgtcgggcggggcatcggtggtggtgctggatggtgccgacgacctcgttggtctggcggctgaggaggatggtgtgccgggggtggtggtgttgcggtgcccggatgccggtgccgatggcggcggtggtggcggtggtgtgggtgaggttgttggtggggtgttgggtgtggtgcaggggtggctggggctggagcggtttgcgggttcgcggctggtggtggtgacccggggtgcggtggtggccggcccggaggacggcccggtggatggcccggtggatgtggtgggtgcggcggtgtgggggctggtgcggtcggcgcaggctgagcatccggaccggtttgtcctcctcgacctggacaccgacctcgacagcggcgctgaccgcgatgccggcaacgaggccggtatggggtctggtctggatggtgggcgtgtggctgcggtggtggcgtgtggtgagccgcagttggcggtgcgtggtgagcgggtgctggccgcacgcctgacacgacttgagtcgccggttgatgtatcgggtcgggaggtgttgccgtggttgtcgggtgggtcggtgttggtgacgggtgggacgggtgtgctgggtgcggcggtggcgcggcatctggctggtgtgtgtggggtgcgggatctgttgttggtgagccggcgtggtccggatgctccgggtgcggagggtttgcgggcggagctggccgcgttgggggcggaggtgcggattgttgcgtgtgatgtgggggagcggcgggaggtggtccggctgctggagggtgttcctgccgggtgtccgctgacgggtgtcgtgcatgcggctggtgtgctggacgatgcgacgatcgcctctctcacgcccgagcggctgggcacggtgttcgcggccaaggtggatgccgctcttttgctggatgagctgacgcggggtatggagctgtcggcgttcgtgctgttctcctcggccgcggggatcctggggtcggccgggcagggcaactacgccgcggccaatgccgctctggacgcgctggcgtaccggcggcgggcggcgggtctgccgggggtgtcgctggcgtgggggctgtgggaagaggccagcgggatgaccgggcatctggccggcaccgaccaccggcgcatcatccgttccggtctgcatcccatgtcgaccccggacgcactggccctcttcgatgcggccctggctctggaccggccggtcctgctgcccgccgacctgcgtcccgccccgcccctgccgcccctgctgcaggacctcctgcccgccacccgccgccgcaccacccgcaccaccactaccggtggtgcggacaacggcgcccagctgcacggccggctggccggccagacacacgaacaacagcacaccaccctcctcgccctggtccgctcccacatcgccaccgtcctgggccacaccacccccgacaccatcccccccgaccgcgcgttccgcgacctcggcttcgactccctcaccgccgtcgaactacgcaaccggctctcccacaccaccggactccgcctccccaccaccctcgccttcgaccaccccaaccccaccaccctcacccaccacctccacacacaactcgtcagcaagggactcaccgccgcggccgagccggacgccgcaacgacacccccggggctgccctcgctgctctcggagctcgagcggctggaggcggtagtgctctcctccaccacatcctccgctgccccgctggacgacggcgcgcgcacgcggctggcctcccgactgcattccctcgcccagaagttgaacggcgacgacaccgcccccgacctcgcagagacatcggacgaggagatgttcgctctcatcgacagggaagtcggattcgaatctcaa

SEQ ID NO: 931 - DNA, 14643 bp, Streptomyces avermitilis
  CDS (1)..(14643)
atggctaacgaggaaaagctccgcgactatctcaagcgcgttactgccgatctcctcaatgtgcggcgtcgacttcagcagattgaatcgggcgagcaggagccgattgcaattgtggggatggcgtgccgttttccggggggtgtggagtcggcggaggatttctgggagttgattgcgtcgggtcgggatgcggtgggggagtttccggtcgaccggggttgggacgtggaggctttctatgatccggagccggggcgggcgggttcgtcgtatacgcgccggggcggtttcctggagggtgcggcggagttcgatgcggggtttttcgggatcagtccgcgtgaggcgttggcgatggatccgcagcagcggttgatgctggaggtgtcctgggaggcgttggagcgggcgggcatcgaccccgccacgttgcgcggcagccggacgggcgtcttcgccggcctcatgtcccaggactacgcgacccgtctgctctcggtccccgacgacctggccggctacctgggcaacggcaacgcgggaagcatcctgtccggacgcgtcgcctacaccttcggcttcgagggccccgcggtgacggtcgacacggcgtgctcgtcgtcgctggtggcactgcacctcgcctgccagtcactgcgcaccggtgagtcctccttcgccctcgccggaggcgtgacggtcatgtccaccccgggcatgttcgtggagttctcgcggcagcggggtctgtcgccggacggccggtgcaaggcgtacgcgtcggctgccgacggcaccggcatgtccgagggcgtggggattttgctgctggagcggctgtccgaggctgaacgtcgtggtcatcgggttttggcggtggtgcgggggagtgcggtgaatcaggacggtgcgtcgaatgggttgacggcgccgaatggtccgtcgcagcagcgggtgattcggcaggcgttggcgtgtgcggggttgtctgtggcggatgtggatgtggtggaggggcacgggacgggcacgacgctgggtgatccgatcgaggcgcaggcgttgctcgccacgtacgggcagcgggccggtgacacgccggtgtggttggggtcggtgaagtcgaacatcgggcatgcgcaggctgctgcgggtgtggcgggtgtgatcaagatggtgatggcgttgcgggcgggggtgttgccgcggacgttgcatgtggatgagccgtcgtcgcaggtggattggtcgagtgggtcggttcgtgtgttggcggatgaggtggagtggccgggggtggagggtcggctgcggcgtgcgggggtgtctgcgttcggggtgagtgggacgaatgcgcatgtgattttggaggaggcgtcggggggcgcgggtgggggtgcgggccggctgcaggagttgggtccgggggtggtgtcgggttcgggggtggtgccgtgggtggtgtcggcgcggtcggagttggcgttgcgggggcaggcgcgtcggttgcgtggggttgtggcggttggtgggggtgcggatggtgtgggggtgagtccggctggggtcgggcgggctttggtgtcggagcggtcggtgttcgagcatcgtgcggtggtcgtggccgaggaccgcgacgagttcctgcacgcactcgacgcactggccggcggccgccccgtgcccggcgtcgtcgagggacgaaccacctcgggcgaactcgccgtactcttcgccgggcagggaacccagcgcgcaggcatgggccgcgaactgtacgaggcgtaccccgtcttcgcccaggccatcgacgagatctgcgcggaggccgacaccgcccgcaccgaccccggtgcccctgggctgcgggacgtactcttcgcaccgcaggactctcccgaaggccggctgatcgaggacacgggtttcgcccagcccgccctgttcgccttcgaggtggcgctgttccggctgctggagacctggggtctgacgcccgactacgtcctcggccattccgtcggtgaactggcggccgcccatgtcgccgggatgctctgccttgccgacgcggtggcactggtggtcgcacgaggccgcctgatgcaagggctcccgtccggcggagccatggtggccatcgaggcgtccgaggacgagatcctcccgctgcccgacgaatacgcatcccgggtcgcgcacgccgcggtgaacgggccgcggtcgatcgtcctctccggggacgaggacgcggtcctggacctcgcgcagcaatgggcggcacgaggccgccgcacccggcggctgcggaccagccacgccttccactcgccgcacatggacgccatgttgggcgacttccgccgcgcggccgagcaggtcaccttcagcgccccgcggattcccgtcgtctccaacgtcaccggcgcgcccctccccgccgagaccatgtgcaccccggactactgggtcgaacacgcccgcagcacggtccgtttcgcggacggcatctcatggcttcaggaacagggcgtcaccacctgcctcgaaatcggccccgacggcacgctgtcggccctcgcacaggactcgctcagtgcaccggcccgcgccatccccgccctgcggccggaccagccggaggcacggtcggtcatgaccgccctggcggagttgttcgtggctgggacggcggttgagtgggccggtgtgttcgaggggactgctcgcgaggtcggtgatggatgcggggtggagctgccgacgtatgcgtttgagcgggagcgattttggctggacgtggaggagggatctgcgggaggttccggggtttccgggatgtggggtggtccgttgtgggaggcggtcgagtgtggtgatgcgggggtggtggcatcgctccttggggtggatgagggggcgtcgctgggtgcggtggtgtcggcgttgggggaatgggggcgggtacggcacgagcgtgaagtggtggacgggtggcgctatcgggaggtgtggcgacccgtttcgggcggtggtgtaggggggctgtcgggcgcgtggctggtggtgtccgagggcgaggcgggcccggttgatgtggtggcggaggggttggagcggtgtggggcgcgagtggttcgggtggaggtggaagcggggtgtgtgagcagggaagtgttggccggccacctgcgtgaggcggtcgatggtgaggctgtcggcggtgtcgtctcccttgtgggctgggggagtggcgtcgtgcaggcgggagtggcgtctgtggggttggtgcaggcgctgggtgatgtgggcgtgggggcgcggctgtggtgtgtgacgggcggggccgtgtcggtggggggccgggatgctgtgtgggggccggcctcgggtgtggtgtgggggctgggccgtgtggtgggggcggaggcaccggaccgctggggtgggctggttgatgtgccggagctcgtggatgagcgggtggtcgatgggttggtaggtgtgctggcgggtgtggggggagggggtgagagtgagtttgccgtgcggtcttcgggggcgtttgtgcggcggttggtgcgggcgccgttggaggaggccgtcgcggagcgggagtggcggccccgcggcaccgtactcgtcaccggaggcaccggcgagttgggtgcgcacgtcgcccggtggatggcccggcgtggcgccgaacacctgctgctggtgagccgacgcggggagagcgcccagggagtcgaagaactccgagcggacttgatgggcttgggcgcgcgggtgtcggtggtggcgtgtgatgcggcggaccgtgaggcgttggcggaggtgttgcggtcggccgttccggcggagtgcccgctgggtgtggtggtgcatgccgcgggagttgtggatgacggggtgttggaggggttgtcgtccgagcgtgtcacgggggtgctgcgggcgaaggcgctggcggcctggaatctgcatgagttgacgcggggggcggatctttcggggttcgtggtgttctcgtcggctgcggcgacgttcgggccggcgggacaggggagttacgcggcggcgaacgcgtatgtggaggcaatcgttcggcaccggcgtggtgagggcctgccggggttggcggtggcgtggggtccgtgggctggtggggggatggcggagggggccgtggggcagatgcggcgtcggggtctggcggcgatgacgccggagacggcgctggtggcactgggccaggcgttggaccatgacgagacctgtgtgacggtcgccgacatcgactgggaccgattcaccgccaactccctccccggctcccgactctcgcccctcatcagcgacatccccgaagcacgcctcgcccgggaaaccaccggactcgacaccgccaccgcatcccccgactcgttctccgcacggctcaaggccatggacaccgccgagcaggaacgtgcgcttctcgacctggtccgtacgtacgcggcgaccgtgctcggacacagcacccccaccgccgtacgccctgagcgagccttccgcgacctgggcttcgtctccgtgagcgccgtcgaactgcgcaaccgcctcaacgccgtcaccgggctcctcctgcccaccacgctgatcttcgactaccccactccctccgcgctggccggatacctcaaggaacagctggaggagggcgcgggcggccagcgtgacattgctcctccggtcccggcgtcgcgtgtcgacgttgacgagccgattgcgattgtggggatggcgtgccgttttccggggggtgtggagtcggcggaggacttgtgggaactggtcgcgtcgggtcgggatgcggtgggagagtttccggtcgaccggggttgggacgtggaggctttctatgatccggagccggggcgggcgggttcgtcgtatacgcgccggggcggtttcctggagggtgcggcggagttcgatgcggggtttttcgggatcagtccgcgtgaggcgttggcgatggatccgcagcagcggttgatgctggaggtgtcctgggaggcgttggagcgggcgggcatcgaccccgccacgttgcgcgggtccacgaccggtgtcttcgccggcatgtgcagtcaggactacgccgacctcgtgcgccgggccaccgaggacctcgagggctacgccatgacgggcctgtccagcagcgtcacatccggacgcgtcgcctacaccctggggctcgagggtccggcggtgacggtggatacggcgtgttcgtcgtcgttggtggcgctgcatctggcgtgtcaggcgttgaggtcgggggagtgttcgctggcgttggcggggggtgtgacggtgatgtcgacgccgggtgcgtttgtggagttctcgcggcagcggggtctgtcgccggacggccggtgcaaggcgtacgggtcgggggccgatggggtcggctgggccgagggtgtgggtgtgctgttggtggagcggctgtccgaggctgaacgtcgtggtcatcgggttttggcggtggtgcgggggagtgcggtgaatcaggacggtgcgtcgaatgggttgacggcgccgaatggtccgtcgcagcagcgggtgattcggcaggcgttggcgtgtgcggggttgtccgtggcggatgtggatgtggtggaggggcacgggacgggtacgacgttgggtgatccgatcgaggcgcaggcgttgctcgccacttatgggcagggtcgttcgggggagcggccggtgtggttggggtcggtgaagtcgaacatcgggcatgcgcaggctgctgcgggtgtggcgggtgtgatcaagatggtgatggcgttgcgggcgggggtgttgccgcggacgttgcatgtggatgagccgtcgtcgcaggtggattggtcgagtgggtcggttcgtgtgttggcggatgaggtggagtggccgggggtggagggtcggctgcggcgtgcgggggtgtctgcgttcggggtgagtgggacgaatgcgcatgtgattttggaggaggcgtccgggggcgcggatgggggtgcgggccggctgcaggagttgggtccgggggtggtgtcgggttcgggggtggtgccgtgggtggtgtcggcgcggtcggagttggcgttgcgggggcaggcgcgtcggttgcgtggggttgtggcggttggtgggggtgcggatggtgtgggggtgagtccggctggggtcgggcgggctttggtgtcggagcggtcggtgttcgagcatcgtgcggtggtcgtggccgaggaccgcgacgagttcctgcacgcactcgacgcactggccgagggggcacccaccgcgggggtggtacagggtgtggccggaccggcggccgacggaaagatcgccatgctgttcggaggacagggcacccactgggaaggcatggcgcaggaactcctcggctcctcaccggtcttcgcccagcagatgtccgactgcgcccaagccctcgaaccgtacctggactggtctctcctcgacgtcctgcgcggcgcaccggacgcaccccctctgcaacgcgtcgatgtcgtccagcccgtcctcttcgcggtgatggtctcgctggcggcgctctggcgctcgtacggtgtacacccggacgcggtggccgggcactcgcagggcgagatcgcagcggcctacgtcgccggtgcactctccctcgacgacgccgcccgggtcaccgccctgcgcagccaggcgctggccgcactggccgggcagggggcgatggcatcggtcggtctgccggtcgagaagctggagccgcgtcttgcgacatggggcgaccgtctggtcatcgccgccgtgaacggggcgcgttcggccgtggtctccggggagccggaagcggtcgacgccctggtggaggagctgtcacacgaagacgtaccggcccgcaggctcatggtcgactgggcgtcgcactccccgcaggtcgaggcgatccaggggcggctgctcgaactcctcgcccccatccgcgcgaggaccggcgacgtgcccttctactccaccgtcaccggcgaacgcatcgacggcaccgaactcgacgccgactactggtaccgcaacctgcgccaggtcgtccgcttccgggacgcgacacaggcgctggtccgcgccggccacaccgtcttcatcgaggcgtgcccgcatccggccgtcgcggtcggtgtgcaggaaaccctggacgagatgggtgacttggacagcctggtcgtcggatctctgcgccggggcgaaggcggcttgcgacgcttcctgatgtccgtggccgagttgttcgtgggtggggtggcggttgagtggtccggtgtgttcgggagtgttggtcgcggggtcgctggtggttgcggggtggagctgccgacgtatgcgttcgagcgagagcgcttttggctggatgtggagggggcgccgcggggttccggggtctctgggcagtggggtggtcagttgtcggaggcggtggacaccgtgcgcggcggcatgctgcgcgactgcctcgccggactcgaccccgccgcacaggccgagaccgtgctggacctggtccttacccatgccgcggccgtccttggacacggcaccgccgatgcggtggtgcccgagcgcgccttccgcgacctcggtttcgactccctcaccgccgtcgaactacgcaaccgcctcaacaccgccacgggcctgcgcttcccgaggaccctggtgttcgaccatccccgcccggtggcactcgcggcacacatccacgagcagctgagcggcggaagcccgaccaccggcactgcccttgcccttgcccttcgggccccggcaccgcgtgtggatgtcgacgagccgattgccattgtggggatggcgtgccgttttccggggggtgtggagtcggcggaggatttctgggagttgatcgcgtcgggtcgggatgcggtgggggagtttccggtcgaccggggttgggacgtggaggctttctatgatccggagccggggcgggcgggtacgtcctacacgcggtgtggtgggtttttgcagggtgcggcggagttcgatgcggggtttttcgggatcagtccgcgtgaggcgttggcgatggatccgcagcagcggttgatgctggaggtgtcctgggaggcgttggagcgggcgggcatcgaccccgccacgctgcacgggtccacgaccggtgtcttcgccggcgtctcgcagcaggactacgccgagctcctgcgccgcggcacccaggaccacgaggggtacgcgctcaccggcgtctccaacagcgtcgtctccgggcggctttcctacaccttcggcttcgagggtccggcggtgacggtggatacggcgtgttcgtcgtcgttggtggcgctgcatctggcgtgtcaggcgttgaggtcgggggagtgttcgctggcgttggcggggggtgtgacggtgatgtcgacgccgggtgcgtttgtggagttctcgcggcagcggggtctgtcgccggacggccggtgcaaggcgtacgggtcgggggccgatggggtcggctgggccgagggtgtgggtgtgctgttggtggagcggctgtccgaggctgaacgtcgtggtcatcgggttttggcggtggtgcgggggagtgcggtgaatcaggacggtgcgtcgaatgggttgacggcgccgaatggtccgtcgcagcagcgggtgattcggcaggcgttggcgtgtgcggggttgtccgtggcggatgtggatgtggtggaggggcacgggacgggtacgacgttgggtgatccgatcgaggcgcaggcgttgctcgccacgtacgggcagggtcgttcgggggagcggccggtgtggttggggtcggtgaagtcgaacatcgggcatgcgcaggctgccgcgggtgtggccggtgtgatcaagatggtcatggccctgaaccacgaactgttgccgaccagcctgcacatcgacgaaccctccccccacatcgactggtcgagcggcggcgtccggcttctcaccgagcccgtaccgtggcagcagaacggccggcccaggcgcgcgggcgtctccgcgttcggagtcagcgggaccaacgcccacgtcatcatcgagcaggcgccggtcgaggcgcacgtcatcagtgagccggtaccggctgaggcgcacgtcatcgtcgagcaggcgccggtcgaggcgccccacgtggtcgacgccaccggaccggcggacctcaccgagccgcaagaggaggcggctgaaccggagtgcgtcgctgacgccgtgaccgagatgtcggctgaaccggagtgcgtcgccgacgccatgtccgagatgtcggctgagtgcgtcgccgaggccgtgtccgacaagtcggctgaaccggagtgcgtcgccgacgccatgtccgacaagccggccctcctgcccatcccgtggctgctctccgccaagtccgagcgagcgctgcggggccaggcgcgacggttgcggcagttcgctgccagggcatccgatgcccggccggccgacgtggcgcacgccctggcggcacagcggtccgtgttcgatcaccgggccgtcgtcgtggccgaggaccgcgacggcttccttcaggccctcgacgcgctggccgagggccggtcggcggacggcctgatcgaagggtcggtcggcccgcgtggcggccactcaggccgccggcgcggaaagaccgccatgctgttcgccggacagggcacgcaacgcgtgggaatgggccgtcagctgtatgcggctcacccggcctacgcggacgcgctggaccaggtactggcggaactggacggtcacctggaccagcccctgcgcccgctgatccacgccagtgcggatcttgcggatgtcgcggatgccgcggatgttctggaccgtacgcggtacgcccagccggcgctgttcgccgtccaggtcgcgctcttccggcacctggaacgtctcggcgtgcgcgcggacttcgtggccgggcactcgatcggcgagctcgcggccgcccacgtcgccggggtgcttcccctggcagcagcctgccgcctggtggcggcccgcgggcgcctgatggagcagctcgcaccaggcggcgccatggtcgccgtacgggcgagcgaagccgaggcgcgacaggcgctcgacggccgggaagcccgggtgtcggtcgcggccgtgaacggacccgcctcggtggtgttctccggcgccgaggacgaggtggggaacatggcggactggttcgccgagcgcgggcggagagtcaagcgcctgcgaaccgggcatgccttccactcaccgctgatggacccgatgctggaggagttccagcaggtcgcggcctcgctgacctacagcgaaccagccattcccatggtgtcgacgctcaccggcgacatcgtggcggcgggagaactgagcgaccccgagtactgggtccggcaggtacggcggaccgtgcgcttcggcgacgcgatcagccgcctgcacaccgacggagtccgcaccttcatggaactgggcccagacgggaccctgtcggcactggccgaggaatgcctagaggccaccgccgacagccaccccgccgacgacgacaccggcaccccgcaagagaacctgctcatcccgctcctacggccggacagcccggaacccggcaccctgctcaccggcttggcccggctgcatacgcacggagcggcggcggtcaactggcccgccgccctgcccgaacgcgatcgagcccgccacctcgacctgccgacctacgccttcgatcaccaccgctactgggtcgacacctcggccggccacccgggggacctgtcggcagcggggctcggcaccgccgggcatcccctgctcggttccgcggtggcactggccgagtcgcaggaactcctcttcaccggccgtctctccctgcgcacacacccgtggctggccgaccacgccatcttcggtaccgtcctgctgcccggcacggccatcctggaactggccgtgcgcgcaggcgacgaggtcgactgcggcaccgtcgaggaactcaccctgcggacaccgctcgtccttcccgaacagggctcggtgatcctgcaactctccgtcggggcaccccagggcccccagacgcccgaggagcccgaacggcgcaccttcgccctgtacgcccgcgaagacgacggactgtcgtcctcgtccgcggcggcgaccggcaccgagtggacctgccacgccaccggcgtcctgaccggcaccgcccggcccgcggaggagcacacacaggaaccgtggccgcccgccgacgcagcaccggtggacctggacggctggtacgagcagctggccggcgccggcctgggatacgggccggtgttccaggggctgcgcgaggtctggcggcgcggggacgaggtgttcgccgtcgtcaccctgcccgagagcacggagggacaggcggccgacgccgcccggtacgccctgcacccggccctgctggacgcggcactgcacccggtcgttctgcgccacgagggcgatgccgccgccgacggacacggctggctgccgttctcctggaccggcgtcacggtcgccgcctccggcgcctccaccctgcacgtccgtctcaccgtccgcacggacgaggacgcggtcggactgctggccaccgacgcatcgggacgcatcgtcatctccgcggggtccctcgccttccggcccgtctccgccgagcagctccaggccgcgcgcaccggctaccacgaccacctcttccgcatcgaatggcggccgctgcacctccccaccacaccggcacggacagccgactgggccctaatcggccccggtgcccggcggacggccgccgtcctggagcgcaacggcgcctcctggcaggcctacccggacccggcggctctcgcagaagccctggcggccggcgccccggcaccgggcatggtcgtcatctcgtgcgagccggacggcgcatccgcccccaccgattccgccctcaccgattccgccctcaccgattccgccccggccggctcggccccggccgactccaccgccctcgccgacgccacccggcaagccaccacccgcgtcctcgccctgctccaggaatgggtcgccgacgaacggctcgcggcctgccgcctggccctcctcacgcacggctcggtcaccgcgacccccgacgagcccgtgtccgacctcgcacacgccgccgtctggggactggtccgctccgtgcagaccgagaaccccgaccggttcctgctggccgacaccgacgacaccgacgcctcccgcaacgcccttcccctgctggccggggaaccgcagatcgccctgcgaaatggtgccgtccgcatcccgcggatgacacgagtgcccgtccggcagccacagccgagcaccaccgacgccgactgggacccggaggccacggtcctcatcacgggcggtaccggcgtcctcggccggctcgtcgcccgtcatctcgccacggcccacggggtacggcacctgctgctggccacccgccgcggcacggccgcggacggcgccgccgacctggtcgccgaactcgccggcctcggcgccgaggccacggtcgcggcctgcgacatcggggaccgggcggccgtcgccgcgctcctcgaccaagtgcccgcgcagcaccccctgaaagccgtgatccacacggccggtgtggtcgacgacggcatcctcacctcgctcactccggagcgcatggaggccgtcctgcacgcgaaggcgttcggcgccgcgcacctgcacgacctgacccgcgacgccggcctcaccaccttcaccgtcttctcctcggccgccgcctccttcggcagtcccggacagggcaactacaccgcggcgaacgcctttctggacgccctgatgcagcaccgccacacccaggcactgccgggccggtcgctcgcctggggcctttggggcgaggccgacggcatgacccgcaacctcgccggcaccgacttcgcgcgcatggcccgcggcggcctgctccccctgtccaacgcacagggactcgcgctcctcgacacagcggatcgcctcggccctttcggtgacgggctgctcctcgccacccggctcgacgcggccaccctccacgcacaggccacggccggcgccctgccgcgcatcctgcacgggctgatccgcatcccggcccggcggtccgccgaccacggcatcgcgaccgacacccccgccacgctgcgcgagcgcctggccggactcaccatccccgcgcagcgcaccggtctcctcctggaactcgtacggacccatgccgccgccgtcctcggccaccccaccagcgccgtcacagccgcggacggcgcactcccggacgatctggtcccggccgacaccgagttccgcgacctcggcttcgactcgctgaccgccgtcgaactccgcaaccggatcaacgccgtcaccggcctgcgcctcccggcaacgctcatcttcgaccagcccagccccgcggcactcgccgatcacctcgcgacccgcctgacggccgaggcgggcacgccggacgagccggcccctgccgccgcggcagccggggccgggagcgcagggagtgccgagaccggacagcagcgcagtacggggagcgagaagcagcagaccaggggcggcacctccaccgaaaccgtcgaatccctgttctggatcggacacgacacccgccgcatcgaggagtccatggccctgctctcggcggcctccttcttccggcccgccttcacggacccctcggacatcccggagccgacgttcgtccggctcgcccagggtgaagcgcgcgcccaaggtgaagcactcgcccggggcgaaacacggcccgccctcatctgcctgcccaccgtcgccgccgtgtcgagcgtgtaccagtactcacgtttcgcggcgggactgaacggacaccgagacgtctggtacgttcctgcgccagggttcctggagggcgaacccctgccgtccggaatcggcgcggtgacccgcatgttcgccgacgcgatcgtccggttcaccgacggcgcgccttttgcgctcgccgggcattccgcgggcggatggttcgtctacgcggtgacgagtcatctggagcgtctaggcgtccgtccggaagcggtggtgaccatggacgcctatctcccggacgacggcatcgcacctgtcgcgtccgcgctgacaagtgaaatcttcgaccgcgtcacgcagtttgtggacgtggactacacacgcctggtcgccatgggcggatacttccgcatcttctccggctggagtcctccggacatcaccacacccgccctcttcctgcgcggccgggacggagaacagatgccgccgccgtggggagttccgcacaccgttctggacatccaggggaatcacttcacgatgctggaacagtttgcggattcgactgctcggcatgtcgacgaatggctgacagaaatcgcatcagtgcggcgc

SEQ ID NO: 932 - DNA, 711 bp, Streptomyces avermitilis
  CDS (1)..(711)
gtgtgcgtggaccgggacggccgcggcgccggggtgacggccgacctggcccggacgcggggcgcgcgggcggcctggcccgaggtggccgacgtgtccgacggagcggcgatggagcggttcgccgagcgcgtcgccgagacgtacggggtcgtggacctgctggtgaacaacgccggcatcggcatggcggggcgttttctcgacacgtccgtcgaggactggcagcgcaccctgggcgtcaacctctggggtgtcattcatggttgccgcctcatcggccggcagatggcggagcgcgggcagggcgggcacatcgtgacggtggcgtcggcggcggcgttccagccgacgcgggcggtccccgcgtatgccaccagcaaggcggcggtgctgatgctgagcgagtgcctgcgcgcggagttcgcggagttcggggtcggagtgagcgtggtgtgcccgggcttcgtccgtacgtcgttcgcgtcggcgatgcatttcgccggtgtgccccggctggagcaggagcggctgcgggcgctgttcgccggtcgcggatgcagcgcggagaaggtggccgcggcggtactgcggtcggtggcgcgcgactcggccgtggtgaccgtgacggcggaagcgcggctgtcacggctgatgagccgcttcacgccacgcctgcgcgccgcggtggcgcggatggatcccccttcg

SEQ ID NO: 933 - DNA, 1236 bp, Streptomyces avermitilis
  CDS (1)..(1236)
atgtcagatcattttctcttcatgagtgcgccgttctgggggcatgtgttccccagtctcgccgtggcggaggagctcgtgcaccggggccaccacgtcacctttgtgacgggcgcggaaatggccgatgcggtgcgttccgtgggcgctgatttcctgcggtacgagtccgccttcgagggtgtcgacatgtaccggctgatgaccgaggccgagccgaacgccatccccatgacgctgtacgacgagggcatgtccatgttgcgttcggtggaggagcacgtcggcaaggacgttccggacctggtggcctacgacatcgccacctccctcaacgtgggtcgtgtcctcgccgcctcctggagcaggccggccatgacggtcattcccctgttcgcgtccaacgggcgcttctccacgatgcagtcggtattggatccggattccgctcaggtcagtgcgccgccgccgcgcttctcggagcagatggagttgttcggcctcggggcgctggtgccgcgcctcgcggagctgctcgtttcccggggtatcacggaaccggtcgacgatttcctttccggaccggaggacttcaacctggtgtgtctgccgcgcgccttccagtacgcgggcgacaccttcgacgagcggttcgccttcgtcggaccatgtctgggtaagcgcaggggtctgggcgagtggacaccaccgggcagcgggcatccagtggtgctcatctccctcgggaccgtgttcaaccggcagctgtccttcttccgcacgttcgtccgggcgttcaccgacgtccccgtgcacgtcgtgatctcgctcggcaagggggtcgaccccgatgtgctgcggccgctgccgccgaatgtcgaggtgcaccggtgggtgccgcaccatgcggtgctggagcatgccagggctctggtcacgcacggcggtaccggcagtgtgatggaggcactgcacgcagggtgcccggtgctcgtcatgcccttgtcgcgggacgcgcaggtgaccggccggcggatcgccgagctggggctgggtcgtatggtgcagccggaggaggtcacggcgacgacgctgcgccggcacgtgctggacatcatctccgatgacgcgatcacccgacaggtcaggcagatgcagcgggccacggtcgaggcgggcggcgccctgcgggcagcggacgagaccgagcggtttctgcgccggacgcgccgtcac

SEQ ID NO: 934 - DNA, 1002 bp, Streptomyces avermitilis
  CDS (1)..(1002)
gtgacgggcggcgccggtttcatcggttcccatttcgtacggcggttgctgacgggcgcgtatccggcgttcaccggtgccgaggtcgtggtgctcgacaagctgacctacgcgggtcgcctggagaacctcgcaccggtcctgggaagcccatccctgatcttcgtgcacggcgacatctgcgacgggcccttggtcgcggacctgatggacggctccgacatggtggtccacttcgcggcggagtcacacgtggaccggtccgtggccgacgccgccgagttcgtacgcaccaatgtcctcggcactcacaccctgctccgcgccgccaccgacgccgccgtggaccgcttcgtgtacatctcgacggacgaggtctacggctccatcgactccggctcgtggaccgaggacgccccgctggagccgaactcgccctactccgcgtccaaggcgtcctccgacctgctcgcccggtccttccaccgcacgcacggcctaccagtgatcatcacccgatgctcgaacaactacggcccccaccagttcccggagaaactcatcccgcggttcgtcacccatctgctgaacggcacgaaggtgcccttgtacggcgacggcgaaaacgtccgcgactggctgcacgtggacgaccactgccgtggcatcgccctggtcgccgaacgcggcaggcccggcgagatctaccacatcggaggcgggacggagctgtccaaccgtgagctcaccgcccggctcctggacctgctcggcgtggactggtcgatggtcgaacccgtgaccgaccgcaaggggcacgaccggcgctactcgctggacatcagcaagatctccgccgagctcggttacgcgccccgcgtgcccttcgaggaggggctggcacagaccgttcagtggtacgtggagaaccgaaccctgtgggagccactcaccgcccggcccgagctgccggtcagtgacggcgcgtccggcgcagaaacc

SEQ ID NO: 935 - DNA, 897 bp, Streptomyces avermitilis
  CDS (1)..(897)
atgaagggaatcgtgctcgcggggggaaccggctctcggctttacccgttgacccgtgccctttccaagcagctgctccctgtctacgacaaacccatgatctactacccgctctccgtgttgatgctcggcggcataaaagacatcctggtgatttcctcacccgatcatctcgaacaattccggagactgctcggagacggaagccgcctcgggctgaacatcgactacgccgcgcagcagcgaccgggaggaatcgccgaggcattcctcatcggcgccgatttcatcggtcaggatcaggtgtcccttgtccttggggacaacatcttccatggcatgggcttttcgcacctgctgcgcagccacacccgcgatgtcgacggctgtgtgttgttcggatacgcggtgacggatcccgaacggtacggagtcggagaggtcgacgcctccggaaagctgctgtccgtcgaggagaaacccaccgccccccggtccaacctggcgatcacaggcctgtacctgtacgacaacgacgtgatcgaggtggcccggggcatccgctcgtcggcccgcggcgagctggagatcaccgacgtcaacagggcctacctcgccgaggggcgggcccggctggtggacctgggccggggcttcacctggctcgatgcggggacgcacgactcgctgatgcacgccgggcagtatgtgcaggtcctggagaagcgccagggagtacggatcgcctgtctcgaggagatcgccttccggatgggtctgatcgacgcggacgactgctatctgcgcggggtcgaactggccggctccggctacggcgagtatctgatgagtattgcggcggaagccgcggtgaggagcccgggatgcgcctactcg

SEQ ID NO: 936 - DNA, 1029 bp, Streptomyces avermitilis
  CDS (1)..(1029)
atggggcggttttcggtgtgcccgccccggccgaccggaatactgaagagcatgctgacgactgggatgtgcgaccgaccgctggtcgtcgtactcggagcctccggctatatcgggtcggccgtcgcggcggaactcgcccggtggccggtcctgttgcggctggtggcccggcgaccgggcgtcgttccgccgggcggcgccgcggagaccgagacgcgtacggccgacctgacggcggcgagcgaggtcgccctcgccgtgacggacgccgacgtggtgatccacctggtcgcgcgcctcacccagggagcggcatggcgggcggcggagagcgatccggtggccgagcgggtgaacgtcggggtgatgcacgacgtcgtcgcggccctgcggtccgggcgccgcgccgggccgcccccggtggtggtgttcgccgggtcggtctaccaggtgggccgcccgggtcgggtcgacggcagtgagccggacgagcccgtgacggcctatgcccgtcagaaactcgacgccgaacggacgttgaagtccgccacggtcgagggtgtcctgcgggggatctcgctgcggctgcccaccgtctacggcgcggggccgggcccgcagggcaacggcgtcgtgcaggcgatggtgctccgggcgctcgccgacgaggccctcaccgtgtggaacggaagcgtggtggagcgtgacctggtgcatgtggaggatgtcgcgcaggccttcgtgagctgcctggcgcacgcggatgcgctcgccgggcggcactggctgctcggcagcggtcgtcctgtgaccgtcccgcacctcttcggtgccatcgccgccggcgtgtccgcccgcaccgggcgccccgcggtgcccgtgaccgcggtggaccctccggcgatggcgacggcggcggacttccacgggaccgtcgtcgactcctcggcgttccgcgcggtcaccgggtggcggccgcggctgtcgcttcaggagggcctggaccacatggtggcggcttacgtg

SEQ ID NO: 937 - DNA, 582 bp, Streptomyces avermitilis
  CDS (1)..(582)
ctcgtcgtcgagggcgccgtcgaattcaccccgacggtcttccccgacgagcgcgggctcttcgtcaccccctaccaggaaccggtcctcagcgaggccgtcgggcaccggtttcccaccgcgcagacctgccagagcgtctcgcgccgcggcgtcgtccgcggcgtgcacttcaccgcgacaccacccggccaggccaagtacgtccactgcgcccggggacgggccctggacttcgtcgtcgacctgcgcaccggctcaccgactttcgggcagtgggactcggtcctcctcgaccaggagcgcttccgttccgtctacctgccgatcggggtcgggcacgcgttcgtggcgctggaagacgacacggcgatggtgtacctgatgtcgagcggctacgttccgcagaacgaacacgccctctcgcccgaggatccggacctcgccctgcccctcggccaccacctcgggcgggcaccgatcctctccgagcgcgaccggcgcgcgccgactctccagcaggccctgcgacgcggcatgttgccggagtaccgcgcgagccgcggcctcgacgagaagctg

SEQ ID NO: 938 - DNA, 1407 bp, Streptomyces avermitilis
  CDS (1)..(1407)
atgagcgtacgagccgatgccgaccacaccgagcccagcaccgctcaccgcgcggcacgacgccgccctgcccgcgtgcctcgcccgctccgccgccgtgggcgacaccggcgccggacgtccctcgacgcgttcaccggctggtggacgcggcggtccggggcccaccggttccgggtcgagcgcatccccttccacgggatggacgcctggtcgtttcaccccggaaccggcaatctggcccaccgcagcggccggttcttctccgtggagggactgcacgtccgaggcggtgaacagcccttcccggaatggcagcagcccatcatccaccagcccgagatcggcatcctcggcatcctcgccaagaagttcgacggggtcctgcacttcctgatgcaggccaagatggagcccggcaacatcaacctggtccagctgtcgcccaccgtgcaggccacgcgcagcaactacaccaaggtccacgggggcgccgccgtgaagtacctcgagtacttcacacagccccggcgcgccaccgtggtggtcgacgtcctccagtccgagcacggagcctggttccaccggaagttcaaccgcaacatcgtggtggagaccgacgaggacgtaccactggacgacgacttccgctggctgacactggggcagatcggcgaactgatgcaccgggacaacctggtgaacatggacgcacgcacggtcctcgcctgccttcccaccccgttcgacgagcccgcggccctgcacagcgacgccgaactgctctcctggtacgccgccgaacgctcccggcactccgtgcacgcccgccgcgtgcccctggccggcatccccggctggaccacgggcgcggagtccatcgcccaccacgcggaccggtacttccgtgtggtcgcggtccgtgtcgaggcctccaaccgggaggtcgccgcctggacccagcccctgatcgaaccgtgcggccacggcatcaccgccttcctgacccggcggatcggcggcgtaccgcacctgctcgcccacggcagggtcgagggcggcttcctcgacacgatcgaactcggcccgacggtccagtacaccccgcgcaactacgcccacctcacgggaccggccaggccgcgcttcctcgacctggtgctggaggccgcgcccgaccgcatccgctacgcggcggtccactcggaggagggcggtcgctttctgcacgcacaggcgcgctacctgttcgtcgaggccgacgagagccaggcgccgaacgacccgcccccggggtaccgctggtgcaccccgggccagctgacccagctgctgcggtacggccgttacgtgaacgtgcaggcccgcaccctgctgtccctgctcaccacccgcgccgtcgagctg

SEQ ID NO: 939 - DNA, 771 bp, Streptomyces avermitilis
  CDS (1)..(771)
atgaccgagcgggagttcaccgatccccggatcgtgccgcacgagtccgagcaggaacgcgctgcccgcgagcagctgaccaagctcctcgtcgacagcccgatcccgccgaagtacctgatcgacaacctgtccgtctacatgcggcgcaaccagctcgccgacctgctctccatggacgcgctgtaccgcatgctgccggaagtccccggcgtcatcatggagttcggcgttctgcacggacggcacctcgccacgctgaccgcgctgcgcagcatctatgagccgtacaactcgctgcgccgcgtcatcggcttcgacacgttcaccggcttccccgacatcgacgaggcggacgaggtcagcaccagcgcggtccctgggcggttcgccgtgccggacggcgaagtggagcacctgcggcaggtgctcgcggcgcacgaggcgaacgaaccctacggccacacccagcgttccttcgtggtccagggcgacgtacgcgaaacggtgccccaatacctggcggaacacccgcacaccgtcatcgcgctggcctacttcgacctggacctctaccgccccacgcgcgaactgctggacgtcatcacaccgcacctgaccaggggcagcatcctcgccttcgacgaactcacccaccccaaatggccgggggagaccagggcgctgagcgaggcgttcggcctcgaccacgccccactgcgccaactgcccggccgcgagccaccggtgatctacatgacgtggggtgca

SEQ ID NO: 940 - DNA, 1041 bp, Streptomyces avermitilis
  CDS (1)..(1041)
atgatgcctacgacggccgagcccgcacccgtccagtccgacagcaacagcagtgctcccctccacaccgaactgggcaggacccggctgaggatcagccgactggcgctcggaacggtcaacatcggcggacgggtggaggagcccgaagcgcgccgactgatggatcacgccctggctcagggcatcaccctgttcgacaccgccaacacctacggctggcgcgtccacaaggggtacaccgaagaggtcatcggcaggtggctggcggaccgccccgcccggcgtgagcaggtggtgctggccaccaaggtcggcgatccgatgggcagcggccccaacgatcacggactgtccgtacgcaatatcgtggccgcctgcgacgcctcgctgcgccgactgcgcaccgactggatcgacctgtaccagctgcaccacatcgaccgccgcgccggctgggacgaggtgtggcaggcgatggacctgctcatcacgcagggcaaggtgcgctacgtcggctcctccaacttcgcgggctgggacatcgcttccgcccaggaggcggcccggcggcgcaacgccctgggcctcgcctccgagcagtgcgtctacaacctcgtgacccgacacgccgagctggaagtcatccccgccgcgtccgcctacggtgtcggcgtcctggtctggtcgccactgcacggcggcctgctcggcggtgtcctgcgcaagacgcgggagaacaccgcggtcaagtcggcacagggccgggccgtcgaggccctggagcaccaccgcaccaccatcgcggcgtacgaggacgtgtgcgcggaccacggcctcgaccccgcccatgtcggcatggcctgggtgctgtcgcggcccggcgtgaccgggctggtcatcgggccgcgcaccgaacagcacgtggacggggcactgcacgccctgcgcaccccgctgcccgagcccgtcctggcccgcctggaggagctgttccccccggtcggccgcggcggatccgcccccgacgcctggctgtcc

SEQ ID NO: 941 - DNA, 750 bp, Streptomyces avermitilis
  CDS (1)..(750)
atgaccagtgttcagacgagcgacaactggctccggcgtttccatccggccgcggaggctccgacgcgactggtctgctttccgcacgcgggcggctcggccgcctacttccacggtgtttcccgtgcgctctcgccggccgtcgacgtcttggcggtgcagtatccgggccgtcaggaccggcggcacgagccgctcatcgacagcatcgacggcctggccgcccgggtacgggaggagttggcgccgtggacggaccggccgttggccctgttcgggcacagtatgggcgccatggtggcgttcgaggtggcgctgcggctgacggccgacggcgccgcgccgagcgtgctgttcgcctcgggcaggcgggcgccgtctcggtaccgcgaggaatccgtacacctccatgacgatgcgggcatcatggcggagctgagccgtctggacggcaccgatacgcaggtactgaccgatccggagctgcgggagatggttcttccggcgttgcgcagcgactaccgggcggtcgagacgtaccgctaccaaccggggccgccgctgccctgccccgtggtcgccctggtgggcgacagcgatcccaaggccacggtcgacgaggcccgcgcctggggcgatcacacggccggaccgttcgaactctcggtctttccgggtggccacttctatctcaatgcgcacgcggaagccgtcacggaattggtgcggacgcgactggcgaccatcagg

SEQ ID NO: 942 - DNA, 1581 bp, Streptomyces avermitilis
  CDS (1)..(1581)
gtgacacgtattggattggtcgtcctcgccctggccgcggccctcgcggcgggcgccgccgcggggtcgatatcgccgtggtggtggttcgccgccgtcccactcaccctgctgggcctgctgggcacgtgggaccttttgcaacgccggcattcggtgctgcgcaactaccccgtcctcgggcacgcccgcttcctcctggagcggatacgtcccgaactccagcagtacttcgtcgagcggaacttcgacggccgccccttcgaccgggatgtgcgcagcatcgtctacgagcgggcgaagggtaccgacgccgagcagccgtacggcaccgagcaggacgtctaccagcccggctacgagttcctgatcccgtcgatggcgccccgcccggtgccgcagacgccaccgcgggtgcggatcggcgggcccgactgcagccgcccgtacgacatggcgctgctgaatgtgtcggcgatgagcttcggctccctgtcgtcgaacgcgattctcgccctcaacgggggcgccgcggccgggggtttcgcccacgacaccggcgagggcggcctgtcggagtaccacctgcgtcctggcggtgacctcgtctgggagatcggcaccggctacttcggctgccggacccaggacggcgagttcgacccgaaggagttcgccgacaaggcggcgcacgagcacgtgaagtgcgtgtcgctcaaactctcgcagggcgccaagcccggcatcggcggggtgctgcccgggccgaaggtcaactccgagatcgcgcgggtgcgggatgtgcccgaggggcggacggtgatctcgcctccgtaccaccgggagttctccaccccgcgcgaactcgtcctcttcatcgccaggatgcgggagctgtccggcggcaagccgaccggcttcaaactctgcccgggctcgcgccggcagttcctcgccgtgtgcaaggcgatgctggaggagggtacggccccggacttcatcatcgtcgacggggccgagggcggcaccggcgcggcgccgctggagttcgccgatcacgtcggcacgccgctcaccgaggggctgctgaccgtgcacaacgcccttgtcggcgcgggcctgcgcgaccggatcaggatcggggcgagcggcaagatcgccaccggcaccgatctggtcaaacgcctgctccagggtgccgactacggcaacgccgcgcgggcgatgatgttcgccgtgggctgcatccaggcgcagcggtgccacacgaacacctgccccaccggtgtcaccacccaggacccccggcgtgcccgcgctctcgacgtcggtgacaagacgctgcgcgtccagcgcctccaggaggcgaccgtggccagcgcgctgcagatcatggcgtccatgggggtcaccgatccctcgcagctgcgtccgcacatgctccaccggcgtatcgacccctacaccgaacgctcctacgacgagctctatgagtggctgcggcccgggcagttgctcgccgagccgcccgctgcctgggcggccgactggcacgccgccgaccccgaccgtttcaccgtg

SEQ ID NO: 943 - DNA, 1761 bp, Streptomyces avermitilis
  CDS (1)..(1761)
gtggcccgaaccgttgcccgcgtcatcgtggacgcgctgagtgagcttggcgtgcgccaggtcttcggcgtcgtcggcgacgcgctcaatccggtgaccgacgccatccgcaccaccgaggacgtggagtgggtgggttgccggcacgaggaggcggcggcgttcgccgcgagcgcccagtcgcagctcagcggcaccctcggtgtgtgcatgggcactgtaggacccggctccgtccacctcctcaacgggctgtacgacgcggccaagagccgtaccccggtcctggcgatcgccggccaggtaccgctcgccgaactcggcagcgactacttccaggaggtcgacaacgacgcgctcttcagtgacgtggcggtcttccgggcgacgatcacctcgcccgaccagttgccgcagctgctggagacggcggtgcgcaacgcgctgggccgcaagggagtcgccgtcctcaccgtgccgggcgacctcggcgaccgggagctgagcgcggaccggccgacccgcttctccctgagtacccccgtgagccggccggaggagtccgccgtgcgccgcgccgcggagctgctcgaccgcgcggaacggatcacgctgctcgtcggacggggtgcccgcgccgcgcgtgctgacgtactgaccctggccgaccgcctcgccgcgccgatggtgctcaccctgaaggccaaggagggcttcgaaggtgaagccaatcccttccaggtcggccagaccgggctgatcggcaaccccgcggcggcatcggccctccaggacgcggacacgctcctcctgctgggcaccgacttcccctaccgcgactggtatccggacggccggacggtcatccaggtggacagcgaggccgcgcacatcgggcgccgggtgcccgtcgaggtcgggctcgtgggcgacacgggcgccaccgtccgggatctgctcggccacctcgccaccgcgcctcccggcaccgagggcgcgcgggaccgctcgcacctggaggacgcgcgcaagagcttcggcaagtggcgcgcgagtcaggcccggctcgccgacccggcgcacgacaagggcctcgtcggacgggtccgctccgcactggacaaccgcgcgcacgacatccgcccggaggcgctggccgccgtggtggaccgggtcgccgacgagaacgccgtcttcacctccgacacgggtatggccacggtgtggctctcgcggttcgtcgagatgcgcggtgaccggcgactgctcggctcgtacaacctcggctcgatggccaatgcgatgccgcaggcgctcggcgcccagtgcctggaccgggggcgccaggtcgtggccttctgcggcgacggcgggctgagcatgctcctcggcgacctcatgacgctgaagacgagccggctccccgtcaagctcgtcgtcttcgacaaccgccggctgggcatggtgaaactggaacaggagcaggccgggctgccggagttcggcaccgtgctggacaaccccgacttcgccgccgtcgccacggccatgggcatcaccggtatccgcgtgaccgatccggccgagctggaggagtccgtgcgccgcgcgttcgccactcccgggcccgtactgctcgacgtgctcacgaacccggacgagatcgccgtcccggccaagccgaccgtcgagcagggctggggcttcgcggtggccaaggtgaaggaggtcgtgcgcagccacggggacagcgacgggcac

SEQ ID NO: 944 - DNA, 1197 bp, Streptomyces avermitilis
  CDS (1)..(1197)
atggatggcggagatctggaactgggtgagcttctggccgccgcggaggccgcgccgccgggggagtccgttgacgtgatcgcacgcaacctgcgaaagcggttcggggcggagcgtgtgtccttcctgttcgtcgacctcattggtcagcggctggtgcggctgactccggccgtcgagggtgatgccgtggagcatgccgagccggtcggcctgcgaggcagcgtctacgacatcgttctgcagagccagcgccagcatgtggaaccggacggccagggcggacagcgcgtcatcacgcccgtcaccaaccgcggcgactgcatcggcgtactggaggtgaccctccagtacgccgacgacaccgtgctcagacaggtcggcgaagcggcacacgcgctcgcctacatcatcgtcacggaccgccggttcaccgacctgtaccacttgggccggcgtaccaccaagaccagcctggccgcggagatccagcaccagctgctcccctcggcctcctgttgcgaggccgcccagttcaccctcgccgcagggctgatcccggctgacgacatcggcggtgacacctacgactacaccctcgaccgcgacaccctgcacctgtccatcaccgacgccatgggccacgacaccgactccgctctgctggccaccttgctggtcggtgccctgcgcggtgcccgccgcagcggctgtgacgccgcccttcaagcccaccacgcccaccaagccctgctgaaccacagccgcggcctggccaccggacaactcctgtgcgtcgacctcgaaacaggcatgtgccgtctggtcaacgccggacatccctggccgctgcgtctgcgcgacggcatcgtcgaagaggtcaaactcgccgtcaacctgccgttcggcgtgtcggcacccaccgcctaccgcgtacaggaactgcccctgcgccccggggaccggctgatcctgctcaccgacggcatgcaggagcgcggcgccgcggccgtcgacctgcccgcgctcgtacacgacacccgcgccttccacccacgggaagccgtccgagctctgacggccggggtgctggagacctgcgacggcaacctcaaggacgacgccacggtcctgatcctggactggcacggcacccctggagcaccccggtacggggacacgccgatgcaggctcgg

SEQ ID NO: 945 - DNA, 171 bp, Streptomyces avermitilis
  CDS (1)..(171)
atgagtgccggagaaaaggccaaggccaaggccgagcaggttgtcgggaaggccgtgaggaaggcagcccatgcgatgggccaggagaccaccgccgccaagggcgccgcgttggaggcccggggcaaggcccgggacaccaaggagagggcgaagggcagcttcaggcac

SEQ ID NO: 946 - DNA, 168 bp, Streptomyces avermitilis
  CDS (1)..(168)
atggttcccctgctgctcgttcttctgctcgccctgatcctcttcggtgccggattcgcactcaaggccctgtggtggatcgccgtgatcgtcctggtgatctggctggtcggcttcttcgctcgctcctcgggagcaggtgggaagcgaggccgctggtatcgctgg

SEQ ID NO: 947 - DNA, 282 bp, Streptomyces avermitilis
  CDS (1)..(282)
ttggaccaccaacgcgaggcgcgtcagccaaggttcggcggcacgctcaagatcaagtgtagcgcagccacagcgccgtttcgccacgaccgcgaccggccgggcggcctgctgcccgaccagtcgtccgccgcccgcacgaggtgggtcccgtatcgccttgtcggcgtgccgcggcgccggcggccggcccatgtgctccggaaacctgcggcgttgggccagcgaggcgaactggtcgtcacagcccgcgcagtagccctccagcgattccggtggact

SEQ ID NO: 948 - DNA, 405 bp, Streptomyces avermitilis
  CDS (1)..(405)
atggccaagtacctgctgctcaagcactaccgcggcgctccggcggcggtcaacgacgtacccatggaccagtggacgccggaggagatctcggcccatatccagtacatgaacgacttcgccgcccggctcgaggggaccggcgagttcgtcgacggtcaggcgctcgcccccgaggggacgttcgtccggtacgacggcgagggccgcccgccggtcaccgacggcccgttcgccgagaccaaggacctcatcgccggctggatggtgatcgacgtcgacagctacgagcgcgccgtcgagctggccggggagctgtcggcggcccccggcgcgggcgggaagccgatccacgagtggctcgagctgcgcccgttcctggccgcgccgcccaccatcaccgag

SEQ ID NO: 949 - DNA, 1143 bp, Streptomyces avermitilis
  CDS (1)..(1143)
atgaacgaggccctgctccggagcctcacaccgagcgtgctcgggatcctcgtccgccgcggagccgacttcgcggcggccgaggacgccgtccaggacgcgctggtcgaggcggtccgcgtctggccggccgacccgccacgggaccccaagggctggctggtcaccgtggcctggcgccggttcctcgacgcgacccgcgcggacaccgcccggcgccggcgtgaggacctcgtcgacgacgaaccggcgcccgggcccgcgcccacggtggacgacacgctccagctgtacttcctgtgcgcccacccgtcgctgacgccgtcgtccgcggtcgcgctcacgctgcgcgccgtcggcgggctgaccacccgccagatcgcccaggcctacctggtgcccgaggcgaccatggggcagcgcatcagccgggccaagcgcaccgtctccggcgtgcgattcgaccagcccggcgacgtcgccaccgtgctgcgcgtcctctacctggtcttcaacgagggctactccggcgatgtcgacctcgccgccgaggccatccggctcacccggcagctcacggccgcgatcgaccaccccgaggtggcggggctgctcgccctcatgctgctccaccacgcccggcgcgccgcccggaccaagcccgacggcagtctggtgccgctcgccgagcagaaccggagccggtgggacacgcagctgatcgccgagggcgtcgagatcgttcaggcggccctcgcccgcgaccggctgggtgagttccaggcccaggccgccatcgcggcacttcacaccgacgcgcccaccgccgaggagaccgactgggtgcagatcgtcgagtggtacgacgagctcgcgcgcctgaccgacagcccggtcgtgcggctcaaccgcgcggtggccgtcggcgaggccgacggaccgcgcgccggcctggcggcgctcgcggcgctggacgactcgctgccccgccacgccgcggtggcggcgtaccttcacgagcgcgacggcgacctggcgacggcggcacggctgtacgccgaggcggcccaaaaggcaccgaacctcgccgagcgcgaccacctgacgcgccaggccgcccggctcaacgcccgcgggtgtcgc

SEQ ID NO: 950 - DNA, 312 bp, Streptomyces avermitilis
  CDS (1)..(312)
ttgccgacggggaggccttgcggcgacgacaggcgcgccggaggcgcgctgacgcccgtgatcaatctcgggcgtactgcgcccgtgatcgatctcggcgctacttcctgtatcgcacgtactcacacatcggagtcgcacggcatccgacgcgggtgcacgggcggcgccgcgctgagctgtcagcggtcggcgatgtcctcgcggaggccgtcggagaattcccaccacgacaaagggagccagtcaccgttgacaaaggcatcgacagtcgcaccgcgaccgcggacagtcacggtcgttcctggcggg

SEQ ID NO: 951 - DNA, 1131 bp, Streptomyces avermitilis
  CDS (1)..(1131)
atgaaggccgtcgtttacaagggagcattcgacgttgcggtcgaagatgttgaaaagcccagcatccagcatccgaacgatgtgatcgtacggatcacctccaccgcgatatgcggctccgatctgcacatgtacgaggggcgcaccgctgcggagcccggcatcgtcttcggccacgagaacatgggaatcatcgaggagctcggccagggcgtcaccgcgctcaaggagggcgaccgcgtggtcatgcccttcaatgtcgcctgcggcttctgcaccaactgcgtcgacgggttcaccggttactgtctgaccgtcaatcccggtttcgcgggcggcgcgtacggctatgtcgccatggggccctggcagggcggccaggcggaatacatacgcgttccctacgccgacttcaactgcctgaagctgccgccgggaaacgagcacgagagcgatttcatattgctcgccgacatcttcccgaccggctaccacgggtgtgaactcgcccaagtccgcccgggcgagagcgtcgcagtctacggcggagggcccgtcgggctcatggccgcctattccgctctgctgcgcggagcgaaaaaggtgttcgtcgtggaccgggtactggagcggctgcaaaaggccgaggagatgggcgcggtcccgatcaacttcgccgagggcgacccgatcgcgcagatcaaggagcagaccgagggcatcggcacggacaagggcgttgacgccgtcggctaccaggcgatggcgcacggcacggaccgcgaggaaccggcgaccgtcctgaactcgctcgtcggcacggtccgacccaccggagcgctcggcgtgcccggcctctacgtcccggccgaccccggaggccccgacgagcaggccaaacagggcatgcttctcgtcgcgatcggcaagctcttcgagaagggcctgcgagtgggcacgggacagtgcaacgtgaagcgctacaaccggtacctgcgcggcatgatcaccgagggccgggcgaagcccagcttcgtcgtctcccacgaactgcccctggatcaggcaccgtcggcctacgacaagttcgacaagcgcatcgagggctacacgaaggtggtgctgcacccg

SEQ ID NO: 952 - DNA, 438 bp, Streptomyces avermitilis
  CDS (1)..(438)
atggctggagcaagtaacaagacgacgaatggacagtcgccgaccgcgaacgcgcgagcggcgaagaagaccgtggccgaaggagccgcaacaccggcgaaggaggcgcagcaggccgccacggaggcgacgaagaacgccggggacgcggcgggcgccgtcggccgcggcagcaaggaagtcctggcgggcctcggcggagcggcgtcggagaaggccagggaagcggccaggacggtgcagggcaccgtcgtctcggccgccgaacagaccgtcggcaaggccggcttggtctggaccctcctgaaggccaggaaggtcgtggcggccgccgccggcgcgggaaccgccaccgtggttctctgctcctacacactgggccgccgtgccggtctacggcagcgtggaccgctctcccgtctcagcggcggccgtctt

SEQ ID NO: 953 - DNA, 423 bp, Streptomyces avermitilis
  CDS (1)..(423)
gtggttaccaagcaggtcaggcgcgcgcccgaggacaaagacgtgacgcgtgccgactccctggcccgcgagatcttctccggtgtggccaacaagtgggcgctgctgatcatcaatgtgctgggcgagcagaccctccggttcaccgaggtgcggaccgcggtggacggcatcagccacaagatgctcacccagaccctgcgtgggctcgaacgggacgggctggtgcacaggacggtgtacgccgaagtgccgccacgggtcgactaccgcctcaccgaggcgggcggggcgctgcgcgacacggtcaacggcatgtgcgcgtggacccgccggtacctggacgagatcgaggcggcccggcgacgcttcgacgcgcagcacaacgacgccgctcaccccccgcacaccggcaccaaggac

SEQ ID NO: 954 - DNA, 459 bp, Streptomyces avermitilis
  CDS (1)..(459)
atgagcatcctgaagacgtacgcccgcctgtggaccgacagcctcgacagcgcgctgccgctcctcacggaactcaccggcgtgcagccggacctgcggctggcgtttcactccgtggaactggccgccatcggcgacttcctcgtcatcgcgggcccggccgacgagcgcgcgaagtacgcgcacgcctccgccaccgtggtcgtcgaggacctcgacgccctcgccacgaccctgaaggccgccgacgccaccatcaccactcccacgacgagcggtccgacgggacggttcctctacgcccgccacgccgacggggcagaggtcgaatacgtcgagtgggtcccggagttggtccgccggctcatccaccagggatccctcgcacgcaccacgcctcgcacgacatcgggtaaggccgagcccgaaagggggagcagcgtttcgagctccttgggg

SEQ ID NO: 955 - DNA, 1206 bp, Streptomyces avermitilis
  CDS (1)..(1206)
atgacgccccgtcaccagcgcgacctctcccgtcgcaagctgctcgccgcgctcgccggaacggccgtggccgtcccggcggccgccatgggagcgccgcacgccctcgccaccgtggcctcggacaacgggggcgcggccccacgtgcggccggtgcgctcccgctgacgatcgtcaacaggactggatcgttcgccaactcctcggtgcacctctacatcgtgggaaacgaggacggtaagcaggttcgggttacctctgagggcaccctggctccgatatccctcgcggacaacggcgccgacggctttaccgactacgccatcgccctgtccggcagcggcgaaacgaggctgtcactgccgtacatgtccggccgcatctacgtcgcgctcggtgacaagctgaagttgaaggcggtggcggacggcaacggcaacgccgctctgcagtaccccgccgggtgggtggagtcggaccccaactatcgcgtgttgcacgactgcgccgagttcacccacaactcagcggggatgttctgcaacaccaccatggtcgacatgttcagcgtcccgctgagtatccggctgaccggcaccaaggaccagaccacggggactctgcgtgacggtggacgggcgcgagtcttcgccgcggtcaagtcggtccccgagttcgagcgactggtggtggacgacctgcgcgtcatcgccccgggacacggcctggacgccggcatcttcgccgaggactacttcgccccgtacatcgacgaggtgtggagcacgtatacaggcaaggacctgaccgtcaccacgaacgccggtgccttcaccggtcgggtccgcggggacaagctgaccttcaccggcccggcctcggtctccttcagcaagccgtccacccgcgacgtgttcttctgcgacggcagtctggccgcccccaatgacgggaccaccggccctgttgccgccgtcctcggcgccggcttcaaccgttccacccttgtcaacgactccgcgcagcccactacggatcccgccgccttctacgggtcggccctcgccaaccactacgcgaaggccattcacgcggccaccgaggacggcaaggcgtacggcttcgccttcgacgacgtcgccgacttcgcctcgtacattcaggacaccgcgcccacgggcatcaacctgactctgacccccttc

SEQ ID NO: 956 - DNA, 996 bp, Streptomyces avermitilis
  CDS (1)..(996)
atgtccgcatccggtgtcgaggccggcagggggagcggcgtcgtccgcggcgagcggctcagcgccctggcccagcagcacggtgcgctggtggccctcctggtactggcacttgtcgcctcgttctccttcgactccttcgccaccggcgacaacatcgagaacctggccatgacgtcgtcgttcctggccgtggtcgcactcggcatgaccttcgtcatcgtcaccggaggcatcgacctgtccgtcgggtcggtcttcgccctcggtggcgtactcgccgcctggggctcgcggtacggcgccctggtcgccctgctgctgccgctcgcggtctgcggtctgatcggatgcgtcaacggtctgctcatcgccaggacccggctcgcccccttcatcgtcacgctcgccgcgatgctcgccgcacggggtctcatgctcaacatcaccgacgaaggcgccaccacgtatctggtcgacaaggaaacggtcttcgtccacctcggccagggcagactgctgggcgtcggcgcgccggtgtggatcaccggcgcgctgttcctggcgggtgccgtcgccctgcgccgcactcgcttcggccagaacgtctacgccgtcgggggcaacgaggacgccgccgctctcatgggagctccggtcgcccgcaccaagatcacggtgtacacgctttccgcgctgctcgccggattggcaggtgccctgaacgcggcctggctcgcctccggcgtcacgatcctcggttacggcatggagctggacgccatcgccgccgtcgtcatcggcggcacgctgctctccggtggcctcggcttcgtcagcggatccctggtgggtgtgctgctgctgaagacgatccagaacatcatcaaccagatcggctcactcgactccgcctaccagcaggtggtcagcggtggcttcctcgtggtggtcatcatcgcccagacctggctggccaggcggcgccgggtcgcc

SEQ ID NO: 957 - DNA, 963 bp, Streptomyces avermitilis
  CDS (1)..(963)
atggctgacgtcgccctgcgcaacgccctgcccgcggaccgcgcggcggccgtgcggtggctccaggaatacggcgtctacgcgggcgtcgtggtcctgctgctgttcaacgtcgctttcaccgaccacttcctgtccgccgcgaacttccgcacccaggccgtccaggtcgcccccgtcctggtcgtcgccctcggcatggcactggccatcggcaccgagggcatcgacctgtcggtgggatccgtcatggccctgtcgacctcgctgctgtccctctacctcggctacggcccctgggtggccctgctcaccgtggtcgtcggcggcgtggtcatcggccttgccaacggcaccctgatcgcgttcgtcggcgtccagccgatcgtcgccaccctggccctcatggtcggcacccgcggtctggcactcgtcatgctgccgcagctcaaggacgtgcgcgatccgacgctgctgtccctcggctcgggtgacgtcgtcggcgttccgtatctcgtgctcatcgcggcggccctcgcggtcgtggtcgccttcgtcgtgcggcgcaccacgttcggccgccaactgctggccatcggagacagcaggccggcggcgcagctcgccgggcttcccgtacggcgcgtcctgatcaccgtctacgtctgctccggcgtgctcgccgccgtcgccgggttcctctccaccgcacgcctgtccgcgagcgatccgacgtcactgggccagctcatggagctgtcggcgatcaccgcggtcgtcgtcggcgggacgcccctgaccggcggacgtgtccgcgtcggcggcaccgtcgcgggcgccctgctcatccagctgctgacggcgaccctcatcaaacacgacctgtccccgtcctggacccagctggcccaggccgtggtgatcatcctggccgtctacgcggcacgtgagagggggaagcgg

SEQ ID NO: 958 - DNA, 1566 bp, Streptomyces avermitilis
  CDS (1)..(1566)
gtgaccgcgtcacccgtatccgctgaagtcctcgccgtacgaggactgaccaaacgcttccccggcgtcaccgcactcgacgacgtcgacttctccgtacgcgcgggggaggtgcacgcgctcgtcggcgagaacggcgcgggcaagtccaccctcatcaaggtcctcaccggcgtccaccgggccgacgagggcggggtgttccaccggggcgagcccgtcgctttcggcacaccactggaagcgcagcacgccggtatctcgacgatctaccaggaagtcaacctcatcccgctgatgagcgtggcccgcaacctctttctcggccgcgagccccgcacccgcctcggactgatcgacttccgccgcatgcacacggaggcccaccaggtcctcaccgcgtacggggtcgacgtcgatgtccgccgaccgctgcgccaactcggcgtcggagcacagcagatggtcgccctggcccgcgcggtggccgtcgacgcgagcgtcgtcgtcatggacgaaccgacatcgtcgctggaaccacgcgaggtccacaccctcttcggcgtcatccgccgcctgcgcgaccagggcatcgccgtggtctatgtcagccaccgcatggaggagctgtacgccgtctgcgacagcgtcaccgtgctgcgcgacggccaccatgtgcacaccggcccgctcgccggcaccgaccgtctcaccctggtctcgtacatgctgggacgcgacctcggcgaggtgcgcagcgagggcacgaccaagttctccggtacgcacgacacgggcggtgagccggtgctgcgcgccgaaaacctcacccggccccaccaactgcgcgctgtctccctggaaatacaccccggtgaagtactcggcctcggtggattgctgggttccggccgcagcgagaccgccaaagccgtcgccggcgcgctggcactcgccgacggccgtgtcaccgtcgccggtgtcccggtacgcaccggctccaccgtcgcggccatccgcgccggcatcagtctcctgcccgaggaccgcaagtccgaaggcatcgtgccggggctgtcggtgcgggagaacatcgccctggccgccctgccccagctctcccgctacggcctggtcgccgagtcccgcatggacgccgtcgtcgacaccttcatgaagcggctgcgcatcaaggcgtccagtccgcaccagaaggtcggcgaactctccggcggcaaccagcagaaggtgctgctcgcccgctggctcgcgatgaaccccaaggtgcttcttctggacgagccgacccgcggcatcgacatcggtgccaaggccgaggtgcagcagctcatcgacgaactcgccgaggacggcctgggcgtcctgctcatctcgtccgacatcgaggaactgatcgaaggctccgaccgcgtcgtcgtcctccgggacggtgcggccatcgccgaactgcgcgctgacgacgtcacggccgaccggctgatgcgggccatcgcacaagcggcggaagaagaagcgtccaccgaggaggaggccgccacccatggc

SEQ ID NO: 959 - DNA, 1113 bp, Streptomyces avermitilis
  CDS (1)..(1113)
atgaagtcgaactctgcctttcgccgtatgccagccatgtctcgccgtacgtcagccacgtctctgcttgccgccggcctggtcgccggcctcgcgttgtgcaccgggtgcaccaagtccgagagtgatgcctccggcagcaacagctctgccgccgggggcgattccagtcaggtcgtcgcgactcccggggccgacagcaagacctgtgacatcgccacgttcggcggcaagaagctcgatctgaagaccgccacggtcggcttctcccagtccgagaaggaggccaacccgttccgcatcgcggagaccgcctccctcaaggccgaggccggcaagcgcggcgtcaagctgctcaccgccaacgcccagtcgcagttctccaagcagatcagcgacgtccaggacctcatcgccaagggcgccgacctgctcgtcatcgccccgctcaactccgacggctgggagccggtactgcgccaggccgcggccaagaagatcccgatcgtcaccgtcgaccgaaagatcaacgcaaccccctgcacggactatgtgagcttcatcggctccgacttcaccgagcagggcaagcgcgccgcggacgagatgatcaaggcgacgggcggcaagggcgaggtggccatcctgctcggcgccgccggcaacaacgtgacgaccgaacgcaccaagggcttcgaggaccgcctccaggagaaggcccccggcctgaagatcgtgttcaggcagaccggtgaattcgcccgggagaagggccagtcggtcaccgagaacctcatccagtccaagcccggtatcaccggcgtctacgccgagaacgacgagatgggcctcggtgccgtcaacgctctcaagagcgcgggcaagaagcccggcgacgtcaagatcgtcaccgtggacggcacgcgcaacgcagtccagggcatcgtggacggctggatcgacggcgtcatcgagtccaacccccgcttcggcccgctcgccttccagaccctcgactcgttcaccaagggcgccaaggtcggccaggacatcgtcatccaggacagcgcctacaccaagggcaacgccacgtccgacatcggcaaggcgtac

SEQ ID NO: 960 - DNA, 1011 bp, Streptomyces avermitilis
  CDS (1)..(1011)
gtgcgggtgagtctgaaggacgtagcggagcgcgcaggtgtttcgatcaagaccgtctcgaacgtggtgaacaactatcagcacgtcactccggggatgcgggcccgtgtccagcaggccatcgacgagctcggctaccggccgaacctgacggcacggcacctgcgcaagggccgtaccggcatcatcgcgctggccgtgcccgagctgggaaacccctacttcgccgagctcgcggcggccgtcatcgacgcggccgccgagcaggacctcaccgtgctgctcgaccacacccgcggtgaacgggaacgggagatcctggtcagccagggcttccgggccggtgtcatcgacggtctgatcctcagccccctggagctggaggcggaagacctgcgcgggcgggcggccgacgtgcccctggtgctgctcggtgagcgggagtacgacctgccctacgaccacatcgcgatcgacaacgtcgccgcggcccgcaccgcggtgcggcacctgctgggccgcggccggacccgtatcgcctacctcggcgcgcgcaccgactccgccaaccgccccgcccacctgcggcttcagggctggcaagaggagctttcggcggccggcgtgccgacgccggagcagctcgtcggcccgaccggcggctgggaccgctccgacggggccgaggccatggcgcgcatgctggacgccggagtgcgcccggacgccgtgttcgcctacaacgacctggtggcgatcggggcgatgcgggtgctgtccgagcgcggactgcgggttccgtgggacgtggcggtggtcggcttcgacgacatcaccgagagccggtacggagccgtcaccctcaccacgatcgccccggacaagcaggccatcgcacggcttgcggtggagtcgctgctgcgctcgctccgccgcgagagcgcggacggcgggcgcgaactcaccgccgcattccggctggtggagcgcgagagcaccctgggccgccgc
